United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 120

SEQ ID NO: 232858 - DNA, 699 bp, Artificial Sequence
  Description of Artificial Sequence: Synthetic coding sequence
atggagcggtgccccagcctgggtgtaacactgtacgccttagtcgtggtattagggttgagagccacacctgccggaggtcagcactacctgcacatccgtcccgctccatccgacaatttgcctttggtggacctaatcgagcatcctgatcccattttcgaccccaaagagaaggatctaaatgagactctcctgaggagcttattggggggacattatgatcccggatttatggccaccagtccccctgaagacaggccaggcggagggggaggcgcagccggaggcgctgaggatcttgcagagctggatcaactgctgcggcagcgcccttcaggagcaatgccttccgaaattaagggactggagttttctgaggggctcgcccagggcaagaagcagcgcctttcaaaaaaacttcgaagaaagctgcagatgtggctctggtcccagacgttctgtcccgtgctctacgcttggaacgacttaggcagccgattctggcctagatacgttaaagtcggcagctgcttttccaagcgttcttgtagcgtgccggaaggaatggtatgcaaaccttcaaagagcgtacacttgacagtactccgatggcgatgccagcggcgtggagggcagaggtgcggctggattcccatccagtatcccatcatctcagagtgtaagtgtagctgctag

SEQ ID NO: 232859 - DNA, 990 bp, Artificial Sequence
  Description of Artificial Sequence: Synthetic coding sequence
atgggcacagctgctgccgctgcggcagccgctgctgctgccgcagctggcgagggggctaggagtcctagtcccgctgctgtgtctctaggccttggtgttgcggtagtaagctctctggttaatggttcgacctttgtgctccagaaaaaggggatcgtgcgcgctaagcgtcgcggaaccagttacctgacagatattgtgtggtgggccggtactatcgcaatggcagtggggcagattggaaacttcctagcctatacagccgtgcccacagtgttagttactcctctcggagcactgggagtccctttcggttccatccttgcctcttacctgcttaaagaaaagcttaacatcctaggaaagcttgggtgcctgctgtcctgcgccggaagtgtcgtcttgatcatccacagccctaagtcggaatccgtaaccacacaggcggagctggaagagaagctgacgaatcctgtttttgtggggtacctgtgcattgtattactgatgctcctcctcctcattttctggatagccccagctcacgggccaactaatataatggtgtatatctctatctgcagtctgttgggcagctttacagtgccatctaccaaagggatagggcttgccgctcaggatatactgcataacaatccgtcttcccagcgggcactgtgcctttgcctggtgttgctggcggtcctggggtgttctatcattgtgcagtttaggtacatcaacaaggctcttgaatgttttgatagttctgtgttcggggctatttattacgtcgtgttcactacgcttgtgctgttagctagcgcaatcctctttagggagtggtctaacgtaggcctcgtggacttcctgggaatggcttgcggctttaccactgtgtctgttggcattgtcctcattcaggtgttcaaggaattcaatttcaatctcggggagatgaacaaaagtaatatgaagactgactag

SEQ ID NO: 232860 - DNA, 765 bp, Artificial Sequence
  Description of Artificial Sequence: Synthetic coding sequence
atggccgtagggcagataggaaacttcctagcctacacggccgttccaactgtcctggttaccccgttaggagccctcggcgtcccgttcggttctatacttgcaagttaccttctgaaggagaaacttaacatactgggcaagttgggctgcctgttatcctgtgctggctctgttgtgctcattatacattcccctaagtcggagtcagtcaccactcaggcagagttagaggaaaagctgaccaaccccgttttcgttggatatctgtgcatagtcctgctgatgcttcttctgctgatcttctggatcgctccagcacacggcccaacaaacatcatggtttatatctccatttgttctcttctgggctcctttactgttccgagcacaaagggaataggtctagctgctcaagacattttgcacaacaacccgtcctctcaacgtgccctctgtctctgtttggtgctcctggcagtcctagggtgctccataatcgttcaattccgctatatcaacaaagctctggaatgcttcgacagttccgtttttggagcgatctactatgtcgtgttcacaacacttgtactcctggcctccgcgattttattccgagaatggtcaaacgtgggcctcgtagacttccttgggatggcctgcggatttactactgttagcgtggggattgtattgattcaggtattcaaggaatttaattttaacttgggtgaaatgaataagtccaacatgaaaaccgattag

SEQ ID NO: 232861 - DNA, 480 bp, Artificial Sequence
  Description of Artificial Sequence: Synthetic coding sequence
atgcttctcctgctcattttttggattgccccagcccatggaccaactaacatcatggtgtacatctctatctgcagtcttctgggttccttcacggtcccatccactaagggcattggcttagccgcacaggatatcctgcacaacaatccctctagtcagcgagccctgtgtctgtgtctcgtgttgcttgccgtcttagggtgctctattattgttcaattccggtatattaataaggccctggaatgtttcgattcatcagtgtttggcgcaatctactacgtggtctttaccaccttagtgcttctggcctccgcgatcctgttccgcgagtggtctaacgtgggacttgttgatttcctcgggatggcttgtggtttcacgacagtctccgttggtatagtgctcattcaagtgttcaaggagttcaacttcaatctgggcgaaatgaataaaagcaacatgaagaccgattag

SEQ ID NO: 232862 - DNA, 765 bp, Artificial Sequence
  Description of Artificial Sequence: Synthetic coding sequence
atggccgtggggcagattggcaatttcctggcatacaccgccgttcccactgtgctggtaaccccgctgggcgcacttggagtgccattcggctcgattcttgcatcatacttgctcaaagaaaagctgaacattctcggaaagctcggctgcctcttatcttgcgccggtagtgtcgtgctcataatccactctcctaaatcggaatcggtgacaacacaagcggagctggaagaaaaactgaccaatccagtcttcgttgggtatctgtgcatagtgctgctcatgctccttctcctcatattttggatagctccagcacatggtcccaccaatatcatggtgtacatttcgatttgctccctgttgggctctttcactgtgccttcaacaaaagggattgggctggccgctcaggacatcctgcacaataatccatcttcgcagagagcactttgtttgtgtctggtgcttctggcagtgctagggtgttcaatcattgttcaattcaggtatattaataaagccctggaatgctttgacagctcagtttttggggcaatctactacgtagtctttactacactggtgctccttgcatccgctatcctgtttcgagagtggtctaacgtgggacttgttgacttcctaggcatggcgtgtgggtttacgaccgtgagtgtggggattgtgctcatccaggtgtttaaggaattcaatttcaatcttggggaaatgaacaaaagcaacatgaaaacagactag

SEQ ID NO: 232863 - DNA, 1083 bp, Artificial Sequence
  Description of Artificial Sequence: Synthetic coding sequence
atgagccagggcaggggaaaatatgacttctacattggtctgggcctcgctatgagtagttcaattttcattggaggaagtttcattctgaaaaaaaaaggccttctccgcctggccagaaaaggatctatgcgtgcaggccagggtggacatgcatacttaaaggagtggctctggtgggccggacttctgagtatgggggctggcgaggtcgctaatttcgcagcctatgcgtttgcacccgctacattagtgacaccccttggtgccctgtctgttttagtgtccgccattttatcatcctatttcctgaacgagcggctgaatttgcacggcaagatcgggtgtcttctgtccatactagggtccacagtcatggtgattcatgccccaaaagaggaggaaatagagaccctcaatgagatgtctcataaactcggcgatcccggattcgtggtttttgccaccctcgtggtaatcgtcgctcttattctaatttttgtggttggacccaggcatggacagacgaacattttggtgtacatcaccatctgctctgtaataggggcattctccgtgtcctgcgtgaaggggctgggtatcgctatcaaagagctgttcgcaggtaagcctgtcctcaggcatccactggcttggattttgttgctgagtctgattgtgtgtgttagcactcagattaattatctcaatagggcactggatatttttaacacctccattgttactcccatttactacgtgttcttcactacctccgtgctaacttgttccgcgattttattcaaagagtggcaagacatgcccgtagatgatgtcatagggaccctgtcaggattttttactattattgtaggcatttttctgctccacgcatttaaagatgtctccttttccttagccagtttgcctgtgtcttttcggaaagatgaaaaggccatgaatgggaacctctctaacatgtacgaggtgctcaataacaacgaagagtctctgacctgcggaatcgaacagcacactggagagaatgtctcacgcagaaacggcaaccttacagctttttag

SEQ ID NO: 232864 - DNA, 1026 bp, Artificial Sequence
  Description of Artificial Sequence: Synthetic coding sequence
atgtcgcaaggccgtgggaagtatgatttctacatcggactggggcttgctatgtcaagctcgatattcatcggaggatcatttatcttaaaaaagaagggccttctaaggctggccagaaagggcagtatgcgtgccgttggcgctggagaagtggcgaacttcgccgcttacgcctttgccccagccaccttagttactcctctaggagccttaagcgtgttggtgagcgcaatcctgtcttcctatttcctaaacgagcgtctgaacctccatggaaagattgggtgtctgcttagcatcttaggaagtactgtgatggttattcatgcccctaaagaagaagaaatcgagacactcaatgaaatgtcgcataaactgggggaccctggattcgtggtctttgccacgctggtggtaatcgtcgcgctgatcttaatatttgttgtgggccctcggcatggccaaacaaatattctggtctatattaccatatgttcggtgatcggagcattcagcgtgtcatgtgtcaagggtctgggcatcgctataaaggagctgttcgctggcaagcccgtactccgccatccattggcctggatcctgctgctgagcctaatcgtttgcgtctccactcagatcaactacttaaatagagccctggacatcttcaatacaagcattgtaactccaatctactatgtatttttcaccaccagcgttctgacatgctccgccatccttttcaaagagtggcaggatatgcccgtcgacgatgtgatcgggaccctgtctgggttttttaccataatcgtggggatctttctccttcacgcctttaaggatgtgtccttttccctggcatccctgcctgtctcgtttaggaaggacgagaaggccatgaatggaaatctctcaaatatgtatgaagtactgaacaataatgaggagtcactgacgtgtggaattgaacagcatacaggagaaaacgtgtccagaaggaatggcaacttaactgcgttctag

SEQ ID NO: 232865 - DNA, 1083 bp, Artificial Sequence
  Description of Artificial Sequence: Synthetic coding sequence
atgtcccagggtcgtggaaagtatgacttctatatcggcttgggactggctatgtctagcagcatttttatcggaggttcttttatcctgaagaagaaaggcctgcttcgcctggcgcgtaaggggtcgatgcgggcagggcaaggagggcatgcatacctcaaggagtggctgtggtgggccggactgctgagcatgggagctggagaagtggccaattttgccgcatacgccttcgcaccggcaaccctggtcacccccctgggcgctctgtccgtactggtgtcagctattcttagctcttactttctgaacgaaaggctcaacctccatgggaagataggttgcctgctgtctatactggggtccacagtgatggtgatacacgctcccaaggaagaggagatcgaaactctcaacgagatgtcccacaaattgggggaccctggttttgtggtattcgctacccttgtcgttatagtagcccttattctgatcttcgtggtgggcccaaggcacggacagaccaacatcctagtttacatcaccatttgttctgtaatcggagctttctcagtgagctgtgtcaagggcttgggcatcgccatcaaagagctatttgctggaaaaccagtcctgcggcaccctctggcctggattcttttactgtccctcattgtttgtgttagcacacagataaactatttgaaccgtgccctagatatatttaacacaagcatagtcactccaatttactatgtgtttttcaccactagtgtcctgacctgctccgctattctgttcaaggaatggcaggacatgcccgtagacgatgtgatcggcactctgtccggtttttttactatcatcgtcggcattttcttgctgcacgccttcaaagacgttagttttagcttagcttccctcccggtctcttttcggaaagacgagaaggccatgaatgggaatctcagcaatatgtacgaggtccttaacaacaacgaggaaagcctcacatgcgggatcgaacaacatacaggtgagaatgtgagtaggcggaatggcaatctaaccgctttttag

SEQ ID NO: 232866 - DNA, 1083 bp, Artificial Sequence
  Description of Artificial Sequence: Synthetic coding sequence
atgtctcagggaaggggcaagtacgatttttacatagggctgggccttgcgatgtcaagcagtatcttcatcgggggaagtttcatcctcaagaagaagggccttctaagactggccaggaagggatctatgcgtgcgggacagggcggtcacgcctatctgaaagaatggctctggtgggctgggctcctaagcatgggagcaggagaggtggctaacttcgctgcctacgcttttgctccagcaactctggtcaccccactgggcgcactctcagtgttggtgtctgcaatattgagcagctatttcctcaatgagcgcctgaaccttcacgggaagatcgggtgcctcctgtccatattgggctcaactgttatggtgatccatgcccctaaagaggaggagattgaaacccttaacgagatgagtcataaacttggtgaccccggatttgtggtgtttgctacactcgtggtcatagtggcgctaattttgattttcgtggtggggccaagacacggacagacaaatattctggtctacataacaatttgctccgttattggcgctttctctgtaagctgcgtgaaaggtttagggatcgccattaaggaactgtttgccggtaagccagtgctgcgccacccactagcttggattctactgctatcccttatcgtgtgcgtgtcgacccaaatcaactacctgaacagggcccttgatatctttaacaccagtatcgtgacccctatctactacgttttctttacaacctccgttctgacctgtagtgcaattctgtttaaggagtggcaggacatgccagtggatgacgtcatcggtactctcagtggtttttttacgattatcgttggtatttttttgttgcacgccttcaaggacgtcagctttagcctggcctctcttcctgtgtcctttcgaaaagatgagaaagccatgaacggtaacttaagcaacatgtacgaggttctcaacaataacgaggagagcttgacgtgtggcatcgaacaacataccggcgaaaacgtctcacgacggaacggaaacctgacggccttttag

SEQ ID NO: 232867 - DNA, 1026 bp, Artificial Sequence
  Description of Artificial Sequence: Synthetic coding sequence
atgtcgcagggccgaggtaagtacgacttttatatcggcttgggcttagcaatgtcatctagcatcttcatcggtgggtcctttattcttaagaagaagggcctgctgcggctggccagaaaagggtctatgcgagccgtgggggctggggaggtggctaacttcgctgcgtacgcattcgctcctgctaccctggtgactccgctgggtgctctgagtgtccttgtatcagctatcctgtcgtcctactttctgaacgaacgtttgaatttgcacgggaaaatcggttgcctcctaagtattctgggcagcacagtgatggtaattcacgcaccaaaagaagaggaaattgaaactctcaatgagatgtcacataaacttggtgaccctggcttcgttgtgtttgccaccctagtcgtcatcgtggctctgattctgatcttcgttgtggggccacgacatgggcagaccaacatactcgtctacatcaccatctgcagtgtcataggcgctttttctgtttcctgcgttaaaggtctggggatcgccataaaagaactatttgcgggaaagccagtactacgtcacccccttgcctggattctgctcttgagccttatcgtttgcgtgagcactcagatcaactacctcaatcgagcactggatatcttcaatacttccattgtaaccccaatatattacgtcttctttactacttccgtgttgacatgctcagcaatcctgtttaaggaatggcaggacatgcctgtagatgatgttatcggcacattatctgggttctttaccattatcgtcggaattttcctcttgcatgcctttaaggatgtaagctttagcttagcctccctgccagtgtcgtttcggaaagatgagaaggcgatgaacggaaacctgagtaatatgtacgaagtcttgaataacaacgaggagtcactgacatgcggtatcgagcagcatacgggcgaaaatgtgtctcgtcggaacggaaacctgacggcattctag

SEQ ID NO: 232868 - DNA, 180 bp, Artificial Sequence
  Description of Artificial Sequence: Synthetic coding sequence
atgtcacagggaagaggcaaatacgacttttacataggtctgggacttgctatgtcgagctccatctttattggcggtagcttcatattgaagaaaaaggggctgctgaggcttgctcgcaaaggcagcatgagagccggtcaggggggacacgcttacctgaaggaatggctgtggtag

SEQ ID NO: 232869 - DNA, 900 bp, Artificial Sequence
  Description of Artificial Sequence: Synthetic coding sequence
atggaagagttggaacagggactgctgatgcagccatgggcatggcttcagttagcagaaaattcgctgctggccaaggtctttatcaccaagcaggggtacgctctgctcgtgtctgaccttcagcaagtatggcatgagcaggtagatacttcagtagtttcccagcgggctaaagagctcaataagcgcctgacggcccctcctgctgctttcttgtgccacctggacaatctgttgagacccctgttaaaagacgctgctcacccctctgaagccaccttttcctgtgattgtgtggctgatgctctgatactgcgtgtgcgaagcgaactcagtggcctgcccttttactggaacttccattgcatgcttgcaagcccgtctctggtctcccaacatcttatccgcccacttatggggatgtcactcgccttacagtgtcaggtgcgagagctcgccacattgcttcatatgaaagacctggagattcaggactatcaagagtctggcgctaccctcattcgggaccgcctgaagaccgaaccatttgaggagaatagttttctggagcagttcatgatcgaaaagttgccagaagcatgcagcattggcgatgggaaacctttcgtcatgaacttgcaggacctgtacatggctgtgactacgcaagaagttcaagtcgggcagaagcatcaaggtgccggagaccctcatacgtcgaatagcgcaagtctacagggtatcgacagccagtgcgtcaatcaacccgagcagctggtgtcatctgctcccaccctctctgctccagaaaaagagtccacaggtaccagcgggcctctgcagcgaccccagctttctaaggttaagagaaagaagcctagaggtctcttttcttag

SEQ ID NO: 232870 - DNA, 951 bp, Artificial Sequence
  Description of Artificial Sequence: Synthetic coding sequence
atggaagaacttgagcaggggctactgatgcagccttgggcctggctgcagttagccgaaaactccctgctagctaaagtgttcatcaccaaacagggatatgccctgctggtgagcgatctgcaacaggtgtggcatgagcaagtggatacatccgtcgtctcccaacgggctaaagagttgaacaaaaggctgacagctccgcctgccgctttcctctgtcacctagacaatctcctgaggcctctgctgaaagatgctgcccacccctccgaggccaccttttcttgtgattgcgtcgccgatgccctgattctgagagtgaggagcgagctctctggtctccccttctactggaacttccactgcatgctggcaagcccttctctggtatcccagcacctgatccgacccttgatggggatgtctctggcactgcagtgtcaggtgagggaactggcgactctgctgcacatgaaagacttggagatccaggactaccaagagagtggagctaccctcataagagaccgcctcaagactgagccctttgaagaaaactccttccttgagcaattcatgattgagaagctgccagaggcttgtagtataggggatggaaaaccctttgtcatgaatttgcaggatctctacatggcggtcaccactcaggaagttcaggtgggccagaagcatcagggcgctggagatccccacacatcaaactctgcgtctctgcagggaatcgatagtcagtgtgtgaaccaaccagagcaactggtgagtagcgctccaacactctccgctccggagaaggaaagcacagccctctgcagggacctgagctgccaacgttcccggggaaggagccagggggtgtcttctgtgaacctgttatggcctcagctgctgagaatggacctggagaattccttccaggcctctccgtag

SEQ ID NO: 232871 - DNA, 690 bp, Artificial Sequence
  Description of Artificial Sequence: Synthetic coding sequence
atggaggagctggaacagggcttactcatgcagccttgggcctggctccagttggctgaaaacagccttctggcaaaggtgttcattacgaaacaggggtacgcgctgctcgtgagcgatcttcagcaggtgtggcacgagcaggtcgacacctccgtggtgagccagagagccaaagaactaaacaaacgtcttactgctccacccgcagctttcttatgccacctggataacctgctgagaccacttctcaaagatgccgctcatccatctgaggcaaccttctcttgtgactgtgttgcagacgcacttatcctgcgggttcggagtgagctgagcggcctgcctttctattggaattttcattgcatgctggcctcccccagcctggtttcccaacacttgatcagaccgcttatgggtatgtcactggctcttcaatgtcaggtaagggaactggctactctgcttcacatgaaggacctagagatccaagattaccaggaaagcggagctacccttataagagaccgactgaaaaccgagcccttcgaggaaaattcctttctcgagcagttcatgatcgagaagctgcccgaggcttgcagtattggcgatggtaaaccatttgttatgaacctgcaggacctctatatggctgtgaccacacaggaggtgcaggtcggatag

SEQ ID NO: 232872 - DNA, 804 bp, Artificial Sequence
  Description of Artificial Sequence: Synthetic coding sequence
atggcaaattgcgaaaggacattcattgccatcaagcccgacggcgtccagaggggactagtaggcgaaatcatcaagagatttgaacagaagggcttcaggcttgtggggctgaaattcatgcaggcctcagaggatctcttgaaagaacactatgtcgatctaaaggaccggccattcttcgccggtctggtgaaatacatgcactccggccctgtcgtggcgatggtctgggaagggttgaatgtagtcaaaaccggaagagtgatgttgggggaaaccaatccagccgactcaaagcccggtacgattcgaggtgatttctgtattcaggtaggccgtaccatggctaacttggagagaaccttcatcgcaatcaagcctgatggagtacagagagggctcgtgggagaaatcatcaagaggttcgaacagaagggattccgcctggtggctatgaaatttctgagagcgtccgaggagcacctgaaacagcactacatcgatctgaaggatcggccattttttccaggactggtaaaatacatgaacagcggcccagtggtcgctatggtgtgggagggccttaacgtcgtcaaaacagggagggtcatgctgggtgaaacaaatcctgccgattcaaaacccggaacaatcagaggcgacttctgcattcaggttgggcgaaacatcatccatgggtccgactccgtcaaaagtgcagagaaagagatctcactgtggttcaaacccgaggagctcgtcgactataagagctgtgcacacgattgggtgtatgagtag

SEQ ID NO: 232873 - DNA, 234 bp, Artificial Sequence
  Description of Artificial Sequence: Synthetic coding sequence
atggtatgggagggtctgaacgtcgtgaaaaccggaagggttatgcttggggagactaatcctgctgactctaagcccggaacaatcagaggggacttctgcattcaggtgggcaggaacatcatccacgggtcggattctgttaaatcagcggaaaaggagatcagtctgtggtttaaacccgaggaactggtcgactacaagagctgtgcacacgattgggtctacgaatag

SEQ ID NO: 232874 - DNA, 234 bp, Artificial Sequence
  Description of Artificial Sequence: Synthetic coding sequence
atggtgtgggagggactgaatgtggtgaagactggccgagtcatgctgggtgagacaaatcccgcagactcaaagccaggtacaattcgcggagatttctgcatacaagtaggtagaaatatcattcatgggtcagattctgttaaaagtgccgagaaagaaatttcactgtggttcaagccagaggaacttgtcgactataaatcttgcgcacatgactgggtctatgagtag

SEQ ID NO: 232875 - DNA, 459 bp, Artificial Sequence
  Description of Artificial Sequence: Synthetic coding sequence
atggcaaatctggagaggaccttcattgccattaaaccagatggcgtccagcgaggattagtgggcgaaatcattaaaagattcgaacagaaaggcttcaggctggtggctatgaagttccttagagcttccgaagaacacctgaaacagcactatattgatttgaaggacagacctttctttcctgggctcgtgaagtatatgaatagcgggccagtggtcgcaatggtgtgggaaggcctgaatgtggtaaaaactggcagagttatgctgggggaaaccaaccccgcagatagcaagccgggaacaattcgaggagacttctgtatccaagttgggcgtaacatcatccacggcagcgactcagtgaaatctgccgaaaaggaaatcagcctgtggttcaaaccagaggaactggtggattataaaagctgcgcacatgactgggtgtatgagtag

SEQ ID NO: 232876 - DNA, 459 bp, Artificial Sequence
  Description of Artificial Sequence: Synthetic coding sequence
atggcaaacttagaaaggacctttatcgcaatcaagcccgacggtgtgcagagggggctggtgggcgagatcattaagaggttcgagcaaaagggcttccgactcgtggcaatgaagtttctgcgtgctagcgaggaacacctgaagcagcactatatcgacctcaaggacagacccttcttccccggtctggtcaaatatatgaacagcggacccgtagtagctatggtgtgggagggtctaaacgtggtaaagacaggcagagttatgctgggcgagactaatccagccgacagcaaaccgggtacaatccgcggtgatttttgcatccaagtggggcgaaatatcattcatggatcagactcggtgaagagcgcggagaaagagatcagtctttggtttaagcccgaggagctcgtggattataaatcctgtgcgcacgattgggtgtatgaatag

SEQ ID NO: 232877 - DNA, 459 bp, Artificial Sequence
  Description of Artificial Sequence: Synthetic coding sequence
atggccaacctcgagaggacttttatagctattaaacccgacggtgtacagagaggtctcgtaggagaaattatcaagcgcttcgagcaaaaagggttcaggctggtggctatgaagtttcttcgcgcaagcgaggaacaccttaaacagcactatatcgacctaaaggacaggcctttctttccaggacttgtcaaatatatgaattccggcccagtagtagcaatggtgtgggaagggctgaatgtggttaaaactggcagggtgatgctcggcgagaccaaccccgctgactctaagccgggaaccatacggggagatttctgtattcaggtcggcagaaacattattcacgggagcgactccgtgaaaagtgccgaaaaggaaatctctttatggtttaagcctgaagagttagtggattacaagagttgtgctcacgattgggtatacgaatag

SEQ ID NO: 232878 - DNA, 459 bp, Artificial Sequence
  Description of Artificial Sequence: Synthetic coding sequence
atggccaacttggaacgcacattcatcgctattaaaccggacggagtgcagcgcggtcttgttggcgagatcatcaaacgctttgagcaaaaaggcttccggctcgtcgcaatgaaatttctcagggcatcggaagaacatctaaagcagcactatattgatctcaaagatcggccatttttccccggtctcgtcaagtacatgaattccggcccagtcgtcgccatggtgtgggaaggtcttaacgtcgtgaaaacagggagagtgatgctcggagagacaaaccctgccgatagcaaacccggtacaatccggggagatttctgtattcaggtggggaggaatatcattcatggcagtgactctgtgaaaagcgcagaaaaggagatatcattatggttcaagcccgaggaactcgtggattacaagtcctgtgcacacgactgggtatatgaatag

SEQ ID NO: 232879 - DNA, 459 bp, Artificial Sequence
  Description of Artificial Sequence: Synthetic coding sequence
atggctaatcttgagcgtacattcatcgccattaaacccgatggggtgcagcggggactagtcggcgaaatcattaaaaggttcgagcaaaaaggattccgcctagtagctatgaaattccttcgggcatctgaggaacaccttaaacaacattatatcgacttgaaggatcgtcccttctttcctggccttgttaagtatatgaactccggcccagtcgtggccatggtatgggaaggtctgaatgtagtcaagactgggcgagtgatgctgggtgagacaaaccccgcagattcaaagccagggaccattcggggagacttctgcatacaggtgggacgtaatataatccacgggagcgatagcgtgaagtcagccgagaaagagataagcctttggttcaaacccgaggaactggtggactataaatcatgcgcccatgactgggtctatgagtag

SEQ ID NO: 232880 - DNA, 879 bp, Artificial Sequence
  Description of Artificial Sequence: Synthetic coding sequence
atggtcctgctctcaacattaggcatagtttttcagggcgagggaccaccaatcagtagttgtgataccgggacgatggccaactgcgagcgaacctttatcgctattaaacctgatggcgtgcaacgaggtcttgtaggagagatcattaagaggtttgagcagaaaggattccgcctggtgggtctgaagtttatgcaggctagcgaagatctgctcaaagagcactatgtggacctgaaagaccggccattctttgcagggttggtgaagtacatgcactcaggaccagtggtggcgatggtgtgggaaggcctcaacgtggtaaaaacagggcgtgtcatgctgggagaaacaaatcccgcagatagcaagcccggtactataagaggggatttttgcatccaggtcggcagaacaatggctaatcttgagaggactttcattgccataaaaccggacggcgtccagagggggctcgtcggagagataataaagcgatttgagcagaagggcttccgtttagttgccatgaaattcttgagagcttccgaggaacacctcaaacagcattacatcgacttgaaggacaggccatttttccccggtctggtgaagtatatgaactcagggccagtggtggccatggtgtgggagggactcaacgtcgtgaagacaggcagggtgatgctcggcgagactaaccctgcagacagcaaaccgggaacgatccgcggtgatttttgtatccaggtgggcaggaacatcatccacggttcagattccgtgaagtctgccgaaaaggagatttccctgtggttcaagcctgaggagctcgtagattacaaatcctgtgcccatgactgggtgtacgagtag

SEQ ID NO: 232881 - DNA, 1188 bp, Artificial Sequence
  Description of Artificial Sequence: Synthetic coding sequence
atggtcagcgccgctggtttatcaggtgatgggaagatgagaggggtgttgctcgtactcctcggcctgttgtatagtagcacctcatgcggtgtgcagaaagcctccgtgttttacggcccagatccaaaagagggcttggtgtcctctatggaattcccttgggtggtgtcccttcaggattcacagtatacacacttggcttttgggtgcatactaagcgaattctgggtgttgtctatcgcctccgcaatccagaaccgaaaagatatcgttgtgattgtgggaatcagtaatatggacccgagcaaaattgcacacactgagtatccggtcaacacaatcatcatacacgaggactttgataacaatagcatgtcaaataatattgcactactcaaaacagatacagccatgcatttcgggaacttagtccaatccatttgttttctgggacgcatgctccatactccgcctgtcctgcagaactgctgggtgagcggttggaatcccacctcggcaactgggaaccatatgacgatgtctgttctgcgtaaaatctttgtgaaagacctagatatgtgcccgctctacaagctgcaaaaaactgaatgtgggtcacacaccaaggaagagacaaaaacggcttgcctgggcgatccgggttccccaatgatgtgccagttacagcagtttgacctgtgggtgctgagaggggtattaaatttcggtggagaaacatgccctgggttgttcctctacacaaaagtggaggattattccaaatggattacttccaaagctgagcgggctggccctccattgtctagcctccaccattgggagaagcttatttcatttagccatcatggccctaacgccactatgacccagaagacttatagtgattccgagctcggacacgtgggttcgtacttgcaggggcagcggaggaccattacacactcacggttgggtaacagttcccgggacagtctcgacgtgagggagaaagatgtcaaggagtcgggacgctccccagaagccagtgtgcagccactttactacgattactacggtggagaagtcggcgagggacgaatttttgcgggacagaacagattgtaccaacccgaagagatcattctcgtcagctttgtccttgtcttcttttgtagtagcatatag

SEQ ID NO: 232882 - DNA, 639 bp, Artificial Sequence
  Description of Artificial Sequence: Synthetic coding sequence
atggagatttcgatgccaccaccacaaatttacgtggaaaaaactttggccatcatcaagccagatatcgtagacaaggaagaagagatccaagacataatcctgcgctcaggattcacaatcgtccaacgcagaaagctgagactctcgccagagcagtgcagcaacttttacgtggagaagtatggaaaaatgtttttcccgaatctgaccgcctacatgagcagcggccctcttgtagccatgattttagcaaggcacaaagccatctcctactggttggaactgcttggtcccaacaactcactggtggccaaggaaactcaccccgactctttgcgcgctatatatggcaccgacgatctccggaatgcgctacatggcagcaatgacttcgccgctgctgaaagggaaatcagattcatgtttccagaagttattgtagagccaattcccatagggcaggcagccaaagattatcttaacttgcatatcatgcccacgctactagaaggacttacagagttatgcaaacaaaaaccagccgacccacttatatggctggcggactggcttctgaaaaacaaccccaacaagccaaaactgtgccaccaccccatcgtagaggaaccctattag

SEQ ID NO: 232883 - DNA, 561 bp, Artificial Sequence
  Description of Artificial Sequence: Synthetic coding sequence
atggcctctattctccgttccccccaggctttgcaactcaccctggccctcatcaagcccgatgctgtcgctcaccctttaattcttgaggctgtgcaccagcaaatactaagtaataaattccttatagtacgtatgcgcgagctgctgtggcgaaaggaagactgccagcgcttttaccgggagcacgaagggaggttcttctatcagcgacttgtagaatttatggcttccggacctatccgggcttacatcctagcccataaggatgcaatccaactatggagaacactgatgggcccaactcgcgtttttcgtgcccgacacgtagcaccagatagtatacgcggatcctttggtctcacagatacccggaacaccacccacggctctgactccgtggtatctgcaagcagagaaattgctgcctttttccccgatttttctgagcagcggtggtacgaggaggaggaaccccagctacggtgcggacccgtttgctatagccctgagggcggagttcattacgttgctgggactggcggattaggacccgcttag

SEQ ID NO: 232884 - DNA, 585 bp, Artificial Sequence
  Description of Artificial Sequence: Synthetic coding sequence
atgacgcagaatctgggtagcgaaatggccagcattctgagatccccccaggccctgcagctgacgctcgccttaattaagcccgatgctgtggcccacccactcatactcgaggccgtgcatcaacagattctgtccaacaagtttctgatcgtaagaatgcgcgaactcttatggcggaaagaagactgtcaaagattttaccgggagcacgagggcagatttttctaccagagattggtggagttcatggcatccggccctatcagagcatacatcctggctcacaaggacgcaattcaactgtggcgcacactgatgggaccaacacgggtgttcagggcaagacatgttgcacccgacagtattaggggcagtttcgggcttacagacactcggaatacaacgcacgggagcgacagcgtcgtgagtgcttcaagggagatcgccgcttttttcccggacttcagtgagcaaagatggtacgaagaagaagagcctcagcttcggtgcgggcctgtatgttactcgccagaggggggagtacattacgtagctgggaccggtggcttaggcccagcttag

SEQ ID NO: 232885 - DNA, 561 bp, Artificial Sequence
  Description of Artificial Sequence: Synthetic coding sequence
atggcatcgattctgcggagtcctcaagcgcttcagctgaccctggcccttatcaagccagacgctgttgcacaccctcttatcctcgaggccgtacatcagcagatactctccaacaaattcctgatcgtccggatgcgagagctgctgtggcgtaaggaagactgccagcggttctacagggagcatgaaggcaggtttttctatcagagactggtggaattcatggcctctggaccaatcagagcatacatattggctcataaggatgctattcagttatggcgcacgctgatgggtcctactagggtttttcgcgctaggcacgtcgctccagatagcatccggggttccttcgggcttacagatacaaggaacaccacgcacggatctgactccgtagtttctgcgtcacgcgagatcgcagctttcttcccagattttagcgagcagaggtggtatgaagaagaagaaccacagctcaggtgcggccctgtctgctacagtcccgaaggcggagtccattacgttgcaggaaccgggggtctcggtcctgcctag

SEQ ID NO: 232886 - DNA, 360 bp, Artificial Sequence
  Description of Artificial Sequence: Synthetic coding sequence
atggcttccattttgcgttcaccccaggcactccagttaactctggctctgatcaaacccgatgccgtggctcacccccttatcttggaagctgtacaccagcagatactctcaaacaagtttttgattgtaagaatgagggagttgctgtggagaaaggaagactgtcagagattttacagagagcatgaagactcagttgtgagtgcctcccgtgagattgccgcattcttccctgacttcagcgaacaacggtggtatgaggaggaagagccccagcttcgctgcggcccagtctgttactccccagaagggggtgttcactacgtcgccggaacgggcggactgggacctgcctag

SEQ ID NO: 232887 - DNA, 561 bp, Artificial Sequence
  Description of Artificial Sequence: Synthetic coding sequence
atggccagcatcctccggtctcctcaggctctccagctgacattggctctcattaagcctgacgccgtcgcccatcctctgattcttgaggcggtccatcagcaaatactcagcaataagtttctgatcgttaggatgcgagagttgctgtggaggaaggaagactgtcagcgattttatcgggaacatgaaggccgtttcttttaccagagactcgtcgagtttatggcatctggaccaatcagagcctacatcttggcccacaaggacgccatacaactttggaggacgctgatgggtcctacacgggtctttagggcgcgacatgtggcccctgatagcattagagggtcgtttggactgaccgacacccgtaacacaacacatggaagcgactccgtggtaagcgctagcagggaaattgcagcgtttttcccagatttctctgaacaaaggtggtacgaggaagaagaaccgcaacttcgctgtgggccagtatgttacagccctgaaggcggagtgcactacgtggcaggcaccggcggactgggccctgcttag

SEQ ID NO: 232888 - DNA, 492 bp, Artificial Sequence
  Description of Artificial Sequence: Synthetic coding sequence
atggcatcaattctgcgaagcccacaagccctacagttaaccttggcattgattaaaccagacgcggtcgcccaccctctgattctcgaagccgttcaccagcagatcctgagtaataagtttctgatagtgcgcatgcgggagttgctgtggagaaaggaagattgccagcggttttacagagaacatgaggctggacagtctgaaccaactagcttacctacccggatgccttcttcgtcaggcggacggagctgggacccgccagagtgctccgagcacgctatgtggccgcagatcctgagcgtgggagtgtccgcaagtttaacacctgccacgccccctatggtgagaactttgtggtttcagccagctgagcgcttacaacccagctctttgaccagcgtcaactcagctggcatgcgccgaaaaagtccatcctgtgcagtagcgttatgcgcgattgcccaaagggaagtgagcacaatgtag

SEQ ID NO: 232889 - DNA, 561 bp, Artificial Sequence
  Description of Artificial Sequence: Synthetic coding sequence
atggcaagcatactacggtcacctcaagctttgcagcttacactggcgctcatcaaacctgatgctgtcgctcacccgttgatattggaagctgtccaccaacaaattctcagcaacaaatttctgatcgtaagaatgcgcgagctattatggcgcaaggaagattgccagagattttatagagagcacgagggcagatttttttaccagcggctggtagaatttatggctagcggacccatcagagcctacatcctcgcccacaaggacgccattcagttatggcgcactctgatggggccaacgcgagtcttccgggctcgacatgtagctcccgattcgattcgtggctcatttggactgacagacacacgaaataccacacatggttctgattcagttgtgagcgcctcccgggagatcgcagccttcttccccgattttagcgaacaacgatggtacgaggaagaggaacctcaactcagatgcggtccagtgtgctattccccagaggggggagttcactatgtggcaggaacagggggattgggacccgcatag

SEQ ID NO: 232890 - DNA, 1131 bp, Artificial Sequence
  Description of Artificial Sequence: Synthetic coding sequence
atgaaccacagcgagaggttcgtgtttatcgccgaatggtatgacccaaacgcaagccttcttagaagatacgagctgctgttttatccaggggatggatccgttgagatgcacgacgtcaaaaaccacaggacttttctaaagcggacgaagtacgacaacctgcacttggaggatctgtttattgggaataaagtgaacgtgttctcccgtcaacttgtgctgatcgactacggtgatcagtatacagctagacagttagggtctagaaaggaaaaaacgctggccctaatcaaacccgacgctatcagcaaggcgggtgagatcatcgagataataaataaggccggatttacaatcaccaaattgaagatgatgatgctaagccgtaaagaagcacttgattttcacgtggatcatcagagtagacccttttttaacgagctcattcagtttataacaactggcccaataatcgcaatggagattctccgtgacgatgccatatgcgagtggaagaggttgttaggacctgcgaactctggagtagcacgcaccgacgcctccgagtctatccgcgctcttttcgggactgacgggatcagaaatgccgcacacggaccagactctttcgcaagcgctgctagggagatggaactgttttttccctcatccgggggttgtggacctgccaacaccgcgaagttcaccaattgtacttgctgtattgtgaaacctcatgcagtatccgaaggattgctcggaaagattcttatggcaatacgagatgccggtttcgaaatctccgctatgcagatgttcaacatggacagagttaatgttgaggagttctacgaggtgtacaagggcgttgtgacagaatatcatgatatggtcaccgagatgtacagcggcccttgcgtggcaatggagattcagcagaataatgccaccaaaacttttcgcgaattttgcggtcctgcggatccggaaattgccagacatctcaggccgggaactctgcgtgcaattttcggcaaaacaaaaatccagaatgccgtccactgtacagatttgccagaggatggcctgctggaagtgcaatacttttttaaaattcttgacaactag

SEQ ID NO: 232891 - DNA, 1023 bp, Artificial Sequence
  Description of Artificial Sequence: Synthetic coding sequence
atgcacgacgtgaagaatcatcgtacctttctgaaacgcacaaagtatgacaatctgcatctggaagacctcttcattggaaataaggttaatgtcttctccaggcaactggtgcttattgactacggggaccagtacacagcacggcagctggggagtcgaaaggagaagactttggctctgattaaacctgatgctatatcgaaagctggagagattatcgagattataaacaaagccggatttaccattaccaagttgaagatgatgatgctgtcaagaaaggaagcactggatttccatgtcgatcaccagtcacgccctttcttcaatgagctgatccagttcataacgacgggcccaatcattgctatggaaatcctgcgcgacgatgccatatgtgagtggaaacggttgttaggtcccgctaatagtggggtggctcgcactgatgcaagcgaatccatccgcgcattgtttggaaccgacgggataagaaacgccgcacatggacccgattcttttgcaagcgccgcaagagagatggagttgtttttcccatcctccggcggatgcggcccagcaaacactgccaaattcaccaattgcacttgctgtattgtgaaacctcatgcagtgtccgaaggcctactcgggaagattttgatggcgatccgagatgcaggatttgagatttctgccatgcagatgtttaacatggacagggttaacgtggaagaattctatgaagtttataagggagtcgtcaccgagtaccatgatatggtgacagagatgtattcagggccatgcgtggctatggagattcagcagaataacgcgacgaagacttttcgtgagttctgcggtcctgcggacccagagattgcacgacacctgcgcccaggtaccctgcgagccatcttcgggaaaaccaaaatacagaacgcggtgcattgcaccgacttgcctgaagacggcctgctggaggttcagtatttttttaaaatcttagacaactag

SEQ ID NO: 232892 - DNA, 1416 bp, Artificial Sequence
  Description of Artificial Sequence: Synthetic coding sequence
atgcagagtaacaaaacatttaatttggagaagcagaaccacacccctcggaaacatcatcaacaccaccaccagcagcagcatcaccagcaacagcagcaacagcctccgccaccgccaatcccagcgaacgggcagcaggccagctctcaaaacgaggggctcaccatagatctgaagaattttcgaaagcccggagaaaagacatttactcagcggtctaggctgtttgtggggaacttgcctcccgacatcaccgaagaggagatgaggaaactgtttgagaagtatggcaaggctggagaggtttttatccacaaggacaaggggttcggattcattagactggaaacccggacactcgccgagatcgccaaggtggagctcgacaatatgccactacgagggaagcagctgcgagttaggttcgcttgtcatagcgcatccctaaccgtccgtaacctcccacagtatgtctccaacgagctgctagaggaggccttcagcgtcttcggtcaagtggagcgcgcagtcgtgatcgtcgatgacagagggaggccgagtgggaaaggcatcgtggagtttagcggcaagcctgcagcaagaaaggccctggatagatgtagcgaaggctctttcttgctgacgacgtttccacgacctgtgacagtggagcccatggatcagcttgatgatgaggagggcctgcctgaaaagttggtgatcaaaaatcaacaatttcataaggaaagggagcaacccccacggttcgcgcagccaggctccttcgaatacgaatacgccatgcgctggaaagctttaattgagatggagaaacagcagcaggaccaagtagaccggaacataaaagaggctcgggaaaaacttgagatggaaatggaggccgcaagacacgagcaccaagtgatgcttatgaggcaggatctgatgcgacgccaggaggaactgcgcaggatggaggaactccataatcaagaagtgcagaagagaaagcaactggagcttaggcaggaggaagaacgccgacgaagagaggaagagatgcggagacaacaggaggagatgatgaggagacagcaagaaggctttaaaggcacttttcccgatgcccgagaacaagaaatacgaatgggccagatggctatgggcggagccatgggtatcaacaatagaggggctatgcctccggcacccgtgcctgccggaacccctgcccctcctggacccgctaccatgatgcccgacgggacattaggcttgacccctcccaccaccgagaggttcggccaagccgcaacgatggaggggatcggggctattggagggacacccccagcgtttaatcgtgccgctcctggggcagaatttgccccaaataaacgtcggcgatattag

SEQ ID NO: 232893 - DNA, 1416 bp, Artificial Sequence
  Description of Artificial Sequence: Synthetic coding sequence
atgcagtcaaacaaaacatttaatcttgagaaacagaaccacaccccaagaaaacaccatcaacaccaccatcagcagcagcaccaccagcaacagcagcaacaaccacccccaccacccattcctgccaacggacagcaagctagcagccagaatgagggtttgaccatcgacctgaagaattttcgtaaacccggtgagaaaactttcacccagcggagccggctgtttgtaggaaacctgcctcctgatatcaccgaggaagagatgaggaaactgtttgagaagtatggcaaggccggtgaggtgttcatacacaaggacaaaggcttcggattcatcagactggaaacccgcactttagcggagatcgcaaaagttgagttggataacatgccgttgcgcggtaagcagctccgcgttcggtttgcctgccacagcgcatcactgactgtgagaaatctgccacagtacgtatccaacgagctactggaggaagcatttagcgtgttcggccaggtggaaagagccgtcgttatcgttgacgataggggtcggccatcaggcaaaggcatcgtggaattcagcggcaagcccgcagctaggaaagcattggatcgctgttctgaggggtcttttcttcttacaacgttcccgagacccgtcactgttgagcctatggaccaactagacgacgaagagggccttcccgaaaaacttgttattaagaaccaacagttccataaagaaagggagcagcctcccagatttgcgcagcctggctcttttgaatacgaatatgctatgcggtggaaagccctcatagaaatggagaagcagcagcaggatcaagtcgatcgcaatattaaggaagccagagagaagcttgaaatggaaatggaagccgctcggcacgagcaccaggtcatgctcatgcggcaagacttaatgcgtcggcaagaggaactgcggcgaatggaggaattgcataatcaggaggtgcaaaagcgcaagcagttagaactgcgccaggaggaagagcggcgaaggagagaagaggagatgcgcagacagcaggaagagatgatgagacgccagcaggaagggtttaagggaacgtttcctgatgcacgggagcaggagattcgcatgggccagatggctatgggaggggcaatgggaattaataatcgcggagcgatgcctcccgctccagtgccagctggaacacccgctccacctggccctgctaccatgatgcccgatggaacactcggacttaccccgcctacaaccgagcggttcggccaagccgcaaccatggagggtattggggctattggcggaaccccaccagctttcaaccgggcagcccctggcgctgagttcgcccctaataaacggaggcgatattag

SEQ ID NO: 232894 - DNA, 1416 bp, Artificial Sequence
  Description of Artificial Sequence: Synthetic coding sequence
atgcagagtaacaagacgtttaatttagaaaagcagaaccacaccccaagaaagcaccaccagcaccaccatcagcagcaacatcaccagcagcaacagcaacagcccccaccccctcccatccctgccaacggtcagcaggcgtcttcccaaaacgaggggcttaccatcgatcttaagaacttccggaagcccggagagaagacgttcacacagagatcccgccttttcgtaggcaatctcccccctgacatcaccgaagaagagatgaggaaattgtttgagaaatatgggaaggctggtgaagtcttcatacataaggataagggattcggcttcattaggctagagacccggacgttagctgagattgcaaaagtcgaactggacaatatgcctctgaggggtaaacagctaagagtgcgattcgcatgccattcagcctccctcacagtccggaacctcccgcagtatgtgagtaatgagctactggaagaggcattttcggtcttcggtcaggtggagcgagcggtcgttatcgtggatgaccgaggacgcccttcaggtaaggggatcgtggaattctccggtaagcccgctgctagaaaggccctggatagatgttcggaggggtccttcctgctcaccacattccctcgtccagtgaccgtagagcctatggaccaattagacgatgaggaggggttgcctgagaagttagtaataaaaaatcagcaattccacaaggagcgagaacaaccgccaagattcgcccagcctgggagcttcgagtacgaatatgctatgcgctggaaagccctgatagagatggagaagcaacagcaggatcaggtggacaggaatattaaagaggcccgagagaagctcgaaatggagatggaagcagcccgtcacgaacaccaggtgatgcttatgcgccaagacttaatgagacggcaggaagagctgcgccgtatggaggaattacataatcaggaggtgcaaaagagaaaacagctcgagttaagacaggaggaggagcgccgtaggagggaggaggaaatgcgacgtcaacaggaagaaatgatgcggaggcagcaggaaggcttcaaggggacattcccagacgcccgtgagcaagaaatacggatgggacagatggccatgggtggggctatgggcataaataatcgaggtgccatgccccctgcacctgttcccgctggcactccagcaccacccggacccgctacaatgatgccagacggcactctcggtctcacacccccaacaacagagagattcgggcaagccgctacaatggaggggattggcgcaattggagggacaccccctgctttcaatagggcagccccaggagcagagtttgccccaaataaacggaggaggtattag

SEQ ID NO: 232895 - DNA, 747 bp, Artificial Sequence
  Description of Artificial Sequence: Synthetic coding sequence
atgcagtctaataagactttcaacctggaaaagcagaatcacactccacgaaagcaccaccagcaccaccaccagcagcagcatcatcagcagcagcagcagcaaccccctccacctccaatcccagctaatggccaacaggcgtctagccagaacgagggattgaccattgacctgaagaactttcgcaaaccaggagaaaaaacatttacccagcgatctcgcctgtttgtcggcaacctgcccccagatattactgaagaagagatgaggaaactattcgaaaagtatggtaaagcgggtgaggtcttcatacacaaggacaagggttttgggtttatcaggctggagactcgcactctggctgaaattgcaaaggtggagcttgacaacatgcctctacgtgggaagcagctccgcgtccggtttgcctgccatagcgctagcctgaccgtccgaaacttgccccaggagcgcgaacagccccctcggttcgcacagccagggtccttcgagtatgagtatgccatgcggtggaaggccctcatcgagatggagaagcagcaacaagaccaggtggatagaaatataaaggaggcgcgagaaaagctcgagatggaaatggaggcagccagacatgagcatcaggtgatgctgatgagacaggatctcatgcgacgccaggaggagctgcggcgtatggaagagctgcacaaccaggaagttcaaaaaagaaagcagctgtag

SEQ ID NO: 232896 - DNA, 708 bp, Artificial Sequence
  Description of Artificial Sequence: Synthetic coding sequence
taaccagatattactgaagaggagatgcggaagctttttgagaagtacgggaaagccggtgaggtcttcattcacaaggacaagggctttggctttatccgtctcgtcgagcgagccgtggtaattgtggacgacaggggccgtccatccggtaaaggtatcgtcgaattctcaggaaagccagcggctaggaaagccctggacaggtgttccgaggggtcgttcttacttactactttccccaggccagtgactgtggagcccatggatcagctggatgacgaagaagggttgccagaaaagctagttattaagaatcagcagttccacaaggagcgagaacagccgccacggtttgcacagcctggcagttttgagtacgaatacgcgatgcgttggaaggccctgatcgagatggaaaaacaacaacaggaccaggtggatagaaacattaaggaagctcgcgagaagctggagatggagatggaagctgctaggcacgaacaccaggtgatgcttatgcgacaagatctcatgcgaagacaggaggaactgcgccgtatggaggagctgcacaatcaggaggttcagaagcgcaagcagctggagttgcggcaggaggaagagcgccgacgacgggaggaggagatgagacgccagcaggaggaaatgatgcggagacagcaggaagggttcaaggggacatag

SEQ ID NO: 232897 - DNA, 375 bp, Artificial Sequence
  Description of Artificial Sequence: Synthetic coding sequence
atgcagagcaataaaacgtttaacttggaaaaacagaaccataccccccgtaagcaccaccagcaccaccatcagcagcagcatcatcagcagcagcaacaacagccccctccaccacccatccccgcaaatggccagcaagcgtcctcacaaaacgaaggattaaccatcgatctcaaaaacttccggaagcccggagagaagacatttactcagcgtagtcggctgtttgtcgggaatctaccccctgatatcactgaggaggagatgcggaaattgtttgaaaagtatgggaaggagactagaaccctggccgaaatcgcaaaagtggaacttgataatatgcccctcagaggcaaacagctgcgggtgtag

SEQ ID NO: 232898 - DNA, 201 bp, Artificial Sequence
  Description of Artificial Sequence: Synthetic coding sequence
atgcagagtaacaagacattcaatcttgaaaagcaaaaccatacacccaggaagcaccaccaacatcaccatcaacagcaacatcatcagcagcagcagcagcaaccacccccacctccgatccctgcgaatggccagcaggcaagctctcagaatgaaggactgactatcgacctcaagaacttcagaaaacccggatag

SEQ ID NO: 232899 - DNA, 624 bp, Artificial Sequence
  Description of Artificial Sequence: Synthetic coding sequence
atgcagtccaacaagactttcaatttagagaaacagaatcatactcctcgcaagcaccaccagcatcaccatcagcagcaacatcaccagcagcaacaacaacaaccaccaccccctccaatccccgctaacggacaacaggccagctcccagaacgaaggattgaccatagatttaaagaactttcgcaagccaggggaaaaaacattcacacagagatctcggctttttgtcgggaatttgccacccgatatcaccgaagaggaaatgcgcaagctctttgagaagtatggcaaagcaggggaggtgtttatccacaaggacaaagggttcgggttcatcaggctggagacaaggactctggccgagattgcaaaagttgagttggacaacatgcctctaagagggaaacagctgagggtccgctttgcttgtcactcagcctccctgaccgtgcgtaatctgccccagtacgtcagcaacgagcttctggaggaagcttttagcgtttttggccaggtggaaagggccgttgtgattgttgacgatagaggcagaccgagcggtaaaggaatcgtcgaattcagcggcaaacccgcagcccgaaaagcccttgatagatag

SEQ ID NO: 232900 - DNA, 1149 bp, Artificial Sequence
  Description of Artificial Sequence: Synthetic coding sequence
atgcggaagctctttgagaaatacggcaaggctggcgaggttttcatccacaaggataagggtttcggcttcattcgcttggagacacggaccctcgccgaaatcgccaaagtcgaactcgacaatatgccactgagaggtaaacagcttagggtacggtttgcctgtcattccgcaagtctgactgtgcgtaacctgcctcagtacgtatcaaacgagttactcgaagaggcgttttcggtgttcgggcaggtggagagggcagtcgtaatcgtggatgacagggggaggcctagtgggaaaggcattgtagaattctccgggaaacctgcagctcgcaaggccttggatcgctgcagtgaaggctcttttctgctaaccactttcccacggccagtgacagtcgaacctatggatcagctcgatgacgaagagggactccccgaaaagctcgtgattaagaatcagcagttccacaaagagagagaacagcccccacggttcgcacaacccggttcgttcgagtatgagtatgcaatgagatggaaggccttgatagaaatggaaaagcagcagcaggatcaggtcgaccgaaatattaaggaagcgagggagaagttggagatggagatggaggcggctcgtcacgaacaccaggtgatgctgatgcggcaggatcttatgcggaggcaggaggaactgaggagaatggaggaactacacaatcaagaggtgcagaagcggaagcagctcgaactgagacaggaggaagagagaaggcggagagaagaggaaatgcgaaggcaacaggaggagatgatgcgcagacagcaagaagggttcaagggcactttccccgacgcgcgtgaacaggaaatacggatgggccaaatggccatgggcggagccatgggtattaacaaccggggagccatgccgccagctcctgtaccagctgggactccagctccgcctggacccgctaccatgatgcccgacggaactctcggattgacaccgccaactactgagcgattcggccaggcagctactatggaaggtatcggagccatcggcggtaccccaccagcgttcaacagggctgcaccaggcgctgaattcgcgcctaataagcggcgacggtactag

SEQ ID NO: 232901 - DNA, 3048 bp, Artificial Sequence
  Description of Artificial Sequence: Synthetic coding sequence
atgggagccgagagaagactcttatccatcaaggaggcctttcgcctcgcccagcagccccaccagaatcaagcaaaacttgtcgtcgccttgtcgcggacatacaggaccatggacgataagaccgtcttccatgaagaatttatacactatctaaagtacgtcatggtggtgtataaacgcgaacctgccgtggagcgggtgatagagttcgcggcaaagttcgtgactagtttccaccagagtgatatggaggatgatgaggaggaagaagatggtgggttgttaaattacctgttcacttttctgctaaagtctcatgaggctaatagtaacgctgtgcgctttcgtgtctgcttactgatcaacaaactcttgggtagcatgccggaaaacgctcagatcgatgacgatgttttcgataaaatcaacaaagcaatgctaattaggcttaaggacaaaattcctaatgtcaggatccaggccgtactggcgctgagccggctccaggacccaaaagatgacgagtgtcctgtggttaatgcctatgcaactctgatagaaaacgattctaacccagaggttaggcgggcagttctgtcatgtattgccccttctgctaaaaccctgcctaaaatagttgggagaactaaagacgtcaaagaagcagttcggaagctagcctaccaggtgctggccgagaaagttcatatgcgcgcaatgagcatcgctcagcgggttatgctccttcagcagggcttgaatgataggagtgacgccgtgaagcaggccatgcagaagcatttactgcagggctggctgaggttctccgaaggcaacattctggaactactgcacagactggacgttgagaacagcagcgaagttgccgtcagtgtgctgaacgcccttttttcaatcaccccactgagcgagctcgttgggctgtgcaagaacaatgatggtcgtaagttgatccccgtggagactctaacccctgaaatcgccctgtactggtgtgccctgtgcgaatacctgaaaagcaaaggcgacgaaggggaggagtttttagagcagattctgcccgagcccgtcgtgtatgcagattatctgctgtcttatatccagtccattcccgtagttaacgaggagcacagaggagatttctcctacatcgggaacttgatgactaaagaatttattgggcagcaactgattctgattatcaagtccctggatacctctgaagagggaggcaggaagaagctgctcgccgtgctccaagagatactgattctccctacgatccctatatccctggtgtcattcctcgtggagcgcctgcttcacattataatcgatgacaacaagcgtacacaaatcgtcaccgagatcatatccgagattcgggcacccatagtaacagtgggggtgaataatgatccggctgacgtgagaaagaaggaactcaagatggccgagattaaagtcaaactgatcgaggctaaagaggcgctcgagaattgtatcacattacaggatttcaacagggccagcgaactcaaggaggagatcaaggccctggaggatgctaggatcaaccttctaaaagagacagaacaacttgagataaaagaggtccatatagagaaaaatgatgctgaaacgctgcagaaatgcctaatcctttgctacgagttgctcaagcagatgtccatcagtacgggactttccgcaaccatgaacggcattattgaatctcttatcctgcccggtatcatctcaatacatccagtggtccggaatctggcggttctgtgtctgggctgttgcggtcttcagaaccaagattttgccagaaagcacttcgtgctgttactgcaagttcttcaaatcgacgacgtgacaattaagatttccgccttgaaagctatatttgaccagctgatgacattcggcatcgagccgtttaagacaaagaagatcaaaaccctgcactgtgaaggtacagagatcaattccgacgacgagcaggagtctaaggaggtcgaagaaacggctacagctaagaatgtgctcaaattgctttctgacttcctcgactctgaagtgtcagagctccggaccggagctgcggaaggactggcaaagctaatgttttccggactgctagtctcttctcgtatactctcacggctgatactgctgtggtataatcccgtaactgaggaagatgtgcaactgaggcattgtctaggggtgttctttcccgtcttcgcatacgccagtaggactaaccaggaatgcttcgaggaggcgttcttaccaacactccagaccttggctaatgccccagcctccagtccccttgccgagattgacatcactaacgtcgctgaactcctggtggacctgactcggcctagtggtctgaatccgcaggccaagaccagtcaggactatcaagccctgacagtgcacgacaacctggcaatgaagatttgcaacgagatcctgacgagcccatgctcgcccgagattagagtgtacacaaaggccctatcctctctggaactgagcagccatcttgccaaggacctgctggtccttctgaatgagatcctggagcaggttaaagatcgtacctgtcttagagcattagaaaagatcaaaattcagctggaaaagggaaacaaggagttcggggaccaagctgaggccgcacaggatgctaccctgacaaccaccacgttccagaacgaggacgaaaagaacaaagaggtctatatgacccccctccgtggcgttaaagccacgcaagcttctaagagtacgcagcttaaaacaaataggggccagagaaaggtaactgtttccgccagaacaaaccgacggtgccagaccgcagaggcagacagtgagtccgaccacgaagttcccgagcctgagagcgagatgaagatgcgcctgccaagacgggctaaaacggctgccctggagaagtctaaactgaatctggcccagtttctgaacgaagatctgtcctag

SEQ ID NO: 232902 - DNA, 951 bp, Artificial Sequence
  Description of Artificial Sequence: Synthetic coding sequence
atgagcggcgacagtagcggtagaggccctgagggccgaggccgaggccgagaccctcatcgggatcgcacacggtctaggagtcgatctcgcagccccctctcccctcgatctaggagggggtcagctcgggaacggagggaggccccagagagaccaagccttgaggataccgaaccttccgactccggcgacgagatgatggatcctgctagcctcgaagccgaggccgaccagggattatgccgtcaaattagacaccagtaccgggctctgatcaattcagtacagcagaaccgagaagatatcttgaatgccggagacaaattgacagaggttctggaagaggccaacacgctgttcaacgaggtttcccgcgctagagaggccgtgcttgatgcacactttcttgtgcttgctagtgatctgggcaaggagaaggctaaacaactgaggagcgatctgtcaagctttgatatgttgcggtacgtggaaaccctcctgacccatatgggagtcaacccactagaggccgaggagcttattagagatgaagacagccccgatttcgagtttatagtgtacgattcatggaagatcaccggtcgcaccgccgagaatacctttaataagacacataccttccacttcctgttgggctcaatttacggagaatgtcctgttcccaagccacgcgttgatagaccccgaaaggtacccgtaatccaggaagagcgcgcaatgcccgcacaactgcgcaggatggaagaatctcatcaggaggccacagagaaggaggtggaacgcatcttgggcctgctgcaaacttacttcagagaagatcgagacagcctgaccttgagtcccagactcgaatgtagtggcacgataagcacacattgcaacctgcatctactcgattctagtaattcaccggcttctgccagctag

SEQ ID NO: 232903 - DNA, 1158 bp, Artificial Sequence
  Description of Artificial Sequence: Synthetic coding sequence
atgtccggtgactccagcgggcgtggtcccgaaggtcgcggtagaggccgagatccacaccgggaccgcacccgttcccgctcccgctccaggagcccactttcaccgagaagccgtcggggaagcgcacgcgagcgacgcgaggccccagagaggcctagcctggaagacaccgagccaagtgatagtggcgacgaaatgatggacccagcttctcttgaggcagaggccgatcaaggactgtgccggcagatccgtcatcagtatagggcgctcatcaattcagtacagcagaaccgcgaggacattctgaacgctggtgacaaactgaccgaggttctggaggaggccaatacattgtttaacgaagtatcccgagccagagaggccgtgttagacgcccacttcctggtccttgcttccgatctgggcaaagaaaaagccaaacagttacgcagcgatttatcttcctttgacatgctgcggtacgttgagaccctgctaacgcatatgggcgtcaatcccttggaagcagaagagttgattcgcgacgaggacagcccagactttgagttcattgtgtacgacagctggaagattacaggcaggaccgccgaaaatacattcaacaaaacccacacctttcactttctgcttggatccatctacggcgaatgccctgttcccaagcctagggtggatcggcctcggaaagtccctgtgatccaggaggaacgcgctatgcccgcacagctacgtcgcatggaagagtcacatcaggaggctacagagaaagaggtggaaaggattcttggactcctccagacgtactttcgtgaggatcccgatacaccaatgtccttcttcgatttcgtggttgatccacacagttttcctaggactgtggagaacatttttcacgtctctttcattatccgcgacggatttgcgaggatccgtctggatcaagatcggttacccgttatcgagcctgtgagtattaatgaggaaaatgaagggttcgaacataatacccaagttcggaaccagggtattatcgctctgagctaccgcgactgggaggagatagttaagacattcgagatttcagagcccgtaattactcccagccagaggcagcagaagccgtctgcctag

SEQ ID NO: 232904 - DNA, 519 bp, Artificial Sequence
  Description of Artificial Sequence: Synthetic coding sequence
atgctccgctatgtggagaccctgctgacacacatgggcgtaaatccactagaagcagaggaacttattcgcgacgaggattctccagattttgagtttatcgtgtacgattcttggaaaataacgggacgaaccgcggagaacacattcaacaaaacacacacttttcattttctgcttgggagcatatacggggaatgcccagtccccaaacccagagtggacagaccacgcaaggttcctgtgattcaagaggaaagggcgatgccagcacagctgaggcggatggaggagtcacatcaagaggccaccgaaaaggaggtggagcgaattctgggcctgcttcaaacctacttcagagaagaccccgataccccaatgagtttttttgattttgtagtggacccccacagctttcctaggaccgtcgagaatatttttcacgtctctttcatcataagggacggattcgcacgaattcggctcgatcaagaccgcctgcctgttatcggtaaatag

SEQ ID NO: 232905 - DNA, 2574 bp, Artificial Sequence
  Description of Artificial Sequence: Synthetic coding sequence
atggcaaaggccaaaaaggtgggtgctcgcaggaaggcaagtggagccccagcaggtgctagaggtggcccagctaaggccaacagtaatccattcgaggtcaaagtaaacaggcagaagtttcaaatcctcgggaggaaaactcgacatgacgtgggactgccgggagtctctcgagcccgtgcactgagaaagaggactcaaactctgcttaaggagtataaggaacgtgataaatcaaatgtgtttcgggataaacggtttggcgaatataacagcaatatgtcacccgaagaaaagatgatgaaaaggtttgctctggagcagcagcgccaccatgaaaaaaagtccatttacaaccttaacgaagacgaagagctcacacactacggccagtcgttggcagacatcgagaaacacaacgacatcgtcgacagtgatagcgatgctgaggatcgcggtacactgtctgccgagctcacagccgcacacttcggagggggtggcggattgcttcacaagaaaacacaacaggaaggcgaggagcgggagaagcccaagtcacgtaaagagcttatagaagagctcattgctaagagtaaacaggagaaacgggagcgccaagcccaaagggaagatgcgctggaacttacggagaagctagatcaagactggaaggaaatacagaccctcctaagtcataagacaccaaaaagtgagaatagggacaaaaaagaaaagccgaagcccgacgcttacgatatgatggtgcgggagctgggctttgaaatgaaggctcagccttctaacaggatgaagactgaagccgagctggcgaaggaggagcaggagcatctccgcaagttagaagcggaaaggctgagaaggatgcttggtaaggacgaagacgagaacgtcaagaaaccaaagcacatgagcgctgacgacctgaatgacgggttcgttctggacaaagacgaccgcagacttctgtcctacaaggacggaaagatgaatgttgaggaggacgtccaggaagaacagagtaaggaagcttcagatcctgagagtaatgaagaagagggggattccagcgggggtgaggacaccgaggagtccgacagccccgactctcatctcgacttggaaagtaatgtggaatccgaagaagagaacgagaaaccagctaaggaacagcggcagacaccgggtaagggtttgatttcaggtaaagagcgagccggtaaggccactcgggacgagttgccatataccttcgccgctcccgaatcctacgaggagctgcgcagcttgctgcttggacgtagcatggaagaacagctccttgtggtggagcgcattcagaagtgcaatcacccttctcttgccgaggggaacaaagcaaagctagagaaactcttcgggtttttgctagagtatgtgggcgacctagccacggacgacccccctgacctgaccgtgatcgacaagctcgttgtacacctctaccacctgtgccagatgttccccgaatcagcctctgatgccattaaattcgtcctccgtgatgcgatgcatgaaatggaggaaatgattgagaccaaggggagggccgctcttccgggactcgacgtgctcatatacctcaagattaccgggttgcttttcccgacttctgatttttggcacccggtggtaacgcctgcattagtatgcctgtcccagctgctgaccaaatgtccaattctgtctctgcaagatgtggttaaggggttattcgtctgctgtttgtttcttgagtacgttgccttgagccagaggttcattcccgagctcatcaacttcctactcggcatcttatatatagccaccccgaacaaagcatctcagggctcaactctcgtgcaccccttcagggcactggggaaaaactcagagctgttggtagtgagcgcgagggaggacgtggcaacttggcagcagtcttccctgtctctgcgatgggcatctaggcttcgggctcccaccagcaccgaggcgaatcacattcggctgtcctgcctcgcggttggcctagccttactgaagaggtgcgttttgatgtatggcagtctaccaagtttccatgccattatgggcccactgcaggccctgttaaccgatcacctggcggactgctcccaccctcaggagctccaggaactttgtcagagcacactcacagagatggagagtcagaagcaactgtgtcgacctctgacctgtgagaaatcaaagccggtcccgctgaagctatttactccgagattggtgaaggttctggagtttggtaggaaacaaggatcctccaaggaggagcaggagcgcaaaaggcttatccacaaacacaagcgcgagttcaaaggagccgttagggaaataaggaaggataatcaatttttggcacggatgcaattgagcgagattatggagagggatgcagaacggaaacgcaaggtgaagcaattgttcaatagtcttgcaactcaggaaggcgagtggaaggccctcaagcgtaagaagttcaagaagtag

SEQ ID NO: 232906 - DNA, 2421 bp, Artificial Sequence
  Description of Artificial Sequence: Synthetic coding sequence
atggcaaaggctaaaaaggtgggcgcaaggcgcaaagcatctggggctccggcaggcgcacggggtggcccagccaaggccaacagcaacccattcgaggttaaggtgaatcgccagaagttccaaatcctcggtaggaagacacggcacgatgtgggcctaccaggagtgtctagagccagggctttacggaagagaacacaaactctgctgaaggagtataaggaacgggataaaagtaacgtttttcgcgataaacggttcggcgaatataactccaatatgtcccctgaagagaagatgatgaagcgcttcgcacttgaacagcaacgccatcatgagaagaagtctatctacaacctcaatgaggatgaggaactcacccattacggccaaagcttggccgatatcgaaaaacacaatgatatcgttgattccgacagcgatgccgaggatcggggaacactgagcgctgagctaactgcggcacacttcggcggagggggtggtcttctgcataagaaaacgcaacaggaaggtgaggagagagaaaaacctaagtcgcgaaaggagctgattgaggagctcatcgccaaatccaagcaggagaaacgggaacgtcaagctcagcgagaagacgcactggagctcactgaaaagctggatcaggactggaaagagatacagacgttgctgtcacataaaacccccaaatccgagaatagggataagaaggagaagcctaaacctgacgcatatgatatgatggtgcgggaattgggctttgagatgaaagctcagccgagtaatcggatgaaaacggaggccgagcttgctaaggaagagcaggaacaccttagaaaactcgaagctgaaaggttgcgcaggatgcttgggaaagacgaagatgagaacgtgaaaaagcctaagcacatgtcggcagacgatctgaatgatggctttgtgctggataaagacgataggagacttctgagttacaaggatggaaagatgaacgtagaagaagatgtgcaggaggagcagtcaaaggaggcttcagacccagagtcaaacgaggaagaaggagattcaagcggcggagaggatactgaggagagcgattcccctgacagccaccttgacctggaatccaatgtcgagtccgaggaagaaaacgagaaaccggctaaagaacagaggcagacacccggtaaaggcttgatctccggaaaggagcgggctggcaaggctactagagatgaactgccttatacttttgctgcacctgagtcatacgaagagctgaggagtcttcttttagggaggtccatggaggaacagttactagtggttgagaggattcagaaatgtaaccatcccagcctggctgagggcaataaggcgaagctcgaaaagctatttggcttcctacttgagtacgtgggagacttagcgactgatgatccacccgacctaactgttattgataagctggtcgtgcacctgtatcatctgtgccagatgtttcccgaatccgctagtgatgccattaagttcgtattacgagacgctatgcatgaaatggaagagatgatagaaactaaaggaagagcagcacttccagggctggacgttctgatctacctgaagattactggcctgcttttccccacttcagacttctggcaccctgttgtcacgcctgccttagtttgcctcagtcagcttctgactaaatgtcctattttgtctctccaggacgtggtgaaaggactgttcgtatgctgcctgttcctcgagtacgttgccctctcacagaggttcatccccgagttaattaacttcttactgggtatactttatattgccaccccaaacaaggcgtcccaggggtccacattagtgcatccatttagggccctcggcaagaactctgaactgttggtggtatcagcaagagaggacgtggcaacctggcagcagagttcactgtccctacgctgggcctcccggttgagagcaccgacatcaaccgaagccaaccacatcagactttcctgtctcgctgtggggttagcgttgctgaagagatgcgtcctcatgtatggtagcctaccatcgtttcatgcgatcatgggacctctgcaggctctactcaccgatcatctggctgactgcagccacccccaagaacttcaagagttgtgtcagtccacccttaccgaaatggagtcacaaaaacaactgtgtcgtcccctgacctgcgagaagtccaagcccgttcctctgaaattatttactcctagactggtctccaattcaaggccacaggtgattcatctgccctggccacccaattaccgttgcgagccgcaacaccccgcaaagaaggtgattttcttccgagtcataatgctgtag

SEQ ID NO: 232907 - DNA, 2574 bp, Artificial Sequence
  Description of Artificial Sequence: Synthetic coding sequence
atggctaaagctaagaaagtaggagctcgcaggaaggcctccggggcacccgctggggctcgcggtggtcctgctaaggcgaactcaaatccattcgaagtgaaagttaacaggcagaaatttcagatactgggtaggaagacaagacatgatgtggggcttcccggagttagcagggccagggccctcagaaagcggacccagaccctgctcaaggaatacaaagagcgtgataaaagtaacgtgtttcgcgacaagcggtttggtgaatacaattccaatatgagccctgaggagaagatgatgaagcggtttgccctggagcaacagagacaccatgagaaaaagtctatctataatctgaatgaggacgaagaactcacacattacgggcagtccctcgcagacattgaaaaacacaacgatattgtggattcagattccgatgccgaagacaggggtaccctgtcagcagagctgacagccgcacattttggaggcggagggggacttttgcataaaaaaactcagcaggaaggggaagagagggaaaagcccaaatcccgtaaggagctgatcgaggagcttatcgcaaagagcaagcaggagaaaagagagagacaggctcaaagggaagatgccctagaactgaccgagaaacttgatcaagattggaaggaaattcagactctgctcagccataagacacccaagtcggagaatagggacaaaaaagaaaagcctaagcccgacgcttatgacatgatggtcagagagctcggtttcgaaatgaaggcccaaccttccaacagaatgaagacagaagctgagttggctaaggaggagcaagaacatctgaggaagctggaagctgaacgactccgccgtatgctcggaaaagacgaggatgagaacgtgaaaaagcccaagcacatgtctgcagatgacctgaatgacggattcgtgcttgataaggatgacaggcgattgctcagttataaggacggcaaaatgaatgtggaggaagatgttcaagaagagcagtcaaaggaagcaagcgaccccgaaagcaatgaggaggagggtgattcctcaggcggagaagataccgaagagtcagattccccggatagccacctggatctggagagtaacgtggaaagcgaagaagagaatgagaaacccgctaaagaacagcggcagacccccggtaaaggactgataagcgggaaggagcgcgctggaaaggccacgcgggatgagctgccgtatacgttcgctgcccctgagtcgtatgaggagctccggagtttattgttgggtcggagtatggaagagcaacttctggtggtggaaagaatccaaaagtgcaaccacccatcgctggcagagggcaataaggccaaattggagaaactgttcggcttcctccttgagtacgtgggggacctggccacggacgacccccctgacttgactgtcattgataagttggtcgtccatctgtatcacttgtgtcagatgtttcctgagtcggcttcggacgcaatcaaatttgtactccgagatgccatgcacgaaatggaggagatgatagaaaccaaaggcagagccgcactcccaggtctcgatgtcttgatatacctgaagattaccggcctactgttccctacatctgatttttggcatccagtggtcacacctgcattggtgtgtctgagccagctcctgaccaaatgccctatactctcactgcaggacgtggtgaagggcctctttgtctgttgcttgttcctggagtacgttgctctcagtcaaaggttcattcccgaactgatcaattttctgctggggatactgtacatagccacgcccaataaggcatctcaggggtcaacactggttcacccttttcgtgctttgggcaaaaactctgagctgttggtggtgtcagcccgagaggacgtggccacttggcagcaatcttcccttagtctcagatgggcctcccgactgagagcaccaactagtacggaggcgaatcacatcagactgagctgtcttgcagtcggcctcgcactgctgaaacgctgcgtcctgatgtatgggagtttaccgagctttcacgcaatcatgggccctcttcaggctctattgaccgatcacctagctgactgttcccacccacaggagttacaagaactgtgtcagtctacactcacggaaatggagtctcaaaaacagctgtgtagacctcttacatgcgagaaaagtaaacctgtgccactgaagctgtttacaccaaggctggtgaaggtcttggaattcggcagaaagcagggatcttctaaggaggagcaggagcgaaagcggctcatacacaagcacaagcgtgagtttaagggtgccgttagagagatccgcaaagacaatcagtttctcgccaggatgcagttaagtgagatcatggaacgcgatgctgagcgaaaacggaaagtcaaacagctgttcaactccctagctacacaggaaggcgaatggaaggccctgaaacggaaaaagtttaagaaatag

SEQ ID NO: 232908 - DNA, 1728 bp, Artificial Sequence
  Description of Artificial Sequence: Synthetic coding sequence
atgaagcggttcgctctggagcagcagagacaccacgaaaagaagtccatctataatctgaatgaggatgaggaacttactcattatggccagtctctcgcagacatcgagaaacacaacgacattgtagacagcgattcagacgctgaagataggggcaccttatctgctgagttgactgcggcacactttggcggtgggggaggtctgctgcacaaaaagactcagcaggaaggggaggaaagagagaagccgaagagccggaaggaactaattgaagaactcatcgcaaagtccaagcaggagaaaagagagagacaggctcagcgtgaggacgcactcgaacttaccgagaaactggaccaagattggaaggaaattcaaactttattgagccacaaaacccccaaaagcgaaaatagagataaaaaggagaagcctaaacctgatgcttatgacatgatggttcgtgaactgggcttcgagatgaaggcccagccttccaatcgtatgaaaactgaggcagaactcgcaaaggaagagcaggagcatctgagaaagctcgaggcagaacgcctgcgcaggatgctcgggaaagatgaggatgagaatgttaagaaacccaagcacatgagtgctgatgacctgaatgatggcttcgtcctggataaagatgaccgcagactgctctcctacaaggatgggaaaatgaatgtcgaagaggacgttcaagaggagcagagcaaagaagctagcgaccccgaatccaacgaagaagaaggggattctagtggcggtgaagatacggaagagtctgacagcccagactcccatctggatctggagtccaatgttgaatccgaggaggagaacgaaaagccagccaaggagcagcggcaaacccctgggaagggtctgatttcggggaaggagcgggctggcaaagctacccgagatgaacttccctacaccttcgccgcacctgaatcatatgaggaactgaggtctctcctactgggaaggtcaatggaggaacagctgttagtcgtagaaagaatacagaagtgtaaccatcccagcctagcggaggggaataaagccaagttggagaaacttttcgggtttctcctggagtacgtgggagacttagccacagatgacccacctgatctgacagtgattgacaaattggttgtccatctgtaccacctgtgccagatgttcccagaaagcgcatctgacgccatcaagttcgtgctccgtgacgccatgcacgagatggaggaaatgattgagaccaagggacgtgcagctctcccaggactggatgtgctcatttacctgaagattactggcctgctgttccccacttccgacttctggcacccagtggtcacgcccgcactagtctgtttatctcagctcctcaccaaatgccctattctgtccctgcaagacgttgtgaaagggctctttgtgtgctgcctgttcctggaatacgtggccctttcccagcgctttatcccagagttgattaattttctgctagggattttgtatatcgccacccctaacaaagccagtcagggttccacactcgtgcatcctttccgcgctctggggaagaattccgagctgttagtggtttcagcaagggaggacgtcgctacttggcagcagagttcactctccctacgctggtggagcaggattccagatctcaggtag

SEQ ID NO: 232909 - DNA, 2304 bp, Artificial Sequence
  Description of Artificial Sequence: Synthetic coding sequence
atgggtagacggtctcggggacgcagactgcagcagcagcagcggccagaggacgctgaggatggcgctgaaggcggagggaagagaggtgaggctggctgggagggtggctatcccgagatcgtgaaagagaataaactgtttgaacactattaccaggaactgaaaatcgtgcctgagggcgaatggggacagtttatggatgccttacgagagccgctccctgcgactctgcgaataaccggctacaaatcgcacgcgaaagaaatcttgcattgtcttaaaaataaatattttaaggaattggaggacttggaggtggacgggcagaaggtagaggtacctcaaccgctgagttggtatcccgaggagctggcttggcataccaatctgtctaggaagatattaagaaagtctccgcatcttgagaaattccaccagttcctcgtttctgagacagaatcaggcaacatctccagacaggaggccgtttccatgattccaccgcttctcctaaatgttcgtccgcatcacaagatcctggatatgtgtgccgctccagggagtaagaccacccagcttattgaaatgctgcacgctgatatgaatgtgcctttcccagagggcttcgtcatcgccaacgatgtggataacaaacgctgctatctgcttgttcaccaggccaagagactcagctctccatgtatcatggtcgtcaaccacgacgcaagcagcattcctcggctgcagattgacgtagatggaagaaaagaaatccttttttatgatagaatcctatgcgatgtaccctgtagcggagacggcacgatgcggaaaaacattgatgtgtggaaaaagtggaccacattaaactccctgcagctgcacggtttgcaactgcgcattgctacaagaggcgctgagcagctggccgagggcggacggatggtgtattccacatgcagcctgaatccaatagaagacgaggcagtcattgcatcactgctggagaaaagtgaaggtgcactggaactggccgacgtcagcaatgaactgcccggattgaagtggatgcccggtattacacagtggaaggtcatgaccaaagatgggcaatggtttaccgactgggacgccgtgccccattctagacacactcaaatcaggccaactatgtttccgcctaaggacccggagaaactgcaagccatgcatctggaacgctgtctccgcatcttgccccatcatcagaataccgggggttttttcgttgccgtgctcgtgaagaagtcttcgatgccctggaacaagaggcagccaaagctacaaggaaagtctgcagaaacacgtgagtccacccaacttagccctgccgatttaaccgagggcaagcctaccgatccttcaaaactcgaaagcccgtcgttcactgggaccggcgacacagaaattgcccatgccactgaggatttggaaaataacggttccaaaaaggatggcgtgtgcgggccacccccttcaaagaaaatgaagttgttcggcttcaaggaggaccccttcgtgtttatacccgaggatgatcccttgtttccgccaattgagaaattttacgccctggacccaagtttccccaggatgaacctcctgacacgaacaacggaggggaagaaacggcagctctacatggtgagcaaagaacttaggaacgtgctcttaaacaactctgagaagatgaaagtaattaatacagggataaaggtttggtgccggaataattctggagaagagtttgattgcgcctttaggctcgcccaagaaggaatctacacactatacccgttcattaattccagaattatcacggtctcaatggaggatgttaagattctgctgactcaggagaatcctttttttcgaaaactgtccagcgagacgtacagccaggccaaagatttagctaaaggttccatcgtcctgaaatacgaacctgattccgcaaaccccgatgcattgcagtgccccatcgttctctgcggctggcgcggaaaggcatcaattcgcaccttcgttcccaaaaacgaacgccttcattacctccgtatgatgggactggaggtcctcggcgagaaaaagaaagagggcgtgatcttgacaaacgaaagtgcggcttcaacaggacagccggacaacgacgtgaccgaaggacagcgagccggagaaccaaactctcctgatgcagaggaagcaaactctccagacgtgactgctggatgcgaccccgcaggggtgcaccccccacgttag

SEQ ID NO: 232910 - DNA, 1596 bp, Artificial Sequence
  Description of Artificial Sequence: Synthetic coding sequence
atggtcgtgaaccatgatgcttcctctatcccacgtctacaaatcgatgtcgacggacggaaagagatactattctatgatcgcattctgtgcgatgtgccctgttccggcgacggaacaatgagaaagaacatagacgtgtggaaaaagtggacaacacttaactcacttcaacttcatggactgcagctgaggatcgccactcggggagcagagcaattggccgaaggcggacgaatggtatattctacatgcagtctcaaccctattgaagatgaagctgtcatcgccagcttactggaaaaatcggaaggagcgctggaactggcggacgtgtccaacgagcttccagggctgaaatggatgccaggaatcacccagtggaaggtcatgacaaaagatgggcagtggttcaccgactgggatgccgtcccccactccaggcacacccagatcagacccaccatgttcccacccaaggaccccgagaagctccaggcaatgcacctggaacgttgcctgaggatcctaccgcaccaccagaatactggagggttttttgtcgccgttctggtgaagaagtcatcaatgccttggaacaaacgccaacctaagctgcagggtaaaagcgccgagacgcgcgagtctactcaattgtcaccagctgatctgactgaaggcaagccgacagatcctagcaaattggaatcccccagctttacaggcaccggagatacggaaatagctcatgctaccgaagatctggagaacaacgggtcaaaaaaggacggcgtgtgtggacctccgccttcaaaaaaaatgaagcttttcggattcaaagaggatccttttgtgtttatcccagaagacgatcctctattccccccaatcgagaaattttacgcccttgacccgagcttccctcgaatgaacctgctcaccaggactaccgagggaaaaaaacgtcaattatatatggttagcaaagagttgcgtaacgttctgctcaataattctgagaagatgaaggttataaataccggaatcaaggtctggtgccgaaacaattctggagaagaattcgattgtgcatttcgtctggcccaggaggggatttataccttatatccctttataaacagtcgtataattactgtgagcatggaagacgtgaagattcttttgacacaggagaatccgttcttcagaaagctgtcttctgaaacttatagccaggctaaggacttggctaaagggagcattgttctgaagtatgagcccgattccgccaaccccgatgccctgcagtgcccaatagttttatgcggctggcgcggaaaagccagcatccggacattcgtcccaaagaacgagagactacactaccttcggatgatgggtttagaggtcttgggagagaagaagaaggagggagtcatactgacaaatgagtctgccgcaagtacgggacagccagataatgatgtgactgagggacagagggctggagagccgaacagccccgatgcagaggaagcaaacagccccgatgtgaccgccggatgcgatcccgcaggcgttcacccccctcgctag

SEQ ID NO: 232911 - DNA, 2199 bp, Artificial Sequence
  Description of Artificial Sequence: Synthetic coding sequence
atgggacgaaggagcagagggagacgcttacagcaacaacagaggcctgaggatgctgaagatggggctgagggcggaggcaagcgtggtgaggccggttgggaaggaggatacccagagatcgtcaaggagaacaagctgttcgaacactactatcaggagttgaagattgtaccagagggagaatggggacaattcatggacgcactgagagaaccattaccggctaccctgcgtatcaccggctataagcgataccccgaggaactcgcatggcacacaaacctttctcgtaagattctgcgaaagagcccacacctcgagaagttccaccagtttctggtcagtgaaactgagagcggaaacatcagtcggcaggaggccgtctctatgattcccccactgctgctgaatgtgagacctcaccacaagatcctggacatgtgcgccgctcccggaagcaagactacacagctaatagaaatgctgcacgctgacatgaatgtgccctttccagagggttttgtgattgccaatgacgtagataacaagcgctgctaccttctcgtgcatcaagcaaaacgactcagctctccttgtataatggtagtgaatcatgacgcaagctccattcccaggctgcaaattgacgtggacggccgaaaagaaatccttttttatgatcgcattttgtgtgacgtaccctgcagtggcgatggtactatgaggaaaaacatagatgtttggaagaaatggaccacactgaattctttacagctgcatggtctgcagcttcgcattgcgactaggggcgctgagcagcttgcggagggtggtaggatggtctactccacatgttcgcttaatccaattgaggatgaagctgtgattgcttcattgctggaaaagtctgagggggctctcgaactagcggatgtttctaacgaacttcccggacttaaatggatgcccggaattacccaatggaaagtgatgactaaagatggacagtggtttaccgactgggacgcagtgcctcattctagacatacacagatacgccctactatgttcccccctaaggatcccgagaagctccaagcaatgcatttagaacgctgtctgcggatattgcctcatcatcaaaacactggagggttttttgtcgccgtgctcgtcaagaagtcctccatgccctggaataaacgacagcctaagctccagggaaagtccgccgaaacccgggaaagtacacagctgagccccgcagatctgactgagggcaaaccgaccgatccaagcaagctggaaagtccatcctttaccggcacaggtgacaccgagattgctcacgccaccgaagatctcgagaataatggttctaaaaaagacggcgtgtgcgggccaccaccctccaagaaaatgaagctgttcgggttcaaggaggatcctttcgtgtttatacctgaggacgaccccctcttccctcctatcgaaaagttctatgctttggacccaagcttcccccgtatgaacctgttaacacgaactaccgaggggaagaaacgccaattgtatatggtctccaaggagctgcgcaacgttctgctgaataactctgagaaaatgaaggtgattaatacagggataaaggtgtggtgccgtaataactccggggaagaattcgactgcgcattccgcctagcccaggaaggcatttacacactctacccatttatcaactcccggatcattacagtctctatggaggatgttaaaattctgctgacacaggaaaatcccttttttcgaaaactctcctctgagacctatagtcaggcaaaggacttggccaagggtagcattgtactcaaatacgagcctgatagtgccaatccagacgccctccagtgccctattgtcctgtgcgggtggcgtggcaaagcaagcattcgtacgttcgttcctaagaatgaacggctgcactacctgcggatgatgggtctggaagtcctgggtgagaaaaagaaggagggtgtcatcctaacaaacgaatccgccgctagcaccggtcagcccgacaacgacgtcactgaagggcagcgcgctggggaacctaactcacccgatgccgaggaagcgaactcacctgatgttactgcgggatgtgatcccgctggggttcatccaccccgatag

SEQ ID NO: 232912 - DNA, 1785 bp, Artificial Sequence
  Description of Artificial Sequence: Synthetic coding sequence
atggtcttactgcacgtactctttgagcatgcagtcggctatgccttgctggccctcaaggaggtcgaagagatcagcctgctgcaaccgcaagtggaggagtccgtcctaaatctgggaaaatttcactctatcgtgaggctggtggcattctgccccttcgcgtcaagccaggttgccctggaaaacgccaacgccgtctcggagggcgtggtgcacgaagacctgcgcttgttgctggagacacatcttccgagcaagaagaaaaaggtgcttttgggcgtcggtgacccgaagattggagccgcaattcaggaggagctggggtacaattgccagacgggaggcgtgattgccgagatcctaaggggggtgcgactccactttcacaacttggttaaagggctgactgatttatctgcctgtaaggctcagcttggcctgggccacagttactctagggctaaggtgaaatttaacgttaatagagttgacaatatgatcatacagagcataagtctgctcgaccagcttgataaagacattaacacgttctcgatgcgggtaagggagtggtacggctatcatttccctgaactcgtcaaaattatcaacgataacgccacatactgccgcttggcccagtttattggtaaccgcagggaattaaacgaggacaagctagagaaattggaggaactgactatggacggcgctaaggctaaagctatcttggacgcttcgagatccagcatgggaatggatatctccgctatagatctgatcaatattgagtcattctcgagccgtgtggtctcattgtccgagtaccggcagagtctacacacttacctccgcagtaaaatgtcacaggtcgcccctagcctatcagctctgattggggaagccgtgggcgcacgactcatcgctcatgctggatccctgacaaacctcgcaaaataccccgcaagcaccgtccagattctaggcgctgagaaggccctctttcgagccctaaaaaccagaggaaatacgcctaagtatggcctgatattccactccacattcattggcagggcagcggctaagaataagggtcgtatatcccgttatttagcgaacaaatgctccattgcttctcgaatcgattgtttctctgaggtgccaacttccgtctttggcgaaaaactgagagagcaggtggaagagaggctaagcttttatgaaaccggcgaaatcccaagaaagaacctggacgtcatgaaagaagctatggtgcaggccgaggaggccgctgctgagatcacaagaaagttggagaagcaggaaaaaaagcggctgaagaaagagaagaaaagactagccgctctagctctggctagctccgagaactccagcagcacgcctgaagaatgtgaagaaatgtctgaaaagccaaagaagaagaagaagcaaaagccccaggaggtaccccaggagaatggaatggaagacccatccatatccttttcaaagcccaaaaaaaagaagtctttcagtaaggaagagttgatgagctcagacctggaggagaccgcaggcagcacatcaatccctaagaggaagaaatctacacccaaggaggaaaccgtgaatgatcctgaggaggctggacatcgttccggttctaaaaaaaagaggaaattctccaaagaggaaccagtgtcttccggacccgaggaagctgtggggaaatcttcttccaagaagaagaaaaagttccataaggcatctcaggaggactag

SEQ ID NO: 232913 - DNA, 678 bp, Artificial Sequence
  Description of Artificial Sequence: Synthetic coding sequence
atggatatcagtgccatcgatctcattaatattgaaagcttcagttctcgggtggtatcccttagtgagtatagacaatcgctacatacctatcttcggagcaaaatgtctcaggtggctcccagcctatcagccctgatcggtgaagctgtgggcgcaagactgatcgctcatgccggtagcctgacgaatctagcaaaatatccggctagcactgtgcaaatactcggggcagaaaaagcactgttcagagccttaaagaccaggggtaacactcctaaatacggcctaattttccattccacctttattgggagggcagcagctaaaaacaagggtagaatctctaggtacctcgctaataaatgctcaatcgcctctcgtatagactgcttctcagaggtgcctaccagcgtgtttggcgagaagctgagagagcaggtggaggaaagactatcattttatgagaccggcgagattcctagaaagaacctggacgtgatgaaagaggcaatggtccaggcagaggaggccgctgctgaaataacgaggaagctcgagaagcaagagaaaaagcgtctcaagaaagaaaagaaacgactcgctgccctcgctctcgccagttcggagaatagttcatccacccccgaggagtgcgaggaaggagacagatgctag

SEQ ID NO: 232914 - DNA, 660 bp, Artificial Sequence
  Description of Artificial Sequence: Synthetic coding sequence
tagctcattaacatcgaaagcttcagcagccgggttgtttctttgagcgaatatcgccaaagcttgcatacttatctgcgatctaaaatgtctcaggtcgcacctagcttgagcgccctcatcggagaggccgtgggtgccagacttatcgctcatgcgggaagcctgactaatttagccaaataccctgcatcaaccgtccagatcctgggtgcagaaaaagcactgtttcgtgcgctgaaaacacgagggaatacccccaaatatggactcatttttcacagcacattcattggcagggcagccgctaagaataaaggacggatcagtcgctatctggctaacaagtgttccattgctagtcggattgattgctttagcgaggtcccaactagtgtcttcggggaaaaattacgtgagcaggtcgaggagaggcttagtttctatgaaacaggcgagattccacgtaagaacctggacgtgatgaaagaggcaatggtgcaggctgaagaagccgcagcagaaatcacccggaagctggaaaagcaggagaagaaacggctaaaaaaggagaaaaaacgtctcgcagccctcgctctggcatctagcgagaattcatccagtacgcctgaggaatgtgaagagggggacagatgttag

SEQ ID NO: 232915 - DNA, 846 bp, Artificial Sequence
  Description of Artificial Sequence: Synthetic coding sequence
atggtgctcctacacgtgttgttcgagcacgcagtgggctacgcacttttggctctgaaggaggtcgaagaaatcagcctcctgcagccccaagtcgaggaatcagtcttaaacctcgggaaatttcactctattgtaagacttgtggcgttctgtcccttcgcctcttcccaggtggcactggagaacgccaatgcggtctccgagggggtggtgcatgaggacctgaggttgctcttagagacccacttaccgagcaaaaaaaaaaaagtgctgctgggcgtgggcgatcctaaaattggcgcagccatccaggaagagctggggtataactgtcagaccggtggcgtcatcgctgaaattctgcgcggtgttcgcttgcatttccacaacctggtcaaaggactgactgacctctccgcatgtaaggcccagttaggcctgggccacagttattcacgggctaaggtgaagttcaatgttaaccgcgtcgataacatgatcatacagtccattagcttgttggaccagctagataaggacattaacactttttcaatgagagtacgtcagagtcgctgcggggaaggcaaggctgtcgccctctggttcctgatgaagcagctgggccaaggtgttaccgtcgccctttgtcgagaatggtatggctaccactttcctgagcttgtcaagataatcaacgataacgcgacttactgtagactcgcccagttcataggaaatcgacgcgaattaaacgaggataagctcgagaagctggaggaacttaccatggacggtgcgaaagcaaaggccatcttggacgccagcaggtcaagcatgtag

SEQ ID NO: 232916 - DNA, 402 bp, Artificial Sequence
  Description of Artificial Sequence: Synthetic coding sequence
atgcggaagcacgtgttggccgcatctttttcaatgttgagcttgctggtgatcatgggggatacagacagtaaaactgatagttcctttataatggatagtgaccctagacggtgtatgcggcaccactatgtcgattccatatctcatcctctgtacaagtgctcaagcaagatggtccttttagcacggtgtgaggggcattgtagccaggcaagcaggtccgagccacttgtgagcttttcgacagtgctcaagcagccattcagatcaagctgccactgttgtcgccctcagactagcaaactaaaagctctcagactaagatgttctgggggtatgcggctgacggctacttaccgctacatactctcttgtcactgcgaggagtgcaatagctag

SEQ ID NO: 232917 - DNA, 7416 bp, Artificial Sequence
  Description of Artificial Sequence: Synthetic coding sequence
atgcccgctctgaggcccgcacttctgtgggccctgttggcactctggctttgctgtgctgccccagcgcacgccctgcagtgtcgagacggatatgaaccctgtgttaatgagggcatgtgcgtgacataccataacggcacagggtactgcaaatgcccggaaggattcctgggcgaatactgccaacatagggatccgtgcgaaaagaacaggtgccagaatggtgggacgtgtgtcgcacaagccatgttggggaaggccacatgccgctgcgcttccggttttaccggagaggactgccagtattctacttcccatccctgctttgtatctagaccctgtctgaacggtggtacttgtcacatgctctctagagacacgtatgaatgcacttgccaggtcggctttacaggaaaggaatgccaatggactgatgcatgtctgagtcacccctgcgcgaatggcagtacttgcacaactgtagcaaatcagtttagttgcaaatgtctcaccggttttacagggcagaaatgtgaaaccgacgtcaatgagtgcgatatcccaggtcattgccagcacggcggaacatgcttaaacctgccagggtcttaccagtgccaatgcccacagggtttcaccggacaatattgtgactcattgtatgttccttgtgcaccaagtccctgcgttaacgggggtacctgccggcaaaccggtgactttacctttgaatgtaactgcctgcccggatttgagggctctacatgtgagcggaatattgacgattgccccaatcaccgctgccaaaatggcggtgtgtgcgtagacggcgtcaacacttacaattgtcgatgtccccctcagtggaccggacagttttgcacggaggacgtcgacgagtgtttgttacaacctaacgcttgccagaatgggggaacttgcgctaataggaacggagggtacggctgtgtttgcgtcaatggttggtctggagacgactgttctgaaaatatcgatgattgcgcatttgccagctgcacacccggaagcacttgtatagatcgcgtagcttctttctcgtgtatgtgtccagagggcaaggcgggattactctgccatctcgacgatgcttgtatctccaacccgtgccacaaaggggctctttgtgataccaatcctttgaatgggcagtacatctgtacctgtccacagggctataaaggagccgactgcactgaagacgtggatgagtgtgcaatggccaactccaatccctgtgagcacgccggaaaatgcgtcaatacagatggagcattccactgcgagtgcctgaaaggttatgccggtccccgttgtgaaatggacataaacgaatgccactcagatccctgtcaaaacgatgcaacttgtctagataagatcggcggattcacttgcctctgcatgcctgggtttaaaggtgtccactgcgagcttgagataaatgaatgccagtctaacccttgcgttaataacgggcaatgcgtggacaaagttaatagattccagtgcctgtgtccgcctggcttcactggacctgtatgtcagatcgacattgatgactgttcatctacaccgtgcttaaatggagccaagtgtatagaccatcccaacggctacgagtgtcagtgcgcgacagggtttacaggggtgctctgcgaggagaacattgacaattgtgatcccgacccatgtcaccacgggcagtgtcaggacggtattgactcatacacatgcatctgtaaccctgggtacatgggtgcgatctgtagtgatcagatagacgagtgctacagcagcccctgtctaaacgacggcagatgcattgatctagtaaacggctatcaatgcaactgtcagcctggaacctcaggtgtcaattgcgaaatcaactttgacgattgtgcttcgaacccttgcatccatggcatttgtatggacggcataaatcgctactcatgcgtatgctctccagggtttacgggccaacgctgcaacattgacatagacgagtgtgcaagcaacccctgtcggaaaggtgcgacctgcattaatggcgtcaatggctttagatgtatatgccccgagggcccacaccatcccagttgctatagtcaggtgaatgaatgcctctctaacccatgtattcacggcaactgtactgggggtctgagcggctacaaatgtttatgcgacgctggatgggttgggatcaactgcgaagttgacaagaacgaatgcctgtccaacccctgtcagaacgggggtacttgcgacaatctcgttaatggatatcgctgcacctgcaagaaagggttcaaggggtacaactgtcaagtcaacatagatgagtgcgcatctaatccatgtctcaaccaggggacttgcttcgacgacatctccggctacacttgtcattgcgtcctgccttacacaggaaaaaattgccaaacggtcctggccccatgctctcctaacccatgtgaaaatgccgcagtctgcaaggaatctcctaactttgaaagttatacatgcttatgcgcacctggctggcagggacagcggtgtaccattgacatcgacgaatgtattagtaaaccatgcatgaatcatggcctgtgccacaatactcagggaagctacatgtgtgaatgcccccctggtttttctggcatggactgtgaagaggacatcgatgactgcctcgctaatccctgccagaatgggggatcctgcatggacggcgttaatactttctcttgtctgtgcctgcccggattcaccggcgacaaatgccagaccgatatgaatgagtgcctgagcgagccttgcaagaacggcggaacctgtagtgattacgtaaactcatacacctgcaaatgccaggctgggtttgacggcgtgcactgtgagaacaacattaatgagtgtactgaatcatcatgcttcaacggtggaacatgtgtggatggcattaactccttcagctgcctgtgtcctgtgggattcacaggatcattctgcctgcatgaaattaacgagtgctctagccacccctgtctgaatgagggcacctgtgtcgacgggctggggacttaccggtgttcttgtccattaggatatactgggaaaaattgccagacgctggttaacctctgtagcagatccccctgtaagaataaaggaacttgcgtccaaaagaaggccgagtcccagtgcctgtgcccgagcgggtgggcaggggcatattgcgatgtgccgaatgtgagctgcgacatagctgcctccaggaggggcgtcctggtcgagcacctgtgtcaacactcgggcgtttgtatcaacgctggaaatacccactattgccagtgtcctttgggatatacaggcagctattgcgaggaacagctcgacgagtgtgcttccaatccttgtcagcacggtgctacctgctcggatttcattgggggataccggtgcgagtgcgtgcccggttatcagggtgtcaactgcgagtacgaggtcgacgaatgccagaaccagccttgtcaaaatggcggtacctgcattgacctggtgaatcactttaagtgttcctgccccccaggtactagggggctcctatgcgaagaaaacatcgacgactgcgccaggggcccacactgtctgaatggaggccagtgcatggaccgcatcggcggatattcctgccggtgcctccctggcttcgccggagaacgttgcgaaggagatataaacgagtgcctgagcaacccctgctcatccgaaggcagcctcgattgtatccagttgactaatgactacctttgcgtgtgcagatccgcatttacagggagacattgcgaaacattcgtggatgtgtgccctcagatgccttgcctgaacggagggacttgcgctgtggcatccaatatgcctgatggtttcatctgcagatgccctccaggatttagcggcgcacgctgtcaaagctcatgtggccaggtgaagtgcaggaagggggaacaatgcgtgcataccgctagcggcccacgatgtttttgcccttcaccaagggattgtgagtcaggttgcgcctccagcccatgtcagcatggcggttcctgccatcctcaacggcagccgccttactattcttgtcagtgtgcccctccgttttcaggatccaggtgtgagctctatacagcgccaccaagtactcctccggctacatgcctgagccaatattgcgcagacaaggccagagacggagtctgtgatgaggcctgcaattcgcatgcatgccagtgggatggtggagattgtagtcttaccatggagaacccttgggcaaactgtagcagcccgctgccgtgctgggactatatcaacaatcagtgcgacgagctgtgtaacaccgtcgaatgcctgtttgacaattttgagtgtcaggggaatagcaagacctgcaaatatgacaaatactgtgccgaccatttcaaagacaaccattgtgaccagggttgtaatagcgaggaatgtggttgggatgggctggattgtgccgctgaccaaccagaaaacctggccgagggcactctggttattgttgttctgatgccgcctgaacagctcctgcaggacgctcggtcatttctgagggctctcggaacgttgcttcacaccaacttacgcatcaagagagactctcagggggaactgatggtgtatccatactacggagaaaagagtgctgccatgaagaagcagcgaatgaccaggaggtctctccctggagagcaggaacaggaggtagctggaagcaaagtatttctcgaaatcgacaacaggcaatgtgtccaggacagcgatcactgttttaagaatactgacgcagcagctgcacttctcgcgtctcatgctattcaagggacactgtcttaccctcttgtctcggtagtctcagaatccctaacacctgaaagaacccagctcctttacctgctcgcagtggcagttgtgattattctgttcattatcctgttgggggtcatcatggcaaaacgcaagcggaagcacggaagcttgtggctgcccgagggattcactctccgccgtgacgcctctaaccacaagcgcagggaacccgtcgggcaagacgccgtgggcctgaaaaacctgtccgtccaggtgtccgaggcaaaccttattgggactggcacttctgaacactgggtagatgacgaggggcctcagcccaaaaaagtgaaggctgaagacgaggccctgttgtctgaagaggatgaccccatcgaccgacgtccatggactcagcaacacctggaagcagccgacattaggcgaacgccctctttagctttgacccctccccaagccgaacaggaagtggacgtgctggatgtcaacgtgaggggccctgacggatgcacaccattgatgctggccagtctccgaggcggatccagtgatctgtccgacgaggatgaagacgccgaagactccagtgcaaatataataacagatctggtctaccagggtgccagcctgcaggcacaaaccgaccgcacaggagagatggccctgcaccttgccgctagatattcccgggcagacgccgctaaacggttgctcgacgctggggcagatgccaacgcacaagacaatatgggaagatgtccactacacgccgctgtggctgctgacgcccagggcgttttccagatcctcatccgtaatagagtgacggacctggacgcaagaatgaatgatggtaccacaccacttatcctcgccgctcggttagccgttgaaggaatggtcgcagagctgatcaactgccaggccgatgtcaacgccgtcgacgatcatggcaagtctgctctgcattgggccgctgccgtcaacaacgtggaagccaccttattgctgctcaagaatggggcaaatagggacatgcaagataataaggaagaaacacctctcttcctcgctgctcgtgagggatcctatgaagccgctaagatattgctggaccacttcgcgaaccgggatattacagaccacatggacaggctgcccagggatgtagccagagacaggatgcatcacgacatcgtgcgactgttggacgaatacaacgtcaccccgtctccccctggcaccgtgctgacgagcgccctgtctcctgtgatatgtggcccaaaccgtagcttcctgtcactcaaacacacccctatgggaaaaaagtctcggcgaccctcagcaaaatctactatgcccacctccttaccaaatctcgctaaggaagccaaagatgcaaaggggtctcgtagaaagaaatccctttccgaaaaggtccaactgtctgagtcctcggttaccttatcccccgttgatagcttagaaagcccccacacatacgtgagcgatactaccagctcacccatgatcactagcccaggaatattgcaggcttcacctaaccctatgttggctactgccgctcctccagccccagttcacgcgcagcatgcgctgagcttcagcaatcttcacgaaatgcaaccactcgctcatggggcaagcaccgtgctgcctagtgtgtcccaactgctgtcacaccaccatatcgtgtctcctgggtccggatctgctggtagtctgtcccgcctccacccagtgcccgtgccagccgattggatgaataggatggaagtcaacgaaactcagtacaacgaaatgttcggcatggtgctcgcccctgccgagggtacccacccaggcatcgcaccgcagtctaggcctcccgagggtaagcatattactacacctcgagagcctcttccacccattgtgaccttccaattgatccctaaaggttccattgcgcaacccgcaggcgctccccagccccaatctacgtgcccccctgccgttgcaggacctttacccaccatgtatcagattcctgaaatggccaggctcccttccgtagcctttcctactgctatgatgccccaacaggacggtcaggtcgcacaaaccattctacccgcataccaccccttcccagcctcagtggggaaatacccaactccaccatcccaacacagctacgcctcctccaatgcggctgagcggactcctagccacagtggacatctccagggtgagcacccttacttaactccttcccccgagtcaccagatcagtggagttccagctctccccattccgcatcggactggtctgacgtgacaaccagccctacccccggtggagccggaggtggccagcgaggtccgggaactcacatgagcgaaccccctcataataatatgcaggtttatgcatac

SEQ ID NO: 232918 - DNA, 711 bp, Artificial Sequence
  Description of Artificial Sequence: Synthetic coding sequence
atgtgcgtcacttaccataatggaacaggctactgcaaatgtcctgaaggcttcttaggggagtactgccagcatcgcgatccgtgcgaaaagaatcggtgtcagaacggagggacttgcgtggcgcaggccatgcttggcaaagcgacttgtcggtgtgcaagcggcttcaccggagaggactgtcagtattccacttcacatccatgtttcgtgtctcgtccatgtctcaacgggggaacctgccatatgctctcaagggatacttacgagtgtacgtgccaagtgggattcacagggaaagagtgccaatggacagatgcctgcttgtcgcatccttgtgccaacggaagcacatgcactaccgttgctaatcagtttagctgtaaatgcctcacaggcttcacaggccagaagtgtgaaacagatgtgaatgagtgtgatattccaggacactgtcagcacggtggcacgtgtctgaatctcccaggcagctaccaatgccagtgtcctcagggcttcacagggcaatactgtgattcgttgtatgttccttgcgctccaagcccttgcgtcaatggagggacctgtaggcagactggagatttcactttcgagtgtaattgcctgcccgagaccgtgaggcgcggaacagaattatgggagagagatcgtcaagtgtggaacggcaaggagcacgatgaaaattag

SEQ ID NO: 232919 - DNA, 720 bp, Artificial Sequence
  Description of Artificial Sequence: Synthetic coding sequence
tgcagggatggttatgagccatgtgtgaatgaggggatgtgcgtaacttaccataacgggactggctattgcaaatgtcccgaaggctttctgggagagtactgccaacacagagacccatgtgagaaaaaccgctgtcagaatggcggaacatgcgtcgcgcaggctatgctggggaaggccacctgtcgttgcgcttccggatttaccggagaggattgtcaatacagcacttcacacccttgcttcgtatctcgcccttgcctgaacggcggtacatgccacatgctttctcgagatacctacgagtgcacatgccaagtcggcttcactgggaaggaatgtcagtggaccgacgcttgtctgtcgcacccctgtgcaaacggctcaacctgtaccacagtggcaaatcaatttagctgtaagtgtcttaccggattcacaggacaaaaatgtgagacagatgtgaatgagtgtgacatccctgggcactgtcagcatggagggacttgtctgaatctgcctggctcttatcaatgccaatgcccacagggcttcaccggccagtactgcgactctttgtatgttccgtgtgcaccctccccttgtgtaaacggaggcacctgccgccaaaccggcgacttcacgtttgaatgcaattgtctccccgcttgttggcctcggactccagacctgagactcctactgggggaaaagtag

SEQ ID NO: 232920 - DNA, 672 bp, Artificial Sequence
  Description of Artificial Sequence: Synthetic coding sequence
atgtggatttgtccgggaggcggaggtggtgggggtggcggaggcgatcgggaggacgcaagaccacctctgtgctgtggacgttgctggcggagcggatgcgcagcaaggccgccaaggatggtgtcaattggactgaggggcgctgtccgcggagcccgaggatgccatctcgggcgaccttttagtcccagtgtgttactgtgcgtgggcaggcctggctctgctgcgggagccgagcggggacattccctgggctcgcaggaattcgggcatcgccgaggcccattgccctggtgcccagcaaaccgcaggggaagtccaccctctgcaccaagaggcccagggcctctgacacgcctgctgggtagacgggaagccggatctaagagccagaagctgttgtttcgaagcgctagagtccaggggggaggacagttttgtcctagcggaagcgcctttcttggcgtagaaagagagccgactgcgggattgggcggagctgaaaggcgaaatgctagattttggcgcggagaaaggggtcagggcagacaggccaagagacccgcaccctcccagcctgccagccccttacctgggggaggaacttgggccggatgtgtgggtctcgtctggatgggcaccggcttctgcggggctccagagttttag

SEQ ID NO: 232921 - DNA, 2592 bp, Artificial Sequence
  Description of Artificial Sequence: Synthetic coding sequence
atgtgcgtcacttaccataatggcacaggttactgcaaatgtccagagggatttctaggggaatattgccagcacagggacccttgtgaaaaaaataggtgtcaaaatggcggtacttgtgttgcccaggccatgctggggaaagccacctgccgatgcgctagcggcttcaccggtgaagattgccagtactccacgtctcatccctgctttgtgtctagaccatgcctgaacggcggtacatgccacatgctgtctagggacacttatgagtgtacctgccaagtggggtttactgggaaggaatgccagtggacagacgcttgtcttagccatccttgcgcaaatgggagcacatgtacgacagtggcaaaccagtttagctgcaaatgcttgaccggcttcaccgggcaaaagtgcgagactgatgtgaacgagtgtgacattcccggacattgccagcacggaggcacctgtcttaatctcccgggatcgtaccagtgtcagtgtccacaaggctttacgggacagtactgtgactccctctacgtgccatgtgcccctagcccatgcgtcaatggcggtacatgccgccagaccggagatttcacattcgaatgtaattgtctacccggatttgaggggagtacgtgcgagcggaatatagacgactgtccgaatcacagatgccagaacgggggtgtttgtgtcgatggtgtcaacacttacaactgccggtgtcctcctcagtggaccggtcagttttgcacggaagacgtggacgagtgcctcctccagcccaacgcctgccagaatggcggaacttgcgccaacaggaacgggggttatgggtgcgtgtgcgtgaacgggtggtcgggcgacgattgctcagaaaatattgatgattgcgcttttgcatcatgtacaccaggcagcacttgcatcgacagagtagcgtcgttctcttgtatgtgtccagagggaaaagctgggctgctgtgtcacctggacgatgcatgcatcagtaatccctgtcataagggagccctctgtgacacaaatccactgaacggccagtatatctgtacatgccctcaggggtataagggcgcagattgcaccgaggacgtggacgagtgcgccatggctaacagtaatccatgtgaacacgctggcaagtgcgtgaataccgatggggcatttcactgcgagtgcctgaagggatacgccggtcccagatgcgagatggacattaatgaatgccattcagatccctgtcaaaacgacgctacctgtctggataagattgggggattcacgtgcctgtgtatgcccggtttcaaaggagtacattgcgaactggaaattaacgaatgtcagtctaatccttgcgttaataatggccaatgtgtggacaaagttaaccgattccaatgcctctgtcctccaggatttactgggccagtttgtcagatcgatatcgatgactgcagtagcacaccatgcctgaacggcgctaagtgcattgatcatccgaacggttatgagtgtcagtgcgctactggcttcaccggcgtgttgtgtgaggaaaacatagacaattgcgacccggatccttgtcaccacggccagtgtcaggacggcatcgactcctatacttgtatttgtaatcctggttacatgggcgctatctgctcagatcaaattgacgaatgctattcatccccttgtctgaacgatggtcggtgtattgatctggtgaacggatatcagtgcaattgccagcccggtacctcaggtgttaattgtgaaattaattttgatgattgcgcaagtaatccatgcatccatggtatttgtatggacggaatcaaccggtacagctgcgtgtgttcccccggtttcaccgggcagagatgcaatattgatatcgatgagtgcgcctccaacccatgtagaaagggggcaacatgtatcaacggagttaacgggttccggtgtatttgccccgaggggcctcatcaccccagctgttattcacaggtgaatgagtgcttgagcaatccatgtatccacggtaactgcaccggtggactctcgggatacaaatgtctgtgtgacgccggttgggttgggatcaactgcgaggtggacaaaaacgagtgtctatctaatccctgccagaatggcggtacctgcgataatttggtaaacgggtatcgctgcacctgcaagaaggggttcaaagggtataactgtcaggtgaacattgacgagtgtgcctctaacccctgtctgaaccagggcacgtgtttcgacgacatttccggttatacttgtcactgtgtcttgccatatactggcggttcttggcgatatcagcaaggacctgaaggcatcctggaccttgctctgagcgtcccagaaagtcagtgtcctgggctgtgggggtgtaatgcccctccacgggctcattcgagtgtagtgttgccagcattcaccgattggattctttcattcgaagagactttgtggcctcccaaaatgcaggtcgtcgatagtcatctgcccaccctgtacttcagcatatag

SEQ ID NO: 232922 - DNA, 6966 bp, Artificial Sequence
  Description of Artificial Sequence: Synthetic coding sequence
atgggcccaggcgcacgcggtagacgacgcagacggagacccatgagccctccacctccgccaccccctgtgagggccttgcccctccttctgctgctggctggcccaggcgctgccgcacctccatgcctggacggctctccctgtgccaacggcggtagatgcacccagctgccctcacgcgaggccgcatgcctctgcccacctggctgggtcggggaacggtgtcagctggaggacccatgtcacagcgggccatgtgccggaaggggtgtgtgtcagagctccgtggtcgctggtacagcaaggttctcctgtcgctgcccaaggggcttcaggggccctgactgtagcctgcctgacccatgtctgtcatccccatgcgcccatggcgcacgttgtagcgttggtccagatgggaggttcctgtgctcctgcccccctgggtatcagggaaggtcatgtcgatccgacgtggacgaatgccgggtgggcgagccctgcaggcacggaggcacctgtctgaacaccccaggatccttcaggtgccagtgcccagcaggctacaccggcccactatgtgagaacccagctgtcccctgcgctccttccccttgtcgcaatggagggacctgtcggcagtctggggacttgacatacgattgcgcctgccttcctggatttgagggtcaaaattgtgaggtgaacgtagatgactgccctgggcaccgatgtctgaacgggggaacatgtgtggacggcgtgaacacatacaattgccaatgcccccctgagtggacagggcagttctgcacggaggacgtggacgaatgtcagctccagcccaacgcatgtcataatggcggtacctgtttcaataccctgggcggacactcctgtgtatgcgtgaacgggtggacaggagagtcctgtagtcagaatatcgatgactgtgcaactgcagtgtgctttcatggagctacctgtcatgatcgagtcgcatctttctactgcgcttgtcctatgggcaagacagggttgctgtgtcatctggacgatgcttgtgttagcaatccatgtcacgaggatgcgatttgtgacaccaatcccgtgaacggccgtgcaatctgtacttgcccacccggttttacgggcggagcatgtgaccaggatgtagatgaatgcagcatcggcgctaatccctgcgagcatctcggccgatgcgtgaatacccagggaagcttcctttgtcaatgtgggcgaggctacaccgggcctcgctgtgagacagacgtgaacgaatgtctctccggcccttgtcgaaaccaggccacttgtctggataggatcggtcagtttacatgtatctgcatggctgggtttactggcacctactgtgaggtggacattgatgagtgccagtccagtccttgcgtgaatggcggtgtgtgcaaggacagggttaacgggtttagctgtacctgtcccagcgggttttctggttccacctgccagctagatgtggatgagtgtgcctcaacaccctgtagaaatggcgcaaaatgcgtcgatcagcctgatggctacgagtgccgttgtgcagaaggctttgagggtacactctgtgaccgcaatgtcgacgactgttccccggatccctgccaccatggacggtgcgtagacggaattgccagtttcagctgtgcctgtgccccaggttatactgggaccagatgcgagtcacaggtggacgagtgtcggagccagccatgccgtcacggtggtaaatgtctggacttggttgataagtacttgtgccgctgtccatccgggaccaccggggtgaactgtgaggtgaacatcgacgactgtgccagcaatccatgcacctttggagtgtgcagagatggaatcaaccgctatgattgcgtctgtcagcctgggtttactggtcctctatgtaatgtagagatcaatgagtgcgcatcctcgccttgcggcgagggaggatcatgtgttgatggcgagaatgggtttagatgtctgtgcccccctggctccctgcctcctctttgccttcccccatctcatccctgtgcccatgagccttgcagccacggcatttgctacgacgccccagggggatttaggtgcgtatgcgagccagggtggagcggccctcgctgctcccagtcactggctcgtgacgcttgcgaatcacagccatgccgagctggagggacttgctccagcgacggaatgggattccattgcacatgcccaccgggagtccaaggtcgacagtgtgagctcctgtcaccttgtactccaaacccgtgtgaacatggcggacgatgcgagtccgcgcctggacagctaccagtgtgtagctgtccccaggggtggcagggcccaaggtgtcagcaagacgtggatgagtgtgccggacccgctccttgtgggccacatggaatatgtaccaacctggctggcagctttagctgcacttgtcatggcggatacacaggaccgtcttgtgaccaggacatcaatgattgcgatcccaacccttgtctgaatggaggcagctgccaggacggtgtgggatcttttagctgcagctgccttccgggatttgccggtccgcgttgtgccagggatgttgacgaatgcttatctaacccttgcggacccggaacctgtacagatcacgtcgctagtttcacctgtacttgcccgcctggatatggcggattccattgtgagcaggacctgcctgattgcagtccctcctcctgtttcaatggaggaacctgtgtggatggggtgaatagcttctcttgtctgtgcaggcccggttatacaggcgctcattgccagcatgaggccgacccttgcttatcacggccatgtcttcatgggggtgtgtgcagcgccgctcaccccggatttcggtgcacatgtctggagtcattcaccggccctcagtgccagaccctcgtggattggtgctcaaggcaaccgtgccagaatggtggtaggtgcgtgcaaaccggggcttactgtctgtgccctcccggttggtctgggaggttatgcgatattcgctctctgccttgtagagaagccgctgcacaaataggggtccggctcgagcaattgtgccaggccggaggccagtgtgtcgatgaggatagctcccattactgcgtgtgcccagagggacgtactggttcccactgtgaacaggaggtggatccctgtctggcccagccctgtcagcatggcggaacttgccgcggttatatgggtgggtatatgtgcgagtgcctgcccggatacaacggggacaactgtgaggatgatgttgacgaatgcgcttctcaaccctgtcagcatggtgggtcttgcatcgaccttgtggcacgctatctctgttcatgtcctcctggaaccttgggcgtcctgtgtgagattaatgaagatgattgcggacctgggccaccgctggatagtggccctaggtgtttgcataatggaacctgcgtggacctcgtcggtggctttcgctgtacctgcccacccggatacacagggctacgctgcgaagcagatataaatgagtgcaggagcggcgcatgtcacgcggcacatacccgcgattgcttgcaggatcccggtgggggattccggtgtctctgccatgccggatttagtggaccgcgttgccagaccgttctctccccttgcgagagtcagccctgtcaacatggcggtcagtgtagacctagccctggcccaggcggaggcctgacattcacttgccactgtgcgcagccattttgggggcctcggtgcgagagagtggccagatcttgtcgggaacttcaatgccccgtcggagtgccttgtcaacaaaccccaagaggccctaggtgcgcttgtccccctggcttatccggacccagctgtcgcagcttccctggaagcccgcctggggcatccaacgccagttgcgccgcagccccttgcttgcacggaggttcatgccgcccagcacctctggcacccttcttcagatgtgcctgcgcccagggatggactggacctagatgcgaggcccctgctgccgcaccagaagtcagcgaagagccgagatgtcccagggccgcttgccaggcgaaacggggtgaccagaggtgtgaccgagagtgcaatagccccggatgtggctgggatggtggggattgtagccttagcgtgggagatccctggcgtcaatgtgaggcccttcagtgctggcgcctctttaacaacagtcgttgcgacccagcatgcagttcacctgcctgcctttacgataattttgattgccatgcaggtggccgtgaacggacatgcaatcccgtgtacgagaaatattgtgcagatcacttcgcagacggacgatgtgatcagggatgcaacactgaagagtgcggctgggacggcttggattgtgcctccgaggtgccagccctgctggcgaggggcgtgttggttcttacagtactcctgccacccgaggagctcctgcgttccagtgcggatttcctgcagcggctgagcgcaatcctcagaaccagcctccgttttagacttgacgcccatggtcaggctatggtttttccctatcatcggccaagccccggttctgaaccaagggccagaagagaactggcccctgaagtgataggcagcgtggtgatgctcgagattgataataggttatgtctacagtcaccggagaatgatcactgtttcccggatgctcagagcgccgcagactacctcggcgctctgtcagcggtcgagagactggactttccttatccattacgcgatgtgaggggtgagcctctcgaaccgcctgagccatcagttccactgcttcctttgttggttgccggagctgtgcttctgttagtgatactggtgctcggggtgatggtcgctagaagaaagagagaacatagcacattgtggttcccggaagggttctctttgcacaaggatgtcgcctccggacataaaggccgaagggaaccagtgggccaggatgccctgggaatgaagaatatggctaagggggagtcactcatgggtgaggtagctacggactggatggacaccgagtgtcccgaggcaaagcgcctcaaagtggaagaaccaggcatgggagctgaagaagctgtggattgccgccagtggacccagcaccacttggtggccgctgacattagggttgcgccagccatggccctaacccccccacagggcgatgctgacgccgacggtatggatgtaaacgtccggggtccagacggtttcacacctctgatgttagcttcattttgcggaggagccctggaacctatgcccactgaagaggacgaagctgacgacacttctgccagtataatctcagacctcatttgccagggagcccaactcggcgctagaaccgaccgcacaggagagactgccctgcatctggccgctcggtatgcaagggcggatgcggcaaagaggctgctggacgcaggagcggatactaacgcccaggatcactctggccgaaccccgctacatactgccgttacggcggacgcccagggagtctttcagatcttgattaggaatagatcgaccgatctggacgccaggatggccgatggttccacagcattaatcctggccgctcgtctggccgttgaaggaatggttgaggaactgatagccagccatgcagacgtcaacgctgtcgacgagctgggcaagagcgctctccactgggcagctgctgtgaacaatgtggaagccaccctggcccttctcaaaaacggagcgaataaagacatgcaagattctaaggaagaaactcctctttttttggccgcacgagaggggtcctacgaagccgctaagttattactagatcattttgcgaaccgagaaatcacagaccacctggatagactccctcgcgacgtggcccaggaaagactccaccaagatatcgtccgcctgttggatcaaccaagtgggcctcgtagccctccagggcctcatgggctgggaccactgctctgtccaccaggggctttcctccccggattgaaggccgcacagtctggttcaaaaaagagtaggcgtcctccagggaaagcaggactcggcccacaaggacccagaggacgcggaaagaagctgaccctggcgtgccccggtcccctcgctgactctagcgttactttgagcccagttgattccctggatagccctcgtccttttgggggacctcccgcatctcccggagggttccccttagaaggaccatacgcagccgcaaccgcaactgcagtttctctggcccagctgggagggcctggcagggctggactcggcagacagccacccggaggatgcgtacttagcctggggttgctcaaccccgtcgccgtgccactggattgggctcgactccctcccccagccccacctgggcctagctttctgctgcccctcgccccaggcccacaacttttgaatcccggtacaccggtttctccacaggagaggcctcctccctatttggccgtccccggtcatggagaggagtacccagccgcaggggcacattcaagccctcctaaggcaaggttcctgcgcgtgccgagcgaacacccctacctgacacctagccctgaatctcctgaacattgggcgtcaccctctccaccaagtctgtccgactggtcggagagtacaccatccccagcaactgccactggtgcgatggccaccaccactggggctctcccggctcaacctcttccccttagtgtgccatctagtttggcccaggctcagactcaactcggcccacagccagaagtgacaccgaagcggcaggtgctggcatag

SEQ ID NO: 232923 - DNA, 3867 bp, Artificial Sequence
  Description of Artificial Sequence: Synthetic coding sequence
gccgctatgggacccggtgccaggggaaggcgcaggcgtaggcgacccatgtcacctcctccaccgccaccccctgtccgggctctccctttgcttctgctgctcgccggaccgggagccgcagctcctccatgcctagatggatccccctgcgctaacgggggaaggtgcacacagcttccttctcgggaagctgcttgcctctgcccaccagggtgggtgggcgaacgctgccagcttgaggatccctgccatagcggaccttgtgccggtcgcggagtgtgtcagagtagcgtggtcgccggaacagctagattcagttgccgctgccccagaggttttagaggacctgactgttcccttcccgacccctgcctgagctcaccatgcgcgcatggcgctcggtgctcagtcggacccgacgggagattcttgtgctcttgcccaccaggctatcaaggtcgctcgtgccgatctgacgttgatgaatgcagagtcggagagccctgtcgacacggcggaacatgcctaaacacacccggatccttcaggtgtcagtgtcctgctggctatacagggcctctctgcgagaatcccgctgttccctgcgcaccttctccttgtcgtaatggaggaacgtgtcggcaatcaggagatttgacatacgactgcgcctgtctgccgggtttcgaaggccagaactgtgaagtcaacgtggatgactgcccaggtcatcgctgcctaaatgggggaacatgcgtggatggagtgaacacttacaactgccagtgtcctcctgaatggaccggacagttctgcacagaagacgtggatgagtgtcagttgcaacccaacgcatgccataatgggggtacctgctttaacaccctcggtggtcatagctgcgtctgcgtgaatggatggaccggagaatcctgtagccagaacattgatgattgcgcaaccgccgtgtgttttcatggcgcaacctgtcacgatagagtcgcctctttttactgtgcgtgccccatgggcaaaactgggttgctgtgccacttagacgacgcctgtgtgagcaacccttgccacgaagacgccatctgcgacaccaaccccgtcaacggtagggctatttgcacctgcccccctggatttacagggggtgcctgcgaccaggatgtggacgagtgttccataggggcaaacccttgcgagcacttgggccgatgcgttaacacccagggcagtttcctgtgccagtgtggtcgaggctacacgggacctcgatgtgaaactgacgtgaatgagtgcctgtctggaccatgcagaaaccaggccacctgtctcgatcgtattggtcaatttacatgtatttgtatggcgggattcaccggtacttactgcgaggtcgatatcgacgaatgtcagtctagcccatgcgtaaacggcggagtctgtaaggatagggtcaacggattttcatgtacgtgtccctccggcttctcggggtctacctgtcagctcgatgttgatgaatgcgctagtactccgtgtagaaacggcgctaaatgtgtcgaccaacctgatggctatgaatgtcggtgtgcagaaggttttgaagggacgctgtgtgaccggaatgtggatgactgcagccccgacccctgccaccatgggagatgcgtagacggaatcgcttcattttcatgtgcttgtgctcccggatatacgggcactcggtgcgagtcccaagtggacgaatgccggagccaaccctgtagacacgggggaaaatgtctcgacctcgtcgacaaatacctctgccggtgcccaagcggtactacaggagttaactgcgaggtgaatattgacgattgcgcctcaaacccttgtacttttggtgtgtgtcgcgatggaattaacagatatgattgtgtatgccagcccggattcactggtcccttgtgtaatgtcgagatcaatgaatgcgcgtcctcaccgtgtggagagggaggatcttgtgtggacggggaaaatggctttagatgcttgtgtcccccaggctctttacctcccctgtgcctgccacccagccatccttgcgctcatgaaccatgctcccatgggatatgttacgacgccccaggcggatttcgctgcgtatgcgagcccggttggagcggccctcgatgctctcagagcctcgctcgtgatgcatgtgagtctcagccttgtcgcgcaggaggaacctgttcatccgatggcatggggttccattgcacctgtcctcccggagttcagggaaggcagtgcgagctcctctcgccatgcactccgaacccatgcgaacacgggggtcgttgcgaaagtgcgccaggtcagttgcctgtttgtagctgccctcaaggatggcaggacccctgcctcaacggaggcagctgccaggacggggtggggtctttttcatgttcgtgcctccccggatttgcgggtccaagatgcgcacgagacgtagacgaatgtctgtcgaatccgtgcggaccgggtacatgcactgatcatgttgcatcttttacttgtacatgtccacccggatacggcggtttccattgcgaacaagatctgccagactgctcccctagttcttgtttcaatggaggcacttgtgtggatggggtcaattccttcagctgcctctgccgcccaggttataccggcgctcattgtcagcacgaggctgatccctgcctgtctcggccatgtcttcacgggggtgtctgctccgccgcacatcctggatttaggtgcacctgtctggaaagtttcactggccctcaatgtcagacattggtcgactggtgttctagacaaccttgccagaacggcggaaggtgtgtacaaactggcgcttactgtctctgcccccctgggtggagcgggagattatgtgatatccgctcactgccgtgtagagaggccgctgcccagatcggcgtgcgtttggagcagctgtgccaggccggtgggcaatgcgtcgatgaagacagcagtcactactgtgtgtgccccgaggggcgtacaggctcacattgtgaacaagaagtagatccttgcctcgcacagccctgtcaacacgggggtacatgcagaggctatatgggcggatatatgtgcgaatgtctgccagggtacaacggggacaattgtgaagacgatgtcgatgagtgcgcatcacaaccatgccagcatggcggatcctgtattgatttagtggcacgctatttatgttcatgtccacccggaaccctgggtgtcctctgtgaaattaacgaagacgattgtggtcccggtcctcccctcgattccggccctaggtgcctccataatggaacatgcgtcgacctggttggcggtttccgttgtacatgccccccaggctataccggcttaaggtgcgaagctgacatcaacgaatgccgaagtggagcctgtcacgccgcacacacaagagattgtctgcaggatcccggaggtgggtttagatgcctgtgccacgcagggtttagtggccctcgctgtcagacagtgctttccccatgtgaatcccagccttgtcagcacgggggacagtgtcgccctagccctgggccaggcggagggctcacatttacttgccactgcgcacagcctttctggggcccacggtgtgaacgagtagctagatcctgtcgggaattgcagtgcccagttggggtcccctgtcagcaaaccccgcgaggccctaggtgcgcctgccccccaggactgtccgggccttcttgccggtcattcccgggatcccctcccggagcatctaacgcctcttag

SEQ ID NO: 232924 - DNA, 6011 bp, Artificial Sequence
  Description of Artificial Sequence: Synthetic coding sequence
atgcagcctccatcgctgctcctgctgcttctgcttcttctgctgctgtgtgtgtctgtcgtgagacccaggggccttctgtgcgggtctttccccgaaccctgcgctaacgggggaacatgtctatcgttatccctgggccagggcacttgtcagtgcgcccctggctttctgggagaaacgtgccagtttcccgatccctgtcagaacgctcagctttgccagaacggtggcagttgtcaggcactccttcccgcacctttgggtcttccttccagtccttctccgctgaccccgagcttcctgtgcacgtgcctccccggattcactggcgaacgatgccaggctaaacttgaggacccatgtccaccatcattttgttctaaaagggggcgatgtcacatacaggccagcggcaggccccagtgctcctgtatgcctgggtggaccggcgaacaatgccagctgcgggacttttgcagtgccaacccatgcgtgaacggaggtgtgtgtctggcgacttaccctcagatccagtgccattgtcccccaggatttgagggccatgcctgtgaacgggatgtgaatgaatgttttcaagatcccggaccttgccctaaggggacctcatgtcataacacccttggttctttccaatgcctctgtcccgtgggccaggaagggcctagatgcgagctgcgtgcaggcccttgccctcccagggggtgttcaaatgggggtacgtgccagctcatgccggagaaagattccacattccatctctgtctttgcccgcctggatttatcggacccgattgcgaagtgaaccctgataattgcgtatcccaccagtgtcagaacgggggtacttgtcaggacggcctggatacttacacttgcctgtgtccagaaacctggaccggatgggactgctctgaagacgtggacgagtgcgaaacacaggggcctcctcactgccgaaatgggggtacctgccagaatagcgctggctctttccactgcgtgtgcgtgtctggatggggaggtacgtcttgtgaagaaaacctggacgactgcatcgcagccacctgcgccccaggttcaacttgcatcgatcgagtcggcagcttcagctgtctatgtccgcctggcagaaccgggcttctgtgccatctggaggacatgtgcctgtcacagccctgtcatggcgatgcccagtgctctaccaaccctctgactggaagcaccctctgcttgtgccagccgggttacagtggacctacatgtcaccaggaccttgacgagtgtctgatggctcaacagggaccatcgccctgcgagcacggcggaagttgtttaaacacacctgggtccttcaactgcctttgcccacctggatatacaggcagcagatgcgaagccgatcacaacgagtgtctaagtcagccatgtcacccaggcagtacatgccttgacctgctagccacgttccactgcctctgcccacccggattggagggacagctatgcgaggtcgaaaccaacgaatgcgcctccgcaccttgcctgaaccacgccgactgtcatgacttgctgaacggctttcagtgcatctgtctccctggtttctcaggcactagatgcgaggaggacattgatgaatgccggagctccccttgtgccaacggaggacaatgccaggatcagcccggtgcgttccactgcaagtgtctacccggtttcgagggacctcgatgtcagacagaagtggacgagtgcttaagtgacccttgccctgtcggcgcttcttgcctcgatctccctggtgccttcttttgtttatgcccgtccggctttaccggtcagctgtgtgaagtgccactgtgtgctcccaatctgtgccagcctaagcagatctgcaaggaccagaaggacaaggcaaactgcctctgcccagacggaagccccggttgcgcccctccagaggataattgtacctgccaccatggccactgccaacgatccagttgtgtctgcgacgtaggttggaccggaccagagtgtgaggccgaacttggcggatgtataagcgccccttgtgcccatggcggtacgtgttacccccagccatccggttataattgcacctgtcctacgggttacacagggcctacgtgttcagaagagatgaccgcatgccactctgggccttgcctgaacggaggttcctgtaacccatcccctggtggctactactgcacttgtcccccttcccacactggccctcaatgccagaccagtacagactactgcgtaagcgcaccatgctttaacggcggaacatgtgtgaaccggcctggcaccttctcctgcctgtgcgcaatgggattccagggccctagatgtgaggggaaactgcgaccaagttgcgcggactccccctgcagaaaccgagccacttgccaggattccccacagggaccgaggtgcttatgtcccacaggctacactgggggatcttgccaaaccctgatggatttatgcgcacaaaagccgtgcccaagaaatagtcattgcctgcagacaggcccatcctttcactgtttatgcctccaaggctggacgggaccactctgcaacctgcctctgtcatcctgtcagaaagccgcattgagccagggcattgacgtcagtagcctgtgtcacaatgggggactgtgcgtggattctggtccgtcctacttttgccactgtccgcctggatttcagggaagcctgtgtcaggaccacgtcaatccttgcgagtcaagaccatgccagaatggagccacatgtatggcccagccgtccggttatctgtgccagtgcgctcccggatacgacggccagaattgtagtaaagagcttgacgcctgccagagccagccctgtcataatcacgggacatgtacaccgaaacccggaggctttcattgcgcctgcccaccaggattcgtgggtctgaggtgcgagggcgatgtggatgaatgcctggatcagccttgccatcctacagggacagctgcctgccacagcctggccaatgctttctactgtcagtgtctgccgggacataccggacagtggtgcgaggtggagattgacccatgccacagtcaaccatgcttccatggaggcacttgcgaggccactgccggttctccactgggctttatctgccactgcccaaagggcttcgagggaccaacatgttcccaccgcgcaccgtcctgtggtttccatcactgccatcacgggggactgtgtctaccctcccccaaacccggattccccccaaggtgtgcttgcctctccggctacggcggaccagactgtctgacacctccagcaccaaaaggctgtgggcctccctctccttgtctctacaatgggagctgcagtgagaccaccggactgggcggtcccggattccggtgtagctgtcctcatagctcgccaggccctaggtgccagaaaccaggtgctaaagggtgtgagggcaggtcaggcgatggcgcttgcgacgcaggctgttcaggccctggaggcaactgggacgggggtgactgctccctgggagtaccagacccgtggaaaggctgtccttctcacagtcgctgctggctgctgtttagggatggccaatgccatcctcaatgcgactcagaagagtgcttatttgatggatacgattgcgaaacacccccagcctgtaccccggcttatgaccagtattgtcacgaccactttcacaacggacactgcgagaaagggtgtaacactgctgagtgcgggtgggatggcggagattgcagacctgaagatggcgaccctgagtggggcccttctcttgccctactcgtggttttgtcaccacccgcactggaccaacagctgtttgcattagcgagagttctttccctcaccctgcgagtgggattgtgggtccggaaagatcgcgacggacgggacatggtgtacccttaccccggagccagagctgaggaaaaactggggggtacccgcgaccccacctatcaagagcgggcagctccccagactcagcccctcggtaaggagaccgattctctgtccgcaggctttgtggtcgtaatgggcgtcgatttgtcacgctgcggacccgaccaccccgcaagccgatgtccatgggatcccggactgttgcttcggttcttggccgctatggccgctgtgggggcactggaacctttattgcccggaccactgctcgccgtgcatccacatgccggtactgccccacccgcaaaccaactaccctggccagtgctgtgtagcccagtggccggtgttatcctcctggcgttaggcgctctactggttcttcagttgatcagaagaaggcggcgagaacatggggctctctggttgcctccaggatttaccaggcgcccaaggacccagtccgctccccacagaagacgccctccccttggcgaggattccattgggctcaaagcgctgaaaccaaaagcagaagtggacgaagacggggtggtgatgtgtagtggtcctgaagagggggaagaggttggccaggctgaagagactggacccccatccacctgccaactgtggtcactgagcggtgggtgcggagcccttccacaggccgcaatgctgacaccccctcaggagtccgaaatggaagcccctgacctggatactaggggaccggacggggttacacctcttatgtccgctgtttgctgcggcgaggtccaatccgggacttttcagggagcttggctcggctgtcctgagccttgggaaccactcctcgacggaggcgcttgtccccaagcccatacagtgggtaccggcgagacacctttgcatctggctgccagattctcccgcccaactgccgcacggaggctgttagaagccggagcaaatccaaatcagccagacagggccggaaggacccccctccatgctgccgtggctgctgacgctagggaggtgtgccaactgctgctgaggtctcgtcagaccgccgttgatgcgagaacagaggatggcacgacaccgctgatgctggcggcacgcctggccgtcgaagatcttgtggaggagcttatagccgctcaggccgacgttggggcaagagacaagtggggcaagactgcactccattgggccgcagccgtgaataacgctcgggctgctcgatccctgctgcaggcgggagccgataaagatgcccaggataatcgggaacagacacccctgtttctggccgcacgcgagggcgcagtggaggtcgcacaactccttcttgggctgggagctgcaagagagctgcgcgatcaggctggcctcgcccctgcagatgtggcccaccagcgtaaccattgggatctactgacccttctggagggggcaggccctcccgaggccaggcacaaagctacgcctggccgagaagctggaccctttccacgggcacggaccgtgagtgtgtctgtgcctccacatggtggaggggcactacctcgatgcaggacacttagtgcaggggctggcccaagaggaggtggagcctgcctgcaggctcggacttggagcgtggacctggctgctcgagggggtggtgcttattcacactgtcggagcctgtccggagtaggcgctgggggtggcccaacccctagggggcgacgttttagtgcgggtatgcgaggaccaagacctaatccagctattatgcggggtcgctatggggtcgcggctggcagggggggtcgagtcagtactgatgactggccctgtgactgggtggcgctcggagcttgcgggtcagcctccaacatcccaatcccacccccttgtctcactccatcaccagagcgaggaagccctcagctggattgcggacctcctgcccttcaggagatgcctatcaaccagggtggtgagggaaaaaagta

SEQ ID NO: 232925 - DNA, 3147 bp, Artificial Sequence
  Description of Artificial Sequence: Synthetic coding sequence
tgcgcacctgggtacgatgggcaaaattgctccaaggagctggatgcatgccaaagccaaccctgtcataatcacggaacatgcacccccaaaccaggtggatttcattgcgcgtgtccgcctggcttcgttgggctgcggtgtgaaggggacgtggatgagtgcctggaccagccctgtcatcccaccggcacagcagcatgccatagccttgctaatgctttttattgccagtgccttccagggcacaccggacaatggtgtgaagtcgaaatagacccctgccacagtcagccgtgttttcacggtggcacctgcgaagcaactgctggatctcctcttggctttatatgccattgtcccaagggattcgaagggcctacctgcagtcaccgtgctcccagctgtgggttccaccactgccaccatggaggtttgtgtctgccatcccccaaacctgggttcccccctcggtgcgcctgtctgtccggatacgggggacccgattgtctgaccccacctgctcctaagggttgcggcccaccctcgccctgcctgtacaatgggagctgtagcgagaccaccggcttggggggaccaggctttcggtgttcttgtccccatagcagccccggtccaagatgtcagaaaccgggtgcgaagggatgcgaggggagaagtggggatggtgcatgtgacgccggatgtagtgggcctggcggtaattgggatggaggcgattgtagtcttggagtgcccgatccttggaagggctgtccatctcatagtcgctgttggctgctgttcagggacggccagtgccatccgcagtgcgattccgaggaatgcctctttgacggctacgattgtgagacaccccctgcatgcaccccagcatatgatcagtactgccacgaccacttccacaacgggcattgcgagaagggctgcaatacggccgagtgtggttgggacggtggagactgtagacccgaagacggggatccagagtggggcccatcactggctttattagtagtgctgagtccaccagccctggatcagcagctgtttgcactggccagggtcttgtccctaacactccgggtcggcctgtgggttcgcaaggaccgggatggcagggatatggtgtatccataccctggcgctagagcagaggagaagcttggcggtacccgcgaccctacgtaccaagaacgggctgctccgcagactcaacctctcgggaaagagaccgactccctatcagctggatttgtggtggtgatgggagtagacctgagccgctgcggtcctgatcaccctgccagtcgctgcccgtgggatccaggacttctgctgcggttccttgctgcaatggcggcagtcggggctctcgaaccactcctccctggaccattactggccgtgcatcctcacgccggaacggcccctcccgctaaccagttaccatggcctgtactttgttccccagtggccggagtgatattgctcgctctgggcgcactccttgtgttgcagttgatcaggcgccgacggcgtgaacacggggctctctggttgccacctggatttaccagacgacctcggacgcaaagtgccccacatagacgtcgccctcccctaggggaggatagcatcggtttgaaagctcttaaaccaaaggcggaggtggatgaggatggcgtcgtaatgtgcagcggccctgaggagggagaagaggtgggacaagccgaagaaactggaccgccttccacttgtcagctctggagcctctcaggagggtgcggggctctgccacaggctgcgatgcttacaccccctcaggagtcagaaatggaggcacctgatctcgatactcgaggccctgacggcgtcacgcctctcatgtccgccgtctgttgcggcgaagtccagtctggcactttccaaggcgcttggttaggttgcccagagccgtgggagcctctgttggacggcggtgcctgcccccaggcacacactgtcggcactggtgagacccctcttcatctcgctgcgagattcagcagaccaacagccgcaagaaggctcctggaggccggtgcaaaccctaaccagccggaccgcgcaggtagaactccattgcatgcagccgtcgctgcggatgctagggaagtgtgccaactgttgctgcgaagccggcagactgctgttgacgcgagaactgaagacggaaccacaccattaatgctggccgctaggctcgccgtcgaggacctcgtggaggaactgatcgccgcacaagccgatgtaggcgcaagggataagtggggcaagactgcgcttcattgggccgcagcagtgaacaacgcgagggcggctaggagcctgctgcaagctggggcagataaggatgcacaggataaccgggaacagacacctctgttcctcgccgctcgcgagggagcagttgaggtggcgcagctgctgctagggctcggagctgcaagggaattgcgggaccaagccggactggctccagcggacgtggctcaccagaggaaccactgggatttgctgaccttgttagaaggagcaggcccacctgaagctcggcataaggcgacgcctgggagggaagctggccctttccctcgcgctcggacggtgtccgtgagcgtcccccctcatggcggaggagccctgcccaggtgtaggacactaagcgccggtgcgggaccccgtgggggaggagcctgtctacaggctagaacctggtctgtcgacctagccgctagaggtggcggagcatactctcattgccgcagtctgtcaggggtgggagcgggaggtggccctacccccaggggtagaagatttagtgccggaatgcggggaccaaggcccaatcctgcaattatgagaggcagatacggtgtcgctgccggtaggggtggccgagtgagcacagatgattggccctgcgactgggtggccttgggcgcatgtgggtcagcatccaatattccgatacccccaccatgcctaacccccagccctgagcgcggaagtccacaactggattgtggccctcctgccctacaggaaatgcctatcaaccagggtggagaaggcaagaagtag

SEQ ID NO: 232926 - DNA, 6017 bp, Artificial Sequence
  Description of Artificial Sequence: Synthetic coding sequence
atgcagccccctagccttctcttacttctcttattgctcctgctcctcttattgtgtgtgagcgtagttcggcctagaggcctgctgtgtggcagtttccccgagccatgtgctaacggcggtacctgcctttctttatctctcggacaggggacctgccaatgtgcgcctggcttcctgggcgagacgtgtcagtttcctgacccctgtcagaatgctcagctttgccagaacggcggaagctgtcaggcactcctgcctgcacccctgggcttgccatcctcgccgagccccctgacacccagtttcctctgtacttgcctgcccggtttcactggtgagcgctgtcaagcccaactggaggacccttgccccccttctttctgctctaagaggggcaggtgtcacatacaggcatctgggcgaccccagtgttcctgtatgcctgggtggacaggagagcagtgccagcttagagacttttgcagtgccaacccctgcgtgaacggcggtgtatgcctcgctacgtatcctcagatccagtgccattgtccgcctgggttcgaggggcatgcgtgtgagcgcgacgttaacgagtgcttccaggatccagggccttgtccgaaaggcactagttgtcacaacacactgggaagcttccagtgtctatgcccagtgggccaggaaggaccgcgttgcgagctccgagcagggccttgcccaccaaggggctgctcgaatgggggaacttgccagctgatgcccgagaaagattccacgtttcacctgtgtctgtgcccacccggattcatcggcccagactgtgaggtgaaccctgataattgtgtgtcacaccagtgccaaaatggcggtacttgccaagacggactggatacatacacatgtttatgtcccgagacgtggacaggttgggattgtagcgaggacgtggatgagtgtgaggctcaggggcctcctcattgtcgcaacggaggcacctgccagaattcggctggaagctttcactgtgtctgtgtctctggatggggaggcacctcatgcgaagagaatttagacgactgcatagccgctacatgcgctccgggatcgacctgcatcgacagagtaggctcctttagttgtttgtgcccaccaggacgtaccggactactgtgccacctggaagatatgtgtctgagccagccctgtcatggagatgcccagtgttcaacgaatcccttgactgggagcaccctctgtctgtgtcagcctggatattctggccctacctgccaccaggacctcgatgagtgcctcatggcccagcagggaccttccccgtgcgagcatgggggatcttgccttaacacccctggttcatttaattgcctctgccctcctgggtataccggatctcgttgtgaagcagatcataatgagtgcctctcacagccgtgccaccccggtagcacatgcctggacctcctggccacttttcactgtctgtgccccccaggtctagaaggccagctgtgtgaagtcgaaacgaatgagtgcgcgagcgctccatgtctcaaccacgccgactgccacgacttactgaacggtttccaatgcatttgtttgcccggattctcaggtactaggtgtgaggaagatatcgacgagtgccgctcgagcccgtgcgccaatgggggtcagtgccaggaccaacccggtgccttccactgtaaatgcctgccagggtttgagggcccacgttgccagacggaggtggacgagtgtcttagcgatccctgccccgtgggcgcatcctgtctggatctcccaggcgcttttttctgcttgtgccccagcggctttacaggtcagctgtgcgaggtacccctctgcgctcccaacctgtgtcagcccaaacagatttgtaaggaccagaaggacaaagcaaactgcttatgccccgacggttcccctgggtgcgcgcctccggaggacaattgtacatgccatcatgggcactgccagcgctcgtcctgcgtttgcgatgtgggctggaccggccctgagtgtgaagccgagctgggaggttgtatcagcgctccttgtgctcacggtgggacttgttatccccagcccagcggctacaactgcacctgccccaccggatatacggggccaacgtgctcagaggaaatgacagcttgtcactccggcccttgtctgaacggcggaagctgcaaccccagtcccggaggttattactgcacatgcccgccaagccacacggggccacagtgccaaacaagcaccgattattgcgtcagtgcaccatgctttaatgggggaacctgcgtgaaccgacccggaaccttctcttgcctgtgcgcaatggggttccagggacctcggtgcgaaggcaagctgagaccatcctgcgctgattctccgtgcaggaacagagccacctgccaggactcaccacaaggacccagatgtctttgccccacaggttatactgggggttcctgccagaccctgatggacctttgcgctcagaagccatgccctcgcaacagccattgcctgcagaccgggcctagtttccactgtttatgtctgcagggttggacaggtcccctttgcaatctgcctctatcatcatgtcaaaaagccgcactgagccaggggatagacgtttcttctctgtgtcacaatggcggactctgcgttgactccgggccttcctacttctgtcactgccctcctggcttccagggctccctgtgtcaggaccacgtaaatccctgtgaaagccggccttgccagaatggagccacgtgtatggctcagccaagtggttacctttgccagtgtgcccctggctatgatggccagaattgctccaaggagcttgacgcttgtcagagccagccatgtcacaatcacggcacctgcacacccaaaccagggggatttcactgtgcctgtccccctggttttgttggccttagatgtgagggcgacgtcgatgagtgcctcgatcagccctgccaccctactgggacagcggcttgtcattcactggcaaacgccttctattgccagtgcctgcccggacacacgggccagtggtgtgaggtggaaatcgatccttgccactctcagccttgttttcatggaggaacatgcgaggccacggccggttctcctctggggtttatctgtcactgccccaaagggtttgagggccctacatgctcgcaccgtgcaccttcctgtgggtttcatcactgccaccacggcggtctgtgtttgcctagtcctaaaccaggctttccccctcgctgtgcatgtctgagtggatatggcggaccagattgtctgactccaccagcccctaaaggctgtgggccacctagcccctgtttgtacaacgggtcatgctctgaaaccactggccttggcggtcctggattccgatgttcatgccctcactcctcacctggccctagatgtcagaagcccggagcaaaaggctgtgaaggaagatctggtgatggcgcatgcgacgctggatgctccggacccggaggcaattgggacggtggtgactgctctctcggggtgccggacccttggaagggatgtccgtcccactctaggtgctggctgctgtttagagatgggcaatgtcacccccagtgcgacagcgaagagtgcttgtttgacgggtatgattgtgagaccccccctgcatgtacaccagcttacgaccagtattgccacgatcattttcacaacggccattgtgaaaaaggctgcaacacagctgagtgcggctgggatggcggagactgtaggcccgaggatggagatcccgagtgggggccttcactcgctctcctggtggtgctgtccccgccagctctggaccaacagttattcgctttagcaagagtgctgagtcttacactgcgggtcgggctctgggtaaggaaggatcgggacggcagggacatggtgtatccctatcccggtgctcgggctgaagagaaactcgggggaactcgcgaccctacatatcaggagagagcagcacctcaaacccagcctttagggaaggaaactgattccctttccgccggattcgtggtggttatgggcgtggatctgtcacgctgcggaccggatcacccagcatccagatgtccctgggacccgggactgctcttgagattccttgcagccatggcagccgttggggctttagaacctctgctgcctggcccactccttgctgtacatcctcacgctggcaccgcccctcccgctaatcagctcccgtggccggtgttatgcagccctgtggcaggagtcattctacttgcactcggcgcactactcgtcctgcagctgatacgcaggcgacggagggaacatggagccctatggttacctcctggctttaccaggagacccaggacccagagtgcgccacacaggaggaggccgccattgggcgaggactccatcggtttgaaagcattaaaaccaaaggccgaagttgacgaggatggagtggtcatgtgctcgggccctgaagaaggagaagaggttgggcaggccgaagaaacaggcccaccatcaacttgtcagctctggtctctgagcggaggctgcggcgctctgccacaagccgcaatgctaacgcccccacaagagtcagaaatggaggcaccagacctggacacccggggtccagacggcgtgacacccctaatgagtgctgtttgctgcggcgaagtgcagtcgggcacttttcaaggtgcatggttaggctgtcccgaaccgtgggagccactgctcgacggaggtgcttgcccccaggcgcacacagtcggcactggcgagactcccctacaccttgccgctcggttcagccgacctacagccgcacggagactccttgaggctggcgctaaccctaaccagccagatcgcgctgggaggacaccgctccacgcggcagttgcagccgatgccagggaagtgtgccaactactgttgcggagtcggcagaccgccgttgacgctcgtaccgaggatgggacaactccactgatgctggccgcaagactggcagtcgaagacttagtagaggaactgatcgccgctcaggcagatgtcggagctcgggataagtgggggaaaaccgccctgcactgggccgcagcggttaataatgccagggccgctaggagcctcttgcaggcaggagccgataaggatgcccaggataatcgcgagcagacccccctgttcctcgctgccagagagggagccgttgaagttgctcagcttcttctgggattgggcgctgctagggaactgcgagatcaagccggactggccccagctgacgttgctcaccagagaaaccactgggacctactgaccctgcttgagggggctggtccccctgaagccagacataaagctactcccggacgtgaggctgggccttttccaagggctcgtacggtgtctgtcagtgtgcctcctcatgggggaggcgcactacctaggtgccgcactctgagcgccggagccggtccccgtggaggcggtgcttgtctgcaagctcgtacatggtcggttgatttagccgctagaggagggggtgcttactctcactgtcggagtttatccggggtcggcgctggcggtggcccaacacctaggggcaggaggtttagcgctggcatgcgcggtcccagacctaatcctgctatcatgagagggaggtatggcgttgcagccggacggggtgggagagtgagcacggacgattggccttgtgactgggtggccctgggtgcatgcggaagcgcttccaacatccccattccaccaccctgtctgactcccagcccagagaggggcagtccccagcttgactgcggcccaccagctctccaggaaatgcccatcaaccagggcggagaggggaagaagta

SEQ ID NO: 232927 - DNA, 6011 bp, Artificial Sequence
  Description of Artificial Sequence: Synthetic coding sequence
atgcagccaccttctctactcctgctcctgttacttctcttgctcctttgtgtgagtgtcgtgcggcctcgtggcttgctgtgtggctcttttcctgagccatgtgcgaatggaggaacctgcctgtcattgtccctcggacaaggtacctgccagtgtgcacccggtttccttggcgaaacctgccagtttccagacccctgccagaatgcccagctctgtcaaaatggtggtagttgtcaggccctcctgccagccccattaggtttaccatcctctccaagccccctcacgccgagcttcctgtgtacttgcctacccggatttacaggtgagcggtgccaggcccagttagaagacccatgccccccttccttttgttccaaacgtgggcgttgtcatattcaggccagtggcagacctcagtgttcctgtatgcccggttggaccggggaacagtgccaactgagagatttctgcagtgccaatccctgcgtcaacggcggagtctgccttgccacttatccgcagatccagtgtcactgtccgccaggttttgaaggtcatgcttgcgagcgtgacgtcaacgagtgcttccaggatccgggtccctgtccaaaaggtacctcttgtcacaacaccttgggctcctttcagtgtttgtgtcccgttggccaggaggggcctaggtgtgaattgagagccggaccatgccctccaaggggatgtagcaatggcggtacatgccagctgatgcccgagaaggattccaccttccatctatgcctctgtcctcctggattcattggacctgactgcgaggtaaatcctgacaattgtgtgtcccaccagtgccaaaatggcggaacctgccaggacggcctggacacatatacctgcctctgcccagaaacctggacgggatgggattgcagtgaggacgtggacgaatgcgaaacacaagggccaccgcattgcagaaacggaggtacctgtcagaatagcgctggcagcttccactgcgtgtgtgtgagcggttggggtggcacaagctgtgaggaaaatctcgatgactgcatcgccgcaacttgtgcaccaggttcaacttgcatcgaccgcgtaggatcttttagctgcctctgcccccctggtcggacaggcctcctgtgccacctggaggacatgtgtctgtctcagccgtgccacggagacgcccagtgcagcactaatccattaaccgggtccaccctgtgcctctgtcagcctggctatagcgggcctacttgccatcaagatctcgacgagtgtcttatggctcagcaaggacctagcccatgtgagcacggcggttcatgccttaacacgcccggtagtttcaattgcctttgtcctcctggctataccgggagtcgatgtgaggccgaccataacgagtgcctgtctcagccctgtcaccccggaagcacttgcctcgatctgctggcaacctttcattgcctgtgccctcctgggctggaagggcagctgtgtgaagtcgagactaatgagtgcgcttccgccccatgcctgaatcacgccgactgtcatgacctcctgaacggatttcagtgtatttgcctgcctggcttctcagggactcgctgtgaggaggacatagacgaatgcaggagcagcccttgtgccaacggtggccagtgccaggatcagccaggcgctttccattgcaagtgcctgcctgggttcgaagggcctaggtgtcaaactgaagtagatgagtgcttgtctgacccctgccccgtgggtgctagttgcttggatttgcccggtgcatttttctgtctgtgcccttccggattcaccggacaactatgtgaagtgccgctttgtgcacccaatctctgccagcccaaacagatctgcaaggaccaaaaagacaaagcaaattgcttgtgtcctgatgggtcccccggatgcgcaccaccggaggacaactgcacatgccaccacggacactgccagcggagttcgtgtgtttgcgatgttggctggactggaccagaatgtgaagcagagctgggcggatgtatctccgctccatgtgcgcacgggggaacatgttaccctcagccctctggctataattgcacctgccctacaggctataccgggccaacatgctccgaagaaatgactgcatgccacagcgggccatgcctcaacggcggaagttgcaacccgagtccaggaggatactattgtacctgcccaccttctcacaccggcccacaatgtcaaacaagcacagattactgcgtctcagcaccgtgtttcaacgggggtacatgcgtgaatcggcctggtacctttagctgtctgtgcgcgatgggtttccagggcccaagatgtgagggtaagttaagaccgtcctgcgccgactccccctgcaggaacagagcgacatgccaggattccccacagggacccagatgcctctgtccaaccgggtacacaggcggtagctgccagaccctgatggacctgtgtgcccagaagccttgtcctcgaaattcacactgtctgcagacaggcccttcttttcactgtctgtgtctgcaggggtggacaggcccactgtgtaacctgccgctcagcagctgccagaaagccgctctatcccagggtatcgacgtctcatctctctgccacaatggtggtttgtgtgtggattctggtcccagttacttctgccattgccctcccggattccagggctcactttgccaggaccatgttaatccttgtgaatccagaccatgtcagaatggtgctacctgtatggctcagccaagcgggtatctatgccaatgcgcacccggatacgacggtcagaactgttccaaggagctggatgcctgccagtcccagccgtgtcataatcacggcacgtgcacccctaagcccggagggttccactgtgcctgtccgcctggattcgtcggcctcaggtgtgagggtgatgtcgacgaatgcctggaccagccatgccacccgaccggaactgccgcatgtcacagtcttgccaacgccttctattgtcaatgccttccagggcatacggggcaatggtgcgaagtggagatcgacccttgccactcccaaccttgcttccacggcggaacatgtgaagccacggctgggtcccccctgggatttatctgccactgccccaaaggatttgaaggtccaacttgctcccacagagccccttcttgtggcttccatcactgccaccatggagggctgtgtttaccttcacccaagcctggattcccacctaggtgcgcctgtctgagcggttacggcggaccagattgcctgactcctcctgccccaaaggggtgcggaccgccttcaccctgcctgtacaacgggagctgctccgaaaccacaggcctgggtgggccaggttttaggtgcagttgtccacactccagcccgggaccacgttgtcagaagccaggcgctaaggggtgcgaaggcaggagcggggacggagcctgcgacgccggttgcagcggccctgggggtaactgggacgggggagattgttcgctgggggttcctgatccttggaaaggctgcccgagccacagccgatgttggcttttgtttagggacggccagtgtcacccacaatgtgattcagaggaatgtctgttcgatggatatgactgtgagacgcctcccgcatgtacccctgcgtacgaccaatattgtcacgaccatttccataacgggcactgtgagaagggttgcaacaccgctgagtgcggttgggacggaggcgactgtaggcctgaagacggagatccggagtggggccctagtctagctttgctggtggtgttgtcccctcccgcactggaccaacagctgttcgccctcgctagggttttgtcacttaccttaagggtgggtctttgggttcgcaaagacagagatggtagagacatggtatacccttatcccggtgcccgagccgaggaaaagctgggaggcaccagagaccccacttaccaagaaagggccgcaccacaaactcaacctctgggtaaggaaacagacagcttgagtgctgggttcgttgttgtgatgggagttgacctgtctaggtgtgggcctgatcacccagcttctcgttgtccgtgggatccagggctgctactcagatttttggccgcaatggctgccgtcggcgctctggaaccattactgcctggccctcttctggctgtgcatccgcacgccggaaccgcccctcccgctaaccagttaccatggcctgtcctctgtagtccagtggctggagtgatcttactcgctctgggagcactgctagttctgcaactcatcagaaggcggaggcgcgaacacggcgcactttggctcccgcctggattcactcgcagaccaaggacccagagcgctccccaccgccgacgccctcctttgggagaggactccattggattgaaggccctgaaaccaaaggccgaggtggatgaggatggagtcgttatgtgctccggcccagaggaaggcgaggaagtgggtcaggccgaggagactggtcccccttctacctgccagctatggtctctgtccggcggatgcggcgcactgccacaagccgcaatgttgacccctccacaggagtccgagatggaagctcccgacctggataccagaggccctgatggcgtaacccccctgatgtcagcagtttgttgcggcgaggtccagtcaggcacttttcagggtgcctggcttggatgtcctgagccttgggaaccactccttgatgggggagcttgtccccaggcgcatactgtgggtacaggagaaacccccctgcaccttgcagcgaggttttcccgtcctacagccgcacggaggctgctggaggcaggagccaatcctaatcaaccagatcgggctggtcggaccccattgcatgccgctgtggccgctgatgccagagaggtgtgtcaactcctgcttcggagccgccagacagccgttgatgctaggaccgaagacggtaccacacccctgatgttggcagcgaggctagctgtagaggaccttgtggaagagctcatcgctgctcaagctgacgtgggcgctcgagacaagtggggcaagacagctcttcactgggctgccgcagtgaataatgcccgtgcagctcgctctttgctgcaggccggagccgacaaggatgcgcaagataatcgggaacagacaccattattcctcgctgcgagggaaggagccgtcgaagtggctcagctgctcctgggcctgggagcagccagagaattacgagaccaagccggtcttgccccagccgatgtggcacatcaaagaaatcactgggatttgttaacccttttagagggcgcaggtccgccagaagcaaggcacaaagcgacgccaggcagagaggcaggcccatttccaagggcaaggacggtcagtgtgtctgtcccccctcacggaggcggagcactcccgagatgcaggacccttagtgctggcgcagggccaaggggaggcggagcctgcttgcaggcgcgaacatggtcagtcgacttggccgcacggggtggcggagcctactctcactgtcgatccctttcgggagtgggagcaggagggggacccacgcctagaggcagacgtttttccgctggcatgagaggacccaggcctaatcctgccattatgcgcggacgatacggcgtggccgctgggaggggtgggagagtaagcacagatgactggccatgcgattgggttgcattgggagcctgcggatcagcttccaacattcccatccctcccccttgtttgacgccctcacccgaacgcggaagcccccagctggattgcggccctcctgccctgcaggaaatgcctattaaccaggggggtgaggggaaaaaata

SEQ ID NO: 232928 - DNA, 561 bp, Artificial Sequence
  Description of Artificial Sequence: Synthetic coding sequence
atgtctgccgtgtgctgtggcgaggtgcaaagcggtacctttcagggcgcatggctgggctgcccagaaccatgggagccactcctcgatgggggtgcttgccctcaggctcatacagtcggcacaggcgaaacaccacttcacctggcggctcggttttcccggccaactgccgcaagacgtctgctcgaagctggtgccaatcctaaccagcccgacagagccggtcggacacccctgcacgcagccgtcgctgccgacgcacgtgaggtttgccagctcttgctgcgttctagacagacagccgtggacgctagaactgaagatggcacgacaccactgatgctggcggctcggctggccgttgaggacctcgtggaagaactgattgccgctcaggcagacgtgggcgcacgagataaatggggtgccgacgccgctattccaggtggcgctggcagatcagggggaagtagtccggctacagccggagccggaggctcccctcgcgctgccggacccggttgggcaagcgccggtggaagaagatcacccacatag

SEQ ID NO: 232929 - DNA, 6008 bp, Artificial Sequence
  Description of Artificial Sequence: Synthetic coding sequence
atgcagccacccagcctgttactccttctgttgctactgctgctctgcgttagcgtcgtgcgccctcggggtctgctgtgtggaagttttcctgaaccctgcgccaatggagggacgtgcctgagcctgagtctcgggcagggcacttgtcaatgcgcgccagggttcctgggcgaaacatgtcagtttcctgatccatgccaaaatgctcagctatgtcaaaatggtgggagttgccaggctctgctgcctgcacctctcggactgcccagttccccatcccccctgaccccttcttttctatgcacatgcctgcctggcttcacaggagaacgctgccaagcacagttggaagatccttgccctccctctttttgttccaaaagagggcgatgccacatccaggcaagcggccgaccgcagtgcagttgcatgccaggatggaccggcgaacaatgccagctgagagatttctgctcagcaaacccatgtgttaacggcggagtttgcctggcgacctatccccagattcagtgccactgccctcctggatttgagggccacgcctgtgaaagagacgttaatgagtgttttcaggaccctggcccatgtccaaaggggaccagctgtcacaacacactgggtagctttcagtgtttgtgccctgttgggcaagaggggcctcgttgtgagctcagggccggaccgtgcccccctcggggttgctccaatggagggacgtgccagctgatgcctgaaaaagactcaacttttcacttgtgcttgtgcccccctggcttcatcgggcctgactgtgaggtcaatcccgacaattgcgtttcccaccaatgccagaacgggggaacctgccaggatggcttggatacatacacctgcttatgtccagaaacatggacagggtgggactgctcagaggacgtagatgaatgtgaaactcagggccctccccactgccggaatggcggaacatgtcaaaactccgcaggatcctttcactgtgtctgcgtgagcggatggggcggtacttcctgcgaagaaaacctggatgattgcatcgctgccacttgtgcccctggcagtacttgtatcgatcgagtggggtctttcagttgcctctgcccccctgggagaactggactcttatgccatctcgaagatatgtgtctaagccaaccctgccatggcgacgctcagtgttccaccaatcccctcacgggctctacactgtgcctgtgccagcccggatacagcggaccaacctgccaccaagacttggacgaatgtcttatggcacaacaggggccatccccctgtgaacatggaggtagctgtctcaatacacccggttcttttaactgcctgtgtccccctgggtatactgggtccaggtgcgaagctgatcacaatgaatgcctgtcccagccgtgccatcccggatccacttgtcttgaccttcttgcgacattccattgcctctgcccacctggtctggagggtcagctgtgcgaagtggagaccaacgagtgcgcgtctgccccttgtttgaatcacgcagattgtcatgacctcctgaacggctttcaatgtatatgtctgcctggcttttccgggacccgctgcgaagaagacattgacgaatgccggagctctccttgtgcaaacggaggccagtgccaagatcagcccggagcgttccattgtaagtgcctccctggcttcgaagggccaagatgtcaaacagaggtggatgaatgcctgagcgacccatgcccagtgggtgcttcttgtctggacctgcctggggcatttttttgcctgtgtcccagcgggttcaccggccagctctgcgaggtgccgttgtgtgcgccaaatctttgccagccaaaacagatttgcaaagaccagaaggataaggcaaactgtctgtgccccgacggctctcccggttgtgccccaccagaagacaactgcacatgccaccatggacactgccagcgcagtagctgcgtctgcgatgtcggctggacaggccctgagtgcgaagcagaactggggggatgtattagcgctccgtgtgcacacggtggcacctgctatccccagccttccggttacaattgtacttgcccaaccgggtacaccggccctacctgcagtgaggagatgaccgcatgccatagtggcccttgcctaaacgggggaagctgcaatccttctcctgggggttactactgcacctgcccccctagccatactgggcctcagtgccaaacctcgacagactactgtgtgtccgctccgtgcttcaatggaggcacctgtgtcaacaggcctggcaccttctcctgtctctgtgctatgggctttcagggacccagatgcgaaggtaagctgcggccttcttgtgccgattctccgtgcagaaacagggcgacatgccaggacagtccacagggcccacggtgtctgtgtcccacaggctatacaggtggcagttgtcagaccttaatggatttgtgcgcgcagaaaccctgtcctaggaactcccattgtttgcaaactggaccttctttccattgtctctgcctgcagggatggaccgggccactgtgcaatctgcctttatcatcctgtcagaaagccgctctgagccaggggattgacgtgtcatctttgtgccacaacggcggactgtgcgtagactcaggaccgagctatttctgtcactgcccccctggattccaaggtagtctgtgccaggatcacgtgaacccctgtgaatctagaccttgtcagaatggcgctacctgcatggctcagccctccggctatctctgtcagtgtgctcccggttacgacggacagaactgcagcaaagaactggacgcatgtcagtcccagccatgtcacaaccacggcacctgtacgcctaagcctgggggatttcattgcgcatgcccacctggctttgtgggcctgaggtgcgagggggatgtggacgaatgtctggatcagccatgccaccctaccgggacagccgcatgtcacagcctcgctaacgcattctactgccaatgcctgcctggccacacggggcagtggtgcgaagttgaaatcgacccctgtcacagccagccttgctttcacggtggcacatgtgaagccactgctggcagcccattgggctttatctgccactgcccaaagggatttgagggaccaacctgttcacatcgggctccatcctgcggcttccaccattgccaccatgggggactgtgtttaccatctccaaagcctggatttccccctcgctgtgcttgtctgtctggttacggcggacccgactgcctgacccctcctgctccaaagggctgtgggcctccatccccctgcttatataatggttcctgctctgagacaacaggactgggcggaccaggctttagatgtagctgccctcacagtagtccgggaccgaggtgccaaaaaccaggtgccaagggttgcgagggccgtagtggggacggagcatgtgatgctggctgttcaggcccaggaggaaactgggatggaggagactgctccctgggcgtgccagacccctggaagggatgtcccagccattcccgatgttggctcctgttccgcgacgggcagtgtcacccacagtgcgattcagaagaatgcctgttcgatggctacgactgcgagacgcctcccgcatgtacgccggcttacgaccagtattgtcacgatcacttccataacggccactgtgaaaaagggtgcaataccgcggagtgtgggtgggatgggggagattgcaggcccgaggacggagacccagaatggggacccagcctcgctctgctggtggtgctgagcccaccggctctagaccagcaattatttgccctggcacgggtcttatcattaactctgagagttggcctctgggttcggaaagatagggacggaagggatatggtgtatccttaccccggagcccgagccgaggagaaactgggagggactcgggaccctacctaccaagaacgcgcagctccacagacccagccactaggtaaggagacagattccctgagcgcaggctttgtcgtcgttatgggtgtcgatctgtccagatgtgggcctgatcaccccgctagtcgttgcccctgggatcccggactgttactgcgattccttgccgctatggccgctgtaggcgcacttgaaccgctgcttccagggccactcctggcagtccaccctcacgccggaacagcgccacctgcaaaccagctgccctggcctgttctctgttcccccgtggctggggtcattttactggctctaggtgcacttctcgtgctgcagctgatcaggcgtcgccgtcgtgaacacggggcattatggcttccacctggcttcacaaggcggccacgtacacagtctgccccacaccggaggaggccaccgttaggcgaggatagcattgggttaaaggcactcaaaccaaaggccgaggttgatgaggacggtgtcgttatgtgtagcggtcctgaggagggagaggaggtgggccaggccgaagaaacaggaccaccaagtacatgccagctctggtctctgtcaggcggatgcggggcattgccgcaggcagccatgttaacccctccacaggaaagcgagatggaagcaccagacctggacaccaggggcccagacggagtgactcctttgatgtccgctgtttgctgcggagaagtgcagtcgggcactttccagggcgcttggctggggtgtcccgagccctgggagccgttactggatggcggagcctgtccccaggcacatacagtaggaactggagaaacccccctccatctcgctgcacgctttagtaggcctacagctgccagacggctgctcgaagcaggagccaaccctaaccaacccgacagagcagggcgtacccccctccacgctgcagtcgccgctgacgccagggaggtgtgccagttgctcctccggtcacgtcagaccgctgtagacgcccgaaccgaggacggcacaacgcccctgatgcttgctgcaagactcgccgtggaagatctggtggaggagctcattgccgctcaggccgacgtgggggcacgtgacaagtggggcaagactgctttgcattgggcagcagctgtgaataacgccagagccgcacgctctcttttgcaggccggtgccgataaggacgcccaggataatagagaacagaccccgctgtttctggctgcgcgagaaggcgcagtggaagtggctcagcttctgctggggctgggcgcagccagggagcttagggaccaggccggactggctccagccgacgtggcacatcaacgaaaccattgggacctcctgacactcctagagggcgcagggccacctgaagctcgccacaaggccacacccggacgtgaggctggtccattccctagggcacgaactgtttccgtctctgtgccccctcatggtggcggagcattaccacggtgtagaacgctgagcgccggagccggacccagggggggtggtgcttgcctccaagctagaacatggtccgtcgacctggcagcgaggggcggaggagcatactcccactgcagatcactcagcggagtgggcgcaggtggcggtccaacaccacggggaagacgattcagcgcgggaatgcgagggcctcgccctaacccagccatcatgcgcggacgatacggagtggcagccggtaggggcggtcgtgtcagtaccgatgactggccatgcgactgggttgcactgggtgcttgtgggtcagcctcgaatattcccatccctccaccatgcttgacgcctagccccgaacgcggatcccctcagctggactgtggcccacccgcactgcaggagatgcctatcaaccagggcggtgaaggaaagaagta

SEQ ID NO: 232930 - DNA, 6011 bp, Artificial Sequence
  Description of Artificial Sequence: Synthetic coding sequence
atgcaacccccatcactactcttactccttttattactattgctgctgtgtgttagtgtggtccgtcctaggggcttactatgtggttctttccctgagccttgcgccaatggcggtacttgtctctcactatctctcggccagggaacatgccagtgcgcacctgggtttctaggagagacctgccagtttcccgatccatgccaaaacgcacaactgtgccaaaatggaggcagctgccaggcgcttcttccagcaccgctgggcttgcccagttcgccaagccccctcacacccagcttcctctgcacgtgtctgcctgggttcactggtgagcggtgccaagctaagctagaggacccgtgccctccatctttttgttccaaaagagggcgttgccatatacaggcatcgggacgtccccaatgtagctgcatgcctggatggacaggtgaacaatgccagctaagagacttttgttcagccaacccttgcgtgaacggaggcgtatgtttggcgacctacccccagatccagtgccattgtcccccaggttttgaaggtcacgcgtgtgagagggatgtgaatgagtgcttccaggacccagggccatgtcccaagggaacctcatgccacaacacattaggctctttccagtgtctgtgtcctgtcggacaggaggggccacgatgcgagctcagggccggaccttgtcctccgcgaggttgctccaacggaggaacatgccagcttatgcctgaaaaggatagtacgttccacttatgcctgtgtccgcctggctttatcggacccgactgtgaggtcaaccccgacaattgcgtctctcaccagtgtcagaacggcggaacctgccaggatggtcttgacacatacacatgtttgtgtcctgagacctggaccggatgggactgttccgaggacgtggacgagtgtgaaactcagggacccccacattgccgaaacggcggaacatgtcagaactccgcgggtagcttccattgtgtatgcgtgtctggatggggcggtacttcctgcgaggagaacttggacgactgcatcgcggctacatgcgcacccggatctacgtgtattgatagagtcggatcattttcctgtctgtgccccccagggaggactggactactttgtcatctggaagatatgtgtctttcccaaccatgccatggggacgcccaatgctctaccaacccattaacgggatccacgttgtgcctgtgtcagcctggttacagtggacccacctgccatcaagatctggatgaatgtctgatggcgcagcagggcccttctccatgtgagcatgggggttcatgtctcaatacacctggcagctttaattgtctctgtcctcctgggtacacaggttcccgatgtgaggcagatcacaatgagtgcctcagtcagccatgtcacccaggcagcacctgcctagatcttttggcgacctttcactgcttgtgcccgcctgggctagagggccagctgtgtgaggtggagacaaatgagtgcgccagtgctccatgcctgaaccatgccgactgtcatgatctcttgaacggctttcagtgtatctgtctgcctggcttcagcggcaccagatgcgaggaagacatcgatgaatgcagatcctccccgtgcgccaatggaggtcagtgtcaagatcagccaggcgctttccattgcaagtgcctcccaggcttcgaaggccctaggtgccaaaccgaggtggacgagtgcctgagcgacccttgtcccgttggagccagctgcttggacctgcctggcgcttttttttgcctgtgcccctcaggtttcactggccagttgtgcgaagtgcccctctgtgcgcctaatttatgtcagcctaagcaaatatgtaaggatcagaaggacaaggccaattgcctgtgtcctgacggtagcccagggtgcgcccctccagaggacaactgtacatgccaccatggtcactgtcaacggagctcttgcgtctgcgatgtcgggtggacaggacccgagtgcgaagccgagctgggtggttgcataagcgctccttgcgcacacggcggtacttgctacccacagccctcaggttataactgcacatgcccaaccggttatacaggccctacatgcagcgaagagatgacggcctgccatagtggcccatgcctgaacgggggatcatgtaaccccagccccggaggctactattgcacctgccccccttcacacactggccctcagtgccagacctccacagattactgcgtctctgcgccttgctttaacggcggaacgtgcgtcaacaggcctggaacattcagctgtctttgcgcgatggggttccagggcccacggtgtgaaggaaaactgcggccatcttgtgcggattccccctgtcgcaacagggccacatgtcaggactcccctcagggaccacggtgcctgtgtccgactggatataccggcggatcttgccagacactaatggacctgtgtgcccaaaagccctgtcctagaaatagccattgccttcagacgggcccttcctttcattgtttgtgtctgcagggctggactggacccctgtgtaatttgcctctcagttcctgtcagaaagctgctctttctcagggaatagacgtctcatcactgtgccacaacggaggcctgtgtgtggattcaggaccttcctatttttgccactgcccaccgggattccaaggcagtctgtgtcaggatcacgtcaacccgtgtgagtcccggccatgtcaaaacggagcgacatgcatggcacaacccagcggctacctctgccaatgcgcgccagggtacgatggccaaaattgttcgaaagagctagatgcttgccaatctcaaccatgtcataatcacggtacttgtacgcccaaaccgggagggtttcactgtgcctgtccaccagggttcgtgggactcaggtgtgagggcgatgtcgacgaatgcctggatcaaccctgccatcctacaggcactgcggcatgtcacagcctggccaacgcattctattgccagtgcctcccaggccacaccgggcagtggtgtgaggtggagattgatccttgccattcccagccttgcttccatggtggaacttgcgaggccactgccggttcacctttgggatttatctgccactgccctaaaggctttgagggtcccacttgctcacacagagctccaagctgtgggttccatcattgtcaccacggcggactatgcctccctagccctaagcccggattccctccacgatgtgcctgtctgtcaggttatggtggtcctgactgtctcacaccccctgcaccgaaaggatgcggtcccccaagcccctgcctctacaatgggtcctgttccgagacgactggtctgggcggacctgggttccgctgttcatgccctcattcatcccccggaccccgatgtcaaaagccgggagcgaagggatgcgagggcagatccggggatggagcctgcgatgccggatgttccggccctggcggaaattgggatggcggagactgcagcctgggagtgccagacccgtggaaaggctgccccagtcactcacggtgctggctcctctttcgagacggccagtgtcatccacaatgtgatagtgaggaatgtctcttcgatgggtacgattgtgaaaccccacctgcttgcactccagcctacgaccagtattgccacgaccactttcacaatggccattgcgagaagggatgtaataccgctgagtgtggctgggacggcggagattgccgccctgaggacggcgatcctgagtgggggccttccctggcgctgctcgtggtgctgagcccccctgcgcttgatcagcaactgttcgcccttgccagggtactctcgctcactctccgtgtgggcctttgggtcagaaaggaccgcgatggtagagacatggtgtatccttaccctggcgcacgggctgaggagaaattagggggtacacgggaccctacctaccaagaaagagcggcaccacagacgcaaccactgggcaaggaaacagattctcttagtgcagggttcgtggtggtcatgggcgtggacctgtcacgctgcggcccagaccacccagcctcaaggtgcccctgggaccccggactgctccttcgattcttggctgcgatggcggcagtaggggctctggagccgctgctgcctgggccattactggcggtccatccccacgccggaaccgccccacccgctaaccaactgccgtggccggttttatgcagccctgtggccggtgtcattttgttggcactgggggcattgctagtgttgcagctgatcagacgtaggaggcgcgaacatggagcactgtggctgccaccgggattcacacggaggcccagaacgcagagcgccccacaccggaggcgccctcctttgggcgaggattccatcggcctcaaagctttgaagccaaaggctgaggtggatgaagatggggtagttatgtgtagtggtcccgaggagggcgaagaagtcggtcaggcagaagaaactggcccaccttcaacatgtcagttgtggtcgctctctggcggatgtggtgcactgccacaggccgctatgctaactccaccccaggaatctgaaatggaggcgcctgatcttgacactagaggtcctgacggcgtgaccccgcttatgagcgctgtgtgttgcggggaggtacagtcgggaacgttccagggcgcatggttgggatgtcccgagccctgggagcccttgttggacggcggagcttgtccacaggcgcataccgtgggaacaggtgaaactccacttcacttagcggcacggttttctaggcctacagcggcaaggaggttactcgaagccggagccaaccccaaccagcccgacagggccggtaggacccccctacatgccgctgtcgccgctgatgcgagggaagtgtgccagctactgcttcggtcaagacagaccgcagtcgatgcccgtaccgaagacggaacaacacctctgatgttagctgccagactggccgtagaggatctcgtcgaggagctcattgctgcccaggccgacgtaggggcaagagacaaatgggggaagaccgccctgcactgggcagccgctgtgaataatgccagagctgccaggtctctcttgcaggcgggtgctgataaggatgcacaggataaccgagagcaaaccccactctttctggcggcaagggagggcgctgtggaggttgcacagttactgctgggcctcggagctgcccgagagctgagagaccaggcaggacttgctcccgcagacgtagctcaccagagaaatcattgggatctgctgactttactcgagggcgcaggacctccagaagcccgacataaagcaactccgggtcgggaggccggaccttttccacgagccaggaccgtgtctgttagcgtgccacctcatggaggaggcgcattgccacgctgccggacgctgtcagccggagctggacctcggggaggaggagcctgcttacaggcgaggacttggtccgtcgaccttgctgcacgcggaggaggcgcatattctcactgcagaagcctcagtggtgtgggcgctggaggcggtcctacccccagaggcagacgattcagcgctggtatgagaggccctcggcctaatccagcgattatgcgcggacggtacggtgtggccgctggcaggggcggtagggtgtccaccgacgactggccctgtgattgggtggcactcggcgcatgtggctccgcatcaaacataccaatccctccaccttgccttacgccttcaccagaacgaggtagtccccaacttgactgtggaccccctgcactacaagagatgcctattaatcagggcggagagggaaagaaata

SEQ ID NO: 232931 - DNA, 561 bp, Artificial Sequence
  Description of Artificial Sequence: Synthetic coding sequence
atgtccgcggtgtgctgcggggaggtccaaagtgggacattccagggagcctggcttggttgccctgaaccctgggaacctctcctggatgggggtgcctgtccacaggcccataccgtagggacaggtgaaacccctctgcatttggctgccagattctcacgcccaactgccgcacgcagactactcgaagctggcgcaaatcccaatcaacccgatcgggctgggagaacgcctctgcacgctgcggtggccgctgacgctagggaggtgtgtcaacttttgctgagaagtaggcagactgcagtcgatgccagaaccgaggatggtactacacctctgatgctggctgcacgcctggctgtggaggatctcgtagaggaattgatcgccgctcaggctgatgtgggggctcgcgataaatggggcgctgacgcagctatccccggaggtgccggtcgctcaggtggcagctccccagcaaccgcaggcgctggagggtcccctagggcagctggacctgggtgggctagcgccggtggacgcagaagccccacttag

SEQ ID NO: 232932 - DNA, 561 bp, Artificial Sequence
  Description of Artificial Sequence: Synthetic coding sequence
atgtcagctgtttgctgtggtgaggtacagagtgggacatttcagggcgcttggttgggttgtcccgaaccatgggagcctctgctggatgggggagcttgtcctcaagctcataccgtgggaaccggcgagactccactccatctcgcagctagattctctaggcccacagcagctaggaggctgctcgaagcaggcgctaacccaaaccagccagaccgggcagggcgtactccgctccacgctgccgttgcggcagatgccagagaggtatgtcagctgttgctaagatctagacagacagcggtggatgccagaacagaggacgggaccaccccactgatgttggccgcacgactcgctgttgaggacctcgtggaggagctcatcgctgcgcaggcggacgtgggggcacgagacaagtggggagccgacgccgctataccgggaggagctgggagatctggcggatcttccccagcaaccgctggcgctggcggatctccaagagctgcaggtccgggatgggcctctgcaggcggaagacggtctccgacctag

SEQ ID NO: 232933 - DNA, 561 bp, Artificial Sequence
  Description of Artificial Sequence: Synthetic coding sequence
atgagcgcagtttgctgcggtgaggtccagtccgggactttccaaggagcgtggcttggatgtccggagccctgggagcccttactggatggtggagcctgcccacaggctcacactgttgggaccggagagactcctctgcatctggctgcacgattctcaagacccacagcagcaaggcggctgctggaggccggagcaaatccgaatcaacctgaccgagctggtcggaccccgctgcatgccgcagtggctgcagacgcccgagaggtgtgccagttgcttctaagaagcagacagacggctgtagacgccaggactgaagatggtactacaccattgatgctggcggctcggctggccgtggaagatcttgtagaggaactgatcgccgctcaggcagacgtgggggcacgcgataagtggggggcagatgcggctattcctggaggcgcaggtcgcagtgggggtagttcccccgcaacggctggtgccggaggatcgccgagggccgcaggcccaggatgggcttcggccggaggaaggcgaagtccaacctag

SEQ ID NO: 232934 - DNA, 561 bp, Artificial Sequence
  Description of Artificial Sequence: Synthetic coding sequence
atgtccgcagtgtgttgtggtgaagtacagtccggaacctttcaaggcgcttggctgggatgccccgaaccgtgggaaccgctgctggacgggggtgcgtgccctcaggctcataccgtgggaactggggagactccactccatctggctgcacggttctcacgcccaactgcggctcgcaggctgctcgaggccggagccaatccgaaccagcctgatagggctggaagaactcccctacacgcagcagtagccgctgacgctagggaggtgtgtcaattgttgctacggtccaggcagactgctgtggacgcacgaacagaagatgggacaacaccgcttatgttggcagctaggctggctgtagaagatctggtggaggagctaatagcagctcaagccgacgtcggagcaagggacaagtggggagcagacgcagcgataccaggaggagccggacggtccggcggatcttcacccgctacggctggggctggcggaagccccagagctgccggtccaggatgggcatccgctggcggacgtagatcccccacatag

SEQ ID NO: 232935 - DNA, 561 bp, Artificial Sequence
  Description of Artificial Sequence: Synthetic coding sequence
atgagtgccgtgtgctgcggtgaagtgcaaagtggaacattccaaggggcttggctaggctgcccggaaccatgggagcccctgctagacggcggtgcttgtccacaggcccatacagtggggacaggcgagaccccactccacctcgcagccagattttcacgtcccactgcagcacggaggcttctcgaggccggagctaatcccaaccaaccagatcgggcagggaggactccattgcacgctgccgtcgcggctgatgctagggaagtctgccagttgctgctcagatcaagacagaccgccgtggatgcgcgtactgaagatggaacaactccccttatgttggctgccaggctggccgtggaggacctggtggaagagctcatcgctgcacaggccgacgttggagctagggacaagtggggcgcagacgcggcaattccaggcggagcagggcgtagtggcggatcttctcctgccaccgcaggggctgggggatctcctcgcgctgccggacctggatgggcatccgcagggggaaggaggtctcccacctag

SEQ ID NO: 232936 - DNA, 1491 bp, Artificial Sequence
  Description of Artificial Sequence: Synthetic coding sequence
atgggaaggggtgttagggtcttgcttttgttgtcccttctgcattgcgctggcggatcagaaggcagaaagacatggcggcgacgcggacagcagcctccgccacccccacgcactgaagcagctcctgctgctggtcagcctgtggagtccttccccttggatttcaccgccgttgaggggaatatggactcttttatggctcaggtgaaaagtttagctcagagcctgtacccatgtagcgcccagcagctgaacgaggacttgcgtctgcacttgctccttaatactagcgtcacctgtaacgacggttcgcctgccggatactacctgaaagagagcaggggttcacggcgttggctcctttttctggagggaggttggtactgtttcaacagagaaaactgcgatagcaggtacgataccatgaggagattgatgtctagtcgtgattggcctaggactcggacgggcactggaatcctttcctctcagcctgaagaaaacccatactggtggaacgcaaatatggttttcatcccatactgctcctcagatgtgtggtccggtgccagttctaaaagcgagaagaatgagtacgcctttatgggggctctgattatccaagaggtcgtccgcgagctgctaggtagaggacttagtggagctaaagtgttgctgttggctggttccagcgccggtggaacaggcgtattgttgaatgtcgaccgcgtggccgagcaattagaaaagctgggatacccagccatccaggtgcggggactggctgattctggctggttcctggataataaacaatatagacacaccgattgcgtcgatacaattacgtgcgcaccaaccgaagctatccgacgcggaatcagatattggaacggcgttgtccccgaaaggtgtaggagacagttccaagagggtgaggaatggaattgtttttttggctacaaagtttacccgacgctccgttgtcctgtatttgtggtgcaatggctgttcgatgaagcacaacttacggtcgataatgttcatctgacagggcaacctgttcaggaaggcctacgcctgtacatccaaaatctagggagggagctgcgccacaccttaaaggacgtgcccgcatcctttgctccagcatgtctgagtcatgagatcattatacggtcccactggacagacgttcaagtcaaagggacctccttgccaagggctttacactgctgggacagatccctgcatgacagtcataaggcatccaagacccccctgaaaggatgcccggtgcacctagttgactcctgcccctggccacattgtaacccttcttgtcccactgttcgcgaccagtttacaggccaagaaatgaacgttgcacaattccttatgcatatgggatttgacatgcaaaccgttgctcagcctcaggggctggagccttctgagctgctcggcatgctcagtaatgggtcctag

SEQ ID NO: 232937 - DNA, 888 bp, Artificial Sequence
  Description of Artificial Sequence: Synthetic coding sequence
atgggaagaggggtccgggtccttctgttgctgagcctgctgcactgtgccggaggatcagaggggcgtaagacctggagacgccgaggccaacaaccaccaccgcctccgaggaccgaggccgcaccggcagcaggacagccagtggaaagttttccactggacttcaccgccgtggagggtaacatggactcattcatggcccaggtgaagtctcttgcccagagtctctatccttgcagcgcccagcaacttaacgaggacctgagactacatcttctgctgaatacgagcgtgacttgcaacgatggatctcccgcagggtactatctgaaggagtcaaggggctcccgccgttggctgctattcctcgagggcggttggtattgttttaatcgggaaaattgcgacagccggtacgacactatgcggagacttatgagcagccgagattggccaaggaccaggaccggtacggggatcttaagcagccagcctgaggaaaatccttactggtggaacgccaacatggtgttcattccttattgcagcagtgacgtatggtcgggtgcaagcagcaaatctgaaaagaatgagtacgccttcatgggcgctctgataatccaggaggttgttcgtgagcttctgggacgaggtctcagtggcgctaaggttctccttctcgccggaagttcagcagggggaacaggggtactgctgaacgtggatcgggtagcagagcagttggaaaaattgggttaccccgctatacaggttcggggactcgctgactctgggtggtttctcgacaataaacagtatcggcacaccgactgtgtggacactatcacttgtgctccaactgaagctattcgacgtggaatctag

SEQ ID NO: 232938 - DNA, 4080 bp, Artificial Sequence
  Description of Artificial Sequence: Synthetic coding sequence
atggcagaggcaggcttacgagggtggctgctctgggccctgctgttgcgtttagcacagagcgagccatacacgactatccatcagccagggtattgcgccttttatgatgagtgcggtaagaatccagagctatccggctctttgatgacactctccaacgtaagctgtctgtccaatacaccagccagaaaaataacaggcgaccacctgatcttgttgcagaagatctgcccgcgtctttacaccggacccaatacacaggcttgctgtagtgccaagcagctggtctccctggaggctagcctatccattacgaaggctctcttgacccgttgccccgcttgttcagacaatttcgttaatttgcattgtcataatacctgttctcctaatcaatctcttttcatcaatgttactcgcgtggcacagcttggagcaggccagcttcctgcggtcgtggcgtatgaagccttttaccagcacagctttgctgagcagagttacgactcttgttccagggtgcgtgttccagccgcagctaccctagcagtcgggaccatgtgtggcgtgtatggatcagccctatgtaatgcccaacgctggcttaatttccagggtgatacgggaaacggactggctcccctggacatcacttttcatcttttagagccagggcaggctgtgggctcggggatccaacccctgaacgaaggagttgcgcgatgcaacgagtcccaaggggatgatgttgctacttgctcatgccaggattgcgctgcatcgtgccccgcaattgcaaggcctcaagctctggactcaactttttatctcggccagatgcccggaagtctggtgctgatcattatactctgctctgtcttcgccgttgtgacaattctgctggtgggctttcgagttgcacccgcacgggataagagtaaaatggttgatcccaagaaaggtacttccctctccgacaaacttagcttctctacacatacactcctggggcagtttttccaagggtggggtacttgggttgcaagctggccactcactatcttagtcctgtctgtaattccggtagtggcactggccgcaggactggtgttcaccgaactgacaaccgaccctgtggagctgtggtcagctccaaacagtcaggcacggagcgagaaagccttccacgaccagcattttggcccattctttcgcacaaatcaggtgatcctgacggcgcctaaccgcagctcataccgttatgatagtctcctgctgggtccaaagaatttctccggcattctcgacctggatctactgctggagctgctggagcttcaggaacgcctacgacacctccaggtttggagtccagaggcacagcgtaatatatcactccaggacatctgttacgctcccttgaaccccgataatacaagcctttacgattgttgtattaacagcttactacagtactttcagaataatcggacgctcctgctgctgactgctaaccagacgctcatgggacagaccagccaggtcgactggaaggatcactttctttattgcgcaaatgcacctctcactttcaaagatgggaccgccctggctctgtcttgcatggccgattacggcgcacctgtgtttccttttctagccatcggcggttataagggcaaggattattctgaggcggaggccctgataatgactttcagcttgaacaactaccctgccggagatcccagactcgctcaggctaagctgtgggaggaggcgtttcttgaggaaatgcgcgcttttcagagacgcatggcaggtatgtttcaggttacatttatggcggagagatctctggaggacgaaattaatcgcacaacagctgaagatctccccatcttcgccacatcctatatagtgatcttcctctatatatctctcgccctgggatcatacagcagttggtcgcgcgtaatggtggactctaaggccaccctaggattgggaggcgtggcggtcgtcctgggagccgttatggctgctatggggttttttagctacctggggatccgttcaagcctggttatcctgcaggtcgtaccgtttcttgtcctgtcagttggagctgataacatttttatcttcgtgttagagtatcagaggctgcctcggcgacccggtgagccccgagaggtccatataggcagagccctcgggagagtggcgccttccatgctgctgtgctcactctcagaggctatatgctttttcctgggtgcccttaccccgatgcctgctgtccgtacattcgcgcttacatctgggcttgcagtgatacttgattttttgttgcagatgtcagctttcgtggccctgctatcactcgacagtaagcggcaggaggctagtaggctggacgtgtgctgctgcgtgaagcctcaagagttgccgcctccgggacaaggcgaggggctgctcttaggattcttccaaaaggcatatgccccattcctgctgcattggatcacgaggggcgttgtactgctgctgtttcttgctctttttggggtctccctatactctatgtgccacatttcagtgggcctggatcaggaactcgcactgccgaaggactcttatctcctcgactatttcttatttctgaaccgctatttcgaggtgggagctcccgtgtactttgttacgacgttaggatataatttcagctccgaggctggtatgaacgcaatctgtagcagcgctgggtgtaataatttttcattcacacagaaaattcagtacgcaacagaattcccagagcagtcataccttgctatacccgcatccagttgggtagatgacttcattgattggttgacaccttcctcctgttgtagactttatatatccggccctaataaagataaattctgtccatctaccgtgaactccctgaactgcctgaaaaattgcatgtcaatcactatggggagtgtccgtccttctgtggaacagttccataagtatctaccctggttcctgaatgatcgacccaatattaaatgccctaaggggggactcgccgcatattctacatctgtgaatttgacctccgatgggcaggtactggataccgttgccattctaagtcctcgattggaatacagtggcacaataagtgctcattgcaatctgtacctactcgacagtacatctagattcatggcgtaccacaaaccattgaagaactctcaagactatactgaggctctcagagcagccagagagctggctgccaacattacagcagatttgcgtaaagtgcccggaaccgaccccgctttcgaggtgttcccatataccataaccaatgtgttctatgaacaataccttacaattctcccggaaggactgtttatgctttccttatgtctggttcctacttttgcggtcagctgcctccttcttggcttggatttgaggagtggcctgctgaatcttttgtctattgtgatgattctggtggatactgtggggttcatggcactgtggggtatttcctacaatgccgtatctctgataaacctcgttagtgccgtgggtatgtcagtagaattcgtttcccatatcacaaggagttttgccatatccacgaagcctacttggcttgagagagcgaaggaggcaacaatcagcatgggcagcgcggtattcgctggcgtcgcaatgaccaatttgccaggaattctggtactgggattagcgaaggcgcagctgatccagattttcttttttagactgaacctgctgattaccctgctgggcttgctccatggcctggtcttcctgcccgtcatcttgagctacgttggcccagacgttaatccagccctggcattggaacagaaaagagcagaagaggcagtagccgcagtgatggtggctagctgccctaaccaccctagtagggtgtctactgctgataatatctacgtcaatcactccttcgagggcagcatcaaaggtgctggtgctattagcaattttctgcccaacaatggaagacaattttag

SEQ ID NO: 232939 - DNA, 3999 bp, Artificial Sequence
  Description of Artificial Sequence: Synthetic coding sequence
atggcagaagcgggtctgaggggatggctcctgtgggccttgctgctgcgccttgcccagtctgagccatataccactatccatcagcccggatattgcgccttctatgacgagtgtggtaaaaatccagaactcagcggcagccttatgaccctttccaacgttagctgcttgagtaacaccccagctcgcaaaatcaccggcgaccacctgatactgctgcaaaagatttgccctcgcctgtacacagggccaaatacccaggcttgctgtagcgccaagcaattagttagtctagaagcctctctgtccatcactaaggctctgttaacacgctgcccagcctgttcggacaattttgttaacctgcactgccataatacctgttcaccaaaccaaagtttgtttattaatgtgactcgagtcgcccagctgggtgccggacagctacctgctgttgttgcctatgaggctttttatcagcactcatttgcagaacagtcatatgattcttgttccagagtacgggtgccagccgcagccaccctcgcagtgggcacaatgtgcggcgtatatgggtcagccctttgcaatgcccaacgctggctgaatttccagggtgataccggcaacggattggcaccactggatataacttttcacctcctggagccaggtcaggctgtcggaagcggcatccagcccctgaatgagggcgtggcccgatgcaatgaatcccagggagacgatgtggcgacctgtagttgtcaagattgcgccgcttcatgccctgctattgccagaccccaggccttggacagcaccttttatctaggacagatgcccggaagcctggtcctgatcattattctgtgcagcgtgtttgcagtggtgactatcctcctggttgggttccgcgtggcgcctgccagggacaaatccaaaatggtggatcctaagaagggcacatcactgagtgataaactgtccttcagtacacatacacttctggggcagttcttccaggggtggggcacttgggtcgcctcatggccattaaccatcctagttctttccgttatccccgtggtggctctcgcagctggtctggtgtttactgaattgactaccgatcctgtggagctctggtctgctcctaactcacaggcccgaagtgaaaaggctttccatgaccagcatttcggacccttttttcgcacaaaccaggtcatacttaccgcccctaaccgaagctcgtaccgttacgacagtctgctgttgggtccgaagaacttcagtgggattctagacctggatctcctgctggagctgctggagttacaggagcgcttgcgacatttacaggtctggagcccagaggcccagcgaaatatctctcttcaggatatttgttacgccccactgaacccggacaacacctcactgtacgactgttgcatcaacagtttgctccaatatttccagaacaacagaaccctgctcctgctgaccgctaatcagactttgatgggccagacgtctcaagtcgattggaaggatcatttcctgtactgcgctaacgcccctcttactttcaaggacggcaccgcgctcgcgctaagctgtatggctgactatggcgctccagtgttcccctttctggccatcggcggttataaaggcaaggattacagcgaggccgaggcactgatcatgacgttcagcttaaacaattatccagccggtgatccgagactggcccaggcaaaactgtgggaagaggcttttttagaggagatgagagccttccagcgtcggatggccggaatgttccaggtcacattcatggctgagagaagcctggaggacgagatcaaccgaactaccgctgaagaccttccaatttttgcgactagttacattgtgatattcttgtatatcagcctcgctctagggagctactcttcctggtcccgagttatggtcgatagtaaggccaccctcggtctcggcggtgtggccgtggtcttgggcgcagtcatggctgccatgggattctttagttacctgggcatccgaagttctctggtgattctgcaagtggtcccattcctggtgctatctgtgggagctgacaacatctttatatttgtcttggaatatcagcgcctgccaagaagacctggggagcccagagaggtccacattgggcgagctctgggtcgcgtcgccccatccatgctgctctgcagcctcagcgaagcaatctgttttttccttggagcactcactcctatgccggctgtgcggacatttgctctgacttcaggcctggccgtcattcttgattttctcctccaaatgagcgcgtttgtggcccttctctctctggacagtaagaggcaggaggcatctcgattagatgtgtgttgttgcgttaaaccacaggagttgcctcccccaggacaaggagaaggcttgctgcttggtttcttccaaaaggcttacgcgccattcctgttgcactggataacccgcggagtggtgcttttgttgtttttggctctctttggagtttccctttactctatgtgccacattagtgtcggactggaccaggagctcgcactgcccaaagattcgtatctgctcgattatttcctctttcttaaccgttactttgaggttggcgctcctgtttacttcgtcactaccctcggctataattttagctcagaggcagggatgaacgcaatctgcagcagcgctgggtgtaacaacttctccttcacgcagaagatccaatatgccacggagtttccagagcagtcttaccttgctatcccagcgagctcgtgggtcgatgatttcattgactggctgaccccgtccagttgctgtaggttgtacatttctgggcctaataaagacaaattctgtccctccacggttaatagtcttaactgcctaaagaattgtatgagtatcaccatgggttcagtgcgaccctctgtcgagcagtttcataaatacttgccttggtttttgaacgatcgaccaaatatcaaatgcccgaagggcggtttggccgcatattctacaagtgtgaacctaacctcagatggtcaggtgctcgcttcccggtttatggcttatcataagccattaaaaaatagccaggactataccgaggcccttcgagccgctagagaactggcagcaaacattacagccgatctgagaaaggtgccaggcaccgaccctgcattcgaagtctttccttatacaatcactaacgtgttctacgagcaatatctgactatattgccggagggactgtttatgctgagtctttgtctcgtccctacctttgcagtgtcttgtctgcttcttggactcgatctgcggtcaggcctgctaaatctcctgtcaatcgtgatgatcctggttgacacagtcggattcatggccctgtggggaattagttacaacgccgtcagcctgatcaatctggtgtccgctgttggtatgtctgtggaattcgtctcccacatcactcgaagtttcgccatttcgactaagccaacgtggttggaacgtgctaaagaggcaacgatcagcatgggctctgctgtgtttgctggggttgccatgaccaacctgcccggaattttggtattgggtctagccaaggctcaattgatacaaattttcttctttagacttaatctcttaattaccctgctcgggctgctgcacggtctcgtttttctcccggtgattttgtcctacgttgggcctgacgtgaacccagctctcgctctcgaacagaagcgggctgaggaggctgtggcagcggtgatggtggccagttgtcctaaccacccaagccgagttagcacggcagacaatatctacgtgaatcactccttcgaggggtctattaagggggctggcgctatctcaaactttttgccaaacaacggtcgccagttttag

SEQ ID NO: 232940 - DNA, 3861 bp, Artificial Sequence
  Description of Artificial Sequence: Synthetic coding sequence
atggcggaggctggtctcagaggttggctgctgtgggcactcctgctccggctcgcccagagcgagccctacaccacaattcaccagccagggtattgcgctttttacgatgaatgtggcaaaaacccagaactgagtggcagcctgatgaccctgtcaaacgtgagctgcctatccaacactccagctcgcaaaatcactggcgaccatctgattctgctgcagaaaatctgtcccagactgtataccggccctaacacgcaggcttgctgctcggctaaacagctggtgagtttggaagctagtcttagcatcacaaaggccctccttacccgatgcccggcttgtagtgacaacttcgtaaacctccactgccacaacacgtgtagcccaaaccaatcccttttcatcaacgtgaccagggtcgcccagctgggcgcaggccagctgcctgcagtggtggcgtatgaagccttttatcagcatagctttgcagaacaatcatatgactcttgttccagagtcagggtgcctgcagctgccacactggctgtgggcactatgtgcggcgtgtatggttctgccctttgcaacgcacaacgttggctcaactttcagggcgatactggcaacggcttggccccactggatataacattccacctactggaacccggtcaggctgtcggaagcggcatccagccgctaaatgaaggcgtggcccgttgcaatgagagtcagggtgatgacgtggcaacatgctcatgtcaggactgtgccgcatcctgtccagctatcgctcgaccccaggcactcgactctactttctatttgggacagatgccgggatctctggttctaatcatcattctatgtagcgtgttcgccgtcgtcacaattctgttggtcggattccgtgtggcccctgccagagacaaaagcaagatggtggaccctaaaaaaggcaccagcttaagcgacaagctgtcattcagcacccatacacttctgggtcagttcttccagggctgggggacctgggtggcctcgtggcctttaaccatcttggttctctcagtcattcctgtggtggctctggctgcgggattagtgtttaccgaacttacgacagaccctgtagagctgtggtcagccccaaacagccaggccaggtctgagaaagcattccacgatcagcattttgggccttttttcaggaccaaccaggtaatattgaccgcccctaaccgctcctcctataggtatgactctctgttattagggccaaagaactttagcggtattctggacctggatctcctgctggagctcttggagctccaggaacggctccgacatctgcaggtctggtctcctgaggcccaaaggaacatctccctccaggatatttgctacgcgccactcaacccagataacacatcactttacgattgttgtatcaacagtttgctgcagtactttcagaataaccggactctactcctactgacggcaaatcagaccttgatggggcagacgagccaggtggactggaaagaccactttctatattgtgccaacgcaccactcacttttaaagacggtactgccctagctctgagctgtatggcagactacggcgcaccagtgtttccctttctcgcaatcggaggttacaagggaaaagattactctgaggcagaggccctgatcatgacgttttccctcaataattatcccgctggggaccctcgattagctcaggccaaactttgggaagaggcctttcttgaggaaatgcgggcttttcagagaaggatggcagggatgtttcaagtaacattcatggccgagagaagcctagaggacgaaataaatcgaacaaccgctgaagatctgcctatctttgctacctcatacatagtgatcttcctttacattagtctggctctgggcagctattcttcttggtcccgcgtgatggtggatagcaaggcaacactggggttgggcggtgtcgctgtcgtgctgggagccgtcatggccgcaatggggttcttcagttatcttggcatcagaagctcactggtcatcctgcaagtcgtcccctttctggtgctcagtgtgggggcagataacattttcatcttcgtactggaataccagcggctgcccagaagacctggcgagccccgagaggttcacatagggagggccctcggtcgagtcgcaccgagtatgctgctctgttctctgagcgaggcaatatgcttctttttgggcgcactgacgccgatgcccgctgtcaggacgttcgccttgacctcaggcctggccgtgatcctcgattttctgctgcagatgtcggcatttgtggcgctgctcagccttgactctaagagacaggaggcatctcggctcgacgtatgctgttgcgtcaaaccgcaggagctgccacctcctggacaaggcgaggggttgcttcttggctttttccagaaggcgtatgcaccgtttctgcttcactggattacccggggtgtggtggtgggagccccagtgtatttcgtcacaacattggggtacaacttcagtagtgaagcagggatgaatgcaatctgcagttcagccggatgtaacaacttctcatttactcagaagatacagtatgcaactgagtttcctgaacagtcttatctcgccataccagcttcctcgtgggtggatgactttattgactggttgacaccttcaagttgctgcagattgtacattagcggccctaataaggacaaattttgcccgagcacagtgaatagcctgaattgcctaaagaactgtatgagtatcaccatgggatcagttagacccagtgtggagcagtttcataagtatctgccctggtttctgaacgaccgaccaaatatcaagtgcccgaaaggcggtctggccgcttatagtacttcagtcaatcttacatccgacggtcaggtgttggcgtccagatttatggcgtatcataagccgctgaagaactctcaggactacaccgaggcgttacgcgcagctcgcgaactggcagctaacatcactgctgatctgcgcaaagttcccggtaccgatcccgcattcgaggtttttccctacaccattaccaatgtcttctacgaacagtacctcaccattctcccggaaggtctattcatgctgagtctatgtctcgtaccaacattcgcggtgtcttgtttgctcctagggctggatcttcggagtggactgctgaatcttttatccatcgtcatgattttggtcgacactgtcggattcatggcactctgggggatctcatacaatgccgtgagcttgatcaaccttgtcagtgctgtcgggatgagcgtagagttcgtgtctcacattaccagatcattcgccatctctaccaaaccgacatggctagaaagggcaaaagaagcaaccatctccatggggtctgcagtgtttgcaggagtcgctatgacaaatctgcccggtattctggttttgggtctggcaaaggcccagctgatccagatcttcttctttaggctcaaccttcttatcaccctgctcggcctgctccatggtctggtttttctccctgtgattctgagctatgtgggaccagatgttaaccccgctctcgctctggagcagaagagggctgaagaggccgttgccgctgtgatggttgctagttgccctaatcaccccagccgtgtgagcacagctgacaacatctatgtgaaccactcttttgagggatctattaaaggggctggggctatatccaatttcctgccgaacaatgggaggcagttttag

SEQ ID NO: 232941 - DNA, 783 bp, Artificial Sequence
  Description of Artificial Sequence: Synthetic coding sequence
atgccacagaacgagtacatcgagcttcacaggaagcgctacggataccgtctggactatcatgaaaagaaaaggaagaaggagtcccgtgaagcgcacgagaggagcaagaaagccaagaagatgattggactgaaggctaaactttaccataagcagaggcacgctgagaaaatacagatgaagaaaacgatcaagatgcatgaaaagcgcaacaccaaacagaagaatgacgagaaaacgccccaaggtgccgtgcccgcatatctccttgatcgggaggggcagtcccgcgcaaaggtcttgtctaacatgattaaacagaaacgcaaagagaaagcaggcaaatgggaggtgccactcccgaaagtgagggcccagggagagaccgaggttctgaaagttattcggacagggaagcgaaaaaagaaggcctggaaacgtatggtaacgaaggtttgtttcgtgggagacgggtttacacgaaagccacccaagtatgagagatttatccgcccaatgggcctcaggttcaagaaagctcatgtgacacacccggaactgaaggcaacattctgcttgccaatcctgggtgtgaaaaagaacccttcatctcccttatacactacacttggggtgattactaaaggcacggtcatagaagtgaatgtcagtgagctcgggctggtaacgcagggaggtaaagtaatttggggaaagtacgcacaagttactaacaatcctgagaatgatggctgcataaacgcggtactcttagtttag

SEQ ID NO: 232942 - DNA, 1509 bp, Artificial Sequence
  Description of Artificial Sequence: Synthetic coding sequence
atgagttgccctgtacctgcatgctgtgctttattattagtactgggactttgtagagcacgcccacgcaacgctctactcttgctggcagacgacggcggattcgaatcaggagcgtataataactccgccattgccaccccccacttggacgctctggctcgcaggagcttactttttcgcaacgcattcacgtcagtcagttcctgctcgccctctcgagcatccctactcacaggtctacctcagcaccagaacggcatgtatggcctccatcaggatgtgcaccattttaactcttttgacaaggtcagaagcttgcccctgttactgagccaggccggtgtccgaactggcattattggaaagaaacacgtcggccctgagaccgtataccccttcgatttcgcttatactgaggaaaatgggagtgtcctccaggtcggcaggaacattacaaggattaagctgctagtgcgcaaatttctgcaaactcaggatgaccgcccttttttcctgtacgtcgcattccatgaccctcatcgttgcggccacagtcagccccagtacggcacattttgcgaaaagtttggtaatggcgaatctggcatgggacggatcccagactggactcctcaggcatacgatccactcgatgttcttgtgccttactttgtacccaacacccccgcagccagagcggatctggcagctcagtatacaactgtcggaagaatggaccagggggttggccttgtgctccaggaactgcgagatgcgggagtgttgaatgatacactggtaatttttacctctgacaacggaatccccttcccttctggaagaacaaacctgtactggcctggtacagccgagccccttctggtcagtagccccgaacaccccaagagatggggacaggtctctgaggcctacgtgagcctgctggatttgacacctacaattctggactggttcagcataccatatccgtcctatgctatattcggctctaagacaatccatctgacaggccgatctttgcttccagccctggaggctgaacctttgtgggcaacggtgttcggcagccaatctcaccatgaggtaaccatgtcctatcctatgagaagcgtacagcatcgacattttcgactggtacacaatcttaactttaagatgcccttcccaattgaccaagatttctacgtgtcccccacgttccaggatctgctgaaccgaacgaccgcaggccagcccactggttggtataaagacctcagacattactactatagagctcgctgggagctctacgaccgatcccgggacccacacgaaactcagaatctggccaccgaccccaggttcgcccaacttctggagatgttacgggaccagcttgcaaagtggcagtgggagacccatgacccctgggtgtgcgcgcctgacggtgtgcttgaggagaagctcagcccccagtgccagcctctgcacaacgagctgtag

SEQ ID NO: 232943 - DNA, 900 bp, Artificial Sequence
  Description of Artificial Sequence: Synthetic coding sequence
atgggccgaataccagactggactcctcaggcttacgatcctctggacgtcttagttccgtattttgtgcccaacaccccagccgcaagagcggatctggctgctcagtacacaacggttggcagaatggaccagggtgttgggcttgtgctccaggagctgcgagatgccggagttctgaacgatactcttgtcatctttactagtgacaatgggattccattcccctccggccgaaccaatctctattggccagggactgcggagcctcttctggtgtcaagccccgagcacccaaaaagatggggccaggtctccgaggcatacgtgagcctcttagatctgacgccaacaatcctggactggttctcgattccatacccgagctacgccatttttggcagcaagacaattcatctaacagggcgatcgctacttcccgctctggaggcggagcctctctgggcaacggtctttggatcgcagtcccaccatgaggttaccatgtcctatccaatgcgaagtgtgcaacaccgccactttaggttagtccacaacctgaacttcaaaatgcccttccccatagatcaggatttctatgtgtcccctacctttcaagatcttttgaaccggacaacagccggtcagccaaccgggtggtacaaggatctccgccactactactacagggccagatgggagctgtacgaccgcagtcgcgatccacacgagacccagaatctcgccaccgatcctaggttcgcccagcttctggagatgctacgcgatcagctcgccaagtggcaatgggagacacacgacccttgggtgtgtgccccagatggcgtcctcgaggagaagctaagccctcagtgtcagccactgcacaacgagctgtag

SEQ ID NO: 232944 - DNA, 618 bp, Artificial Sequence
  Description of Artificial Sequence: Synthetic coding sequence
atgtcatgcccagttcccgcatgttgtgccctgctgctggtactagggctttgccgggcaagaccaagaaacgccctgctcttgctagcagatagggctctgtcagtgagtcatctgactcaacgaatgacagaggctctgagagttgccagaacaaccacagctcctagcccccctcgaacctggacaccttggccagcggcagcatcgagttttgctatgccaagcccgaggtccgccgctgctctgcccgctgccccagcttccagccttgcctgcccatccattcgaatgggctgcaccggttgcaccagaacatgcaccacttccacgccatccactcgttgcggcgcttgtaggtgctgctctgcaaagcttgtgtgtgcccaagcctcaagtggccgttctacttggggcaggcgcccatgcactaggctgaccctccggacaagacgcagaatggcaccgtccagcaggtgggggggaaccagccttgaattatcctgttcaagcggcaattcttgtcggctgcgaatgacagggctctcctccagcacctcaccctccactaccccaacactgtgggcactgccagccccagtcagaaatctgctctag

SEQ ID NO: 232945 - DNA, 1191 bp, Artificial Sequence
  Description of Artificial Sequence: Synthetic coding sequence
atggcctgcgctggcttgcttaccgtttgcctgctcaggcctcccgctccccagccccagcctcagacccctaggcaccctcagttggcccctgatcccggacctgcaggacataccctctttcaggacgtttttcgtagagccgacaaaaacgacgacggtaaactctctttcgaggagtttcagaattacttcgccgacggcgtcttaagtctgggagaattgcaagaactgttctctggtatcgatgggcaccttacggataacctcgagacagagaaactatgcgactattttagcgaacacctcggggtgtatcgtccagtgctggccgcacttgaaagcctgaatcgcgctgtgctggccgctatggatgcaaccaagttagaatacgagagggcatctaaggtggatcagtttgttacgcgctttctgttgagggagaccgtgagccagctgcaagccctgcagagctccttggaaggcgcttctgatactctcgaggcccaggcacatggctggaggtccgatgctgagtccgtagaggcccagtcccgtctgtgcggcagcaggcgcgcaggcaggagagctctgcggtccgtctcgcgctcctctacatggtctcccggatcatccgataccggtagaagtagcgaagccgagatgcagtggcgccttcaggtgaacaggctgcaggaactcatcgatcagctagagtgcaaggtgcgagctgtgggtccgggtcctcacaaaggcggtcctagttggtatcccccagagcccggaccatgttggcgcccaggcccacacagtgtacctagtcaggccccacggctcgaacccctccgagaggaggatctggcgaaagggcctgacctgcatatccttatggcccagcgccaggttcaggttgccgaggaggggcttcaggacttccatcgcgcacttaggtgttacgtggattttaccggcgcacagtctcactgtcttcacgttagtgctcagaaaatgcttgacggggcttccttcactctctatgaattttggcaagacgaggcatcatggcgcagacaccagcagtctcccggttccaaggcatttcagagaatcttgattgaccatttgagggccccagataccctgaccactgttttcttccctgcatcttggtggattatgaataataactag

SEQ ID NO: 232946 - DNA, 1089 bp, Artificial Sequence
  Description of Artificial Sequence: Synthetic coding sequence
atggcctgcgccggattgctcactgtttgccttctgagacctcctgctccccaacctcagccgcagactccgcgtcatcctcagcttgcaccggatccgggtcctgcagggcacaccctgtttcaggatgtcttccgaagagcggataaaaacgatgacggaaaactcagctttgaggaatttcagaactacttcgccgacggcgtgctgagcctgggggagttacaggaactgttcagcgggattgacggccacctgacagacaatttggaaacggagaagctctgtgactatttctctgaacatctgggagtgtacagaccggtgctggcagcccttgagtctctaaaccgagccgttcttgccgctatggatgcaaccaagctggaatatgagcgggcaagcaaggtggaccaattcgtgacgagatttctgctgcgcgagaccgtaagccaattacaagccctacaatctagtcttgagggagccagtgacaccctcgaggcacaggcacacgggtggcgaagcgatgcagaaagcgtggaggctcagtctcgcttgtgtgggtctagacgggctggcagaagggcacttaggtccgtttcaagaagtagcacttggtctcccggtagttctgacacaggcagatcttcagaggctgagatgcagtggcggctgcaggtcaacaggttacaagagctgattgaccaactcgaatgtaaagctccccgtctggagcccttacgcgaggaggatctggctaagggacccgatctgcacattctgatggctcagaggcaggttcaggtggcagaggaaggactgcaggactttcatcgtgcgttgcgctgctacgtcgactttacaggtgcacagagccattgcctgcacgtctctgcacagaagatgctggacggcgcttctttcacactgtatgagttctggcaagacgaagcatcttggagaagacaccagcagagccccggtagcaaggcattccagaggatcctgatcgaccatcttagggcccctgataccctcaccacagttttttttcccgcttcttggtggattatgaacaacaactag

SEQ ID NO: 232947 - DNA, 870 bp, Artificial Sequence
  Description of Artificial Sequence: Synthetic coding sequence
atggcctgtgccggactgcttactgtatgcttgttacgcccacccgctccacagccacaaccacagacccctcggcaccctcagctggcccctgaccccggtccagctggacatacactcttccaagacgtgttccgcagggccgataagaatgacgacggaaagctatcatttgaagaatttcagaactacttcgctgatggcgttttgagcctgggcgaactccaagaattgttttcagggatcgacggccatttgaccgacaacctggaaactgagaagctctgtgactatttctcagaacacctcggagtttataggcccgtacttgccgcactggagtctctcaatagagcagtgctggcggctatggatgctacgaagctcgaatatgaaagggccagcaaagtggaccagtttgtaactagatttctgttgcgcgaaactgtcagtcaactgcaggctctacagtccagccttgaaggcgcaagtgataccctcgaagctcaggcccatggttggcggagcgacgcagaaagtgtggaggctcagtcgaggctctgcggctcccgacgggcaggcagaagagctctgcgaagcgtgtcaagaagctcaacgtggtcccccggatctagcgatacaggacggtcctctgaagccgaaatgcagtggcggctgcaggtgaacagattgcaggagttgatcgaccagctggagtgtaagcatatcctcatggctcagagacaggtgcaggttgctgaagagggtttgcaagacttccatagggcactgaggtgttatgttgacttcactggtgcccagtctcattgtctgcatgttagcgcccagaaaatgctcgacggtgcctag

SEQ ID NO: 232948 - DNA, 423 bp, Artificial Sequence
  Description of Artificial Sequence: Synthetic coding sequence
atggcttccgttgactttaagacgtacgtggaccaggcatgccgggctgccgaggagtttgtgaacgtgtactataccacgatggacaagcgcagaagactgctaagtcgcctgtatatgggtacggccacactagtgtggaatgggaatgctgtgtcaggccaggaaagcctgtctgagttctttgagatgctgccctcgtctgagttccagattagcgttgtcgactgtcaaccagtgcacgacgaggcaaccccaagccaaaccacggttctcgtggtcatctgtgggagcgtcaagttcgagggtaacaagcaaagagactttaatcagaacttcattctcaccgcccaggcaagcccttcaaataccgtttggaagatagcaagtgactgtttccgcttccaagactgggccagctag

SEQ ID NO: 232949 - DNA, 984 bp, Artificial Sequence
  Description of Artificial Sequence: Synthetic coding sequence
atggctgtgcctgcgaagaagagaaaaatgaatttttccgaaagagaggtggagattatcgtggaagagctggaactgaaaaagcacctgctagtaaaccactttaacgccggtgtgccactcgctgccaagtcagccgcatggcatggcatcctgagacgggttaatgccgtcgcaacatgccgtcgggagctgccagaagttaaaaagaaatggagcgatctgaagacagaggtacgcagaaaggtggcccaggttcgggcagccgttgaaggaggggaggcccctggtcccaccgaggaggatggcgctggcggacccggaactggtgggggatccggcggtggaggcccagccgtagcgcctgtacttcttacccccatgcagcaaagaatttgtaacctgctcggtgaagcaactatcatctcattaccaagcaccacagagatacaccctgtggcccttgggccatctgcaactgccgcagccgctacggttactttgacgcaaatcccgactgaaaccacctatcatacgctggaggaaggcgttgttgaatattgtacagccgaagcgccacccccactccctccagagacaccggtagacatgatggcccagcacgcggacaccagcgttaaaccccaggcactgaagtcaagaattgctctaaatagtgcaaagctgattcaggaacagagagtcacaaatcttcatgtgaaagaaatcgctcaacatcttgagcagcagaacgatcttctacagatgatccgcagatctcaggaggtgcaggcctgcgcccaggagcgacaagcacaggctatggagggcacgcaagccgcactgagtgttctgatacaggttcttcggccaatgatcaaagatttccgccgttacctgcaatctaataccgccaatcctgctccagcttcagaccctggtcaggtggcgcagaacgggcaacccgactctatcatccagtag

SEQ ID NO: 232950 - DNA, 1485 bp, Artificial Sequence
  Description of Artificial Sequence: Synthetic coding sequence
atggaagtcgtcgaggctgctgcagcccaactggagacgcttaaattcaacggcactgattttggcgtcggcgaggggccagcggctccttctccagggtcagcccctgtcccaggaacacagcctcccctgcagagtttcgaggggtccccggacgcgggacagacagtagaagttaaaccagctggcgagcagcctctgcagcctgtgctcaacgcggtggctgctggcactcctgcccctcagccccaaccaccggctgagtctcctgcatgtggagattgcgttacaagtccgggtgcagcagaacctgcacgggcacctgacagtctggagacgagcgactccgactcagatagcgatagcgagaccgattctgatagctcttcttcttcatcctcctccagtagctcaagcagctcaagcagcagttcctgcatctctcttcccccagttttgtctgatggggacgatgacctgcagatcgagaaggaaaataagaatttcccacttaaaaccaaggatgaactccttttaaatgagctgccatccgttgaggagttgacaatcatcttaccagaggacattgagctgaaaccgctgggaatggtgagctctattattgagcagctcgtaattatcgaaagcatgacaaacctgccccctgttaacgaggagacggtaatattcaagtctgacagacaggctgcaggcaagattttcgagatctttggaccagtggcccaccccttctatgtgctgaggttcaactcctcagaccacatagaaagtaaaggaatcaagatcaaggagacgatgtatttcgctccctcgatgaaggatttcactcagtatatcttcaccgagaagctgaagcaggacaagggaagcgatgcttcttggaagaatgaccaggagccccctccagaagctcttgacttctctgacgatgagaaagagaaagaagctaagcaacggaaaaagtcacagatacagggaaggaagaaacttaaatcagagttcaacgagcccggagaagattttaccgaggtgcatcagaactggaacgcccacagctccgcctccgagcacgcaaagggctaccgaaaccgcgagtttacccggggattctctcgcgcacgatatccaaggtcttgtcacggcagaccaccaccacagcatttctacaactctgagcacatggtatctcaggagacgagcgggtttcccagtcagagacagaacaatcccatcatgcctcaatatccattcccactgcccgtgttcgacatgcataatttcccactacgaccccctcctccacctccccctcctcccgtgaacatgggatgggccacaccaaacatggcagctcatcctctgctgaacctgccttatagtcttcctcctccaccccctcctccgccacttccacctccaccctcaagcggcgactctaatagccactttggaccatattattag

SEQ ID NO: 232951 - DNA, 1170 bp, Artificial Sequence
  Description of Artificial Sequence: Synthetic coding sequence
atggaggtagtggaagctgcagccgctcagttggaaacacttaagttcaatggtaccgattttggggtaggtgaaggaccagcagccccttcccccggtagtgctccagtgcctggtactcagccccctttacagtctttcgagggatcgcctgacgcgggtcagacagtggaggttaaacctgctggagagcagcccctgcagcctgttctaaatgccgtggcggcaggtactcctgctccccagcctcagccccctgcagaatcacctgcctgcggcgattgtgtgacctcccctggcgcagcagagccagccagggcgccagactctctagaaacgagtgattcagattccgactccgacagtgaaacagattcagatagtagctcttcttcgagtagttcctcttccagctcatcttccagctcttcatcttgtatttctttgccccctgttctatcggatggtgacgacgaccttcagatcgaaaaagagaacaagaatttcccactgaaaacgaaagacgaacttcttctgaatgagctcccaagtgttgaggaactgaccataattctgcccgaagacatcgagctgaagcctttgggcatggtgtcctctatcatcgaacagctagtaattatagagtccatgaccaacctgccgccagtgaacgaggagacggtgatattcaaatccgatcggcaagcggcagggaaaattttcgaaatttttggcccagtggcccacccattctacgtgttaagattcaacagctcagatcacatagagagcaagggcatcaaaatcaaagagactatgtacttcgcacctagtatgaaggatttcactcaatacatcttcaccgagaagctgaagcaggataaaggctcggacgcatcgtggaaaaacgatcaggaacctccacctgaggcgctagatttctctgacgatgaaaaggaaaaagaagcgaaacagcgaaagaagagtcaaatacaggggaggaaaaagctgaagagcgagtttaacgagcctgggacggggatttcacacaggtactgcggactgggctctcgacccctgcagtctagcgagtctcacaagttgttcgggttccagatgcacattaaggtgaccttcacatgctacttttccctcttaagcatgcaatag

SEQ ID NO: 232952 - DNA, 345 bp, Artificial Sequence
  Description of Artificial Sequence: Synthetic coding sequence
ctcgcatccagattgggaccggttagtactgcaaacatgtcaagacccgtgaggaaccggaaggtggtcgattattctcaatttcaggaatctgatgatgcagacttcgagtctgaagactctgaggacaaagatgtaaaaacaaaaaaggatgacagccactccgccgaggactctgaagacgaaaaagaagaccataaaaacgtgaggcaacagaggcaggccgcttctaaggctgcatcaaagcagcgggaaatgctgatggaggatgtcggaagtgaagaggagcaagaagaggaagacgaggccccattccaggagaggaaggacagcttctctcagtag

SEQ ID NO: 232953 - DNA, 732 bp, Artificial Sequence
  Description of Artificial Sequence: Synthetic coding sequence
atgtcacggcctgtaagaaacaggaaagtggtagactatagccagtttcaagagtcagatgacgccgacgaggactatgggagggacagcgggcctcctactaagaagattcggtcctcgccgagggaagccaagaacaaacgacggtccggtaagaacagccaggaggattccgaggactccgaagataaagacgtgaaaacaaagaaggatgattcccattcggcggaagattccgaggacgagaaagaggatcacaagaatgtcagacaacaaagacaggccgctagtaaagctgccagcaaacagagggagatgctgatggaggatgtcggctccgaagaagaacaagaggaggaggacgaggccccattccaggagaaggactctgggtcagacgaggatttcttaatggaggatgatgatgacagtgactatgggtctagcaagaagaaaaacaagaaaatggtcaaaaaatccaagcccgagagaaaggaaaagaagatgccgaaacccagacttaaagcaactgtgactccctcccccgtcaaagggaagggtaaagtaggtcgacccacggcttctaaggcatctaaggagaagacccctagcccaaaagaggaagatgaggagcctgagtctccccctgagaaaaaaactagcacatccccaccacctgagaagtcgggggatgaaggaagcgaagatgaggccccttccggcgaggattag

SEQ ID NO: 232954 - DNA, 1122 bp, Artificial Sequence
  Description of Artificial Sequence: Synthetic coding sequence
atgtccccatgcccgcctcagcagagtagaaaccgcgtgattcagctgtccactagcgagctgggggaaatggaattgacctggcaggagattatgtccataactgagctccagggactgaatgcccctagcgaaccgtcttttgaaccgcaggcgccagccccttacttaggtccaccgcctccgacaacttactgtccatgttctatacacccagattctgggttccccctgcccccacccccatacgaactccccgcatcaacttcccatgtgcctgacccgccttacagctatggtaacatggctatccccgtctctaaacccctcagcctgtccggcttgctgagcgagcctcttcaggatcctctggccctgttggacattggtctccctgccggtccgccaaagccgcaagaggatcctgagtcagactctggactgtcgctcaattactccgatgccgagtcactggagcttgagggtaccgaagccggaagaagacgaagcgagtatgtggagatgtaccctgtggagtatccctattccttgatgcccaactctctagcccactctaattataccctgcccgctgctgagacgccactggcccttgagccaagttcaggcccagtgagggccaagccaaccgccaggggcgaagcgggatcaagagatgagcgcagggcactggccatgaagattccattcccaaccgataagatcgtgaatctcccggtcgacgactttaatgaactgctggcccgatacccactgactgagagccaactggccctagtccgggatatcagacggagaggaaaaaacaaagtcgctgcccaaaattgtcggaaacgcaaactggagaccatcgtgcaactcgagcgcgagctcgaacggttgacgaacgagcgcgagagattgttgcgggctcgcggagaggctgatcgaactttggaagtgatgcggcagcagctaaccgaattgtatagggacatctttcagcacctgcgagatgagtctggcaattcttattcaccggaggagtacgccctgcaacaggctgccgacggtacgattttcctcgtgccgagagggactaaaatggaggccaccgactag

SEQ ID NO: 232955 - DNA, 1122 bp, Artificial Sequence
  Description of Artificial Sequence: Synthetic coding sequence
atgagcccatgccctccccagcagtccagaaaccgcgtcatacagcttagcacttccgagctgggggagatggaacttacttggcaggagatcatgagcattaccgagctgcaaggcctaaacgcaccttcagaaccaagctttgagccccaggctccggctccatacctggggcctcctccaccaacaacatactgtccatgcagcatccaccccgattccgggtttcctctgccgcctcccccttacgagcttcccgcaagtacatcccacgtgcctgaccccccttactcctatgggaatatggccattcccgtgagcaaacccctgtcactgtctggcctcctgagcgagcctctgcaggatcctctagccttactggatatagggcttcccgcaggaccacccaaaccacaggaagaccctgagagcgatagcggcctgagcttaaactattccgatgccgaaagccttgaactggaagggactgaagcaggcagacgacgctctgagtatgttgagatgtaccctgtcgaatatccgtacagtttaatgcctaacagccttgcccacagcaattacactctccctgctgccgaaactcctctcgcccttgagccaagttccggccctgtgcgggctaagccaaccgcgaggggtgaggccggatccagagatgagagaagagccttagctatgaaaattcccttcccaacagacaagatcgtcaacttgcccgtcgatgactttaacgaactccttgctcgctacccactgactgaatcccagttagctctcgtgagagacattagacgaagaggcaagaataaagtcgctgcccagaattgtaggaagcgtaagctggagacaattgtgcagcttgagagggaactggagcgcctgacgaatgagcgggaacggctcctcagggccaggggggaggccgacaggacgctggaggtcatgaggcagcaattgacagagctgtaccgtgatatctttcaacacctccgcgacgaatcagggaacagctattcgccggaggagtacgctctccagcaggctgccgatggaaccatctttctggttccacggggaaccaaaatggaagccactgactag

SEQ ID NO: 232956 - DNA, 1122 bp, Artificial Sequence
  Description of Artificial Sequence: Synthetic coding sequence
atgtcaccttgtcctccccaacagagccgaaatagggtgattcagctgagcacctcagaattaggcgagatggaactcacctggcaggagatcatgtctattaccgagctgcaaggcctaaatgcgcctagcgagccgtctttcgaaccacaggcccctgctccgtacctgggccctcctcctccaactacttattgcccatgttccattcaccccgactctggcttcccactgcctcctccgccttacgagctgcccgctagtacctcacacgttccagacccaccgtattcctacggtaacatggcaataccggtcagtaagccactgagtctctccgggctgctttcagagccgctgcaggatcccctggcactgctggacatcggtttacctgcagggccacccaaaccacaggaggaccccgagagcgacagtggcctgtctttgaattactcggacgccgagtccctcgagttagaaggaaccgaggcaggcagaagaaggtcagaatacgtggagatgtaccctgtagagtatccttactctctgatgcctaattctctcgcacatagcaactatactctgccagccgcagaaacccctctagctcttgaaccatcttccggaccagtacgtgccaagccgacagcacgaggtgaagcaggtagcagggacgagcgtcgcgcactcgctatgaaaatcccctttccgaccgacaaaattgtgaacctgccagtcgacgattttaacgagcttctggctcggtaccctctgactgagtctcaacttgctctggttagggacatcagacgcagaggtaagaataaagtggccgctcagaactgccggaaacgaaagctggaaacaattgtacagctagagcgcgagctggagcggcttaccaatgagcgcgaacgcctgcttcgagctagaggcgaggccgatcggacgctcgaggtgatgcgacagcagttgacggaactttatcgggacatctttcaacatttgagggatgagagcgggaacagttactcccctgaggagtacgccctgcagcaagccgcagacggaactatttttctcgtgcccaggggaaccaaaatggaggcaaccgattag

SEQ ID NO: 232957 - DNA, 1122 bp, Artificial Sequence
  Description of Artificial Sequence: Synthetic coding sequence
atgagcccatgtcctccacagcaatcacggaacagggtgatccaactgagcactagcgagctgggagagatggagctcacatggcaagagatcatgtcgatcactgagttacaggggctgaatgccccatcagagccaagcttcgaaccccaggctcctgccccatatctcggaccccctcctccaacaacctattgtccatgtagtattcatcctgattccgggttccccctgcccccaccaccctacgagcttccagccagcacatcccacgtccctgaccctccttattcctacgggaacatggcaattcctgtgagtaagcccctgtccttaagcggcttgctgtctgaaccactgcaagaccccctcgccttgctggatatcgggctacctgccggaccacctaaaccccaagaggacccagagtccgactcgggcctgtccctcaactacagcgacgctgagtcactggaattggagggaacggaggccggtcgtcgtaggtccgagtatgtcgaaatgtaccccgtagagtatccctactccttgatgccaaactccctcgcccactcaaactatactcttcccgctgcagagacccccctggccttggagccatcttccgggccagtgagggcgaagcctaccgcgaggggcgaagccggatcacgcgacgagagaagagcactggctatgaagattccttttcccaccgataaaattgtaaatctgccggttgacgactttaacgaactgctggcaagataccctctcaccgagtcccagcttgccctcgtgcgggacatccgccgacgcggaaagaataaggtggctgctcagaactgccggaaaagaaagctcgagacaatcgtacagctggaacgagagcttgaaagactgacaaacgagcgcgagaggctgttgagagccagaggagaggccgataggacgctcgaggtgatgcgtcagcagctgacagagctctaccgtgatatctttcagcatctgagagacgagagtggtaatagctactcccccgaggagtacgccttgcagcaggccgcagacgggaccatttttttggtgcccaggggaactaagatggaggcaaccgattag

SEQ ID NO: 232958 - DNA, 1032 bp, Artificial Sequence
  Description of Artificial Sequence: Synthetic coding sequence
atgtcaccgtgtccgcctcagcagagcagaaaccgcgtgattcaactctcaaccagtgaacttggagagatggagcttacatggcaagagattatgtcaatcaccgagttgcagggcttgaatgctccctcagaaccttccttcgaaccgcaggctcctgccccatacctaggaccccctcctccaactacatattgtccctgctccattcacccagattctgggtttcctctccccccacccccatatgaactgcctgcctctactagccatgtgcctgaccctccatattcatacggcaacatggccatccccgtctccaagccattgtcactatctggcctcctgagcgaacccctacaggaccccctcgccttgctggatatcggtctgcctgcagggccaccaaagccccaagaggaccccgaatccgacagtggactgagcctgaactactctgacgcggagagccttgagcttgaaggcacggaggcaggaagaagacgcagtgagtatgtcgagatgtacccagtggaatatccgtacagtctgatgcccaactccctggcacattcgaactatacgttgcccgctgccgagacaccactggctctcgaaccttcttcgggccctgtccgagcaaagcccacagcccgaggggaggctggatctagagacgagcggagagcacttgccatgaaaattcccttccccacagacaagatcgttaatctgcccgtcgatgatttcaacgagttactggccaggtaccctttgacagaaagccaattggctctggtgcgagacattagacgcaggggaaagaacaaggtggctgcccaaaactgcagaaagaggaaactcgagactattgtgcagttggagagggagctcgaacggctgacaaatgaaagagaacgcctcctacgggctcgcggtgaggccgaccggactctggaggtcatgcgccagcagctgacggagctctaccgggacatcttccagcaccttagggatgaaagtgggaactag

SEQ ID NO: 232959 - DNA, 2229 bp, Artificial Sequence
  Description of Artificial Sequence: Synthetic coding sequence
atgctgagtcttaaaaaatacctcactgaaggtcttctgcagttcacaattttgctaagcctgatcggcgtacgtgttgatgttgacacctaccttacctcacaacttcccccattgcgtgaaattatactgggtcccagctcagcctatactcagacacagttccataacttgagaaacaccctcgatggttacggtatccaccccaagagtatcgatctggacaattatttcactgctcggagactccttagccaggttagggctttggataggttccaggtccccaccactgaggttaacgcctggttggtgcacagggaccctgaagggagtgtgtctggctcccagccaaatagcgggctggcactggagagtagctccggtcttcaggatgtcactggaccggataatggcgttagagaatccgaaactgaacaggggtttggcgaagatctcgaggacctgggagccgtggcacccccagtgtcaggggacctgacaaaggaggacatcgacttgatcgacattttgtggcggcaggacatagatcttggtgctggcagagaagtttttgactactcacaccgccagaaggagcaggacgtcgagaaagagttgcgtgacggaggcgagcaggatacttgggctggcgagggagccgaagccttggctcgtaatctgctggtggacggagaaacaggagaatccttccccgcacaattccccgcagacatcagcagtattactgaagccgtgccaagtgagagtgagccccctgcattacagaacaacttgctgtctcctctcttaacaggcacggagagcccttttgatctggagcagcagtggcaggacctgatgtctatcatggaaatgcaggccatggaggttaacacatcagcgagcgaaatcttgtacagtgcacctccaggtgaccctctgagcaccaattattcattggccccaaacacgccaataaaccagaatgtgagcttacaccaggctagtctgggaggctgcagccaggatttcttactcttctcgccggaggtagaatctctgccagtggcgtcttcctcaactctactgcctctggctccctccaactctacctccctgaattcaaccttcggttctacgaatcttaccggcttatttttcccacctcagctcaacgggaccgccaatgatacagctggaccggaacttccagaccctctgggaggcttgctcgacgaggcgatgctggatgagatttccctgatggacctcgccatcgaggaaggcttcaaccctgtacaggcctcacagttagaagaagaatttgatagtgattctggactgtcgctggactcgagtcacagcccatcgagcctttcctctagcgaggggagtagtagcagcagttcaagctcgtcaagctcttcatcctccgcatccagcagcgcgtcctcctcattttcggaggagggtgccgtcggttactcgagcgatagtgaaacattggacctggaggaagcagagggagccgttggttatcagcccgagtatagcaagttttgcagaatgtcatatcaggaccccgctcagctgtcctgcttgccataccttgaacatgttggtcacaatcacacgtacaatatggccccttcggctctggactccgccgatctgccgccaccgagcgctttaaagaagggcagcaaggagaagcaggccgacttcctggataaacagatgagtagggacgaacatcgtgcacgggcaatgaagattcccttcaccaatgataagattatcaatctgcctgtggaggagtttaatgaactgctgtctaaataccagctctcagaggcccaactcagtctgatccgcgatatccgccgtcgtggcaaaaataagatggccgctcagaactgtcggaagcggaaactggacaccatcttgaacctcgaaagagatgtcgaagacctccagagggacaaggctcggctgttacgcgaaaaggtagaattcttaaggtcccttcgccagatgaagcagaaggttcaaagcctttatcaggaggtgtttggtaggctgcgtgacgagaatggtcgtccttatagcccttctcagtacgccctgcaatacgctggggacggatccgtattgctgatccctcgaacgatggcagaccagcaggctaggagacaggagaggaaaccaaaagatagacggaaatag

SEQ ID NO: 232960 - DNA, 2319 bp, Artificial Sequence
  Description of Artificial Sequence: Synthetic coding sequence
atgctcagccttaagaaatatttgaccgaaggactactgcaattcacaatactgctgagtttaatcggggtgcgggtagacgtggatacgtatctcacatcacagcttccgcctttgcgcgagattatccttgggccaagtagcgcatacactcagacccagttccataatttgcggaacacactggatgggtacggtattcaccccaagtcaatagatctagataattattttacggccagacgactgctctcccaggtgcgggcactggatcgattccaagtgcctacaacagaggtcaacgcctggctggtgcaccgagatcccgaggggtccgtaagcggcagccagcctaactctggactggccttggagtcgtctagcgggctgcaggacgtgacagggcctgacaacggggtgagggagtcagagaccgagcaaggctttggtgaagatctggaggaccttggcgcagtagccccaccagtgagtggtgatctgactaaggaagatatcgacctgatagatattctgtggcgacaggatattgatttgggagccggaagggaagtgttcgattactcgcaccgccaaaaggagcaggatgtcgagaaagaactaagggacggaggggagcaggatacctgggcaggggagggggctgaagcactggctcggaacctcttggtcgatggcgaaacaggagaaagtttccccgctcaagtgccgtctggtgaagaccagaccgccctgagcctggaagagtgcctgaggttactggaagcaacttgcccttttggagaaaacgccgagttccctgcggatatcagttccattacggaggcggtgccgtccgaaagcgagccgccagcactacagaacaatctgctgtcgccactcctgaccggtacagaaagccccttcgacttggagcagcagtggcaggacttgatgtccatcatggagatgcaagccatggaagtgaatacttccgcaagcgaaatcctctattcagccccaccgggtgacccgctgtctacgaactatagcctagcacccaacactccaattaaccaaaacgtcagcctgcaccaggcctccctcggagggtgtagccaggatttcctactttttagtcctgaggtggaatcactgccagtcgctagctcctctactctactgccgctggccccatcgaacagcaccagcttgaattccacctttgggtctaccaatctaacgggtttattcttcccgccacagctgaacggcaccgctaatgatactgctgggccagagctccctgatcccctagggggattactcgatgaggcaatgctggacgagattagcctgatggacttggccattgaggaaggcttcaaccctgtgcaggcctcacagcttgaagaagagtttgattcggattccgggcttagtctcgattccagccattctccaagtagcctttcttcttccgaaggcagcagttccagtagctcatcatcttcctccagctcaagctctgcctcatcatcagcttccagtagcttctcagaagagggagctgtggggtatagttccgactccgagacacttgacttagaggaagcagagggggcagtcgggtaccagcctgaatacagcaagttctgtagaatgagctatcaggacccagcccaactctcgtgcctgccttaccttgaacatgtgggccataaccatacttataacatggcaccgagcgctttagattctgcagacctgccgcctccttctgcccttaaaaagggaagcaaagaaaaacaggctgattttctggacaagcaaatgagccgcgatgagcatagggccagagctatgaagattccgtttaccaacgataagatcattaatcttccggtggaggagttcaatgaactgctctctaagtaccagcttagtgaggcacagttgtccctaatccgggacattcggaggcgcggtaaaaacaagatggccgcacaaaattgccggaaaagaaagctggataccattctgaacctggaacgcgatgtggaggatctccaacgggataaggcaagattactccgggagaaagtcgaatttttaaggtccctccggcaaatgaaacagaaagtccagagcctctaccaagaagtcttcgggagactgagagacgagaacggcagaccttacagccctagccagtacgcactacagtacgctggagacggctctgtcctcctgatccccagaacgatggctgatcagcaggcaagacgacaagagcgaaagccaaaagatagaagaaaatag

SEQ ID NO: 232961 - DNA, 2376 bp, Artificial Sequence
  Description of Artificial Sequence: Synthetic coding sequence
tttgtcttctggaagattctgaaaaccaaaaagcacaaacactctgggccatccgcgatgctttcattgaaaaagtacctgacagaaggcctcctgcagttcaccatcctgctttctctgattggggtccgcgtggacgtggatacttatctcacttcccagctgccacctttgcgggaaattatccttggaccctcgtccgcctatacccagacacagtttcacaacctgcgcaacacacttgacggttatggcatccaccccaaatcaatcgacctcgataactacttcaccgcgaggcgtctgctgagtcaggtgcgggctcttgatagattccaggttcctaccaccgaggtgaatgcctggctggtgcatcgggaccccgaggggtcagtgtcaggctctcaacccaattcaggtctcgccctcgaaagttcgagcggtctgcaggatgtcaccggcccagacaacggtgtgagggaaagtgagaccgaacagggcttcggcgaggacctcgaggacctgggcgcagtagccccaccggtttccggagacctgacgaaagaggatatcgatctcattgatattctgtggagacaggatatcgatcttggcgctgggcgagaggtgtttgactactcccatagacagaaggaacaagacgtggaaaaggaactcagagatgggggagagcaagatacttgggccggtgagggagcggaggccctggctaggaacctgttagtcgatggggagactggcgaaagttttccggctcaagtgccttcaggcgaggatcagaccgcgctgagccttgaagagtgtttacgcctcttagaggccacctgtcccttcggcgagaacgctgaattccctgccgatatctcctccattaccgaagctgtgccgtctgagtccgagcccccagccctgcagaataaccttctcagccctctcttaacgggcaccgaatcaccctttgacctggaacaacagtggcaggacctgatgtcaatcatggaaatgcaggctatggaagtgaacacgagtgcgtccgagattctgtatagcgcgcctccgggagatccacttagtacaaattattcactggcccctaatacaccgattaatcagaacgtatccctacaccaggcctctctcgggggatgctcacaggattttcttctgttttctccagaagtggaaagtttgccagtagccagttcttccacactactacctctcgcccctagcaactcaacctccctgaatagcactttcgggtccaccaatctgaccggtctgtttttccccccacagctcaatggcacggcaaatgacacagccggaccggaacttcctgaccctctagggggattacttgacgaagcgatgctggacgagatttcactgatggacctcgctattgaggaaggattcaatcctgtccaggcgagccaacttgaagaagagttcgattctgattccggtttgagtctggacagttcgcactcccctagtagtctgtcaagctccgagggctcaagctcctcttcttctagttctagctccagttcatccagcgccagctcttccgcctccagctcattctctgaggagggagctgtggggtactctagcgacagcgaaactctggacttggaggaggccgagggggctgtgggttaccagcctgaatattcaaagttttgtcggatgtcatatcaagatccagcccagttatcttgtctgccgtatctggagcacgtgggtcataatcatacgtacaacatggcaccatccgcactggatagtgcagatctgcctcccccttctgcattgaaaaagggcagcaaagagaaacaggcagatttcttagacaaacaaatgtcacgcgatgaacacagggccagggccatgaagattccattcacgaacgacaaaatcatcaatctgcctgtggaagaatttaatgagcttttaagcaagtaccagctgtcggaggcccagttatcgctgatcagagacatcagacgacgcggaaaaaataaaatggcagcacagaattgtcggaaaaggaaacttgacacaattctgaacctggagcgggatgtggaggatttgcagcgcgataaggccagactgctccgagagaaggttgaattcctgagatccctgaggcagatgaagcagaaggtccaaagtttgtaccaggaggtttttgggagattgcgcgatgagaacggacgcccatactcaccctcccagtacgccctgcagtacgccggagacggaagcgtcctgcttatccctcgaaccatggcagaccagcaggctagacgacaagagaggaaaccaaaggaccggagaaagtag

SEQ ID NO: 232962 - DNA, 1851 bp, Artificial Sequence
  Description of Artificial Sequence: Synthetic coding sequence
atgactaggttagacaggtcaagccactcaggtggtggccacgccaaaggatcccggcctctcaactcactgctcgccggacatagagtggcacagcctgcaagcgccccagggagtcgcgcttctgtgcaggatattgacctgattgatattttgtggagacaggatatcgatctcggtgctggcagagaggtcttcgactattctcaccgtcagaaggagcaagatgtcgaaaaggaacttcgagatggtggcgagcaggacacgtgggcaggagaaggcgcagaagcgctggccagaaatctgcttgtggatggagagaccggtgaatccttccccgctcagtttccggctgatatcagcagcattacagaggcggtgcctagcgaatcagagcctccagccctccagaataatttgctgagccctctgcttacaggcacggagagccctttcgacctcgagcagcagtggcaggatttgatgtccatcatggagatgcaggcaatggaagtgaatacaagcgcgtcggagattctatacagtgcaccacctggagacccactctcaaccaattattctttggctccgaatactccaattaaccagaatgtctccctgcaccaagcaagcctgggtggctgtagccaagactttctgctgttctcccccgaagtggaatctctgccagtggctagttcttcgacgttgctgcctctggctccatccaattctacttccctaaattcaactttcgggtctacaaatctaaccggacttttttttcctccacagctgaacggcacagctaacgacacagctggtcccgaactccccgacccactggggggactattagacgaggctatgctggatgaaatcagtttgatggacctcgccatcgaggaggggtttaacccagtacaagcctcccagctggaggaagagttcgacagtgatagtgggctgagcctggacagcagtcatagtcccagctcgttatcctcatccgaaggttcaagcagcagctcttctagcagcagctcatccagtagctctgccagcagtagtgccagctcatctttctctgaagagggagctgtgggctattcaagcgattcagagacactcgacctggaggaggccgagggggcagtgggttatcagccagaatattctaagttctgcaggatgtcttaccaggacccggcacaactgtcctgcctaccttatctggagcacgtcgggcacaaccatacctataacatggctccatcggctctcgatagcgcagatctccctcccccttctgccctcaaaaaagggtcaaaggagaaacaggcagacttccttgacaagcagatgtctcgggacgagcaccgagcacgggctatgaaaatccccttcactaacgacaagatcatcaacctgcccgtcgaggagtttaatgagcttctgagtaagtaccagttgagcgaagcacagctttcattaatacgagacattcgcaggaggggaaaaaataagatggcagcacagaattgccggaaaagaaagctggatacaattctcaatctggagcgtgacgtggaggatctgcagcgtgataaagcccgactcctccgcgagaaggtggagttccttcgaagtctgagacagatgaaacagaaggttcagtctctgtatcaggaggtgttcgggcgactgcgcgacgagaacggccgaccttattcaccttcccagtacgcactgcagtatgctggtgacgggtctgtgctcctcatacctcgcacgatggccgatcaacaggcacgccgacaggagcgcaagcccaaggatcgcaggaaatag

SEQ ID NO: 232963 - DNA, 1818 bp, Artificial Sequence
  Description of Artificial Sequence: Synthetic coding sequence
atgatggacctggaacttccacctccagggctgccttcccagcaggacatggacctaattgatatcctgtggcggcaggatattgatctcggtgtctcccgagaagtgttcgatttttcccagagacggaaagagtacgagttagagaaacagaaaaaacttgaaaaggagcgacaggagcagcttcagaaggagcaggaaaaggccttcttcgcccagctgcaattagacgaagagaccggagaattcctacccattcagcctgcgcagcatattcagtctgagacatccgggtcggcaaattactcacaggtagctcatatacccaaatcagacgccctctacttcgatgactgcatgcagctcctggcacagacatttccttttgtagatgacaatgaggtgtcctcggctacattccagtcactggttccagacatccccggacacattgagtctcctgtcttcatcgcaacaaaccaagctcagtctccagagacatctgtcgcacaagtagccccagtggacctggacggaatgcagcaggacattgagcaggtatgggaggaactgctctccattcccgagcttcagtgtctcaacattgagaatgacaagctcgtcgagaccacaatggtaccatcacctgaagccaaactgaccgaggtcgacaattaccatttttactccagcatcccttctatggaaaaggaagtgggcaattgttccccacacttcctgaacgctttcgaagactccttcagtagcatccttagcacagaggatcctaatcagctcacagtaaacagtctcaactccgatgcaaccgtaaacactgactttggggacgagttctactctgcatttattgccgaacccagtattagcaattccatgccctccccggctacattgtcccattctctctctgagctgctgaacggccctatagatgtctctgatctaagcttatgcaaagctttcaaccaaaaccatccagaatctacggccgaattcaatgactccgacagcggcatttccctgaatacaagcccgagtgtcgcatctccagagcactccgtggagtctagcagttacggcgataccctgctcggcctcagtgactctgaggtagaagaactcgactcggccccaggatccgtaaagcaaaacggcccaaagactcccgtccatagctctggggatatggtacagccgctgagccctagccaggggcaaagcacccacgtccatgatgctcagtgcgagaacacccctgaaaaagaactccccgtatcacccggtcacaggaaaacccccttcactaaggacaagcattcttcaaggctggaggcacatttaacacgggatgagcttcgggctaaagctctgcatatccccttccccgttgagaagattattaacttaccggtggttgactttaacgagatgatgagtaaagagcagttcaacgaggcgcagctcgcactaatccgggatatcaggcgcagagggaagaacaaagtggcggctcagaactgtcgaaagcgcaaactggaaaacatcgtagaattagagcaagacctggatcatcttaaggacgagaaagagaaactattaaaagagaaaggagaaaacgataagtccctccacctgcttaagaagcagttgagcaccttatacttggaagtcttcagcatgctgagggatgaggacggaaagccctacagcccctccgagtacagtcttcagcagaccagagacggaaacgttttcctcgttccgaagagcaaaaagccggacgtgaagaagaactag

SEQ ID NO: 232964 - DNA, 1770 bp, Artificial Sequence
  Description of Artificial Sequence: Synthetic coding sequence
atggatctgattgacatcctgtggagacaggatatcgacttaggcgtcagccgcgaggtgttcgacttcagccagagacgaaaggagtatgaacttgaaaagcagaagaagctggagaaagaaagacaagaacaactgcagaaggaacaggagaaggctttctttgctcagctccagttagacgaagagacaggggaatttctcccaattcagcctgcccaacatatacagtccgaaaccagtgggtctgcgaattactctcaggtcgcccacatcccaaaatccgacgctttatacttcgatgactgtatgcagctcctggcccagacttttccctttgtggacgataatgaggtttccagcgcaaccttccagtccctagttccggatatccccggacacatagaaagccccgtcttcatagcaacaaatcaggcacagtcgccagagacctcagtggctcaggtggcccctgtagatcttgacgggatgcaacaggacatcgaacaggtctgggaggaattgctgagtatccccgagcttcagtgcctgaatattgagaatgacaagctggtggagactacaatggtgccctcaccggaggctaagctcactgaagttgacaactatcacttttactcatctattccctctatggagaaggaggtcgggaattgctccccacatttcctcaatgcctttgaggactcgttctcctcgattctgtccaccgaagaccccaatcaactcaccgtgaacagcctgaactcggacgcaaccgtcaataccgacttcggcgacgagttctactccgctttcattgccgaaccgtcgatcagtaatagcatgccttcgcctgctactttgtcccactctctgtctgagctgctgaacggaccaatagacgtgagcgatctgagcctctgtaaggcttttaaccagaatcaccctgagtctactgccgaattcaacgatagcgactccggtattagcctgaatacaagcccatcagtggcctcgcctgaacatagtgttgagtcctcttcctacggcgatacattgctcgggttatccgactctgaggtagaggaactggattctgcgccaggctcagtgaaacagaacgggccaaagacacctgtgcacagttcgggggacatggtgcagcctctcagtcctagccagggtcagtcaacccacgttcacgatgcacagtgcgaaaatacccctgagaaggagctgccagtttcccctggccacagaaaaacacccttcaccaaggataagcatagctccaggctggaggctcacctgactagggacgagctgagagctaaggccctgcacataccattcccagtcgagaaaattataaacctcccagtggtagactttaacgaaatgatgtccaaggaacagttcaatgaagctcagttggctttgataagggatattcggcgaagaggtaaaaacaaggtggccgcacagaactgcaggaaacggaagttagagaacatcgtggagctggagcaagatctggatcatctgaaggacgaaaaggagaagctgttaaaggagaagggagagaacgacaagtctctccatttattaaagaaacaacttagcacattatatctggaagtgttctccatgttgagagacgaagacggcaaaccatatagcccttccgagtactccctgcagcagaccagagatggaaatgtgtttctagtgcccaagtccaagaagccagacgtgaagaaaaactag

SEQ ID NO: 232965 - DNA, 705 bp, Artificial Sequence
  Description of Artificial Sequence: Synthetic coding sequence
atggacctcatcgacatcttgtggagacaggacatcgatctgggcgtatcgcgcgaggtttttgatttttctcagagaagaaaagaatatgagttggagaaacagaagaagttggaaaaggaaagacaggaacagctccagaaggaacaggaaaaagccttcttcgcacaactccagctcgatgaggagacaggcgaattcctgccaatacagcccgctcaacatatccagagcgagacgtccggttcagccaattactcccaagtcgcacacattcctaaaagtgacgccctgtacttcgacgactgtatgcaattattggcgcagacttttcctttcgtggacgacaacgaagtaagcagtgccacctttcagtctctcgttccagatataccaggacacatcgaaagccctgtttttatcgccactaatcaggcacagagccctgagacttctgtggcacaggttgctccagtagatctggacggcatgcagcaagacatcgagcaggtgtgggaggagctgctctctatacccgagctgcaatgtttgaacatcgaaaacgacaagcttgtggagactactatggtgcccagtcctgaggctaagcttactgaggtagacaattaccacttctattcaagcataccctccatggaaaaggaagtcggaaattgctccccccattttctgaatgctttctag

SEQ ID NO: 232966 - DNA, 843 bp, Artificial Sequence
  Description of Artificial Sequence: Synthetic coding sequence
atggaccttatcgatatactttggagacaggatatcgatctcggggtttcgcgcgaggtttttgacttctcccagcgtcggaaagagtatgagctggaaaagcagaagaaactggagaaagaacggcaggaacagctgcaaaaggaacaagagaaagcgttcttcgcacaattgcagctggatgaagagactggggagtttctgcctatccaacccgcacagcatattcagtctgagacaagtggcagcgcaaattacagccaagtcgcgcatataccgaaatccgatgccttgtattttgatgactgcatgcagttgcttgcacagacctttcctttcgtcgacgacaacgaagtgagttcagcaacatttcaatctctcgtgcctgatatacccggacacattgagtctccggtttttatagctacaaatcaggcccagagcccggagacaagcgtagctcaggttgcgccagttgatctggacggcatgcagcaagatatcgagcaggtttgggaagagctgctgtctatccccgaattgcagtgcctgaatatcgagaatgacaagctcgtagagaccacgatggtacccagtccagaggccaagttaactgaagtagacaactaccatttttacagctccattcccagcatggaaaaggaggtgggcaattgcagtcctcattttttgaatgcattcgaagattcgttctccagtatcttatctactgaagatccaaatcagctaaccgtgaattccctgaatagtgacgctactgtgaacaccgactttggagacgaattctatagtgctttcatcgccgagcctagtatcagttag

SEQ ID NO: 232967 - DNA, 1749 bp, Artificial Sequence
  Description of Artificial Sequence: Synthetic coding sequence
atggacctgatcgacatcctgtggcgacaagacatcgatcttggagtatctcgggaggtcttcgacttttctcagagacgcaaggagtacgagctcgagaaacaaaagaaactcgaaaaggaacgacaggaacagcttcagaaggagcaagagaaagcattcttcgcccagctccagttggacgaggagaccggtgaattcctgcccatacagcctgctcaacatatccaatcagaaacaagtggtagcgctaattatagccaggtggctcatatacccaaaagcgacgctttatattttgatgactgtatgcagctcctggcccagacattcccgtttgtggacgataacgagtcccttgtccccgatattccaggacacatagaatcgccggtattcattgccacaaatcaggcccagtcaccagagacgtcagttgctcaagtggcaccagtagatctcgatggcatgcagcaggatatagaacaggtgtgggaggaactcctaagtattccggagttgcagtgtcttaacatagaaaacgataaactcgtggaaacaacgatggtccctagtcctgaggcaaaactgaccgaagtggacaactaccatttttactcatccatccccagcatggagaaggaagtgggcaattgctccccccatttccttaatgcttttgaggactcctttagctctattctgagtactgaagacccaaatcagctcacagtcaactctttgaactcagatgctactgttaacaccgactttggggatgaattttatagtgccttcattgcagagccttcaatttcaaattccatgccaagccctgccaccctatcacacagtctaagcgagcttctgaatgggccaattgacgtttcagatctgtctctgtgcaaggcttttaaccagaatcaccctgaatctaccgcagagttcaatgactccgacagcggaatctctctgaatacgtcacccagtgtggcaagtcctgagcattctgtggaatcctctagttacggcgacactttgttgggccttagcgattctgaagtggaggagctggatagtgcgccaggctctgtgaaacagaacggccctaagactccagttcattcgagtggcgacatggtccagcccctctccccttctcagggtcagagtactcacgtccatgatgcccaatgtgaaaatacccctgagaaagagctgccagtttcccccggacacaggaaaacgccctttacaaaggacaaacactcttcacgtctggaggctcatctgacaagggatgagttgcgcgcaaaagccttgcacattcccttccctgtcgagaaaatcataaacctccctgtagtggacttcaatgaaatgatgtccaaagagcaattcaatgaggcccagctagccttgattcgtgacattcgtcgacgcggaaaaaataaggtggcagcccagaactgtagaaagcgcaagctggaaaatatcgtggaactagaacaggatctggatcaccttaaagacgagaaagagaaactactgaaggaaaagggagaaaacgacaaatcactgcacctgctgaaaaagcagctcagcactctctatctggaagtcttctccatgctcagggacgaagatgggaagccatactccccctcagagtatagcctgcagcagacaagggacggaaacgtgtttttggttccaaaaagtaaaaagccagacgttaagaagaactag

SEQ ID NO: 232968 - DNA, 2085 bp, Artificial Sequence
  Description of Artificial Sequence: Synthetic coding sequence
atgaagcatctaaagagatggtggtccgctgggggtggtctactacacctcactctgttactgagtctggccggactgcgagtcgacctggatctgtacctgctcctcccacctcctacattgctccaggatgagctgctgtttctcggaggaccagccagcagcgcctatgctctctctccattctctgcctcgggaggatggggtagagctggacatctccaccctaaggggagggagcttgatcctgcagcacctcctgagggccagttgctgcgtgaggtacgtgcgctcggagtgcctttcgttccaagaacatccgtggacgcttggttagtccattcggttgccgctggctcagccgatgaggctcatggccttctcggcgcagctgctgctagttctaccgggggagctggggcatcagttgatggcggatcacaggctgtgcaggggggaggtggcgaccctagggccgctaggtccggtcccctggacgctggggaagaagagaaggcccctgccgaacctacagcacaggtaccagacgcagggggatgcgctagcgaagaaaatggagtgttgcgagaaaaacatgaggccgtcgatcacagcagccagcacgaagaaaatgaggagcgggtgtctgcacagaaagagaactcactgcagcagaacgatgacgacgagaacaaaatcgctgagaagcccgattgggaagcggagaagacaacggaaagtcggaacgagcgtcatctgaacgggactgacaccagcttttcacttgaggatctgttccagctactctcttcccagcctgagaactctctcgagggaatatcactcggagacattccccttcccggttctatctcagatggaatgaattcttctgcacactaccacgttaacttctcacaggctatcagtcaggacgttaacctgcatgaggctatcctgctgtgtcccaacaacacattccgcagggacccaacggctaggaccagccaatcacaggagcctttcctgcaactgaattcgcacactactaaccctgaacagaccctccctggaactaacttgacaggttttctgtcaccggtcgacaaccatatgcgtaacctgacaagccaggacctgctgtacgaccttgacattaacatcttcgacgagattaacctgatgagcctggcaaccgaagacaattttgatcctattgatgtgagccagctctttgatgaacccgatagcgattctggactgtcactagacagcagccacaataacacctcagttatcaagtctaattcctcacactccgtatgcgatgagggtgcaattggttactgtactgatcacgagagcagcagccaccatgatctggaaggcgcagtgggtgggtactaccccgaaccctcgaaactgtgtcacctggaccagtctgactcagactttcacggtgacctaacattccaacatgtgtttcacaatcatacgtatcatttacagcccaccgccccagaatccacctccgaacccttcccatggcccggtaaatctcaaaagattcgtagcagatatttggaggacaccgaccggaatctctcccgggatgagcagagagcgaaagcgctacacattccgttcagcgtagacgagattgtggggatgccagtagattccttcaactccatgctgtctcgctactacttaactgatctccaggtgtcactgattagggatatcaggcgaaggggcaagaataaagtggccgcacagaactgtcgaaaacgtaaactggatatcattctgaaccttgaagacgatgtatgcaacctgcaagccaaaaaggaaacactcaaaagggagcaggcacagtgcaacaaggcaatcaatattatgaagcagaagttacacgacctgtaccacgacattttctcccgactcagagacgaccagggtcgcccagtgaatccaaaccactatgctttacagtgtacccacgatggcagtatcttgatagtacccaaggaactcgtcgcgtccgggcataagaaggagactcagaagggaaaaagaaaatag

SEQ ID NO: 232969 - DNA, 1200 bp, Artificial Sequence
  Description of Artificial Sequence: Synthetic coding sequence
atgaattcctcagcacactatcacgtgaattttagccaggccataagccaagatgtaaaccttcatgaggctattctactgtgtccaaataacacgtttaggagagaccccactgctcggacgtcacagagccaggagccttttcttcagttgaactctcataccaccaaccctgaacaaaccctcccagggaccaatctcaccggatttctatcacctgtcgataaccacatgcgcaaccttactagtcaggacttactgtatgatttagacatcaatatttttgacgagatcaatctcatgagtctggctactgaggataattttgatcctattgacgtgagtcagcttttcgatgagcccgatagcgattctgggctgtcactcgacagctctcacaacaacaccagcgttattaaatccaattcaagccactctgtttgtgacgagggagctatcgggtactgtactgatcacgaatcaagtagccaccacgacctcgagggcgctgtggggggttactatccagaaccgagcaaattgtgccatctggatcagagcgatagtgattttcacggggacctgaccttccagcacgtctttcacaatcacacctaccacttgcaacctacagcccctgagagcacctctaacctgttcagacccggaaagtcacagaaaatccgcagccggtatctcgaagatacagaccgcaacctttcgagagacgaacagagggccaaggccctgcacatccccttttctgtggatgaaatcgtgggcatgcccgttgacagcttcaacagcatgctgtctaggtattacctcactgatctccaagtgagtctcattagagatatccggcgtagaggcaagaacaaggtggccgctcagaactgccggaaacgcaagcttgacatcatccttaatttagaagacgacgtgtgtaacttacaggctaagaaagagactctcaaaagggaacaagcccagtgtaataaggctatcaatattatgaagcagaaactgcacgacctttatcacgacattttctccaggctgagggatgaccagggcagacccgtcaacccaaatcattatgcattacaatgtactcacgacggtagcatactgatcgtgcctaaagaattggtagcctcgggacacaaaaaagaaactcagaagggaaagcgaaaatag

SEQ ID NO: 232970 - DNA, 1143 bp, Artificial Sequence
  Description of Artificial Sequence: Synthetic coding sequence
atgtactctccattgtgtctgacccaggatgagttccaccctttcatcgaggctctgctcccccatgtccgcgcttttgcttacacctggttcaatctgcaagcccgaaagcgcaaatactttaaaaagcatgaaaagagaatgagcaaggaggaggagagggccgtgaaggatgaactgctgtctgagaagcctgaggtcaagcaaaaatgggccagtaggcttctagccaagctgcgaaaggacatcagacctgaatatcgggaggacttcgtgctaaccgtgaccggcaagaagcctccgtgttgcgtgctttctaatcccgatcagaagggcaagatgcgccgtattgactgcctccggcaagcggacaaagtctggaggcttgacctcgttatggtgatcctgttcaagggaatcccactagaatcaaccgacggcgagcgcctggtgaagtccccccaatgctccaacccaggcctgtgcgtgcagccacaccatataggggtatccgtgaaggagctggacctgtacctggcctactttgtccatgccgcaggcatgccctctcctactaccctgaagaaatcagagaagtccgggttttctagcccttctccatcccagacctcaagcttgggaacagcttttacccagcatcaccgccctgtgattacgggacccagggcgagtcctcatgctacaccctcaaccctccattttcctacctcaccaataattcagcaacctggtccctacttcagccatcccgcaattaggtaccacccgcaggaaactttaaaagaattcgtccagttggtctgcccggatgctggccagcaggcaggacaagtcggtttcctcaatccaaatggctcatcccaggggaaggttcacaaccccttcctgcccacaccgatgctcccgcctcccccacctccaccgatggctagaccggtgcccctgccagtgcctgatactaagccacctactacttcaaccgagggaggcgcagcttcacctaccagccccacctacagcaccccatctacatctcctgctaaccggttcgtgtctgtaggaccaagggacccgagcttcgtgaacattcctcagcagacccagagttggtatttgggttag

SEQ ID NO: 232971 - DNA, 1464 bp, Artificial Sequence
  Description of Artificial Sequence: Synthetic coding sequence
atgtactcgccactgtgtctcacacaggacgagttccacccttttatcgaggcccttctcccccacgtacgagcgtttgcctacacctggttcaatttgcaggcacggaaacggaagtactttaaaaagcacgaaaagcggatgagcaaggaggaggaaagagcagttaaggacgaactactttctgagaagcctgaagtgaaacagaagtgggcaagtagactgctggccaaacttcggaaggacataaggcccgagtatcgagaggactttgttctaacagttacaggaaagaagcctccctgttgcgttctatctaatcctgaccagaaaggcaaaatgcgccgtatcgattgcctgcgccaggctgataaggtgtggagactggatttagttatggtcatcctttttaaggggatcccgctggaaagtactgacggtgaacgacttgtcaaatccccccaatgctcaaacccgggtctgtgtgtgcagccacaccacattggcgtctccgtcaaggagttggacttgtatctggcctacttcgttcacgctgcaggacacctcggattccaggattccttcgtgacctccggtgtattctctgtaaccgagctcgtgagagtcagtcagacccctattgcagcaggcaccggacccaacttctctctctcagacttggagtcttccagttattattccatgtcaccaggagccatgcgtagatctctcccaagcacgtcctctacaagctctacaaagaggctgaagagtgtagaagatgaaatggatagtcctggtgaagagcctttctatactggacagggccgttcacctggatcagggagccagtcttctgggtggcacgaagttgaaccgggaatgccctccccgacaacattgaaaaagtcagaaaagtcaggtttttcctctcccagcccctcccaaacaagctcacttgggactgccttcactcagcaccatcggccagtgatcactggccctcgagcaagccctcatgctacgcctagcactctgcatttccccacatcacctattatccagcagccgggtccttacttctcgcatccggcaatcagataccacccccaggagaccctgaaggagtttgtacagttggtctgcccagacgccggacagcaggccggtcaggtcggcttcctcaaccccaatggcagttctcagggaaaggtgcacaacccatttttaccaacaccaatgctgcccccaccgccaccacccccaatggccaggccagtgcctctgcctgtgccagacactaagccaccgaccacctcaaccgaaggaggggctgcttcgccaacatccccaacttattctacaccatccacctcaccagccaacaggttcgtcagcgtcgggccaagagatccaagttttgttaacatcccgcagcagacacagtcctggtatttggggtag

SEQ ID NO: 232972 - DNA, 1401 bp, Artificial Sequence
  Description of Artificial Sequence: Synthetic coding sequence
atgtattcaccactatgcctgacacaggatgaattccaccctttcatcgaggccctcctgccacatgtgcgggcatttgcttacacctggttcaaccttcaggcacggaagaggaaatactttaagaagcatgaaaaaagaatgagcaaggaggaagagagagccgtgaaagacgagctattgagtgaaaagcccgaagtcaagcagaagtgggcttccagactgcttgccaaactcagaaaagatattcgaccggagtaccgtgaagattttgttctgaccgtgacagggaaaaaaccaccttgctgtgtgctgtccaacccagatcagaagggcaaaatgaggcgcatcgattgtctgcggcaggccgacaaggtctggcgcttggacctggtgatggtcatcttgtttaagggcatcccccttgaatccaccgatggagaacgactggtgaaatcacctcagtgcagcaatcccggactctgcgtccagccacatcacattggcgtttccgtgaaagaactggatttgtacctcgcatattttgttcatgctgccgatagttcacagtccgaatctccgagtcagccatctgacgccgatattaaagaccaacctgagaacggtcatctgggcttccaggactcattcgttacttctggcgtcttctccgtcacagagctggtgcgcgtttcccagacacccatagccgctgggaccggccctaatttctctctgagcgatctggagtcctcttcctattactccatgagccctggagccatgaggagatcacttccctctacgtcctccaccagttctacaaagagactgaagagcgttgaggacgaaatggattcacccggagaggaaccattctacaccggacagggaaggagtccaggttccgggagccagtcctccggatggcacgaagtcgaacccgcttctcctcacgctaccccttctacccttcactttccgacgtcaccaattatccagcaaccagggccatacttcagccatcccgcaatacggtaccatccgcaggagactcttaaagagttcgtccagttggtttgccccgacgccggacaacaggcgggtcaggtaggattcctgaatccaaacgggtcctctcaagggaaagtccacaacccatttttgcctacaccaatgcttcctccaccccctcctcctcctatggcgaggcctgtgcctcttccagtccctgatacaaagcccccaactactagtaccgagggcggtgcagccagtcccacctcacccacttactcaacgcctagtacttccccagctaacaggtttgtttctgtggggccaagagatccatctttcgtaaacataccccagcagacccaatcctggtatttaggatag

SEQ ID NO: 232973 - DNA, 1665 bp, Artificial Sequence
  Description of Artificial Sequence: Synthetic coding sequence
atgcagatgtgtagacccgcatcttccagcgtcttgtatgttccaacacggtggcctggcggttgtggagctacatggcagtcgtgccccagtccgccacccagacgcaccagaatccctcagcgccctgcagtcatgtacagcccgctgtgccttacccaagatgaattccacccatttatagaagcgctgctgccacacgttagagcattcgcatacacctggtttaatctccaagcaaggaagaggaagtactttaagaaacacgaaaagaggatgtctaaagaggaagagagagcagttaaggacgagctgctatccgagaagccagaggtgaagcagaagtgggcctcccggctgctagctaagctcagaaaagacattcggcctgagtatagagaggatttcgtccttaccgttaccgggaaaaagccaccatgttgcgtgctgtctaacccggatcaaaaaggtaaaatgaggaggatagattgcttgcggcaggccgacaaagtttggagattagacctggtgatggtcatcttgttcaaaggaatccctttggagtccacggatggggaacgacttgtgaagtccccacagtgcagtaatccgggactctgcgtgcagccgcaccatatcggggtctccgtaaaagagctggacctttatctcgcatatttcgtgcatgccgcagattcaagccagagcgaatcaccttctcagccttccgatgctgatattaaggatcagccagagaatggccacctaggctttcaggactcttttgtcaccagcggagtcttttccgttacagaactcgtacgcgttagtcagaccccgatcgccgctggcaccggccctaatttctctctcagtgacctggagagctcttcttactatagcatgtctcccggagccatgagaaggagtctgccctcaacctcctcaaccagctcaactaagcgattgaagtctgtggaagatgagatggattcacccggagaggagcctttttataccggtcagggcaggtcccccggatccggctcccagtcgtccggctggcatgaagtggagcctggtatgccatcccccaccacattgaagaaatccgagaagagtggcttttcctccccttcaccgtcccaaacctcttcactcggcacagcgtttacacaacatcaccgacctgtgataaccggacctcgggcatcgccccacgccacacccagcaccttgcactttcccacttcacccattatacagcagcctggcccatatttttcccatcctgccatccggtatcatccgcaggaaaccctgaaggagtttgtccagctggtctgtccagatgccggacaacaggccggacaggttggcttcctgaaccctaacggcagtagccagggaaaggtgcataatccattcctccctacacccatgctgcctccacccccacctcctccaatggccaggcccgtgccactgcccgttccggacaccaaacctccgactacatcaacggaagggggagcagcgtccccaactagtccaacctactctacgccttctacttcacctgcgaatcggtttgtctctgtgggtccacgggatcccagctttgtcaacataccacagcagacacagagctggtatctcggttag

SEQ ID NO: 232974 - DNA, 1599 bp, Artificial Sequence
  Description of Artificial Sequence: Synthetic coding sequence
atgaagctcgccgactctgtcatggctggcaaggcttccgatggcagcatcaagtggcagctatgctatgatatctccgctaggacttggtggatggatgagttccacccattcattgaagcactccttcctcacgtgcgcgcattcgcctacacatggtttaacttgcaagccaggaaaagaaagtactttaagaagcacgagaagaggatgagtaaggaggaagaaagagcagtcaaagacgaattgctgtcagagaagcctgaggtgaagcaaaaatgggccagccggcttctggcgaaattgcggaaggacatccggccagaatacagagaggattttgtgctgaccgtaacaggaaaaaaacctccctgttgcgtgctctctaaccctgaccagaaaggcaagatgaggcggatcgactgtttgcggcaggctgacaaggtttggcggctcgacctagtgatggtgattctgtttaagggtattcctctggagagcacggatggagaacgcctggtgaagtcgccgcaatgctcgaatcccggactgtgtgtgcagccccatcatattggtgtgtccgtcaaggaattggacctctacctcgcttattttgtccatgccgcagactcaagccaatctgaaagtccctcccaacctagcgacgcggacataaaggaccagcccgagaatggccacttagggttccaggactcctttgttacgagtggagtcttttctgtgaccgagttggttcgggtgtcacagacccccattgcagctggcacgggcccaaacttctccttaagcgacttggagtcttcctcttactattccatgtcccctggcgctatgagaaggagccttccttctacctccagcacttcatccaccaaacgcctgaaatccgtggaagacgagatggattcacctggcgaggaaccgttttatacaggccaagggagaagccccggttcaggctctcagtcctctggttggcacgaagtggaacccggaatgccctctccaaccacattaaaaaagagcgagaagagcggattctcctcaccttctccatcccagaccagtagcctggggaccgcttttacccagcaccaccggcctgtcatcactggccctagggccagcccacacgccaccccatccaccctccattttcccacatccccaatcatacagcagccaggaccctatttttcacacccagccatccgctatcatccgcaggaaacgctgaaagagtttgtgcagctggtatgccccgacgccggtcagcaggccggtcaggtgggattcctgaaccccaatggctccagtcaggggaaggtacacaatccattcctccccacaccgatgttgccgccaccaccgccacctcctatggccagaccagttcctctgccagtgcccgataccaaacctcctacaacatcaaccgagggaggggctgcctctcctacttccccgacctattctacacctagtacatcacctgccaacaggttcgtatcagtgggcccaagggacccatcctttgtaaatatcccccagcagacccagagctggtatttaggctag

SEQ ID NO: 232975 - DNA, 1530 bp, Artificial Sequence
  Description of Artificial Sequence: Synthetic coding sequence
atgtacagcccactatgcctgacacaggacgaattccaccccttcatcgaagccctactgccccatgtacgagcattcgcctacacatggttcaacctacaggcacgtaaacgcaagtattttaagaaacacgaaaaacgtatgtccaaggaagaagaacgggctgtgaaggatgagctgttgtccgaaaagcccgaggtgaaacaaaaatgggcttcgcggctcctggccaaattaagaaaggatattaggccagaatacagggaggactttgttcttactgtaactggaaagaagcccccttgctgcgtgttgagtaacccagatcagaagggcaagatgcggaggattgactgcctcagacaagcagacaaggtgtggcgcctggatctggtcatggttatattgttcaagggaattccactggaatcaaccgacggcgagagactggtaaagtcaccacagtgttcgaaccctggcctgtgcgtgcagcctcaccatataggtgtgtccgttaaagagcttgacctctatctggcatattttgtgcacgcagccgattccagtcagtccgagagtccctctcagcccagcgatgctgatatcaaagaccaacctgagaacggacacctggggtttcaggattccttcgtgaccagtggcgtgttttcagtcaccgagctggtacgcgtcagccagacaccaatcgcagctggtacggggcctaattttagtctgtcagatttagaaagttcgtcttactactctatgtcccctggagctatgcgccgttctctcccaagcacgtcatctacctcttccactaagagattaaagtccgtagaagatgaaatggacagccccggtgaagaacctttctatactgggcaagggagatcacccggttccggcagtcagtcttctgggtggcacgaggtcgaacccggtatgccttctcctactaccctcaagaagtctgagaagtccgggtttagttccccatcgcccagccagacaagtagcctggggaccgccttcacccagcatcatcgtccagtcatcactggcccacgggcttcacctcacgccactccctcaaccctgcacttcccaactagcccgattattcagcaacccggaccctacttttcacaccctgcaatccgctatcacccacaggagactctcaaggaattcgtgcagctggtctgtcctgacgctgggcagcaggcaggtcaggtcgggttcctcaatcctaacggctcaagccaaggtaaggtgcacaacccgttcctgcccacccccatgttgcccccaccaccacctccccctatggcccgtcccgtgcctctgcccgtgcctgacactaagcctccaacgacctctacagaaggcggagccgcaagtcctacaagccctacctactctaccccctctacttctcccgctaatcgattcgtgtcagtgggcccacgcgacccaagctttgtaaatatacctcagcagacgcagtcctggtacttgggatag

SEQ ID NO: 232976 - DNA, 1506 bp, Artificial Sequence
  Description of Artificial Sequence: Synthetic coding sequence
atggatgaattccacccattcattgaagccctgcttccccatgttcgggcattcgcttatacatggtttaatctgcaggctcgcaaaagaaaatattttaaaaagcacgaaaaacggatgtcgaaggaagaggagagagccgtgaaggacgaacttcttagtgaaaagcctgaggtcaagcaaaagtgggctagcagattgctggctaagctgcggaaagatatcagacccgaataccgggaggatttcgttctgaccgtaacgggaaagaagccgccttgttgcgtgttatctaacccggaccaaaagggtaagatgcgtaggatagactgcctgcggcaggctgacaaggtctggcgtttagacttggtcatggttattctcttcaaaggcatccccctggaatcaactgatggagagcggctagtgaaaagcccccagtgttcaaatcctgggctctgtgtccagccgcaccatatcggggttagcgtaaaagagcttgacctttatctcgcctatttcgtgcatgccgctgacagttctcagtcagagagtcccagtcagccttcagatgctgatatcaaggaccagccggaaaatggtcatttaggcttccaggactctttcgtgactagcggcgtgttcagcgtgaccgagctggttagagtgtcccaaacgcctatagcagcgggaaccggtccaaacttctcgctgagtgatctggagtcttccagttactattccatgtctcccggagctatgcggcgatctctgccatccacgagcagcacctcgagtactaaacgacttaagagcgtcgaggacgaaatggacagcccaggtgaagaacctttttatacaggccagggacggagcccgggttctggatcgcaaagttctggctggcatgaggtggagcccggtatgcctagtccaactacgcttaagaaatcagaaaaatctggtttcagtagcccttccccttctcaaacctcttccctcggcaccgcgtttacgcaacatcaccggcctgtcataaccggcccacgcgctagtcctcatgcaacgccttctactttgcacttccctacctccccaattatccagcaaccaggcccttactttagccatccggcaataagataccatccacaggagactctgaaggaatttgtccagctcgtgtgtcccgacgcagggcaacaggctggccaggtcggctttctgaaccccaatggcagctcacaaggcaaagtgcataatccgtttcttcccacacctatgctaccacccccacctccaccacctatggccagacctgtgcccctgccagtgcctgatacgaaaccacccaccacaagcacagaagggggagccgctagcccaacgtcccctacctattccaccccgagcacgtccccagcgaataggttcgtatctgtgggacctagagatccatctttcgtaaacatcccacagcaaacacagagttggtacctggggtag

SEQ ID NO: 232977 - DNA, 1497 bp, Artificial Sequence
  Description of Artificial Sequence: Synthetic coding sequence
atgtattcacccctttgcctgacacaagatgagtttcaccccttcatcgaggctctgctaccccacgtgagggcctttgcttatacttggttcaacctgcaggccaggaagaggaagtatttcaaaaaacacgagaaaaggatgtctaaagaggaagaaagggctgtcaaggatgaactgctgagcgagaaacctgaagtaaaacagaagtgggcctcgcgcctgctggctaagctcaggaaggacatccgccctgagtaccgcgaggactttgtcctaactgtgacgggcaagaagcccccttgctgtgtgttgtcaaacccagatcagaaggggaagatgaggaggatcgattgtctgcgacaggcggacaaagtgtggaggctagatctcgtcatggtaattctcttcaagggcatccccctcgaatccacggatggcgaacgcctcgtgaaatccccacagtgctctaatccaggtctttgcgtacagccccatcatatcggtgtttccgtcaaggaattagacctctacttagcatatttcgtgcatgctgccgactcatcccagagcgagagccctagccagccctctgatgccgatatcaaggaccagcctgagaacggccatctcgggtttcaggacagcttcgtgacttctggagttttttcagtcactgaattagtacgggtctcccagacaccaatagcagccggaaccggtcctaatttcagcctatctgatctggagagctcgagctactattcgatgagccccggagccatgaggcggtctctgccttcaactagctctaccagctccaccaagagactgaaatctgttgaggacgagatggactcccccggtgaggaacccttctacaccggacaaggaaggtctccaggctcagggtcccaatctagcggatggcatgaagtcgaacccggtatgccctccccaacaactctaaagaagtcagagaaaagcgggttttcatctcccagcccgtcgcagacgtcttcactggggacagcgtttacgcagcaccatagaccagtcatcactggacccagggcctctccccacgcaacacctagcaccttacactttccaaccagtcccatcattcagcagcctggaccctacttttcacaccccgcaattcggtaccacccacaggagactctgaaagagttcgttcagctcgtttgccctgatgccggtcagcaagcgggacaggtggggttcttaaaccccaatggaagctcacaggggaaggtgcataacccctttctaccaactcctatgctcccaccaccaccgcctccgccaatggcgagaccggtccctctgcctgtccctgatacaaagccgcctaccacttcgactgaaggaggcgcagctagccctacttctcccatcttagtgcctgggatcaaagtagccgcatcacatcacccacctgataggccgcctgatcccttttccacattgtag

SEQ ID NO: 232978 - DNA, 603 bp, Artificial Sequence
  Description of Artificial Sequence: Synthetic coding sequence
atgatgtattcacccatttgtctgacccaggatgagtttcaccctttcattgaagccctcctacctcacgtgcgggcaattgcgtacacgtggtttaacctccaggcacggaagcgtaaatactttaagaaacatgagaaaagaatgtcaaaagatgaagaacgggcagtgaaggatgaactcctgtccgaaaagcccgagatcaagcagaaatgggcatctcgactgctagccaaattaaggaaagacatccggcaggaataccgggaagactttgttctgactgtgaccggaaaaaaacacccctgctgcgtcctgagcaatcctgatcaaaagggcaaaatccggagaatcgactgtctccggcaagcggataaggtgtggcggctagacttagtgatggttattctgttcaaggggattcctctggagagcaccgacggagagcgtcttatgaagagcccacactgcacaaatccggctttatgtgtccagccccatcatatcaccgtgtctgtaaaggagttagacctgtttttagcctactacgtgcaggagcagggaaaaaacttctttagtagcaacaagtgtatcaagatatag

SEQ ID NO: 232979 - DNA, 507 bp, Artificial Sequence
  Description of Artificial Sequence: Synthetic coding sequence
atgaactcaggggtgaacctgcagcgatctttatcgagccctccgagctctaagagacccaaaactatttcgatcgacgaaaatatggagccatcccccaccggagacttctacccaagcccctcatcgcccgctgctgggtcccggacttggcatgaacgcgatcaggatatgtcatcccccacaaccatgaagaaaccagagaaacccctattctccagcgcttccccacaggactccagtcctcgactctctacctttccacaacaccatcaccccggtatcccgggagttgcacacagcgtgatctctacgagaacgccacccccaccttctcctctgccattccccacacaggctatcctgccaccagcccctagtagttatttctcccacccaactatccgctatccgcctcatctcaacccccaagacacactgaagaactacgtgccttcatacgaccccagctctccccaaacctcgcagtcttggtaccttggctag

SEQ ID NO: 232980 - DNA, 1341 bp, Artificial Sequence
  Description of Artificial Sequence: Synthetic coding sequence
atggaaagaattcccgttagcgttgacttctgggtggtatgctgcgcagtgctcaagtgcaatcccggaatacctaagaggatgtccaccctttgttttggcttctcagatgagtttcaccctttcattgaggcgctgctgccccacgtgagagccatcgcttacacatggttcaatttgcaggcaagaaaacgcaagtactttaaaaagcatgagaagaggatgtccaaagacgaagagagagctgtcaaggacgagctactgagcgagaaaccagaaatcaagcagaaatgggcctctagacttctggctaaactgcggaaggacattagacaagagtaccgggaggactttgtcctcacagtgaccgggaagaagcacccatgttgtgttctgtcgaaccccgatcagaagggaaagatccggaggatagactgtcttagacaggccgataaggtgtggaggcttgacctagtgatggttatcctgtttaaagggatcccgctggaaagcactgatggggagcgcttaatgaagagtccccattgcacaaaccctgctctgtgcgtgcagccacaccacattaccgtgtcagtcaaggagttagatctgttcctcgcttactacgtccaagagcaggattccggccaaagcggttcgcctagccacaacgaccccgctaagaatccaccgggatacctggaagacagcttcgtcaagtccggagtatttaatgtgtccgaactcgttcgcgtgagtcgaactcctatcacccagggcacaggcgtcaacttccctatcggtgagatcccttctcagccctattaccacgacatgaatagcggcgttaatctgcagagaagtctcagttctcctcctagcagtaagaggcccaaaacaataagcatcgacgaaaacatggaacctagcccgacaggtgatttctacccgtcccctagctcgccggcagctggatcacgtacatggcacgaaagggatcaagatatgagcagccccactaccatgaaaaagccagagaagcccttattctcctcggccagtcctcaggactccagtcccagactgtcgacctttcctcaacaccaccaccctggaattcccggtgtcgcccattccgtcatctccactaggacaccaccccctccttcccccttgccatttccaactcaggccatcctgcccccagcacctagttcctatttttcgcaccctactatccgttacccgccacacctaaacccacaagacactttgaagaactatgttccaagttatgatcccagtagccctcagacatcacagagttggtaccttggctag

SEQ ID NO: 232981 - DNA, 1485 bp, Artificial Sequence
  Description of Artificial Sequence: Synthetic coding sequence
atgatgtactccccaatttgtctgacgcaggacgaattccaccctttcattgaggcactcctgcctcatgtgcgggctattgcgtatacgtggtttaatctgcaggcgcgtaaacgtaaatatttcaagaagcatgaaaaacgtatgagcaaagatgaagagcgcgctgtgaaggatgagcttctgtccgagaaaccagaaattaaacagaagtgggccagtagactcctggcaaagctaaggaaggatatcaggcaggaatatagagaagacttcgttctgacagtcaccggaaaaaagcacccttgctgcgtgctgagtaatcccgaccagaagggaaagattcgcaggattgactgcttacgacaggccgacaaagtgtggcgattagacttggtcatggtgatcctttttaaagggattcctctagaatctaccgatggcgagcgactcatgaaaagcccacactgcaccaatccagccctctgcgtccagccccatcacattaccgtgtccgtgaaggaattggacttgttcctggcctattacgtccaggagcaggattcagggcagagtggatctccgtcccacaatgacccagcaaagaacccccctggctacctggaggatagcttcgtgaagtccggagtgtttaatgtttcggagctggttcgagtgtctcggacacccatcacccaggggacaggcgtaaatttccccatcggtgaaattccttcccagccctactaccatgacatgaattcaggcgtgaatctgcagagatctctttcgtctccccctagctctaaacgccctaaaactatctcgattgatgaaaatatggagcctagtcctaccggggatttctatccgtcacccagctctcctgctgcaggttctagaacctggcacgagagagaccaggacatgagcagccctactactatgaagaaacctgagaaaccccttttttcgagcgcctcaccacaggacagttccccacggctctccacttttccacagcaccaccaccccggtattccaggggtcgcccacagcgtaatctctacgcgaacaccaccaccgccatcacccttacccttcccgacgcaggccattcttcccccagctccctcaagctacttctcgcatcctacaattcgttaccctccccatctgaaccctcaagacaccttgaaaaattatgtccccagctatgatcccagctccccccagactagtcagcccaacggatcgggccaggtggtcgggaaggtccctggacatttcacccccgtattggcgccatcaccccaccccagcgctgtacgtccagtgactctgtcaatgacagacaccaagcctattacaacatcaactgaagcctataccgcctcaggtaccagccaagcaaaccggtacgtgggcctgtctcctagagatccgtccttcctgcaccagcagcagagttggtacctgggctag

SEQ ID NO: 232982 - DNA, 1263 bp, Artificial Sequence
  Description of Artificial Sequence: Synthetic coding sequence
atgatgtattcgcccatatgcctgactcaggatgaattccacccatttatcgaggctttgctgccccatgtcagagcaatcgcatacacctggttcaatttgcaggcgcgtaagaggaagtactttaaaaaacacgagaaacgcatgagcaaggatgaagagagagccgttaaagacgagctcctttcggagaaaccggagattaaacagaaatgggcttctcggctgcttgccaaactgcgaaaggatatccgtcaggaatatagagaggattttgtcctcacagtgacaggcaagaaacatccatgctgcgtgctgagcaacccagatcagaaaggcaaaattcgcagaattgattgtctgcggcaggctgacaaggtctggcggctggatctggtaatggtgattcttttcaaagggatcccacttgagagtaccgacggtgagagattgatgaagtctccacactgcaccaaccccgctttgtgtgtccagccgcatcacattaccgttagcgtgaaggagctggatctgtttctggcctattacgtgcaagaacaggatagcggccaatctggatccccatctcataatgatcccgctaagaatcccccaggttaccttgaggacagtttcgttaagtccggcgtgttcaacgtgagcgagctagtgagagtgtccaggacacccatcacccagggcacaggcgtaaacttccctatcggggagattcctagccaaccatattaccatgatatgaattctggtgtgaacctccagagatccctgagttccccaccgagctccaaaaggcccaaaacaatcagtatcgacgagaatatggagccaagtcctaccggggacttttatccatctccatcatccccagccgcaggttctaggacctggcacgagcgcgaccaggatatgtcatcacctacaacaatgaaaaaaccagagaagcctctgttcagcagcgccagtccacaagactccagccccaggttaagtacttttccccagcatcaccaccctggaataccaggagtggcgcactcagtgatatccacacggacaccccctccaccatctccgctgccgttcccaacccaggccatactccctccagctcctagctcctatttctctcatcccacaattagatatcccccacacctgaacccccaggatacgctgaagaactacgtgccgtcctacgaccctagtagtccccagacttctcagtcttggtatttagggtag

SEQ ID NO: 232983 - DNA, 1686 bp, Artificial Sequence
  Description of Artificial Sequence: Synthetic coding sequence
atgatgtattcccctatctgccttacgcaggacgagtttcacccttttatagaggccctgctgccccacgtacgcgctatcgcttatacctggtttaaccttcaggctaggaagagaaaatattttaagaaacacgaaaaaagaatgtcgaaggacgaggaaagagccgttaaagatgaattactctctgagaagccagaaattaaacagaagtgggcctccagacttttggctaagctgcgcaaggatattcgccaggaatacagagaggactttgtactgactgtgaccggaaaaaagcacccatgttgcgtgctctcaaacccagatcaaaagggtaaaattcggaggatcgactgcttgcggcaggcagacaaagtgtggagattggacctagttatggtcatcttgttcaaaggcatccccctggagtctacggacggcgagagacttatgaaaagtccccactgtacaaacccagctttatgtgtgcagcctcaccacattactgtgagtgtgaaagagctggacctgttcctggcatactacgtacaggagcaggactcggggcagtccggaagtccgtcgcataatgaccctgcaaagaatccccctggttacctagaggatagctttgtgaagtcaggagtcttcaatgtgagcgagcttgtgagagttagccggacgcctattacgcagggaaccggcgtgaattttccaataggcgagatccccagtcagccctattaccacgacatgaatagtggcgttaacctccaacgatcactatccagtcccccaagttccaaacggccaaagacaattagcattgatgaaaacatggagccgtcacctactggcgacttttatccctctccttcttctccagctgccggaagccggacctggcacgaaagggaccaagacatgtcatccccgaccacaatgaaaaaacccgaaaaacccttgtttagctctgcctccccccaagattcctcgccccgactgtccaccttccctcagcaccaccatccaggtattcccggagtggctcattctgttatttcaacacgcaccccccctcctcctagccccctccctttccctacacaggcaattcttccgcctgccccaagctcgtacttctcccaccccactattagataccctcctcatttgaatccccaggacaccctgaagaattatgtgccgagttatgatcccagtagtccccagacatctcaacctaacggctcgggccaggtcgtcggcaaggtgccaggccactttactcctgtccttgccccttctccacacccatccgctgtccgcccagttactctgagcatgactgatacaaaacctataactacctctactgaggcatatactgcttccggaacctctcaggccaaccggtatgtgggtctaagcccccgtgatcctagtttcctacatcaacagcaattgagaatctgtgattggaccatgaaccagaacggcaggcatctgtacccctctacctctgaggacacattaggaatcacctggcaatccccagggacttgggcttcactggtgcctttccaggtgtctaatcgcacccccatattgccagctaatgtccagaattacggccttaatatcatcggtgaaccctttcttcaggccgaaacttctaactag

SEQ ID NO: 232984 - DNA, 1464 bp, Artificial Sequence
  Description of Artificial Sequence: Synthetic coding sequence
atgatgtactctcctatttgcctgacacaggacgagttccaccctttcatcgaggctctgttgccgcacgtgcgcgcaattgcttacacatggttcaacctgcaggccagaaaacggaagtactttaaaaaacatgaaaagcgcatgagtaaagacgaagagagggccgttaaagatgagctcctctcagagaaaccagagattaaacaaaaatgggcgagcaggctgctggccaagttaaggaaggacattagacaggagtatcgggaagattttgtactgactgtaacaggtaagaagcatccatgctgtgttctgagcaaccccgaccaaaaagggaagatccgcaggatcgactgtctgagacaggctgataaagtctggcgactggacttggtgatggtgatactctttaagggaatcccactagaaagcacggacggcgagcgcttaatgaagtctccgcactgcactaatccagcactgtgcgtgcagccccaccatatcacagtatcagttaaggagctggacctctttttggcttattacgtgcaagaacaggacagtgggcagtccggttcaccatctcataacgatcccgctaaaaacccaccaggttacttagaggactccttcgtgaagtctggcgtgttcaacgtatcagaactggttagagtgtctcgcacccctattacgcagggcactggtgtaaatttccctattggcgagattcctagccagccttactaccacgatatgaattctggtgtgaatcttcagcggagtctgtcatcacctccctcctctaaaaggcccaaaactattagcatagatgagaacatggagccttcacccaccggagatttttacccatccccatcctcacctgccgctggtagccgcacttggcacgaacgggaccaggatatgtccagtccgaccaccatgaagaagcctgagaaacccctgttctcctctgccagcccacaggattcttctcctagattatcaacttttccacaacatcaccacccaggtatcccgggagtcgcacactctgtgatcagcacccggactcctccccctcccagtccactaccatttccaacccaggccattttgccccctgcaccgtcgagctatttcagccacccaacaattagatatcccccacacttgaaccctcaggacaccctcaaaaactatgtgccgtcatacgatcccagcagcccccagacctcacagcttagaatctgcgattggaccatgaatcagaatggtcgccacctgtacccgagcacctctgaggatactttgggcatcacttggcagtctccaggaacttgggccagcctcgttccattccaggtgtccaaccggacacctatcctgcccgctaatgtccagaactacggcctgaatattattggggagcctttcctgcaggcagaaacatcaaactag

SEQ ID NO: 232985 - DNA, 1713 bp, Artificial Sequence
  Description of Artificial Sequence: Synthetic coding sequence
atgatgtactcccccatatgcctgacccaggatgagtttcatcctttcatcgaggcgcttctcccccacgtgagagctattgcctatacttggttcaacctccaggctagaaaacgtaaatatttcaagaagcatgagaaacgcatgagtaaggacgaagagagagcagtgaaggatgaactcctgtccgagaagcccgaaatcaagcagaaatgggcctcaaggcttttagcaaagttgagaaaggatattcggcaggagtatagagaggacttcgtgcttacggttactggtaagaaacacccctgctgtgtgctgtccaatccagaccaaaagggaaagatccgacggattgactgcctacgccaggctgataaggtctggcgtctagacttagtaatggtaatcctattcaagggcatacccctggaatcaacagacggcgagaggctaatgaagagccctcactgtacaaaccccgctttgtgtgtgcagccccaccatattacagtatctgtcaaagagctagatctgttcctggcctattatgttcaggaacaggactctggacaatccggctccccttcccacaatgacccagcgaagaatcctcctggataccttgaggactcttttgtgaagtccggggtttttaatgttagtgaactcgtgcgcgtgagcagaacccctatcacccagggtaccggggtcaatttccctatcggcgagattccctcacaaccttattaccacgatatgaacagcggcgtcaatctccagcggtccttgagctctccaccgagctccaaacgcccaaaaaccattagtatcgacgagaacatggagccgtctcctaccggggatttttatccatccccatcaagtcccgctgccggttcaagaacttggcacgaaagagatcaggatatgagctcacctactaccatgaagaaaccagagaaaccgctctttagcagtgccagcccgcaggattcatctccaaggctcagcactttccctcagcatcaccatccaggcatcccaggagtggctcactctgttataagcaccaggacgcctcctcccccttcacctctgccttttccaacgcaggccatcctgccccctgctccgtccagctacttctcacaccctaccatcaggtacccccctcacctgaatcctcaggacaccttaaagaactacgtcccttcatacgacccttcgtcccctcagaccagccagccaaatggaagtggacaggttgtcggtaaggtaccagggcactttaccccagtactggcccctagtcctcatccgtctgctgtgcgccctgtcaccttgagtatgactgataccaaacccatcacaaccagcaccgagggcgaggccgcatcaccaaccgcaacgacatacactgcttcaggcacctctcaggctaaccgctacgtggggctttcccccagggatccatcatttcttcaccagcagcagctgaggatttgcgattggacgatgaaccaaaacggccgacacctgtacccttctacaagcgaggatacactcggtattacttggcagtcaccaggcacgtgggcttcgttagtcccctttcaggtgtcaaaccgcacccccattttacctgccaatgtccagaattacggcctgaatataatcggcgagccatttctccaggctgagacaagtaattag

SEQ ID NO: 232986 - DNA, 930 bp, Artificial Sequence
  Description of Artificial Sequence: Synthetic coding sequence
atgaactctggagtgaacttacagaggagcttgtcatcccccccttcttccaagcgtcctaagactatcagcattgatgaaaacatggaacctagccccactggagacttctacccatccccgagtagtcccgctgccggaagtaggacttggcatgagcgggatcaagatatgagcagtcctaccacgatgaagaaacctgagaagcctctcttcagctcggctagcccacaggacagctctcccaggctgtcaacgttccctcagcaccaccacccaggcattcctggcgtggcacacagtgtgatctccacccggacgccgcctcccccttctccattaccatttccaacacaggctatactgcccccagcacccagctcgtacttcagccacccgaccattcgataccctccacatctcaatccacaggatacactgaaaaactacgttcccagttacgatcctagctcaccacagacaagccaacccaatggaagtgggcaagtcgtgggaaaggtgccaggacacttcactcctgttctcgcacccagcccgcacccgtcggccgtccgaccagtgaccctgtctatgactgataccaagccaatcactacatctactgaggcctacaccgcctctggaacctctcaggccaaccggtatgtggggttgagtcccagggacccctcattcctccatcagcaacagctaagaatatgcgattggacaatgaatcagaatggacgccatttgtacccaagtacatctgaggacactctcggcatcacatggcagagtcccggtacttgggcatcattggtgccattccaggtctcaaatcgaactccgatcctgcctgccaatgtccaaaactacggtttaaatattatcggggaaccctttcttcaggctgagacctcgaactag

SEQ ID NO: 232987 - DNA, 1272 bp, Artificial Sequence
  Description of Artificial Sequence: Synthetic coding sequence
atgtatagttccccgttgtgcctgacccaagacgaattccaccccttcatcgaggcactgcttccccatgtgcgagcgtttgcatacacttggtttaacctgcaggcgcgtaaacgcaagtacttcaagaaacatgagaaacgtatgtcaaaagacgaggagcgggctgtgaaggatgaactgctgggggaaaagcctgaagtgaaacaaaagtgggctagccgcctgctcgccaagttgaggaaagacatccggccagaatgccgggaggatttcgttctgagtattactgggaagaaggccccaggttgtgtcttatctaatcccgatcagaagggaaaaatgcgccgtattgactgcctgcgtcaagcagacaaagtgtggaggctagatctcgtgatggtgattctctttaaaggcatcccactagagagcacagacggagagcgtttggtaaaggccgcacaatgcggtcaccctgttctgtgtgtacagcctcatcatatcggcgtcgcagtgaaggagctggacctgtacctggcctattttgtacgggagagggacgctgaacagagtgggagtccacgcactggaatgggcagcgatcaggaagatagcaaacctattacactagatacgactgacttccaggaaagcttcgtgacttccggtgtattctcagtcacagaactaatccaagtgagtcgaactcccgtggtgacagggaccgggcctaactttagtctgggggagctccaaggccatctcgcttacgatctcaaccctgcgtcaacaggactgagacgcactctacccagtacctcaagcagtggctcaaagagacacaaaagtgggtcgatggaagaggacgtggacacttccccgggaggcgattactacacatcgccctcctctccaacttcaagtagtcgcaactggacggaagacatggaaggagggatctcgtcgcctgtgaaaaagacagagatggataagagtcctttcaactccccatctcctcaagacagtccacgcctgagtagtttcacccagcaccatagacccgtcattgccgtccactcgggtattgccagaagcccccatccatcttccgctctgcattttcctaccacgagcatcctcccccaaaccgcatccacctattttcctcacacggctataagatatccgcctcatctcaatccccaggaccctctgaaggatctcgtttcgctggcctgcgacccagcaagtcagcagcccggaccatag

SEQ ID NO: 232988 - DNA, 1287 bp, Artificial Sequence
  Description of Artificial Sequence: Synthetic coding sequence
atgtactccagtccgttgtgcctgacacaggatgagttccacccattcatcgaggcgctgttaccccacgtgcgagctttcgcttacacctggtttaatttgcaggcccgaaaacggaagtatttcaagaaacacgaaaaacgcatgtccaaggatgaggaacgtgccgtcaaggacgagctgctgggggaaaaacctgaggtaaagcagaagtgggcctcacggctcttagcgaaactcaggaaggacattcgcccagagtgccgcgaagactttgtgttgagcattaccggcaagaaagcaccaggctgcgtactctctaaccctgatcagaagggaaagatgaggcggattgactgcctgcggcaggcagacaaagtctggcggctggacctggtcatggttattttattcaaaggcattcctcttgagtcgacggacggagagagactcgtcaaagccgctcagtgcgggcacccggtgctgtgtgtgcagcctcaccatattggcgtggccgtgaaggaacttgacctttacctcgcttacttcgtgagagagagagatgccgagcagtccgggtcgccacgcaccggaatgggcagcgaccaggaagatagcaagccaatcacactggatacaactgacttccaggaatcgtttgtcacttctggagttttctccgttactgaactcatacaagtgtctaggactcccgtggttaccggcaccggccctaacttctctctgggggaattacaggggcacctggcctatgacctgaacccagcttcaactgggctgcgcaggactctgccaagtacaagctcctccggatccaaacgccacaaaagtggatcgatggaggaagacgttgataccagcccaggcggtgactattatacgtcgccctcgtccccaaccagtagctctaggaactggacggaagatatggaaggagggatcagttctcctgtaaagaaaacagagatggataagtcgccattcaactcgccgagtccgcaggacagcccccgactatcctcttttacgcagcaccaccgtccagtgatagcggtacattccgggatcgctagatcccctcatccctcatctgcattacatttcccaactacaagtattctcccgcaaacagcatccacatattttcctcatactgcaattcggtatcccccacacctgaatccccaggaccctctgaaggaccttgtatcactggcctgcgatcccgcttcccaacagccagggcctagttggtatttgggctag

SEQ ID NO: 232989 - DNA, 1527 bp, Artificial Sequence
  Description of Artificial Sequence: Synthetic coding sequence
atgtactcgtcgcccctctgcctgacccaggatgagttccatccatttattgaagccctgttaccacacgtgcgagcattcgcttacacatggttcaacttacaggctaggaaacgcaaatattttaaaaagcacgagaagagaatgtccaaggacgaggaacgcgcagtaaaagacgagctgctcggggaaaagcctgaggtgaaacagaaatgggcctctcgtctccttgccaagctcaggaaagacattaggcccgaatgccgtgaagattttgtgctgtccattacaggaaaaaaagcccctggctgtgtcttgtcaaaccccgatcagaaggggaagatgaggcgaatcgattgcctgagacaggctgacaaagtctggcgtctggaccttgtgatggtgattctgttcaagggaattccactggagagtacagacggggaacgacttgtcaaggccgcacagtgtggccatcctgtgctgtgcgttcagcctcaccatattggcgttgcagtgaaagagctcgacctttatctggcatactttgttcgggagagagatgcagaacagtccggctcccccaggacaggaatggggtccgatcaggaggacagcaaacctataacattggacaccacagatttccaggagagcttcgtcacctccggcgttttctctgtgacagagttgatccaggtctcccggacgcctgtggttacagggacagggcctaacttttcactgggggagttgcagggacatcttgcatacgacctgaaccctgcatctactggtctgcgcagaacactcccaagtacttcaagcagcggatccaaacgtcacaagagtgggtcaatggaggaagatgtggatacctcccccggaggagattattatacatcgccctcgtctcccacaagttctagccgtaattggacagaggacatggaaggcggaatctcttctccagtgaaaaaaactgagatggataaaagcccctttaattcacctagcccgcaggatagtcctcggctctcttcctttacacagcatcaccggcctgtgatcgcagttcactcgggcatcgcgagaagccctcacccatcctctgctctccactttcctacaacaagcattctgccccagaccgcctctacctattttccacacacagctattcggtacccgcctcatctgaaccctcaggatccactgaaggacctggtcagcttggcttgcgaccctgcgagccagcagccagggcctctgaatggatcaggacagctgaagatgccttctcactgcctcagcgcacaaatgctggcacccccaccgccaggactgcctagactggccttgcctcccgcaacaaagcccgctacgacttctgaaggcggagccacttctccaacatctccatcgtattcccccccagatacctccccagcgaaccggtcctttgtgggtttgggcccacgggaccctgcaggtatctatcaggctcagagttggggggatggctag

SEQ ID NO: 232990 - DNA, 1221 bp, Artificial Sequence
  Description of Artificial Sequence: Synthetic coding sequence
atggacgagtttcatcccttcattgaggctttgcttccgcacgtacgcgctttcgcttatacatggtttaatttgcaggcccgaaaaaggaaatattttaagaaacacgaaaagcggatgagtaaggacgaagagagggcagtgaaggatgagcttctgggggagaaacccgaggttaaacagaaatgggcctctagactgctggccaagctgagaaaagacattcgtcctgaatgccgggaggactttgtcctgagcatcacaggaaaaaaagcgcctgggtgcgtcttatctaacccggaccagaaggggaaaatgcgaagaattgattgtcttcggcaggccgataaggtctggagacttgacttggttatggtcatcctgttcaaaggaatacctctggaatccacagacggcgagagattggtaaaggcggctcagtgcggtcatcccgtattatgtgtgcagccacaccacatcggcgtcgccgttaaggagctggacctgtacctagcctatttcgtccgagagcgagataccactgatttccaggaatcctttgtgacctccggcgttttttcagtgaccgagctgatccaagtctcccggacacccgttgtgacaggcaccggacctaatttctcacttggcgagttgcagggacatttggcctatgatcttaaccccgcttccactggcctgagaaggactttaccatcaacatccagtagcgggtctaaaagacacaagagcgggtctatggaagaagatgtagatacctcgcccggaggtgattattatacatcgccaagctctccgacatctagctcgcgaaactggactgaggacatggaaggtgggatctcaagcccagtgaagaaaacagaaatggataagtcgccattcaatagcccttcacctcaggacagccctaggctttcttccttcactcagcatcatagacccgtgattgcagtacactccgggattgctcgaagcccgcacccctcctctgccctgcactttcccaccaccagcatattgccacagactgcctcaacctacttccctcatacagccatcagatacccgccacacctgaatcctcaggacccattgaaggatctggtgagtttggcatgtgaccctgcctctcaacaacccggtcccccaacactccggccaacccgccctctacagaccgttccattgtgggattag

SEQ ID NO: 232991 - DNA, 1293 bp, Artificial Sequence
  Description of Artificial Sequence: Synthetic coding sequence
atggatgagtttcatcccttcattgaggccctccttccgcacgtgcgcgcatttgcctacacctggtttaatctgcaagcccgaaagaggaaatactttaagaaacacgagaaacggatgtctaaagatgaagagagggccgtgaaggacgagctgctaggagaaaaacccgaagtaaagcagaagtgggctagcaggctgctcgccaagctgcgaaaagatattagacccgaatgtagagaggacttcgtgctcagtatcaccggaaaaaaggctcccggatgtgtactatccaatccagatcaaaaaggcaaaatgagacgcatcgattgtctccgacaggccgacaaggtctggagactggacctggtcatggtgattctgttcaaaggtattcctttggagagcactgacggcgagcgtctggtaaaagccgcacaatgcggccacccagttctgtgtgttcagccacaccacataggcgtcgctgtgaaggaactcgacctctacctcgcttactttgtgcgcgagcgagacgctgaacaaagcggctctcctcgcacaggcatgggatctgaccaggaagatagtaaaccaattactctggatacaaccgatttccaggagtccttcgtgacatccggggtcttttcggtgacagagttgatccaggtttcaagaaccccagtggtaacaggtacaggcccaaacttctctttaggggagctccaggggcacctggcatacgatctaaatcccgcaagcacaggcttaagaaggacactgccatccacgtcctccagcggctctaaaagacacaaaagcggcagcatggaagaggacgtggatacgagtccaggtggcgactactatactagccccagtagccccacctccagcagccgaaactggactgaggacatggaaggaggaattagctctcccgtgaagaaaactgagatggacaagagcccattcaacagcccctcaccgcaagactccccaaggctgtcctctttcacacagcatcaccggccagttatagccgtccactctggcatagctaggtctccccacccgtctagcgctctgcacttcccaactaccagcattctgcctcaaactgcctctacatacttcccccatactgcaataaggtacccccctcatctcaatccccaggatcctttgaaggatctcgtatcgttggcttgtgatccagcgtcacaacagcctgggccaccaactttgaggcccaccaggccactgcagacagtaccactctgggactag

SEQ ID NO: 232992 - DNA, 1500 bp, Artificial Sequence
  Description of Artificial Sequence: Synthetic coding sequence
atggatgaatttcatcccttcattgaggcactgttgccccatgtgcgcgcttttgcatatacctggtttaatctccaggctagaaaaaggaagtacttcaaaaagcatgagaaacgcatgtcgaaggacgaggagagggccgtaaaggacgagttattgggcgaaaaacccgaggtgaagcagaagtgggcctcgcggctcctggccaagctccgcaaggacatccgcccagaatgtcgagaggactttgtgctttctatcacagggaaaaaggccccagggtgcgtactgtctaaccctgaccagaagggcaaaatgaggagaatcgactgtttaagacaggctgataaagtctggcgcctagacctcgttatggttatcctgttcaagggcatacccctcgagagcacagacggcgaacgtctcgttaaggcagcgcaatgtgggcaccctgttttgtgcgtgcaaccccatcacattggcgtggctgtgaaggaattagacctctacctggcctatttcgtgcgggagcgggacgctgaacaaagcggttctcctaggacaggcatgggatccgaccaagaggactcaaagccgatcactctggacactaccgattttcaggagtcgtttgtcacctccggggtgttctccgtgacagagctcattcaggtgtctagaacacctgtagtgaccggtacgggacctaactttagcctcggcgagctgcaaggccacctggcctacgacctgaatcctgcttctactggcctgcgtcgtaccctgccttctacctctagcagtggctcgaagagacacaaatctggatctatggaagaggacgtagacacctccccaggcggagattattatacaagtccttccagtcccacctcttcctccagaaattggactgaggacatggaaggcggtatatcaagtccagtgaagaagactgagatggacaagagccctttcaactcgcccagtccacaggattccccgaggcttagctctttcacccaacatcaccgacccgtcattgctgttcacagcggaatcgctagaagcccacatccgtcgagcgcgctacacttccctactacatcgattctgccccaaaccgcaagtacttatttccctcacactgctatcaggtatcctccccatttaaatcctcaggaccccctgaaagatctggttagcttagcctgtgaccctgccagtcagcaacccggacctctgaatgggagcggacagctgaagatgccctcccattgcctctcagctcagatgctggccccacccccaccgggtctacctcggctcgctttaccacccgcaacaaaacctgcaacgacatcagaaggaggcgctacttctccgacctcgccgtcgtatagcccacctgacacctccccggctaacagaagctttgttgggctggggcctcgcgaccctgccggaatttatcaggcccagtcttggtatctaggctag

SEQ ID NO: 232993 - DNA, 1500 bp, Artificial Sequence
  Description of Artificial Sequence: Synthetic coding sequence
atggacgagtttcacccctttattgaagcactgttaccccatgtgcgtgcatttgcctacacttggttcaacctccaggctcggaaaaggaaatattttaaaaagcatgagaaacgcatgagcaaagatgaggaacgggctgtcaaagacgagttactgggggaaaagcccgaggtcaagcagaaatgggctagtcgattactcgctaagttgaggaaagatatccggccagagtgcagagaagactttgtgctatcaattactggcaagaaagccccaggctgcgtcctgtccaaccccgaccagaaaggtaaaatgcggcgtattgactgcctccgtcaggcggacaaggtctggcggctggaccttgttatggtcattttatttaaaggcattcccttggagagcactgacggagaacgcctggtcaaggctgcccaatgcggccaccccgttctctgtgtgcaaccacaccatattggggtagcagtgaaggagttggacctttatctggcttacttcgtgagagaacgagacgccgagcagtcagggtcccctagaaccggcatgggatccgatcaggaggactccaaacctatcacccttgatacaactgattttcaggaaagcttcgtgaccagtggcgtgtttagtgttactgagcttatccaggtaagtcggacccccgtagtgaccgggacaggcccaaacttctccctgggtgagctgcagggtcatctcgcttacgatctgaacccggcttccactggattaagacgaacgttaccttcaacgtcctcatcggggagcaagcgccataaatctggcagcatggaggaggatgtggatacaagccccggaggagattactacacgtctccatcttctccaacctcaagtagccggaactggacagaagatatggaggggggaatctcttcccctgtgaaaaaaaccgagatggataagtcccccttcaattcaccatctccacaggatagcccacgccttagtagctttactcagcaccataggcccgttatcgccgtgcatagtggcatagcccgaagtccacacccttccagcgcgcttcacttccctacaacgagtattctgccgcaaactgcgtccacctattttccacataccgctatcaggtatcctccccatttgaaccctcaggatcctctgaaagacctcgttagcctagcgtgtgaccctgcatctcaacaacccggaccgctaaacgggtctggtcagctcaagatgccctcccattgcttgagtgcgcaaatgctggcaccaccgccaccaggactgcccagattggccctgcctcctgccaccaaacctgcgaccacttcagaaggtggcgcaacttctcccacaagtccaagctacagtccgcctgatacctctccggcaaaccgcagctttgttggtctgggacctcgggatccagctgggatttatcaagcacagtcttggtacctaggttag

SEQ ID NO: 232994 - DNA, 1212 bp, Artificial Sequence
  Description of Artificial Sequence: Synthetic coding sequence
atgggagctactgagcctggaggggatactagtagcgatgagttccatcccttcatcgaggccctgcttccacatgtaagagcgttttcttatacatggttcaacctgcaggctagaaagcggaagtattttaaaaagcatgaaaaaaggatgagtaaagatgaggagcgggctgtgaaagacgagcttcttggcgagaagccagaaatcaaacaaaagtgggcttctcggctcctcgccaaattacgaaaggatattcgtccagaattccgagaagacttcgtcctaactattactggcaaaaaaccaccttgctgcgtgctctcgaacccagaccagaagggaaaaattagacggattgattgcctccgacaggcagataaggtctggcggttagatctcgtcatggtgattctgtttaaggggattcccctcgagagcactgatggtgaacgcctgtataagtcacctcaatgttctaaccccggtctatgcgtacagccccaccacattggcgttactatcaaagaattggatctttacctagcctatttcgtgcacactcctgaaagcggccagtccgactcctccaaccaacagggagatgccgacattaagcctctgcccaacggccatctatctttccaagactgttttgtgacttctggagtctggaatgtaacagaactggttagggtctcacaaacccctgttgcgactgcgtccggcccaaattttagcctagctgatcttgaatccccttcttactataacattaaccaggtaaccctcggaagacgtagtatcacaagccccccttccaccagtaccaccaaaaggcctaagtccatcgacgattctgaaatggaatcccctgtcgatgacgtcttctacccaggaaccggccgtagtccggcagctggtagtagccaatcttccgggtggcctaacgacgttgatgctgggtccccccgagccactgcatctgctttgcactttccttctacttctattattcagcaatcaagcccctacttcactcaccccacaataaggtatcatcaccaccatgggcaggactcgctcaaggagtttgtgcaatttgtgtgctctgatgggtccgggcaggctaccggccagcattcacaaaggcaggctccccctctacccaccggtctgagcgctagtgaccctggaaccgctaccttttag

SEQ ID NO: 232995 - DNA, 1383 bp, Artificial Sequence
  Description of Artificial Sequence: Synthetic coding sequence
atgctgccggcttgccggctccaagatgaattccaccctttcatcgaagcacttcttccccatgtccgggcattctcttacacatggttcaacctacaagcccgtaaacggaagtacttcaaaaaacatgaaaaacgtatgtcgaaggacgaggaacgcgctgtaaaggacgaacttttaggcgaaaagccagaaatcaaacaaaaatgggcaagccgactgctggcgaagctgaggaaggatatcaggccggagttcagagaggatttcgtgctaaccattactggcaaaaagccaccatgctgtgtactgagcaatcctgatcaaaaaggcaagatcagaagaatcgactgcttgagacaggccgacaaagtctggaggctggatctggtcatggttattcttttcaagggcatacctcttgaatctacagatggagaacggttatataagtcccctcagtgctcaaacccgggactgtgcgtccaaccgcaccacattggggtgacgataaaagagctggatctctatctagcgtactttgtgcatacccccgagtcgggtcaatctgattcgagtaaccaacaaggagacgcagacattaagccattacctaacggccacctgagctttcaggactgcttcgtgactagcggtgtatggaacgtgacagaactggtgcgggtatctcagacccctgtagctaccgcgagcgggccaaatttctcgctggcagatctggagtccccttcatattataacattaaccaagtgactctgggtaggagaagcatcacctctccgccaagtaccagcaccaccaaaaggccaaagagtattgatgactccgagatggaatcccctgtggacgatgtgttctaccccggaacggggagaagccctgcagcgggttcgtcccagagctccggttggcctaacgacgttgacgccggaagcccccgagcgacagcatccgctctgcacttcccaagcacttctattattcagcaatcaagtccatactttacccaccctaccattcgctaccatcaccatcatggccaggattcactcaaagagtttgtccagttcgtttgctcagacgggtctgggcaggcaactggacagccaaacggaagtggacaggggaaggtgccaggcagtttcctactgccacctccccctcccgtggcaagacctgtgcccctgccaatgccggattccaagagtactagtactgccccagacggtgccgctcttacacctccctcgccgtccttcgctactactggggcttcttccgccaatcggttcgtgtcaatcggcccacgcgacggtaatttcctgaatattcctcagcagtcacagtcttggtttctgtag

SEQ ID NO: 232996 - DNA, 1326 bp, Artificial Sequence
  Description of Artificial Sequence: Synthetic coding sequence
atgtactccccttattgccttactcaggatgagtttcacccttttattgaggcacttcttccgcacgtccgtgcattcagctatacctggttcaatctgcaggccaggaaacggaagtatttcaagaagcacgagaaacggatgtcaaaggacgaagaaagggccgttaaggacgaactgctgggggagaaacccgaaattaagcaaaaatgggcatcccgtctgttggccaaattacgaaaagacatcagacccgagttcagagaagactttgtacttactattacgggcaaaaagcccccatgttgcgtgctatctaatcccgatcagaaaggaaaaatccgtcgcatcgactgccttcggcaggcagataaagtatggagactcgacttagtgatggttatcctgttcaaaggaatcccactcgaaagcacagacggagagcgcctctacaaatcaccacagtgctccaatccaggtctctgcgtccagccccaccacatcggggtcacaatcaaagaactggacttatatttagcctacttcgtgcacacacctgagtctggccaaagcgactcctcaaaccaacaaggggacgccgatattaagcccttgcctaatggacatctgtcattccaagactgcttcgtcacgtcaggcgtttggaatgttacagagttggtccgggtcagccagacccccgtcgccactgcctcaggaccgaatttcagcctggcggatctggaatcgccaagttattataacatcaatcaagttactctagggaggcggtccattaccagtccacccagcacatccacgacgaagcggcctaagagtatcgatgactctgagatggagtctccggtggatgacgtattttaccctggaaccggacggtcccccgctgcaggctcttctcagtccagtggatggcccaatgacgtggatgccggtccagcttccctgaagaaatccggaaagcttgatttctgtagtgcgctgagttcccagggaagcagccctagaatggctttcacgcaccaccccctccctgtcctcgccggtgtaaggcccggtagtcctcgagccaccgcttcggccttgcatttcccgagtacttctatcatacagcaatcttccccttacttcacccatccaacaattcggtaccatcaccaccacgggcaagactcactcaaagaattcgtgcagttcgtctgcagtgacgggagcgggcaggcgacaggtcagcatagccagaggcaggcacctcccctgccaacaggcctgagcgcttcggatccaggcactgccacgttttag

SEQ ID NO: 232997 - DNA, 1509 bp, Artificial Sequence
  Description of Artificial Sequence: Synthetic coding sequence
atgtacagcccgtactgcctcacccaagatgaattccatccgtttattgaggccttgcttccacatgtgcgggcattctcttacacgtggtttaatctgcaggcaaggaagcgcaagtactttaaaaaacatgagaaaaggatgtctaaggatgaggagagagcagtgaaggatgagcttctaggcgaaaaacctgaaatcaaacagaaatgggcaagcaggctgctcgcgaaactgagaaaggacatacggcctgagttccgggaagactttgtgctgacaatcaccggaaaaaaaccgccttgttgcgttctaagtaatcctgaccagaagggcaagatccgacgtatcgattgtttgagacaggccgataaggtgtggagactcgatctggtcatggtgatcctgtttaagggaataccactggagagtactgacggggagcgtctgtacaaaagtccgcaatgctcaaaccccggtctctgtgtgcagcctcaccacatcggcgtgaccattaaagaactcgacctgtatctggcatactttgtgcacacccccgagagcggtcagagtgactcctcgaaccagcagggggatgcagatatcaaaccgttacctaacgggcacctttcgtttcaagattgcttcgtcacgagtggcgtgtggaatgttacggaactggtccgtgtgagtcagacccctgtagcgacggcttcaggtcccaatttcagcctggccgacttagaatcacccagctactacaacatcaatcaggtgactctggggaggcgaagcattacaagccccccatctaccagtaccacaaagagacccaagtcgatagatgattccgagatggaatctcccgtggatgatgtgttctatcccggtacaggacgctcccccgctgctgggagcagtcagagctccggctggcccaacgatgtggacgccggacccgcatcgttaaaaaagagcgggaagttggatttttgcagtgccctgagcagccaaggctcttctccacggatggcctttactcaccaccctctaccagtgctggccggagtgagacccggttctcccagggctactgccagcgccctgcacttcccgtccacttccatcattcagcagagctctccctatttcacccatccaacaatcagatatcaccatcatcacggacaggattctctcaaagagtttgtgcagttcgtttgctccgatggcagtgggcaggcaacaggtcagcctaatggctccgggcagggaaaagtcccaggaagcttccttctgccaccaccgcctcctgtagcccgacctgtgcctttgcccatgcctgacagcaaatctacctcaactgcgcctgacggtgcagcactcacccccccatctccctcattcgcaacaaccggcgcaagctcagcaaatagatttgtgtcgataggacccagagatgggaacttcttaaatattccccagcaatcccaaagttggtttctttag

SEQ ID NO: 232998 - DNA, 633 bp, Artificial Sequence
  Description of Artificial Sequence: Synthetic coding sequence
atgtcgaaggacgaggaacgggctgtgaaggatgagcttctcggcgagaaacccgagatcaagcaaaaatgggcaagcaggttgctggcaaagttgcggaaggacatacggccagaatttagggaggattttgtgttgactatcactggaaagaagccgccatgctgcgtcttatctaatccagatcagaagggcaagatccgacgcattgattgcctgcggcaggcagataaggtctggagactcgacctcgtaatggtcatcctgttcaaagggattcccctggagagcacggacggggaaaggctgtacaagtctccacagtgtagtaatccgggtctttgtgttcagccccaccacatcggagtgactatcaaagagctcgacctctacctggcttatttcgtgcacaccccagaatcgggccaatcagactcctctaaccaacagggcgacgcagacattaaacccctacctaatggtcatctatccttccaggactgtttcgtgacctctggagtgtggaatgtgacggagttagtctatcacaggcttttgcttcagcagcatcagggacccactagcccctggagaacctggagggtgcctgctactaccacgagcaccaggtag

SEQ ID NO: 232999 - DNA, 1071 bp, Artificial Sequence
  Description of Artificial Sequence: Synthetic coding sequence
atggcaggagtggcttgtctagggaaggccgcagacgctgacgagtggtgcgattcaggcctcggcagcctcggtccagatgccgcagccccaggcggtcccggattgggggctgagctggggcctgggctgtcttgggctccattagtctttggttatgtcactgaggatggtgacactgcgttgcacctggcagttattcatcagcatgaacccttcctggatttccttttgggattctccgcgggaacggagtatatggacctgcaaaacgacctcggacagaccgctctgcacctggcagctatcctcggggagacatctacagtcgaaaaactgtacgccgctggcgcaggcctgtgcgttgcagaaaggcggggtcacaccgcacttcacctcgcatgtcgtgttggcgctcacgcatgcgcacgtgctctgcttcagcccaggccacgtaggccccgtgaggcaccggacacttacttggctcaggggccagacagaacccccgatacaaaccacacacccgtggctctgtacccggattcggaccttgagaaggaggaagaagaaagtgaggaagactggaaactccagctggaagcagaaaattatgagggacacactcctctccacgtggctgtcatccacaaagatgttgaaatggtgcgactcctgcgtgatgctggggctgacctggacaaaccagagcctacgtgtgggcgaagccctctgcacctggcagtggaggcccaggcagctgatgttctcgagttgctccttagggctggagcaaaccctgcagcgagaatgtacggtggaaggaccccgcttggcagtgcaatgctgagaccaaatccgattctggcaaggctcttgcgggctcatggggctcctgagccagagggggaggacgagaagtctggtccatgcagcagttcaagcgattctgatagcggcgacgaaggcgatgaatatgacgacatcgtggttcattctagtcgctctcaaactaggttgccacccactcctgcctcaaagccgttgccagacgaccctcggccagtgtag

SEQ ID NO: 233000 - DNA, 921 bp, Artificial Sequence
  Description of Artificial Sequence: Synthetic coding sequence
atgaacggtgcgactgcagcttgggccccttgggtgaggactcaaaggcccccagaagatctgggttgggcccgatcgtgggcaaggggatgtcgcggactcccgagcagctccgcaacttcactccgaatgggcaccaggttttccgcgggaaccgagtacatggatctgcaaaacgaccttgggcagacagccttgcatctggcggctattctgggtgagacttcaacggtcgagaagttatacgccgctggtgctggtctgtgtgtggcagagagacgaggacacaccgctttgcatttggcctgcagggtcggcgctcacgcctgcgcgagggccctgctgcagccgcgtccacgccgacctcgtgaggcccctgatacatatcttgctcaaggacccgatcgaactccagacacgaaccacactcctgtggccttatatccagacagcgatctcgagaaagaggaggaggagtctgaagaagactggaaattacaactcgaggccgaaaattacgagggccatactccgctgcacgttgctgttattcacaaggatgtagagatggtgaggttgctcagagacgccggtgcggatcttgataagcccgaacccacatgcggtaggtcgccactccacctcgccgttgaggctcaagctgccgatgtgctggagttgcttttacgggcaggagctaatcctgcggcaagaatgtacggtgggaggaccccccttggcagtgccatgctcaggccaaacccgatccttgcacgcctgctcagggcccatggagctccagaacctgagggagaggatgaaaagtcaggaccttgtagcagctcatctgacagcgatagcggcgatgaaggagtatcgcaagaagagcgacagggaagcccggctgggggaagtggctag

SEQ ID NO: 233001 - DNA, 1086 bp, Artificial Sequence
  Description of Artificial Sequence: Synthetic coding sequence
cttcagaattcgagacagagtcccgctaccggtgggagactccgcggagctccagaggctgccggagccatggcaggggtcgcctgcttggggaaggccgcagacgctgatgagtggtgtgactccggcctcggatctttgggacccgacgccgctgccccaggtggaccaggattgggggcagaactaggcccagggctgtcatgggcacctctggtcttcggctacgtgacagaagacggggacactgctttgcatttggctgtaattcaccagcacgagcccttcctagacttcttactcggattctccgcaggcacagaatacatggatctacaaaatgatcttggacaaacggctcttcatttggccgcaatacttggcgagactagcaccgtggaaaagttatatgcggctggcgcaggactttgtgtcgccgagcggagggggcacacggccttacacctggcctgtcgggttggagcgcatgcgtgcgccagggcccttctccagcctaggccgcgtcgtccccgtgaggctccggacacctacctggcccagggacctgatcgcacccccgatactaatcacactccagtggccttgtacccggacagcgatcttgagaaggaggaggaagagtcagaggaagattggaaactccagctggaagctgagaactatgagggtcacacgcccctgcatgttgccgtgattcacaaagatgttgagatggtgagattgttgcgtgacgcaggagccgatctcgataaacccgagccaacatgtggacggagcccactccatctggcagtggaagcgcaggctgctgatgtcctggagctcctgctgagggccggtgcaaaccccgctgcacgcatgtacgggggtcgcacacccctcggctctgctatgcttcgtcctaacccaatactggcccgtctgctacgcgctcacggcgctccagagcccgagggggaggatgagaagagcggaccttgttcttcaagtagcgacagcgattcgggggatgagggagtatctcaggaagaacggcagggctctcccgctggaggcagtggctag

SEQ ID NO: 233002 - DNA, 1791 bp, Artificial Sequence
  Description of Artificial Sequence: Synthetic coding sequence
atgatcgttgataagctgctggatgattcccggggtggagaggggttgagggacgcggcagggggttgcgggctcatgactagtccacttaatcttagttacttttacggagccagcccaccggcagcagctcctggcgcttgtgatgcatcttgttctgtactgggtcccagtgcccctggatctcctggaagcgatagctctgacttctcttcagcctcttcagtatcttcttgcggcgctgtggagtcaagatcccgaggaggggcaagagcagaaaggcagccagttgagccccacatgggcgttggcaggcagcagagggggccttttcagggcgtcagagttaaaaattcagtcaaggaactgctgctgcatataaggtcccacaaacagaaagcttccggacaggccgtcgatgatttcaaaacgcaaggggttaacatcgagcagtttcgtgagcttaaaaatactgtgagttactctggtaaaaggaaaggacccgactcactcagcgatggtcccgcttgcaagaggccagccctgctccactcccagtttctcaccccaccccaaacacccacacccggagagtctatggaggatgtccatctcaacgaacccaaacaagagagttcagccgatctcctgcagaacattatcaacattaagaatgagtgtagtccagtgtctctgaataccgtgcagacctcatcatctgttcagcagcaaaatgacgcgcatctgcactcattttctatgatgcccagcagcgcctgcgaggccatggtgggtcatgagatggctagcgactccagtaacacttccttgcctttctctaacatggggaaccccatgaacaccacacaattaggcaaatcgcttttccagtggcaagtggaacaggaagagtcaaagctggcgaatattagtcaagatcagttcttgagcaaggacgctgatggagacacctttctgcacattgccgtggctcagggcaggcgcgctttaagttatgtgctagctcgcaaaatgaacgccctgcacatgttggacattaaagagcataacggtcaatcagcttttcaggtggccgtagcagccaatcagcatctgattgtccaagacttggtgaacatcggggcacaagtcaacactacagattgctggggaaggacgccgttacatgtctgcgcagaaaagggccacagccaggtgctccaggctatccagaagggggctgtgggcagtaaccaatttgttgacctagaagcaacaaactacgatggactcacccctcttcattgtgctgttattgcgcataacgctgtggttcatgagttgcagaggaaccaacagccgcattcccctgaagtgcaggaactgctgctgaaaaacaaaagcctggttgacacaataaaatgtttaattcagatgggcgctgctgtcgaggcaaaggaccgaaaatcaggtaggactgctttgcacctcgccgctgaggaggccaatttggagctgatacgactcttcctcgagctcccgtcttgcttgtctttcgtgaacgctaaagcatataatggaaacactgctctgcacgtcgcagccagcctgcaatacagactgacacagttggatgccgtaaggttgctcatgcggaaaggcgctgatcctagcacacgaaacctggaaaatgagcaacccgtgcatctggtgccagatggcccagtgggcgagcaaatccgtcgcatcctgaaaggaaaatcaatccaacagagggctccgccatactag

SEQ ID NO: 233003 - DNA, 2157 bp, Artificial Sequence
  Description of Artificial Sequence: Synthetic coding sequence
atgattgtcgataagttgctggatgattcaagaggcggtgaaggcctccgggacgcagcaggtggctgtggcctaatgacatctccgctgaacctttcctacttctacggggctagcccccctgccgcagcccctggagcatgtgacgcatcttgcagcgtccttgggccaagcgcccctggctctccaggatctgactcttctgactttagctccgcgagctccgtgtcaagttgcggcgcagtcgagtcgcggagccgagggggagccagggccgaacgccagccagtggagccgcacatgggcgttggccgacagcaaagagggcctttccaaggcgtgcgtgtgaagaactccgtgaaagaactgctgcttcacatccgctcccacaagcagaaggcaagcggccaggctgtcgatgactttaagacgcagggagtgaacatcgagcagttcagagagctcaaaaacacagtgagttactccggaaagcgcaaggggccagattcactctcggacggcccagcctgtaaacggcctgcactccttcattctcagtttctgacccccccacagacccctacccccggtgaatcgatggaggatgttcatctgaatgaacctaagcaggagtctagcgcagacctcctacagaacatcatcaatataaaaaatgaatgctccccggtgtctctgaacactgtccaggtcagctggcttaatccggtggtagtcccccagtcttcgcctgctgagcagtgccaggattttcatgggggtcaggtttttagtccaccccaaaaatgccagcctttccaggttaggggctctcagcagatgatcgaccaggcttcactgtaccagtatagccctcagaatcagcacgttgagcagcagcctcattacacacacaaacccacactcgaatacagcccttttccgatccccccacagtcccccgcttacgagcccaacctgttcgatggccctgagtcccaattctgtcccaaccagtccctggttagtcttctgggcgatcagcgagagtctgagaatattgcaaatcctatgcagacatcatcatctgttcagcagcaaaacgacgcgcatctccatagctttagcatgatgccgtcatcagcctgcgaagctatggtgggtcatgagatggcttctgacagcagcaacacttcccttcccttctccaacatgggaaaccctatgaatacaactcaactgggcaagagcctgttccaatggcaagtggaacaggaggaaagcaaactggccaacataagtcaggatcagttcctgagcaaagatgctgatggcgatactttcttacatatagcagttgcccaaggcaggagagccctctcttacgtgctggcgaggaagatgaatgctctgcatatgctggacatcaaggagcataatggccaaagtgccttccaggtggccgtggccgctaaccaacatctgatcgttcaagaccttgttaacattggcgcacaggtcaacacaaccgactgctggggacgcacccctttgcatgtctgtgcagaaaagggccacagtcaagtgctgcaagccatccaaaaaggggcagttggtagtaatcaatttgtggacctggaagcaaccaactacgatggattaacgcctctccactgtgcagtaattgcccacaatgccgtagtgcacgaattgcagcgaaatcagcagccacattcgcctgaagtgcaggaacttttactgaaaaacaagtcactggtcgacactattaagtgcctcatacagatgggggctgctgtcgaagctaaggatcgcaagagcgggaggactgcactgcatttggccgctgaagaagctaacctggagttgattcggttgttcctggagctcccctcctgcctctcattcgtaaatgccaaagcctacaacggcaacaccgcacttcatgtcgcagcttccctgcagtacaggttgacgcagctcgacgcagtgcggttgctaatgcgcaagggagcggacccctctacgaggaacctggagaacgagcagcctgtacacttggtccctgacggacctgtgggggagcaaatccgccgaatcctgaaaggcaagtctattcagcagagagccccaccctattag

SEQ ID NO: 233004 - DNA, 1857 bp, Artificial Sequence
  Description of Artificial Sequence: Synthetic coding sequence
atgggggttgggagacagcagcgaggaccttttcagggcgtacgcgtcaaaaactctgtaaaggaactgcttcttcacattcgtagtcataaacagaaagcgtccgggcaggcggtggatgatttcaaaacccaaggggttaatattgaacagtttcgcgaacttaagaataccgtatcctattcggggaagaggaaaggccctgacagcctcagcgacggaccagcatgcaagcggcctgccctcctccattcccagtttcttacacctccgcagactcctacacccggtgaatcaatggaagacgtacatctaaacgaaccgaaacaagagtcctctgctgatcttctgcagaacatcataaacatcaagaacgagtgctccccggtttctctcaacaccgtgcaggtgagttggcttaaccccgtcgtggtgccccagtcaagtcccgctgagcagtgccaggactttcatggtgggcaggtattctctcctccacagaagtgtcagccatttcaagtccgaggcagtcagcaaatgatcgaccaggccagcctctaccagtactcaccccaaaaccagcacgttgagcagcagccccattatacccacaaaccgacactcgagtattccccattccctatccctccacaaagtccagcttacgagcctaatctatttgacggcccagaatcccagttctgccccaatcagagccttgtttccctgctcggggatcagcgcgaatccgaaaacatcgcaaaccccatgcaaacgagctcttctgtccagcaacagaacgatgcccacttacattcctttagtatgatgccaagcagcgcctgcgaagcaatggtgggacacgagatggctagtgattcctctaacacaagtttgccattttcaaatatgggcaatcccatgaacaccacccaattagggaagagtctgttccagtggcaagtggagcaagaggagagcaagctcgcgaacatatcacaggaccagttcctcagcaaggacgcagacggagacaccttcttacatatagcggtggcacagggtagaagggcactcagctatgtgttagcgaggaagatgaacgcccttcacatgctggacattaaagagcacaacggacagagtgcttttcaggtcgctgtggccgctaaccaacatctgattgtacaagatctggtcaacattggagcacaggtaaatacgacggactgctggggcagaacgcctctgcacgtgtgcgctgagaaaggacatagtcaggtgttgcaagccattcaaaagggcgcagtggggagtaatcagtttgtggacttggaagccacgaactacgatggattgaccccactgcactgcgctgtgattgcccataacgccgtcgtccacgaactacagagaaaccaacagccgcatagccctgaagtacaggaacttttgctgaaaaataaatctctggttgacacgattaagtgcctgatccagatgggcgctgctgttgaggccaaggatcgcaagtcagggaggacagccctgcacttggccgcagaggaagccaaccttgaactgatacggttgtttctcgaactgccatcgtgtctcagtttcgtgaacgctaaagcctacaacgggaacaccgcactgcacgtcgcagcgagtttacagtaccgtctcactcaattggatgccgtgcggctcctcatgagaaagggggctgacccgtccaccagaaacctggagaatgaacagcctgttcacctggtgccagatggccctgttggggagcagatcaggcgcattttgaagggaaagtcaattcaacagagggccccaccgtactag

SEQ ID NO: 233005 - DNA, 333 bp, Artificial Sequence
  Description of Artificial Sequence: Synthetic coding sequence
atgattgtggataaactgttagacgactctcggggaggggagggcctccgggacgcggcagggggatgcgggctcatgacctcgcccctcaatctgagttacttctacggagcgagtcccccagccgcagcaccaggggcttgcgacgcttcatgttccgtgctcggtccaagcgcaccgggatcacccggttccgatagttcggattttagttcagctagtagtgtgagcagttgcggagcagtggagtctcgatcccggggaggagctcgggcagagcgccagcccgtggaacctcacatgggagtcggacgacagcaaagggggccttag

SEQ ID NO: 233006 - DNA, 1806 bp, Artificial Sequence
  Description of Artificial Sequence: Synthetic coding sequence
atgggcgtgggccgacaacagaggggcccatttcagggcgtcagagtgaaaaattccgtgaaagaacttctgcttcacatccgcagccacaaacagaaggcctcgggacaagctgtggacgacttcaaaacccaaggcgtgaatattgaacagttccgggagctgaaaaataccgtttcttacagcggtaagcgcaagggacccgatagcctgtccgatgggcctgcatgcaagcgccctgcgctcctccacagccagtttctgactcccccacagacgccaacaccaggagaaagcatggaggacgtgcatctgaatgagccaaaacaagagtcttccgcagacctcctacagaatatcataaatatcaaaaatgagtgttcccccgttagcctcaatacggtgcaggtgtcgtggttgaatccagttgtagtgccacaatcttcacccgcagagcagtgtcaggactttcatggcggtcaggtgttcagccctccccaaaaatgccagcctttccaggtcagaggaagtcagcagatgattgaccaggcatcactctaccagtactctccacaaaaccagcacgtggagcagcaaccacattacacacacaaaccgaccttggagtattccccttttcccataccacctcagtcacccgcttacgaaccaaacctattcgacgggcctgaatcccagttttgccccaatcagagccttgtgagcctcttgggggatcagagggagtcggagaacatcgctaatcccatgcagaccagttcttccgtgcaacagcagaatgacgctcaccttcacagcttttccatgatgccatctagtgcttgtgaggcgatggttggtcatgaaatggcttctgatagttccaatacaagcctccccttctccaacatgggtaatccaatgaatactacacagctggggaagtccctgtttcagtggcaggtggaacaggaagaatctaagctggctaatatctctcaggatcagtttctcagcaaagacgctgacggagacaccttcttgcatatcgccgtggcccaaggcagacgggctctttcctatgtcctggccagaaagatgaacgctttgcacatgctggacattaaagagcataatggacagtctgcattccaagtggcagttgctgccaatcagcatcttatcgtgcaggatctcgtgaatataggggcacaggtgaataccaccgactgctggggacgaactccactacacgtgtgtgctgaaaagggccattctcaggtgctgcaggccatacaaaaaggcgctgtcgggagcaatcagtttgtcgacctggaggcaaccaattacgatggactcacacctttgcattgtgccgtgatcgcccacaacgctgtagtgcacgagctgcagcggaatcaacaaccccattctccagaggtacaggagcttctgctcaagaacaagtctctggtcgacacgataaagtgtctgatacagatgggggcagcagtggaagccaaggatagaaagtccgggaggaccgccctacatctggccgcagaggaggccaacttagaactgataagactcttcctcgagctaccctcttgcttatcatttgtaaatgctaaggcatataacggcaatacggcactccatgtcgctgcatccctgcagtacagactgacacagctggacgcagtgcgcctgctcatgagaaagggagcagatccctccacccgcaatcttgaaaatgagcagcccgtgcacttggtgccagacggccctgtgggagaacagtag

SEQ ID NO: 233007 - DNA, 393 bp, Artificial Sequence
  Description of Artificial Sequence: Synthetic coding sequence
atgggggtgggcaggcagcagcggggacctttccagggcgtcagagtaaagaacagcgttaaagaactcctgctgcatatcagatcacacaaacagaaggcatcagggcaagctgtggatgatttcaagacacagggcgtgaacattgagcagttcagggaactgaaaaacacagttagctatagcggaaagcgtaaaggaccagattccctcagcgacggacctgcctgcaagcgccctgccttactgcatagtcaattcttgacaccaccgcagactccgacccccggagagagtatggaagatgtccacctcaatgagccaaagcaggaatctagcgctgacctcttgcagaacattatcaacattaagaacgagtgctctccagtttag

SEQ ID NO: 233008 - DNA, 1101 bp, Artificial Sequence
  Description of Artificial Sequence: Synthetic coding sequence
atgagcaacccctcccctcaggtgcctgaagaggaggctagtacgagcgtctgccgaccgaagagcagtatggcatcgacgtcaagacgccagcggagagagcggagatttagaaggtatctgtccgccggacggctggtgagggcccaggccctcctacagagacaccctggactggacgtggacgccggtcagccccctccgctgcatcgcgcatgcgctcgccatgatgcccctgccctgtgcctgttactgcgactcggcgcagacccagcccatcaggatcgccatggggacacggccctgcacgccgctgcccgacaaggtcctgatgcctataccgacttcttcctacctcttctctcccgatgccctagtgctatgggtatcaaaaataaagacggggagacccccggacagattctcggatggggtccaccatgggattcggccgaggaggaagaggaggacgatgcatctaaggagcgtgagtggcgccagaagctgcaaggcgacgcctcacacgaaacgcaggagcccgaatctttcagcgcttggagcgaccgactggctcgggaacatgcacagaaatgtcagcagcagcaaagagaagccgagggcagcaggcgcccacctcgggctgaaggctcgagccagtcgtggcgtcagcaggaagaggagcaaagactgtttcgcgagcgggcaagggcgaaagaagaggagctgcgagaatcccgagcccgtcgggcacaagaggcattgggggaccgcgagcctaaacccaccagagccggaccacgcgaggagcacccaagaggtgccggaagggggtcattgtggagatttggggacgttccctggccatgccccggaggcggagacccggaggctatggctgcagccttggtggcacgtgggcctccactggaagaacagggcgctctgcgcaggtatctgcgggtgcagcaggtcagatggcatcctgatcgttttctgcagaggttccggagccagattgaaacatgggaactgggacgcgttatgggagccgtgactgctctgtcacaggcattgaatcgacacgcagaggcgctgaaatag

SEQ ID NO: 233009 - DNA, 1077 bp, Artificial Sequence
  Description of Artificial Sequence: Synthetic coding sequence
atggcctctacgtcaagacggcagcgtcgggagaggcgatttcggagatacctctctgcaggacgtctggtccgggctcaggctctactccagcgccatcccggtcttgacgttgacgctggccagcctcccccattgcacagagcctgtgcccgtcacgatgccccagccctctgtctcttacttcgactcggcgctgacccagctcatcaggataggcacggcgataccgccctgcacgcggctgccaggcaaggccctgacgcctacaccgatttcttcttgcccctcctgtctagatgcccatcggccatgggaattaagaacaaggacggagagacaccgggacagatcctgggctggggacctccgtgggattctgcagaggaggaggaagaagacgacgcaagcaaagagcgcgaatggcggcagaagcttcagggagagttagaggatgagtggcaggaggtgatgggacggttcgagggggatgcctcacacgaaacacaggagcctgaatcattctctgcttggtcagacaggctggccagggagcatgcccagaaatgccagcaacaacagcgcgaggccgaaggaagccgaaggcccccacgtgcagaaggttccagtcaatcctggcgccagcaagaagaggagcagagactcttccgcgagcgggctagggcaaaggaggaggaactacgcgaatctcgggcacgtcgagctcaggaggctcttggggatagggaacctaagcccacgcgggcagggcctagggaagaacacccacgaggcgcaggcagaggctctttatggcgtttcggggatgtgccttggccttgtcccggaggtggagacccagaagctatggcagcagcactcgtcgccagaggccctccactcgaagagcagggagcactcaggcggtaccttagagtccaacaggttcgctggcaccctgacagatttctacagcgctttaggagtcagatcgaaacttgggagctgggcagagtgatgggggcagtcacagctctatctcaagccctgaaccgccacgccgaagctctgaaatag

SEQ ID NO: 233010 - DNA, 1146 bp, Artificial Sequence
  Description of Artificial Sequence: Synthetic coding sequence
atgagtaatccttccccacaggtacccgaagaagaggcttccacctctgtgtgtcggccaaaaagtagtatggcgtctactagtcgccgtcagcggcgtgaacgacggttccggaggtacctgagtgccggtagactggtgagggcccaggctttactgcagagacaccccggactagacgtggacgccggtcagcccccaccactgcaccgcgcatgcgctcggcatgacgctcctgctttgtgcctgctgctgcgcctaggcgctgacccagcccaccaggacagacacggagatactgctctgcacgccgctgctcggcaaggtccagatgcctacacggacttcttcctgcctcttctgagcaggtgcccgtcagctatgggcatcaaaaataaggacggcgaaactccgggacagattctgggatggggcccaccttgggatagcgcagaggaagaggaagaggacgatgcctctaaagagcgagagtggcgtcagaagttgcagggagagcttgaggacgaatggcaagaggtgatggggaggttcgagggggacgctagtcatgaaacccaagaacccgagtccttttccgcatggtccgatcgcctggcacgcgagcacgctcagaagtgtcagcagcagcagagagaagctgaaggcagcaggagaccgccaagggccgagggtagtagtcagtcatggaggcagcaggaagaagagcagcggctgtttagggagcgagcgcgtgcgaaagaagaagagctacgtgagagtcgggcaaggagggcgcaggaggcattgggggatcgagagccaaagcctacgcgggctggtccccgagaagagcatccgagaggtgcgggacgtggctccctgtggcggtttggcgatgttccctggccctgccctggaggcggtgatcccgaggccatggcggctgccctggtggcacgcggaccacccctggaggagcagggtgccctgagacgatacttgcgggttcagcaagtgagatggcatccagatagattcctgcagaggttccgttcccaaattgagacctgggagctgggaagagtcatgggggctgtcactgcactctctcaggcccttaaccgccatgccgaggcactgaaatag

SEQ ID NO: 233011 - DNA, 1101 bp, Artificial Sequence
  Description of Artificial Sequence: Synthetic coding sequence
atgtcgaacccatccccccaagtgcccgaagaagaggcatcaacgagcgtgtgccgccctaagtcaagcatggctagtacatctcggaggcaacgacgtgagcgtcgctttaggcggtatctcagcgccggtagactggtccgggctcaggcactccttcagagacacccaggattggatgtggatgccggtcagcctcctcccctgcatagagcatgtgctcgccatgacgccccagctctgtgtctgctgcttcggttgggagcagatccagcgcaccaggacaggcacggggatacagctctccatgctgccgcaaggcagggtccagatgcctatacggatttttttctacctctcctgtctagatgcccatccgccatgggcatcaaaaataaagacggagagacccccggacagattttaggatgggggcctccgtgggacagcgcagaggaggaggaggaagatgacgctagtaaggagcgggaatggcgtcagaagctgcagggggatgccagtcacgaaactcaggagccggaaagttttagcgcttggtccgaccgtttggctcgggaacacgcccaaaagtgccagcagcaacaaagggaggcggagggctcctgtagaccgccacgggcagaaggtagttcacagtcgtggagacagcaggaggaggaacaaagactgttcagagagcgcgcaagagccaaggaagaagaactcagagaatcgcgcgctcgaagggcacaggaggccctaggcgatcgcgagccgaagccaacacgggcaggccctcgggaagaacaccccagaggggcagggaggggttcactgtggcggtttggcgatgtgccatggccctgcccaggaggcggagaccctgaggcaatggccgctgcactcgtagctagaggccctccccttgaagagcagggtgctcttcggagatatctgagagtgcagcaggttagatggcatcctgacagattcctgcagaggtttcgcagccaaatagagacttgggagctgggccgtgtaatgggggctgtgacagcgctgtcacaggctctcaacagacacgctgaagccctgaaatag

SEQ ID NO: 233012 - DNA, 1077 bp, Artificial Sequence
  Description of Artificial Sequence: Synthetic coding sequence
atggctagtacttcgaggcgccagaggagggagcgcaggtttcggaggtaccttagcgctgggcgtcttgtgagagcgcaagcgctgctgcagcgacaccctggactggatgttgacgcagggcagccgcctcccttgcacagggcctgcgctcggcacgatgctccagcgctgtgcctactccttcgcctgggagctgatccagcgcatcaggataggcacggagacaccgcactccatgccgctgccagacagggacctgacgcatatactgacttctttctccccctccttagcagatgtccgagtgcaatgggaatcaagaataaggacggggaaacccctggacagattctaggatggggccctccctgggattctgcggaggaagaggaggaggacgacgccagcaaggagagggaatggcggcagaaactgcaaggcgagttggaggacgaatggcaggaggtcatgggcagattcgagggtgatgcctcccatgaaactcaagaacccgaatcattctctgcatggtcggacagattagcccgtgagcatgcacagaagtgtcagcagcagcagagagaagcagaggggagctgccgcccaccaagagccgaagggagctcccagagctggcgccaacaggaagaggaacagaggctgttccgcgagagggccagagccaaggaagaagaacttagggagagccgcgcaaggagggctcaggaggccctgggagatcgcgaacctaagccaacccgcgcagggcctagagaggaacaccctagaggcgctgggagaggtagcctttggcgctttggagatgtcccttggccatgtccaggaggcggagaccctgaagcaatggcagcggcactggtggctagagggccaccattagaagaacagggagctttgcgtagatacttaagagtccagcaggtcagatggcaccccgaccggttccttcagcgatttaggagccaaatcgaaacatgggaactcggaagagtaatgggagccgtaacagccctgagccaggcgttgaaccgacatgccgaggccctcaagtag

SEQ ID NO: 233013 - DNA, 1146 bp, Artificial Sequence
  Description of Artificial Sequence: Synthetic coding sequence
atgagtaatccctcccctcaagttccagaggaggaagcatcaacttctgtttgccgtcccaaatcctcaatggcctctacctctagaaggcagcgcagagagaggaggtttcgccgttatcttagcgccggacgcctcgttcgggctcaggctctgctgcagcgccacccaggattagacgtggacgctggacagccgcctccactgcaccgcgcttgtgcccgacacgatgctccggctctctgcctgctgctgaggcttggggctgatccggctcatcaggatcgccacggggatacggcattgcacgccgctgccagacaaggtccagatgcatacacggactttttcctccctctgctatctcggtgcccctcagctatgggaatcaagaacaaggatggggagactccaggacagatcttgggctgggggcctccgtgggacagcgcggaggaggaggaagaggatgacgcgagtaaggaacgtgagtggcggcaaaaactccagggagagctggaagatgagtggcaggaagtcatgggccgatttgagggcgatgcatcccacgagacgcaagagcccgagtcattctcagcgtggtctgacaggctggcacgagagcatgcccagaagtgccagcagcagcagagagaggcagagggcagctgccgcccacctagggctgaagggagttctcagagctggcgccaacaagaagaggaacaacgcctgttcagggaacgagctagagctaaggaagaggagttgagagaatctagagccagacgggctcaggaggcacttggcgatcgggagccaaaacccacgagagcaggtcctcgtgaggaacatcctcggggagccggtagaggctcactttggcggtttggcgacgttccctggccctgccccggaggcggagacccagaggccatggcagccgctctagtagcccgtggcccaccactggaggagcagggagccctcaggcgctatttacgagtccagcaggtgaggtggcaccctgacaggtttttgcagcggttccggagccagatcgaaacttgggaattgggccgtgtgatgggtgctgttacagcgctgtcacaggccctcaataggcacgctgaggcccttaagtag

SEQ ID NO: 233014 - DNA, 1101 bp, Artificial Sequence
  Description of Artificial Sequence: Synthetic coding sequence
atgtccaatccgtccccgcaggttcctgaagaggaggctagcaccagtgtatgtagacctaaaagctccatggcttccacatcccggagacaaagaagggaacgcagattcagacgatatctctcagccggaagactggtgcgggcacaggctctccttcagaggcatcctggactggacgtcgatgcgggtcaacctcccccactgcacagagcctgtgctagacacgacgcaccagccctgtgcctactgctccgtcttggcgctgaccccgctcaccaggataggcatggcgacacagccttacacgccgcagcccgacaaggacccgacgcgtatactgattttttccttcctctgctcagtagatgtccaagtgctatgggaatcaagaacaaggacggggagacccccggacagattctaggctggggccctccctgggattctgcagaggaggaggaggaggatgatgcttcaaaagagcgcgagtggcgccagaagttacagggggacgctagtcacgaaacccaggagcccgaatccttttctgcttggtcagacaggctcgctagggagcatgctcagaaatgccagcaacagcagcgcgaggctgaggggtcttgtagacccccaagagctgagggcagtagccagagctggcgtcagcaagaggaggagcagcgcctgttcagggagagagcaagggcaaaagaggaagaacttcgtgagtcaagagccaggagggcccaagaggccctcggcgatagagaacccaagcctacacgagccggtcccagggaagagcacccgaggggcgcaggtcggggttcgctctggcggtttggggatgtgccgtggccttgtccgggtggtggcgacccggaggctatggccgcagctctggtggcacgcggtccccctttagaagaacaaggcgcactcaggcgttatctgagggtacagcaggtccggtggcatccggaccgattcctccagcggtttcgatctcaaatcgaaacctgggaactgggcagagttatgggggctgtcacggcactgagccaagctctcaatcggcatgcagaagccctcaagtag

SEQ ID NO: 233015 - DNA, 1146 bp, Artificial Sequence
  Description of Artificial Sequence: Synthetic coding sequence
atgagtaatccttccccccaagtacccgaggaggaagcaagcactagcgtctgtcgccctaaatcctctatggcctccacatcccggaggcaaaggagagagcgcagatttaggagatacctctccgctgggaggctagtacgggcacaggccctgctgcagagacatccgggactggacgtggacgcaggccagccacctcccctgcaccgcgcttgcgcaagacatgatgcaccggcactttgcttgctgcttcgcctgggcgctgacccagctcatcaggacagacatggcgatactgcactgcatgcagccgcacggcagggtcccgacgcatacacggacttcttccttccgctactgagccgatgccccagcgctatgggtattaagaataaggatggagaaacgccgggtcaaatccttgggtggggccctccctgggacagcgcagaagaagaagaggaggacgacgcctccaaggaacgcgagtggcggcagaagcttcagggagaacttgaagacgagtggcaggaggtcatgggcaggtttgagggagatgcgtctcacgagacccaagaacctgaatccttcagcgcatggagcgatagattagcacgtgaacacgcccagaaatgtcagcagcagcagcgggaggccgaagggagttgccgccctcctcgggcagaaggctccagtcagtcgtggagacaacaggaggaggaacagcgcctttttcgagagcgggcaagagctaaggaagaggagctgcgagagagcagggccaggcgagcgcaggaagccctcggggacagggagccaaagccaacccgagctggcccacgggaggaacaccctcggggagccggtagagggtcactgtggcgcttcggtgacgtcccatggccatgcccaggcggtggggatcctgaggcaatggccgctgcgcttgtagcccgagggcctccccttgaagagcagggagccctccgtcggtaccttagggtgcagcaggtgagatggcatccggaccgatttctccagaggtttaggtcccagattgagacttgggaactgggtcgggttatgggggcagttacggcgttaagtcaagctcttaaccgacacgccgaggcattgaaatag

SEQ ID NO: 233016 - DNA, 1101 bp, Artificial Sequence
  Description of Artificial Sequence: Synthetic coding sequence
atgagcaacccttcaccacaggtcccggaggaagaagcttctacgagcgtgtgtcggcctaaaagtagtatggcatccacatccagacgacagcgacgagaacgccgattcaggcggtacttgagcgcaggcagactcgtgagagctcaagccctgctccagagacatcccggactggacgtcgacgcaggccagcctccacccttgcatcgcgcatgcgcgaggcatgacgctcctgccctctgtctgctgctgcgattaggcgcagatccggcacatcaggatcgacacggtgatacagccttgcatgccgcagctcgccaagggccagacgcctacaccgacttctttctgcctctcttgtcaaggtgtccatctgctatggggattaagaacaaagacggagagacaccaggtcaaattttgggctgggggcctccatgggattccgccgaagaagaagaggaggacgatgcttccaaggaacgagaatggcgacagaagctccagggagacgcatcccatgagacccaagaaccagagtccttctcagcatggtccgacagactcgccagagagcacgcccagaagtgccagcagcagcaaagagaggcagagggctcctgtcgtcccccacgggcagagggcagcagccagtcttggcggcagcaggaggaagagcagcgccttttccgggagagagcgagggctaaagaggaggagctgagggaatccagggcaagacgggctcaagaagctcttggggacagggaaccaaagcctacccgggctggtccccgagaggaacatcctagaggggctggaagggggagtctgtggcgcttcggtgatgtcccatggccttgtccaggcggtggcgaccccgaggcaatggcagccgcactggtggccagagggccacccctggaagagcagggcgctctccggcgttatctacgggtacagcaggtccgatggcaccccgacagatttctccagagatttcggagtcaaattgaaacctgggaattaggaagagtcatgggggctgtgactgccctctcacaggccctcaatagacatgctgaagcattgaaatag

SEQ ID NO: 233017 - DNA, 1101 bp, Artificial Sequence
  Description of Artificial Sequence: Synthetic coding sequence
atgagcaatccaagtccgcaggtaccagaagaggaagctagtacatcggtttgccgtcctaagtccagcatggcctcaaccagccggcgtcagcgcagagagcgcagattccggcgttatctgagtgctggcaggctcgtgagggcccaggccctcctgcagaggcatccaggactggacgtggatgctggtcagcctccaccattacatagggcttgcgccaggcatgacgctcccgctctttgcttgcttctgaggctgggcgcagatcccgcacaccaggaccgccatggagacaccgccctgcacgccgcagcgcgacagggccctgatgcgtatacagattttttcttaccacttttgagccggtgcccgtcagcgatgggtattaagaacaaggatggagagacccctggccaaatcttagggtgggggccaccctgggattctgctgaagaagaggaggaggacgacgcctcaaaggagagggaatggcgacagaaactgcaaggcgatgcgagccacgaaacccaggagccagaatccttcagcgcctggagcgaccgactggccagagaacacgcgcagaaatgtcagcagcagcagcgagaggcagaagggtcttgccgtcctccaagagctgagggcagcagccagtcttggcgccagcaggaggaggagcagcgtcttttccgcgaaagagcgagggctaaggaggaggagttgcgggagtctagagctagacgagctcaagaggcacttggcgaccgcgagcctaaaccaactagagcaggccctcgggaggagcatccccgaggggcaggtcgtgggtctctctggcgctttggggatgtgccatggccctgtccaggcggtggtgatcctgaggcgatggccgcagccctagtggctcgcggtccacctttggaggaacagggcgctctgcggaggtatttgcgagtgcagcaggtgcgatggcacccggataggttccttcaacgcttcaggtcccaaattgaaacatgggagctgggtcgagtgatgggcgcagttaccgccctgtcacaggcgctgaatcggcacgcggaagccctcaaatag

SEQ ID NO: 233018 - DNA, 1146 bp, Artificial Sequence
  Description of Artificial Sequence: Synthetic coding sequence
atgtctaacccttcgccccaggtaccggaagaagaggcaagcaccagcgtttgccggccaaagtccagtatggcctcaacgagccgtcgccagcgtcgtgagcgaagatttcggcgttacctctcagctggccgactggttcgggcacaggcgctgctgcagcggcatccaggactggatgttgacgcagggcagcctcctcctctccatcgggcatgtgcccgtcacgatgctccggctctgtgtctgttattgcgtcttggcgcagatccggcacaccaggaccgccacggcgacacggccctgcatgccgctgcgagacaaggtcctgacgcttataccgatttctttctgccattactgtctcgatgcccgagtgcgatgggaattaaaaacaaggacggcgagacacccggacagatcctgggttggggccctccctgggattctgcagaagaggaagaggaagatgatgcctctaaggaaagggagtggcggcagaaactgcaaggtgaactcgaagacgagtggcaggaagttatgggccgtttcgagggtgatgccagccatgagacacaggagcctgaaagcttttcggcctggagcgaccggttggctagggagcatgcccagaaatgccagcaacagcagcgagaagcagaaggctcctgtcgtccccctcgagccgagggctccagccagagctggcggcagcaagaagaggagcagcggctgttcagggagagggccagggcgaaagaggaggagctgcgcgaatcccgcgctcgcagggcgcaggaggccttgggggaccgggagcccaaacccacacgcgctgggccaagggaggagcacccgagaggcgcaggcaggggctcgttatggagattcggggatgtgccgtggccctgccccggaggaggggatcctgaggccatggctgcagcgctggtagccagaggaccacccttggaagagcagggggctctgaggaggtacctccgcgtgcagcaagtaaggtggcatccagataggttcctgcagcgttttagatcgcagattgagacatgggagctgggcagagttatgggtgcagtcaccgctttgtctcaggccctgaaccggcatgctgaagcattaaaatag

SEQ ID NO: 233019 - DNA, 1077 bp, Artificial Sequence
  Description of Artificial Sequence: Synthetic coding sequence
atggcctctacctcacggaggcaacggagggaacgccgtttcaggagatatttatctgccggtcggctggtgagagcccaggcgctactgcagaggcacccgggtttagacgttgatgctggacaaccccctcccctgcaccgggcttgcgcccgtcacgatgcccctgccctatgcctcctgctacgattgggagctgatccagctcatcaggacaggcacggagatactgctctccacgccgcagcacggcagggtcccgacgcatacactgacttctttctgccactactgtccagatgtccatccgccatggggatcaaaaataaagatggggaaacccccggacagatcctcgggtgggggcctccttgggatagcgctgaggaagaagaggaggacgatgcatcaaaagaacgagagtggagacagaaactgcagggcgagcttgaagacgaatggcaggaagtaatgggtagattcgagggagacgcatcacacgagacccaggaacccgagagcttttctgcttggtcagatcggctggcaagagaacacgcacaaaagtgccagcagcagcagcgcgaggcagaaggctcgtgccgtccccctcgcgctgaaggttcctcccagtcctggaggcagcaagaagaggagcagcgcctctttcgggaacgagcacgcgctaaagaagaagagctacgtgaaagccgcgctagaagagcccaggaagcgctgggcgaccgcgagcccaagcctacaagagccggacccagagaggaacatcccagaggtgcaggcaggggcagtctctggaggttcggggatgtgccttggccgtgtccgggtggcggtgaccctgaagccatggctgcagcgctggtcgccaggggacctcctttggaagagcagggggcactgagacgatatttgagagtccagcaggttcgttggcaccccgaccgtttcctgcaacggttcaggagccaaattgagacctgggagctcgggcgagtcatgggcgcagtcaccgccttgtcgcaggcccttaatcggcacgccgaagccttgaaatag

SEQ ID NO: 233020 - DNA, 1101 bp, Artificial Sequence
  Description of Artificial Sequence: Synthetic coding sequence
atgtctaatccctctccacaggtacctgaagaggaagcatcaacctctgtgtgtcggccaaagagttccatggcatctacctcccgcagacagagaagggagaggaggttccgaaggtacctgtccgcaggaagactggtcagggctcaggcattgctccagcgacatcccggtctggatgtggacgcaggtcaaccgcctccgctgcaccgagcttgtgctcgccatgatgctccggctctctgcttactcctgagactcggagccgaccccgctcatcaggaccgccatggagacaccgctctgcatgctgctgctcggcagggcccagatgcgtatacagatttttttcttcctcttctatcaagatgccctagcgcgatgggcattaagaataaggatggggagaccccaggacagatccttggctgggggccaccctgggactccgccgaagaagaggaagaggatgatgcaagcaaggagagggaatggcgccagaagctccagggggacgcttctcacgagactcaggagcccgaaagcttctctgcctggagtgacaggcttgcccgagaacatgcccagaagtgtcaacagcagcagagggaggccgagggctcctgtcggccacctcgtgctgaggggtcgagtcagtcctggcgacagcaagaagaagaacaaaggttgttcagagagcgtgctcgcgcaaaggaagaggaactccgcgaatccagagctaggagagcccaggaggctctaggagacagagaacccaagcctactcgcgctggccctcgcgaagaacacccgcgtggggctggcagaggtagtctttggcgtttcggtgatgtgccttggccatgccctggcggaggggatcctgaggctatggccgctgctctggtcgcaagggggcctcctttggaagagcagggagccctccgcaggtacctccgggtgcagcaggtgagatggcacccagatagattcctgcagagattcaggagtcagattgaaacatgggaactcggaagggtgatgggggctgtgactgcactgtcccaggcgctgaaccgccatgccgaggcactgaagtag

SEQ ID NO: 233021 - DNA, 1077 bp, Artificial Sequence
  Description of Artificial Sequence: Synthetic coding sequence
atggcttccacatcacggcgtcagagacgcgagcgtcgcttcaggcgttatctctcagctgggcgtctggtgcgggctcaggcgttactgcagcgccaccccggtctggacgtggacgccggacagcctccacccctgcacagggcctgcgccagacacgacgcacccgcattatgtctgctgctgagactaggtgcagacccggctcatcaagatcgacacggtgatacagctctgcatgcagccgcaagacagggaccagatgcttataccgatttctttctgcctttgctcagccgctgtccaagtgccatgggtatcaagaataaggacggcgagactccaggccagatactggggtggggaccaccttgggactcagccgaggaggaagaagaagacgacgcttctaaagagagggaatggagacagaagttgcagggagagctggaagacgaatggcaggaagtgatgggtcggttcgagggtgacgcctcacacgagactcaagagcctgaatctttttcggcctggagcgacaggttggcccgagaacacgcccagaaatgccagcaacagcagcgagaggccgaaggctcatgtagacctcctagggcagagggcagttctcaatcctggcgccagcaggaggaagagcagcgtctgttcagagaacgggcacgcgctaaggaagaagagttaagggaatcacgggcacggagagctcaggaagcactgggtgaccgagagccaaagcccacaagggctggtcctcgtgaggagcacccacgcggtgccggaagaggctctctttggaggttcggggacgttccatggccctgcccaggcggaggagatcccgaggctatggcagccgcacttgttgcccgtggaccacctcttgaggaacaaggcgcactcaggcggtacctgcgggttcagcaggtgagatggcacccagaccggttcctgcagcgattccggtctcagattgagacatgggaactcggacgggtgatgggtgcggtgactgccctctctcaagcccttaacagacatgccgaggcccttaagtag

SEQ ID NO: 233022 - DNA, 1146 bp, Artificial Sequence
  Description of Artificial Sequence: Synthetic coding sequence
atgtctaacccctcacctcaggtgcccgaagaggaggctagtacgtcagtctgccggcctaagtcctccatggccagcacaagcagaagacagcggagggaacgcagatttcgcaggtacctttccgctggtaggctagtgagagcacaggcattactccagaggcatcccggtctcgatgtggatgcaggacagcctcctcccctgcatcgagcttgtgcaagacatgacgcccctgccttatgcctcctgctgcgcctaggggcagacccggcacatcaggatcggcatggcgacactgctttgcatgccgcagcgcgacaaggacccgatgcctacactgacttttttcttcctctgctcagccgttgtccttcagcgatgggcatcaaaaataaggatggagaaacgccgggtcaaatcctgggatggggaccaccttgggattctgctgaagaggaagaggaggacgatgcatccaaagaaagagagtggaggcagaagctgcagggcgagctggaggacgagtggcaggaagtgatgggaagatttgagggtgacgcctcccacgaaacccaggagccggaatccttttccgcttggtccgataggcttgccagagagcacgcccagaagtgtcagcagcagcaaagagaagccgaaggctcatgtcggccaccgagagccgaagggtctagccaaagctggcggcagcaggaagaggagcagcgactttttagagagcgtgcaagagcaaaggaggaggagctgagggagtcccgcgctagacgggcacaggaggcgctgggcgatcgagagccaaagcccacaagagcaggcccacgcgaggagcatcccaggggggctgggcgtggaagtctctggaggtttggggacgtaccgtggccctgtcctggaggtggcgatcctgaagctatggccgctgccctggtcgctcggggacctcccttggaggaacagggtgcactgcgccgttaccttcgtgtgcagcaggtccggtggcatcccgatcgttttctccagaggttccgaagtcagatcgaaacctgggagttaggcagagttatgggcgcagtaaccgcactctcccaggcgttgaatcgccacgccgaggcattgaaatag

SEQ ID NO: 233023 - DNA, 1077 bp, Artificial Sequence
  Description of Artificial Sequence: Synthetic coding sequence
atggcctccacatcacgcaggcaacgaagggagcgtcgctttcgtcgctatttgtcagccggacgacttgtgcgagctcaggccctcctgcagaggcacccgggtctggatgtggatgcaggtcagcccccacctctccatagagcgtgcgcacgccacgacgctcccgcattgtgtctactgcttagattgggagccgatcccgctcatcaagaccggcacggggacactgccctgcacgccgctgcacgccaggggccagacgcttacaccgatttcttcctccccctgctctcccgatgtccctccgctatgggtataaagaataaagacggggagactccaggacaaatcctgggctgggggcctccctgggacagtgccgaagaagaggaggaggatgacgcttcaaaggagcgagaatggaggcaaaaactgcagggcgagctggaggacgagtggcaggaagtgatgggtcgttttgagggggatgcaagccacgagacacaggaaccagagagtttctcagcatggtctgaccgcttagcaagagaacatgctcagaagtgccagcagcagcagcgagaggcggaaggctcctgtagaccaccacgagcagagggcagttctcaatcatggcggcagcaagaagaagagcaacgcctgtttcgcgagcgagcacgggctaaagaggaggaactgcgggagtcccgagcgaggcgcgcacaggaagccctgggcgatcgcgagcctaaaccaacacgggcaggtcccagagaggagcaccctcggggagccggtagaggctcactatggcggtttggcgacgtaccctggccctgtcccggagggggagatcccgaagcgatggctgccgctctggtcgctcgcggaccaccactagaagagcagggagcactgcggaggtacctgagagtgcagcaagtgagatggcacccagaccgtttcctgcagagattccgctctcaaattgagacttgggaattgggacgcgtgatgggcgctgtgaccgcactaagtcaggccctgaataggcatgctgaagcactaaagtag

SEQ ID NO: 233024 - DNA, 1146 bp, Artificial Sequence
  Description of Artificial Sequence: Synthetic coding sequence
atgtctaatccaagcccgcaggtgcccgaggaggaggcatcaaccagtgtgtgtagacccaagagctccatggccagtacatccagaagacagcgcagggaaagacgatttcgcaggtacttgagtgcaggcagactagttagagctcaggctctactccagaggcaccctggtctggacgtcgatgcgggacaaccccctcccctccaccgagcctgcgctcggcacgatgcaccagcactgtgtttgcttcttcgactgggcgctgatcccgcacaccaggatcggcacggtgatactgcactgcacgccgctgccagacagggccctgatgcgtataccgattttttcttgccactgctgagccgttgcccgagcgccatgggaatcaagaataaagatggcgagacgcctgggcaaattcttggctggggcccaccttgggatagcgctgaagaggaggaggaggacgacgcctccaaggagagggaatggcggcagaagctccagggggagctggaagacgagtggcaggaagtaatgggcagattcgagggagacgcctcacacgaaactcaagagcctgagtctttttccgcttggtctgaccgactagcacgggagcacgcacaaaagtgccaacagcaacaacgggaagccgaggggtcttgcagacccccaagagctgagggatctagccagtcctggcgacagcaagaggaggagcagcgcctcttccgagaaagggcacgagccaaagaagaagaactgcgagagtctcgggctcgaagagctcaagaggcactgggggacagggaaccaaagccaacccgggcaggtccaagggaggagcatccgaggggagcaggccgagggagcctctggagattcggtgatgtgccttggccctgccctggaggcggagaccccgaggcgatggccgctgctctggtcgccagggggccacctcttgaagaacagggggcactgcgcaggtacttgagggtccagcaggtgcgctggcatcccgatcggtttctgcagcggtttcggtcccagatcgagacctgggagctcgggcgtgtcatgggcgctgttactgctctcagtcaagctcttaacagacatgccgaagcgttgaaatag

SEQ ID NO: 233025 - DNA, 1101 bp, Artificial Sequence
  Description of Artificial Sequence: Synthetic coding sequence
atgagcaatccatcaccccaggtgccggaggaagaggcttccacgtccgtctgccggccaaaaagtagtatggccagcacaagtcgccgacagcgccgagagagacggtttagacggtacctgtcagcgggacggctcgtaagggcacaggccctcctccagcgtcacccgggactcgacgttgatgctggtcagcctccccctttacatcgtgcgtgtgcgaggcatgacgctccagccttgtgcctgctcctgagactaggggctgaccccgctcatcaggaccgccatggtgacactgctctccatgccgctgccagacagggacctgacgcctacactgacttcttcttgcccctgctgagcaggtgtccttcagccatgggtattaaaaataaagatggtgagacacctggccagattctcggctggggaccaccatgggacagtgcagaggaagaagaggaagacgatgcctccaaggaacgtgagtggcggcagaaactccagggggacgcaagccatgaaacccaggagcccgaatctttcagtgcttggagcgaccggctggctcgggagcacgcccaaaagtgtcaacagcagcagagggaagctgaaggttcatgccgcccacccagggcagaagggagctcccaatcttggcggcagcaggaggaggagcagagactctttcgcgaaagggccagggctaaagaagaggagctccgggaatctagagccagacgtgcccaggaggccctcggggacagggaacctaaacccacccgcgctggacccagagaagaacatccacggggagccggacggggttctctctggagatttggtgacgtcccctggccttgcccaggagggggagatcctgaggcaatggccgcagccctggtcgcgagaggccctccactggaagagcagggcgcattgcggagataccttagagtgcagcaggttaggtggcatcctgaccgttttctccagcggttcagatctcaaatcgaaacttgggaactcggtagggtgatgggagcagtgaccgccttatcacaggcgctgaataggcacgctgaggcgctgaaatag

SEQ ID NO: 233026 - DNA, 1077 bp, Artificial Sequence
  Description of Artificial Sequence: Synthetic coding sequence
atggcttctacatctcgcagacaacgtagggaaaggcgcttcaggaggtacctttcggccggaaggctggtgagggctcaggccctgcttcaaaggcatcctggcctggatgtcgatgctggacaacctcctccattgcatcgcgcttgcgcacgccacgacgcaccggctctgtgcctcctcctgcggctgggggctgatcccgctcaccaagaccggcatggcgacactgctctacatgcagcggctcgacaggggccagacgcttataccgacttcttcctgcccctgctctcacggtgtccatccgccatgggaatcaaaaataaagacggtgagacacctgggcagattttgggatggggtcctccctgggattctgcagaggaggaggaggaggatgacgcttccaaagagagagagtggcggcagaagttgcaaggagaactcgaagatgaatggcaagaggttatgggacgcttcgagggagacgcctcccacgagacccaggagcccgaaagctttagtgcctggagcgacagactcgcacgggaacacgctcaaaagtgccagcagcagcagcgtgaagcagagggttcttgtcgccctccgcgagccgaaggatctagtcagtcttggcgccagcaggaggaggaacagagactcttccgggagagggccagagctaaggaagaggaactacgcgagtcccgcgctcggagggctcaggaagccctgggcgaccgcgaacccaagcctacccgggctggaccacgcgaagaacatcctcgcggagctgggaggggttcactgtggcgatttggggacgtaccctggccttgccccggaggtggcgacccggaagccatggccgcagccctggtcgcaagagggccacctctcgaagaacaaggcgctctacgtaggtatctgcgcgttcagcaggtaagatggcatccagatcgattcctgcagagatttcgttcgcagattgaaacatgggagcttggtagggtgatgggcgcagtgacggccctgtcgcaggcgctcaataggcacgctgaggctctcaaatag

SEQ ID NO: 233027 - DNA, 1146 bp, Artificial Sequence
  Description of Artificial Sequence: Synthetic coding sequence
atgagcaacccatctccccaagtgccagaggaagaagcttcgacatcagtgtgtagacctaagtccagcatggcgagcaccagccgcagacagcgtcgggagcgtagattccggagatacctgtccgctgggaggttggtgcgcgcacaagctctgctgcagcgccaccccggactggatgtggacgccggtcagccgcctccacttcacagagcgtgcgcacgccacgatgctcctgctctctgtctgctgttaagactgggcgctgatcccgctcaccaggatcgtcacggcgacactgcattgcatgcggcagcgcgacagggaccagatgcctataccgatttctttttgccactcttgtcaagatgtccaagtgccatggggattaagaataaagatggggaaacccctggccagatcctgggctgggggcctccctgggacagcgccgaggaggaagaagaggatgacgcaagcaaagaacgggagtggagacagaagttgcagggtgagctggaagatgagtggcaagaggtgatgggacgctttgagggggatgccagccatgagacccaagagcccgaatcattttccgcctggtctgatagacttgcccgagagcacgctcaaaagtgtcagcagcagcagagagaagcagaagggtcctgtcgaccacctcgtgccgaaggttcttcccaatcatggcgtcagcaggaagaggaacagcggctgttcagggaacgggctcgtgccaaagaagaagagctgcgtgagagccgcgctcggagggcccaggaggctttgggggacagggaaccaaagcctaccagggctggtcctcgtgaagaacatccccgtggcgctggtagagggagcctttggcgatttggagatgtgccatggccctgcccagggggaggggatcccgaggcaatggcggctgccctcgtggcccgagggccaccgttagaggagcagggcgcattgagacgatatttgcgagtacagcaggtgcgctggcatcccgacagatttctgcagaggttccggagccagatcgaaacatgggagcttggcagggttatgggagcagtcaccgccttaagccaggctttgaatagacacgcggaggcgctgaaatag

SEQ ID NO: 233028 - DNA, 1077 bp, Artificial Sequence
  Description of Artificial Sequence: Synthetic coding sequence
atggcgtctacaagccgcaggcaaaggcgcgagcgtcggtttcggaggtatctatctgctggcaggctggtgagagcgcaagcactcttgcagcgacaccccggtttggatgtcgacgccggacaaccgccacctttacaccgagcctgcgcccgacatgacgctcctgcactctgtcttcttctgcgactgggcgctgaccctgcccatcaggacagacacggcgatacggctctgcacgcagcggctcggcagggccctgacgcttataccgatttttttctgccacttctcagcagatgtccttccgccatgggaatcaagaataaagacggcgagacccccggacagatcctgggttgggggccaccgtgggacagtgccgaggaagaagaggaggacgacgcatccaaagagcgcgagtggcgccaaaaactgcaaggagaacttgaggatgagtggcaggaggtgatgggacgctttgagggcgatgcgtctcatgaaacacaagaaccagaatcttttagcgcctggagcgataggctagctcgagaacacgcacaaaagtgtcagcagcagcagcgggaggctgagggcagttgccggcctccacgcgcagagggaagctcacagagctggaggcagcaggaggaggagcagaggctgtttcgcgagcgggctcgcgcaaaggaggaagagttgagagaatcccgtgccaggcgcgctcaggaggcactgggggatagggaaccaaaacctacccgcgcaggcccacgagaggagcacccaagaggcgcagggcgaggcagtttgtggagatttggcgacgtaccatggccatgcccaggcggtggtgaccctgaggcaatggccgctgccttggtggcaagaggccctcccctagaggaacaaggggctttgagaaggtacctccgagttcaacaggtacgttggcatcctgatcgcttcctgcagcgatttcggtctcagattgagacttgggagctcggccgagtgatgggcgctgtgacagcactgagccaggctttgaaccggcacgcagaggctctcaagtag

SEQ ID NO: 233029 - DNA, 699 bp, Artificial Sequence
  Description of Artificial Sequence: Synthetic coding sequence
atggcctctacatccagacgccagaggagggaaagacgattcagaaggtacctgagtgccggacgccttgtgcgcgctcaggcactgctgcagcgccatccaggtttggacgtggatgccggtcagccccctcctctccatcgggcatgcgcgagacacgacgcgccagcgctttgcctgttactccgtctgggcgctgaccccgctcatcaggatcgtcacggcgatactgctctccacgccgcagctcggcagggacccgatgcgtacaccgacttctttctcccacttctctcaaggtgtcctagcgcgatgggcatcaaaaataaggatggcgaaacccccggacaaatacttggctgggggccaccctgggattcggctgaagaggaagaggaggatgacgctagcaaagagcgcgaatggcgtcagaaactacagggtgaattggaggacgagtggcaggaagtcatggggcgttttgagggtgacgcctctcatgagacccaggaacccgagagtttcagcgcctggtctgacaggttagcaagagaacacgcccagaagtgtcagcagcagcagcgggaagccgagggctctcgcaggccccctcgagccgagggatcaagccagtcctggcggcagcaagaggaggagcagagattgttccgcgagcgcgcaagagccaaagaagagtag

SEQ ID NO: 233030 - DNA, 699 bp, Artificial Sequence
  Description of Artificial Sequence: Synthetic coding sequence
atggcatcaaccagcaggaggcaaaggcgagaaagacgcttccgacgctacctgtctgcaggtcgcttggtgcgagctcaagccctgctgcagagacaccctggtttagacgttgatgcgggtcaacctccacccctccacagggcttgcgccaggcacgatgcacccgctttgtgccttctgctacgtctgggtgctgaccccgctcaccaggaccgccatggagacacggcattacatgcagccgcaagacaaggtcccgatgcctacacagacttttttctgccactcctcagtagatgtccgtccgctatgggaataaaaaacaaggatggggaaacgcccggacaaatcctgggctggggacccccatgggattccgccgaggaggaagaggaggatgatgccagcaaggagcgcgagtggaggcagaaattacagggggagcttgaggacgaatggcaggaggtgatgggccgattcgaaggagatgccagtcacgaaacccaggaacctgagtctttttccgcctggtctgacaggcttgcacgggaacacgcccaaaagtgtcaacagcagcagcgagaggcagagggctcctgccgacctccgagggctgagggatccagccaatcatggagacagcaggaggaagagcaacggctgttcagggagcgtgcaagggctaaggaagagtag

SEQ ID NO: 233031 - DNA, 699 bp, Artificial Sequence
  Description of Artificial Sequence: Synthetic coding sequence
atggctagcacatctaggcgtcaacggcgtgaaaggcgtttccgacgctacctcagtgccggacgcttagtgcgggctcaggcactgctgcagaggcatccaggcttggacgtggatgctgggcagcctccccctctgcaccgcgcatgtgcgagacacgacgctccagctctgtgcctgctcttacgcctgggggctgatccagcccaccaagaccgacacggcgacaccgcgctgcacgctgctgcacgtcagggaccggatgcatacaccgatttttttctgcctctgctctcacgctgtccttctgcaatgggaattaagaacaaagacggagagaccccagggcagatcctggggtggggcccaccatgggatagcgctgaggaggaggaggaggacgacgcgagcaaggaacgcgagtggagacaaaaactgcagggcgagctggaggacgagtggcaagaggttatgggcaggtttgagggtgacgccagtcatgaaacgcaggagcccgagtctttttctgcctggagcgacaggctggcccgagagcatgcgcagaaatgccaacaacagcaacgggaagcagaggggagttgccggccaccacgcgctgagggcagctcgcaaagctggcggcaacaggaggaggagcaaaggttgttcagagaacgcgctagggcaaaggaggaatag

SEQ ID NO: 233032 - DNA, 699 bp, Artificial Sequence
  Description of Artificial Sequence: Synthetic coding sequence
atggcctccacctcaagaagacagcggagagaaagaagatttcgcagatatctcagcgcgggacgtttggttcgggctcaggccctactgcagcgacatcctggattagacgtggacgcgggacagccaccacctctgcacagagcttgcgcaaggcacgacgctccagctctgtgcctgttattacggttaggggctgaccccgcacaccaagatcgccatggagacaccgcactgcacgccgcagctaggcagggaccagacgcttacacagacttcttcttgcctctactgtcccgatgtccatccgccatggggatcaagaataaagatggagagaccccgggacagattctggggtgggggccaccatgggactccgccgaggaagaagaagaagatgacgcttcaaaagagagagagtggcgtcaaaaattacaaggagaactggaagatgaatggcaggaggtcatgggcagattcgagggcgatgcatcacacgaaacacaggagccggagagtttttcagcgtggtccgatcgtctggcacgggaacatgctcaaaagtgccaacagcaacagagggaagccgaagggtcctgtaggccgccaagagccgagggatcctcacagagctggagacagcaagaggaggagcagcggctgtttagagaaagagcacgggctaaagaagagtag

SEQ ID NO: 233033 - DNA, 699 bp, Artificial Sequence
  Description of Artificial Sequence: Synthetic coding sequence
atggcaagtacttcgagaagacaaagaagagaacggagattcaggagatatcttagtgctggacgtctagtcagagctcaggccttgttgcagagacaccctgggctcgacgtcgatgctggccagccaccgcctctgcacagggcctgtgcgaggcatgacgctccagctctgtgtctcctgcttcggttgggagccgacccagctcatcaagataggcatggagatacagcacttcacgctgccgcaaggcagggtcctgatgcctatacagacttctttctccctttgctttccagatgccccagtgctatgggcatcaagaacaaggatggagaaacccctggccaaatattgggctggggaccgccttgggacagcgccgaagaggaggaggaggacgatgcctctaaagaacgggagtggcgccagaagcttcaaggtgagctcgaagacgagtggcaggaggttatgggaaggttcgaaggtgatgcttctcacgagacacaggagccggaatcgttcagcgcttggtcagaccggcttgctcgggagcatgcccagaagtgccaacagcagcagagagaagcagaagggtcatgtcgacctcctcgggctgaaggatcatcacagagttggcggcagcaggaagaggaacaacggctctttcgagagagagcacgagcgaaggaggaatag

SEQ ID NO: 233034 - DNA, 699 bp, Artificial Sequence
  Description of Artificial Sequence: Synthetic coding sequence
atggccagtacatctcgaagacagcgccgagagcgacgcttccgcagatatctcagcgcgggacggctagttagagcgcaggccttgctgcaacggcatccgggactcgatgtagatgctggccagcctcccccactgcacagagcctgtgcgcgtcatgacgcacccgctctgtgtctcctcctccggctcggggctgacccagcacatcaagatcgtcacggagacaccgcgctgcatgccgcagccaggcagggtcccgacgcgtatacagacttctttctgccactcctgtccagatgcccctctgccatgggaattaaaaataaggatggtgaaacaccaggtcagattttaggatgggggccaccatgggactctgctgaggaggaggaagaagacgatgcgtccaaagagagagagtggcgacagaaactccagggagaacttgaggatgaatggcaggaagtcatggggagatttgagggcgacgcctctcatgagacccaggaacccgagtcattctctgcctggagtgacagactggctcgggagcatgcccagaagtgccagcagcaacagagggaggcagaaggcagctgtcgacccccacgtgctgagggctctagccaatcctggcggcagcaggaagaagagcagcggttattcagggagagggcgagggccaaggaagagtag

SEQ ID NO: 233035 - DNA, 699 bp, Artificial Sequence
  Description of Artificial Sequence: Synthetic coding sequence
atggccagcacatcccgacggcagcgcagagaacggaggttccgacggtacttatctgccggtcgcctcgtacgggcacaggctctgctgcagcgccatcccggtctggatgtagacgctgggcagccaccacctctgcaccgtgcctgcgccagacacgacgccccagctttgtgccttcttctgcgactgggggctgatcccgcacaccaggatcggcatggcgatacagcactccacgcagcagccagacagggcccagacgcttacactgacttcttcctccccttgcttagtaggtgcccctccgcgatgggtatcaagaacaaagatggggaaacacccggacagatcctaggctgggggcctccttgggacagcgcagaagaggaggaagaagatgacgcttccaaggaacgcgagtggcggcaaaaactccaaggtgagctggaggacgagtggcaggaggtaatgggcagattcgaaggggatgcaagtcatgaaacccaggaacctgagtcattcagtgcctggtctgaccgcttagccagagagcacgcacagaaatgccaacagcagcagagggaagcggaggggtcttgtcgccctccacgcgctgaaggttcttctcagagctggaggcagcaggaagaagagcaacgcctgtttcgcgagagagccagggcaaaagaggaatag

SEQ ID NO: 233036 - DNA, 3900 bp, Artificial Sequence
  Description of Artificial Sequence: Synthetic coding sequence
atggattctttggaccatatgcttaccgaccccctggaactgggcccttgtggcgacggacacggtacccgcatcatggaagattgtctgcttggcggaacccgcgtgtctctgcccgaagatttacttgaagacccagaaattttcttcgacgtcgttagcctgtctacatggcaggaggtgttgtccgattcacagagagaacacctccagcagttcctccctcagtttcccgaggactcggcagagcaacagaatgagctcatcctcgctctgttcagcggggagaatttccggtttgggaatcccctgcacatcgcgcaaaaactgtttcgtgacggacactttaatccggaggtcgtgaaatacagacagttatgttttaagagtcagtacaagcgctacctgaacagccaacagcagtattttcatcgactactaaagcagatccttgcttcacgttcagaccttcttgagatggctcgcagatcagggcctgctctgccgttcaggcagaaacgacctagtccctcccgtacccctgaggaacgcgaatggcgaacccagcagaggtatcttaaagtgctgcgagaggtgaaagaagaatgcggtgatactgccctctcgtcggacgaggaggatctatccagttggttgccatcctcacccgcacggagccccagcccagcagtgcccctgcgtgtagtccctactctgagcacgaccgacatgaagacagccgataaagttgagctgggagattcggacctcaagattatgctgaaaaaacaccacgaaaaacgcaagcaccagcccgaccaccccgaccttctcaccggagatctgaccttgaatgacataatgacacgagtgaatgccggacggaaaggctcactggccgctttgtatgatctggcagtgcttaagaagaaagtcaaggagaaagaggaaaagaagaaaaaaaagattaagacgattaagagcgaggctgaggatttggctgagcctctttctagcaccgaaggagtcgctcccctgtcgcaagccccttctccactggctatacctgcgattaaagaggaaccccttgaggatttgaaaccctgcctgggtatcaatgagatatcctcctcttttttctctctgctgctggagatcttattgttggaatcccaggcaagcttacccatgctcgaggaacgtgtgctggactggcagtcttctccagctagtagtctgaatagctggttctcagctgccccaaattgggctgagctagtccttcctgcactgcaatacctggcgggagagtcacgagccgtgccgagctcattctccccctttgtggagtttaaagagaaaacccagcagtggaagctcctcggccagtcccaagataacgagaaagagttagccgcactgtttcagttgtggctggaaacaaaagaccaggccttttgtaaacaagaaaatgaggattcaagcgatgcgacaactcctgtgcccagagttcgcaccgactacgtggtgcgccctagcaccggcgaagagaaacgggtctttcaggaacaggagaggtataggtactctcaacctcataaggccttcaccttcaggatgcatggtttcgaatctgtggttgggcctgtcaaaggcgtattcgataaagagacttcactgaacaaggcccgagaacacagcctactgaggagcgatagacccgcttacgtcaccatcctgagtctggttcgagatgctgcagcaagactacctaacggggagggaaccagagccgagatatgcgaactgcttaaagattcccagtttctggctcccgatgtcacctccactcaagtgaataccgtggtatctggggcattggatcggctgcattacgaaaaggacccatgtgtgaagtacgacattggcaggaaattgtggatctacctgcacagagatagatccgaggaagaatttgaacgtatacaccaagcccaggccgcagctgccaaagcccgaaaggccctccagcagaaacctaaacctcctagcaaggtgaagagctcaagcaaagagtccagtattaaagttctctccagcggaccctctgagcagagtcaaatgtctttgagtgattcatccatgccccctacgccagtgacacctgtgacacctacgactccagctctccccgctattccaatttcaccaccaccagtgagtgctgtgaacaagagtgggccaagcacagtctctgaacctgcaaagtcctcctccggtgtcctactcgtcagctctccaactatgccccatctgggaactatgctgagccccgcaagtagccagacggctccaagctcacaggccgcagcccgagtggtgtcacactcgggctctgctgggctgagccaggttcgggtggtggcgcaacctagcctccccgctgtacctcagcagtccggaggtcctgctcaaactctaccccagatgcccgcagggccacagattagggttcctgcaactgctacgcaaacgaaggttgtgccccagaccgtgatggcaaccgtaccagttaaggcacagactaccgccgcaacagttcagagaccaggaccagggcaaacaggcctcacagtgacaagtctcccagctactgcttctcccgtgtccaagccagctacaagctcccctgggacgtcagcgccttctgcctccacagcagcagtcattcaaaatgtgactggacagaacatcattaagcaagtggctatcactgggcaactgggcgtcaagccccagacagggaacagtatcccgttaaccgcaactaattttagaatacaaggcaaggacgtacttagactgcctcctagttccattactaccgatgccaaaggtcaaacggtgcttagaatcacacccgacatgatggctacactcgctaaatcacaggtgacaaccgtgaagttgacccaagacctcttcggcactgggggaaataccacagggaaaggtatcagtgcaaccctacacgtcacaagtaatcctgttcacgctgcagattcacccgcaaaggcgtccagtgcatccgcacctagtagtacccccaccgggacaactgtcgtaaaagtaacaccggatctgaagccaacagaggcttcttctagcgcgttccgactgatgccagccctaggggtctctgtcgctgaccagaaaggaaaaagtacggtagccagtagcgaagctaagcctgccgctacaatccggattgtgcaggggttgggcgtgatgcctcccaaagcaggccagaccatcactgtggcaacacacgccaaacagggcgcaagcgtcgctagtgggtccggcacggtccacacgagcgctgtctcccttccaagcatgaatgcagcggtgtctaaaaccgtagccgtggcttctggggcagccagcaccccaattagcatcagcacgggcgcaccaacagttcggcaagtgccagtgagtacaactgtggtctcaaccagccaggcgggaaaactacccactcggattaccgtacccttgtctgtgatctcccagcccatgaaggggaagtctgtcgtgactgcacctataattaagggcaacctgggggcaaacctgagtggcttggggaggaacattatcctcacgaccatgcctgctggtaccaaattgatagctgggaacaaaccggtgtcttttctcacagctcagcaactacaacagctccagcagcagggtcaggccactcaggtgcggatacagacggtgccagcttctcacctgcagcagggcacagcttccggttcttcaaaagccgtgagcaccgtagtcgttaccactgctcctagcccaaaacaagcacccgaacaacagtag

SEQ ID NO: 233037 - DNA, 3900 bp, Artificial Sequence
  Description of Artificial Sequence: Synthetic coding sequence
atggattccctcgaccatatgttaaccgaccccctggaactaggcccatgcggcgatggccacggcactaggattatggaagattgtctcctcggaggaacccgggtatcattgcccgaggatctactcgaggaccctgaaatctttttcgatgtcgtttctctcagtacatggcaagaggtgctgtcagactcgcagcgggaacacttacagcagtttcttccacaatttcccgaggattcagctgagcagcaaaacgagctgatcctggccctgttcagcggcgagaacttcaggttcggaaatccactccacatcgcacagaaactgttccgggacggtcatttcaatccagaagtggttaagtacaggcagttgtgcttcaagtcgcagtacaagcgctacttgaatagccagcaacagtacttccaccgcttgctgaaacagatcctcgcctctagatcagaccttctggagatggctcggagaagcggtcctgccttgccatttaggcaaaagcggccatcaccctcgagaacaccagaagaacgtgaatggcgcactcagcagcgctacctgaaagtgttgagagaagtaaaagaggaatgcggggatacagctctatcctccgacgaagaagacctctcttcatggcttcctagtagcccggctcgcagtccatcccccgctgttcccctgcgtgtggtacccaccctgtccacgaccgatatgaagacagccgataaggtcgaactgggggacagtgatttaaagattatgctgaaaaagcaccacgaaaaaagaaagcatcagccagaccatcccgaccttttgaccggggatctgacattgaatgacattatgaccagggtcaatgcgggtcggaagggatctttagccgctctgtatgacttggctgtgctgaagaagaaggtgaaggaaaaagaggaaaaaaaaaagaagaaaatcaaaacaatcaaatctgaggcggaagacctggccgagcctctcagttctacagaaggagtggcgcctctttcccaggccccttctccattggcaattccagctatcaaggaggaaccactggaagatctgaagccgtgtttgggcattaacgaaatctccagtagcttcttcagcctcttacttgagatcctgctgctcgaaagccaggcttccctcccaatgcttgaagagcgggtgctggattggcaatcttctcctgcttcaagtttaaattcttggttcagcgcagctccgaactgggcagagctcgtgttacccgctctgcagtacctcgccggagaaagcagagccgtgccttcctctttcagccccttcgttgaatttaaggagaagacacaacagtggaaactcttgggtcagtcacaggataatgaaaaggagcttgccgcactgttccagctgtggctcgaaacaaaggatcaggcgttttgcaagcaggaaaatgaggacagtagcgacgctacaactcccgtgccaagggtgagaacggattatgttgtccggccttcgacaggagaggagaagcgggtcttccaggagcaagaacggtaccggtattctcaaccacacaaggccttcacatttcgtatgcacggttttgaaagcgtggtcggtcccgtaaagggcgttttcgataaagagacttccttaaacaaagcccgagaacatagtctccttcgaagtgataggcctgcatatgtgaccattttaagtctcgtgcgagacgccgctgcaaggctgcctaatggcgaaggaaccagggctgagatctgtgaactgctgaaagatagtcagttcctcgcccctgatgtcacttctacccaggtcaatactgtcgtgagcggagccctggacaggttacattacgagaaagatccatgcgtaaagtacgacatcggtcggaagttgtggatctatctgcatagagacagatctgaggaagagtttgaaagaatacatcaggcccaggccgcagcagctaaggccaggaaagctctacagcagaagcccaaacccccttcaaaggtaaaatcatcaagtaaagagtcttccatcaaggtgctcagttccgggcctagtgagcagtcccaaatgtccctctctgactcatcaatgccgccaacccccgtgacaccagtcactcccaccacgcccgctctgccagcaatcccaatttcacctcccccagtctcagcagttaacaaaagcggcccaagcacggtgagcgagccggcaaagtcgtccagcggtgtactgcttgtgagctccccaactatgcctcacctaggcaccatgcttagcccggctagttctcagactgcgccatccagccaggcggcagccagggtcgtgagtcacagcggcagtgcagggctgagtcaggtccgggtggtagctcagccttctctccctgcagtcccgcagcagtctgggggaccggcacagacacttccccagatgcctgccggaccacagattcgggtacccgctactgcaacccaaacaaaggtggttccacagactgttatggctaccgtacccgtgaaagcccaaaccacagccgcaactgtccagagacctgggccaggtcagaccggcttaaccgttacaagcctacctgccacggcatcaccagtgagtaaacccgcaacctcaagccctgggacgtccgccccttctgcttccactgctgccgtgatccagaatgtgacaggccagaatattatcaagcaggttgcgattacaggacagctgggggtcaagcctcagacagggaacagtattcccttaaccgcgaccaactttcggatccaaggtaaagatgtgcttcgcctgcctccaagtagtataactacagacgctaagggccagaccgtgctgcgaattaccccagatatgatggcaactcttgcaaaaagccaagtcacaaccgtaaagctgactcaagacctttttggaaccggaggcaacaccaccggaaagggcatttcagctacactgcatgtgacttccaatcccgtccacgccgcagatagcccagcgaaggcctcatccgccagtgctccttcctctacccctaccggtactaccgtggtgaaggtcacccccgatctgaagcctaccgaggcaagtagctcagcctttcgtctgatgcctgccctgggagtttctgtagccgaccagaagggaaaaagtaccgtggctagttctgaggctaaaccggcagcaactatcagaatcgtacaagggcttggtgttatgcctcctaaagccggacagactattaccgttgccactcatgcaaaacagggagcctcagtggcctccgggtctggcacagtgcatacatccgctgtgtcccttccatcaatgaacgccgcagttagcaagacggtcgctgtcgcctctggagcagcaagtacgcctatcagcatcagcactggagcaccaacagtgagacaagtgccggtcagcactactgtggtctccacctcccaggccggtaagttaccaacccgcatcacggtgccactgtccgtaatctctcagcccatgaaagggaaatccgtggttaccgcccctataatcaagggaaatcttggtgctaatctgtcaggtttgggcaggaatattatcctgaccacaatgcccgctgggaccaagctgatagctgggaacaagccagttagcttcctgacagcccagcagttgcagcagctgcagcagcagggacaggcaactcaggtgaggatacagacggtgcctgcttctcacctgcagcagggaactgcctctggcagcagcaaagccgtgagcactgtagtcgttactactgctccttctcccaagcaggctccagagcagcagtag

SEQ ID NO: 233038 - DNA, 3900 bp, Artificial Sequence
  Description of Artificial Sequence: Synthetic coding sequence
atggactctctcgatcatatgctgactgatcctctggaattaggcccttgcggcgacggccatggaaccaggattatggaggactgcctgctcggaggaacaagggttagcttgcccgaagaccttctggaggacccagagatatttttcgacgtggttagcctgtcaacatggcaggaggtgctgtccgacagtcaacgcgaacacctacagcaattcctcccacagtttcccgaagacagtgctgaacaacagaatgagttaattttggccctttttagcggcgagaactttcgatttggtaacccactccacatcgcacagaagctgtttcgtgatggtcacttcaatccagaggtagtaaagtacagacagctttgttttaagagtcagtacaagcggtatctcaactcacaacaacagtacttccatcgactgttaaagcagattcttgccagcaggtccgacttgttagagatggcccgacggtcgggcccagccctaccattccgccagaagaggccgagcccaagccggacaccagaagagcgcgaatggcgcacgcaacaacgatacctcaaggtgctccgggaggttaaagaagaatgtggtgataccgcactatcatctgacgaggaggatctcagctcttggctgccaagtagcccggctcgttccccgtcgcctgctgtgcccctacgggtcgtgcctacactgagtacaaccgacatgaagactgcggacaaggttgaactaggagatagtgatctgaaaattatgctgaagaaacatcacgagaagagaaaacatcagcccgaccatccagacttgttgaccggcgatctcactctgaacgatattatgaccagggttaacgcgggtcggaaaggttcacttgcagctctgtacgatctagccgttctcaaaaaaaaggtgaaagagaaggaggagaagaagaaaaagaaaataaagacaattaagagtgaggccgaggacttggctgaaccactgtcctcaaccgagggcgtcgcccctctgtcacaggccccaagccccctggctatccccgcaattaaagaggagccccttgaggatctcaagccatgtcttggcatcaatgaaattagttcctcttttttcagcctgctcctcgagattctgctgcttgagtcgcaggcaagcctccctatgctagaagaaagagtgctcgattggcaatccagcccagccagttctctaaattcgtggtttagcgctgctccaaactgggccgaactcgtactcccagcactgcagtacctcgccggtgaatctcgcgcagtcccgtcctccttttctccatttgtggaattcaaggagaagacccagcagtggaagctcttgggacagagtcaagataacgagaaggaactggccgctctgttccagctgtggctcgagactaaggatcaggccttctgcaaacaagagaacgaggattcctctgatgcaaccacccccgttccacgcgtgagaacggattacgttgtacggccaagtacaggtgaggagaagcgggtgttccaggagcaagagaggtaccggtatagccagcctcataaagctttcacattcaggatgcacgggtttgagtccgtggttggacctgttaagggggtattcgacaaggagactagcttgaacaaagcaagagagcattcactgctgcgatccgaccgcccagcttacgttactattctctcccttgtcagggatgcagccgctcgcctgccaaatggcgaagggactcgagccgagatctgtgagctacttaaagactctcagttccttgcaccagacgtgacctccactcaagttaatactgtagtttcaggggctcttgaccgactccattacgaaaaggacccgtgcgtcaaatacgacattgggagaaagctatggatttaccttcaccgagatcggagtgaggaggagttcgagaggatacatcaagcccaggctgccgctgcaaaggccagaaaggccctgcagcagaagccaaagcctccttccaaagtgaaatcttctagcaaggagagtagcatcaaggtgctctcaagtggacccagcgagcagtcacagatgagcctttctgacagcagtatgccacctactcccgtcacgcccgtgacaccaaccacgcccgctttgcccgcaatccccatttcgccaccccctgtcagcgcagtcaataaatctggcccatcaaccgtaagcgagccagcgaaatctagtagtggggtgttgctagtgtcatctccaaccatgccacacttgggcacaatgctgagcccagcatcatcccagacagctcctagttctcaagcagccgcaagagtagtgagtcactctgggagcgcgggtctctcacaggtgagggtcgtggctcagcccagcttgcccgctgtgccacagcagtccgggggacccgcacagacactaccccagatgccagccggaccgcaaatcagggtgccagcgacagccacacagacaaaggttgtcccccagacagttatggccactgtgccggttaaagctcagactaccgctgcgacggtacagagacctggccctggccagacaggcctaactgtaacatcccttcccgcaacagcgtcgcccgtgagcaagccagctacctcgagtccagggacttccgccccttccgcctccacagctgccgtgattcagaatgtcaccggacagaacataattaagcaggtggctataactggccagcttggcgtaaaaccccagacagggaatagtattcccttgacagccacaaacttccgaatacaggggaaggacgtgcttaggttgccacctagttcgattaccacagatgccaaggggcagaccgtactccgaattactcccgacatgatggccactttagcaaagtcacaggtcacaaccgtcaagctcacacaagacctgtttggcactggaggaaacactactggaaaagggatctcagcaactttgcatgtaactagtaacccagtgcacgcagccgattctcctgctaaggcatccagtgcctccgcaccttcctccacacctacgggtacaacagtggtgaaagtcacccccgacttaaagcccacagaagctagttcttccgctttcagactgatgccagcccttggcgtgtctgtggcagaccaaaagggcaagtccactgtcgcttcatctgaagccaaacccgctgctaccataagaatagttcagggcctcggcgtgatgccacctaaggctggacaaacaattacagtggctacacatgccaagcagggggcatcagtggcatctgggtcaggaaccgttcacacttctgccgtgtcgctcccaagcatgaatgcggcagtcagtaagacagtggcagtggccagcggggcagcgtctactcctataagtatcagtactggggctcctactgtgaggcaggtccccgtgtcaaccacggtggtgtctacctctcaggcaggcaagctgcctacaaggatcaccgtcccgctctctgtgatcagtcagcctatgaagggaaaaagcgtggttacggctcctatcatcaagggcaatttaggggctaacttatctgggctgggcaggaacataatcctgacaacaatgcctgctggtacaaagctgattgcgggtaataagccagtgagttttctgacagctcagcagctgcagcaactccagcaacaggggcaagctacgcaggtgaggattcagaccgtcccagccagtcatcttcaacagggaaccgcatcagggagctcgaaagctgtgtcgaccgtggtagtgaccactgccccttcccctaagcaggctcctgaacagcaatag

SEQ ID NO: 233039 - DNA, 3975 bp, Artificial Sequence
  Description of Artificial Sequence: Synthetic coding sequence
atgcacgtgtttgtccagagtacctgcggagaggagactatggacagtctggaccacatgttgaccgacccgttagaactgggaccttgtggcgatgggcacggcacgcgcatcatggaggactgccttcttggagggacccgggtctccctgcctgaagatctgcttgaggatccggaaattttctttgacgtcgtgtccctatctacttggcaagaggtcctgtccgattcacagcgggaacacctccagcagttcctgccgcagttcccggaggacagtgcagaacagcaaaacgagttgatactggccctcttctctggcgaaaattttcggtttggcaacccccttcatatcgcccagaaattgtttcgggatggccatttcaaccccgaggttgtgaaatatcggcagctttgctttaagtctcagtataagcggtacttgaactcacagcaacagtacttccatcgcctcctgaagcaaatcttagccagtagatccgatctgctcgaaatggccagaaggtccggacccgctctcccttttcgtcagaaaagaccgtctccatctcgaacccctgaagagagagagtggagaacccaacagcgatatttgaaggtgctacgagaagtgaaggaggagtgtggcgacacggccctgagtagtgacgaagaagcaacgctagatttgcaggagcaatttagtttcgaagacttgagttcttggctgcccagttcccctgctaggagcccgtcacctgccgttcctttgagagttgtccccacactgagcaccacagatatgaaaacagctgacaaggtcgagttgggggacagcgacctaaaaattatgttaaagaaacaccacgagaaaagaaaacaccaacccgaccaccccgacttgcttaccggagatctaactctcaacgatatcatgaccagggtcaacgctgggcgaaaagggagtctcgcggctctgtatgacctggcagtgcttaagaagaaagtgaaagaaaaggaggaaaaaaaaaaaaagaaaatcaagacaatcaaatcagaagccgaggatctcgccgagcccctcagctcgactgagggggtggcccctctgtcccaggccccttctccactggcaatccccgcaataaaggaggagcccttggaggacctcaaaccgtgtctcggcataaacgaaataagttccagttttttctcccttttgttagagattctgctcctagagtcccaggccagtctgccaatgcttgaggaacgggtgttggactggcagtcatcgccagcatcctcgctcaactcctggttttctgctgctcccaactgggccgagcttgtgttacccgctcttcagtatttggcgggagagtccagagcggtgccgtcatcctttagcccatttgtcgaatttaaagaaaagacccagcaatggaaactcctaggccagagtcaggataatgagaaggaactagcagcgctgtttcagctgtggttggaaacaaaagaccaggcattttgcaaacaggagaatgaagattcaagcgacgccactaccccggtcccacgggttaggaccgattatgtggtcagaccatccaccggggaggagaagagagtgttccaggaacaggagcgctaccgctattcacaaccgcacaaggctttcacatttcggatgcatgggttcgaatctgtggttgggccagtcaagggagtgtttgataaagaaacgtcattaaacaaagctagagagcattctctattgagatctgacagacccgcttatgttaccatactgtctctggtcagagacgctgctgctagactgcctaacggagaaggcacacgggctgagatttgcgagctgctgaaggattcccagtttttggctcctgacgtgaccagcacacaagtgaacacagtggttagcggagcgctggacagactgcactacgaaaaagatccttgtgtgaagtacgatattggtagaaagctttggatctacctccatcgggatcggagtgaggaagagttcgagagaattcaccaggcccaggcggctgctgctaaagccagaaaggccctgcagcagaagcctaagcctccttcaaaagtaaaaagcagttcaaaagagtcttccatcaaagtcctgtcaagcggccctagtgagcagagccagatgagtctgtccgattctagtatgcctccaactcccgtcactccggtcactcctacgactccagccctcccagcaatacctatctcccctccgccagtgtcggcagttaacaaatcgggtcccagcaccgtatctgagccagcgaaaagctcatcgggggtccttctggtatcttccccaacaatgccccacttaggcacgatgctttcacccgctagctctcagactgcgccatcaagccaggctgccgcaagagtggtgtcccactctggctctgccggactaagccaggtaagagtagttgcacagccctcccttcccgctgtgccgcagcagagtgggggaccagcccagacccttcctcagatgcccgctggaccgcagatcagagtgccagccaccgctacacagacaaaagttgtgcctcaaaccgtcatggccactgtccccgtcaaggcccagaccaccgcagccaccgtccagcggccagggcctggccagacaggtttgaccgtgacgtccctgcccgcaactgcttcccccgtgtctaaaccagctaccagctctcccggaacttccgccccttccgcctctactgccgctgttatccagaatgtgaccggacagaacatcattaagcaggttgccattactgggcagctcggcgtgaagcctcagacgggtaattcaattcccctgaccgcaacaaattttcgaattcaaggcaaggacgtgctgaggctgccaccctccagtatcaccactgacgctaagggtcagaccgtcttgcggattacgccagatatgatggcaacacttgctaagtctcaggtaacaactgtgaagctgacccaggacttgttcggcactggaggaaacacgacaggcaaggggatcagtgctactcttcatgtaacttcaaatcctgttcacgccgctgacagcccagccaaagcctccagcgcatccgccccatcttcgactccaaccggcaccaccgtcgtaaaggttacaccagatcttaagccaacggaggctagttcgagcgcgttccgactgatgccggcactcggggtcagtgttgctgaccagaagggaaaaagtacagttgccagctccgaagccaaacccgctgccaccatcaggatcgtgcaagggctgggggttatgcctcctaaggccggtcagaccattactgtggccacccacgcgaagcaaggcgcttctgtggcatcagggtctgggaccgtccatacatctgcagtgtcccttccctccatgaatgctgcagtgtcaaagaccgttgcagtggcttccggcgctgctagcacccctatctcaatcagcaccggagcacccactgtacgccaagtgccagtgtcaactaccgtcgtcagtacctctcaagccggtaagctgccaaccagaataactgtgcccctgtcggtgattagtcagcccatgaagggtaagagtgtggtcactgcacctatcataaaagggaatctgggtgctaatctttcgggcttaggccgtaacatcattttgaccaccatgcctgcaggcaccaaactcatcgctggcaataaaccagtgagtttcctcacagctcagcagctgcagcagctgcaacagcagggacaggctactcaagtgaggattcagaccgtcccagcaagtcacctgcagcaggggactgctagcggctcgtctaaggcagtgtcaaccgtcgtggtgacaacagccccttcccctaaacaggcgccagaacagcagtag

SEQ ID NO: 233040 - DNA, 1389 bp, Artificial Sequence
  Description of Artificial Sequence: Synthetic coding sequence
atgcaactgcgcaagatgcagaccgttaagaaggagcaagcatctctggacgccagcagtaatgtggataagatgatggtgctcaactctgccctcaccgaggtgtctgaggacagtacgactggcgaagaactcctgttgagcgaaggctccgttgggaagaataaaagtagcgcctgccgccgtaagcgggaattcatacccgatgagaaaaaggatgccatgtattgggaaaagcgacgcaagaacaacgaagcggcaaagaggtcacgggagaagaggaggctaaatgacctcgtgttagaaaataaactcatagccctgggagaggaaaacgcgactcttaaggctgaattattgtcacttaagcttaagtttggattgatatcgtcaaccgcgtatgcccaggagatccagaaactctccaactcaactgccgtgtatttccaggactatcagacatctaaatctaacgtgtcaagcttcgtcgatgaacatgagccttcaatggtatcctcctcatgtatttctgtcatcaagcacagtccacaatcctccctaagcgacgtctcggaggtgtctagcgtagaacacactcaggagtctagtgttcaggggtcctgtaggagccctgagaacaagtttcagattattaagcaggagccaatggaactggagtcttacaccagggagccacgggacgatagaggcagttataccgcttctatttaccagaactacatggggaactctttttccggctacagtcactccccgcctttattgcaggtcaataggagctcctccaatagcccgagaacttccgagacggatgatggcgtggtcggcaagagctcggacggagaggacgaacagcaagtgcctaaaggcccaatccactctcccgtggaactcaagcatgttcacgccactgtagtgaaggttccggaggtgaactcctcggctctgccacacaagctgaggatcaaggcaaaggctatgcagatcaaggtggaggctttcgacaacgagtttgaggcgacccagaaactgtccagtccgattgacatgacctctaaaaggcacttcgaactagaaaagcacagtgccccatctatggtgcactcaagcctcaccccttttagtgtccaagtgaccaatattcaagactggtcactgaagtctgaacattggcatcagaaggaactcagtgggaagacacagaacagctttaagaccggggtggtcgaaatgaaagatagcggatacaaggtttcggacccagaaaacctctacttaaagcaagggatagccaatctgtctgccgaggtcgtctctcttaaacggcttatagcaacccaaccaattagcgcttctgattcagggtag

SEQ ID NO: 233041 - DNA, 1389 bp, Artificial Sequence
  Description of Artificial Sequence: Synthetic coding sequence
atgcagctcagaaaaatgcagacagtaaaaaaggagcaggcaagcctcgacgcctccagcaatgttgataaaatgatggtgctaaatagcgcccttactgaagtgagcgaagactcaacaacgggcgaggaacttcttctgagcgaggggtctgttggcaagaataagagttccgcttgtagaaggaaacgtgaattcatcccggatgagaaaaaagacgctatgtattgggagaagaggagaaagaataatgaagccgcaaagcgatcacgggagaaacgtcggctaaatgacctcgtcctcgagaataagctgatcgccctgggcgaagagaatgcaaccctgaaagccgagctgctaagtcttaaactcaagttcggattgatcagctccaccgcatacgcccaggagattcagaaattgtcaaacagcactgcggtctacttccaagattatcagacaagcaagagcaacgttagctctttcgtggatgagcatgaaccctctatggtctccagctcctgtatatcagtcattaagcactcacctcagagctccttgagcgacgtgagcgaagtttcctccgtagagcatacccaggagtcctcagttcaggggagctgtcgctcccccgagaacaaatttcagatcattaagcaagaaccaatggaactagaaagttacacccgggagccgagggacgacagggggtcatacaccgcatcaatttatcagaattacatggggaactccttctctgggtacagccactcccccccattgcttcaagtgaatcggagcagctctaattcccccagaactagtgagaccgatgatggggtggtgggcaaaagttcagatggagaggacgagcagcaagtgccaaaaggcccaatacacagccccgtagagctcaagcacgtccacgcaaccgtagtgaaagtccccgaggtgaactcctccgcgctgccccataagctgcggattaaggctaaggctatgcagatcaaggtcgaggcttttgacaatgaattcgaggcgacgcaaaaattatcctcaccaattgacatgacctcaaagaggcacttcgagttagaaaaacactctgccccttccatggtgcactcttcgctgaccccctttagcgtccaggtgaccaacatccaggactggtccttaaagagtgagcactggcaccagaaggaactgagcggtaagacccaaaactcgttcaaaaccggtgtggtcgaaatgaaagactccggctacaaagtgtctgaccccgagaatctttatctaaagcaaggcatcgcaaatttaagcgccgaagtggtgagcctgaaacggttgattgcaacacaaccaatatctgccagtgacagtggctag

SEQ ID NO: 233042 - DNA, 1488 bp, Artificial Sequence
  Description of Artificial Sequence: Synthetic coding sequence
atggctgagccaacaagtgacttcgagacacctattggctggcatgcgtcccccgagctgactccaaccctaggccctctgtctgacactgcgccaccgagggactcttggatgttttgggccatgctgccccctcctcccccaccgctcacttcgagcctgcctgccgctggcagtaaaccatctagtgaaagccagccacctatggaagcccagtctctgcccggagctcctccgcctttcgacgctcagatcctccctggcgctcaaccacccttcgatgcgcagtcccctctggatagccagccccaacccagtggccagccgtggaacttccacgcatctacctcctggtattggcgccaaagttccgacagattcccacgacaccagaagagcttcaaccccgctgttaaaaactcatactaccctcgaaaatacgacgccaaattcaccgactttagcctgccaccttcgcgtaagcagaaaaaaaaaaagcgcaaggaacccgtgttccacttcttttgtgacacctgtgatagaggattcaagaatcaagaaaagtatgataagcacatgtcggagcataccaagtgtccagaattagactgctcttttacagctcacgagaaaatagtgcaattccactggcgcaatatgcacgcacctggaatgaaaaaaatcaaactggacactccagaggaaattgcaaggtggagagaggaaaggaggaagaattatcctacattggctaacatagagcggaaaaaaaagctcaaattggagaaggaaaagcgcggagcggtgctcactaccacccagtatggcaagatgaagggaatgtcccgccattcacaaatggccaaaatccgtagtccgggtaaaaatcacaaatggaagaacgataatagccgccagcgagccgtcacaggctctggctctcatctatgcgacttaaagctcgagggccctcccgaagccaatgcggaccctcttggtgtcttaataaactccgactcagagagcgataaagaagaaaaacctcagcactccgtgattcccaaggaggtcactcctgctctgtgcagcctcatgtcaagctacggatcactgagtgggtcggaaagcgagcctgaggagacacccatcaagacagaggcagacgtcctcgctgagaaccaggtgttggattcaagtgcacccaagagcccgtcacaggacgttaaggcgaccgtgagaaacttctcagaggcgaagagcgagaataggaagaagtctttcgaaaaaactaacccaaagcgcaaaaaggactatcacaactatcagacactgtttgaacctagaacgcaccatccctatctgcttgagatgctgctcgccccagatatccgccatgagaggaatgttatcttgcagtgcgtgagatatatcattaaaaaggacttcttcggccttgacacaaattccgccaagtctaaggatgtttag

SEQ ID NO: 233043 - DNA, 648 bp, Artificial Sequence
  Description of Artificial Sequence: Synthetic coding sequence
atggaaacccaggctgaacagcaggaactggagactctgccaactaccaaaatggcccagacaaatcccacacccggaagcctgggaccatggaaaatcactatttatgatcaggaaaactttcagggtaaacggatggagtttactagcagttgtccaaatgtgtcagagcgaagctttgacaacgtgcgatccctcaaggtggagagcggtgcatggatcggctatgagcacacttcattttgcgggcaacagttcatactagaaaggggcgagtatcccagatgggacgcctggtctggcagcaatgcataccacatcgagagattaatgtcttttcgtccgatatgcagcgctaatcacaaggagtccaagatgacgatttttgaaaaagagaactttatcggcaggcagtgggagatttccgacgattatccctccctgcaagctatgggctggtttaataatgaagtgggatccatgaaaattcagagcggagcgtgggtatgctaccaataccccggataccgcggatatcagtatatcctggaatgtgatcaccacgggggagattataagcactggcgggagtggggctcccatgcccagaccagtcagatacaaagcatccgacgcatccagcagtag

SEQ ID NO: 233044 - DNA, 2940 bp, Artificial Sequence
  Description of Artificial Sequence: Synthetic coding sequence
atgaccctgcatgccacccggggagccgctctcctgtcatgggtaaactctcttcacgtcgccgatcctgtggaggcggtgctgcaactgcaggactgtagtatatttattaagatcattgatagaatacacgggacggaagaaggacagcaaatcttgaaacaacccgtgtctgagcgtctggatttcgtatgctcatttctgcaaaagaacaggaaacacccatcaagtcccgaatgtttggtttctgcacagaaggtgcttgagggttcagagttggagctcgcgaagatgaccatgttgctgctctatcatagcactatgagttccaagtcccctagagattgggagcagtttgagtacaaaattcaagccgagctggcagttatccttaagtttgttctggaccatgaggacggactaaacttgaacgaggacctggagaatttcctgcaaaaggcaccagttccaagcacctgtagtagtacttttcccgaagagctgagccctccttcccaccaggctaaaagagagataaggttcctggaacttcaaaaagtggccagttcctcctctggtaacaattttctgtccgggtccccagcatctcccatgggcgacattttacagacgccccagtttcagatgaggcgccttaagaaacaactggccgacgaacgctcaaatcgagacgaattggagctggaacttgctgagaaccggaaactactgaccgaaaaggatgcacagatcgctatgatgcaacagagaatcgacagactggccctcctaaatgagaagcaagctgcatcgcctctcgaacccaaggaactggaggagctgcgggacaagaacgaatctttgacaatgcgtctccacgagacgcttaagcagtgccaagacttaaagactgagaaaagccagatggacagaaaaatcaatcagttatccgaggagaatggcgacctgtctttcaaactgagggagtttgctagccacttacagcagctacaggacgcgctgaacgaactcacagaagaacactcaaaagctacccaggagtggctggagaagcaggctcagctggagaaggagttatccgctgctttgcaggacaagaagtgcctggaggaaaagaatgaaattctccagggaaaactgtcccagttagaggagcatctttcacagcttcaggacaatccacctcaagagaagggagaggtgctgggagatgtgctgcaggtcgaagagctctctaaaaagctggctgacagtgaccaggctagtaaagtccagcagcagaagctgaaggcagtgcaggcgcaggggggagagagtcaacaggaggcccagcggctccaggcccagttgaacgaattacaggcacagctgtctcagaaggaacaggccgctgaacattataagctacagatggagaaggctaaaactcattacgatgctaaaaagcagcagaaccaggagctccaagaacaattaaggtcactggagcagttgcagaaagaaaataaggagctgcgggcagaggctgagcggttaggtcacgaactgcagcaggcaggactcaaaacaaaagaggccgagcagacttgcaggcacctgaccgcacaagtgcgaagcctcgaagcccaagtggctcacgccgatcagcagctccgcgacctgggtaagttccaagtggctacagatgcgctgaagtcaagagagccacaggctaagccacagctagacctctctattgacagcctagacctgtcatgcgaagagggaacacctctgagtatcacatccaagctacccaggacccagcccgacggtacatcagtgcccggtgaacctgcatccccaattagtcagcgtctgcctcccaaagtggagtcgctggaatcattatattttacccccatcccggctcgatctcaggcccctctggagtcttccttagactcgctgggagacgttttcctcgacagcgggaggaaaactcggagcgccaggcggcgtacaacgcagataattaatatcactatgactaaaaagctggatgtcgaggaacctgattctgcaaattctagcttctattcaacaagaagcgccccagctagtcaggcctctcttcgagcgacctcatctacgcagtctttggctcggctcggctctcccgattatggaaattcagccttgctgtccctgccaggataccgtcctacaacgcggtccagcgcgagaaggtcccaggccggtgtttccagcggagctccaccgggacggaattccttttatatggggacgtgtcaggatgagcccgagcagctcgacgactggaaccggattgctgaattgcaacagcggaatagagtgtgtccgccacaccttaagacttgctacccccttgagtcaaggcccagcctcagtctggggacgatcaccgacgaggaaatgaagactggggatccccaggaaactcttcgacgagcctcaatgcagccaattcagatagctgagggaaccggcatcacaactcggcagcagagaaaaagggtgagcctggagcctcaccaaggcccaggcactcccgaaagtaagaaagcaacaagttgcttcccacgcccaatgacaccacgcgacaggcacgaagggcgaaaacagtcgactactgaggcacagaagaaagctgcaccggcatctactaagcaggctgatcggcgacagtcgatggcatttagtatcctgaacacaccaaaaaagctcgggaattcgctactccgcagaggggcaagtaagaaggccctttccaaggccagcccgaacactcggtccggcacacgcaggtccccaagaattgcgactaccaccgcgtccgccgctactgccgcagcaatcggcgcaaccccgcgagcaaaggggaaggcaaagcactag

SEQ ID NO: 233045 - DNA, 6305 bp, Artificial Sequence
  Description of Artificial Sequence: Synthetic coding sequence
atgacccttcatgcaactaggggtgcagctttactttcgtgggttaactcattacacgttgctgatcctgtggaggccgtcttgcagctccaagactgcagcatcttcataaagatcattgacagaatacatggaactgaggaagggcagcagattctgaagcagccagtgagtgaaaggcttgacttcgtgtgtagtttcttacagaagaatcggaaacatccaagttcacccgagtgtctagttagtgcccaaaaagtgctcgaaggatcagaactagaacttgcgaaaatgaccatgcttctactttaccattcaacaatgtccagtaagtccccccgtgactgggaacagttcgagtataagattcaggcagagttagcggtcatccttaagtttgtgcttgatcacgaagatggcctgaacttaaatgaggatctggagaactttcttcagaaagctccagtcccgtccacatgcagtagtacattccccgaggaactgagcccaccgagtcatcaagccaagagggagattcgcttcctggagctgcagaaagtcgcaagctcttcttccggcaacaattttctgagcggcagcccagcttccccaatgggtgacattctgcaaactccacagttccagatgcgtcggttaaaaaaacagttggctgatgagcgcagcaatcgggatgaactagagctggagctggcggagaacagaaaacttttaaccgaaaaggacgcacaaatagccatgatgcagcagcgtattgatcggttagcgctccttaatgaaaaacaagctgccagtcccctggaaccgaaagaactggaggagctgcgggataaaaacgagagccttacgatgcgtctccacgaaactctgaaacagtgccaggatcttaagacggagaaatcccagatggacagaaaaatcaaccagctgtcggaggagaatggggatctttctttcaagctgcgcgagtttgctagccacttgcagcagttgcaagatgccctgaatgagctgactgaagaacattctaaggccacccaggaatggctcgagaaacaggctcaacttgagaaagaactgagtgccgcactgcaggataaaaaatgcttagaggagaagaacgagatcctgcagggcaaactctcccagctggaggagcacttgtctcaattgcaggataatccacctcaagagaaaggcgaggtccttggcgacgttctgcagttagagacactgaaacaggaagctgcaacactggcggctaacaatacccagctccaggccagagtggagatgctggagacagaacgaggacagcaggaggcaaaactgttggcagaacgcggacatttcgaggaagaaaaacagcaacttagttccctgataaccgatcttcagtctagtattagcaacctgtcacaggccaaggaggagctcgagcaggcgtcgcaggcccatggcgcacgtctgaccgctcaagtggcaagcttaacatctgagcttaccactcttaacgccacaattcaacagcaggatcaggagcttgcaggcttaaagcagcaggccaaggagaaacaggcccagctggcacagactctgcagcagcaagagcaggcttcacagggactgcggcaccaagtggaacaactgagctcatctttaaagcagaaagagcaacaactcaaggaggtggcagagaaacaagaagcgacccgccaagaccacgcgcaacagctggcgacagccgctgaagagcgtgaagcatctcttcgcgagcgcgatgccgctttgaagcagctggaagctctggaaaaggagaaggctgcgaagctggaaattttgcagcagcagctgcaggtcgccaacgaagcacgcgactcagcccaaacaagtgtcacacaggctcaacgcgaaaaagccgaactgtccagaaaagtggaggagctccaagcctgtgttgaaacagcccgtcaggagcagcatgaggcacaggcgcaggtcgccgaactggaactccagcttaggtccgaacagcagaaggccacagagaaggagcgggtggcacaggaaaaagaccagctacaggaacagctccaagctctcaaagagtcactcaaagtgactaaaggcagcctggaggaggagaagcgcagagccgctgatgcccttgaggaacagcaacgttgcatttctgagctgaaggcagagaccagaagtctagtggaacaacacaagagagagagaaaggaactcgaggaagagagggctggcaggaaggggctggaagcgcgtttgcaacagctcggagaggcacaccaggctgagactgaggtactccgcagagaactcgccgaggccatggctgcccagcacaccgccgagtcagagtgcgagcagctggtgaaggaagtggctgcatggcgcgaacgctatgaggattcacaacaggaagaagcccagtatggagcaatgttccaagaacaacttatgaccctaaaggaagaatgcgagaaagctcggcaggaactccaggaagcgaaggagaaggtggctggcatcgagtctcacagtgaactccagatcagcaggcagcagaacgagctggccgagttgcatgccaatttggcaagagcactccagcaagttcaagagaaggaggtgagagcccagaagctagccgacgatttaagcaccctacaggaaaaaatggctgccacttcgaaggaggttgctcgcctggagactctcgtgcgtaaagccggtgagcagcaagagaccgcctctagggagctagtaaaggagccagccagagcaggggataggcagccagagtggttagaggaacagcagggcagacagttttgttccacacaagctgccctgcaggctatggagcgagaagcggagcagatgggtaatgaactggagaggctgcgcgctgctctgatggaatcccagggacaacagcaggaggaaaggggacagcaagagagagaagtggcgcgtctcactcaagagagagggcgagcccaggccgaccttgctctggagaaagcagctcgagctgagttggaaatgaggttacagaacgcactgaatgagcagcgagtggaattcgccacactgcaagaggccttggcccatgcactcactgagaaggagggtaaggaccaggagcttgccaaactgaggggattggaggcagcccagattaaggaactggaggaactgcgccagaccgtgaaacagttaaaagagcagctggccaagaaggaaaaagaacacgcttcaggcagcggggctcagtctgaagctgctgggagaaccgagcctacaggccctaaattggaagcattgagagcggaggtgagcaaattggagcagcaatgtcaaaaacagcaagaacaagccgactccctggagcgttcacttgaagcagaaagagccagcagagctgagcgcgactccgccctggagaccctgcagggccagttggaggaaaaagcccaggaactcggacactcccagtcagccctcgctagcgcacagcgcgaactggctgctttccgtaccaaggtgcaggaccactctaaagctgaagatgaatggaaggcacaggtagccagaggaagacaggaggcagagcgtaagaattctctgatttcttcgttggaggaggaggtctcgatccttaacaggcaggtcttggagaaggaaggtgagtccaaggagttaaagcgtctggttatggcagaaagcgagaaaagccaaaaactggaggagaggctaagactactgcaggccgagaccgcctcgaattcagctagagctgctgagagatcttctgccctcagagaagaggtccagagcttacgcgaagaagccgagaagcagcgcgttgcctctgagaatctgcggcaggaactgacctcacaggccgagagggccgaggaactgggccaggagctgaaggcatggcaggaaaagtttttccagaaggagcaggctctttctacattacagctcgagcacacctcaacgcaggccctggtatcagagctgttgcccgctaagcatctgtgccagcagttgcaggcggagcaggctgcagcggaaaaaaggcaccgcgaagaactcgaacagagtaaacaggcagccggaggactgcgggctgagcttcttagagcacagagggagctgggtgagctgataccgctgcgtcagaaagtggctgagcaggagagaaccgctcagcagcttcgggcagagaaggcaagttatgccgaacaattgtctatgctcaagaaggctcacggtcttctggctgaagagaacagaggtcttggagaaagggccaacctgggcagacaatttctggaggtggagctcgatcaggcgagagagaagtatgtgcaggagctggctgccgttcgggctgatgccgagacccgcctggccgaggtacagagggaagcccagtccaccgctcgcgaactggaggttatgaccgctaagtatgagggtgcgaaggttaaagttcttgaggagaggcagaggttccaagaggaaagacagaagctgaccgcgcaagtggaagaactctctaagaagctggctgatagcgatcaggccagtaaggtgcagcagcaaaaattaaaggcagttcaggcccaaggaggggagtctcaacaggaggcccagagactgcaggcccagctcaatgaactacaagctcagttgagtcaaaaagagcaggccgctgaacactacaagttgcagatggagaaggcgaaaactcattacgacgctaagaaacaacaaaaccaagagctacaggagcaactcaggagtctcgagcagctacagaaagagaacaaggaactacgtgccgaggctgagagacttggtcatgaactgcagcaggccggattgaaaacaaaggaggccgaacaaacctgccggcacctcactgcccaggtgaggtctcttgaggctcaagtggcccacgccgatcaacagctccgggatctgggcaagttccaggtagcaaccgatgcactaaagtctcgggagcctcaggccaagcctcagctggatctgtcaatcgacagcctcgacctcagctgcgaggaaggaacgccacttagcatcaccagcaagttgcctaggacacagcctgacgggacatcagtgcccggagagcctgcttcccctatctctcagaggctgccacctaaagtagaatccctcgagtccctttacttcacacccatccctgcgagaagtcaggcccctcttgagtcttccctggactcacttggggatgtgttcctggatagtggcagaaaaaccagatctgcccgacgccgaacaacccagatcattaacattaccatgaccaaaaaactagatgtggaagagcccgacagcgccaacagtagcttctactctacgaggtcagctcctgcttcccaagcctccttacgtgcaacttcttccacacagtcactggctagactggggtcccccgattatggcaactcagcccttctgtcgctccccggatatcggcctaccaccaggtcttcagcgcgacgctcccaagcgggtgtctcaagcggtgcccctcctggccgaaactcgttttatatgggcacttgtcaagacgagcctgaacagctggacgattggaataggatcgcagagcttcagcaacgaaatcgagtttgcccccctcacctgaagacatgctatccactcgaaagtcgaccgtcgctatccctcggcaccatcaccgatgaagagatgaaaacaggggaccctcaggagaccctccgacgagcgtcgatgcaacctattcagattgctgaggggaccggcataacaacaagacaacagcgtaaacgggtgtctctcgaacctcaccaaggaccaggaactcctgagtctaagaaggccactagttgcttccccagacccatgactcctagagatagacacgaaggcagaaaacagtctactaccgaggcacagaaaaaagccgcacctgcatctaccaagcaggctgataggaggcagtccatggcattcagcattctcaatacgcccaaaaagcttggcaacagtctgctgcgaaggggcgcaagcaagaaggcactgagtaaagcgtctcctaatactcggagcgggacccggaggtccccaaggattgccacgacaacagctagtgccgctaccgcagcggcaattggcgctacgcctagggccaaggggaaagcaaaacacta

SEQ ID NO: 233046 - DNA, 4994 bp, Artificial Sequence
  Description of Artificial Sequence: Synthetic coding sequence
atgctggaaacggagcgtggccagcaggaggccaagttgcttgcagaacgcggacactttgaggaggaaaagcagcagttgtctagtctgattaccgatttgcagtcctctattagtaatctgtcccaagcaaaagaggagctcgagcaggcatcacaggcccatggtgccagattgaccgcgcaggttgcttctttaacgagcgagttgacgacgctgaacgcaactattcagcaacaggaccaggagctcgccggtttaaaacagcaggccaaagagaagcaggcccaactggcacagacgctccagcagcaagagcaggccagtcagggacttcgccatcaggtggagcagctgagtagcagcctaaaacagaaggagcagcagctgaaggaagtggccgagaaacaagaagccactcgacaggaccatgctcagcaacttgccacagcagccgaggagcgcgaagctagcctgcgagagcgagacgctgctctcaagcagttggaggccctggaaaaggagaaagctgccaaactggaaattctgcaacagcaactgcaggtggccaacgaggctagggattcagcccagaccagcgttacgcaggcccagcgtgagaaagctgaattgagcaggaaagtcgaggagctgcaggcctgcgtcgagacagccagacaggaacagcatgaggcacaagcccaggtggctgaactggagttgcagctgcgatcagaacagcagaaggccaccgaaaaggagagagtggcccaagagaaggaccagctgcaggaacagctgcaggcactcaaggaatcattaaaagtgaccaaagggagcctggaggaggaaaagaggagggccgctgatgctctcgaggaacagcagcggtgtatctctgagctgaaagccgaaacccgctctctcgtcgaacagcataagcgggaaagaaaggagctggaggaggagcgggctggcagaaagggccttgaggccagactccagcagctaggcgaggcacaccaggccgagaccgaggtgctccgcagagaactggctgaggctatggcagctcagcacactgcagagagcgagtgtgaacaactcgttaaggaggtcgccgcatggcgcgaacgatacgaggactctcagcaggaagaggctcagtatggcgctatgttccaagagcagctgatgaccttgaaagaagaatgtgagaaggccaggcaagagttgcaggaggctaaagaaaaggtcgcgggaattgaaagtcacagtgagcttcagatctcacgacagcaaaatgagctggccgagctgcatgcaaacctggccagagcgttacagcaggttcaggaaaaggaggtgcgagcccagaaactagctgacgacctgtctacccttcaggagaaaatggccgcaacttctaaagaggtcgcaaggctcgaaacgcttgtgcgtaaggcgggtgagcagcaggagacggcctctagagagctagtgaaggagccggcaagagcaggcgatagacagcccgagtggttggaggagcagcaggggcgtcagttttgtagcacccaagcagcactccaggctatggaaagagaggcagagcagatggggaacgaactagaaagattacgagcagccttgatggagtcccagggccagcaacaggaggagcgaggacagcaggaacgggaggtggcgcgtctgactcaagaaagggggcgtgctcaggctgacctcgcactcgaaaaagccgctcgggcagaattagagatgaggcttcagaatgcactgaatgaacagcgcgtggagtttgctacactgcaagaggcactggcccacgccctcaccgaaaaagaagggaaagatcaggaactagccaagctgcgaggactggaagcggctcagattaaggagctggaggaactgagacaaactgtcaaacagctgaaggagcagcttgctaagaaggaaaaagagcacgcgtctgggtctggcgcacaaagcgaggccgcaggcagaactgaaccaaccggacctaagctcgaggcactacgggctgaggtgagcaaactggagcagcagtgtcagaaacagcaggaacaggcagacagcttagaaaggtcactcgaagccgaaagagcctcgagagcagaaagagactccgccctggagaccctgcaaggccaactggaggaaaaagcccaggaattaggacactctcagtcagcactggccagcgcgcagagggagctggccgctttcagaaccaaggtccaggatcattcaaaagcagaggacgaatggaaagcgcaagtggctagaggcagacaggaagctgagcgtaagaattctttgatcagctctctggaggaggaagtgtccatcctcaaccgtcaggttctggagaaggagggggaatctaaggaacttaagaggttggtcatggcggagagcgaaaagtctcagaagctggaggaaagactgcgtcttcttcaagccgagactgcctctaacagcgctcgtgctgcagaacggtcaagcgcgctcagagaggaagttcaatccttgagagaagaagcggaaaagcagagggtcgctagcgagaatctgcgacaagagttgaccagtcaggcggaacgggctgaggagctcgggcaggagctcaaggcttggcaggagaagttcttccagaaagaacaggcgctctctaccctacagttagaacacacctcaactcaggctcttgtgtctgagcttctacctgcaaaacatctgtgtcaacagctccaggcggaacaggctgccgctgaaaagcggcaccgcgaagagttggagcaaagtaagcaggctgctgggggacttcgggcagagctactcagggcacaacgggagctgggcgaactgattccgctccggcagaaggtggcagagcaagaacggaccgcacagcaactcagagccgagaaggcaagttacgctgagcagctctcaatgctgaaaaaagcccatggcttgcttgccgaagagaataggggcctgggcgagcgggctaatctgggcaggcagtttctggaggtggaactcgaccaggctagagaaaagtacgtgcaggagttggccgctgtgcgggcagacgcagaaacccggctggctgaagtgcagagggaggctcagagcaccgctcgggagctggaggtgatgaccgccaagtatgaaggtgctaaagtcaaagtactggaagaacgtcagcgctttcaggaggagaggcaaaaattgactgcccaggtggaggagctgagtaagaaactggcggatagcgaccaggctagtaaggtgcaacagcagaagctcaaagctgttcaggctcagggtggcgagagtcagcaggaggcccagcgcctccaggctcagttaaatgaactgcaagctcagctgtctcaaaaggagcaagctgcagagcactataaactgcagatggaaaaagccaaaacccattacgacgcaaaaaagcaacagaatcaggaactgcaagagcagttacggagcctcgaacagttgcagaaagaaaacaaagaactccgcgcagaggcggagcggttgggacatgagctccagcaagctgggcttaaaaccaaggaagctgagcagacatgcaggcatctcaccgcccaggtccgcagccttgaggcccaggtggcccacgcagatcagcagctgagggatcttggaaagttccaggttgccaccgacgctttgaagagccgggaaccccaggctaagccacagttggacctgtcaattgactccttggatctgagctgtgaagagggcactcccctaagtatcacatctaaactgccccgaactcaacccgatggaacctctgttcctggcgaaccagcatcaccgatatcgcagcggctgccacctaaggtggaatctctggaatctctgtatttcacaccaattcctgcccgtagccaagcacctctggaaagtagcttggactcgctgggagatgtctttctcgatagtgggaggaagaccagatctgcccgtcgaaggactacccagattattaatatcactatgaccaaaaagcttgacgtagaagagccggatagcgctaacagcagcttctactctaccaggtccgccccagctagtcaggcttccctacgggctactagttccacacaatccctagctaggctggggtcacctgattatggtaatagcgcccttctgtcactgcctggctacagacctacaaccaggagctccgcccgacggtctcaggctggcgtgtcctcgggcgctcccccaggaagaaactccttctacatgggtacctgtcaagatgaaccagaacagctggacgattggaaccgcatcgctgaactgcagcagaggaatcgggtctgccctccacacctaaaaacttgctatcccttggagtcccgaccatcactgtcattgggaacaattacagatgaggaaatgaaaaccggagatccacaggagactctaaggcgcgcaagtatgcagccaatccagatcgcggaggggacaggaatcacaacacgtcagcaaagaaagagagtgtcattggagccacatcaggggcctggcacccccgaaagcaagaaagctacctcctgttttcctcggcctatgacacccagagaccgtcacgaaggtaggaaacagagtaccactgaggctcagaagaaggcggcacccgcttccaccaagcaagccgatcggagacaatcaatggccttctccattctaaatacacccaaaaaactggggaacagcctgttaagaagaggggcttccaagaaagcactctccaaggccagcccaaacacccgctcaggcactaggcgttcccctcgcatcgctacgaccaccgcgagcgccgctactgcagccgcaataggagccactccacgggcaaaggggaaggcaaagcacta

SEQ ID NO: 233047 - DNA, 228 bp, Artificial Sequence
  Description of Artificial Sequence: Synthetic coding sequence
atgactctccacgcgacacgcggagctgcccttctatcttgggtgaactctctccacgtcgcagatcccgtggaggctgtactgcagctccaggactgcagcatctttatcaaaattatcgatcggattcacggcacggaagaaggacaacagatactcaaacagcctgtctcagagcgcctggattttgtgtgcagctttcttcagaaaaacaggaaacacccctag

SEQ ID NO: 233048 - DNA, 276 bp, Artificial Sequence
  Description of Artificial Sequence: Synthetic coding sequence
atgacattgcacgctactagaggagccgctctgctgtcatgggtgaacagcctgcatgtggctgatccagtggaagccgtattacagctacaggactgtagcatctttattaaaattattgataggatacacggtaccgaagaaggccagcagattcttaaacagcctgtgtctgaacgccttgattttgtgtgtagctttctgcagaagaaccggaaacacccgtcctcccctgagtgcctcgtctcagcccagaaggtgctggaagggtcttag

SEQ ID NO: 233049 - DNA, 6347 bp, Artificial Sequence
  Description of Artificial Sequence: Synthetic coding sequence
atgacgttgcacgccaccagaggagctgcgctcctgtcctgggtgaattcactccacgttgccgacccagttgaggctgtcttgcaattacaggattgctcaattttcattaaaatcatagaccggatccatgggactgaagaaggacagcaaatcttgaagcaaccagtgagcgagagattggatttcgtgtgtagctttttacagaagaaccggaagcatcctagctctcctgagtgtctagtgtccgcccaaaaggttctggaagggtccgagctggagctggccaagatgacaatgctcttgctttaccatagtacaatgtcatccaagagcccaagggactgggaacaatttgagtataaaattcaagcggagctcgcagtgattctcaaatttgtcttggaccatgaggacggacttaatctgaatgaggacctggaaaacttccttcagaaggccccagtcccaagtacttgctcctcgaccttcccagaggaactctcacctcctagtcaccaggctaagcgtgaaatcagattcttagaacttcagaaagtggcctcctcatcctccgggaataactttcttagcgggtcgcctgctagtcctatgggtgacattttacagacaccccagtttcaaatgcgcaggctgaagaaacagcttgccgacgagcgcagtaacagggatgagctcgagctggaactcgccgaaaatcggaagttgttgaccgagaaggatgcccagatcgccatgatgcaacagcggattgaccggttggctctgctcaacgaaaagcaagccgcatcacctctggaaccaaaagaactagaggagctcagggataaaaacgaaagcttgacgatgagactccatgaaaccctgaaacagtgtcaggacctaaagactgaaaagagccagatggacagaaaaataaaccagctatcagaggagaatggcgacttgtcattcaaattgagggaattcgccagccatcttcaacagttgcaggatgctctgaacgaacttaccgaagaacacagcaaggccacccaggagtggctggaaaagcaggcccagctggaaaaagaactaagcgctgccctccaggataaaaagtgcctggaggagaagaatgaaattctccaggggaaattgtcgcagttagaggaacacctctcgcaactccaagacaaccccccacaggaaaagggagaagtgctcggggacgtgttacaacttgaaactttgaaacaggaagctgcaacattagctgccaacaatacccaattgcaggccagggtggaaatgctggaaacagaaagaggtcagcaggaggcaaaacttctggccgaaagagggcattttgaagaggagaagcagcagctgagctccctgattacagatcttcagagcagtatctcaaacttgagtcaggcgaaggaggagttggagcaggcgagtcaggcacatggtgcgagattgacggcccaagtggccagcctgaccagtgagctaacgacgctcaacgctacaattcagcagcaagaccaagagcttgccggacttaaacagcaggcgaaagagaaacaggctcagttggctcaaacattacaacagcaagagcaagcttcacagggactaaggcaccaggtggagcaactgtcatccagtttaaaacagaaagagcaacagcttaaagaagtggctgagaagcaagaggctacaagacaggatcatgcccagcaattggctaccgctgcagaagagcgggaggcctctctgagagagagagacgcggcactaaaacagctggaggccctggagaaagaaaaggcagccaaactcgaaatattgcaacagcaactgcaagttgccaacgaggcaagagactcagcccagacgtcagtaacccaggctcaacgtgaaaaagctgagcttagtaggaaggtggaagagctccaggcatgtgtggagactgcgaggcaggagcaacacgaagcgcaggctcaggtggccgaactcgagctgcaattgcgaagtgagcaacagaaagctaccgaaaaggaacgagtggcccaagagaaggaccagctgcaggaacaactccaggccctgaaggaaagtctgaaggtgacaaaaggctctctggaggaggaaaagcggagggcggctgatgctttggaagagcagcagcgttgcatttctgagttgaaagctgagactaggtccctggtggaacaacacaaaagggagcggaaggagctcgaggaagaaagggctgggaggaagggcctggaggcgcgtctccagcagctaggggaggcgcaccaagccgaaaccgaggtactccgccgagagctagctgaggctatggcagcccagcacaccgctgagagcgaatgtgagcagctcgttaaagaagtcgccgcatggcgtgaaagatatgaggattcgcagcaagaggaggctcagtacggggcaatgtttcaggagcaactgatgactctgaaagaggaatgcgaaaaagctaggcaggagctgcaagaggcaaaggaaaaggtggccggtatcgagtctcattcggagctgcagattagtaggcagcaaaacgaactggcagagctacacgcgaacctggcaagggcgctgcagcaggtgcaggaaaaagaggtgagagcccaaaaattggctgacgatctttctacactgcaagaaaagatggcagccacatctaaagaagtggcccgtcttgagactctggtccggaaggcgggagagcagcaggaaactgctagccgtgaacttgtcaaggaacctgccagagcaggtgaccgacagcccgagtggctcgaggagcagcagggtcggcaattttgctctacacaggcggcactgcaggcaatggagcgggaggctgagcagatgggaaatgagctggagcgccttcgtgcagccttaatggaatctcagggccagcagcaggaggagcggggacaacaggagcgtgaggttgcaaggctgacgcaagaacggggaagggctcaggctgatctcgcgcttgagaaggccgcacgagctgaactggaaatgcgattgcagaacgccctgaatgagcagagggtcgagtttgcaacgctgcaggaggcattagcacatgccctcactgaaaaggagggcaaagatcaggagctggccaagctgagaggactggaagctgcccagattaaagagctggaagagcttcgccagaccgtgaagcagttgaaggagcaactcgcaaaaaaggagaaggaacatgcctcagggtccggcgctcaatctgaggcagctggacgtaccgagcctacagggccaaaacttgaagctctgcgggcagaagtgagcaagctggaacagcagtgccaaaagcagcaagaacaggctgactcacttgaacgcagtttagaagccgagagggcctcgagggccgagagagattcagcactcgagacactccaggggcagctagaggagaaagctcaggagttaggacactcacagtctgcactcgcatccgctcaaagggagctcgccgcttttcggacaaaggttcaagatcactcaaaggcagaagacgagtggaaggcccaagtggccagaggccgtcaagaagctgagcggaagaatagtctaatttcttcacttgaggaggaagtgtccattttgaatcggcaggtcctggaaaaggaaggtgagtcgaaagaactgaagaggctggtgatggcggagagcgaaaagagccagaaactagaggagaggctgagacttctgcaggctgaaactgccagtaactccgctcgagccgctgaacggtccagtgcactaagggaagaagtccaaagcctgcgggaagaggccgagaagcagagggtcgctagcgagaacctgagacaggagcttacaagccaagcagaaagggccgaagagctgggacaggagctcaaggcctggcaggaaaagttcttccaaaaagagcaggctctgtctaccctgcaactggaacatacatcaacccaagctttggtttccgagctcctccctgccaaacacttatgccagcaactgcaggccgagcaagccgcagcagagaagcggcaccgcgaagagctggagcagagtaagcaggcagcaggaggcctacgtgcagagttgctgcgggcacaacgggaattaggtgaactgatccccctcaggcagaaagtggctgagcaggaaaggacagcccagcaactccgcgctgagaaggcctcttacgccgagcagcttagcatgctaaaaaaagcacatggactgcttgccgaggagaaccgtgggctgggagaacgcgcaaaccttgggagacagttcctcgaagttgagttggaccaggccagggaaaaatacgtacaagaactggccgcagtccgggcagatgctgaaaccagattggctgaagtacagcgggaggcacaaagcaccgctagggagttggaagtgatgacagccaagtacgaaggcgcaaaggtgaaggttctggaagagaggcagagattccaggaggagcggcagaaactcaccgcacaggtggaacagttggaagtgttccagcgggaacaaaccaagcaggtcgaggagttaagcaagaagctggctgatagtgatcaggcctccaaggttcagcagcagaagctaaaggcggtccaagcccagggtggcgagagtcaacaggaggcacagagactacaggcacagcttaatgaattgcaggcacaactcagccaaaaggagcaggccgctgagcactacaaactccagatggaaaaagccaagacccattacgacgccaagaaacaacaaaaccaggagctccaggagcagctgcggtctctagaacagctccagaaggagaacaaggagctgagggcagaagctgaaaggctgggtcatgagttacaacaggcgggacttaagaccaaggaagctgaacaaacctgtagacacttgactgcccaggtccgctccctggaggcgcaggtcgctcatgccgatcaacagctgcgcgaccttggaaaatttcaggtggccaccgacgcacttaagagccgcgaaccacaggccaagccacagctggacctgagtattgactcactggacctttcctgcgaagagggaactcctctgtccataacaagcaagctcccaagaacacaaccagatggcacatccgtccctggcgaacctgcctcacccatttctcagagactgccccctaaggtggagagcctcgaaagtctgtacttcacccctatacctgcaagatctcaggctccactggaaagttcattggattccctgggagacgtgttcctcgacagcggcagaaaaacccgctctgcgaggagaaggaccactcagattataaacataaccatgactaaaaagttggatgtagaggagcctgactcagcaaatagttccttttacagcacacggtccgctcctgcctcccaggccagtctgagagcgacctctagcactcagtcgttagcccgactggggtcaccagactacggaaactccgccctgttgtctctgccagggtatcgccctacgactaggtcttccgccaggcgcagccaggctggtgtcagttccggtgccccacctggcagaaactccttctacatgggcacttgccaagacgagcctgagcagctcgacgactggaaccgcatcgccgagcttcaacaacgaaacagggtctgcccccctcatctcaaaacatgttatcctcttgaatctcggccttccctgtcgctcgggacgataacagatgaggagatgaagaccggcgatcctcaagaaactcttcgcagggccagtatgcagcccatccagatcgctgaaggtacagggattactactagacaacagagaaaacgcgtcagcctggagccacaccaagggccaggcacacccgagagtaagaaggccacgtcatgtttccctaggcctatgacacctcgagatagacatgagggccgtaaacagtcaacaacagaggcacagaagaaagccgctcccgcttccacaaagcaggccgatagacgccagagcatggcatttagcatccttaataccccgaagaagctgggcaactcactcctgaggaggggagcttccaagaaagcgctgagcaaggcttcccccaatactaggagcggaacgcgccgaagccccaggatagcgaccaccacggccagcgccgcaacagccgctgccataggggcaactccaagagccaaagggaaagcaaagcacta

SEQ ID NO: 233050 - DNA, 330 bp, Artificial Sequence
  Description of Artificial Sequence: Synthetic coding sequence
atgaccctccacgcaacccgtggagctgcacttctatcttgggtgaattcactgcacgtagctgacccggtggaggccgtcctgcagctgcaggattgttccatcttcattaagatcatcgatcgaatccacggaaccgaagaggggcagcagatcctaaagcagcccgtaagtgagcgactcgacttcgtgtgcagcttcctgcagaagaatcgcaaacatccctccagccctgaatgccttgtgagtgcccaaaaggtgctggaagggagcgagctcgaactggctaagatgactatgctcctgctttaccattcgaccatgagttag

SEQ ID NO: 233051 - DNA, 186 bp, Artificial Sequence
  Description of Artificial Sequence: Synthetic coding sequence
atgacactgcatgccactcggggtgccgcactgctctcttgggtaaatagtctgcatgtggccgatcctgtcgaagctgtgcttcagctgcaagattgcagtattttcatcaagataattgaccgcattcacggaaccgaagaaggtcagcaaattctgaaacagcctgttagcgagaggctatag

SEQ ID NO: 233052 - DNA, 180 bp, Artificial Sequence
  Description of Artificial Sequence: Synthetic coding sequence
atgactctgcacgcaacacgcggagccgcactcctgagttgggtaaactccctgcacgtagccgatcctgtcgaagccgtcctgcaactgcaagactgcagcatcttcatcaagatcatcgatcgcatccacggaaccgaggaaggacagcagatcttgaaacagccggtaagcgagtag

SEQ ID NO: 233053 - DNA, 441 bp, Artificial Sequence
  Description of Artificial Sequence: Synthetic coding sequence
atgactctgcacgctacccggggtgccgctctgctgtcctgggttaattcgctccacgtggccgatccagtcgaggcagtcctgcaattacaagactgctctatttttattaaaattatcgacaggatccacggtacagaggaaggccaacagatccttaaacagccagtgagcgaacgcctcgacttcgtatgcagtttcctacaaaagaataggaagcacccttccagccccgagtgccttgtgtctgcccagaaggtgctggaaggatccgagctggagctggctaaaatgactatgcttctgttataccatagtaccatgagcagtaaatcacccagagattgggagcagttcgaatacaaaattcaggcagagctggctgtcatcctgaaattcgtgctggatcatgaagacggcttgaatctgaacgaggattag

SEQ ID NO: 233054 - DNA, 3267 bp, Artificial Sequence
  Description of Artificial Sequence: Synthetic coding sequence
atgagactgcagaatgcactgaatgagcagcgagttgagtttgcgactcttcaggaggctctggcccacgcgctgaccgagaaggaaggaaaggaccaggagttggcaaagctgcggggtttggaggctgcacagatcaaggaactcgaggagctacgccagaccgttaagcaactaaaggagcaactggcgaagaaggagaaagagcacgccagtggcagcggggcacagagcgaagcggctggacgtaccgagcctacgggtcccaaactggaagccctcagagcggaagtttccaaactggagcagcaatgccagaaacagcaggagcaggccgacagtctcgagcgttctttggaggctgaaagagccagtcgagctgagcgagatagcgcacttgagactcttcagggccagctcgaggaaaaggctcaagagctcgggcattcgcaaagtgcactggcctccgcccagcgggaacttgctgctttcagaacaaaggtccaggaccacagcaaggccgaggacgagtggaaggcccaggttgccaggggccgacaggaggccgagcggaagaattcattgatctcaagtttagaagaagaagtgtcgattctcaacaggcaggtccttgaaaaggagggtgaatctaaagaattgaagcgcctggtgatggcggagagtgagaaaagccaaaagctggaagagagactcagattactgcaggcagagactgcttcgaacagtgctcgggcagctgaaaggagctccgcactgcgggaagaggtccaaagcttgcgcgaggaggcggagaaacagcgggttgctagcgagaatctgcggcaggaattgacttcacaggccgaacgggcagaggaattggggcaagagcttaaagcatggcaagagaaattttttcaaaaagagcaggctctttccacactacaacttgagcacacatcaacacaggcccttgtctcagaactgctgcccgctaagcatctgtgtcagcagcttcaggcagagcaagccgctgccgagaaacggcatagagaagagcttgagcagtcaaaacaggccgctggcggactgcgagccgagctgctcagggcacagcgtgagctcggagaactgatcccactgaggcagaaggtcgctgaacaggaaagaacagctcagcagctccgtgcagaaaaagcttcttacgctgagcagttaagtatgctgaagaaagcgcacgggctccttgccgaagagaataggggtttgggggaacgggcaaacttgggaagacaatttcttgaggtcgagttggaccaagcacgagagaagtacgttcaggagctggctgccgtgagggccgatgcggagacacgtctcgccgaggtccagagagaagctcaatccacagccagagaactggaagtcatgacggctaagtacgagggcgcaaaggtgaaggtgctggaggagaggcagaggttccaggaggagcgtcaaaaactcactgcccaggttgaagagctgagtaagaagttagctgactcggatcaggccagcaaagtgcagcaacaaaagcttaaagctgtgcaagcccagggcggagaatctcagcaggaggcccagagactccaggcccaactcaatgaactccaagctcagctgtcacagaaagaacaagccgctgagcactataagctgcagatggaaaaagctaaaacccattatgacgccaagaagcaacagaatcaagagctacaggaacaactgagatcattggagcaactgcagaaagagaataaggagttgagggctgaggccgagaggttagggcacgaactccagcaggctgggctcaagaccaaagaagcggagcagacatgtagacacctgacagctcaggtgagatccctggaagcacaagtggcacatgccgaccagcagctcagggacctgggcaaattccaggttgctaccgatgcacttaaatccagggaaccccaggcaaaaccccagctggacctaagtatagacagcctggacctcagttgcgaggagggcacccccctgagtatcacacgccataaagcccttatgaccatcattcctgacctgagtcctaacaacccacttagtaagctgcctaggactcagcccgatggaacatccgttcctggcgaacctgcttctcctatctcccaaaggctgcctcctaaagtcgaaagtctggaaagtctgtatttcacaccgattccagctagaagtcaggcacccctggaatccagcctggactcattgggcgacgtcttcctcgattcggggcgtaagacgcgttctgcgaggcgcagaaccacccagataattaacatcaccatgacaaagaaactagatgtggaggagccagattctgccaattctagtttctactccacacgatctgcccctgcgtcccaggcctctctgagagctacatcctcaacccagagtctggccagactgggctcccccgactacggcaacagcgcgctattgtccttacccggatatagacccactactcgcagcagcgcacggcgaagccaggctggagtatcttcgggggctcctccaggacgcaattccttttatatgggcacatgccaggatgagcccgagcaactagatgactggaatcgtatagcagaactgcagcagcggaaccgtgtctgccctccacacctcaagacctgttaccccctggagtctcggccttctttgtcgctggggaccatcaccgacgaggagatgaagacaggtgatcctcaggagaccctgaggcgagcatcaatgcagccaatacagatcgccgaaggcactggaataactaccagacaacagcggaagcgcgttagcctcgagcctcaccagggtccagggactcctgagtctaaaaaggctacctcttgctttcctcgacccatgaccccccgtgaccggcatgaaggcagaaaacaaagtacgacggaggcccagaaaaaagctgcccctgcatcaaccaagcaggccgatcgcaggcagagcatggcattctccatccttaacacacctaagaaactcggcaatagcttgctgcgaagaggcgcatctaaaaaggccctcagcaaagcctctcccaatactaggtctgggaccagaaggtctcctagaatcgccacgactactgccagtgccgcaaccgcggcagcaataggcgctactcccagagccaagggaaaagccaaacattag

SEQ ID NO: 233055 - DNA, 2076 bp, Artificial Sequence
  Description of Artificial Sequence: Synthetic coding sequence
atgaccttgcatgccacacggggagcagctttgctgtcttgggtgaacagcctccatgtagctgatccagtcgaagctgtgctgcaacttcaggattgctcaatatttattaaaatcatcgaccggattcacggcactgaggaaggacaacaaattctgaagcagccagtgagtgaaaggctggacttcgtgtgctcttttcttcaaaagaatagaaaacatccctcatcccccgagtgcctcgtgagcgcccagaaggttttggaaggctcagagctggagctggccaaaatgactatgcttttgttgtaccacagcacgatgtcttcaaaatctccacgtgactgggagcagttcgagtacaaaattcaggccgaacttgcagtaatactgaagtttgtcctcgaccacgaggacggtctgaatctcaacgaagatctggagaatttccttcagaaagccccagtgccatcgacctgtagctctacattccccgaagagctgagtcccccatcccatcaagccaagagggagattcgattcttagagctgcagaaagtggcttcttccagctccgggaataatttcctatctggttcccccgcttcccccatgggagatatcctccaaactccacagtttcagatgcggaggctcaaaaaacagttggccgatgaacggtctaatcgcgacgaactggagttggagctggccgaaaatcggaaactcctgaccgagaaggacgctcagatagccatgatgcagcagcggatagataggcttgccctacttaatgaaaagcaggcagcaagcccactggaacctaaggagctggaagagctgcgggacaaaaatgagtccttgacaatgaggcttcacgaaactctgaagcagtgccaagatttgaagacggaaaagagccagatggataggaaaattaaccagttgtctgaggaaaacggcgacctttcatttaagttgcgagagttcgcatcgcatctccagcagctacaagacgcgctgaacgaactgacagaagagcattctaaggccactcaggagtggttggagaagcaggctcaactggagaaggaattatctgccgctctgcaggacaaaaaatgtttagaggaaaaaaacgagatccttcagggcaagttgtcccagctcgaagaacacctctcacagttacaggataacccgcctcaagaaaaaggtgaggtgctgggggacgttttacaactcgagacgcttaagcaggaggcggctacactcgccgctaacaatacacaattacaagcccgagtggagatgctcgaaaccgagcgaggtcagcaggaagccaagctactggcagagagggggcattttgaggaagaaaagcaacaactgtcttctctgatcacggatctgcagtcctccatctcgaacctgtcacaggctaaggaggagctggaacaagctagccaggctcatggagccaggctgaccgcccaggttgcctcattaacctccgagctgacaacgttgaacgcgactatccaacagcaggatcaggagctcgccggtttgaagcaacaagcgaaagagaaacaggcccagctagctcaaactctgcaacagcaggaacaggccagccaaggtctcagacaccaagtcgagcagttgagctccagtctgaagcaaaaggagcagcagttaaaggaagtcgctgagaagcaggaagcaacacgccaagaccatgcacagcagctggccaccgccgcagaagagcgagaagcctctcttagagagcgagatgcggctctgaagcagttggaagcactagagaaggagaaagctgctaagctagagatattgcagcagcagctccaggtggcgaacgaggcacgcgattctgctcaaacaagtgttacacaggcccagagagaaaaagctgagctgtctcgcaaagttgaagaactgcaggcttgcgtggagacagcacgccaggaacagcacgaagctcaggcacaagttgccgaacttgaactgcagctgaggtccgagcagcaaaaagccacagagaaggagtag

SEQ ID NO: 233056 - DNA, 480 bp, Artificial Sequence
  Description of Artificial Sequence: Synthetic coding sequence
atgaccctgcacgctactcgcggagcggctctactgagctgggtaaatagcctgcacgtggctgatccggttgaagcagtcctccagcttcaggattgttctatctttatcaagattatcgatcggatccacggcaccgaagagggccagcagatcttgaagcagcctgtttcagagagactggacttcgtatgttccttcctacaaaagaacagaaaacaccctagcagtcctgaatgcttggtgtcagcccagaaagtgttagaggggtctgagctggagctggcaaagatgaccatgttgcttttatatcattctacaatgtcatccaaaagtcctcgggattgggagcagtttgagtacaaaatccaggccgaactggctgtgatcctaaaattcgttctagaccatgaggatggtctgaaccttaacgaagatttagaaaattttctccagaaggctcccgttccaagcacctag

SEQ ID NO: 233057 - DNA, 219 bp, Artificial Sequence
  Description of Artificial Sequence: Synthetic coding sequence
atgaccctccatgcaactcggggtgcggctttgctgagctgggtgaattctcttcatgtggccgatccagtggaggccgtccttcagctacaagactgcagcatcttcataaaaatcatcgatcggatacacggcacagaggagggacagcaaatattgaaacagccagtgtctgagagattagactttgtctgcagttttcttcagaaaaataggtag

SEQ ID NO: 233058 - DNA, 252 bp, Artificial Sequence
  Description of Artificial Sequence: Synthetic coding sequence
atgactctgcatgcgacccgaggagcagctcttctttcctgggtaaacagcttgcacgtggccgatcccgttgaggccgtcctgcagctgcaagattgttccatcttcattaagatcatcgacagaattcatggtactgaggaaggacagcagattctgaaacagcctgtgtctgaacggcttgattttgtgtgctccttcttgcagaagaaccgaaaacacccatcaagcccggaatgccttgtgtcatag

SEQ ID NO: 233059 - DNA, 2559 bp, Artificial Sequence
  Description of Artificial Sequence: Synthetic coding sequence
atgaccctccacgctaccaggggggctgctcttctttcatgggttaacagcctgcacgtggcagaccccgtggaggctgttctgcaactgcaagattgtagcatcttcatcaagattatcgataggattcacggcaccgaggagggacagcaaattctcaaacagcccgttagcgaacgtctcgactttgtttgcagcttcctccagaaaaatagaaagcatccgtcatcccccgaatgtctggtcagcgcccagaaagtcctggaggggtccgaactagagctggcaaaaatgacaatgttgctcttataccattccactatgagttccaaatcccccagggactgggaacaatttgagtataaaatccaggcagagcttgccgttattctgaaattcgtcctcgatcacgaggacggtttgaacctgaacgaggatttggagaactttctccagaaagctcctgtgccgtctacttgctcatccacattcccagaggagctgagtcctccctcccatcaggccaaacgcgaaatcaggtttctggaacttcagaaagttgcaagcagttccagcggcaacaattttttgagtggctcccccgcttccccaatgggtgatattcttcagactcctcagttccagatgcgtagattaaagaagcagctggccgatgagcggtccaatagagacgagctggagctggagctcgctgaaaatcgaaaactgctgactgagaaggatgcgcagatcgctatgatgcaacagcgcattgacagactggcacttctgaacgagaaacaagcggcatcccctttggagcccaaagagttggaggagttacgggacaaaaatgagtcccttacgatgcggctccacgagactttaaagcaatgtcaggacttgaagacagaaaagagtcagatggaccggaaaataaatcagttgtcagaggaaaatggcgatttatccttcaagctcagagaattcgcttctcacctgcaacagttacaagacgctctcaacgagctgacggaggaacactcaaaggccacacaggagtggctcgaaaagcaggctcagctggaaaaagagctatcagccgcactccaagataaaaaatgcttggaagagaaaaacgaaattctgcaaggcaaactttcgcaactggaggagcatttgagccaactccaggataaccccccacaggaaaaaggagaggttttaggggatgtcctgcaactcgaaaccctgaagcaggaagctgctacactggccgcaaacaacacacagcttcaggcacgggtggagatgctggaaacagagcgcggacaacaggaggcgaagttgctggcagaacgcggtcactttgaggaggaaaagcagcagttatcctctcttatcactgatcttcagagtagcatttcaaacctctcccaggccaaggaggaactagaacaggcaagtcaggcccacggggcacggttaaccgctcaagtagctagcctcacctctgagctcacaacactgaacgccacaattcagcagcaagatcaggagctggccggacttaaacagcaggccaaagagaagcaggctcaacttgcacagaccctccaacaacaggagcaggcttcgcagggactgcgccaccaggttgagcagctctcttcctcactgaagcagaaggaacagcaacttaaagaagttgcagaaaaacaggaagctacacgccaggatcacgcacagcagttagctaccgcagcggaggagagggaagcctcattgagggagagggacgccgcactcaaacagctggaggcactcgaaaaagaaaaggccgctaaactagaaattcttcagcagcaattgcaggtggccaatgaagcgagagacagcgcccaaacgtcggtaacccaggcccagagagagaaggctgaactgtcaaggaaagttgaagagctgcaggcctgcgtcgaaacagcaagacaggagcaacacgaagcgcaggctcaggtggccgaattggagctgcagctgcggtctgagcagcaaaaagccactgagaaggaacgagttgcacaggaaaaagatcaactgcaggaacaactccaggctcttaaggagtcgctcaaagtgaccaaagggtcactggaagaagaaaaaagacgggcagctgacgcattggaggaacagcaacgctgcatttctgagcttaaggccgagacaaggtccctcgtcgagcaacataagcgggagcgcaaggaactcgaggaagaaagagctggccgaaaggggctggaggccagactgcagcagctgggcgaggctcaccaggccgaaactgaagtgcttagacgagaactggccgaagccatggcggctcagcacactgctgagtccgagtgcgaacagctggtcaaagaagtggcagcctggcgagaaaggtatgaggacagtcaacaggaggaggcacagtacggggctatgttccaggaacagctgatgacactcaaagaagagtgcgagaaggccagacaagaactgcaggaggcatag

SEQ ID NO: 233060 - DNA, 525 bp, Artificial Sequence
  Description of Artificial Sequence: Synthetic coding sequence
atgactctacacgccactcggggagcagctctgctgagctgggtgaatagcctgcacgtggctgaccccgtcgaagccgtgctgcagttgcaggactgctctattttcataaaaatcattgaccggatacacgggaccgaggagggtcaacagattctgaaacaacctgtcagtgaacgattggacttcgtgtgctccttcctccagaagaacaggaagcatccatccagccccgaatgcctcgtaagtgcgcaaaaggtcctagagggctccgaactggagttggccaagatgactatgttacttctatatcactccaccatgtcctccaaaagcccaagggattgggagcagttcgaatataaaatccaggccgagctggccgtcatactgaagttcgtgctggatcatgaagatggcctgaatctcaatgaggatctcgagaatttcttgcagaaggcccctgtgccttcgacctgttcaagcacattcccagaagaactgtcgcccccttctcaccaatag

SEQ ID NO: 233061 - DNA, 606 bp, Artificial Sequence
  Description of Artificial Sequence: Synthetic coding sequence
atgactcttcatgccactagaggagcagctttgttaagctgggtgaatagcttgcacgtcgctgatccggttgaggctgttctacaattacaggattgttcgatattcatcaagattattgatcgaatccacggtaccgaggaggggcaacaaatattgaagcaacccgtaagtgagagacttgactttgtctgttctttcctccaaaaaaacagaaagcatccgtcctcaccagagtgtttggtgagcgcacagaaggtgttggaaggatctgagttggagcttgccaaaatgaccatgctgctgctgtatcactctactatgagcagtaaatcccctcgggactgggaacagttcgaatacaagattcaggcagagctagccgtaatactgaagttcgtccttgatcatgaagatgggctgaacctgaacgaagacctggagaatttcctgcagaaggccccagtgccatctacctgttcttctacctttcccgaagaactctcaccacctagtcatcaagctaaaagggagatcagattcttggaactgcagaaagtcgcttcttcctcttcaggcaataatttcttgagcggctccccatag

SEQ ID NO: 233062 - DNA, 480 bp, Artificial Sequence
  Description of Artificial Sequence: Synthetic coding sequence
atgaccctacacgctacacggggtgcagccctcctgagttgggttaactccctgcacgtagccgaccccgttgaggccgtgctgcagcttcaggactgctcaatttttattaagatcatcgaccggatccatggtaccgaggaggggcagcaaatcctcaagcagccggtgtcggagagactagattttgtgtgctcatttttgcagaaaaatagaaagcaccctagctctccggagtgtctggtgtccgcgcaaaaagtgctcgagggctcagagctcgaactagcaaagatgaccatgttgctgctttatcactctactatgagtagtaagtcccccagagattgggaacagtttgaatataagatccaagctgagctggcagtgatccttaaattcgtgcttgatcatgaggacggattgaacctcaatgaggaccttgaaaacttccttcagaaagcaccagttccctccacatag

SEQ ID NO: 233063 - DNA, 663 bp, Artificial Sequence
  Description of Artificial Sequence: Synthetic coding sequence
atgaccttgcatgcaactcgcggtgccgcactgttgtcttgggtgaatagtctgcacgtggcggacccagtggaggccgtgctgcaactacaagactgttctatcttcattaagattatcgaccgcatccatgggacagaagagggtcagcagatactaaaacagcccgtaagcgaaagactggacttcgtgtgctcgttcttacaaaagaatagaaagcatcccagcagtcctgaatgtttagtgagcgcccagaaggtcctcgaggggtccgagcttgaattagctaagatgacaatgttgttgctgtatcacagcaccatgagctctaaatctccaagagattgggaacagttcgagtacaagattcaggccgaactggccgtgatactgaagtttgtgctggatcatgaagatggcctgaatctgaatgaagatcttgagaatttccttcagaaagccccagtcccctccacctgttcctccacctttcccgaagagctgagtccaccaagtcaccaggctaaacgggaaatcagatttcttgaattgcagaaggttgcctctagtagcagcggcaacaatttcctaagcgggtccccagctagccccatgggggatatactgcagactccccagtttcagatgagacggctgaagtag

SEQ ID NO: 233064 - DNA, 171 bp, Artificial Sequence
  Description of Artificial Sequence: Synthetic coding sequence
atgacacttcacgcgacaagaggagcagctctcctgagctgggtgaactctctgcatgtcgcggatcctgtggaggcagtactacagttgcaggactgctctattttcatcaaaatcatcgaccgtatacatggaacagaagaggggcagcaaatcctgaagcagccttag

SEQ ID NO: 233065 - DNA, 1053 bp, Artificial Sequence
  Description of Artificial Sequence: Synthetic coding sequence
atgttctgttgtcttggctacgaatggctgtctgggggatgcaagacatggcactctgcttgggtgattaatacactggccgaccaccgtcaccgtgggactgactttggtggttccccatggttgttgatcattaccgtgtttttgcggagctataagttcgcaatatctctttgcacaagctacttgtgcgtgtcctttctcaagacaattttcccatctcagaatggtcacgatgggagcaccgacgtccaacagcgggctcgccgttctaaccggagacgccaggaaggcataaaaattgtcctggaggatatcttcaccctttggcggcaagtggagaccaaagtgcgggcaaagatcagaaagatgaaagtaactacgaaggtgaatcgacacgacaagatcaatgggaagaggaagactgcgaaggagcacctgcgaaaactgtccatgaaggagcgcgaacacggcgaaaaggagcggcaagttagcgaggcagaagaaaatggtaagttagacatgaaggagatccacacatatatggagatgttccagagggcgcaggccctacgaaggagagccgaagactattatcggtgcaagatcactccatcagctcgaaagccgctgtgcaaccgggtgaggatggcagcagtcgaacaccgacactcatccggtctgccctactggccttacctgaccgccgagacactcaaaaaccgcatggggcatcagcctccaccacccacacaacagcacagcataatcgataatagccttagtctcaaaactccaagtgaatgcctcttaacacctctgcccccttccgctttgccctcagcggacgacaatttgaaaacaccggcagagtgcttgctataccccttgccgccttctgcagatgataacctcaagacacctccagagtgcctgctgacaccgctgccaccgagcgctcctccatctgtggatgataatctcaaaaccccccctgaatgtgtctgtagcttgcccttccatccacagagaatgataatctctcgaaattag

SEQ ID NO: 233066 - DNA, 1053 bp, Artificial Sequence
  Description of Artificial Sequence: Synthetic coding sequence
atgttttgctgtttaggctacgagtggctcagcggcggttgcaaaacatggcatagtgcctgggttattaacacactcgctgatcaccgacatcgtggaactgatttcggcggaagcccctggctactgattatcaccgtgttcttacgcagctacaaattcgcaatctccctgtgcacttcttatctgtgtgttagcttcctcaagaccattttccccagtcaaaacggacacgacggatctaccgatgttcaacaaagagctcggaggtcaaaccgacgacggcaggagggcattaaaatcgtgttggaggacatcttcaccctttggcgccaagtggaaaccaaagtccgggcaaagatccgcaagatgaaggtcacaaccaaagtgaatcgccatgacaaaattaacggcaagcgaaaaactgctaaggagcatctgaggaagctttcaatgaaagagcgtgagcacggtgagaaggagcggcaggtgagcgaggccgaggaaaacggcaaacttgacatgaaagaaatccatacctatatggagatgttccagagggcgcaggcccttaggagaagagctgaggattactaccggtgtaaaataacccccagcgccaggaagcctctgtgtaatcgtgtacgtatggctgcggttgagcaccggcacagtagtgggctgccctattggccgtatctaacagccgagacactgaaaaaccgaatgggtcaccagcctccgcctccaacacaacaacattctatcatcgataacagcctgtctctgaaaactccatcagaatgtctgctgactccccttcccccatctgccctcccgtccgccgacgacaatctcaagacacctgctgagtgccttctgtatcctctgccgccaagtgccgatgataatctaaaaacaccgcctgaatgccttctgactccgctgcccccttctgcgccaccttccgttgacgacaacctgaagacaccgcctgaatgtgtttgttctctgccttttcatccccagcgtatgatcatttccagaaactag

SEQ ID NO: 233067 - DNA, 1431 bp, Artificial Sequence
  Description of Artificial Sequence: Synthetic coding sequence
atggcctctccctttagtggcgctctgcagttgaccgacctggatgattttatcggccctagccaggaatgtattaaacctgtgaaggtggaaaagcgggcagggagcggtgtcgcaaagatacggatcgaggatgatggctcttacttccaaatcaaccaagatggaggcacaagacgcctggagaaggctaaagtttctctgaacgactgcctagcctgtagcggttgtatcacaagtgcagaaaccgtcctgatcacccaacagtcacacgaggaattgaaaaaagtcctcgatgcaaacaaaatggctgcaccctcccagcagcgcctagtcgtcgtgagcgtctcacctcagagtcgggcaagcctagctgctaggtttcagttgaatcctaccgacaccgccaggaagctgacctcattttttaaaaaaatcggagtgcactttgtattcgacacagctttcagccgtcacttctctttgctcgagtcccagagggaattcgtgagaaggttccggggtcaggctgactgcaggcaggccctgcctcttctcgcctccgcctgtcctgggtggatctgttacgctgaaaagacacacggtagcttcatcctgccgcacatatccactgctcggagcccccagcaggtcatgggcagcctggttaaggactttttcgcccagcagcagcacctaaccccagataagatttatcacgtaactgtcatgccatgttacgataaaaaactggaggcatctcgacccgactttttcaatcaggagcatcagacacgagacgtggactgcgtcttaacaactggtgaagtgttccgccttctggaggaagagggtgtgagccttccagatctcgaacctgccccacttgattcactttgttccggggctagcgccgaagagccgacctctcatagaggaggcggatctgggggttaccttgagcacgtttttcgacacgctgcccgagagttgtttgggatacacgtagctgaagtgacatataaacctctgcgcaataaagatttccaggaggtaacacttgagaaagagggccaggtgctgttacactttgctatggcatacgggtttagaaacatccaaaacctcgtacaacgactcaaacgcggtcgctgcccatatcactatgtggaagtcatggcctgcccatctgggtgcctgaatggagggggacagctacaggccccagaccgtccttcccgggagctcttgcagcacgtggaacgcttgtatggaatggttcgggctgaggcccctgaagatgcccctggtgtccaggaactatacacgcattggcttcagggcacggatagcgagtgtgcgggaagacttctccacacacagtaccacgccgtggaaaaggccagcactgggctaggtatccgctggtag

SEQ ID NO: 233068 - DNA, 567 bp, Artificial Sequence
  Description of Artificial Sequence: Synthetic coding sequence
atggcgtctcccttctccggagctcttcagctaaccgacctcgatgacttcattgggccttctcaggagtgtataaagcctgtgaaggtagaaaagcgggcagggagcggggtggcaaagatccgcatcgaagacgatggcagctattttcagattaaccaagacggaggaactagaaggctcgaaaaggccaaggtgtccttaaacgactgcttggcctgttccgggtgtatcaccagtgccgagacagtgttaattacacagcagagtcacgaagagctcaagaaggtgctggacgcgaataagggttgtacgtcctcttcaacgcccccaagtcagggaacatcagcgagttggagagccagcgaaagtctttgtggcgacagcgaagaccggcctaccgccgatcggaggtgcccttgctggcccctccccgcacaggcaggatctgccatgccgcgtcgactaactgccgcatcctcgtcaccaacgtcagcccctcccggtccgcgttcccggtcatgggccccttggtcaagaacttcttctccctcgtctagcacctag

SEQ ID NO: 233069 - DNA, 1125 bp, Artificial Sequence
  Description of Artificial Sequence: Synthetic coding sequence
atggccgcaccttcgcagcaacgcctagttgtcgtctccgtgtctccacaatcgcgcgcaagtcttgctgccaggtttcagttaaatcctactgatacagcaagaaaactgacttcattctttaaaaagatcggcgtgcacttcgtgtttgataccgctttctccagacactttagtcttctggagtcccagagggagttcgtgcggcgattcaggggccaggccgactgtaggcaggccctgcccctgcttgcgagtgcgtgcccaggatggatctgctatgccgaaaagacccacgggagcttcatcctcccacacatttctaccgcccgaagtcctcagcaggtgatgggcagcctggtgaaggacttcttcgctcagcagcagcatctgacaccagacaaaatctatcatgtcacagttatgccatgctacgataagaaactggaggccagccgccctgatttcttcaaccaggaacatcagactcgcgatgttgattgtgtcttaaccacaggggaggtcttcagacttttagaggaggagggggttagtctccccgacctggaaccggcaccgctggacagcttatgctccggagccagcgcggaggaacctaccagccaccggggagggggatccgggggttatctggagcacgtgtttagacacgccgctcgcgagttgttcggtatccatgtggcagaagtgacctataagcctctccgtaacaaggactttcaggaggtcaccctcgaaaaggagggccaggttctgctacacttcgccatggcttatggattccgcaacattcagaatctggttcagcgccttaagagagggcgatgcccctaccactacgtcgaagtcatggcatgtccctcagggtgtctgaacggaggagggcaactgcaggcgcctgatcgtccctccagggaactgctgcagcacgtcgagcgactttacggcatggtcagagctgaagccccagaggatgcccctggcgtgcaggagctttatacacactggctccaaggcacagattccgagtgtgctggcaggctgctgcacacccagtatcatgcagtcgaaaaagcatctaccggcctcggcatcagatggtag

SEQ ID NO: 233070 - DNA, 4284 bp, Artificial Sequence
  Description of Artificial Sequence: Synthetic coding sequence
atgcttctacccagcgatgtggcccgacttgttctgggttaccttcagcaggagaaccttatctctacgtgccaaactttcattctggaatcctccgacctcaaggagtatgctgaacactgtacagatgagggtttcatacctgcctgcctcctctcacttttcggcaaaaatctgacaacaatcctgaatgaatacgtcgctatgaaaaccaaagagacgtcaaataacgttccagctataatgtcctcactctggaagaagctcgatcacactctctcccaaatcagatcaatgcaatcttccccgagattcgccggttcccaacgagccaggaccagaactggtattgctgagattaaacgccagcgcaaactggcctcccagaccgcaccagccagtgccgagctgctgacactgccgtatctaagcggccagttcacgacccccccttctactggaacacaggtcaccagaccgtccggacagatctctgaccctagccgcagctatttcgtggtcgtgaatcatagtcaaagtcaggacaccgtcacgacgggagaagctctaaacgttatccccggagcgcaggaaaagaaagcccacgccagtctcatgtcccctgggagaaggaagagcgaaagccagcgcaagagcaccactctctctggtccacacagtaccatccggaactttcaggaccctaacgcctttgcggtggagaagcaaatggtcatcgaaaatgctcgcgagaagatcctgtctaataaatcacttcaggagaagctggccgagaacatcaacaaatttctgacttctgataataacatcgctcaggtgcctaaacagactgacaacaatcctacagagcctgaaacatccattgatgagttcctgggccttccttccgaaattcacatgagtgaagaggcaatacaggatatcctggagcagacggaatctgatcccgcattccaggccctgtttgacctctttgactatggcaagacgaaaaataacaagaatatttcccaatctattagcagccagcccatggaaagtaatcccagtatagtgctagccgatgagacaaatcttgctgtgaaaggctccttcgaaacagaggagtcagatggtcagagtgggcaaccagccttctgcaccagctatcaaaatgacgacccactgaacgctctcaagaactctaacaatcatgatgtcttgagacaagaggaccaggagaatttttcccagatcagcacatctattcagaaaaaagcctttaaaacagcagttcctacagagcaaaaatgtgatattgacataacttttgaatctgtgccgaatctgaatgacttcaatcagaggggcaattccaatgctgagtgtaatcctcattgcgccgaactttacaccaaccagatgtccacagagaccgaaatggcaatcggaattgagaaaaattctcttagctccaacgtcccctccgagtcccaactgcagcctgaccagcctgatatcccaataacctcattcgtctccctcggctgcgaggctaataatgaaaatctaattctgagcggcaaatctagccagctgctttcacaagacacctcattgaccggcaaaccatccaaaaaatcgcaattctgcgaaaattctaacgataccgttaaactgaaaatcaacttccacggaagtaagtccagcgacagctctgaggtgcacaaaagcaaaatcgaaatcaatgtgctggagccagtaatgagtcagctaagtaattgccaggacaactcctgcctgcagagcgagattcttcccgtgagtgttgaaagtagtcacctgaatgtgagtggtcaggttgagatccaccttggtgattcactgagctcaaccaagcagccttccaatgactccgctagcgtggaactcaaccacactgaaaatgaagcccaggcctctaagagcgaaaactcccaggaaccttcctcttccgtgaaggaggaaaacactatcttcctaagcctcgggggtaacgcgaattgtgagaaggttgccctgacaccaccagaggggactccggtagagaacagtcactctcttccccctgaatcagtgtgctcatccgttggtgacagccacccagaaagccagaacacagacgacaagccgtccagtaataattctgccgagatcgatgcgtcaaatattgttagcttgaaggttattatctccgatgatcctttcgtttcctctgataccgagcttacgagcgccgtatctagcattaacggggagaacctgcctaccataatcctatcaagtcccacgaagtctccaactaaaaacgccgagctcgtgaaatgcctgagctctgaggagaccgtgggagccgtggtgtatgcagaagtgggcgattcggccagcatggagcagtctctacttacgtttaagtccgaggattcagctgtcaataacacccaaaacgaagatggaatcgcattcagcgccaacgtgaccccctgcgtgtccaaagacgggggatatatccaattgatgcccgctacctctaccgctttcgggaacagcaacaatatcttgatcgccacctgcgtgactgaccccaccgccttggggaccagcgtgtcccagtctaatgtggtcgttctcccaggcaacagcgctccaatgaccgcacagcccctacctccacagttgcaaactccaccccgatctaactccgttttcgctgtgaatcaagctgtgtctcctaatttcagccaggggtccgcaatcattatcgcgtccccagtgcaaccggttctccagggaatggtcggaatgatcccagtgtcggtagtaggccagaacggaaataacttctccacccctcctcgccaggtgctccacatgcctcttacggctccagtgtgcaacaggagcataccgcaattccctgtgcctcctaagtcacaaaaagctcaagggctgcgaaacaaaccctgcatcggaaagcaggtgaacaatttagttgatagctctggtcatagcgtcgggtgtcatgcccaaaagaccgaagtgtctgacaaaagcatcgctaccgatctgggcaaaaagagcgaggagacgactgtcccttttcctgaagagagcattgttcctgctgcaaagccttgtcataggagggttctctgctttgatagtaccacggcccctgtcgccaacactcagggacccaatcacaaaatggttagtcagaataaggagcgaaacgcagtgtccttccctaacctggactcaccaaatgtgtccagcacactgaagccaccgagtaacaatgctatcaaaagagaaaaggagaagccccctctccccaagatcttgagcaagagtgagtctgccatcagcaggcatactacaatccgggaaacgcagtccgagaagaaggtctcccccacagagatcgtgttggaaagctttcacaaggccaccgcgaacaaagaaaacgaactttgctcggacgtggagcgccaaaaaaacccagaaaactcgaagttgtcgataggtcaacagaatggcggattacggtctgagaagtcaatagcatctcttcaagagatgacgaagaagcagggaacaagttcaaacaataagaacgtgctgtccgtggggacggcagtcaaggacctaaagcaagagcaaactaaatcggcttcttccctgattaccacagaaatgttacaggatatccaaagacattctagtgtgtctcggctggccgacagttccgacttgccagttcccaggacgcctggaagcggggctggcgaaaagcacaaagaagagccaattgacatcataaaagcgcctagttctcgtcgcttcagcgaggactcatcaacctccaaggtgatggtgccacctgtaacccctgacctgcccgcttgctcgccagcgtcggaaactggaagtgaaaatagcgtgaatatggctgctcatacacttatgattttgtcacgcgcagccatctccagaaccaccagcgccaccccattgaaagacaatacacagcagtttagggccagcagccgctccaccactaaaaagagaaagatagaggaactcgacgaaagagaaagaaattctcggccatcctcaaagaatctgaccaatagcagcataccaatgaaaaagaagaaaattaaaaaaaagaagctcccgtccagcttcccggcagggatggacgtggataagttcttgctgagcctgcattacgacgaatag

SEQ ID NO: 233071 - DNA, 7283 bp, Artificial Sequence
  Description of Artificial Sequence: Synthetic coding sequence
atgcctttaaagaccagaaccgctctttcggatgaccctgatagcagtaccagtacattgggcaacatgctggagctccctgggacatcatcatctagtaccagccaggagctgcccttttgccagcctaaaaagaagtctacacccctgaagtacgaagtcggagacctcatctgggccaagtttaagcgcagaccttggtggccctgcagaatttgcagtgatcccttaatcaacacccacagtaaaatgaaggtttctaatagaagaccatacagacagtattatgtcgaggcctttggggatcctagcgaaagggcctgggtggcagggaaggccatcgtcatgttcgagggacgccaccagttcgaggagctgccagtgcttcgaagacggggtaagcagaaggaaaagggatatcgccacaaggtgccacaaaaaattctttcaaagtgggaggcatccgtgggactggcagaacagtatgatgtcccaaagggtagcaaaaaccggaagtgtattcccggtagtatcaagcttgactctgaggaagacatgcccttcgaagactgtactaatgaccccgagtccgaacatgatttgctgctgaacggctgcttgaagagcctagcctttgactctgagcattctgccgatgagaaagaaaaaccatgcgctaagtcccgggctcggaagtcaagcgacaaccccaaaagaacttctgttaagaagggacacatccagtttgaggcccacaaggatgagcggaggggtaaaatacctgaaaacctgggtctgaattttatctctggtgatattagcgacacacaggcaagtaatgagttgagtaggatcgcgaatagtctcactgggtccaacactgccccaggctcctttttgttctcgagctgtggcaagaacaccgctaaaaaagagttcgagactagcaatggcgattctttacttggcctccctgaaggggctctcatttccaagtgcagcagggagaaaaataaaccacaaagatcattggtgtgcggctcaaaggttaagctatgctacattggcgcaggtgatgaagaaaagagatcggatagcataagcatttgtactactagcgacgacggctccagcgatctggaccccatcgagcactccagcgaatctgataatagcgtgctcgagatcccagatgccttcgaccggacagaaaacatgttgtctatgcagaagaacgaaaaaattaaatatagccgctttgccgctaccaatacaagggtgaaggctaaacagaaacccctcatctctaatagtcatacagatcacctaatgggttgcactaagtcggccgagcccggaaccgaaacgtcccaggtcaacctgtctgatttgaaggcatcgacattggtgcacaaaccccagagcgattttactaatgatgccctttcacccaagttcaacctcagcagcagcatctcgagcgaaaatagcctaatcaaagggggtgcagcaaaccaggccctgttgcactccaagagtaaacaaccaaaatttaggagcattaaatgtaaacataaagaaaatcctgtgatggctgagcccccagtcattaatgaggagtgctccctcaagtgttgcagcagcgacacaaagggtagcccactggcctcgatctctaaaagcggcaaggtagacggcctaaagctcctcaataatatgcacgagaagacaagagactcctcggacatagagaccgctgtggtgaagcatgtgttgtccgagttaaaagaactgtcatacagatctctgggggaggatgtgtccgacagtgggaccagtaaaccgtccaaacctctgctattcagtagcgctagttcccagaaccacatacctattgagcctgactacaaattcagtacattactcatgatgttgaaagacatgcacgacagcaaaacgaaggagcagcggctcatgaccgctcaaaacctggtaagttatcgttctcctggcaggggtgactgttctacgaattctcccgtcggcgtatcaaaagtgctggtctccggtggcagtacccataactccgagaagaagggcgacgggactcaaaattccgcaaatccgtccccctcaggcggagactcagcactgtcaggcgaactgtccgccagcctgcccggtctgctgtccgacaagagagatttaccagcaagcggtaagtctcgaagtgattgcgtgacaagaagaaactgtgggagatctaagccttcttccaagcttcgtgacgccttttctgcccagatggttaagaataccgttaaccggaaagcgctgaaaacagagaggaaacgtaagttaaatcagctcccctccgttactctggatgcagtcctccagggcgatagagagagaggcggatctttgcggggaggcgctgaggacccgtcaaaagaggaccccctgcagattatgggccacctcactagcgaggatggtgatcacttcagcgacgtacacttcgattcgaaggtgaagcagtcagaccccggaaaaatttccgaaaagggcctaagtttcgagaatggcaaggggcctgagttagactccgtcatgaacagcgagaacgacgaactgaatggagttaatcaggtggtcccaaagaagaggtggcagagactgaatcagcggaggaccaaaccgagaaaacgaatgaatcgattcaaggagaaggagaacagtgagtgcgctttccgtgttctgctccccagcgatccagttcaagagggacgtgatgagttccctgagcataggaccccgagcgcctcaattcttgaagagcctctgacagaacaaaatcatgcggactgtttagacagtgccggtcctcgcctaaatgtgtgcgataagtccagtgcttctatcggcgacatggagaaggaacccggtatcccttcactgaccccccaggccgaactgccagagcctgcagttcggtctgaaaagaagcggctccgtaaaccaagcaagtggctgctcgaatataccgaggagtatgatcagattttcgcacctaaaaagaaacaaaagaaggtgcaggaacaggttcataaggtttcttcgcgatgtgaagaggaatcattgctcgctcggggtcggagcagtgcacagaacaagcaggtggacgaaaattctcttatcagcacaaaagaagaaccccctgttctagaacgtgaggctccatttttggagggacctttagcacagtcagaactcggaggcggacatgctgagttgccgcagctgacactgagtgtgcctgttgccccagaggtgtcaccaagaccagctctagagtccgaggaactgctagtcaagacaccaggcaattatgagagcaagcgacaaagaaaacccacgaaaaagctgcttgagagcaacgacttggatccgggttttatgcccaaaaaaggcgacctgggcctctccaagaaatgctacgaagcgggtcatctggagaacggaatcactgagtcatgtgccacgtcatacagcaaggacttcgggggaggaaccaccaagattttcgataaaccacgtaagagaaagagacagcgccatgcagccgctaaaatgcagtgcaaaaaggttaagaacgatgatagttctaaggaaatcccaggctcagagggcgaactaatgcctcatagaaccgccacaagcccaaaagagactgttgaggaaggcgtcgagcatgatcccggaatgcccgctagtaaaaaaatgcagggagaaaggggcggaggggcagcgctgaaggaaaatgtgtgtcagaattgcgagaagctcggcgaattgttactgtgtgaggcccagtgttgtggggctttccatctcgagtgcctggggctgacagaaatgcccagaggcaaatttatctgtaatgagtgccgcactggcattcacacatgtttcgtctgtaaacaatcgggagaggatgtgaagaggtgtctactaccactctgcgggaaattttaccacgaagagtgcgtgcaaaaatatccacccacagtgatgcagaataagggtttcaggtgttcccttcacatctgtattacatgccacgctgcaaaccccgctaacgtctccgcctcaaaaggcaggctcatgcggtgcgttcgatgccccgttgcttaccatgctaacgacttttgcctggctgctgggagtaaaatacttgccagcaactcaattatttgtcctaaccatttcacaccccgaagaggatgccgcaatcacgagcacgtaaacgtgagctggtgtttcgtttgcagcgagggcggatcactcttgtgttgtgacagctgccccgctgcattccatcgagaatgcttgaacatcgatattccggaaggcaattggtattgcaatgactgcaaagcagggaaaaagccgcattatcgagagatcgtttgggtgaaagttggccgatatagatggtggcccgctgaaatttgtcaccccagggctgtcccctctaatatcgacaaaatgagacacgacgtgggcgaattcccagtgctatttttcgggagcaatgattatttgtggactcaccaggcaagagtgttcccgtacatggagggcgacgtcagctccaaggacaagatgggaaagggcgtcgatggcacgtacaaaaaggctttacaggaggccgcagcccgattcgaggaacttaaagcacaaaaggaactgaggcaactgcaagaagatagaaagaatgacaagaaaccaccgccatacaaacacattaaggttaaccggccaatcgggagggtccaaatcttcacggctgacctgagcgaaattccaagatgcaattgtaaggctactgatgagaacccatgcggcatagatagtgaatgtatcaataggatgcttctttacgagtgtcatcctaccgtgtgtcccgcaggcggacgttgccaaaaccagtgcttttcgaaaaggcagtatcctgaagtggagatctttaggactctgcagaggggatggggcttgcggacaaagacagatatcaagaaaggggaattcgtgaatgaatatgttggtgaactgatagatgaagaggagtgtcgggctaggatcagatacgcacaggaacacgatataactaacttttatatgttaacactggacaaagacagaattatcgatgctgggccaaaggggaattacgcaagattcatgaaccactgttgtcagcccaactgcgaaactcaaaaatggtctgtcaatggtgataccagggtcggcctgtttgctctaagcgatattaaagccggaacagagctgacatttaactacaatctggaatgcctcggcaacgggaagacggtctgcaaatgtggcgcacccaactgcagtggcttccttggcgttcgcccaaagaatcaaccaatcgctaccgaagagaagtctaaaaaattcaagaagaagcagcaggggaagaggcggacccaaggggaaatcacgaaagagcgcgaggacgaatgttttagctgcggggatgccggtcaactcgtgtcatgtaagaaaccgggatgtccaaaagtgtatcacgccgattgtttaaaccttaccaagcgcccagccggaaagtgggaatgtccttggcaccaatgcgatatctgcggtaaagaagccgctagtttctgtgaaatgtgccccagcagtttctgtaaacaacatagggaaggcatgctgttcatcagtaagttggacgggagactcagctgcactgagcatgatccttgcggacccaacccgcttgaacctggtgaaattcgcgaatatgttccaccaccggttcctttaccccctggcccttctacgcatctggctgaacaaagtacagggatggcggctcaagctcccaagatgtcagataagccccctgcggacacaaatcagatgctcagcctcagcaagaaggcacttgcaggcacctgccagcgccctctactccctgaacgtccattggagagaaccgactctcggccacaaccactcgacaaggtgagagacctcgcaggctccgggaccaaaagccaaagcctcgtgtcatcacagcgacccctggatagacctccagctgtggctggtcctcgaccccagttgtcggacaaaccttctcctgtgactagcccatcttcctccccatccgtgcgcagccaacctcttgagcggccacttggcactgcagacccccgactagacaagtccataggggctgccagtccccgacctcagtcactcgaaaagacttctgtgccaaccgggctgcgattgcctccccctgatagattactgatcacgtcgtcgcctaaaccacagaccagtgatcgacccaccgacaagccccacgccagtctgtcccaacgcttgccccctccagagaaggtgctaagcgctgtcgtccaaacacttgtagctaaagagaaagccctgcgcccagtcgaccagaacacccaatccaaaaaccgggctgcactggtcatggatttgatagacctgacccctagacaaaaagaacgcgcagcatctcctcaccaagtcaccccacaggcagacgaaaagatgccagtcttggaaagcagttcctggccagcctcaaaggggctcggacatatgcctcgagccgtcgagaagggttgcgtctcagaccctctgcagacatcaggaaaagccgctgcccctagtgaagatccctggcaggctgtgaaaagcctgactcaggctaggctgctgagtcagccacccgctaaagccttcttgtatgagcccaccacgcaggcaagcggccgagcgtcagcaggcgcagagcagacaccaggacctctttctcaaagccccggactcgtcaagcaggctaagcagatggtcggaggacagcagctgccagccctggccgctaaaagcggccagagctttcgcagtctcggcaaggcacctgcgagtctcccgaccgaggaaaagaaacttgtgaccactgaacagtctccttgggcgctggggaaggcatcatcgagagctggtttgtggccaatcgtggccggacagacattggcacagtcttgttggagcgccggttcaacccagaccctcgcacagacttgctggagtctgggtcggggtcaggacccaaagcccgagcagaataccctgccagctcttaatcaggcaccatcctcccacaagtgtgccgaaagtgagcagaaata

SEQ ID NO: 233072 - DNA, 7283 bp, Artificial Sequence
  Description of Artificial Sequence: Synthetic coding sequence
atgccactgaagacacggaccgcgctgtctgacgatcccgatagcagcactagcacgctaggtaacatgctggagctccctggaactagcagtagtagtacgtctcaagaactacccttttgccagcctaaaaaaaagagcacaccactgaagtatgaggtcggggatctgatctgggcaaagtttaagaggcgaccttggtggccttgccgcatctgtagtgatcctctgatcaacacccactccaagatgaaggtatctaatcgcagaccctaccgccagtactacgtagaggcctttggggacccatcagagcgagcttgggtcgccggaaaggccatcgtgatgttcgagggacggcatcagtttgaggagctgccagtgctgcgcagacgcggaaagcagaaggaaaagggatacagacacaaggtgccccaaaagatactatcaaaatgggaggccagcgtgggcctggcagagcaatatgacgtcccaaaaggatccaaaaatcgcaagtgtatacctggcagtatcaaactggatagtgaagaggacatgccatttgaagactgtacaaacgaccccgagtcagagcatgatctcctcctgaacggttgtctgaagtcgctcgccttcgacagcgagcactcagccgacgagaaagaaaaaccctgcgcaaaatctcgagctaggaaatcctccgacaatcccaaacggacctccgtgaaaaaaggtcacattcagtttgaggcacataaggatgaacgtcggggtaagatacctgagaacctcggactgaacttcatttctggggatataagcgatacacaggccagtaacgaactctctagaattgccaactctctcacaggctcaaataccgctccaggcagtttcttattctcatcttgtggtaaaaacaccgccaaaaaagaattcgaaacctctaatggcgacagtcttcttggattacctgagggcgcactgatctccaaatgctctagagaaaagaacaagccacagcgcagcctcgtctgcggatcgaaggttaagctgtgttatattggagcaggtgatgaagagaaacggtcagacagtatcagcatctgtacgacatcagacgatggaagtagtgacctcgacccaattgagcacagtagcgagtccgataactctgtgttggagatccctgacgcgttcgatcgaacagaaaacatgttgagcatgcagaagaatgagaaaatcaaatattctcgattcgctgcaactaacacacgggtaaaggcgaaacagaagcctcttatatccaatagtcacaccgatcatttgatgggatgcacaaagagcgctgagccgggaaccgagaccagccaggttaacctcagcgacctgaaagctagcaccctcgtgcataagccgcaatcagactttacaaacgacgccctgtcgccaaagtttaacctgtcttcaagcatttcaagcgaaaattccctgatcaagggtggtgccgcaaatcaggccctgctgcattcgaagtccaagcagccgaagttcagatcaatcaaatgcaagcataaggagaatcctgtcatggccgagccaccggtgattaacgaagaatgttcactgaagtgctgctcttctgacaccaagggttcaccactggcctccatcagcaagagtggaaaggtggacggactgaaattgctgaataacatgcatgagaagacaagggacagttcagacattgagaccgcagtggtgaaacatgtgctctccgagctgaaagaactctcctatcgctcgctgggcgaggacgtttccgatagcggcactagtaaaccttcgaagccattactgttctcctctgcctcaagccagaaccacatacctatcgaacctgactacaagttctcaactcttctcatgatgctgaaagatatgcatgactccaagaccaaggagcagcgattgatgacagcacaaaacctggtgagctacaggtctccaggtcgaggcgattgtagtactaacagtcccgtgggcgtttctaaagtgctcgtgtctggcggatctacccataacagtgagaagaagggggatggcacacaaaacagtgccaatccaagtccctctgggggagactctgcactgagcggagagctgtcagccagtctgccagggctactgtccgataaaagagatctgccggctagtggtaagtcccgatccgattgcgtcacacgccgtaactgcggtcggtctaaaccttcaagcaaactgagagatgctttcagcgcacagatggttaaaaacactgtgaaccgtaaggccctgaagaccgagaggaaacgaaagctcaaccagttgcctagcgtgacactggacgctgtcctgcagggtgacagagagaggggagggtcccttaggggcggagccgaggaccctagcaaagaggatcccctgcaaatcatgggccacttaacttcagaggacggagaccattttagcgatgtccacttcgactccaaagtaaagcagagtgatcctggcaaaatcagcgaaaagggcctgagcttcgagaatggaaagggccctgagctggactcagtgatgaattctgagaatgatgagctgaacggcgtgaatcaggtcgttccaaagaaaaggtggcagagacttaaccagcgccgtactaaaccacgaaagcgcatgaacagatttaaggagaaagagaacagtgagtgcgcctttcgcgtgctcctcccaagcgaccccgtgcaggagggtcgagatgaattcccagaacataggacccctagtgcttccatcttagaagaacccttgactgaacagaatcacgccgactgtctggactctgcaggccctcggctgaatgtgtgtgacaaatccagcgcgagcattggagatatggaaaaggagcccggaatcccctccctgactccacaggcagagctgcctgagcccgcagtgagatcggaaaaaaaacggttgagaaaaccttcaaaatggctccttgagtacaccgaagaatatgatcagatcttcgctcccaaaaagaagcagaaaaaagtccaagaacaggtccacaaggtatccagccgatgcgaggaggaaagccttttggcgagaggacgctctagcgcacaaaacaagcaggttgacgagaactcactgatctccaccaaagaagaaccacctgtattggagagggaagctccgttcctggagggacccctggcacaatccgagttgggcggaggtcacgcagagctcccccagcttaccctgtcagtccctgtcgcacccgaagtgtctccacgcccagcgctggaatcagaggaactcttagtgaagacgccaggaaactacgagtcaaaacggcagcgtaaaccaactaaaaaactcttggagtctaacgatctggacccaggattcatgccgaagaagggcgatttggggttgtccaagaagtgctatgaggcgggacacctcgagaacgggattactgaatcttgcgccacttcatatagcaaggattttggcggtgggactactaagatattcgacaagcctaggaagcgtaagagacagcggcacgccgcagcaaagatgcagtgcaagaaggtgaagaacgatgacagctcaaaagagattcccggaagcgagggcgaactgatgccccaccggaccgcaacctcaccaaaggaaacggtagaagagggtgtggagcacgatcccggtatgccagctagtaagaaaatgcagggcgaacggggaggcggtgccgctctgaaagagaatgtttgtcagaactgtgagaagttgggtgagctcctgttgtgtgaagctcagtgctgcggcgcatttcatctcgaatgcctaggtctcacggaaatgccgagaggaaaatttatttgcaatgagtgtaggaccggtatacatacgtgctttgtctgtaagcagtctggcgaagatgtgaagaggtgcttattacccctctgtgggaagttctaccacgaagaatgcgtccagaagtatcccccaaccgtcatgcagaacaaaggcttccgttgttccctgcatatctgtattacctgccacgctgccaatccagcaaacgtcagtgctagcaaggggcgtctgatgcgctgcgtgagatgcccggttgcttatcatgccaacgatttttgcctggccgctgggtccaagattctggcctccaacagcatcatctgcccaaaccacttcacaccaagaagaggttgtcggaaccatgaacacgtgaacgtttcctggtgctttgtttgtagtgaaggtggcagtctgctatgctgcgacagctgtcccgctgcattccaccgcgaatgcctaaacatcgacatcccggagggtaactggtattgcaatgactgtaaggccggtaagaagcctcactaccgcgagatcgtgtgggtcaaggtgggtcgataccgctggtggccggctgaaatatgccacccaagggcagttccatccaacatagacaaaatgagacatgatgttggggagttccccgtcctgttttttggatctaacgattacctttggacccatcaagctcgagtgtttccatacatggagggcgatgtgtcctccaaagataaaatgggcaaaggagtagacggcacttataaaaaagccctccaagaagctgcagccagattcgaggagctcaaggcccagaaggaactccggcagctgcaagaggacaggaaaaacgacaaaaaacctcccccatacaagcacattaaggtgaaccgtccaattggacgggtgcagatctttacagcggacctgagcgagataccccgatgcaactgtaaggcaaccgatgagaacccctgtggcatagatagtgagtgcataaacagaatgcttctctacgaatgccatcctactgtctgtccagctggcggaaggtgccagaaccagtgtttcagcaagcgacagtaccccgaagtggaaatcttccgcactctgcagagaggatgggggctccggacgaagactgacatcaaaaagggcgagtttgtaaatgaatacgttggagaactgattgacgaagaagagtgtcgcgctagaatacgctatgcccaggagcacgacatcactaatttctacatgttgacactggataaagatcgcatcattgatgcaggacccaaaggcaattacgccaggtttatgaatcactgttgccaacccaattgtgagacacaaaaatggtcagtaaatggcgatacccgagttggattatttgccctcagcgacatcaaggctggaacagagcttacctttaattataacctggaatgcctaggaaatggcaaaaccgtttgtaagtgcggcgctcccaattgcagcggcttcttgggcgttagacctaaaaatcagccgatcgcaactgaagagaagtccaaaaagttcaagaagaagcagcaggggaagcgacgcacccagggcgagattactaaagagcgcgaggatgaatgtttctcatgtggagacgccggtcaactcgtctcctgcaagaaacccggatgcccaaaagtttatcacgccgactgccttaacctgacgaagagacccgcagggaagtgggaatgcccttggcaccagtgtgacatctgcggcaaggaggcggcaagcttctgcgagatgtgccctagttcattctgtaagcaacatcgagagggtatgctttttatctccaaactggatggtaggttgtcttgcacagagcatgatccttgtgggccaaaccccctcgagccaggggaaatacgagagtacgttccccctcctgtgccacttcctccaggaccaagtacccatttggcggaacagtcaacgggtatggccgctcaggctcccaaaatgagcgacaagccgcctgccgacacaaaccaaatgctctctctgagcaaaaaggccctagcgggaacttgccagcggccactgctccccgagagaccgctggagagaacagactcccggccacagccactggataaggtcagagacctggctgggtcagggaccaagtcccagtcgctcgtgtccagtcagcgccctctcgatcgcccaccggcagtagctggaccaaggccgcagttgtccgacaagccttctcctgttaccagtcctagctctagcccctctgtgcggagccagccacttgagagaccattgggaacggctgatcccaggctggacaaaagcatcggtgccgcttcaccgagacctcaatctttggaaaagacctctgtgcccacgggactccgcctgcccccaccagataggctactcattacatcgtcccccaaacctcagacttctgaccggcctactgacaagccacatgcttccctctcgcagaggttacccccaccagagaaagtactgtccgccgtcgtacagacgttggtggcgaaagaaaaggcactccgaccggtggaccaaaacacacaaagcaaaaatcgagccgcattggtcatggatctgatagatctaacccctagacagaaggagcgtgccgcttccccccaccaagtgacacctcaggccgacgaaaaaatgccagtcttggaaagttcaagttggccagcctccaaaggtctgggacacatgcctcgggcagttgaaaagggctgtgtcagtgaccctctccagaccagcggaaaggccgcagccccaagcgaagacccttggcaggctgtcaaatccctcacacaagccaggctcctgtcgcagccacccgctaaagccttcctgtatgagcctactacgcaggcaagcggtcgtgcctctgcaggggcagagcagactcccggtcccctcagccagtcccccggattggtgaagcaagcgaagcaaatggtgggtgggcagcaacttccggctctggctgccaaaagcggacagtcatttaggtcccttggcaaggcgccagcctctttgccgaccgaggagaagaaactggtgacaacggaacagtctccgtgggctctggggaaagcttcaagccgcgctggcttgtggcctatcgtagccggacaaacccttgcacagagttgctggtctgcaggctcaactcagaccctagcccagacttgctggagtctgggaagaggtcaggatcccaagcccgaacaaaacaccctgccggcactgaaccaagccccatcctcccataagtgtgcagaatccgagcaaaagta

SEQ ID NO: 233073 - DNA, 1692 bp, Artificial Sequence
  Description of Artificial Sequence: Synthetic coding sequence
atgcctttgaagaccagaacagccttgagcgatgatccggacagctccacctctacgttggggaatatgctggagctgcctggtacaagctcaagttcgacttcccaagagctgcccttctgtcagcctaaaaagaaatccaccccgctgaaatatgaggtgggggacttaatctgggccaaatttaagcggaggccttggtggccttgccgcatatgttctgaccccctgatcaacacacactcaaagatgaaggtgtcaaatagacggccttatagacagtattacgtggaggcatttggggatccctctgagagggcttgggttgctggaaaagcaattgtgatgtttgaaggcagacaccagtttgaggaactgccggtcctgagaagaagaggcaagcagaaggagaagggttaccgacacaaggtacctcagaaaattctgagcaagtgggaggcctcagtgggcctagcggaacagtacgatgtgccgaagggctccaagaatcgcaaatgcattccaggtagcattaagctggacagtgaggaagacatgccatttgaagactgcacaaacgaccctgaatcggagcacgatctgttgctcaacggatgtcttaaaagccttgccttcgactccgagcactcggcagacgagaaggaaaagccctgtgctaaaagccgagccagaaaatcatcagacaacccaaaacggacttctgttaagaagggacacatacaatttgaggcacacaaagatgaaaggaggggcaaaatccctgaaaacctaggtctgaactttatttcgggtgatattagtgacacccaagcaagtaatgaactcagtcgtatcgccaattcactaacaggctcaaacacagcacctgggtcatttttattttcttcctgcgggaagaacaccgctaaaaaagaattcgagacctccaatggagatagcttgctgggcctccctgaaggcgcactaatctcaaagtgcagtagagagaaaaacaaaccgcaacggagcctagtgtgcggttcgaaagtgaagttatgctatatcggcgctggtgacgaggagaaacggtcagattctattagcatctgcacgacttcagatgacggctcctctgacctggaccctatcgagcactcatctgaatcggacaatagcgtgctcgaaatccccgatgcattcgatcggactgagaacatgctgtcaatgcagaagaacgagaaaatcaagtattcgaggttcgccgcaaccaatacgcgcgtgaaggcaaagcaaaagccgctgataagcaactcacatacagaccatttgatgggctgtactaaatcagccgagcccggtactgagaccagtcaggtgaaccttagtgatctcaaggccagcactctcgtacataaaccacagtcggattttacgaatgatgcccttagtcctaaatttaatctgagttcctctatctcttcagagaacagcttgattaagggaggtgccgctaatcaggcactgctgcactccaaatccaagcagcctaagttccgctccattaaatgcaagcacaaggagaatcctgtcatggcagaaccacccgtaatcaatgaggagtgttctctgaaatgctgctctagtgatacaaaggggagccccctggcttcgattagcaaaacacctccctag

SEQ ID NO: 233074 - DNA, 7781 bp, Artificial Sequence
  Description of Artificial Sequence: Synthetic coding sequence
atggatcagacatgcgaactgccgagacggaactgcctcctcccatttagtaacccagtaaatctcgatgccccagaggataaggactcccccttcggcaacggccagtcaaacttctctgagccactgaacggatgtacgatgcaactctcaactgtgtccggtacatcacaaaacgcctatggtcaagactccccctcttgctacatccctctgaggcgcctgcaagacctggccagcatgatcaatgtcgaatacctaaatggcagtgccgatggatccgaatcctttcaggacccagaaaaaagtgattctcgcgctcagacccccatagtctgcacctcattgtcaccaggcggtccgaccgccctcgccatgaagcaggaaccaagctgtaataattctcccgagctgcaagtcaaggttacgaagaccatcaagaatgggttcctccatttcgagaattttacctgcgtcgatgacgctgacgtggattccgaaatggatcccgaacaaccagtaacagaggatgaaagtatcgaggaaatctttgaggagacacaaaccaacgccacatgcaattatgagaccaaatccgagaacggagtcaaggtcgctatgggaagcgaacaagacagcacccccgaatcacggcacggggctgtcaaatccccattcttacctctggcaccccagacagaaactcagaagaataagcaacgtaacgaggtcgatggtagcaacgagaaggctgcactgctgcctgccccattctctctcggggacaccaacattacgatagaagaacagctgaacagcattaatttgtcttttcaggatgaccctgacagttcgacatccaccctgggaaacatgctggagctgccaggaaccagctcaagctcaaccagtcaggaactgccatttgttccacagaagatccttagcaagtgggaagcatctgttggactggccgagcaatatgacgtccccaaggggagcaaaaatagaaagtgtattcctggatcaataaaactggacagcgaggaagacatgcccttcgaggattgtactaatgacccagagtccgagcacgatctcctgcttaatggatgcctgaagtctctcgcatttgactccgaacactcagccgatgagaaggagaaaccctgtgccaagagccgcgcacgaaaaagctccgataatccaaagcgaacctccgtgaaaaagggacacattcagttcgaggcccacaaagatgagagacgcggtaagattccagaaaatctgggcctgaattttatcagcggagatattagtgacacgcaggctagtaatgagttgtccagaatcgctaacagcttaaccggcagcaacacagcaccaggctctttcttgtttagtagttgtggaaaaaacaccgccaaaaaagaatttgagacatctaacggggatagcttgctgggtctcccagagggtgctctgatcagcaagtgctctagggaaaaaaacaaacctcaacgatcattggtgtgcggcagcaaagtgaaactctgctacatcggagccggtgacgaggagaaaaggtctgactctatctctatctgtactacctcggatgatggatcctcagacttagaccccattgaacattcctcagagtctgataatagcgttttagagatcccagatgccttcgatagaactgagaacatgctgtccatgcagaaaaatgagaagataaagtatagccgatttgcagctacaaacactcgcgtgaaagcaaaacagaagccactcatctccaatagccatacagatcacttgatgggctgcacaaaatccgccgagcctggcacagaaacctctcaggtgaatctgtcagatctcaaagcaagcactctggtgcataagccacaatcagattttacgaatgacgcgctgtccccaaaattcaatttgtcgtcatcaatttcatctgagaactcattgatcaaggggggtgcagctaaccaggcgctgctgcattccaagagcaaacaacctaagttccgcagtataaaatgtaaacacaaggaaaatcccgtcatggccgagcctccggtcatcaacgaagaatgttcgttaaagtgttgttcttccgatacaaagggatctccgctggctagtatcagcaagtctggaaaggtcgacggcctgaagctcctgaataatatgcacgaaaagacaagggactcgagcgatatcgaaaccgctgtcgttaaacatgtgctgtccgaactgaaagagcttagctacagaagccttggcgaggatgtgagcgacagcggcacatccaagccctccaagccattgctcttctccagcgccagcagccagaatcatatccccatagagccagactataagtttagtactctgttgatgatgctcaaagatatgcacgacagcaagactaaagaacaacggctcatgaccgcacagaacctggtgtcatatcgatctcccggacgcggagactgctcaaccaattctcccgttggagtttcaaaggtattggtgagtggaggatctacgcacaacagcgagaagaagggggatggcacccaaaattccgctaacccatcgccatccgggggagatagcgctctgtctggtgagctctccgcaagcctccctgggttgttgagcgacaagagagatctgcccgcatcaggaaaatctcgctccgactgcgtcaccaggaggaactgtggcagatctaagccgagctctaaactgcgcgatgctttttctgctcagatggtgaaaaacacagtaaacagaaaggctctcaaaacagaacgtaaacgcaaactgaaccagttaccatctgttacacttgacgcggtcttgcagggcgatagagagcgcggtggttccttacgagggggagctgaggatccttccaaggaagaccccctgcagatcatggggcatcttacatccgaagatggggatcacttctctgacgtgcattttgacagcaaagtaaagcagtcagatccaggaaaaatctccgaaaaaggtctctcgtttgaaaatggtaagggtccagaactcgactcagtgatgaatagcgaaaatgatgaacttaacggagtgaatcaggtggtccccaaaaaaagatggcagaggttaaatcaacgtagaaccaaacccaggaagcggatgaaccgtttcaaggagaaggaaaactctgagtgtgcgtttagggtgttgctccccagcgaccccgtgcaagagggacgggacgagttccctgaacaccgcaccccctccgcctctatactggaagagcccctgactgagcagaatcatgcagactgccttgacagcgccggtcctaggcttaacgtgtgtgacaaaagctcggcatcaatcggtgacatggaaaaagaacctggcattcctagcttgaccccccaggccgagctgcctgagccagctgtgaggtctgaaaaaaagaggctgcgtaaaccgtcgaagtggctcttggagtacaccgaagagtacgaccagatcttcgcacccaaaaagaaacaaaagaaggtgcaggaacaggtacacaaggtgagctcaaggtgcgaggaagagagcctcctagccagaggacgttcgagtgcccagaacaaacaggtggatgaaaactcattaatcagcacgaaggaggagccaccagtgctggaacgtgaggcccctttcctcgaaggcccactggctcagtcagagttaggcggaggacacgcagagctcccacagctaacattatccgttcctgtagctccggaggtgtcaccccgaccagcgttagaatccgaagagcttttggttaagacacctggcaactatgagtccaagcggcaaagaaagcccactaaaaaactacttgaatcaaatgatctggacccaggattcatgcctaaaaagggggacctggggttatctaaaaagtgttatgaggccggtcacttggaaaacggcataactgaatcttgcgccaccagttactcaaaagattttggcggaggcaccaccaagattttcgacaaaccccgtaaaagaaaaagacagcgacacgctgccgcaaaaatgcaatgtaaaaaggtcaagaatgatgactcaagtaaggaaatcccaggatctgagggcgagttaatgcctcaccggaccgctaccagccctaaagaaaccgttgaggaaggggttgaacacgatccaggaatgcccgcatctaaaaagatgcagggagaaagaggaggaggggctgcactgaaagagaacgtctgtcagaactgcgaaaagctgggggagcttctgctctgcgaggcccagtgctgcggggcattccatttggaatgtctcgggctgactgagatgccacggggaaagtttatctgtaatgagtgtcgtacagggatccatacatgcttcgtttgcaagcaatccggagaggacgtcaaacgctgcctactacccctgtgcggtaaattctaccatgaggagtgcgtgcaaaagtacccccctacagtgatgcaaaacaaaggctttcgctgcagcctccatatttgcattacctgccatgcagccaacccggctaatgtgagcgctagcaaaggtagactcatgcgttgcgtcagatgcccggtggcttatcatgccaatgacttctgcctggccgctgggtctaagatcctcgccagcaatagcatcatctgccctaaccactttacacccagaagaggctgtagaaaccatgagcatgtgaatgtgagctggtgtttcgtttgctctgaaggcggtagtcttctttgctgtgactcgtgtccagccgctttccacagagagtgccttaatattgacattccggagggcaattggtactgcaacgattgcaaggccggaaagaagccccactatagggagatcgtctgggtcaaggtgggaaggtatagatggtggccggcagaaatctgtcatcctcgcgctgtcccaagcaatatcgataaaatgcggcatgacgtgggggaattcccagtgctctttttcggatcaaacgactacctgtggacacatcaggcccgagtttttccatacatggaaggcgatgtgagtagtaaggataaaatgggcaaaggcgtggacgggacttacaagaaggccctgcaggaagcggcagcacggtttgaggaattaaaggctcaaaaggaactcaggcagctgcaggaagatcgcaagaatgacaagaaacccccaccatacaaacatatcaaagtaaacagaccaatcggccgtgttcaaattttcacagcggatctgtccgagatacctcggtgtaactgtaaggctactgacgaaaacccctgcggaatcgatagcgagtgcataaaccggatgctgctgtacgagtgccacccaaccgtgtgccctgctggaggtcggtgccaaaatcaatgtttttctaagcgacaataccctgaggttgagatctttcggactctgcaacggggttggggcctgcgcactaagaccgatatcaaaaaaggagagttcgtgaacgagtatgtgggcgaactgatcgatgaagaggagtgtagagctagaatccgctacgcacaagagcacgatatcaccaacttttatatgctgacgttagacaaagaccgcataatcgacgcaggccctaagggaaactatgctagattcatgaaccattgttgccagcccaactgcgagacccagaagtggtcagtcaatggggacacccgggttgggctctttgcattgagtgatattaaggccggaaccgagctgacttttaattacaatctcgagtgtcttggaaacgggaagaccgtctgtaagtgcggagcgccaaactgcagtggctttttgggtgtcagacccaagaaccagcccatcgcgaccgaggagaaaagtaaaaaattcaagaagaagcagcagggcaaacgacggacacagggagaaatcacaaaggagagagaggatgagtgcttctcatgcggcgacgcagggcagctggttagttgtaagaaacccggatgtccaaaggtgtatcatgccgattgtctgaacctcacaaaaagacccgcaggcaaatgggaatgcccctggcaccaatgcgatatatgtggtaaggaggcagccagtttttgtgaaatgtgtcccagcagtttctgcaagcagcatcgggagggaatgttgttcataagtaaactcgatggacggcttagctgtactgagcacgacccctgtggccctaatcctttggagcccggagaaatccgggagtatgtcccaccaccggtcccacttcctcctggaccaagtacccacctggccgagcagtctaccggaatggcggctcaagcccctaagatgagcgacaaacctcccgctgatacaaaccaaatgttatccctgagcaagaaagctctagccggaacctgccagagaccactgctccccgagaggccacttgaaagaacagactcaaggccgcagcccctagataaagtcagggacctggctggatcgggcacaaagtctcagtccctggtcagcagtcagcggcctctggaccggcctccagccgttgccggaccgaggccccaacttagtgataagccatcacccgttacctcaccgtcaagtagcccttctgtccgctcccagccactggagcgtcccctgggcaccgccgaccctcgactcgataagtctatcggggctgcttctccgagacctcagagcctggagaaaacatccgttcccactgggctgcgtctgccaccacctgacagattactcataacatccagcccaaagccccagacaagtgaccgcccaacggataagccgcacgcatccctgagccagagactccccccaccagagaaggttctgtcggctgtcgtgcagactctcgtcgcaaaggagaaggcactgcgcccagttgaccagaacacccaaagtaaaaatagggccgctcttgtgatggatctgatagacctgacccctagacagaaagagcgcgctgctagtcctcaccaggtgactccacaggcagacgagaaaatgcctgtcttggagtccagcagttggccagcttcaaaaggactaggtcacatgcccagagcggtggaaaaaggctgcgtgagcgaccccctccagacttcagggaaagccgctgcgcctagcgaagatccatggcaggctgtcaaaagcctgacccaagctaggcttctgagccagccccctgctaaggccttcctgtatgagccaactacgcaggcctcggggcgtgcaagcgcaggcgctgagcaaacacccggtccgctctcacaaagcccaggcttggttaaacaagcaaaacagatggtgggaggccagcagttacccgctctcgccgcaaaatccgggcagagtttccgaagtctaggcaaggctcctgcatcattgccaacagaggagaaaaagctcgtaacaaccgagcaaagcccgtgggcgctggggaaagcatcatcccgggcaggcctgtggccaatcgtggccggtcaaaccctggctcaatcatgttggtcagcaggatccacccagacccttgctcagacatgctggtccctcgggagaggccaggacccaaagcctgagcagaacactctccccgctctgaatcaggctccttcctcacataagtgtgccgagtccgaacagaagta

SEQ ID NO: 233075 - DNA, 8090 bp, Artificial Sequence
  Description of Artificial Sequence: Synthetic coding sequence
atggaccagacgtgtgagctgcccagacggaactgcctcttgcccttttccaatcctgtgaacctcgatgcacctgaggacaaagacagtccatttgggaatggtcaatccaactttagcgagccgttgaatgggtgcacaatgcagctaagcaccgttagcgggactagtcagaacgcctatggacaggacagtccatcctgttacatccctctgagaagactccaggacctggcgtcaatgattaacgtggaatacttgaatgggtccgcagacgggtcggagtcatttcaggacccagagaaatccgactcccgggctcaaactcctatcgtctgtacttccttgagccccggtggcccaactgcccttgccatgaagcaggagcctagctgtaacaacagtccagaactacaagtgaaagtgacaaagactatcaagaacggctttctacactttgagaattttacctgcgtcgacgatgcagacgtggatagcgaaatggaccccgaacagccagtgaccgaggatgaaagcattgaggagatcttcgaggagactcagaccaatgcgacttgtaattacgagacgaagtccgaaaatggcgttaaggtggccatggggagcgagcaggactcgactccagagagtcgccacggtgccgtgaaatccccgttcctcccacttgcaccacagacggaaacgcaaaagaataagcagcggaatgaagtggacggatccaacgagaaagccgctcttctgcccgcaccattcagccttggggacaccaacattacaattgaagagcagctcaattccatcaacctgagttttcaggacgaccccgactcctcaacgtctacgctaggcaacatgctggaattgcctggcacgtcctcctcctctacaagtcaggaacttcccttttgtcagcccaaaaagaagtccacacctctgaaatacgaggttggcgacctgatttgggccaaattcaagcgccgtccctggtggccttgtcgcatctgttctgatccacttataaatacccacagcaaaatgaaggtgagtaacagaagaccatatcggcagtactacgtagaggcctttggtgatccctccgagagagcatgggtcgcgggtaaggccatagtgatgttcgagggcagacaccagtttgaagagcttccggtcctgaggcgaagaggcaagcagaaggaaaagggctaccggcataaggtccctcagaagatactgtctaaatgggaagcctctgtgggcttagccgaacaatatgatgtgccgaaagggagcaagaatcgcaagtgtattccaggatctattaagctggacagcgaggaggatatgccctttgaagactgcactaatgatcccgagagtgaacacgatctcctgcttaatgggtgcctgaagagcctggcattcgactctgagcattctgccgacgagaaggaaaagccttgcgctaagtccagggctcgcaaaagtagtgataacccaaagcggacatctgtgaagaagggccacatacaattcgaggcacataaggatgaacgcagaggaaagatccccgagaatctaggactcaactttatttctggagatatttcagatactcaggcctctaatgagctcagtagaattgctaacagcctcaccggtagcaatactgcacccggatcctttttgttttcatcttgtggtaagaacaccgctaagaaggagttcgagacatccaacggtgatagtctgcttggcttgcccgagggggctcttatcagtaagtgtagtcgcgagaaaaataaaccacagagatcccttgtatgcgggtcaaaggtgaaattgtgttacataggggcaggcgacgaagaaaaacgaagcgattctatcagcatctgcactacttcagacgacggatcgtccgatttagatcccatagagcactccagcgaaagcgataacagtgtcctagaaatccctgatgcgttcgacagaactgaaaacatgcttagcatgcagaagaacgagaaaatcaaatactctcggtttgcagccaccaatacaagggtgaaggctaagcagaaaccccttatctctaattctcatactgatcatttaatgggatgcaccaagtccgcggaacctggtacggagaccagccaggtgaacctgtctgatctgaaagcatccaccttggtccataaaccacagtcggactttacgaacgacgctctttctccgaaattcaatctgtcctcctccatctcctccgaaaatagtcttattaaaggaggtgcagctaatcaggccctcctgcacagcaagtcaaagcaacctaaatttaggtccatcaaatgtaaacacaaagaaaatccggttatggcagagcccccagtgattaatgaagagtgtagcctgaagtgctgttcttctgacaccaagggaagccccctggcgagtattagtaagtccggaaaagttgacggtcttaagctactgaataacatgcacgaaaagactcgcgattcgagcgacatagagacggccgtggtgaagcacgttctgtctgaattgaaggagttatcataccggtcattaggagaagatgtgtctgactccggcacctctaagcctagcaaaccattgttgttctccagcgctagtagccagaaccatatacccattgaaccagactataaattcagtactttgctgatgatgcttaaagatatgcacgactctaaaactaaagagcagagattaatgacagcacagaaccttgtatcctatagatcaccagggcgtggcgactgcagcaccaattcacctgtgggcgtctctaaggttctggtgtccgggggtagtacacacaattcagagaaaaagggcgacggtacccagaattcagccaatccatcacccagtggcggagacagtgcactgtctggggaactgagtgcgtcccttcccggactgctctccgacaaacgggacttgcccgctagtggaaaatctaggagtgattgcgttacgagacggaactgcggacgctcgaaaccgtccagcaaactgcgcgacgcattctctgcccagatggtcaagaatacagtgaaccgcaaggccctaaagacagagcgcaaacggaagctgaatcagcttccgtccgtaacactggacgcagtcctgcagggagatcgggagcgagggggaagcctgaggggaggggcagaagatcccagcaaggaagacccgttgcaaattatggggcacttgaccagcgaggatggagaccacttctccgatgttcatttcgatagcaaagttaaacaatccgaccctggcaagattagcgaaaaagggctatctttcgagaatggcaaaggccctgaactcgatagtgttatgaatagtgaaaatgatgaacttaatggggtgaatcaggtagtgccaaaaaagcggtggcagagactgaatcagaggagaacaaagccaagaaagcggatgaatcgtttcaaagagaaggaaaatagcgagtgcgcctttcgcgttttgctaccaagtgatcccgtacaggaggggcgagacgagtttcccgagcaccggactccgtcagcctccatcctcgaagagccacttactgagcagaatcacgctgactgtctcgattctgctggtcctagactcaatgtctgtgacaagagctccgcctccattggagatatggagaaagagcctggcatcccctccctgaccccccaggcggaactgccggaaccggctgtgaggagtgaaaaaaagcgactgagaaagccctccaagtggttgctcgaatacaccgaggaatacgatcagatttttgctcccaagaagaaacagaaaaaggtgcaggagcaagtccacaaagtgtcttcaagatgtgaggaggaatccctgctcgccagaggaagatctagcgctcagaataagcaagtggacgagaactctcttatttccaccaaagaggagcccccagtgctcgaacgggaggctcccttcctagaaggacccttagcccaatctgagctcgggggaggccatgcagaattgccgcagttgacactaagcgtgcctgttgcccctgaggtgagccctcggcctgcgctggagtccgaggaactactggttaagacccccggtaattatgagtccaagaggcagcggaagcccaccaaaaagctcttggaatcgaacgatctagaccctggattcatgccaaagaaaggcgacctagggctttcaaagaagtgctacgaagccggacatttggagaacgggataaccgagagttgcgctaccagctattccaaagatttcggcggaggtactaccaagattttcgacaaaccacgaaagaggaagagacagaggcacgccgctgctaagatgcaatgtaagaaggtgaagaacgacgattcttcaaaagaaattccaggctctgagggagagctcatgccacacaggacagcgacctccccgaaggagaccgtggaagaaggagtggagcacgatcctggcatgccagcgagcaaaaagatgcagggggagaggggaggcggagctgcacttaaggaaaatgtgtgccagaattgtgagaaactgggcgagttactgttatgcgaggcacagtgctgtggtgcctttcaccttgagtgtcttgggctcactgagatgcctcggggtaaattcatctgcaatgagtgtcgcactgggatacacacatgcttcgtttgtaaacagtccggcgaggacgttaaaagatgtctcctgcccttatgcggtaaattttatcacgaggagtgtgtgcagaagtatccacccacagtaatgcaaaacaagggattccgctgctccctgcacatctgtatcacatgccatgccgctaacccagccaacgtgagcgccagcaagggcaggttgatgaggtgtgtgagatgtcctgtcgcttaccatgctaacgacttttgcttagcggcaggatctaaaattcttgctagtaacagtatcatctgccccaaccattttacgcctcgaaggggctgtcggaatcacgagcacgtcaacgttagttggtgtttcgtgtgctccgaaggagggtcgctcctgtgctgcgacagctgtcccgcagcctttcacagggagtgtcttaatatcgatattcctgaggggaactggtactgcaacgactgcaaagctggaaagaagccccactaccgggagatcgtgtgggtgaaggtcgggagataccggtggtggcccgctgaaatctgccacccaagagctgtcccttctaatatcgataagatgagacatgatgtgggcgagttccctgtgctcttcttcgggtccaatgattatctgtggacccatcaggccagggtttttccgtacatggagggcgatgtgagttctaaggacaagatggggaagggagtggatggcacctacaagaaggctctgcaggaagctgcagctcgatttgaggagcttaaggcccagaaagagctgcgccagttacaagaagatagaaagaacgataaaaaacctcctccctacaaacatattaaggtcaaccggccaatagggagagtccagatctttactgcagatctctctgaaatcccacggtgcaactgtaaggccaccgatgagaacccgtgcggtatagatagtgagtgtattaaccggatgctcctgtatgagtgtcatccaactgtgtgtcccgctggtggcagatgccagaatcagtgcttcagtaaaaggcagtatcccgaggtggaaatttttaggacccttcaacgcggttggggactgcgcaccaaaacggacattaaaaaaggcgaattcgtgaacgaatatgtcggcgaactgatcgatgaggaggagtgtcgagccagaatcaggtatgcacaggaacacgacataaccaacttctatatgctgaccttggataaagatagaatcatcgacgccggtccaaaaggtaactatgctagatttatgaatcactgttgccaaccgaactgtgaaacccagaagtggagtgtgaacggggacactagggtcggtttgtttgccctgtccgatataaaagccggaacggagctcacatttaattacaacttggagtgtctcggtaatggaaagaccgtatgcaaatgcggtgcgcctaattgctctggctttctgggcgtacggccaaaaaatcagcctatcgccaccgaagaaaagtccaagaaattcaaaaaaaaacaacagggaaagagacggacacagggggaaatcacaaaggagcgagaagacgagtgcttcagctgcggtgatgccggtcagcttgtcagctgtaaaaaacccggatgcccaaaagtgtaccatgccgactgcctgaatctcacaaagagacctgcgggtaaatgggaatgcccttggcatcaatgcgatatctgtggcaaggaagcggcttccttttgtgagatgtgcccgtcctcattctgtaaacagcatcgggaaggtatgctctttatcagcaagctggatggaagactctcctgcactgagcacgatccgtgcggcccaaatcctttggaacctggcgagatccgcgagtacgtccccccacccgtgcccttgcctccaggcccttccacacatctggctgagcagtcaaccggaatggccgctcaggcacccaagatgtcagataaaccacccgcagacactaaccagatgctaagtctcagcaagaaagctctggccggtacctgccagaggccacttctcccagagcgaccattagaacgcacggatagtcgaccccaaccactcgataaggtcagggacctggccggtagtgggacgaaaagccagtcactggtttcctcccagcgccctttggatagacccccagctgtggcaggacctcgcccacagctgtccgacaaaccttcgcccgtaacatctccttctagctcccccagtgtccggtcccaacctttagaaaggccactgggaactgccgacccaaggttggacaagtccattggggcagcctcacctcggccacagtcccttgagaagacgtcagtcccaactggtcttcgcttgccacctcccgatcggcttttaatcacctcatcccctaagcctcagacctccgatcgtccaacagataaaccacacgcatccctgagtcaacggctgccaccgccagaaaaggttttgagcgctgttgtgcagacactggtggccaaggaaaaagccctgcgccctgtagatcagaatacccaatctaaaaaccgggcagccctggtgatggacctaatcgatttgactccaaggcagaaggagcgggctgccagcccacaccaggtgacacctcaagcagatgaaaagatgccagttcttgaatcttcgagctggccagcatcgaaaggccttggccatatgcccagagcggtcgaaaaaggatgcgtctcagacccactccaaaccagcggtaaggcagccgctccttcagaagatccatggcaggcggttaagagtctgacccaggcccgattgctaagtcagcctccagccaaagcattcctttacgaacctactactcaggcaagcggaagggcatccgccggagccgaacagacaccagggcctctgtcccagtcccccggtctggttaagcaggctaagcagatggtggggggacagcaattacccgcactggccgctaaaagtggacagtccttccgaagcttggggaaggctccagcctcgctcccaaccgaggaaaaaaagcttgtgactactgagcagagtccttgggccttagggaaagccagttcccgtgcgggtctctggcctatcgtggcaggacagactctcgcccaatcctgttggagcgctggctccacgcagacactggcacaaacttgttggagtcttggccgtgggcaagacccaaagccagaacagaacactctgcctgcactgaaccaggccccatccagccacaagtgcgcagagtccgaacagaagta

SEQ ID NO: 233076 - DNA, 468 bp, Artificial Sequence
  Description of Artificial Sequence: Synthetic coding sequence
atgcccctcaagactagaacggccttgagcgacgatcccgacagctctaccagtacattaggaaatatgcttgagctgcctggaacaagctcatcttccaccagtcaggagctacccttttgccagcctaaaaagaaatctacacccctgaagtatgaagtcggagacctgatttgggctaagtttaagagacgcccttggtggccctgtaggatttgcagtgatccccttatcaacacacactccaagatgaaggtgtcaaatcggagaccttaccgacaatactacgttgaggccttcggcgacccttcagaaagagcctgggttgccggaaaggccatcgttatgtttgaaggcaggcatcagttcgaggaactacctgtactacgtcggcgaggaaaacagaaggaaaaaggataccgtcataaggtccctcaaaaaatattatctaagtgggaggcatcctag

SEQ ID NO: 233077 - DNA, 375 bp, Artificial Sequence
  Description of Artificial Sequence: Synthetic coding sequence
atgcctctcaaaacacgaacagctctgtccgacgatcccgattctagtacctcaacacttggcaacatgctggagctgcctgggacaagctccagtagtacaagccaggaactgccgttctgccagcctaagaagaaatccacacctctgaaatatgaggttggcgatctgatctgggcaaaatttaagcgtcgcccttggtggccctgtagaatatgcagtgatcctctgattaacactcactccaaaatgaaggtcagcaatcggagaccatacaggcagtactacgttgaggcattcggtgacccttccgaacgcgcttgggtcgctggcaaggctatcgtcatgttcgagggacggcatcagttcgagtag

SEQ ID NO: 233078 - DNA, 4200 bp, Artificial Sequence
  Description of Artificial Sequence: Synthetic coding sequence
atgtccgggctgggggatagctccagcgaccctgcgaacccagatagccacaaacgaaaagggtcaccatgcgacaccctcgcttccagcaccgaaaagcggcgtcgagaacaggaaaacaagtacctggaagaactggccgagcttctttccgcaaacataagcgatatcgactctttgtctgtgaaaccagacaagtgcaaaatcctgaagaagactgtggatcagatccagctgatgaaaagaatggaacaggagaagtccactactgacgatgacgtgcagaaatccgacatctctagttctagtcagggtgtgatcgagaaagaaagcctcggaccactcctgctcgaagcactggacgggtttttcttcgtagtgaactgcgagggtcggattgtgtttgtgtccgaaaatgtgacttcctatctggggtacaaccaggaagagttaatgaataccagtgtgtatagtatcctgcacgtcggggaccatgctgagttcgttaagaacctgctccctaagtcactcgtcaacggcgtaccctggcctcaggaagccactaggcgaaactcacataccttcaactgtcgcatgcttatccatccacccgatgaacccggtactgagaatcaggaggcatgccagcgctatgaggtgatgcaatgttttacggtgagccagccaaagtccatacaggaggatggtgaagatttccagagttgcttaatttgcatcgccagacggctgccacggccacctgccatcactggggtggagagttttatgacaaagcaggatactacgggcaaaatcatcagtatcgatactagttcattgagagcagctggtcggacagggtgggaggatctggtcaggaagtgtatctatgctttcttccagccacaaggcagagagccatcttacgctcgccagctgttccaggaagttatgacccgcggtacagccagctccccttcatatagattcatcttgaacgacggaaccatgctctccgctcacacaaaatgtaaattgtgttacccccagtctccagacatgcagccctttatcatggggatccacattatcgacagagaacactctggcctgtccccgcaggatgacaccaactctggcatgagcataccgagggtgaacccatccgtgaacccttccatctctcccgctcatggtgtggcccgatctagtacactgcctccatccaactcgaacatggtgtccacaaggatcaataggcagcagtcaagcgacttgcattcgtcctcccactccaacagttcaaactcccagggatcatttggttgtagccccggttcacagattgtggcaaacgtggccctgaatcagggccaagccagctcccagagctccaacccgagcctgaacctgaataatagcccaatggagggcacgggtatttcactggcacaattcatgagtcctaggaggcaggtaactagcggcctcgccactcggcctcggatgccgaataactcctttcctccaaacattagtactctctctagccctgtcgggatgacatcatccgcctgtaacaataataacaggtcttatagcaatattcccgtgaccagcctccagggcatgaacgaagggccaaacaactctgtcgggttttcagccagttctcccgtcctccggcagatgtcttcacagaattcaccgagcagacttaacatccaacctgctaaggccgaaagcaaagataacaaagagattgcatccatcctcaacgaaatgattcagtctgataacagctcctcggacggaaaaccgctcgactccggcctgctccataacaatgatcggttaagcgatggtgattctaaatattcccagacgagccacaaacttgtgcaactgctgaccaccactgccgaacagcagcttcgccatgcagatatcgacacctcttgcaaagatgtgttatcttgcacaggcacctcaaactcagcttcagccaactcctctggtggatcctgtccatcttcccattcaagtttaaccgagaggcataaaattctccatcgcctgctgcaggagggatccccttctgatatcacgactctgtccgtggagccggataaaaaagactcagcttctacgtccgtttcggtaacaggccaagtgcaagggaattcatctatcaagctagagctggacgcgagtaagaagaaagagagcaaggaccaccagttgttacgttatttgctcgacaaagatgagaaggatttgcggtctaccccgaacttgtcccttgacgatgttaaggtgaaagttgagaaaaaagagcaaatggacccttgcaacacaaatcccaccccaatgaccaaaccaaccccggaggaaattaaactggaagcgcagagccaattcaccgctgacctcgaccagttcgatcagctgcttcccacacttgagaaagctgctcagctgccaggtctgtgtgagaccgaccgcatggacggagcagtaacatctgtgaccataaaatccgagattttgcccgcatctctccagagcgcgacggctcgccctacatctcgtcttaaccggctgcctgagctcgagctggaggctatcgacaaccaatttggacagccaggaaccggtgaccagataccttggacaaataataccgtcaccgctatcaaccaaagcaagagcgaggatcaatgtattagcagccagctggacgaacttctctgcccccctaccacagtggaaggcaggaacgacgagaaggcccttctggagcagctagtctcattcctatccggaaaggacgagaccgaactggccgagctcgaccgggcacttggtatcgataagctcgtccagggtggcggactggacgtgctcagcgaaagattcccccctcagcaggccaccccccctctaataatggaagagaggcccaacctttattctcagccctatagcagtccctctcctacagccaatctgccttcccccttccaggggatggtccggcagaaacccagcctgggcactatgcccgtgcaggtgactccacctcgtggcgcattcagtcctggcatgggaatgcagcctagacagactttaaacaggccaccagccgcaccaaatcagctgaggctgcagctccagcagagactgcaaggacagcaacagttgattcaccagaatcgccaggctatactgaatcagttcgcggcaacggcacctgtaggaatcaatatgcgatctggcatgcaacagcagattaccccccaaccacctcttaatgcacagatgctggcccagcggcagcgcgagctctactcgcagcaacacaggcaaaggcagctaattcagcagcaaagagctatgttgatgaggcagcaaagtttcggcaataacttgcctcccagttctggtctacccgtccaaatgggtaacccaaggttgccccagggagccccacagcagttcccatacccgccaaattatgggactaatccaggaactcccccagccagtacatccccattttcccaactggccgctaaccctgaagccagcctcgccaataggaattcaatggtaagcaggggcatgactggcaatataggagggcagttcgggaccggaatcaatccccagatgcagcagaatgtctttcagtatccaggggcaggaatggtgccccaaggcgaagcgaatttcgccccaagcctgtcacctgggtcctccatggtcccaatgccaatcccccctcctcagtcctcactcctgcaacaaaccccacccgcttcaggttatcagagccctgatatgaaggcctggcaacagggagctatcggaaacaataacgtgtttagtcaggccgtgcagaatcaacccacgccagcccagccaggcgtgtacaacaatatgtctatcaccgtgtccatggccggaggaaatactaacgtgcagaatatgaacccaatgatggctcaaatgcagatgtcttccctgcagatgccaggcatgaacactgtatgccccgagcagattaacgacccggcattgagacacactggattgtactgcaaccagctgtctagcacggacctcctcaaaacagaggcggatggcactcaggataagaagaccgaggagttctttagcgtggtgaccaccgactag

SEQ ID NO: 233079 - DNA, 4326 bp, Artificial Sequence
  Description of Artificial Sequence: Synthetic coding sequence
atgagtgggctcggcgactcttcctcagaccccgcaaacccagactcgcataaacgaaagggatccccctgtgacaccctggcatcatctacggagaaacgtcgcagagaacaggagaacaagtatctggaagaactggctgaactgttgagtgccaacatttccgatattgatagcctgtccgtgaagccggataagtgtaagatcctgaaaaaaactgtagatcagattcaacttatgaaacgaatggagcaggagaaaagcactacagacgacgacgtgcagaagagtgacatttcatcctcgtcccagggagttattgaaaaggaatcactgggcccactacttctggaagccttggacgggttttttttcgtagtcaactgtgaggggaggatcgtcttcgtgtctgagaatgtaactagctacctgggctacaatcaggaggaactcatgaatacatccgtttactcgatcttgcatgtaggagatcatgctgagtttgtgaaaaatctgttgccaaagagcctcgttaatggagtcccatggccacaggaggctacacgtcgtaactcacacacatttaattgtcgaatgctgattcaccctcctgatgaaccaggcaccgaaaatcaagaggcttgtcaacgatacgaggttatgcaatgtttcaccgtttcacaaccgaaatctattcaggaggacggcgaagacttccagtcctgtctgatctgtatcgcacggaggctgccgagacccccagctataaccggcgtggaaagcttcatgacaaagcaggatactaccggcaagatcattagtatcgacacctccagcctgagagccgctggacgaactgggtgggaggatctggtgagaaaatgtatctacgcattctttcagccccaggggcgagaaccatcctatgccaggcagctgttccaggaagtcatgacacggggaacggcttcctcaccaagttaccgttttatcctcaatgacggaactatgctgtccgcacatactaagtgcaaactctgctatcctcagagccctgatatgcagccgtttattatgggaattcacatcattgatcgagaacactccggattgtcgccacaggatgacaccaattccgggatgagtatccctcgcgttaacccttccgtgaatccaagtataagtccagcccatggggtggccaggagctcaactttacctccaagcaattcaaatatggtgagcactcgtatcaatcgccagcagtccagtgacctgcactcaagttcccatagtaatagctccaatagccagggcagcttcggatgcagcccaggcagtcagattgttgctaacgtggcgctcaaccagggccaggcttccagccaatcatccaatccttccctgaatttaaacaattcccccatggagggcactggcattagcttggcacagtttatgtcaccacgacgtcaggtcacatcaggcctggctacacgccctcgcatgcccaataactcattccctcccaacatctctacactcagttctccggtcggcatgacgagcagtgcttgtaacaataacaaccgctcttatagcaacatacccgtcaccagccttcaaggcatgaacgagggtcctaacaacagcgtgggttttagtgccagttcccctgtgctaaggcaaatgtccagtcagaatagcccaagtcgtctgaacatccagcccgcaaaggccgagtctaaagataacaaggagatcgccagcatcttgaacgagatgatacagagcgataacagtagctcagacggaaagccccttgattccggactgttacataacaacgaccgcctatccgacggtgacagcaaatacagtcaaacaagccataagctggttcagttgttaacaaccactgccgaacagcaactgaggcacgcagacatagatacatcttgtaaggacgtgcttagctgtaccggcactagtaactccgccagtgccaatagcagcggcggaagctgtccctcatcccactcaagcttaacagaacgtcacaagatcctgcaccggttgctgcaggaaggcagcccctccgacattacaacgctgagtgtggagcccgacaagaaggatagtgcctctacctccgttagtgtgacagggcaggtgcagggaaatagttcaatcaagcttgagctagacgcttctaagaaaaaggagtccaaggaccaccagttacttcggtacctgttggacaaagatgaaaaagacttgcgttccacaccaaatctctctctagacgatgtcaaggtaaaggttgagaagaaagagcaaatggatccctgcaacacaaaccccactccaatgacaaagcctactcccgaggagataaagctggaggcgcagagtcagttcactgcagacttggatcagtttgaccaactactgccgactcttgagaaggctgcacagctccctggcctctgcgaaactgatagaatggatggagcagtgacctctgttactatcaagtcagaaatcctgccagcatccttacagagtgcaactgctcggccaaccagccggctgaaccgattgcccgagcttgagcttgaggccattgacaaccagttcggccagccgggtacgggtgaccaaattccctggaccaataataccgtcactgctattaatcaatctaaatctgaagatcaatgcatttcctctcagctggacgaactgctgtgcccgccaacaacagtggaggggagaaatgacgaaaaggctttgttagaacaactggtttcattcctgagtgggaaagacgagacagagctggcagaattagatcgagcgttgggtattgataagctggtgcagggtggcggattggacgttctgagtgagcgcttccccccacaacaggccactccgcctctgattatggaagaacgacctaatctatattcgcagccgtacagctctccatctcctacagccaatctcccaagtccatttcaaggcatggttcggcaaaagccttctctcggtacaatgcctgtccaagtgaccccacccaggggcgcattctctccaggaatgggtatgcaacccagacagaccctgaataggcctcccgctgcacccaatcagctgaggctccagttgcagcagcgcctccaagggcagcagcagctcatccaccagaatcgtcaggccatcttgaatcagtttgccgctaccgctcctgttgggataaacatgaggagcggcatgcagcagcaaatcacacctcagccgccactcaatgcacagatgctagctcagcgacagagagagttgtattctcagcaacatcgccagagacaactgatacagcagcagagagcaatgctgatgcgtcagcagagcttcggaaacaatcttccgcctagcagtggcctacctgtgcagatgggaaatcctagacttccccagggggctcctcagcagtttccctacccccctaattatgggacgaatcccggaactccaccagccagtacaagccctttcagccagctcgcagctaatccagaggcttccctcgcaaatcgaaactccatggtatccaggggtatgaccggtaatatcgggggacagttcggcaccggaattaacccccagatgcaacagaacgtcttccaatacccgggtgccggaatggtccctcagggggaggcaaacttcgccccttccctctcacctggctcttccatggtccccatgcccatccccccaccacagtctagtctgctacagcagacccccccagcctctggatatcagtctcccgacatgaaggcatggcagcagggcgcaataggcaacaacaatgtattctcacaggccgtgcaaaaccagcccacgccagcccagccaggcgtttataataatatgtctatcacggtttccatggctggaggaaacacaaacgtgcagaatatgaacccaatgatggcccaaatgcagatgtcttccctgcaaatgccagggatgaacactgtgtgtcctgagcagatcaacgatccggctctcagacataccggattatactgtaatcagctgtcttcgaccgatctgttaaaaacagaagccgacggaacacagcaagtgcagcaggtccaggtctttgctgacgtgcagtgtacggtaaacctcgttggtggtgacccctatctaaaccagccgggaccccttgggacgcaaaaacctacctctgggcctcagacgccacaggctcagcaaaaaagcctgctccagcagctcttaaccgagtag

SEQ ID NO: 233080 - DNA, 4323 bp, Artificial Sequence
  Description of Artificial Sequence: Synthetic coding sequence
atgtcggggctcggagactcatctagcgatccagcgaaccctgattcacacaagagaaaagggtccccatgcgatactcttgcatcaagtacagagaaacgacgtcgcgaacaggaaaataagtacctggaggaattagcggagttacttagtgcaaatatctccgacatagactcgctttctgttaaaccagacaagtgtaagatcttaaaaaaaacggtggatcaaattcaactcatgaagcgaatggagcaggagaaatcaacaacggatgacgacgttcagaagtcagacatcagcagcagtagtcaaggtgtcatcgagaaggagtctctgggcccactgctgcttgaggccctcgatggcttcttcttcgttgttaattgtgaaggacgtatagtgttcgtctctgaaaacgtaacttcgtatcttggctacaaccaggaggaactgatgaatacgagcgtgtacagtatactacacgtcggcgatcacgccgagtttgtaaagaatctgcttccaaagtccctcgttaacggtgtgccatggccccaggaggccacaagaagaaatagtcacacttttaattgccgaatgctgatccacccccctgacgagccaggaactgagaaccaagaggcttgtcagaggtacgaagtgatgcagtgcttcaccgtcagtcagccaaagtcaatccaagaggacggcgaggattttcagtcttgcctgatttgtatcgcaagacggctgccaaggccacccgcaataaccggagtggaaagctttatgaccaagcaggataccacagggaagatcatcagtatcgataccagcagccttagagccgcaggaagaactgggtgggaagacttagtgcggaagtgcatctacgcatttttccagcctcaagggcgagagcccagctatgcccgacagcttttccaagaggtgatgaccagaggaactgcatcttctccttcttatcggttcatcctcaatgacgggactatgctgagtgcccacacaaaatgcaaactgtgttatcctcagagcccagatatgcaaccctttatcatgggcattcacatcatcgatagggaacactctggcctgtcgccacaggatgacactaactctggaatgagcatccccagggtgaacccgtctgtgaacccctcgatttctcccgctcatggggtggctcgctcttcaaccttaccgcctagcaacagtaatatggtgagtacacggatcaatcggcaacaaagttcggacctgcactcgtcttcccactccaatagcagcaactctcaagggtcctttggttgctctcccggatcccagattgttgccaacgtggctctcaaccagggacaggcgagtagccaatcctctaacccatcattgaatttgaataactctcccatggaggggacgggcatctccctcgctcagttcatgtcgcctagacgccaggtgacgtcgggcctggccacccgcccaaggatgcccaataactcatttcctcccaatatcagtactttgtccagccccgttgggatgacctcatctgcatgcaataataacaaccgttcgtactctaatataccagtgacttcactgcagggcatgaatgaaggacccaataactccgtgggattcagcgccagttcacccgtattgcgtcaaatgagctcgcagaacagcccatctcgcctgaacattcagcccgcaaaggcagaatctaaggacaataaagaaatcgcaagtatattgaatgaaatgatccaatcggataactccagctccgacggtaagccgctggacagcggtctgcttcacaacaacgatagactttctgacggtgatagcaagtatagtcagacatcacacaaactcgtccagttactgactacaactgcagagcagcagctgagacacgccgacattgatacctcctgcaaagacgttctgagctgcactgggactagcaatagtgcatccgctaactccagtggaggatcttgtcctagcagtcattccagcctgaccgaaagacataagatcctgcataggttacttcaggagggtagcccttctgatattacaactctcagcgtcgaacccgacaaaaaggatagtgcatctacaagtgtgtccgtcaccggacaggttcagggcaattcttccatcaaactggagcttgatgcttctaaaaagaaagaatcaaaagaccatcaattactgagatatctgctggataaggatgagaaggaccttcggtcgacacctaacctctccttagacgacgtcaaggtcaaagtggaaaaaaaagagcagatggacccctgtaacacaaatcccacaccgatgactaagcctaccccggaggagattaaactggaggcccagtcccagtttactgccgacctggaccagtttgaccagcttctcccaaccctagaaaaggccgcacagctgccagggctttgtgagactgacaggatggacggagccgtcactagtgtaactattaaatccgaaatactgcccgcttctcttcagtctgctaccgccaggcccacgtctaggctaaataggctgcccgagctggagctggaggccattgacaatcagttcggtcagcctgggacgggagaccagattccatggaccaacaacaccgtgacagcaattaatcaaagtaagagcgaagatcagtgtataagttcacagttagatgagcttctgtgccctcctacaaccgtagagggacggaacgacgaaaaagcactgttagagcagttggtgagttttttaagtggcaaagacgagaccgaattggcagaattggaccgcgcactcgggatcgataaacttgtgcagggtgggggactcgacgtcctgagcgagcgctttcctccgcagcaagccaccccccctctgattatggaagaacgcccaaacttgtactctcagccatacagctccccatctccgaccgccaacctccccagcccctttcaaggcatggtgcgccagaaaccaagcctggggactatgcctgtccaggtgacccctccacgaggtgctttttcccccggtatgggtatgcaacccaggcaaacactgaaccggcctcccgctgctccaaaccagcttaggctacaattacagcagaggctccagggccagcaacaactgattcaccaaaataggcaggccatattaaatcagttcgccgcaacagccccagttgggattaacatgcgttcaggaatgcagcagcaaatcactccccagcccccacttaacgcacagatgttggctcagaggcagagagagctctattcacagcagcacaggcagcggcagctgattcagcagcagcgtgcaatgctaatgagacagcaaagttttggaaataacctgcctcccagtagtggtctgccagttcagatggggaaccctaggctaccccagggcgcaccccagcagtttccctaccctccaaactacggaactaacccaggaaccccacccgctagcacatcaccattttctcagctcgccgcaaaccccgaggcctccttagctaacaggaacagcatggtgtcacgtggcatgaccggcaacattggtggccaatttggtaccgggattaatccccagatgcaacagaacgtgtttcaatacccgggagccggtatggtgccacagggggaagccaatttcgcaccatcactgagccccggaagttccatggtaccaatgcccattcctcccccacagagcagcctcttgcaacagacacctcccgcatccggttaccagtcccccgatatgaaggcatggcaacagggtgccattggcaacaataatgtattctcacaggcggtgcaaaatcaaccaactccagcccagccaggtgtgtataacaacatgtctattactgtgtccatggctgggggaaatactaatgtgcaaaacatgaatcccatgatggctcagatgcagatgtccagtctacagatgcccggaatgaatactgtatgcccggagcaaattaacgatccagccttaagacacacggggctgtactgtaatcagttatcatcaacagatctgctgaagacggaagctgatggtacgcaggtacagcaggtacaagtgtttgctgacgtccaatgcacagtgaatctggtgggcggtgacccttatctgaaccaacctgggcctctcgggacccagaagcctaccagcgggccacagaccccccaagcgcagcaaaagagcctgcttcagcagttgctgactgagtag

SEQ ID NO: 233081 - DNA, 4200 bp, Artificial Sequence
  Description of Artificial Sequence: Synthetic coding sequence
atgtctggcctcggagactcatcttccgaccccgcaaatcccgattcacataaaaggaaaggatcaccttgtgataccctggccagcagcactgaaaagcgccgaagggaacaggagaacaagtacttggaagagcttgcagaactcctcagcgctaacatctctgatatcgactccctttccgtgaagccagataaatgtaagattctgaagaaaactgtagaccagatccaattaatgaagcggatggagcaggagaagagcactacagatgatgacgttcaaaagtcagacatctcatcctccagccaaggggtaattgagaaagaatcgctaggccctctgctcctggaagcacttgacggattctttttcgtcgttaattgcgagggcagaatcgtattcgtttcagagaacgttacctcctacctggggtacaaccaagaggagttaatgaacacatcagtgtactcaatactgcacgttggagatcacgccgagttcgtaaagaatctgcttcctaaaagcctcgtgaatggagtcccatggccccaggaagccacacgtagaaattctcatacattcaattgccgcatgctgatccatccaccggatgaacccggaacggagaaccaggaggcctgccagcggtacgaggtgatgcagtgtttcaccgttagccagcccaagagtatccaagaggacggggaggattttcagagctgcctgatctgtatagccaggaggctgcccaggccgcctgccatcacaggggttgaaagttttatgactaaacaggacaccaccggaaagataatctcaatagataccagtagcttgcgagctgccggacgtaccggatgggaggacctcgtgagaaagtgcatctatgctttcttccaaccccaggggcgagagcccagctatgcgcgacagctgtttcaggaggtcatgacacgcggaactgcttccagcccaagctacaggtttatcttgaatgatgggacaatgttaagtgcgcacacaaagtgtaagttgtgctatccccagtcgcctgacatgcaaccgttcattatggggatccacatcatcgaccgagagcatagcggcctctccccccaggatgacactaatagtggcatgtcaatcccacgggtaaacccttcagtgaacccatccatctcccccgcacatggcgttgctaggtcctcgacactccctccctcaaactccaatatggtgtccaccaggatcaacagacagcaatcgagcgatctgcacagtagctctcatagtaatagctctaatagccaggggagtttcggctgctcaccagggagccagatcgtagccaacgtggcactaaatcagggtcaggcttcctcccaatctagcaacccgtctctcaacctgaataattctcccatggagggaaccggtatctcattagcacagtttatgtcacccagaaggcaggttacgtcagggttggcaacccgccctcgtatgcccaataactcattcccacccaatatctccaccctgtcaagtcctgtcggcatgacctctagcgcttgcaacaacaacaaccggtcttactcaaatatcccagtaaccagcctgcagggaatgaatgaaggacccaataactcagtcgggttctctgcctccagcccagtgcttcgccaaatgtccagccaaaacagcccttctcgcctcaatatccagcctgcaaaggccgagtctaaggataacaaagaaatagcaagtattctgaacgagatgatccagtccgataatagctctagcgatgggaagccactggacagtgggttattgcataacaacgataggctttcagacggtgacagcaaatacagccagacttctcacaaattagttcaactccttaccacaacagctgagcagcaactgcgccacgcggacattgataccagttgcaaagacgtcctgagctgtacaggtactagcaattctgctagcgccaacagctccgggggttcctgccctagcagtcacagttctctaactgagcggcacaaaattctccatagactgttgcaggagggaagcccgtcggacattactacccttagcgtggaaccggacaaaaaggatagtgcttctacttctgtgtccgtcaccggtcaggtccaaggaaactcttctatcaaactggagctggatgcttcaaaaaagaaagaaagcaaagaccaccaactgttgcgatatctactggataaggatgagaaggacctacgatctacgccgaacctgtccctcgatgacgtgaaggttaaggtggaaaagaaagagcagatggacccctgtaacaccaatcccaccccaatgactaagccaacacccgaagaaattaagctggaggcccagtcacaattcaccgccgacctggatcaatttgaccagttgctcccgactctggagaaggcagcccagctccccggtctgtgcgagacagaccgtatggatggagctgtcacctctgtgaccatcaagtcagaaatcctgcccgctagtttgcagagtgctactgctcgacctacaagccgcttgaatcggcttcctgagctggagctggaggccattgacaaccagtttggccagcccggaaccggagatcagataccatggaccaataacaccgtcacagctatcaatcagtcaaagtcagaagaccagtgtatcagcagccagctggatgaactgctttgcccgcctactaccgtagaggggagaaatgacgagaaagctctgctggaacagctagtcagttttctcagcggaaaggatgaaacggaactagcggagctcgatagagctctgggtatcgacaagctagtgcagggcggaggacttgacgtactatccgaacgattccctcctcaacaagctaccccgccactgatcatggaagaaagacccaacctttattcccagccctactcttcaccgagtcccacggctaatctcccatccccatttcagggcatggtgagacagaaaccctccttgggaaccatgcccgtgcaggttactcctccaaggggcgcattttccccaggaatgggcatgcagcccagacagaccctcaacagacctccagcggctcccaaccagctgcggctgcaactgcaacagcggctgcagggacaacaacagctgatacatcagaatcgccaagctatcctgaatcaatttgcagcgacggcacctgtaggcataaatatgcgctcagggatgcagcagcagatcactcctcagccacctttgaacgcacaaatgctcgcacagcgacaacgggaactgtattcgcagcagcacagacagagacagctcattcagcagcagagagccatgcttatgcgccaacaatctttcggcaataacctgccccctagttccggcctgccagtccagatggggaatcctcgattaccacagggggctcctcagcagttcccatatccacccaactatgggactaatccagggacccccccagcatccacctcccccttttctcagctggccgcaaatccagaggctagcttggctaacaggaacagcatggtttctcgtggtatgacgggcaatatagggggtcaattcggaaccgggataaacccccagatgcaacagaacgtgttccagtaccccggtgcaggcatggtgccccagggagaggccaattttgccccatcactgagcccagggagctcaatggtgcctatgcccattccaccgccacagtcctccttgctgcagcaaacacccccagcctctgggtatcagtcgccagatatgaaagcctggcagcagggcgctataggcaacaacaatgtgtttagccaggcagtacagaatcagccaacccctgctcagcccggtgtgtataataatatgagcatcacagtgagcatggccggagggaacacaaacgtgcaaaatatgaaccccatgatggcacagatgcagatgagctcgctgcagatgcccggaatgaacactgtctgtccagaacaaattaacgatccggctctacgccatactggactgtactgcaaccagttgtcctctacagacctgttgaagaccgaggctgacgggacacaagataaaaagacggaagagttcttttccgttgtcacaaccgactag

SEQ ID NO: 233082 - DNA, 4326 bp, Artificial Sequence
  Description of Artificial Sequence: Synthetic coding sequence
atgagtggcctaggtgatagctctagcgaccccgcaaatccagactcacacaaaaggaaagggtccccatgcgataccctcgcatcctcgaccgagaagagacggagagagcaggagaataagtacctggaggagctggccgaactgctgagtgctaatatcagcgatatcgacagtctaagtgtgaagccggataagtgcaagatcctaaagaaaactgtcgaccagatccagctgatgaaacgtatggagcaggaaaagagcaccacagacgacgacgtacagaaatctgacatatcgtctagttcacagggagttattgagaaagaaagcctggggccattgctgcttgaagccctcgatgggttcttctttgttgtgaattgtgagggaaggattgtgtttgtctctgagaacgtaaccagttatttgggatacaaccaagaagagctgatgaatacaagcgtctattcaatcctccatgtgggggaccatgccgagtttgtaaagaacctcctccccaaaagtttggtgaatggagttccttggccacaggaggcgacccggaggaatagccatacattcaattgcaggatgctcatccatccccctgatgaacccggaactgaaaaccaggaggcctgtcagcgctatgaagtcatgcagtgctttaccgtgtcgcagccgaaatctattcaggaggacggcgaagatttccagagttgtttaatctgtattgcacggaggctcccccgtcccccagcaattacaggcgtagagtctttcatgaccaagcaagacactactggtaagatcatcagcattgatacatccagcttgagagccgctggtaggactggttgggaggatttagtgcgcaagtgtatctatgcgtttttccagcctcagggtagagagcctagctacgcaaggcagctgttccaggaggtgatgacccgcggaactgcctctagcccatcctaccgattcatactgaatgacggcaccatgctgagtgcccatacaaagtgtaagttatgttacccacagtcccctgacatgcaaccattcataatgggaatccacattattgaccgtgagcactcaggcctttccccgcaagacgataccaattcgggaatgtccatccctcgcgtcaaccctagtgtcaacccaagtatttcacccgcacatggcgttgcacggagctccaccctgccacccagcaatagtaatatggttagcacacgcattaatcgccagcagtcatcggatctgcactctagcagtcattccaattcttccaactcacaaggcagcttcggatgctcccctggctcacagatcgttgctaacgtggcactgaaccaggggcaggcttcatcccaatcctcaaatccgtccctgaaccttaataactccccaatggaaggcactgggatttctctagcccaattcatgtccccaagaaggcaggtgaccagcgggttggctaccaggcccaggatgccgaataattcctttcccccaaacatttccaccctgagtagcccagttggaatgacctcatcagcgtgcaacaataataataggtcgtactccaacattcctgtcacctcactgcaaggcatgaacgagggccctaacaatagcgtaggatttagtgcaagttcccctgtgctgcgccaaatgagtagccagaattccccatcccgattaaatatacagccggcaaaagctgaatcgaaagataacaaagaaatcgccagtatactgaacgagatgatccagtccgataactccagctccgacggaaagccgctggatagtgggttgctccataacaatgatagactgtcggatggagattcaaaatattcgcagacctctcacaaactcgtgcagctcctgaccactacggccgagcagcagctgcggcacgccgatattgacacatcttgtaaggatgtactttcttgcactggaacctctaacagtgcctcagcaaatagcagcggcggttcatgccccagctcccattcctccctaacggagcgccacaagatccttcaccgactgctgcaggaaggatccccaagtgacatcaccacattgtccgtggagcccgacaagaaggactcagcctcaacaagcgtgagcgtcaccggacaggttcaggggaacagctctatcaagctggaactggatgcatcaaaaaagaaggagagcaaggaccatcagctcctccggtatctgcttgacaaagacgagaaagatctgcggtcaacgccgaacctttccctggatgacgtgaaggtgaaggtggaaaagaaggagcagatggacccttgcaacactaacccaactcctatgacaaagcctacgcctgaagagattaagctggaggcccagagtcaattcactgcagacttagaccagtttgaccagctattgccaacgctagagaaggcagctcagctgcctggcctgtgcgaaacagaccgcatggacggagccgttacatcagttacaatcaagtctgagatcctccctgcgagcctgcagtccgccacggctaggcccacctcccgcttgaatcgcctcccagagctcgagttggaggcaatagataaccagtttggtcaaccaggcacgggcgaccagatcccatggaccaacaatacggtgacagctatcaatcagtctaagagtgaggatcagtgcatatctagccaattggacgagcttttatgcccacctaccaccgtagaggggagaaacgacgagaaagccctgctagagcaactagtgagcttcctttctgggaaggacgagaccgaactagcggagttggatcgggctcttggaatcgacaagctcgtccagggcggaggcctcgatgtgctgtccgagcgctttcctccacagcaggcaacaccccctctcattatggaagaaaggccaaacctttacagtcaaccttattcctcccctagccctaccgcaaatctgccttctccattccaggggatggtgagacagaagccgtccctgggaaccatgcccgtgcaagtcacacctccacgaggagcttttagcccaggcatgggcatgcagccgaggcagaccctgaatagaccgcctgcggctccaaaccaactgcggcttcagctgcaacagcgcctgcaggggcagcagcagctgattcaccagaaccgtcaggccatcttaaatcaattcgcagctacagccccagtgggaatcaacatgcggtcaggaatgcaacagcagataacccctcaaccgccacttaatgctcagatgcttgcccagcgacagcgcgaactctacagccagcaacaccgccagaggcagttaatacaacagcagcgagccatgctaatgcggcagcagtctttcggcaataacctcccgccatcaagtggcctgcctgtgcagatggggaacccgaggcttccacagggagctccacagcagttcccttatcccccaaattacgggactaatccaggcacacctcctgccagcacatcccctttcagtcagctcgccgcaaatcccgaggcaagcctggcaaacagaaattccatggtctctaggggtatgacaggtaacataggcggacagttcggaacggggatcaacccccaaatgcaacaaaacgtgtttcagtatcccggagcgggaatggtgcctcagggcgaggctaactttgctccctcccttagtcccggttcctctatggtcccaatgcccatccccccacctcaatcctcactgctgcagcagacacccccagcttccggctaccagtcacccgatatgaaggcctggcaacagggcgctataggaaacaataacgtctttagccaggcggtgcaaaaccagcccaccccagcccaacccggagtatataacaacatgtctatcacagtgagtatggccggtggcaacaccaatgtccagaatatgaatcccatgatggctcagatgcagatgtcttccttgcaaatgcccggaatgaacactgtgtgtccagaacagattaacgatcctgcactaaggcacactggtctgtactgcaatcagctgagcagcactgatctccttaagacggaggccgacggtactcaacaggtgcagcaggtccaggttttcgcagacgtccagtgcacagttaatctcgtagggggagatccttatttgaaccagcccggacctttgggtactcagaagcccacttctggccctcaaacccctcaagctcagcagaaatcgcttttgcaacaactgctgacagaatag

SEQ ID NO: 233083 - DNA, 4200 bp, Artificial Sequence
  Description of Artificial Sequence: Synthetic coding sequence
atgagcggattaggagactcaagttccgatccagcaaaccctgactcccacaagcgcaaaggctcaccatgtgatactctggcctcctctacagaaaagagaaggagggagcaagagaacaaataccttgaagagttagccgaattgctctccgcgaatatctctgatatcgacagcctctccgtgaagcctgacaagtgcaagatcctcaaaaaaaccgtggatcaaatacagttaatgaagagaatggagcaggaaaagagcaccacagacgatgacgtgcagaagtccgacattagctcctcttcccaaggggtgatcgagaaagaatccctggggcctcttctgctcgaggccttagacggattcttctttgttgttaattgtgaaggacggattgtgtttgtcagtgagaatgtgaccagttaccttggctataatcaggaagaattaatgaatacctccgtgtatagcattcttcacgtcggagatcatgccgagtttgtcaagaatctgttaccgaagagcctggtgaatggggtgccatggccccaggaagccactagacggaactcccacacattcaactgcagaatgcttattcatcctcctgatgaacccggaactgagaaccaagaagcctgccagcggtacgaagtgatgcagtgcttcactgtctctcagccaaagtctatccaggaggacggcgaggacttccaatcctgcttaatctgcatcgccagacgattgccacggccaccagccataaccggagttgagtccttcatgacaaagcaagataccacaggcaaaatcatctcaattgacaccagctccttgagggccgcaggtaggacgggatgggaggatttagtgcgaaaatgcatttacgctttttttcagccgcaaggccgtgaaccatcatatgcacgccagctgttccaggaagttatgacacgcggaactgctagctccccatcttacagattcattttaaatgacggaactatgctttccgctcataccaagtgcaaactgtgttacccacagagccccgacatgcaacccttcataatggggatccatataattgatcgtgagcacagcggacttagcccccaggatgacaccaatagcggaatgtccattccgagagttaacccctccgttaacccttcaatttccccagcacacggcgtggcgagatcatcgactctgcctcctagcaatagtaacatggtgagcacgcgtatcaacaggcaacagagctcagacttgcatagcagcagtcactctaattcaagcaactcacagggttctttcggctgcagtccaggctcccagatcgtagcaaacgtggccctaaaccaggggcaggccagttctcagagctcaaatccgagcctcaatttaaataactcgcccatggaggggactggcatcagcctggcacagtttatgtcccctagacgtcaggtcaccagcggactggctacgcgccctaggatgcccaataattcctttcccccaaacatctcaacccttagctcacctgtcggaatgacatcatctgcctgcaacaacaataacagatcatattccaacatccctgtgacatcattgcagggaatgaacgaaggtccaaacaactcagtcggatttagcgccagctcacccgttctgaggcagatgtcgtcgcagaactcgccttctaggctgaatatccaacccgctaaagctgaatccaaggacaataaggagattgctagcatccttaatgagatgatccagagtgacaattcaagttccgatgggaagccccttgactctgggctgcttcataacaacgatcggctaagcgatggagattcaaaatactcccagactagccacaagttagtgcagctgctgacgactacagccgaacagcagttacgacatgcagatatcgacacgagttgtaaggatgtgctatcctgcacaggaacctcaaattccgcaagcgccaactcttcgggcggtagttgtcccagttcccattcgtcccttactgaaaggcataagatcctccaccggctgctgcaagagggatcccctagtgacatcacaacattgagcgtcgagcctgacaaaaaggacagcgcgtccacatctgtgagcgtgacaggtcaggtccagggtaactcatccattaagctggagctcgacgccagtaaaaagaaggagtctaaagatcaccaactgcttcgataccttctcgataaagacgaaaaagatctccggtctacacccaatctgagtctggacgacgtgaaagtgaaggtcgaaaaaaaggaacagatggatccgtgcaataccaatcccacccctatgacgaagccgacgcccgaggagatcaagttggaagcccagagccaattcactgccgacctcgaccaatttgatcaattgctgcctacgctggaaaaggccgctcaacttcctggtctatgtgaaacagatagaatggatggtgcagtaacaagtgtcacaatcaaatccgagatactgcctgctagcctgcagtctgcaaccgccaggcctactagtcggctgaatagactgccggaactagagttggaagccatcgataatcagttcggccaacctggtacaggcgaccaaatcccttggacaaacaacaccgtgaccgcaatcaaccagagcaaatccgaggatcagtgcatctcctcccagcttgacgagctgctctgtcccccaaccactgttgagggccgtaacgatgagaaagcactccttgagcagctggtcagcttcctctcgggtaaagacgagacagagctggctgagttggacagggcacttggcatcgataagctcgtgcaaggcggaggattagacgtgctgtcagagcggtttcctccgcagcaggctacgcctccactgataatggaggagcgcccaaacctatactcacagccgtattcttccccaagtcctactgccaatctcccgagccctttccagggtatggtgaggcaaaagccatccctgggcaccatgccagtccaagtaactcctcccaggggggctttcagcccaggaatgggcatgcagcctaggcagacattgaatcgcccacctgccgctcccaatcagctacgtcttcagctgcagcagagactgcagggtcagcagcagctcattcaccagaaccggcaggccatcctcaaccagtttgctgccactgcacccgtaggcatcaacatgaggagcggaatgcaacagcagataaccccccagcctccacttaacgcccaaatgctggctcagaggcagagagagctatactcacagcagcatcgacagcgccagctgattcagcagcaacgagccatgctcatgcggcagcaatcattcggcaataacttgcctccaagtagtggcttgcctgtgcaaatggggaaccctaggctccctcagggtgccccacagcagttcccgtatccaccaaactacggaaccaatcctggcacacccccagcctcaacatctccatttagtcagttagcggcaaaccctgaagcatctctggccaataggaattcgatggtatccaggggcatgacaggaaacataggagggcaatttggcaccggtatcaaccctcagatgcagcagaatgtgttccagtacccgggagcagggatggttccacagggggaagcgaatttcgccccttcgctaagccccggatctagcatggtgcctatgccgattcctcccccacaaagctctctgttgcagcagacgccccctgcctccggatatcaatccccagacatgaaagcctggcaacagggtgctattggcaacaacaacgtcttcagccaggccgtgcaaaaccagcccactcccgcacagccaggtgtctacaacaacatgagtattaccgtgtctatggccggaggcaacaccaatgtccagaatatgaatcctatgatggcacagatgcagatgtccagtttgcaaatgcctggcatgaatactgtgtgtcccgagcagattaacgatccagctcttcggcatactggcctgtactgcaaccagctgtcatccactgacctgctcaagacagaagccgatggtacccaagacaaaaagacggaggaattttttagcgtggtgacgaccgattag

SEQ ID NO: 233084 - DNA, 1659 bp, Artificial Sequence
  Description of Artificial Sequence: Synthetic coding sequence
atgcagctcacagctgagaacagccctgttacccctgtgggtgcccagaagaccgccttgaggatttcccagtcaaggatgatcggcaattctgcctcccgaccaacaatgcccagcggcgagtgggcccctcaaagctcagcggttagagtgacctgtgcagcaaccacttccgcaatgaaccgcccagtgcagggtggaatgattagaaatcccgcagcctcaatcccaatgcgaccttcaagccagcccggacagaggcaaaccctccaatcacaagtaatgaatattggtccttccgagttggaaatgaatatgggcggtccccaatatagtcagcagcaggcccctcccaatcaaacggcaccctggcccgagtctatcctcccaatcgaccaggcctccttcgcaagtcaaaaccggcagcccttcggaagctcgcctgacgaccttctttgtccccacccagccgctgaatcaccctcagacgaaggggcactcctggatcaactgtatctggccctgcgcaatttcgatgggttggaggagatcgatagagcccttgggattcccgaattggttagtcagagccaagctgtggatcctgaacagttttcttctcaggatagtaatattatgctggaacagaaggccccagtttttcctcagcaatatgcctcacaagcgcagatggcgcaagggtcctactcgcctatgcaagatccaaattttcataccatgggccagagaccaagctatgccactctgcggatgcaacctcggccaggactccgtcccaccggccttgttcagaaccaaccaaatcagctgaggctccagctgcaacacaggcttcaggcacagcagaaccggcagccccttatgaaccagattagtaacgtaagcaacgtgaacttgaccctgcgaccaggcgtccccacgcaggcacccatcaacgctcaaatgttggcccagcgccaacgtgaaatcctaaaccagcacttgaggcagcgccaaatgcaccagcagcagcaggttcagcagcgcacactgatgatgcggggtcaaggcctgaatatgacgccttccatggtcgcgcctagtggtatgccagcgactatgtctaaccccaggatccctcaggccaatgctcaacagttcccttttccccctaattacgggatttctcagcagccagaccccggatttactggggctacaacacctcagagcccactgatgtcccctcggatggcccatacccagagccctatgatgcagcagtcccaggcgaatcccgcttatcaagctccatccgacataaatgggtgggcacagggaaacatgggtggaaactcaatgttcagccagcagtctcctcctcactttggccagcaggccaatacttccatgtacagtaataacatgaatataaatgtaagtatggctactaatacaggaggtatgagttccatgaatcagatgacggggcagatctccatgactagtgtgacatccgttccaaccagcgggctgtcgtccatggggccagaacaggttaatgaccccgctcttagaggcggtaacctgtttccaaatcagctgcccggaatggacatgattaagcaggagggcgacaccacaaggaagtattgttag

SEQ ID NO: 233085 - DNA, 4395 bp, Artificial Sequence
  Description of Artificial Sequence: Synthetic coding sequence
atgtctggcatgggggaaaacacttcagatccgagtcgggcagaaacacgcaagcggaaggagtgtcccgaccagcttggtccatcccccaaaagaaacacagagaaacgcaatagagagcaggagaataaatacattgaggagctcgccgaactgatttttgcgaatttcaacgacatcgacaattttaatttcaaacccgacaagtgcgccatcctaaaggaaaccgtgaagcaaatccgtcaaattaaggaacaggagaaagcagccgctgcaaacatcgacgaagtacagaagtcagatgtctcctccaccggccagggtgtcatagacaaggatgcactggggccaatgatgcttgaggcgctcgacggttttttcttcgtggtcaacctggaaggtaacgtagtatttgtttctgaaaacgtcacccagtacctgaggtacaaccaagaagaactgatgaacaaatcagtgtactcaatccttcacgtgggggaccacaccgagtttgtgaagaatcttctgcctaaatcaattgtgaacggcggaagttggtctggagaaccacctcggaggaactcccacaccttcaactgccggatgctggtcaagcctctccctgattctgaagaggaaggtcacgacaatcaggaagctcatcaaaagtacgagacaatgcagtgcttcgcagtttcccagccgaaatcaattaaggaggagggagaggatctgcagagttgtctcatctgtgtagccaggcgagtgcccatgaaggaacggccagtactgcccagctccgagagtttcacaactcgccaggatctccagggcaagattacaagcctggacacctctactatgagagcagccatgaagcccggatgggaggatcttgtgaggaggtgtattcagaaatttcacgcacagcacgaaggcgagagcgtgagctatgcgaagagacatcaccatgaggtgctacggcaaggattagctttcagccagatttacaggttttccttgtcagacggcaccttagtggctgcccagacaaaaagcaagctgatcaggtctcaaaccaccaacgagcctcagctcgtgatctccctgcatatgctacaccgggaacagaatgtgtgtgtaatgaatccagatctgacaggccagactatgggaaagccattaaacccaatctcatcaaattctcctgcacatcaggctctgtgctcggggaatcccggtcaggatatgactctctcctctaatatcaacttccctatcaacggccctaaggaacagatgggaatgcccatgggcaggttcggcggttccggaggaatgaatcatgtcagcggaatgcaagccactactccccaagggagcaattatgctctgaagatgaattcaccatcccagtcctctcctgggatgaacccgggtcaaccaaccagtatgttatcgccgcgacatagaatgtcaccaggagtagccggatctcccagaattccaccgtctcagttcagccccgctgggtctctgcactcacctgtgggcgtgtgttcctcaaccgggaactctcactcatacacaaactctagtttgaacgctctacaagccctgtcggagggccatggagtgagtctcgggtcttccctcgcttctccagatctgaagatggggaatctccagaactcgcccgtgaacatgaatcccccaccactctcaaagatgggaagcttggatagcaaggactgtttcgggctctatggggaacctagcgagggcacaaccggacaggccgaatcatcctgccatcctggggagcagaaagagaccaacgaccccaacctgcccccagcagtttccagtgagcgggcagatgggcagtcaaggttgcatgattcaaagggacagaccaagctgcttcagctcctcactactaaatccgaccagatggagcctagtccactcgcctccagtctctcagacaccaataaagactccaccgggtcactgccaggaagtggatctacccacggaacctctcttaaggagaaacacaaaatcctacataggctccttcaggacagcagtagccctgtagacctggctaagcttaccgctgaggcgaccgggaaggacttaagccaagagtcctcaagtaccgcaccagggtccgaagttactattaaacaggagcctgttagcccgaagaagaaggaaaacgctctgttgaggtatctccttgacaaggacgacacaaaggatatcggcttacctgagatcacgccaaaactggaacggctcgatagcaagactgacccagcatctaataccaagctcatcgctatgaagacggagaaggaagaaatgagtttcgaacccggagatcagccaggctcagaattggacaatctcgaggagattctggacgatctgcagaacagccagctacctcagctcttcccagacacaaggcccggagcccctgccggttccgtggacaagcaggcgatcataaatgacttaatgcaactgaccgctgaaaattcccctgtaacccccgtgggagcgcagaagactgctttaagaatttcacagtcaacctttaacaaccccaggcccggacaactcggacgtctcctgccaaaccagaatctgcccttagacatcacccttcagtcacctactggcgctgggcctttccctccaattcgaaactcgtccccatacagcgtgatcccacagcctggcatgatgggaaatcaggggatgattggcaatcaggggaatcttgggaacagctcaactggcatgatcgggaactccgcatcgaggccaactatgccatccggtgagtgggcaccgcagtcaagcgcagtgagggtcacttgcgccgctaccactagcgcaatgaaccgcccagtgcagggtggaatgatccgcaacccggcagcatctatacctatgagaccttccagtcagccgggacagcggcagacgctgcagtcccaggtgatgaacatcggaccctccgaattggaaatgaacatggggggacctcagtactcgcagcagcaggcccctccaaatcaaactgcgccatggccagagagtatcttaccgattgatcaggcaagttttgcatctcagaaccgtcagccctttggatcctctcctgatgacctactgtgccctcacccagcagccgaaagcccctcggatgaaggggcactgctggaccagttgtacctggctctgcgaaacttcgacgggctggaagaaattgatcgtgccctggggataccggagttggtctcacagtcccaggctgtggatccagaacagttttccagccaggatagcaatattatgctcgaacagaaagctccagtgttcccacagcagtatgcctctcaggcacaaatggctcagggatcctattctccaatgcaggatcccaacttccatacaatggggcaacgcccatcatatgctacgcttaggatgcagccgcgtcccggacttcggcctaccgggctggttcagaaccagccaaatcagttacgacttcaactgcagcaccgattgcaggcccaacagaataggcagcctcttatgaatcaaatttccaacgtgagcaatgtaaacctgaccctgcgacctggagttccaacccaagctcctataaatgcgcaaatgctggcccagaggcaacgagaaatcctcaatcagcacctgcgtcagcgtcaaatgcatcagcagcagcaagtgcagcaacgcacgttaatgatgaggggccagggactcaacatgactcctagtatggtggccccaagcggcatgccagcaacaatgtcaaacccgagaatcccacaggctaacgcccagcaatttccttttcccccaaattacggcatcagtcagcagcctgaccccggatttaccggcgcaaccacgccacaatctcctctcatgtcaccgagaatggcacacactcaatcccccatgatgcagcagtcacaagcaaacccggcttaccaagcgcctagtgatatcaatggttgggcccagggaaacatggggggaaacagcatgtttagccaacaatcaccccctcactttggacagcaggcaaatactagtatgtattctaataatatgaacatcaatgtatccatggccaccaacactggcggaatgtctagcatgaaccaaatgacaggacaaatcagcatgactagcgtaaccagtgttcccaccagtgggcttagcagcatgggccctgaacaggtgaatgatcctgccctgaggggcggaaacctattcccaaatcagctgccaggtatggatatgataaagcaggaaggtgacactacaagaaagtactgttag

SEQ ID NO: 233086 - DNA, 51 bp, Artificial Sequence
  Description of Artificial Sequence: Synthetic coding sequence
atgagtggcatgggcgaaaatacatctgatccaagtagggcggagacatag

SEQ ID NO: 233087 - DNA, 27 bp, Artificial Sequence
  Description of Artificial Sequence: Synthetic coding sequence
atgagtggcatgggagagaatacctag

SEQ ID NO: 233088 - DNA, 4263 bp, Artificial Sequence
  Description of Artificial Sequence: Synthetic coding sequence
atgtcaggattgggagagaatctcgacccccttgctagtgattctcggaagcggaagctaccgtgcgatacccctggacaaggcctgacctgcagcggagaaaaaaggaggagggaacaggaaagcaaatatattgaggagcttgccgaacttatatccgccaacctgtctgatatcgacaactttaacgtcaagccggacaaatgcgccatcctgaaggagaccgtacgccaaattcggcagatcaaggagcagggaaagacaatatctaacgacgacgatgttcagaaagccgatgtgtcttctaccgggcagggcgtaatcgataaagactccctcggaccgttacttctccaagccctcgacggctttctcttcgtggtgaatcgtgacgggaatattgtcttcgtgtctgagaacgtgacccagtacctccaatacaagcaggaagatctcgtgaacacctctgtttacaacatcctgcacgaagaggaccgaaaagactttctgaaaaatctccccaagagcaccgtgaacggagtctcctggactaacgaaacacagaggcagaaatcccacacgtttaactgcaggatgttgatgaaaaccccccatgacatcctcgaagacattaatgcaagtcccgagatgcggcagcggtatgaaaccatgcagtgttttgcgttgagtcagccacgagccatgatggaagaaggggaggacctccaaagttgcatgatctgcgttgcccgtcgaattactaccggggagcgcacatttcctagcaatcccgaatcttttattacgcgccacgacctgagtgggaaggtcgtgaatatcgatacaaactcactcagatcctctatgcgacccggatttgaagatattattcgcagatgtatccagcgttttttctcattgaacgatggccagtcctggtcacaaaagcgccattatcaagaagcctatctcaacggccatgcagagacccctgtgtacagattttccctcgccgacggcacaatagttaccgctcagactaagtccaaactgtttcgcaatcccgtgaccaatgatcggcacggattcgtgagcacccacttcctccagagagagcagaatggctacaggccaaatcccaacccagtggggcaaggtatccggcctcccatggccggttgcaacagcagtgtaggcggaatgtccatgtcccccaatcaagggttacagatgccatcgagccgggcttatggtcttgctgacccatctacaacaggccagatgagtggagccaggtatggaggctcgtccaacatcgcttctcttacccccggtccgggtatgcaaagccccagcagctaccagaataataactacggactaaatatgagtagcccgccacacggcagcccaggtctggccccaaaccagcagaatataatgatttcccctcgtaaccggggttctcctaagattgcttcacatcagtttagccccgtggcaggtgtgcactctcccatggcgtcttctgggaacaccggaaatcactcttttagctccagcagtctttccgccctccaggcgatttcagagggcgtcggcacatctttgctgagcacattgtccagccctggccctaagctcgacaacagtcccaatatgaacattactcagccttccaaagtaagcaaccaggactctaaatctccactgggtttttactgtgaccagaatccagttgagtcatccatgtgccagtcaaactcgagggatcacctgagcgacaaagaatctaaggagtcctctgtagaaggcgcagagaatcaacgtggacccctcgaatcaaagggacacaaaaagctcctccagttactgacatgctccagcgacgatcggggacatagctctttaacaaattcccccttggactccagttgcaaagaaagtagcgtttcagtgacgagcccatccggggtgagctcatcgaccagcgggggagtctcttcgacctcaaacatgcatggatcactgcttcaggagaaacataggatccttcacaaactattacagaacgggaatagcccggcagaagtagctaaaattactgctgaggctacaggcaaggatacctcttctatcacttcatgcggcgatggaaatgtggtgaagcaagaacagctgagcccaaaaaaaaaagagaacaatgccctgctacggtatttgctcgatcgtgatgatccttctgatgccctgtctaaagagcttcaacctcaggtagagggcgtcgataacaaaatgagtcagtgcacttcctccacaatcccctcttcatctcaagagaaggatcccaagatcaagactgagacttccgaggagggaagtggcgacctggataacttggatgctattcttggagacttgacctcctcggatttctacaataacagcattagctcaaatggctcccatttaggcaccaagcagcaagtgttccagggcacaaacagcctaggtctcaagtcctcccagtctgtccagtctattaggcctccatataatagggcagtgtcgttagattctccagttagtgtcggctcctcgccccctgtaaagaacatcagcgcttttcctatgctccccaaacaacctatgttgggcggtaatcccagaatgatggattctcaggagaactatggaagcagcatggggggacctaatcgcaatgtgacagtaacccagactccaagctcaggcgattgggggctgcctaatagcaaggcgggacggatggagcccatgaactcaaatagcatgggcagaccaggaggggattacaacactagtctgccccgtcccgctttgggaggctcaatcccaacactgcctctgcgcagtaacagcatcccgggagcgcgacccgttttacagcaacagcagcagatgctgcagatgagacctggagagattcccatggggatgggggcaaacccctacggccaggcagcggcttcaaaccagctgggcagctggcctgacggtatgctctctatggaacaagtgtcccacggaacccagaacagaccacttctgcggaattctctggacgacctggtgggccctccttccaacctggaaggacagtcagatgaaagggccctcttggaccagctccacaccctgctgtcgaacaccgatgccactggtctggaagagatagatcgtgcccttggcatccccgagctcgttaaccagggacaggctctggaacctaaacaagatgcatttcagggtcaggaagctgctgtcatgatggatcaaaaggccggactgtatggccagacatatcccgctcaaggacctccaatgcagggaggatttcacctccagggtcagtctccctcatttaacagcatgatgaaccagatgaaccaacaggggaactttcccttacagggtatgcacccaagggctaacattatgaggcctaggacaaatacacccaagcagctgcgcatgcagctccagcaacggctccaaggccagcagttcctgaatcaatctagacaggctctggaactgaagatggaaaaccccactgcgggaggcgctgccgttatgagacccatgatgcagccccagcaagggtttctaaacgctcagatggtcgcccagagaagcagggaattgcttagccaccactttcgacagcagcgcgtggcaatgatgatgcaacagcaacaacagcaacaacaacagcagcagcagcagcagcagcaacagcagcagcagcaacagcaacaacaacagcaacagcaaacgcaggcattctctccaccccctaacgttaccgcgagcccgtccatggatggactgctggctggacctaccatgcctcaggctcccccacaacagtttccctatcagcccaattacggaatgggccagcagcccgatcccgctttcggaagagtgagttctccccctaatgcaatgatgtcgtccagaatgggaccaagccagaatccaatgatgcagcatccacaagcagcctcgatctaccagtcaagcgagatgaaaggctggcccagtggcaacctggcccgaaatagctccttcagccagcagcagtttgctcatcaagggaaccccgctgtttactcaatggtgcacatgaatggcagctccggccatatgggtcaaatgaacatgaaccctatgccaatgtccggcatgcccatgggaccagaccaaaagtattgttag

SEQ ID NO: 233089 - DNA, 4053 bp, Artificial Sequence
  Description of Artificial Sequence: Synthetic coding sequence
atgtccgggctgggagaaaatctagatcctctcgctagcgactcacggaagagaaaactcccttgcgacactccaggacagggcctcacttgttctggggaaaaaagacggagagagcaggagagcaaatatatcgaggagcttgcagaattgatctccgctaacctgagtgacatagacaacttcaacgttaaacctgataagtgcgcaattctcaaggaaactgtgcgacagatcaggcagattaaggaacaggggaagaccatctccaacgacgatgacgtccagaaggcagacgtgtctagcaccggccagggagtaattgacaaggattcgctgggccctctgctactgcaggccctggacggtttcttatttgtggtgaaccgggatggaaacattgtgtttgtcagcgaaaacgttactcaatatctccaatacaagcaagaggatttggtgaacacttccgtctataacatcctgcacgaggaggatagaaaggactttctaaaaaatctcccaaaatctactgttaatggggtcagctggactaatgaaacacagagacagaaaagtcacacattcaactgccgtatgctaatgaagactccacacgacattctcgaggacataaacgcatcccctgaaatgcggcagcgatacgaaacaatgcagtgttttgccctgagccagccgagggccatgatggaggagggggaagacctgcagtcatgcatgatttgcgtggcgcgtcgaattacgacaggggagcgaacattcccatccaatcccgagtcttttatcacgaggcacgacctctcgggcaaggtcgtgaacattgatacgaactctttgcggtccagtatgaggcccggattcgaagatatcatacgacgttgcattcagcgatttttttccctaaacgatggccaatcctggtcccagaagcggcattatcaggaggtcacaagtgacggtattttcagtccgactgcatatcttaacgggcatgccgagacccctgtctatcggttctctttggccgacggcacaattgttaccgcacagaccaagtcaaagctgttccggaatcccgtgacaaatgaccgacacggcttcgtgagtacccacttcctccagagggagcaaaacgggtatagacccaatcctaaccccgtggggcaaggcatccggccaccaatggccggttgtaactcctccgttgggggtatgtccatgagccctaatcaaggcttgcagatgcctagtagtagggcgtatggcctggctgacccctcaaccaccggacagatgtcaggtgctcgctacggtggcagttccaatattgcctctctgactcccggtccaggcatgcagagcccgagcagttatcaaaacaataactacggcctaaatatgtccagtcctcctcacggctcgcccggtttggcaccaaatcagcagaacatcatgattagccctaggaataggggctcacctaagatcgcgtcccatcagttctctcccgtggctggagtgcattcccccatggcctcctccgggaatacaggcaatcactctttttccagttcttctttatcagcactgcaggcaattagcgaaggggttggaacctctcttttgtccaccctaagcagccctggtcctaaactggataatagccccaatatgaacattacacagccgagcaaagtgtctaatcaggactcaaaatcccctctcggattctattgcgatcagaatcctgtagaaagtagtatgtgtcagagtaattctcgggatcatctgagtgataaggagagcaaagagtctagtgtcgaaggggctgaaaaccaacggggtcccctggaaagcaaaggccataagaaacttctccagttgttaacttgctctagtgacgaccgaggacattcttctctcaccaatagcccgcttgactccagctgcaaggaaagctctgtttcagtgacctctcccagcggagtgagctctagcacttccgggggtgtttcatctacctctaacatgcatggcagcctcttacaggagaagcatagaattctacataagcttctccaaaacgggaactcacctgctgaagtggctaaaattaccgctgaggccaccgggaaggacaccagttccattaccagttgcggagatggtaacgtggtgaagcaggagcagcttagccctaagaaaaaggagaataacgcactgcttagatacctgctcgaccgggacgatcctagcgacgccctgtctaaagagttacagccacaggttgaaggtgtagataacaagatgagtcagtgtacttcctctacaatccccagcagctcacaagagaaggaccccaagattaagacagaaacctccgaggaaggctcgggggaccttgataacctggatgccatcctgggagatcttactagttccgatttctacaataacagtatctcaagcaacggaagccatttgggaaccaagcagcaggtattccagggaactaacagcctgggagattggggcctgccaaacagtaaggctgggcgtatggagccaatgaacagcaattcaatgggaagacccggaggggactataacacaagtctgccacgaccagctctggggggatctatcccaacactgccactgcggtccaactccatccctggtgcgagaccagtactccagcagcagcaacagatgctccagatgaggcccggtgaaatccctatgggaatgggcgctaatccctatggtcaggctgctgcctcaaatcagctaggatcgtggcctgacggaatgctgtcaatggaacaagtttcgcacggaactcaaaaccggccactgctgcgaaatagcctcgacgatctcgttggacccccatctaacctcgagggacaaagtgacgagcgtgctctgctcgatcaattacacacattgctctccaacaccgatgctacaggcttagaggagattgatagggcgctgggtattcccgagttggtgaaccaggggcaggctcttgaaccaaaacaagatgcatttcagggacaggaagccgctgttatgatggatcagaaggccggtttgtacgggcagacataccctgcccagggaccacctatgcaagggggtttccatcttcagggacaatccccctcctttaacagtatgatgaatcaaatgaaccaacaagggaattttccgttacaagggatgcatccacgtgcaaacattatgcgaccgagaaccaacactcctaagcaactgcggatgcagctgcaacagcggctgcagggccagcagttcctcaatcaaagccgccaagctctggagctgaagatggaaaatcctacagccggtggagctgccgtgatgcggccaatgatgcaacctcaacagggcttcctcaacgcccagatggttgcccagagaagccgtgagctgctaagccaccactttagacagcaaagggtcgccatgatgatgcagcaacagcagcagcagcagcagcaacaacagcaacagcagcaacaacagcagcaacagcagcagcaacagcagcaacagcagcagactcaagcgttctcgccaccccctaacgtcaccgcgtctccatcaatggacggtctgctggccggaccaactatgcctcaagcaccaccacagcagttcccctaccaacccaactacggaatgggacagcagccagaccccgctttcggcagggtcagttcccctcctaatgccatgatgagcagccggatgggcccttcccagaaccccatgatgcagcacccacaggcggcttctatctaccagtcaagcgaaatgaagggatggccaagcggaaacctcgccaggaacagttctttttcgcagcaacagttcgcacaccagggcaatcccgcagtttattccatggtccacatgaatggctcctctggccacatgggccagatgaatatgaatccaatgccaatgtccgggatgcctatgggacctgatcagaaatactgttag

SEQ ID NO: 233090 - DNA, 4248 bp, Artificial Sequence
  Description of Artificial Sequence: Synthetic coding sequence
atgtcaggtctgggagaaaacctcgatccattggcgtccgactcccggaagaggaaactgccctgcgacactccagggcagggcctgacgtgtagcggagagaagcggcgtcgcgaacaggagtcaaagtacattgaggaactggcggagttgatctccgccaacctgtctgatatcgacaacttcaatgttaagcctgataagtgtgccattcttaaagagaccgtacgccagattagacagataaaggaacagggcaagactatcagcaacgatgatgacgttcagaaggccgatgtttcgtccactgggcaaggggtcatagacaaagacagcctgggacccctgctgctccaggccttagatggtttcctctttgtggtgaaccgggatggcaacattgtctttgttagcgaaaatgtgacgcagtatctgcaatataagcaggaggaccttgtgaacactagtgtgtacaacattctgcatgaggaagatcgtaaagacttcttgaagaatttgcccaaaagcacagtgaacggtgtgagctggaccaatgagactcagcggcaaaagtctcacacatttaactgccgcatgctgatgaagactccacatgatatcctcgaggatattaatgcttccccggagatgcgccaaagatacgaaactatgcagtgctttgcgctctcccagcctcgggctatgatggaggagggagaggacctgcagagctgtatgatctgcgtggctcggcgtatcactaccggagaaagaacatttccctcgaaccctgagagcttcatcactcggcatgacctgtccggcaaagtagtgaacatagacaccaactctctccggtcaagcatgcggccaggcttcgaagatattattcgccgttgtatccaacgatttttcagccttaacgacggccaatcctggtcacagaaaagacattaccaggaggtgaccagtgatggtattttttccccaactgcgtatctaaacggccacgctgagacccctgtctacagattctctctagcagacggaaccattgtgacagcgcaaacaaagagtaagctttttcggaatccagtaaccaatgaccggcacggcttcgtttcgacccactttctgcaacgggagcagaatggataccggcctaatcctaatccggttggtcagggcatcaggcctcccatggctggctgtaattccagcgtcggtgggatgagcatgtctcccaatcaaggcttgcagatgccctcatctcgagcctatggcctagctgacccatccactactggccagatgtctggggctcggtatggagggtcaagcaacattgcaagcttaaccccgggacctgggatgcagtcaccaagtagctaccaaaataacaactatggattgaatatgtcttctcctccccacgggtcccccggtctggcacctaatcagcaaaatatcatgatatcacccaggaaccggggaagtccgaaaatcgcttcccaccagttttcccctgttgccggagttcattctcccatggcctcttccgggaacacagggaaccatagctttagctccagttcactttctgccctacaggccattagcgaaggggtcggcacgtctttactatctaccttatccagccctgggccaaagctcgataacagccctaatatgaacatcacacagccctcaaaagtgtccaaccaggatagtaagagccctctgggcttctattgtgatcagaaccctgtggagtcctccatgtgccagagcaatagtcgtgaccaccttagtgataaagaaagcaaggagagctcagtcgaaggcgcagagaaccagcgcggacctctggagagtaaggggcataagaagctgcttcagctgctgacttgtagcagcgacgatagaggccactctagtctgaccaattcccctctggactctagctgtaaggaatcttcagtatccgtcacatctcccagcggcgtgtcgtcctcaaccagtggaggggttagttcaaccagcaacatgcacgggtccctgctacaagaaaagcatcggattttacacaaactgctccaaaacggcaacagccctgccgaggttgcgaagataacggctgaggccactggtaaggacaccagttctattacatcttgtggggatggaaacgtggtgaagcaggagcaactcagtcccaagaaaaaggaaaacaatgctctgcttagatatttgctggatagagacgatccaagtgatgctctgtcaaaagagctacaaccgcaggtcgaaggcgtggataacaagatgagccagtgtacctcttccactattccttcatcttcacaggagaaagatcccaagatcaagactgaaacttcagaggaaggctcaggggacctggacaacctggacgcaattcttggagatctgacaagcagtgatttttataataactcaatatcctccaacggatcccatttgggcactaagcagcaagtattccagggcaccaactctctcggcctgaagagtagtcagagcgttcagtccattcgtccaccttacaaccgcgctgtgagtctcgactctcccgtctccgttggcagcagcccacctgtgaagaacatcagtgctttcccaatgctccctaagcagccaatgctcggcggaaatcctcggatgatggatagccaggagaattacggctctagtatgggagactgggggctgcctaactctaaggctggccgaatggagcctatgaactccaattctatggggagacccggtggcgattacaatacttcccttcccagacctgctctgggaggatctatccctacccttccacttcggagtaacagcatccctggcgcacgccctgtgctccagcagcagcagcagatgttacagatgaggcccggagaaatcccaatggggatgggggcaaatccctatggccaggcagcagcatcaaaccaactgggcagctggcctgacgggatgctgtcaatggagcaagtgtctcatgggacacagaataggcctctgcttagaaactctctggatgaccttgttggaccgcctagcaacctcgagggacaatcagacgagcgagccttgcttgaccaactgcacactctattgtccaacacggatgcaactggccttgaagagatcgaccgcgcactgggcatacccgaactggttaaccaagggcaggctttagaaccaaaacaggacgccttccaaggacaagaggctgccgtgatgatggaccagaaggccggactctatggccaaacttaccccgctcagggcccaccaatgcagggagggttccatttgcaggggcagtcccctagcttcaactcaatgatgaatcagatgaatcaacagggaaattttcccctgcaaggcatgcatcctcgcgcaaacattatgaggccacgcaccaatacacccaaacagcttcgcatgcagctacagcagcgcctgcaagggcagcaatttctgaatcaatcccgtcaggccctcgagctgaaaatggaaaatccaaccgccggtggcgctgccgttatgcgccctatgatgcaacctcagcaaggcttcttgaatgcccagatggtggctcagcggtccagggaactcctgtcccaccacttcaggcagcaacgagtggccatgatgatgcaacagcaacaacaacagcagcagcagcaacagcaacagcaacagcagcagcagcaacagcagcaacagcagcagcagcaacagcaaacacaggctttttcaccaccccctaacgtgaccgcctcgccttccatggacggactcctagcaggcccaactatgccccaggcaccacctcagcagtttccttaccaacctaactacgggatgggacaacagcctgacccagcattcggcagagttagctctccacctaacgctatgatgagctccaggatgggcccatcccaaaatccaatgatgcaacatccacaggctgcaagcatctaccaatcctccgagatgaaaggctggccctccggcaacctggcccgaaatagctccttcagccaacaacagtttgctcaccaagggaatcctgctgtgtatagtatggtccatatgaacggcagcagcggtcatatgggccagatgaacatgaatcctatgcctatgtctgggatgcctatgggaccagaccaaaagtattgctag

SEQ ID NO: 233091 - DNA, 4275 bp, Artificial Sequence
  Description of Artificial Sequence: Synthetic coding sequence
atgtcagggttgggggaaaacctggaccctctcgctagcgatagtagaaaaagaaaactgccctgcgacacaccgggtcagggtcttacctgtagcggagagaaaaggaggcgggagcaggaatcaaaatacatcgaggaactggctgagttgatcagcgctaatttgtctgacatcgacaacttcaatgtcaagcctgataagtgtgccatccttaaggagactgtcagacagattagacagatcaaagagcaaggcaagacgattagcaatgacgatgatgtgcaaaaggcagatgtttcgtccacaggccaaggggtcatcgataaagattccctgggaccgctactgctgcaggccttggatggctttctgtttgtagtgaaccgggacggtaatatagtatttgtgtccgagaatgtaactcaatacctgcagtataagcaggaggatctcgtgaatacttctgtgtacaatattttgcacgaggaggatcgaaaggactttctgaagaaccttcctaagagcacagtgaacggcgtctcctggactaatgagacccagagacagaaatcacacacattcaactgtcggatgctgatgaagacaccgcacgatatcctcgaggatattaacgctagccccgagatgaggcagcgctatgaaacgatgcagtgctttgctttgtcacagccgagagcaatgatggaagagggagaggatctccagtcttgtatgatttgtgtggcacgtagaataacaacaggtgagagaaccttcccctccaatcccgaaagttttattaccaggcacgatctcagtggtaaagttgtgaacatcgataccaattccttacggagttcaatgagaccgggttttgaggatatcatcaggcgatgcatccagcgcttctttagtctgaacgacgggcagtcttggtctcagaaaagacactaccaagaagcttatctaaacgggcacgccgagaccccagtctatcgtttctcccttgctgacgggacaatcgtcaccgcccaaacgaaaagcaagctctttcggaatcccgtcaccaatgacaggcatgggtttgtcagcacgcacttcctgcagcgcgagcaaaatgggtaccggcctaacccgaacccagtaggccagggcattcggccaccaatggcagggtgtaattcttcggtgggtggaatgagcatgtcgcccaatcaggggttgcagatgccatcaagccgagcctacgggctagccgacccatcaacaaccggccagatgagcggcgctcggtatggcggaagttctaacatcgcatctttgacacctggcccaggcatgcagagcccctcaagctatcagaacaacaactacggtctgaacatgtcctctcccccacacggctccccgggactggctcccaaccagcagaacatcatgatctcacctaggaataggggatctcccaaaattgcctcccaccagttttcacccgtcgcaggggtgcattccccaatggcatcttctggcaataccggcaaccactctttcagcagcagttcactatcagcactgcaagctatttcagagggcgtcgggaccagcctgttgtctaccctttctagccctggcccaaaactagataattcccccaatatgaacataacccagccatccaaagtgagtaaccaagacagcaagtctcctctgggattttactgcgatcaaaaccccgtcgagagctcgatgtgtcagagcaatagccgggaccatctcagtgataaagagtctaaggaatcgtcagtggaaggtgccgagaatcagaggggtccactcgagtccaaggggcataagaagctgttgcagctccttacctgcagctccgatgaccggggacacagctcgcttactaacagtccccttgacagcagctgtaaagagagctcagtttcggtaaccagtcctagtggtgtttcctccagcacctccggtggcgtcagtagcactagcaacatgcatggctctctgctccaggagaagcataggattctgcataagctgctccagaatggcaactctcctgctgaggtcgctaaaataacggcggaggctacagggaaagacacctcaagcattacctcatgtggtgacggtaatgttgttaaacaggaacaactgagcccgaaaaagaaagaaaataacgcattgctccgctatctgctggatcgggacgacccttcagatgctttgagtaaggaactgcagccccaggtagagggtgtggacaataagatgtcacagtgcacttcctctacgattccaagctcttcacaggaaaaagaccctaaaatcaagaccgaaacaagcgaagaaggcagtggggatctggataatctggatgctatcctaggggatctcacgagctccgacttttataataactcgataagctcgaacggctcccacttgggcactaagcagcaggtcttccaggggaccaatagccttgggctcaaatcatcacagtccgtgcagtccattaggccgccatataatcgggcagtatcattagactctcctgtatcggtcggcagttccccaccagtaaaaaatatctcagctttcccaatgttacccaaacaacccatgcttggcggaaacccacgtatgatggacagtcaagaaaactatgggtcttccatgggtggccctaatcgcaacgtaactgtgacccagacccccagttcaggcgactggggtttgcccaattctaaagcagggaggatggagcccatgaactccaattcaatggggaggcctggcggtgattataatactagccttcctcgccctgccctgggcggttcgatccctactctcccgttgcggtcgaactctattccaggagccagacctgttctgcagcagcagcagcagatgcttcagatgagaccaggggaaatacccatgggcatgggtgcgaatccatatggccaagccgctgctagtaatcaactgggcagctggcccgacggcatgctgagcatggaacaagtgagtcacgggacacagaatcggccactgcttaggaattcattggatgatctcgtaggccctccctcgaatctggagggacaatcagacgaacgggcactgctcgaccaactccacactttattatcgaacacggacgcaaccggcctcgaggagattgacagggctctcgggatccctgagctagtgaatcagggccaggctcttgagcccaaacaggatgccttccagggacaggaagccgctgtcatgatggaccagaaggcagggctgtacggccagacttatcccgcacaagggcctccgatgcagggaggctttcacctgcaaggacagagtccctctttcaatagcatgatgaaccagatgaatcagcaggggaactttccactgcaggggatgcacccgagggccaatattatgaggccgcgtactaacactcctaaacagctacggatgcagctgcaacagaggctccaagggcagcagtttctcaatcaaagtcgtcaagctcttgagcttaagatggaaaatccaactgcagggggagcagcagtgatgcgccctatgatgcaaccccaggtatcgtcccaacagggattcctaaatgctcaaatggtcgctcagcgcagccgcgaacttctctcccaccatttccgacagcagcgggttgctatgatgatgcagcagcagcagcagcaacagcaacagcagcagcagcagcagcagcaacagcaacagcagcagcagcaacagcaacagcagcagcagacacaggccttttctcctcccccaaacgtcaccgcctccccttctatggatggactactagcagggcctacaatgccacaggctcccccacaacagtttccttaccagcctaattacggcatgggtcaacagcccgatccggcttttggtagagtgagcagccccccaaacgctatgatgtccagtcgcatgggaccttcccaaaacccaatgatgcagcatcctcaagccgcttcgatctaccagagcagcgagatgaaagggtggccttctgggaaccttgctcggaactcttcgttctcacagcagcagttcgctcatcaagggaatcccgcagtgtactctatggtgcacatgaacggatcatccggccacatggggcagatgaatatgaatcccatgcctatgagcgggatgcccatgggccctgaccagaaatactgttag

SEQ ID NO: 233092 - DNA, 4263 bp, Artificial Sequence
  Description of Artificial Sequence: Synthetic coding sequence
atgtcagggctgggtgagaatctggatccactggcctctgactcccgaaaacgcaagcttccttgtgatacgccaggtcagggtcttacatgcagcggagagaagcgaagacgcgagcaggagagcaaatacattgaagagttggcggagctgatctccgctaacttgtcagacattgacaacttcaatgtcaaaccagataaatgtgccattctgaaggagaccgtcagacagatacgccagattaaagagcagggcaagaccatttcaaatgacgacgacgtccaaaaggctgatgtttcctcaaccggacagggtgtcatcgataaggactccctgggcccactcttacttcaggcgcttgacggcttcttgtttgttgtcaaccgggatggtaacatcgtttttgtgagtgagaatgtgacgcagtatctgcagtataagcaggaggaccttgtgaatacaagcgtgtacaatattctgcacgaggaggacaggaaagattttctgaagaaccttcccaaatctactgtgaatggggtgagttggactaacgagacacagagacaaaagtcacacacctttaactgtaggatgctgatgaagacccctcacgatatcctggaggacatcaatgcttcgcccgagatgaggcagcgctatgagaccatgcaatgtttcgccctttcgcagccaagggcaatgatggaggagggcgaagatctgcagagttgtatgatctgtgtagcccgaagaataaccacaggggagagaacgttcccctccaatcccgagtcttttatcacccggcatgaccttagcggaaaagttgtcaacattgacacaaattcactacgatcgtcgatgcggcctggctttgaagacatcattcgcaggtgtatacagcgattcttcagtctgaacgacggacagtcctggtcccagaagcgtcactaccaagaggcttatctgaatggccatgccgagacaccagtgtataggttttcccttgctgacgggaccattgtcacggcccagaccaaatccaagcttttcagaaatcccgtgacaaatgatcggcatggatttgtttctacccatttcctgcagagggaacagaacggctacagacccaatcccaatccagtaggccaaggcatacggcctcccatggctgggtgtaacagtagcgtcggtggcatgagcatgagtccaaatcaaggtctccagatgcctagctctcgagcttacgggttggctgatccaagtacgacaggtcagatgtccggggctcggtacggagggagctccaacatcgcaagtctgactcccggacccggtatgcagtcaccatccagctaccagaataacaactacgggctgaatatgagttctcctccccacggttctccaggtcttgccccaaatcagcagaatatcatgattagccctaggaaccggggtagccccaaaatcgcatcgcaccagttctctcccgtagcaggggtgcattctccaatggcatcgagtggcaacacagggaaccacagtttcagcagttcttccctttccgcactccaggccatttcagagggcgttggaacctctctactcagtacactctcttctccaggccctaagcttgacaattcccctaacatgaacatcacccaaccatctaaggtgtctaaccaggactctaagagtcccctcgggttttactgtgatcagaaccccgttgagagcagcatgtgtcaaagcaactctagagatcacctgtccgacaaagagtctaaagagtcttccgttgagggagccgaaaaccaaaggggacctctggagtctaagggtcacaagaagctgttgcagctcttgacatgctcctcagatgacaggggccactcctctctgacgaattcccccctggattcttcctgcaaagaaagcagtgtatcggtgacgagtccaagcggggtgagctcaagtaccagtgggggtgtgtccagcaccagtaatatgcacgggtcactgctccaagagaagcaccgcattcttcataagttactgcagaacggaaactctcccgcagaggtggctaagataaccgccgaggcgaccggcaaagatacttcttccataacatcttgtggggacggaaatgtggtgaagcaggaacagctgtcgcccaagaaaaaggaaaacaacgctctcctcaggtatctcctggacagggatgacccctctgatgcactttccaaagaattgcagccacaggttgagggcgtggataacaagatgtcacagtgtacctccagcacaataccttcctctagtcaggaaaaagatcccaaaattaaaactgagacctccgaagagggttctggggacctggacaaccttgacgcgattcttggagacctgaccagtagcgacttctacaataatagcatctcctcaaatggtagtcatttgggcacgaaacagcaggtctttcagggcactaattcgctgggccttaagtcgtctcagtcagtgcagagcatacgtcctccctacaaccgcgcagtgtctctggactcaccggtgtcagtggggtctagcccaccggtcaaaaatatcagtgcctttccgatgctgccgaaacagcccatgcttggtggcaaccctcgcatgatggacagtcaagagaactatggctcaagcatggggggacccaaccgcaacgtgaccgtgactcagacgcctagtagtggagactggggattgcctaactctaaagcgggacgcatggagcccatgaactcaaatagcatgggacgccctggtggggattataacacgtccctcccaagaccagccttgggaggctccatccctactctgcctctgcgctccaacagtatccccggagccaggccggtgctgcagcagcaacagcagatgctccagatgcggccaggtgagattccgatgggtatgggcgcaaatccgtatggccaggccgctgcgagtaatcagctcggttcctggcctgatggcatgttgtctatggaacaggtttctcatggcacccagaatcgaccgctcctgcggaactcactggacgacctggttggcccaccttcgaaccttgaagggcagtccgatgaacgggctctcctggatcagctacacacactgttatctaataccgatgccactggattagaggagatcgacagagcactcggcatccctgaactcgtcaaccagggccaagccctcgaacctaaacaggacgcctttcagggtcaggaagccgctgtgatgatggaccagaaggccggtctgtatggacagacctatccagcccaggggccaccaatgcaggggggtttccaccttcaggggcagagcccatcattcaattctatgatgaatcagatgaaccagcaggggaactttcccctgcaagggatgcaccccagagccaatatcatgcggcctaggaccaacactcctaaacagctgcgaatgcaactccagcagaggctgcagggacaacagtttctgaatcagtcacgccaggcgcttgagcttaagatggaaaacccaacagctggaggcgcagctgtaatgcggcctatgatgcagccacagcagggctttttaaatgcccagatggtggcgcagcggagcagggagcttttaagtcaccactttagacagcagcgcgttgcaatgatgatgcaacagcaacagcagcaacaacagcagcaacagcaacaacagcaacaacagcagcagcagcaacagcagcagcaacagcagcagcagacccaggcattctcacctcccccaaatgtcacagccagcccctccatggacggcctcctcgccggtcctaccatgccccaagcaccccctcagcagttcccgtaccaaccgaactatgggatgggacagcaacccgatcctgctttcggtcgcgtgagttccccgccaaatgccatgatgtcttcgaggatggggccatcccagaatcccatgatgcagcatccccaagccgcaagcatctaccagtcttctgaaatgaagggctggcccagcgggaacttggcacgaaactccagcttttcacagcaacaattcgctcatcagggtaacccagcagtgtattccatggtgcacatgaatggatcttcaggtcacatgggacagatgaatatgaatccaatgcccatgagtggcatgccgatgggcccagaccaaaagtactgttag

SEQ ID NO: 233093 - DNA, 774 bp, Artificial Sequence
  Description of Artificial Sequence: Synthetic coding sequence
atgatggaagagggcgaggatcttcaatcttgcatgatctgcgtggcgagacgaattacaacaggggagcgcacttttccttctaaccctgagagtttcataactagacacgacctctccggcaaggtggtcaacattgacaccaattctctcagaagttcaatgcgaccgggattcgaagacatcatccgcaggtgcatccagcgattttttagccttaatgatggtcaatcatggtctcagaaaagacactatcaggaggcctatctgaatggccacgccgaaacccccgtttaccgatttagcctggctgatggcacaatagttacggcccagaccaagagcaaacttttccgaaatcccgtgactaacgatcgccacggatttgtaagcacccattttcttcagagagaacagaatggctacagaccaaatcctaacccagtgggccagggcatcaggcccccaatggcgggttgtaattcttccgtgggcggaatgtcgatgagccccaatcaaggtctgcaaatgccaagtagcagagcctatgggctcgcagaccctagcactacagggcagatgtccggcgctaggtacgggggaagttcaaacattgcaagcctgacccctggacccggtatgcagagtccaagttcctatcagaacaataattacggcctcaatatgtcatccccccctcacggcagtccgggattggcccctaatcagcaaaacattatgatcctccttgtaatcgtcggcgtacagcgttag

SEQ ID NO: 233094 - DNA, 864 bp, Artificial Sequence
  Description of Artificial Sequence: Synthetic coding sequence
atgaacacattccaggatcagtctggtagtagcagcaaccgcgaaccgctgctgcgatgcagtgatgctagacgtgacctggagctggccattgggggtgttcttagggctgaacagcaaatcaaggataacctgcgagaagtgaaagcccaaattcactcctgcatatccaggcatttggaatgcctgagatcacgcgaggtgtggttgtatgaacaggtcgatctgatctatcaactgaaagaagaaaccttgcagcaacaggcccagcagctttattcactcctcggtcagttcaactgcttgacccatcaactagaatgtacacagaacaaggacctcgctaaccaggtttcagtctgcctagagcgcctcgggtctctgactttaaagcctgaagattccaccgtgctccttttcgaagctgataccatcaccttacgacagacaatcaccactttcggatccctgaaaacgattcaaatccctgagcacctcatggcgcacgctagcagcgcaaacatcgggccatttcttgagaaacgtggctgtatctccatgcccgagcagaaaagcgcctccggtattgttgcggtcccattttccgaatggctgcttgggtcaaagccagcctcaggataccaggctccctatattccttctacggatccgcaggattggctgacgcagaagcagaccctggagaattctcagcaggaagtcctgctgaactctcccctgcaggaggaacataattttccaccggaccattacgggttgcctgccgtgtgcgatctgttcgcctgtatgcagctgaaggtagacaaggagaagtggctatacaggacccctctccaggtgtag

SEQ ID NO: 233095 - DNA, 1845 bp, Artificial Sequence
  Description of Artificial Sequence: Synthetic coding sequence
atgaacacttttcaagaccagagcggctccagttctaaccgggagcctctgctccgttgttcggatgcaaggagggacctcgaacttgcaatcggcggagtgctgcgcgctgagcagcaaatcaaagacaatctaagagaggttaaggcccaaattcactcttgtattagtcggcatctcgagtgcctgcgtagccgtgaagtgtggctttatgagcaagtggatctgatataccagcttaaggaagagacccttcagcaacaggcgcagcaactttattctctgctggggcagttcaactgtctgacccaccagctcgaatgcacccagaacaaggacttagctaatcaggtgtccgtgtgtctggaaagattgggatctctgacactgaagccagaagattcaaccgttctcctttttgaagccgataccattactcttcgccagacaattacgacattcggctccctcaagactatccagattccggaacacctgatggcccacgcctcttcggcaaacatcggtcccttccttgagaagaggggttgcatctctatgccagaacagaaatccgccagtggaatcgttgccgtgccttttagtgaatggctgctggggagcaagccagcatctgggtaccaggcaccttacataccgagtactgacccccaggattggctgacacaaaaacagaccctcgaaaattcccagacttctagtcgggcatgcaactttttcaacaatgtcggaggcaacctgaaagggctcgagaactggctgctgaagtccgaaaaaagcagctatcagaaatgcaattctcacagtactacctcgtcatttagtatagaaatggagaaagtcggggaccaggagctccccgaccaggatgagatggatctctccgattggcttgttacgccacaggagtcacataagctgaggaaacctgagaatggcagtagagagacctcagagaaattcaagctgctgtttcaaagctacaacgtcaatgactggctggttaagacggacagctgcaccaactgtcagggaaaccagccaaaaggggtggaaatagagaacttagggaatctgaaatgtcttaacgaccacttggaggctaagaaacctctttcgactccctctatggtcacagaagattggctcgtgcaaaaccaccaggacccatgcaaggtggaagaggtgtgccgggctaacgagccctgcaccagcttcgcagaatgcgtttgtgacgagaattgtgagaaggaagctctgtataaatggctgctgaaaaaagagggtaaagataaaaatggcatgcctgtcgagcccaaaccagagcctgagaaacacaaagactctctgaatatgtggctgtgccctagaaaagaggttatagagcagacaaaagcgcctaaggcgatgacaccatctaggatagcagattcatttcaggtcataaagaactcccctctctcagaatggctgatcaggcctccttataaggaaggttctcctaaagaagtgcccggaactgaggatcgcgctgggaagcaaaagttcaaatctccaatgaacacttcatggtgttcgtttaatactgccgactgggtccttcccggaaagaagatgggcaatctctcccaactaagttcaggagaagataaatggctcctgcgaaagaaagcccaggaggtcctcctaaattcacccctccaggaagagcacaacttcccacccgatcattatggactgccagctgtgtgtgacctgttcgcctgtatgcaattgaaagtggacaaagagaagtggctttacaggacacctcttcagatgtag

SEQ ID NO: 233096 - DNA, 1728 bp, Artificial Sequence
  Description of Artificial Sequence: Synthetic coding sequence
atgaacacattccaggaccaatccggatcttccagtaacagagaaccactgctcaggtgtagcgatgcgcgacgagacttggagctcgctattggcggagttctgcgggctgagcaacagatcaaggataacttacgggaggtgaaagcgcagatccattcctgtattagtcgccacctggaatgcctgcgtagtcgcgaggtctggctgtacgagcaggttgacctcatctatcagctgaaggaggaaacactccaacagcaggcccagcagttatacagcttactcgggcaattcaattgccttacacaccagctggagtgtacacagaataaggatttggctaatcaggtgtcagtatgcctagaacgactcggatccctgaccctcaagcccgaggacagcaccgttctgctttttgaagcagatacaatcactctgagacagacaattactaccttcggatccttgaagacaatacagattcccgagcatctcatggctcacgcctcttccgctaacatcggtcctttcctggaaaaacgtggctgtatctcaatgcctgaacagaagtcggcctctggaatcgtagccgtgccgttctctgagtggctattaggtagtaaacccgcaagcggttatcaagcaccctacatcccatcaacagacccacaggactggttgactcaaaaacagacattggaaaattcccagacctctagtcgggcttgcaacttctttaataacgtcggtggcaacctcaagggactcgagaactggttattaaagagcgaaaagagctcatatcaaaagtgtaacagccactctacaactagctcctttagtattgagatggaaaaagtaggggaccaagaactcccagatcaagatgagatggatttgtctgactggctggtcactccgcaagagtcacacaagctgaggaagcctgagaatgggtcaagagaaacaagtgaaaaatttaagttgttattccagtcttacaatgttaatgattggctggtgaagacggacagttgcaccaactgccaggggaaccagcccaaaggcgtagagatcgagaacctcgggaacttgaagtgtctgaacgatcacctggaggccaaaaagccactctccaccccaagcatggtaaccgaagattggttggtgcagaaccaccaggacccctgtaaagtggaagaggtatgtagggccaacgagccatgtacctcttttgcagagtgcgtgtgcgatgagaattgtgagaaggaggccctgtacaagtggttgctgaaaaaagaaggaaaagacaaaaacggaatgcctgtggagcccaaaccggaaccagagaagcataaggactctctcaacatgtggctgtgccctcgcaaagaggtgattgagcagacaaaagccccaaaggcaatgaccccaagtagaatcgcagacagtttccaggtgattaaaaacagccccctgtccgagtggctgattcgtcctccttataaagagggctcccctaaggaggttccagggaccgaggatagagccggaaaacaaaagtattaccttatccacctttatcggaggaacatcacaagcccccaaacaatcatggcctccctgcagtttgtgatcagcctgcccgtgtgctccctcaagctcataaaacggtcaggctacattgagttgctgtatcggtgcgagggtatggacaagagttag

SEQ ID NO: 233097 - DNA, 1845 bp, Artificial Sequence
  Description of Artificial Sequence: Synthetic coding sequence
atgaatactttccaggaccaaagcgggtcctcgtccaatcgcgaaccactgctgcgatgtagtgatgctaggagagatctggagctcgccattggaggagtactaagggcagagcagcagatcaaggacaacttaagagaggtgaaagctcaaattcactcatgtatctctcgtcacctagaatgcctacggtcccgggaggtgtggttgtatgaacaggtggacctcatctatcagctgaaggaagagacgttgcagcagcaggctcaacagctgtactccctactgggccaattcaactgtctcacacaccagctggagtgcacccaaaacaaagacctagctaatcaggtcagtgtctgcttggagcgcctgggtagtcttacattgaaaccggaagactcaactgtgctgctgttcgaggcggacacaataaccctgcggcagactatcactacctttggctctctcaaaacaatccagatccccgagcacctcatggcacatgccagctctgcgaatatcggaccattcttagagaagcgcggatgcatttcgatgcctgaacagaagtccgcttccggaatcgtagcggtcccattttccgaatggcttcttggctcgaaaccagcctctgggtaccaggcgccttacattccctctaccgacccccaggactggctgacccaaaagcagacactggagaactctcagacgtcctcccgtgcgtgtaattttttcaataatgtggggggaaatctgaaagggctggagaactggctgctgaagagcgaaaaaagtagttatcagaagtgcaacagtcactctactacttcttcattctctattgagatggagaaggtgggtgaccaggaacttcccgatcaagatgagatggacttgtccgactggctggtaacaccacaggagagccacaagctccgaaagcccgagaacggcagccgagagacttccgagaaatttaaactgctcttccagtcatacaatgtgaatgactggctcgtgaagacggatagttgtactaattgtcagggaaatcagcctaagggtgtcgaaatcgaaaacctcggtaacctgaagtgcctaaacgatcatcttgaggccaaaaagcctctgagcacaccctcaatggtgacggaagactggctggtgcagaaccatcaggatccatgcaaggtggaggaggtttgtagagcaaatgagccatgcactagtttcgctgagtgcgtctgcgatgaaaattgtgaaaaagaggccctttacaaatggctgctgaaaaaagagggaaaggacaagaatgggatgcctgtagagcctaaacccgagcccgagaagcacaaggactccctgaacatgtggttgtgccccaggaaagaggtgattgagcaaaccaaggcccctaaggccatgacacctagcagaattgctgatagctttcaggtgatcaagaattcgccgctgtctgaatggctcattagacccccatataaagagggctcccccaaggaggtacctggcaccgaagatcgggctgggaagcagaagttcaaatcacctatgaataccagctggtgcagtttcaatacggccgactgggtcctgcctggcaaaaagatgggtaacttgtctcagctgtcctccggtgaggacaagtggctcctcaggaaaaaagctcaggaagtgctcttgaattcacctctgcaggaggaacacaattttcctcccgatcattacggactgccagctgtatgtgatctgttcgcatgcatgcagctgaaagtggataaagaaaagtggctttaccggactccgctgcagatgtag

SEQ ID NO: 233098 - DNA, 1347 bp, Artificial Sequence
  Description of Artificial Sequence: Synthetic coding sequence
atggctcatgcaagctccgccaatatcgggcctttcctggaaaaacggggttgtattagtatgccagagcagaaatccgcttcgggtattgttgcagtgccattctccgagtggctgctcggtagcaagcccgcatctgggtatcaagctccttacattcccagcaccgatccacaggactggctgacccaaaaacagacacttgagaactcccaaactagttcgagagcatgcaatttttttaacaacgtcggaggtaatcttaagggcctcgagaactggttactgaagtcagaaaagagctcataccagaaatgcaatagtcactctaccacgtcatcgttctccattgagatggagaaggtaggagaccaggagctacctgaccaggatgagatggatctatccgactggcttgttaccccgcaggagtcccacaaacttcgcaaacccgagaatggctcaagggagacctccgagaaatttaagctgttgttccagtcctataacgtcaatgactggctcgtgaagacggacagttgcaccaactgtcaaggcaaccagcctaaaggtgtggaaattgaaaacttaggtaatttgaaatgtctcaatgaccacctggaagccaagaagccattgtcgactccaagcatggtgactgaagactggttggtgcagaaccaccaagacccatgcaaggtcgaggaggtctgtagagctaacgaaccgtgtacttcatttgccgaatgcgtctgcgatgaaaattgtgagaaggaggctctgtataagtggttactgaaaaaagagggcaaagacaagaacgggatgccagttgagccaaagcccgagcctgagaagcataaggacagtttaaacatgtggttatgcccgagaaaggaggttatcgagcagacaaaagcacctaaagctatgactcccagccgcattgccgacagcttccaggtgattaaaaactcccctctatcagaatggctcatacgacctccatacaaggaaggctccccgaaggaggtccccggtactgaggatcgcgctgggaagcaaaaatttaaatcaccgatgaacactagctggtgctcgtttaacacagccgattgggtgctgccaggaaagaagatgggtaacctgtcacaactgagcagcggagaggataaatggctcctgcggaaaaaagcccaagaagttctgctgaattccccactgcaggaggagcacaattttccaccagatcactatggcttgccagccgtctgcgatttgttcgcctgcatgcaactcaaggtcgacaaggagaagtggttatatagaaccccactgcagatgtag

SEQ ID NO: 233099 - DNA, 1545 bp, Artificial Sequence
  Description of Artificial Sequence: Synthetic coding sequence
atgaacaggtggacactgttcatcagcctcaagagaagacacttcaacagtagactgtctagctcaacacgtctgggcagcctaactctaaaaccagaggattccacagtgctgcttttcgaggctgacaccataactttacgacagaccatcactacctttgggtcattgaagaccatccagatccccgagcacttaatggctcacgcaagctcagccaacataggcccattcctggagaaaaggggctgcatcagcatgcccgaacagaagagtgcgagcggcatcgtagctgttcccttctcagagtggcttctcggctccaagcccgcttccggttatcaagcaccctatatcccaagtacggaccctcaggactggctcacccagaagcagacactggagaatagccaaacatcatcgcgagcatgcaacttctttaataatgtgggcggaaacctgaaggggctggaaaactggttgttaaagtccgaaaaatctagctatcagaaatgcaacagtcactctaccacttcatcattctctatagaaatggagaaggttggcgatcaggaactcccagaccaggatgagatggatctttccgattggctggtgacccctcaggaaagtcacaaactgagaaagccagaaaacggctcccgggagacctccgagaagttcaagttgctgtttcagagctacaacgtgaatgactggctcgtgaaaacagatagttgcaccaactgtcaggggaaccagcccaaaggagtggaaattgaaaatctgggcaatttaaagtgcctcaacgatcacctagaagccaagaagcccctatcgacaccaagcatggtgactgaggactggttggtccaaaaccaccaggatccgtgcaaggtggaggaggtgtgccgtgccaacgagccctgtacttcctttgctgaatgtgtctgcgacgagaattgcgaaaaggaggctctgtacaaatggttgttgaaaaaggaaggaaaggataaaaacggaatgccagtggaaccgaaacccgaaccagaaaagcataaggacagcctcaacatgtggctctgccctcgcaaagaggttatcgagcagacaaaggcgcctaaagctatgaccccttctagaattgcggactcatttcaggtcatcaagaacagccccctgagcgagtggctgatcaggccaccatacaaggaggggagccccaaagaagtgccgggaacggaagatcgcgctggcaagcaaaaatttaagtccccaatgaacacaagctggtgcagcttcaatacagccgattgggtgctgccgggaaaaaagatgggcaaccttagccagctgtcttctggcgaggacaaatggcttttgagaaagaaagcacaggaggtcctgcttaattctcccctgcaggaagagcacaacttcccgcctgaccattatggccttcccgcagtgtgcgatttgttcgcttgcatgcagctcaaagtggataaggaaaagtggctataccggactcctctacagatgtag

SEQ ID NO: 233100 - DNA, 795 bp, Artificial Sequence
  Description of Artificial Sequence: Synthetic coding sequence
tgatgcacacctgcttgggcagcagagttggattcagtgagtaaacaaaaaaaaaatccgaagcctacctttaaaaaaaaaactgaagagagaacctgtgaggttaagaaggtgagcagactcggctctctgacacttaagcctgaagactctacagtgcttcttttcgaagctgacaccatcactctgcgacagacaattaccaccttcggctctttgaaaaccatacagattcctgagcacctgatggctcacgcctcatcagctaatatcggtccattcttagagaaaaggggttgcatcagtatgcccgaacagaaaagcgcttctgggatcgtagccgtgccattctccgagtggttactggggagcaagcccgcttccgggtaccaagcaccatatataccctccacggacccacaagattggctgactcagaagcagaccctggagaattcccagacaagtagtagagcctgtaattttttcaataacgtcgggggtaacctgaagggcctcgagaactggctcttgaagtctgagaagagctcctaccagaagtgtaactcccacagtacaacgagttcgtttagcatcgagatggaaaaggtgggagaccaggagctgcccgatcaggatgagatggacctgtcggattggctggtgacaccccaagagtcgcacaaactgcggaaacctgaaaacgggtcgagggagaccagcgagaagtttaaattgctgttccagagctacaacgttaatgactggctcgtcaagacggacagctgcacctag

SEQ ID NO: 233101 - DNA, 1893 bp, Artificial Sequence
  Description of Artificial Sequence: Synthetic coding sequence
atgggagctcaacttacgaccttcgctctggccggtgcggtcagacgcatgaatacctttcaggaccagtctggttcctccagcaatcgagagcctttattgagatgctccgatgctcgacgcgacctcgaattggcaatagggggtgtcctgcgggctgagcagcagattaaggataatctgagagaggtcaaagcccagattcatagctgcatcagccggcacctggaatgcctccgcagtcgggaggtgtggctgtatgagcaagtggacctgatttatcaactgaaggaggaaactctgcaacaacaagcacagcagctttactcgctgctgggacagtttaactgccttactcatcaactggaatgcacccagaacaaggatctggccaatcaggtgagtgtttgtttggaacggcttggttcacttacactgaaacccgaggactccacagtattactgttcgaagcggatacaataacactaaggcagaccattaccacattcgggagcctgaagaccatccagatccccgaacacctgatggcacatgcaagttcggcaaatattgggccttttctggaaaagagaggttgcattagcatgcccgagcaaaaaagtgcaagcggtattgtggcagtccctttctccgaatggctgctggggtccaagccagcgagcggatatcaggcaccatacattccttctactgatccacaagattggctcacacagaagcagacacttgagaattcacagactagttccagggcttgcaatttcttcaataatgttggagggaacctgaaggggcttgagaattggctcttgaaaagtgagaaaagttcctaccagaagtgcaattcgcacagtactacatcatcttttagtatcgaaatggaaaaggttggagatcaagagcttccagaccaagacgaaatggatctatcagattggctcgtgaccccccaggagtcacacaaactcagaaagccagagaacggatcaagagagacctcggagaagttcaaattactttttcagagctataatgttaatgattggctggtcaaaacagattcttgcaccaattgtcaggggaaccagcccaaaggggtagagattgagaatctcgggaatctgaagtgtttgaacgaccatctcgaggccaagaagccgttgagcaccccctcaatggtgactgaggactggcttgtccaaaatcaccaggacccctgtaaggtagaagaggtgtgtcgtgctaatgagccgtgtacttcatttgcagagtgtgtgtgcgacgagaactgcgagaaggaggccttatacaaatggttgctaaaaaaagagggtaaggataagaacggcatgcccgtggaacctaaaccagagcctgaaaagcataaagactccctgaacatgtggctatgcccacgcaaggaggtcatcgaacagacaaaggcacccaaggccatgacgccaagtcgcatagctgattcctttcaggttatcaagaattccccactttccgaatggcttatcagacccccatacaaggaaggcagccccaaggaagtcccaggtacggaggacagggccggaaagcagaagtttaaatctcctatgaacacctcctggtgtagtttcaacacggcagactgggtcttacccggtaagaagatgggcaatctgagtcaattatcttccggtgaggacaagtggctgcttcgtaagaaggctcaggaagttctgctcaattctcccttacaggaggaacataacttcccccctgatcactatggactgccggcagtctgcgacctgttcgcctgtatgcaactgaaggtggacaaagaaaaatggctttacaggacacctctgcagatgtag

SEQ ID NO: 233102 - DNA, 1845 bp, Artificial Sequence
  Description of Artificial Sequence: Synthetic coding sequence
atgaacacatttcaagatcaaagcggatcatcctcgaatcgtgaaccgctcctgagatgcagtgatgccagacgagatctggaattagccatcggaggggtcctgagggctgaacagcagatcaaggacaatctgcgcgaggttaaggcccaaattcattcctgtatctctagacacctcgaatgtctcaggtcacgagaggtgtggctttatgagcaagtagacctaatttatcagctgaaggaggagaccctccagcagcaggctcagcagctatactccctactagggcagttcaactgcctgacccaccagctggaatgtacccagaacaaggacctggctaaccaggtttcagtttgcctggagcgtttagggtctctcactttaaagcccgaagatagcacggtcctcctgttcgaggctgatacaattactttgcgacaaaccattactacctttgggagcttgaagacgattcaaatcccagagcatctgatggcacacgctagttccgcgaacataggcccattcctcgagaagagaggctgtatctctatgccagagcaaaaaagcgcgagcggcatagttgcagttccttttagtgagtggcttctaggcagtaagcctgcctctggctatcaggcaccatacatcccgtcaactgatccacaggattggttgacccagaagcagaccctagagaacagccaaacaagctctagagcctgcaattttttcaataatgtcggagggaacctgaaagggctcgagaattggctgctgaaatctgagaaatccagctaccagaagtgcaactctcattccacaacttcttccttctctattgaaatggagaaggtgggggatcaggaactacccgatcaagatgaaatggatctttcagattggctggtcactccgcaggaaagtcataagttgcgtaaacctgaaaatggctcccgcgagaccagcgagaagttcaagctgcttttccagtcatataacgtgaacgactggctggtaaagacagattcctgtaccaactgtcagggcaatcaaccaaagggagtggagatcgagaatctgggtaacctgaaatgccttaacgaccacttggaagccaagaagccactgagcacaccttcaatggtgactgaggattggcttgtgcagaaccatcaagacccatgcaaggtggaggaagtgtgccgggcaaacgagccctgtacttcatttgcagagtgcgtatgcgatgagaattgtgagaaggaagctctgtataagtggctgctaaaaaaggaggggaaagacaagaatggtatgccggtagagcccaagcctgaacccgaaaaacataaagattcactgaacatgtggctgtgccctcgtaaggaggtgattgaacaaacaaaagcacccaaagccatgacgcccagtaggatcgccgattctttccaggttataaagaattcgccattgtcagagtggctgatccgcccaccatacaaggaggggtcgcccaaagaagtgccgggaaccgaggacagagcaggcaagcaaaagttcaaaagtcctatgaacacatcttggtgctcatttaatacagcagactgggtgctcccaggtaaaaaaatgggtaacctgagtcagctgtcatccggcgaagacaagtggctgcttcgtaaaaaggcccaggaggtgctgcttaactcccccctgcaagaagagcacaattttccccctgatcattacggccttcccgctgtgtgtgatctgttcgcctgtatgcagctgaaagtggataaagagaaatggctctacagaactcctttgcaaatgtag

SEQ ID NO: 233103 - DNA, 1953 bp, Artificial Sequence
  Description of Artificial Sequence: Synthetic coding sequence
atgggcgctcaactgaccacattcgcactggcaggcgcagtgagaaggatgaatacctttcaggaccagtctggtagctcatccaatcgcgagccgctgctgaggtgctccgacgctagaagagatctggagcttgctatagggggagtgcttcgcgcagagcaacagatcaaagataatttgcgcgaggttaaagcccagatccactcctgcatctcccgccatttagagtgcctgagatccagggaagtttggctgtacgaacaggtcgatttgatataccagttaaaggaggagaccttgcagcagcaggcccaacagctttatagcctcctgggacagtttaactgtctaactcatcaactcgaatgcactcagaacaaagatctggctaatcaggtttccgtctgcctcgagaggttgggtagtctcactctaaagccagaagattctacagtgctcctgttcgaggccgataccatcacactccggcagaccatcacaacgttcggctctctgaagactatccagattcctgagcatctcatggcccacgcatctagcgcaaatatagggccatttctggagaaacggggttgcatcagcatgcctgagcagaaatccgcttctggaattgtggcagtgccatttagcgaatggctcttgggtagtaagcctgcctcaggctaccaggcaccgtacataccctcgaccgatccccaagattggctcactcagaaacagacgctcgaaaactcccagactagctccagagcttgcaatttttttaacaacgtgggcggtaatctgaaaggcttagaaaattggctgctgaagagcgaaaagtctagttaccagaagtgtaattctcacagcacgactagttccttcagcatcgagatggaaaaggtcggtgaccaggagctgccggatcaggacgagatggacttaagcgattggttggtcactccccaggaatcccacaagctcagaaagcctgaaaacggatcccgggagacctcagaaaagttcaagcttctgtttcagtcctacaatgtgaatgattggctggtgaagacggattcttgcacaaactgtcaaggtaatcagcccaagggcgtcgagattgagaacctggggaatctgaaatgtctgaacgaccacctggaggctaaaaaacccctatctacaccatctatggtgaccgaggactggctggtgcagaaccaccaggatccctgcaaagtcgaagaggtttgtagagccaacgagccttgtacgtcctttgccgagtgcgtgtgcgatgaaaactgtgagaaagaggccctgtataagtggctgcttaaaaaagaagggaaggacaagaatggcatgcctgtggaaccgaagcctgagcccgagaagcacaaagatagtctcaatatgtggctctgtcccaggaaagaagttattgagcagacaaaagccccaaaagctatgaccccaagtagaatcgccgatagctttcaggtcattaagaacagtccactgtccgagtggctcattaggccaccctataaggagggaagtcccaaggaggtccccggaacagaggacagggctggaaagcagaagtttaaatcacctatgaacacgtcatggtgctcgtttaatacagcagattgggtacttcctggcaaaaaaatggggaacttgagtcagcttagctcgggtgaagataaatggcttctgagaaaaaaagcccaggaagtgctactgaattcgcctctccaggaagagcataactttccgcctgatcattacggtttacctgccgtttgtgatctgtttgcctgtatgcagctaaaagttgataaagaaaagtggctctaccgcaccccccttcaggcttactttaagatgaacttccaggacgtcacagtgggaaattttcagattccttgtggcttttag

SEQ ID NO: 233104 - DNA, 6191 bp, Artificial Sequence
  Description of Artificial Sequence: Synthetic coding sequence
atggtcctggatgacctgcctaacttggaggacatctacacgagtctgtgttcatctacgatggaggattccgaaatggattttgattccggcctagaagatgacgataccaagagtgactcgatcctggaggacagcacaatcttcgttgcttttaagggcaatatagacgacaaggactttaagtggaagttggacgcaatcttaaagaatgtgccgaacctgctccatatggagtcttccaagctgaaggtccaaaaagttgaaccttggaatagcgtgcgtgttacctttaatattccacgggaggcagctgagagactcaggatccttgctcagtctaacaatcaacagctcagagatctcggaattctttctgtgcagatcgagggggaaggggcaatcaatctggccttggctcagaatagatcccaggatgtaagaatgaacggccctatgggggcagggaattctgtgcgcatggaagcaggattcccaatggcctccggtccgggaattattcgcatgaacaatcctgcaactgtgatgattcctccgggtggcaatgtgtcctcctccatgatggcccctggccctaacccggagctacagccacgtacgcctaggccagccagccagtcggacgcgatggatccactgctgtctggccttcacatacagcaacagtcacacccatctggatccctggccccaccacaccatccgatgcaaccggtgtccgtgaaccgccagatgaacccagccaacttcccccaactgcagcagcagcagcagcagcagcagcagcagcagcaacagcagcaacagcagcagcagcagcaacagcaacagcagctgcaggctcggccacctcagcagcaccagcagcagcagccccagggcattaggcctcagtttacggcacccactcaggtgcctgtgcctcccggatggaaccaattgccgagtggcgcattgcagccaccaccagcacagggtagtctgggcacaatgactgcaaatcaaggctggaaaaaggcaccactccctgggcctatgcagcagcaacttcaggctaggccttcgctcgcaaccgtgcaaaccccaagtcatccacctcccccatatccattcgggtctcagcaggcgagtcaggcccacaccaattttccacaaatgagcaacccaggtcaatttacggcccctcagatgaagtctcttcagggcggaccaagtcgggttccaaccccgttgcaacagcctcatctgaccaacaaaagcccagcatcaagcccttcaagcttccagcaaggctcccccgcaagttcccctactgtcaaccagacacagcagcaaatgggcccacgcccaccacagaacaatcctttgcctcaggggtttcaacagccagtcagtagcccaggcaggaatcctatggtgcaacaaggaaacgtgccccctaacttcatggtaatgcagcagcagcccccaaaccaaggcccacagagtctacatcctggactcggcggaatgccgaagaggcttcctcccggttttagcgccggtcaggctaatcctaacttcatgcaaggccaggttccaagcacaaccgccaccacacccggtaattctggcgctccccagctgcaggccaaccagaatgtccagcatgcgggaggccagggagccggtccccctcagaatcagatgcaggtctctcacggacctcccaatatgatgcagccgtcactgatgggcattcacggtaatatgaataatcagcaggccggaaccagcggcgtgccccaagtgaatttgtctaacatgcaaggacaaccgcaacaaggccctccaagccaactaatgggaatgcatcagcaaatagtgcctagccagggtcagatggttcagcagcaaggtacccttaaccctcagaatcctatgatcctttctagagcccagctgatgccccagggacagatgatggtcaacccgcctagccaaaacctggggccttcgcctcaacgcatgactccacctaagcaaatgctgtctcagcaggggccacagatgatggcgcctcataatcaaatgatgggaccacagggccaggtgctgctccagcagaacccaatgattgagcagataatgaccaatcagatgcagggtaataagcaacagtttaacacccaaaaccagagtaacgtgatgcccggtccggcacagattatgcggggtcccacgccaaatatgcaagggaacatggtgcagttcacgggtcagatgtccggccagatgcttccccaacagggtccagttaacaattcaccgtcacaggtgatggggatccagggacaagtgttgagaccgccagggccttcccctcacatggcccagcagcatggcgacccagccacaacggcaaacaatgatgttagcctcagccagatgatgcccgatgtttctatccaacaaactaacatggtccctccacacgtgcaagccatgcaaggcaattcagcttctggcaaccacttttccggccacggcatgtcatttaatgcgccttttagcggtgctccaaatggtaaccagatgtcatgcggccaaaaccctggcttccctgtcaataaggatgtgacactcaccagccctcttctggtgaacctgttacagagcgacatatccgccggacatttcggggtaaataacaaacagaataatacaaacgccaacaaaccaaaaaagaagaaaccgccaagaaagaagaagaactctcaacaggacttgaacacaccggatacccgtcctgccggattagaggaagcagaccagcccccactgcctggagaacagggaatcaatcttgacaacagtggtcccaagttgcctgaattttcaaacaggcctcctggctaccctagccagccagtggagcagcggccactgcagcagatgccgcctcaactgatgcagcacgtggcaccaccgccacagccgccacagcagcagccacagccccagctacctcagcaacaacaaccgccacctccatcacaaccacagtcccagcagcagcagcagcagcagcagcagatgatgatgatgttgatgatgcagcaggatcccaaatcggtcagactccccgtaagccagaacgttcatccccctaggggcccactcaatcccgactcgcagaggatgccgatgcagcagagtggttcagtcccagtcatggtgagtctccagggccctgcttccgtgcctcccagtcctgacaagcaacggatgcctatgcccgtcaacaccccattaggctccaattctcgcaagatggtgtatcaggagtcaccacagaatcctagctcgtctccgctggccgaaatggcatctcttcctgaggcctcaggatccgaggcaccatccgtgcctggaggacccaacaacatgcctagtcatgttgtgctccctcagaaccagctgatgatgactgggcctaagccaggccctagccccctgagcgccacccagggcgcaacgcctcagcagccgcctgtgaacagcttgccatcatctcacggtcatcacttcccaaatgtggcggcaccaacccaaactagccggcctaagacaccaaacagagcgagtccgaggccctattacccccagacaccgaataaccggcctccttctacagaaccctctgaaatatcattgtccccagaacgcctgaacgcaagtatcgccggactgtttccgcctcaaattaacattcccctaccccctcgccctaacctgaaccgcggatttgatcagcaggggctcaatcctacaacacttaaggcaatcgggcaggcccctagtaatttaacaatgaacccctctaatttcgcaacaccccagacacacaagctcgactctgtggtcgtgaattctggcaagcagtcgaattccggtgccaccaagagggcatctcctagcaacagccggcgatcgtcaccaggtagttccaggaagactaccccaagcccagggagacagaattcaaaagccccaaagcttaccctggccagccagacaaatgccgctctcctgcagaacgtggaactgcccaggaacgtccttgtctctcctacgccacttgcgaatccccctgtccctggatccttccctaacaattctggtctgaacccccagaactctaccgtttctgtggcagccgtgggcggtgttgtggaggataacaaggagtcacttaatgtaccacaggactccgactgtcagaattctcagtcacggaaggaacaggttaacattgagcttaaggcggtgcctgcacaggaagtgaagatggttgttcctgaagaccagtccaaaaaggacgggcagccttctgaccccaataaactgcctagtgtggaggagaataagaatctggtgtccccagctatgcgcgaagcacccacgtccttaagccagcttcttgacaactccggcgctcctaacgtaacaatcaaacccccaggcctcacggacctcgaggtgactccccctgtggtgtcaggcgaggacctgaaaaaagcatcagtgatccccacacttcaggatctaagcagtagcaaagagccctccaacagcctgaatcttccccactcaaatgagctatgctccagcctggtgcaccctgaactatctgaggtgtccagcaacgtggctcccagcatccctcccgtgatgagtaggcctgtgagcagtagcagtatctcaactcctctcccacccaatcagatcaccgtgttcgttacgtctaatcccattacaaccagtgccaatacatcggcagctctgcccacacacctgcagagtgctctcatgagcaccgtagttacaatgcctaatgctggatcaaaggttatggtcagcgaaggccagtcagcagcccagagcaacgctcgccctcagttcatcactccggtgttcatcaattcttcctctatcatacaggtcatgaaggggtctcaaccaagcacaattccggctgctcccttgacaaccaattctggtctaatgccgccttctgtcgctgtagtcggaccccttcacattcctcagaacatcaaattcagtagcgcgcctgtacctcctaatgcactctcatcttcacccgctcccaatatacagacgggacgccctttggtgcttagctctagagccactccagtgcagctccctagcccaccatgtacttcttctcctgtggtacctagtcaccctcctgtccagcaggtgaaggagctcaatccagacgaggcgagccctcaagttaacactagtgccgatcagaacaccctgcctagctcacaatcaacaacaatggtgagcccactgttgactaatagcccagggtcctcaggtaatagaagaagtcccgtgagctcttcaaaaggcaaaggcaaagtcgacaaaattggccaaattctgctgaccaaggcgtgtaagaaagtcactggctccctcgaaaagggcgaagaacagtatggcgcagatggggaaaccgaggggcaaggtcttgatacaacagccccaggtctgatgggcactgaacagttaagcactgagctggacagtaaaacccctaccccccctgcaccaaccctcctgaagatgacctcgtcgccagtcgggcctggcacagcatccgccggaccctcactgcccggaggcgcactgccgacctctgtaagatcgatcgtgactaccctggtcccttcagaactcatatccgcagtgcccaccaccaaatcaaaccacggcggaattgcctcagagtccctcgcaggcggattagtggaagaaaaagtcgggtcccaccccgagctgctaccatctattgcgccaagccaaaaccttgtgtcaaaagagacgtccaccacagcgcttcaggcctcggtggccagacctgagcttgaggtcaatgctgccatcgtatctgggcagtccagcgaacccaaggagattgtcgagaagagcaaaattcctggcaggcgtaactcgaggactgaagagcctaccgttgctagtgagtccgtcgagaacggacacagaaagagatcatctcgaccagctagcgcctctagttccacaaaggacatcacctcagcggtgcagtccaaaagaagaaaatctaaata

SEQ ID NO: 233105 - DNA, 6191 bp, Artificial Sequence
  Description of Artificial Sequence: Synthetic coding sequence
atggtgcttgacgatctccccaacctggaggacatttacacgtccctttgtagcagcacaatggaagacagcgaaatggacttcgactctggcctggaagatgacgacaccaagtccgacagcatactggaggacagcaccatttttgttgcattcaaggggaatatcgacgacaaagatttcaagtggaagctggacgcaattctgaagaatgtgcccaatctgctccacatggagtccagcaaactgaaagtccagaaagtggagccatggaattctgtcagagtgactttcaatatccctcgcgaggccgctgagagactacgcatccttgcccaaagcaacaatcaacagcttcgggaccttggcattcttagtgtgcaaattgagggagaaggcgcaatcaatctggctctagcacagaacagatctcaggatgttcggatgaacggcccaatgggtgctggcaattcagtacgaatggaggctggctttcctatggcgtctggaccaggaattatacgtatgaataacccagctacagtgatgatacctcccggaggcaacgtttcctcatccatgatggcacccggtccaaacccagagttgcagcctcgaactccacggccagcctcccagtctgatgccatggaccctttgctctccggactacatattcaacagcagtctcatccaagtggctcactggcccctccacatcatcccatgcagccagtttccgtgaaccgccagatgaaccccgctaacttcccccagttgcagcagcaacagcagcagcagcagcagcaacagcaacaacagcaacagcagcagcagcagcaacagcagcagcagttgcaggcacgccctccccagcagcaccaacaacagcagcctcaggggataaggccccagttcacggcacctacccaggtcccagtgccacccggatggaaccagctcccaagcggagccctgcagccgcctcccgcacaaggaagtctcgggacaatgaccgcaaaccagggatggaagaaggcccctctgccaggccctatgcaacaacaactgcaagcacggccaagcctggccaccgtgcagacacccagccacccaccccctccttatccgttcggtagccagcaggcatctcaggcgcacaccaactttccacagatgagcaaccctggccaatttaccgcccctcagatgaaatccctgcaggggggaccttcaagagtgcccacccccctccaacaacctcatctcacaaataagtctccagccagctccccctccagcttccagcaaggatctccagcctcttctcccactgtgaatcagactcagcaacagatgggccctaggcctccacagaataatcctctaccccagggatttcagcagcccgtgtcatcacctggcagaaatcccatggtgcaacagggtaatgtgcccccaaacttcatggttatgcagcagcaacctcccaaccagggaccgcaatctctccacccaggcctgggcggaatgcctaaaagacttccgcctggattcagtgctggacaggctaaccctaatttcatgcagggccaggtccctagcacgaccgcaactactcccggtaacagcggggcaccccaactccaggccaaccagaatgttcagcatgcgggaggccagggggcaggccctccccagaaccagatgcaggtgtctcacggtccccctaacatgatgcaaccatctttaatgggcattcatggcaacatgaataaccagcaggcaggcacctcaggcgtcccccaagtcaacctgagcaacatgcagggccaaccacagcaaggtcccccatctcagctgatgggcatgcatcaacagattgtgcctagccagggccaaatggtccagcagcagggcaccctaaatccccaaaaccccatgatcctctcaagagcacaactgatgccacagggtcaaatgatggttaatccgccttcccagaatttaggacccagcccgcagcgcatgactccacccaagcaaatgctgtcccagcagggccctcagatgatggccccacacaaccaaatgatgggcccacagggacaagtgctcctccaacagaacccaatgatcgaacagataatgaccaatcagatgcaggggaacaaacaacaatttaacacccagaaccagtctaacgtcatgcctggccctgctcagattatgcgagggccaacccccaatatgcagggtaacatggttcagttcacaggccagatgtcgggccagatgcttccacagcagggacctgtcaacaattcacccagccaggtcatgggcattcaggggcaggttctcagaccccctggcccttccccccacatggcccagcagcatggtgatccagccaccactgctaacaacgacgtatctttatcccagatgatgcccgacgtgtcaattcagcagactaatatggtgcctccccacgtgcaagctatgcagggaaacagcgcctccggcaaccatttctctgggcatgggatgagtttcaacgcaccattctctggtgcaccaaatggaaatcaaatgtcatgtggccagaacccaggcttccccgttaataaagacgtcacattgactagcccactgctggtgaatcttcttcagtcagatatctctgccggtcattttggggtgaataacaagcagaacaatacgaatgctaataagccaaagaagaagaagcctccacgtaaaaagaaaaacagtcaacaggatctgaacactccagatacgcgccctgctggacttgaggaggccgaccagccaccactgcccggagagcagggcattaacctggataatagcgggcctaaattacccgaattctctaacaggccacctggctatccttctcagcctgtggaacagcgtcctctccagcagatgccgcctcaattgatgcaacatgtcgctcccccaccacagccgccacagcaacaaccccaaccccagctcccccaacaacaacagccgccacccccatcacagcctcaatcccaacaacagcaacagcaacagcagcaaatgatgatgatgctgatgatgcagcaggatcctaagtccgtcagactgcccgttagccagaacgtccatcctcctcgaggcccattaaacccagatagccaacgcatgcccatgcaacagtctggttctgtacccgtcatggtgagcctacaaggacccgcttccgtgcccccttccccagacaagcagaggatgccgatgccagttaacaccccgctgggtagtaatagccgtaagatggtgtaccaggaatctcctcagaatccctcttcatcgccgctggcagagatggcctcactcccagaagcttccgggagtgaggcacctagcgtgccagggggtcctaataacatgccctcccacgtcgtcctaccacagaaccagctgatgatgacaggccctaagccaggaccatctccgctctctgcgactcagggtgctacaccacaacagccccctgtaaatagcctgccatcaagccatgggcatcatttcccgaacgtggctgctcccacgcagacatccaggcccaagaccccaaaccgggcttctccacgcccttactacccccagacccctaacaatcgtccaccaagcactgagccttctgaaattagtctgagccccgaacggctgaatgctagtattgctgggctgttcccgcctcagataaacatccctttgccaccacggccaaatttgaacaggggcttcgaccaacagggactgaacccaactacacttaaggctatcggacaagccccttccaacttgacgatgaaccctagcaatttcgcaaccccacaaacacacaagctcgatagcgttgtggttaacagcggtaaacaaagcaattcaggggctaccaaacgagcatccccttctaactcgagacgttcatcccctggatcatctagaaaaactacgcctagccctggtaggcagaactccaaagcacccaaactaaccctcgcatcacagactaatgctgccctgctgcagaatgtggaattgcctcgaaatgtactggtgagtcccactcccctggccaatcctcctgttccgggatcattccccaacaatagcgggctcaatccgcagaactccacggtcagcgtagcagcagtgggtggggtggtcgaggacaacaaggaaagtctgaatgtcccccaggacagtgattgtcagaattcccagagtaggaaagagcaggtgaatatagaactcaaagctgttcccgctcaggaagtgaagatggtggtgcctgaggatcagtcaaagaaggatggacagcctagtgatcccaataaactgccatctgttgaagaaaataagaaccttgtgtcgccggctatgcgagaagcaccgaccagtctcagccaattactcgacaacagtggtgccccaaatgttactatcaaaccaccgggattaaccgatctggaagtcacacctccggtggtttcgggcgaggatctaaaaaaggccagtgtgatccctacgttgcaagatttgagctcaagcaaggaaccaagcaattccttaaatctccctcattccaacgagctatgtagcagtttggtccatccagaactgtccgaggtgtcatccaatgtcgccccttccatcccccctgtcatgagcaggcctgtttcctcttcttctataagtacgcctttgccccctaaccagataaccgtgttcgtcacctcaaatccgattacaacatctgccaacacatctgccgctctccctacacacctgcagtctgcactgatgtctaccgtggtgaccatgccgaacgccggatcaaaggtcatggtgtccgagggccagtctgctgcgcagagtaacgcgcgtccccagtttattaccccagtctttataaattctagtagcatcattcaagtcatgaaaggctcacagccatccaccattccagctgccccactgaccaccaacagtgggcttatgcccccatcagtcgccgtcgtggggcctctccacattccacagaatatcaaatttagcagtgcacccgtgccgcctaacgcactctcctcgtcacccgcacccaatattcaaacaggcagaccgctggtgctttcctcccgtgctacacctgttcagctaccaagcccaccctgtacaagtagccctgtggtccctagtcatccgccagttcagcaggtgaaagagctgaacccggatgaggcttcacctcaagtgaacacatccgccgaccaaaatactttaccatcctcgcaaagcacaactatggttagccccttgctaaccaattcgcctgggagctccgggaatcgaaggtcccccgtgagctcttccaagggaaaaggtaaagtcgataagatcggacagatcctgctcaccaaggcatgtaagaaggtcactggctctctggagaagggtgaggaacagtacggggctgatggggagacggaggggcagggtttagatacaactgctccaggtctaatgggaactgagcagctgagtactgagctagattccaaaacccctacccctcctgcccctaccctgttgaagatgacttcctcacccgtgggaccgggtacagcatcagcagggccatccctaccaggcggagccctccccaccagcgtccgtagcatcgtcacgacactggtgccttcagagctcatatccgccgtgcccactaccaaatctaaccacggaggtattgcgtccgagagccttgccggagggctcgttgaggagaaagtcgggtctcacccagaattacttccttctatcgcaccctcccagaaccttgtgtccaaggagaccagcacgactgccctccaagcgagtgtggctaggccagaactggaggttaatgccgctattgtttccggtcagtccagtgagcctaaggaaatagtcgaaaaaagcaagatcccaggcaggcgaaactcacgaaccgaggaacctaccgtagcttctgaaagcgtggaaaatggacacagaaagaggagctccaggcccgcaagtgcatcttccagcacaaaggacatcaccagcgccgtccaatcaaaacgcagaaaatcaaaata

SEQ ID NO: 233106 - DNA, 1086 bp, Artificial Sequence
  Description of Artificial Sequence: Synthetic coding sequence
atggttctggacgacctacctaatttagaggatatctacacatccctctgtagctccactatggaggattcagagatggatttcgattccggcctcgaggatgatgatactaaaagcgactcaatactggaagatagtacaatttttgtcgcgttcaaaggaaacatcgacgacaaggattttaagtggaagctggatgcaattctgaagaacgtgccaaatctgctgcacatggaaagttctaaactgaaggtacagaaagtggagccctggaactcggttagggtgacctttaatatccccagagaagcggctgagcgactcagaatcttagcccagtctaacaaccaacaactccgagatctggggatcttaagcgtacagattgagggcgagggggctatcaacctggcattggcccaaaatcggagccaggatgtacgaatgaacggcccaatgggtgccggaaacagcgtccggatggaggccggattccctatggcgtcaggccctgatgccatggatccccttctttcaggcctgcatatacaacagcagtctcatcccagtgggagcctggcgccaccccatcatccaatgcaaccagtcagcgttaatcgtcagatgaaccccgctaattttccccagctgcagcagcagcagcagcaacagcagcagcagcagcagcagcagcagcagcaacagcaacagcagcagcaacagcagttgcaggcccgaccaccccagcaacaccagcagcagcagccccagggtatccgaccacagttcactgctcctacacaggttcccgtgcctccgggttggaaccagctgccctctggggctctgcagccacctcctgctcaagggagtttaggaacgatgacagcgaaccagggttggaagaaagctccgctccctggtccgatgcagcagcagctgcaggcccgtcccagcctcgcgacggtgcaaactccaagccaccccccacctccgtaccctttcgggtcacagcaggcgagccaagcgcacactaacttcccccagatgtctaaccccggacaatttaccgctccccaaatgtag

SEQ ID NO: 233107 - DNA, 549 bp, Artificial Sequence
  Description of Artificial Sequence: Synthetic coding sequence
atggccgaggagcaggtgaatcggagcgccggtctggccccagattgtgaggcttctgccaccgctgaaaccaccgtgagctccgtggggacctgtgaagcagcaggcaaatcccctgagcctaaggactatgactccacatgcgtgttttgccggattgcaggaagacaggatcccggaaccgagcttctgcattgcgagaatgaagacctgatctgttttaaggatattaagcctgccgcaacacaccattatctggtggtccccaaaaaacatataggaaattgtaggactctccgtaaggaccaagtggagctggtcgagaacatggtgacagttggaaaaacaatccttgagcggaacaactttacggacttcactaacgtgaggatggggtttcacatgccgcctttttgtagcatctctcacctgcatctgcacgtactagctcctgtggatcagcttggatttctgagcaaattagtgtaccgtgtcaattcctattggtttataaccgctgatcacctgatcgagaagctcaggacctag

SEQ ID NO: 233108 - DNA, 552 bp, Artificial Sequence
  Description of Artificial Sequence: Synthetic coding sequence
atgggcgctgcccattccgtttgggaagtggaccacctgtatacgttctttgttcagtggagcccggacgtgtacggaaaagatgctaaagagcaaggatttgtggtagtggaaaaggaggagctgaacatgatcgacaactttttctcagaacccactactaagtcctgggagatcatcactgtggaggaggccaagcgaaggaagagcacttgttcttattacgaggatgaggatgaggaagtccttcctgtgctgcgaccacactctgccctcctggaaaacatgcacatagaacagctggcacgtagattgccggctcgggtgcaaggctatccctggcgactcgcttatagcactctggaacatgggacctcacttaagaccctttataggaaatctgcatccctcgattcgcccgtattgctggtgattaaagatatggataaccaaatcttcggagcttacgcaactcacccctttaagttctccgatcactattacggcaccggcgaaacatttctctacaccttctctcctcatttcaagtag

SEQ ID NO: 233109 - DNA, 2829 bp, Artificial Sequence
  Description of Artificial Sequence: Synthetic coding sequence
atggataccaaggaggagaaaaaggagaggaagcagtcatacttcgctcgcttgaagaagaagaaacaggccaagcaaaacgccgaaacagccagcgctgtggctacacgcactcacaccggcaaagaagataacaacacagtagtattggagcccgataagtgcaatatagctgtggaggaagaatatatgacagacgagaaaaaaaagcggaaaagcaatcagctgaaagagattcgccgaacagaactgaagaggtattattccattgacgacaaccagaacaagactcacgataaaaaggaaaagaaaatggtagtgcagaaaccccacgggacaatggagtacacggcaggcaaccaggacaccctgaactcaatcgctctcaaatttaatattacacctaacaaactcgttgaactgaacaagctgtttactcacactatcgtccctggacaggtcctattcgtccccgatgcaaatagtccgagttctacgttaagactctcatcttcgtctccaggggctactgtgtcaccttcatcttctgatgcagagtatgataaattacccgatgctgatttagcccgaaaagcactgaagcccattgaacgggtgctgtcaagtactagcgaggaggacgagcccggtgtggttaagtttctcaagatgaattgtcgctactttactgacgggaaaggcgtggtaggtggtgtgatgatcgtcactccaaataacataatgtttgatccacacaagagcgaccctctcgtgatcgagaatggctgcgaggaatacggcctgatctgccccatggaggaggtggtgtctatcgccctgtacaatgacatttctcacatgaaaatcaaggatgcgcttccctctgaccttccgcaagacttgtgcccactttatagacccggagaatgggaggacctcgcaagcgaaaaggacattaaccccttctctaagtttaaatctatcaacaaggaaaagcgccagcagaatggagagaagattatgacttcagatagcaggcctatcgtccccctggaaaaaagtacgggtcacacccctaccaaaccgagcggttctagtgtctccgaaaaattaaaaaaattggatagctcaagagagactagccacggaagtcccacggttacaaagctctcaaaggagcccagtgacacttcaagtgcctttgaatcaaccgctaaggaaaatttcctgggtgaggacgacgatttcgttgatctagaagaactctccagtcagacaggaggcggtatgcacaagaaagacacattaaaggagtgcctctcactggaccctgaggagcgaaagaaagccgaatcacagatcaacaattccgctgtggagatgcaagtccagtctgctttagcgtttctgggaactgaaaacgatgtggagcttaagggcgcactggatctcgaaacttgcgagaaacaggacattatgcctgaagtggacaaacaatccggtagcccagagtcacgggtcgagaacacgctgaatatacatgaagaccttgacaaggtgaaactgatcgaatactatctgacaaagaacaaagaggggccacaggtctccgaaaatctccaaaagacggaactttctgatggcaagtctattgagcccggtggcattgatatcactttgtcctccagcctttcccaggctggcgacccaatcactgaagggaataaagaaccagataaaacatgggttaagaaaggcgaacctctgcccgttaaattgaactcgtccacagaggctaacgtcattaaggaagccttggattccagcctggaaagcacccttgacaactcctgtcaaggtgcccagatggataacaagagcgaggttcagttgtggctgttaaagagaattcaagtacccatagaggacattttaccaagtaaggaagaaaaatcgaagacccctccaatgtttctgtgtattaaggtggggaaaccaatgcggaaatcgtttgctacgcacacggcggctatggttcagcagtacgggaagcgcagaaagcagcccgagtattggttcgccgtgccacgagagagggtcgatcatctgtatactttctttgttcaatggtcacctgatgtttacggcaaagacgcaaaagagcagggctttgtcgtggtggaaaaagaggaactgaatatgatcgacaacttcttctcggaacccaccaccaaatcatgggagatcattactgtggaagaggcgaagcgcaggaagagtacatgctcatattacgaggacgaggacgaggaggtgcttccggtgcttcgccctcactcggcactcctggaaaacatgcacattgagcagctcgcccgtaggttgcccgcacgcgtgcagggatacccctggaggctggcatatagcactctcgagcatggcacttccctcaaaaccctctaccgcaagagcgcgagccttgattcccccgtcctcctcgtaatcaaggacatggacaatcagatctttggtgcctacgccacccatcccttcaagttctctgaccactattatgggacaggggagaccttcttgtacacatttagccctcacttcaaggtttttaagtggtcaggtgagaacagttacttcattaacggagacatttcgtccctggaactcggcggaggaggtggcagatttggactatggttggatgcggacctatatcatggtcgcagcaacagctgtagtacctttaacaacgatattctgagcaagaaagaagacttcatagtgcaggatttggaggtgtgggctttcgattag

SEQ ID NO: 233110 - DNA, 2829 bp, Artificial Sequence
  Description of Artificial Sequence: Synthetic coding sequence
atggatactaaggaggagaagaaagagagaaaacaatcctatttcgctagactcaaaaagaaaaaacaagccaaacagaacgccgaaactgcctcggctgtggcaaccagaacacataccggcaaggaagataataacacagtggtgcttgagcccgacaaatgtaatattgcagtggaagaggaatacatgaccgatgaaaagaaaaagcgcaaaagcaaccagctcaaggaaattcgcagaaccgagctgaaacgttactatagtatcgacgataatcagaataaaacccatgataaaaaggaaaaaaagatggttgtacagaagccccacggcaccatggagtatacagcagggaatcaggatacacttaacagtatcgctctgaaatttaacattacccccaataagctggttgagttgaataaattgttcacccacaccatcgttcccggacaagtgctattcgtcccagatgccaacagtccgtcatctacactgcgattatccagtagcagccctggagcaacagtcagtccctcatcttccgacgccgagtacgataaactccctgacgccgacctggcacggaaagccttaaagcccatcgagagggtcctttcctcaacctctgaagaagatgagcctggcgtggtaaaattcctcaaaatgaattgtaggtattttactgatggaaagggagtggtgggaggcgtgatgatcgtgacccccaacaacataatgtttgatcctcataagagcgacccacttgtgatcgaaaatggatgtgaagaatacggcctcatctgccctatggaagaagtcgtaagtatcgcgctctataatgatataagccacatgaaaattaaagacgccctgccgtccgatctgccacaggacctgtgtccactgtacaggcctggtgagtgggaggatttggcatcagagaaagacattaacccatttagcaaattcaagtctatcaacaaagagaaacgccagcagaacggagagaagatcatgacttcagacagccgccctattgtcccactcgaaaaatccaccggacacacccctacaaagccctccggttcttccgtgagcgagaaactgaagaagcttgacagcagcagggaaacgtcacacggcagtcctacggtgacaaagcttagcaaagagccaagcgatacgtccagcgcgtttgagagtacggccaaggagaactttctgggcgaggacgacgatttcgtggatctcgaagaattgtctagccagaccggcggtggaatgcataagaaggatacgctgaaggagtgcctgagcctggatcctgaagaacgtaaaaaggcagaaagccagatcaacaactccgccgtggaaatgcaggtacagtccgcccttgccttcctcggcactgagaatgacgtggagctcaaaggtgcactggacctggaaacttgcgaaaagcaggatataatgccagaggtagacaaacagtcaggaagccccgagtcaagggtggagaatacactgaacatccacgaagacctggataaagtgaaactcatcgagtattacctgactaaaaacaaagaaggtcctcaggtgagcgaaaaccttcaaaaaacagaactgagcgatggtaaatcaatcgagccaggaggaatcgacattacgctctcttctagcctgtcccaggctggggatccgataacggagggcaataaggaaccagacaaaacatgggtgaagaagggcgagccgctgcccgttaagctaaacagctctacggaagccaatgtaatcaaagaggccttagactctagtctggaaagtactctagacaattcctgtcagggggctcagatggacaataaatcagaggtgcagctttggctgcttaagaggattcaggtaccaatagaagacattctgccttccaaggaggaaaaatccaaaactccccctatgttcttgtgtattaaggtgggaaagcctatgagaaaaagctttgcgactcacactgccgcaatggttcaacagtacggaaaaagaagaaagcagcccgagtactggttcgctgttcccagggagagagttgatcatctctatacttttttcgtgcaatggtcaccagacgtttacggtaaagacgctaaggagcaggggtttgtggttgtggagaaagaagagttgaatatgattgataacttcttttctgaacctactacaaagagctgggagataattaccgtcgaagaggcaaaaagaagaaagtcaacttgcagttactacgaagatgaagatgaggaagtcctgcctgtgctccggccacatagcgccctgcttgaaaacatgcatattgagcagcttgctcggcgactgccagcccgtgtacagggctacccctggaggctcgcctacagtacgctcgagcatgggacatcccttaagacactttatcggaagtctgccagcttagactctcctgtcctactggtaattaaagatatggataatcagatttttggtgcttacgcaacgcaccccttcaagttcagcgatcattattatgggaccggggagacgtttttgtatacgttctcccctcattttaaggtcttcaagtggtccggtgaaaattcatatttcattaatggagacattagctctcttgagctcggaggaggcggtggcagattcggactctggctggatgctgatttataccacggcaggtcgaactcctgctctacatttaacaacgacatcttaagtaagaaggaggacttcattgttcaggatttggaggtgtgggcttttgactag

SEQ ID NO: 233111 - DNA, 1323 bp, Artificial Sequence
  Description of Artificial Sequence: Synthetic coding sequence
gacgctgatttagcgagaaaggcactcaagccaattgaacgggttctgagctccacttctgaggaagacgagcccggagtggttaagtttctcaaaatgaattgtcgttactttactgacggcaaaggcgttgtgggaggtgtgatgattgtgacgcctaacaacattatgtttgacccacacaaatccgatcccctagttatagaaaacggatgcgaggagtacggactcatctgccccatggaggaagttgtgtctatagcactgtacaacgatatttctcacatgaagatcaaggatgcccttccttcacccggagagtgggaggacctggcttctgaaaaagacattaatccattcagtaagttcaagagtataaacaaagagaagaggcaacagaatggtgaaaaaatcatgaccagcgactctagaccaattgtgcccctggagaagagcaccggccatacccctactaaaccaagtggctcctccgtatccgagaaacttaaaaaattagactcaagccgagaaactagtcatggttcgcccaccgttacaaaactttcgaaagagcctagcgacacgtcctccgcattcgaaagcactgccaaggaaaacttcctgggtgaggacgacgacttcgtggatctggaggaactgtccagtcagacaggcggagggatgcacaaaaaggataccctcaaagagtgcttaagcctggacccagaggagaggaagaaggccgaaagccagatcaacaattcagcggtggaaatgcaagtgcagtcagctctagcctttctcggcacagagaatgatgtggagttgaagggcgctctggatttggagacgtgcgagaagcaggatataatgcccgaggtggataaacagagcggcagtcctgagtcacgagtcgagaataccttgaatatccacgaagacttagataaagttaagctgattgagtactacctcaccaaaaataaggagggaccccaggttagtgagaatctccagaaaacggagctcagcgatgggaagagcatcgaaccaggagggattgacatcaccctgtcctcgtcactttcccaggcaggcgaccctattaccgagggcaacaaagagccagataagacctgggtaaagaagggcgagcctctccctgtgaaactgaactcttcaactgaagccaacgtcatcaaagaggctcttgattcctccctcgaatctaccctggacaacagctgccaaggtgcgcagatggataacaagtctgaagtccagttgtggctgctgaagcggatccaggttcctatcgagtag

SEQ ID NO: 233112 - DNA, 576 bp, Artificial Sequence
  Description of Artificial Sequence: Synthetic coding sequence
atggataccaaggaggagaaaaaagagcgcaagcagtcctactttgcgagattgaaaaaaaagaagcaggccaaacagaatgccgagaccgcatccgctgtcgccacgaggacacacactgggaaagaagacaacaataccgtcgttctcgagcctgataagtgtaacatcgcagtggaggaagaatacatgacagatgagaagaaaaaacgaaagtccaatcagctcaaggagatcagaagaacagagctgaaaagatactatagcattgatgataatcagaacaagacccacgataaaaaggaaaaaaaaatggtcgtccagaagccacatggcacaatggaatacactgccggaaaccaggataccctgaatagcatcgcactgaaatttaatatcacacctaataagctggtcgaactaaacaagctgttcacccacacaatcgtccccggacaggtcctatttgtgcctgatgccaattccccttcctcaacactgaggctgtctagttcctccccaggcgctacggtgtcccccagcagttccgatgccgagtacgataaacttccatag

SEQ ID NO: 233113 - DNA, 354 bp, Artificial Sequence
  Description of Artificial Sequence: Synthetic coding sequence
atggatacgaaggaggagaagaaagagcgcaaacaatcttattttgcacgactgaagaaaaagaagcaggcgaagcagaatgcagagacagcttctgccgtggccactaggacgcataccggaaaagaagataacaacacggtggtgctagagccagacaagtgcaacattgcagtagaagaagaatacatgactgatgaaaaaaaaaagcggaagtcgaatcagctgaaagaaatccgaaggacagagctgaaacgttactattctatagacgataaccagaataagacccacgacaagaaagagaagaagatggtggttcagaagcctcacggaactatggagtatacctag

SEQ ID NO: 233114 - DNA, 273 bp, Artificial Sequence
  Description of Artificial Sequence: Synthetic coding sequence
atggacaccaaagaggagaaaaaagagcgcaagcagtcttactttgccagactgaaaaagaagaagcaggccaagcagaacgccgaaacagcctctgccgtggccacccgcacacacactgggaaggaagataacaatactgtggtgctggagcccgacaagtgcaatatagcagttgaggaagaatatatgactgacgagaaaaagaagcgcaagtccaatcagctgaaggaaatcaggaggacagagctaaaacgctattactctatatag

SEQ ID NO: 233115 - DNA, 273 bp, Artificial Sequence
  Description of Artificial Sequence: Synthetic coding sequence
atggacaccaaagaagagaagaaagagagaaagcagagctactttgccaggctcaagaaaaagaagcaggccaaacaaaatgccgaaaccgccagcgccgtcgccactcgtactcatactggcaaagaagacaacaacactgtggtattggagcccgacaagtgcaacatagctgtagaagaggaatatatgaccgacgagaaaaaaaagcgcaagtccaaccaactcaaggaaattcgcagaaccgaactgaagcgctactacagcatttag

SEQ ID NO: 233116 - DNA, 552 bp, Artificial Sequence
  Description of Artificial Sequence: Synthetic coding sequence
atgggcgctgcacatagcgtgtgggaggtggatcacctgtatacatttttcgtgcagtggtcccctgacgtgtatggcaaggacgccaaagagcaggggttcgttgtggtagagaaagaagaactgaacatgattgacaattttttctccgagcctacaacaaaatcttgggagatcataaccgttgaggaagcaaaaaggcgtaagtctacctgtagctattacgaagatgaagatgaggaagttttgcctgtgctgcggcctcactcagcactcctggaaaacatgcacattgagcagcttgcaagacgcctgcccgctcgtgtacagggttacccctggcggctggcttactccaccctcgaacacggtacttcccttaaaaccctgtatcgcaagagtgcgagcctcgattctcccgtattactggtaatcaaggatatggacaatcagatttttggggcatacgctactcatccgttcaagttctccgaccactattatggtacaggagagacttttctgtacacattttccccccactttaaatag

SEQ ID NO: 233117 - DNA, 714 bp, Artificial Sequence
  Description of Artificial Sequence: Synthetic coding sequence
tgagagaagacctgttcttcacttgagagggagcctcacttcagcctactaacaatgagagggcagcggctccctttggatatccagattttctattgtgccagacctgacgaggagccgttcgtaaagatcattacagtggaggaagcaaagcggaggaagagcacgtgttcgtactatgaggacgaggatgaggaggtgctgcctgtcctaagaccccactcggccctgctggaaaatatgcacatcgaacagctggccaggcggttgcctgcgcgagtccagggctacccttggcgcctggcttactctactttggaacacggcaccagcctgaagactctttatcgcaaatccgctagtttggattctccggtccttttagtgatcaaggacatggataatcaaatttttggcgcatacgccacacaccccttcaagttctctgatcattactacgggacaggcgagacctttttatacacattcagtcctcactttaaagtgttcaagtggagtggagaaaactcatatttcataaacggcgacatctcctctcttgagctggggggaggagggggacgatttggactctggctggatgctgacctgtaccatggacgcagcaactcctgttcaactttcaacaatgatatattaagcaagaaagaggatttcatagtacaggatctggaagtttgggcatttgattag

SEQ ID NO: 233118 - DNA, 534 bp, Artificial Sequence
  Description of Artificial Sequence: Synthetic coding sequence
taagagaagacatgtagttcacttgagcgtgagcctcacttttccctcctcacaatgcggggtcagcgacttccgctggatatacagattttctactgcgcaagacctgacgaagaacctttcgtgaagatcataacggtggaagaggctaagaggcggaaatcgacctgtagttattacgaagacgaggacgaagaagtgttgccagttctccggcctcattctgctctactggagaatatgcacattgaacagctggctcgcagacttccggctagagttcagggctacccttggcgcttggcctatagtaccctcgaacatggcactagcctcaagaccctctatcgaaaaagcgccagcttggactcccctgttctgcttgtaattaaagacatggacaatcagatcttcggtgcttatgcaacacacccatttaagttctctgaccactactacggaacaggtgagacttttttgtacacctttagtccgcacttcaagggcacgatttggttcatggccagatgctag

SEQ ID NO: 233119 - DNA, 573 bp, Artificial Sequence
  Description of Artificial Sequence: Synthetic coding sequence
taggagaagacctgttccagccttgaacgggagccccacttctctctccttacgatgcggggtcagcggttgccgctggatatccagatcttctactgcgccagacctgacgaagaacccttcgtaaagataatcacagtggaagaggcaaagcgtagaaagtctacctgcagctattacgaggacgaagacgaggaggttttgcccgtcctccgacctcatagcgctctccttgagaacatgcatatcgagcagcttgcaagaaggctccccgctcgagttcaaggatacccatggcgtctggcttactctaccctggagcacggtacctcactcaagaccttgtataggaagtctgcatcacttgactcaccagtgctcctagtgattaaggatatggataatcagatcttcggcgcttacgccacacaccccttcaagttcagcgatcattattacggaaccggagaaacttttctctacacgttttccccgcattttaaatggagtggagaaaattcttacttcatcaacggcgatatttcaagcctagaactcggcggtggcggatag

SEQ ID NO: 233120 - DNA, 273 bp, Artificial Sequence
  Description of Artificial Sequence: Synthetic coding sequence
atggataccaaggaagaaaaaaaagaacgcaagcagtcctattttgctagactcaaaaaaaagaaacaggccaaacagaatgcagagacagcaagcgctgtggctacacgaactcacacggggaaagaagataataatacagtggtgctggaacctgacaaatgcaacattgctgttgaagaagagtatatgactgacgaaaaaaagaaacgtaaatcaaatcaactgaaagagatccgtaggacagagctaaaacgctactactctatttag

SEQ ID NO: 233121 - DNA, 7565 bp, Artificial Sequence
  Description of Artificial Sequence: Synthetic coding sequence
atgtccggatctacccagccagtcgctcagacttggcgggcaacggagcctcggtaccctcctcattcactctcttacccagttcaaattgccaggactcatacagacgttggattgctggagtaccagcaccactcacgtgattacgcaagccatctgtctcctggaagtataatccagcctcagagacgcaggccgtctctgttatctgagttccagcctggcaatgagagatcgcaggagcttcacctccgaccagaatctcactcatacttgccagagctggggaaatcagaaatggaatttattgagagcaaaagacccagactcgaactgctgcccgaccctctgttgagaccaagcccactgctcgctacaggtcagcccgctggttccgaggatttgaccaaagaccggtccctgactggcaaactggagcccgtctcgcccccttcacccccacatacagaccctgagttggaactggtgccgccacgactgagcaaagaagagcttatccagaacatggaccgggtggaccgcgaaatcaccatggtggagcagcagatctccaagctgaagaaaaagcaacagcagcttgaagaggaggccgctaagccaccagagcccgaaaaaccggtgtcaccgccacctatagagagcaaacaccgttccctcgttcagattatctacgacgagaacaggaagaaggctgaagctgcgcatcggatcctggagggcctgggtcctcaagtggagcttccattatataaccagccatctgatacccgccagtatcacgaaaacattaagatcaaccaggccatgcgcaagaagctgatcctctactttaaacggaggaaccatgctaggaagcagtgggagcagaagttttgtcagcgctatgaccagctaatggaggcatgggaaaagaaagttgaaagaattgagaacaatccacgtcgtagagccaaagagtctaaggttcgtgagtattatgagaaacagttcccagagatccggaaacagagagagctccaggaacggatgcagagtcgagtggggcagcgagggtccggtctgtccatgtccgccgctagatccgagcacgaggtgagcgagatcatcgacggattaagtgaacaggagaatctcgagaaacagatgaggcaactggcagtgattcctcccatgctctatgacgccgatcaacagagaataaaattcataaatatgaacggattgatggccgacccaatgaaggtttataaagaccgacaggtgatgaacatgtggagcgaacaagaaaaagaaacctttcgggagaagtttatgcagcacccaaagaatttcggcctcattgcatcttttctggagcggaaaaccgtggctgagtgcgttttatattattacctgaccaagaaaaacgagaattataaatctctggtgagacgctcttacaggcggagagggaaatcacagcaacagcagcagcagcaacagcagcaacagcagcagcagcagcaacaaccaatgcctcgctcctctcaggaggaaaaggacgaaaaagagaaagagaaggaggcagagaaggaagaggagaaacccgaagtggagaacgataaagaggaccttctgaaagaaaagacagatgacacctctggagaagacaatgacgagaaggaggccgtggcctctaaaggaagaaagacagccaattcccaagggagacgcaaaggcagaataacaaggtccatggctaacgaggctaactcagaagaggcaatcaccccacagcagtccgcagagttggcatccatggagcttaacgagagctccagatggactgaagaggagatggagacggctaaaaaggggttgctcgagcatggcagaaactggagcgccatcgcacgcatggtgggctcaaagaccgtgtctcaatgtaagaatttttacttcaactataaaaagcggcagaacctggacgaaattcttcagcagcataaactcaaaatggaaaaggaaagaaatgctagacggaaaaagaagaaggccccagccgctgcctctgaggaggcagctttccctcccgtggtggaggacgaggaaatggaagccagtggcgtgagcgggaacgaagaggagatggtggaggaggcagaagcacttcatgcaagcgggaacgaagtgccccgaggcgaatgtagtggcccagccacagtgaataactcaagcgacactgaaagcatcccttccccccacacagaggcagccaaagacacgggccagaacggtccaaagccgccagcgacattgggcgcagatggaccaccaccgggacctcctaccccacccccagaagatattccagcccctaccgagcctactcctgcttctgaggctacaggagcgcctacccctcctccagcaccccctagcccttcagctccccctcccgtggtgccaaaagaggagaaggaggaagagaccgcagctgctcctcccgtggaagagggtgaggagcaaaagcctccagccgctgaagaactcgcagttgacactggcaaggcggaagaacctgtcaagtctgaatgtacagaggaagcagaggaagggccagccaagggcaaagatgctgaggcagctgaagcgacagccgagggggctctgaaagcagagaaaaaagaggggggtagcgggcgagctaccacagccaagtcctccggggctcctcaagacagtgatagctccgctacttgcagcgccgatgaagtggatgaagctgagggcggtgacaagaacagactcttatcccctcgaccatctttgcttacacccactggggatcctcgagccaacgctagtccgcagaaaccattagacctcaagcaactgaagcagcgggctgcagccattcctcccatcgttaccaaggtgcatgaaccccctcgagaagatgcagcacctacaaaacccgcaccgccagccccaccacccccacagaatctccagcctgagtcggatgctccccaacagccagggtcatccccacggggtaagagccgcagcccggctcctcccgcagacaaggaggccgaaaaacccgtgttctttcccgcatttgcggcagaggctcaaaaactgcctggcgatccaccttgttggacgtctggactgcctttccctgtgccacctagggaagttatcaaggcctcacctcacgccccagacccttccgcattctcatatgccccacccggacacccactccctctgggtttgcacgacaccgccagaccggtgttacctcgtcccccaacaatctctaatccacccccattgatatcatcagccaaacacccctcagtgctggaacggcagattggcgctatcagccagggtatgagcgttcagcttcacgtgccgtactccgaacacgcaaaggccccagtcggcccagtgactatggggttgccactgcctatggaccctaaaaaactggcccctttctcaggagtgaagcaagagcagctgtcgccgagagggcaagcgggtcctcctgagagtcttggagttcccacagctcaggaggcgagcgttctccggggaaccgctctggggagtgttcccggtgggagcataactaagggtattcccagcacgcgcgttccatctgacagcgctattacatacaggggctccatcacacatggtaccccggctgacgtgctctacaaaggaaccatcacccgaattatcggcgaagactctccctcccgtctggaccgaggtcgtgaagactccctcccaaagggccatgtaatttatgagggcaaaaagggacacgtgctcagttacgagggaggaatgtcggtcacgcagtgctccaaagaagatggaaggagcagtagcgggcctcctcacgaaacggctgccccaaaaaggacatacgacatgatggagggtcgtgtaggcagagccatcagttccgcctcaattgagggactcatgggacgagccatcccacctgagcggcactcccctcatcatctgaaggaacagcaccatattagaggcagcatcactcaaggaattccacggtcttatgtcgaggcccaggaggattatttgaggcgggaggcgaaattgctgaagcgcgaaggaaccccccctcctcctcccccttctcgtgacctcactgaagcttacaagacccaggctctaggaccacttaagctcaagccggctcacgagggcctggtggctacagtcaaagaggcaggaaggagcattcacgagatccctcgagaggagctgcggcatacccctgagctccctctcgccccaagacccttgaaggaaggaagtatcacccagggcacccccttgaagtacgacacaggggcatctaccacaggctctaaaaagcacgatgtcaggtccctgattggcagtcctggaagaacattccctcctgtacatccgcttgacgtcatggccgacgccagagcactcgagcgtgcctgctacgaggaatctctgaagtctagaccaggtactgcctcttcctctggaggtagcattgccaggggagcaccagttatcgtcccagaattaggtaagcctcggcagagccccctgacctatgaggaccacggcgctccttttgcaggtcacctgcctaggggatctcccgtcactacacgcgaacccacccctagattgcaggagggctctctctcttcaagtaaagctagccaggatcgcaaactgacaagtacccccagagagattgctaagtctccacacagtactgtcccagagcatcaccctcatccaatctccccgtatgagcacttgctgcggggagtaagcggggtagatttatacaggtcccatattccactggccttcgaccccacttctattccacgtgggattcccctcgacgcggcagcagcttattatctgcctcggcacctggctcccaatcctacttatccacatctgtaccccccttacttaattcggggttaccccgacacagcagctctagaaaaccgtcaaaccataattaacgactatatcacctcacagcagatgcaccacaatgcagccacagctatggcccagagggctgatatgctgcgtggcctctcacccagagagagttccctggccctaaattacgctgccggacctcgagggattatcgacctcagtcaggtgccccacttgccggtgctggtcccacctacacctggaacacctgctacagccatggatcggctggcttacctgcctaccgcgcctcaaccgtttagctctcgccacagtagttcacctctgtcccccggtgggcctacgcatctaacaaagccaaccaccacctcgagcagcgagagggagagagaccgagacagggagcgggatagagaccgagaacgggagaagagcatactgacctcaaccacaactgtggaacacgccccaatatggagacccggtaccgaacaatctagcggatccagcggagggggagggggatccagctctcgacccgcttcccacagccacgcacaccaacactcccctatctccccacgcacccaggacgcactgcaacaacgcccttcggtgcttcacaataccggtatgaaggggattatcacggccgtggagcccagcacccctaccgtcttgaggtcaacttcgaccagttctcctgtgcgccctgcggcaacatttcctccagccacccattgccccctgggtggcacattagatggagtatacccaactttgatggagccggtgctgttgcctaaggaggctcccagagttgcaaggcccgagcgcccacgggcagacacaggccatgcatttttggccaagccacctgcaaggagtggactggagccagcgtctagcccatccaaggggtctgaaccacgcccactggtgcctccggtgagcggtcatgctacaatcgcacgcacccctgcaaaaaatctcgccccacatcacgcaagccccgatccgccagctcctcctgcaagtgcttcagacccgcatagagagaagacccagagtaagccatttagcatacaggaactggaattgcgttctctagggtaccacggctcaagctacagtccggaaggcgttgaacccgtctctcccgtgtcttccccttccctgacccacgataagggtttgccaaagcatctggaagagttagacaaatcccacttggaaggagagctgagaccgaagcaaccaggccctgtaaaactcggaggcgaggcagctcacctgccacacctgaggcctctccccgaatcccagcctagttcaagccctctgctccagacagctccaggcgtaaaaggacaccagcgcgtggttaccctggcccaacatatctcagaggtcataacacaggactacaccaggcatcacccccagcagttgagcgcacccttacccgctccgctgtactcattcccaggtgcctcctgccccgtgctggatttgcgcaggccgccatccgacctgtacctaccacctcctgatcacggcgcacccgcacggggtagcccccatagtgagggaggaaaacgctcacctgagcctaacaagaccagcgtcctcgggggaggcgaggacggaatcgaacccgtttctcccccagaaggaatgactgagccgggacattcccggtccgcggtctaccccctgttgtatcgggacggcgagcagaccgagccatccaggatgggcagtaagtcccctggcaatacctcccagccacccgcttttttttctaagctgaccgaaagtaatagcgccatggtcaaatccaaaaagcaggagattaataaaaagctgaacacccacaaccggaacgagcccgaatacaacattagccagccaggcacagaaatctttaatatgccggctataactggcaccgggcttatgacctaccggtcgcaagccgttcaagaacatgctagcaccaacatggggttagaagctattatccgtaaggccttaatgggcaaatacgaccagtgggaagaatccccccctctgagcgccaacgccttcaaccccctaaatgccagcgcctcactgcctgcggctatgcctatcaccgcagctgatggtcgctcggatcataccctaacttcaccgggaggtggcggtaaagccaaggtgtcggggaggcctagcagccgcaaggcgaagtcacctgctcccggtctggcatcaggggaccgaccaccttccgtgagctccgtgcacagtgagggagactgcaacagacgcaccccattgacaaacagagtctgggaggataggccctcaagtgcaggtagcaccccgtttccatataaccctctgatcatgaggctgcaggccggtgtgatggctagcccacctcctcccggactgcctgcgggtagcggccctctggctgggccacatcacgcatgggacgaggaaccgaagcccctgctgtgctcacagtacgagactctctcagacagcgagta

SEQ ID NO: 233122 - DNA, 7379 bp, Artificial Sequence
  Description of Artificial Sequence: Synthetic coding sequence
atgagcgggagcacacagccggtggctcagacgtggagggccacagagcctagatacccacctcattcacttagctaccctgtccagattgctaggactcacactgatgtgggactgctggagtaccagcaccacagtcgagactatgcttcacacctgtctccgggatcgatcatccagccacagaggcgtagaccatctttgctatctgagttccagcctggtaatgaacggtctcaggagctccacctccgtcctgaaagtcatagctacctgcccgagcttggaaaatcggaaatggagttcattgagagtaaacggcctcgcctggagctactcccggaccctttactgcgcccaagtcccttgttggctacgggccagccagccggaagcgaggacctgactaaggaccgcagtctaaccggcaaactcgaacccgtaagccctcccagccctccccacaccgatcccgaactagaactggtgccaccccgactgagcaaagaagagttgatccagaacatggatagagttgaccgtgaaatcactatggtcgagcaacagattagtaagcttaagaagaaacagcagcagttggaggaagaggctgcaaagccccctgaacctgaaaagccagtgagtcccccacccatagaatccaagcataggtctctggtgcagatcatttatgatgaaaatagaaaaaaggccgaggctgctcaccgcatactcgagggactgggcccacaggtggagctcccactatacaatcagccttccgacactcgccagtaccacgagaacatcaagatcaaccaggctatgcggaagaagctgatcctctacttcaagagaaggaatcatgcacgcaagcagtgggagcagaagttctgtcaacgttacgatcagctcatggaagcatgggagaaaaaggtcgagcgaatagagaacaacccaagaagacgcgcaaaggagagcaaggtccgcgaatattatgagaagcaatttcccgagatccgaaagcaaagagagttacaggaacgcatgcagagccgcgtcggacagagaggatccgggctctcaatgagcgctgcccgttctgagcatgaggtgtccgagataatagacgggctgtctgaacaggaaaacttagagaagcagatgcggcaactagctgtgatccctccaatgctgtatgacgccgaccaacagcgtattaagtttataaacatgaacgggctgatggccgatcctatgaaggtgtacaaagaccggcaggttatgaatatgtggtctgaacaagagaaggagacattccgtgagaaatttatgcagcaccctaaaaactttggactgattgcttcatttttggagcgaaaaactgtcgccgagtgcgtgctctactattatctgactaaaaagaacgagaattataaatctttagttagaagatcttacaggagaagaggcaagagccaacagcaacagcaacaacagcagcaacagcaacagcaacaacagcaacaacctatgccaagatcttcacaggaggaaaaagatgaaaaagagaaagagaaggaggcagagaaagaggaggaaaaaccggaggttgagaacgacaaggaagaccttctaaaggagaagactgacgacactagtggagaggataatgacgaaaaagaagctgtggccagcaagggcaggaagactgccaattctcagggcaggaggaaaggccgaattacccgctctatggcgaacgaggcaaatagtgaagaggcgattactccacagcagtctgccgagctcgccagcatggagctaaatgaatcctcgcgctggactgaggaggaaatggaaactgccaaaaaaggtctgttagaacacggcagaaactggtctgccatcgcccgtatggtcggttcaaaaactgtgtcccagtgtaagaacttttatttcaattataaaaaaaggcagaatctggatgagatcctgcagcagcacaaactcaagatggagaaggagagaaacgctcggagaaagaagaagaaggccccagcagccgcatccgaggaggctgcttttccaccggtggtcgaggatgaagaaatggaggcttcgggagttagcggaaacgaggaggagatggtcgaggaagctgaggccacagtgaacaactccagtgatactgagtcaattccctcaccccacaccgaggccgctaaagataccgggcagaatgggccaaagcccccagccaccctgggcgctgatggaccccctcccggtccgcctacccctcccccagaggacattcccgcacctaccgagccaacaccagcctctgaggctaccggagcccctacaccaccaccagccccaccctcaccaagcgcaccaccccctgttgtgcctaaagaagagaaagaagaggagactgccgctgccccaccagtggaagagggtgaggagcaaaagccccctgctgccgaggagctggcagtcgatactgggaaagccgaggagccagtaaagtctgagtgtaccgaagaggccgaagagggacctgctaagggcaaggacgcggaggccgctgaggctaccgctgaaggagctctgaaggccgagaagaaggagggtggaagtgggcgagcaaccaccgcaaagagttcaggagctccccaggattccgacagctcggcaacctgctcagcagacgaggtggacgaggccgagggcggtgacaagaatcgccttctgtcacccagaccctctctattgacccccaccggggatcctcgtgccaatgcaagccctcaaaagccactcgacctgaagcagctgaaacaaagagccgctgccataccacctattcaggttacaaaggtgcatgagcccccaagagaggatgcagcccctactaagccagctccacctgcaccccctccccctcagaatctccagcctgagtccgacgctccccagcagccgggatcgtccccacggggaaagagccgcagccctgcccctcccgcagataaggaagcagagaaaccagtgttctttccggcttttgccgcagaagctcagaaattgcctggggatcccccttgctggacttcagggctccctttcccagtccccccacgcgaggtcatcaaggcctcccctcatgcccctgatccgtctgccttttcttacgccccacccggacatcccctgccactgggcctgcacgacaccgccagaccggtgttgcccagaccccctacgattagcaatccgcctccccttatatcaagcgcaaaacacccttccgtgctggaacgacagattggcgctataagtcaaggtatgagcgtgcagctgcacgtgccttactcagaacatgccaaggcaccagttggtccggtgaccatgggcctgccgctgccaatggatcccaagaaactcgccccattctcaggcgtcaagcaagagcaactctcaccacgtgggcaggccggacccccagaatctctgggggtccctacagcccaggaagccagcgtgctaaggggcaccgccctgggctccgtgcctggaggctctataactaagggcatcccatcaacaagagtgccctctgacagtgctatcacgtatcgaggcagcatcacgcatgggacccctgctgacgttttgtacaagggaactatcactcgcatcataggagaagactcccctagccgactcgaccggggtcgggaggactcgctgccaaagggccatgtcatatatgagggcaaaaaagggcacgtcctttcatacgaaggcggaatgtctgtcacccagtgcagcaaggaggatgggagatcgagctccggaccgcctcacgaaaccgccgctccgaagagaacatatgacatgatggaaggacgggtaggccgagccatttcttccgcttctatcgaaggtttaatgggaagagccattcccccagaacgccattccccgcatcacctcaaagaacagcaccatatcagaggaagcatcacccaggggattccccgatcctacgttgaggcacaggaggactatttacggcgagaagccaagctcctcaaacgggagggaactcctcccccacccccaccttccagagacctgacggaggcttacaaaacgcaggccttgggccctctgaaacttaaaccagcgcatgaaggcctggtcgccacagtcaaggaagctggtcgaagcatacacgagattccacgggaagagctacgccatacgcctgagctacccctggccccacggccactgaaagaggggtctattacccagggcacgcccctcaagtacgacaccggcgcaagtacaaccggatccaaaaaacacgatgtgagatctctcatcgggtcccctggacgtacattccctccagtccacccgttggatgtgatggctgatgcacgggcactggaacgggcttgctatgaagagtctcttaagtctcgaccagggactgcatcctcatctggagggagcattgcgagaggcgcacctgtcattgtacctgagctcggcaagcccaggcagtccccactcacttacgaagatcacggcgcacctttcgccggacacctccccagaggtagtcccgtgactacacgggaacctaccccacgcctgcaggagggcagtctgagtagtagtaaggcttcacaggatagaaaactaacctctacacctagagaaatagccaaatctccacactcaacagtacccgagcatcatccgcacccaatctcaccttacgaacatctgctgcgcggagttagcggcgttgacctctatcgttcgcacattccccttgcattcgacccgaccagtattcccaggggcatcccactcgacgcagcggcagcatactacctgcctcgtcatttggcccctaaccccacttaccctcatttgtacccaccctatttgatcaggggctacccagacacggccgcactagagaacaggcagaccatcattaatgattatattactagccaacaaatgcaccacaatgcggctacagccatggctcagagggccgacatgttaaggggccttagtccaagagaatcctccctggctcttaattacgccgctgggccacgcggaatcatcgatctgagccaggttccccaccttcccgtgctcgtcccccctacccccggaacacccgctactgcgatggaccggctcgcctacctgccgacagcaccgcagccgtttagctcccgtcatagttcatccccactctcgccgggaggcccaactcatttgaccaaaccgacaactacaagctcctcagagagagagcgggaccgagatcgcgagagggaccgcgatcgggagcgagaaaagtctattctgacctcaacaacgaccgtggaacacgcacccatttggagaccgggaacagaacagagtagcggctcttcaggcggaggtggcggttcttcgagccgtcctgcttcccattcccatgcacaccagcacagtccgatcagtccgaggactcaggacgctctgcagcaacgcccttcagtcttgcataataccgggatgaaaggtattatcaccgccgtagagccgagcacacctactgtgctgcgctcaacaagtacctccagccccgttagacccgctgctacatttcctccagccactcactgccccctggggggtacgttggatggggtttaccccactctaatggaaccagtgctgctgcccaaggaggcccctagggtggcacgccctgaaaggccacgcgctgataccgggcacgccttcttggccaaaccaccggctaggagcgggctcgaacccgcatcaagcccatcaaagggctctgagcccagaccactggtcccgccagtatccgggcacgcgaccatcgctaggactcctgctaagaatctggccccacatcacgcctctcctgatccccctgcccctccggcatctgccagcgatccccatagagagaagacacagagcaagccatttagcatacaggagctcgagctcaggtcactggggtatcacggctcctcctactcacccgagggtgtagagcctgtctctccagttagctccccttcccttacacacgataaaggactccctaaacacctggaggagcttgacaagtcccatcttgagggcgagctcagaccaaagcagccaggcccagtcaagctgggcggtgaagcagctcatctgcctcatctcagaccactgcccgagtcacaaccaagctcatcacctctgctccaaacagctccaggagtcaaaggccaccaaagggtggtcacactggcgcagcatattagtgaggtcatcacacaggattacacccgccatcacccacagcaactgtctgctccattgcccgctccactctactctttcccgggagcgtcctgtcccgtcctggacctgcgaagacccccaagcgacttatacctgcctccaccagatcacggtgcgcctgccagggggagcccccattcagaaggaggcaaacggtccccagagcctaataagactagcgtgttgggagggggagaggacggcattgagcctgtctcaccccctgaaggtatgaccgagccaggccactcacggtcagccgtgtatcccctcctgtatcgggacggggaacagacggagccatcacgcatggggtctaagtcacccggtaacacctcacagccgccagccttcttttctaaactcactgagagtaacagcgcaatggtaaagtctaagaaacaggagataaataaaaaactgaacacccacaacaggaatgagccagaatacaatattagtcaacctgggaccgagatattcaacatgccagcgatcacaggaaccggcctgatgacttatagatcccaagccgttcaagagcatgcaagtactaatatgggcttggaagccattatccgaaaagcactgatgggaggaggcggtaaggccaaagtcagcggacgtccctctagtagaaaggccaaatcccctgctcctggcctggccagtggtgatagaccacccagtgtgagctcagtccacagtgagggtgattgcaaccgcaggacccccctgacaaacagagtctgggaggataggcctagttccgcagggagcacaccttttccctataacccgctgattatgcggctccaagccggtgtgatggcttcccctccacccccagggttacccgctggatccggacctctcgccggacctcaccacgcctgggatgaagaaccgaagcccctactgtgtagccaatatgagaccctctctgactctgaata

SEQ ID NO: 233123 - DNA, 6227 bp, Artificial Sequence
  Description of Artificial Sequence: Synthetic coding sequence
atgtggtctgagcaggaaaaagagacttttagggagaaatttatgcagcacccgaaaaactttggattaattgcgtcctttctcgagagaaagaccgttgctgagtgcgtgctgtattactaccttacgaagaagaatgaaaattacaagtctctggtacggagatcatatagacgcaggggcaaatctcaacagcaacagcaacagcaacagcagcaacaacagcagcagcaacagcaacccatgcctcgttcatctcaggaagaaaaggacgagaaggagaaggagaaagaggcagaaaaggaggaggagaaacccgaggtggagaatgacaaggaagatttgctcaaggagaagacagacgatacaagcggagaggacaatgatgagaaggaagccgtggcatctaagggcaggaaaacagcaaatagccaggggcgacgcaagggaaggattacgcgcagcatggccaatgaagccaattcggaggaggcgattactccacagcagtctgcagagctggcttcaatggagcttaacgagtcaagccggtggaccgaagaggaaatggaaaccgccaagaaaggcctgctggagcatggaaggaactggtctgcaatagcaagaatggtcggctcaaagacggtgagccagtgcaaaaatttttattttaactacaagaaacggcaaaacctcgacgaaattctgcagcagcacaagctcaagatggagaaggagagaaatgctcggcgaaagaagaagaaagcccctgccgctgcaagcgaggaggccgcatttcccccagtggtagaagacgaagaaatggaagcgagcggggtgtcaggcaatgaagaggaaatggtggaggaagcagaggccaccgtaaataactcctccgacactgagtccataccaagcccccataccgaggccgctaaggacaccggtcagaatgggccaaaacccccagcaacactcggggctgacggcccaccccctggccctcctaccccccctcctgaagatatccccgctcccaccgaacccactcctgcatctgaggctaccggggctcccacgccacccccagctccaccgagcccctccgctcccccaccagtcgtccctaaagaagaaaaagaggaggagaccgccgctgcccctcccgtggaggagggtgaagagcagaaaccaccagccgcagaagagctggccgtcgatacaggcaaggctgaggagcccgtgaaatctgagtgtacagaggaggccgaggagggtccagctaagggtaaggacgctgaagctgccgaagcaacagcggagggtgctctcaaggcagaaaaaaaagagggtggctctggacgggctacgaccgccaaatcatctggtgctcctcaggatagcgactcctccgccacatgttcagcggacgaagtcgacgaagctgaggggggtgataaaaatagactgctttctcctcggccatccctgctcacccccaccggggatcccagggcaaacgcttctcctcagaaacctcttgacttgaaacagctgaagcaaagagccgctgctatcccccctatccaggtgacaaaggtccacgaaccccctcgggaggacgccgctccgaccaaacccgctcccccagcccctcctccccctcagaacctgcagcccgaatcggacgccccacagcagccgggttcatcccccagagggaagagccggtctcccgctcctcctgcagataaggaggccgagaagcctgtcttcttccccgctttcgctgccgaagcgcagaagcttccgggagaccctccttgctggaccagcggcctaccgtttcctgtgccaccaagggaggttattaaggcatccccacacgcaccggacccctccgcgttttcctacgcacccccaggccaccccctgcctctggggttgcatgataccgccagaccagttcttcccagaccccctactatcagcaacccccctcctctgatttcatcagccaagcacccttccgtgttagagcggcagattggagctatctctcagggcatgtcggtccagcttcacgtgccttattcagagcatgctaaagcgcctgtaggcccagtgaccatggggttgccacttcctatggacccaaagaagttggctcccttcagcggtgtcaagcaggagcagctttcccccaggggacaagctggcccaccagagtcactaggcgtgccaaccgcacaagaggcttccgtgctgcggggtactgcactcgggagtgtccccggaggatccattacaaaaggtatcccgagcacacgcgtgccatccgatagtgccatcacttaccgcggttcaattacccacggtacacccgcagacgtactttacaagggtacaattactaggatcataggcgaggatagtccatcccggctggacagaggacgggaagactccctgcctaagggccatgtcatctacgaagggaagaaaggccacgtcctgtcatatgagggcggaatgtccgtgacacagtgttccaaggaagacgggagaagtagcagtgggcctccccacgagaccgccgctccgaaacggacatacgacatgatggaggggagagtgggtcgcgcaattagtagtgccagtattgagggactgatggggagagcaattcccccagaaagacactcaccccaccacctaaaagagcagcaccacattcggggaagtattacacaaggtatcccccgaagctatgtagaagctcaggaagattaccttcgtcgagaagcaaaactgcttaagcgagaaggaacgcccccacctccaccaccgtcgagagacctgaccgaagcttacaagacccaggcgctgggcccactcaagctcaaacctgcacacgagggcttagtcgctaccgtaaaggaggcaggacgatccattcacgagatacctcgggaagagctgcgccatactccagagcttcccttggcaccacgacccctaaaagagggatcgataacccagggcaccccgctcaaatacgacaccggggcatccaccactggttccaagaaacatgacgtgcgatccctcattgggtcacctgggaggacgtttccacctgtccaccccctcgacgtgatggcagacgcgcgtgcactggagagggcatgttatgaagaatcacttaaatcccgccctggcaccgccagcagttcaggcggatccattgccaggggggcaccagttatcgtgccagaactgggcaaaccaagacagagtcccctcacctatgaggatcacggagctccattcgccggtcatcttcctcggggaagtcccgttactacccgcgagcctacacctagacttcaagaaggatctctcagcagtagtaaagcgagccaggacaggaagctgacatccactcctcgggagatcgccaagagtcctcactcaaccgtcccagaacaccacccacaccccatatcaccctacgagcaccttctacggggtgtaagcggagttgatctgtataggtcacatatacctctcgccttcgaccccacttcaattccaagggggatcccactggatgcagccgcagcttactacctccccagacacctggctcctaatccaacatacccgcacctgtatccaccatacttaataagaggataccccgatactgccgctcttgaaaataggcagaccataataaatgactacataactagccagcagatgcaccataatgccgctactgctatggcacaaagggccgacatgctgagaggtctttcccctagggagtctagcctagccctcaattatgccgctggcccacgaggaattattgatctgagccaggtcccacacttgcccgtgctagtgccaccaacccccggaactcccgctaccgccatggacaggctggcctatctcccgaccgcccctcagccctttagctctcgacatagctcaagccctttgagcccaggaggtcctacacatcttactaagcccactactaccagctcttccgagagggagcgggacagagaccgcgagcgtgaccgtgatcgagaacgggaaaagtctatcttgacatctaccaccactgtggaacatgctcctatctggagacccggaacagaacagtcctctggcagttccggcggaggcggaggatcttctagcaggccggcatcccatagccatgcacatcagcattcccccatttctccgagaacacaagatgccctgcagcagcgcccttccgtccttcataacacggggatgaaggggattattacagccgtagaaccgagtacacctactgtcttgagatccacaagtacatcttcacctgtgagaccggctgctacttttccccctgccacacactgccctttagggggaactttagatggcgtgtaccctacactgatggagcccgtgctgctgccaaaggaagcacctagagtagctcggcctgagagaccacgcgctgatacaggccacgcatttctggccaaaccacctgcacgctccggcttggagcccgcttcctccccctcaaaaggaagcgagcccagacctttggtgcctcctgtgagtggacatgccactatcgccagaactcccgcaaaaaatctggccccacaccacgcctcccctgatccccctgcccctcccgctagcgcgtctgatccgcaccgggaaaaaacacagtcaaaaccgttcagtattcaggagctggagctgcggagtctgggctaccatgggtcgagttacagcccagaaggagtggagcctgtcagccccgtgagctccccttctctgacccatgacaaggggctccccaaacacctggaagagcttgacaagtcacatcttgaaggtgagctcagaccgaaacagcccggacccgtgaagctcggaggtgaagcggcacatctgccgcacttacgccctctcccggaatcacaacccagctcctccccccttttgcaaaccgcaccaggtgtgaaaggccatcaacgcgtggtgactctggcccagcatatctccgaagttatcacgcaagactacacgaggcatcatccacagcagctgtccgcgccactacccgctcctttatattcattcccaggcgcaagctgccccgtgctggacctcaggaggcctccctcagatctgtatttgcccccaccagaccacggggcaccagccagagggtcaccccattcggaggggggaaaaagatctcccgaaccgaataagactagtgtcctgggaggtggtgaagatggtattgaaccagtgtcccctccagaagggatgacagagcctggtcatagtcggagcgccgtgtacccactgctatatcgtgacggcgaacagactgagccgtcccgtatgggatctaaatcccctggaaacacaagtcagcctcctgcgttcttctccaaactgaccgagtctaactcagccatggtgaagtcgaaaaagcaagagattaataagaagctaaacacacacaacaggaacgaaccagagtacaacatcagtcaaccaggaacggagatcttcaatatgcccgctattactgggacaggcttgatgacctatagatcccaggcggtccaggagcatgcctcaactaatatggggctggaagctattattaggaaggcactaatgggaaaatacgatcagtgggaggagagccccccactctcagcaaacgcgtttaatcccctgaacgcttccgccagcttaccagctgcgatgccaatcaccgccgcagacgggagaagtgaccacacactgactagtcctggcggagggggaaaggctaaggtgtccggacgaccatcgagtaggaaagccaaatcgcccgctcctggactcgcatcaggcgataggccaccttcggtatctagcgtacacagtgagggtgattgcaacagacggacccccttaacgaatcgtgtgtgggaagacagacctagtagtgctggctccaccccgttcccctataacccattaattatgcggcttcaagctggcgtcatggcaagtcccccacctcccggacttccagcaggtagcgggcctttggccggtccccatcacgcatgggacgaggagcccaagcccctgctgtgctcacagtatgagacactgagcgattctgagta

SEQ ID NO: 233124 - DNA, 7376 bp, Artificial Sequence
  Description of Artificial Sequence: Synthetic coding sequence
atgagtgggtccacccaacccgtagcccaaacctggcgggcaaccgaacctaggtatccccctcattccctgtcataccccgtacaaattgcgagaactcacacagatgtcggcctgcttgaatatcaacaccactctcgggattacgcatcacacctttcccccggaagcattatacagcctcagaggcgcaggcccagcctactgagtgagttccagccgggaaatgaacgtagtcaggagctgcacttgaggccggagtctcacagttacctgcctgagctaggcaagagcgaaatggaattcatcgagagcaagagacctcgtttggagttgctccccgatcccttgctgaggccatctcctctacttgctaccgggcagcctgccggtagcgaggacctcacaaaggacaggagcctgactggcaagctcgagcccgtgtctcctccctcccctcctcacactgaccccgaattagaactagtgcctccccgacttagcaaagaggagctgatacagaacatggacagagtcgacagagagattaccatggtagagcagcaaatcagcaagctgaagaagaagcagcagcagttagaggaagaagccgctaaacctcccgagcccgaaaaacctgtgagtccgcctccaatcgagtcaaaacacaggtcccttgtgcaaatcatctacgacgaaaacaggaaaaaagctgaggctgctcacagaatactcgaagggcttgggccacaagtcgagttacccttatacaaccagccttccgacacgcggcagtaccacgagaacatcaaaataaatcaggctatgagaaagaaattaatcctatatttcaagagaagaaaccacgctcggaaacagtgggagcaaaagttctgccagcggtatgaccagctgatggaggcttgggaaaaaaaagttgaaaggatcgagaacaatccaagacgccgagcaaaggaaagtaaagtgcgcgaatactatgaaaagcagttcccagagattaggaaacagagggaactgcaggagaggatgcaacgggtaggccagcgcggttccggattgtccatgagcgccgctagatcggaacacgaggtgtcagaaatcatcgacgggttgtccgaacaggaaaatcttgaaaagcagatgagacagctggcagttatcccccctatgctgtatgacgccgatcagcagcgtattaagtttattaacatgaatggcttaatggccgatcccatgaaggtgtataaggaccggcaggtcatgaacatgtggtctgaacaagaaaaggaaacctttagagagaaattcatgcagcacccaaagaacttcggattaattgcaagttttctcgagcgcaagacagtggcagaatgtgtgctctattattatcttaccaagaagaacgaaaactataaatctctggttaggcgctcttacagaagaagggggaagagtcaacagcagcagcaacagcagcagcagcagcagcagcagcagcagcagcagccaatgccccgttctagccaggaagagaaagatgagaaagagaaggagaaagaggctgaaaaggaggaggaaaaaccggaggttgaaaacgacaaggaggatttgctgaaggaaaaaaccgacgacacatctggggaggacaatgacgaaaaagaagctgtcgcatctaagggtagaaagaccgccaattcgcagggaagacgcaaaggcagaattaccagaagcatggcgaacgaggctaactctgaagaagcaattacacctcagcagtccgctgagttagcaagcatggaacttaacgagtcatcacgttggaccgaggaggagatggaaactgccaagaagggcctgctggagcatggtcgaaactggagcgctatagcccgtatggttggttcgaagaccgtttcccaatgcaagaacttctactttaattataagaagagacagaacttagacgaaattctgcagcagcacaagctgaaaatggaaaaggagagaaatgctcggcgtaagaaaaaaaaggccccagcagcggcttcagaagaagctgcctttccgccagtagtcgaagacgaagaaatggaggcatctggcgtatccggcaatgaggaagaaatggtggaagaggctgaagccactgtgaacaatagctccgacacagagagtatcccctctcctcacacagaagccgctaaagataccgggcaaaatgggcctaagccaccagctaccctgggggctgacggaccccctcccggtcctccaacacccccaccagaggatattcccgctcccacggagcccactccagcatcagaggctacaggggctcccactcctcctccggctcctcctagcccctccgctcccccaccagtagtgccgaaggaggagaaggaggaggagacggccgctgcccctccggttgaggaaggtgaggaacaaaaacctcccgcagcagaagagctggccgtggatacagggaaggcggaagaacccgtgaagtccgagtgcacggaagaggctgaagaaggaccggcaaaggggaaggatgcagaggcagctgaggccactgctgaaggagctctcaaggcagagaaaaaagaaggcggaagtgggagagcaaccacggctaaaagctctggagctccccaggacagtgactcctcagctacatgctcggccgatgaggtggacgaggccgaggggggtgacaagaaccggctgcttagtcctaggccgagcttgctgacaccaacgggggaccctcgggctaatgcctcgccccagaaaccgttggacttaaagcaattgaagcaacgtgctgctgcaatcccacctattcaggtgactaaagttcacgaacctcctagggaagacgccgcacctaccaaaccggctccaccagcgccacctccaccgcagaatctccaacctgaatctgatgccccacagcagcctggcagctcaccacgtgggaagagccgttccccggctcctcccgctgacaaggaagcagaaaagccagtcttcttccctgccttcgctgcggaagcccaaaagttacccggagatcctccttgttggacctcaggtctcccgtttcccgttcctcctagagaagtgataaaagcctccccacacgctccagatccaagtgccttcagttacgcccctcccggacacccccttcccctaggactccacgacactgcaaggccagtcctgccacgtccaccaactatctccaatccacctccactgatttcctcagctaagcatcccagtgtcttggaaaggcagattggagctatcagccaggggatgtctgtgcagctgcatgtcccctactccgaacacgcaaaggctccagtaggtcctgttactatgggtctgccactgccaatggatcccaagaaactcgctcctttcagcggagtaaagcaggaacagctctcccccagaggacaggcagggcctcccgagtctttgggcgtgcccaccgctcaggaggctagcgtgctgagaggaaccgctttgggatctgtgcctgggggtagcattactaagggcatcccttccacaagagttcccagcgacagcgccatcacctatagaggatccatcactcacggaacaccagctgacgtcctgtacaaaggcaccataaccagaatcatcggcgaagactctccttctaggctagacagggggcgagaggactctcttcctaagggacatgtcatctatgaggggaaaaaaggacacgttctaagttatgaaggcggaatgtctgtgacgcaatgcagcaaggaggatggcagatcctcatctggccctcctcatgagaccgcagctcccaagagaacatacgacatgatggaaggcagagtcggacgcgctatctcctccgcctctatcgagggtttgatgggtcgggctattcctcccgaaaggcattcgcctcaccacttgaaagaacaacatcacattcgtggatcaattacccagggaataccgcgttcatacgtcgaagctcaggaggactatctgaggcgggaggctaaactcctgaagcgtgaggggactcccccaccacccccaccttcccgagatctgactgaagcctacaagactcaggctctcggaccactcaaacttaaaccggctcatgaggggttggtcgctactgtgaaggaagccggtcgatcaattcacgagatacctagagaggagctgcggcacacaccggaactgccactggcgccacggcctctgaaggaaggttctatcactcagggcacaccccttaagtacgatacaggcgctagtacaaccggtagtaagaagcatgacgtgcggagtttgatcggcagccctggaaggacatttccaccagtccatcctctggatgtcatggctgacgccagagccttggaaagggcctgctacgaggaatctctcaaaagtcggcctggaacggcctcctcaagtggagggtccattgccaggggagcgcctgtcatagtgccagagctcggcaagccaaggcaatctcctcttacgtatgaggaccatggcgctcctttcgcaggccatttgcctcgcggatctcccgttaccacacgcgagcctacacctcgtttgcaggaagggagtcttagtagcagtaaagcatcgcaggacaggaagctaacctcaacaccacgggagatcgccaaaagtccccactccacggtgcccgagcatcacccccatccaatatctccatatgaacacctgctgcgaggggtgtccggcgtcgacttataccgctcacatattccactggcttttgatcctacatcaatccctagagggatccccttagatgctgcagccgcttattatctgcctagacatctggcgccaaacccgacatacccacatctatatccaccctacttaatcagaggctatcctgacactgcagccctcgaaaaccggcagacaattataaacgactatatcacatcacagcagatgcatcacaacgctgcaactgctatggcccaacgagctgacatgctgaggggattgagtcccagagaatcctccctggcattaaactatgccgctgggcctcgcggtatcatcgacctatcccaggtgccccatttaccagtactggtaccaccaacccccggaactccagccacagccatggatcgcctggcctatcttcccaccgcaccccaaccattttcttctagacatagcagttccccactatcaccgggaggacctacccacttgacaaagcctactacaacatcatcttcagaaagggagcgtgaccgcgatcgcgaaagagatagagaccgcgagagagagaaaagtattctgacgtcaacaaccactgttgaacacgcacccatttggagacccggaaccgaacagtcttcaggatcttctggaggtggcggaggctcgagtagtaggcccgcttcacactcccatgctcatcaacactcacccatttctcccaggacccaggatgcgctgcagcagagaccaagcgtactgcacaataccggcatgaagggaattatcaccgcggtggagccctcgacaccaactgtgttgcgctcaacatccacgagctccccagtgcgccctgcagccacattccccccagcaacgcattgcccactgggcggtaccctcgatggagtctaccccactctgatggagccagtcctgttgcctaaggaagcccctcgggttgcacgtcctgagagacctagagcagataccggccatgcttttctcgccaagcctccggctaggagcggacttgagccagcttctagcccatcgaaaggtagcgagcctaggcctctcgtaccaccagtgtctggacacgcaaccattgctaggacccccgctaaaaatttggcgccacaccacgcatcgccagatcccccagcccctcccgctagcgcgtcggatccacatagggaaaagactcagtccaagccattctcaatccaagagctcgagttgagaagcctgggctaccatggcagtagctattcccccgagggagtggaaccagtgtcacctgtctcctccccctctttgacacatgacaaagggctgcctaagcaccttgaggagctcgataagtctcacctggagggagaactcaggccgaaacaaccaggtcccgtaaagctgggtggtgaggctgctcacctccctcacttgagacccctgcccgagagccaaccaagctccagtcctctgctgcaaacagccccaggggtcaagggacatcagcgcgtggtaaccctagctcagcatattagcgaagtcatcacccaggattacactagacaccatccacagcagctcagcgccccactgccagcacccctatattcattccctggtgcaagctgtccagtcctggacctgcgtcggcctcctagcgatctttacctaccaccacctgaccatggagctccagctcgaggctctccccacagcgaaggaggcaaacgatccccggagccaaataaaacctcggtgctcgggggtggcgaagatgggatagagcccgtctcgccacccgaaggaatgaccgaaccagggcactcccgaagtgctgtgtatcccctgctgtatcgagacggcgagcagacggaaccgtcccggatgggcagcaaaagcccaggcaatacttcacagcctcctgcgtttttcagtaaacttactgaatcaaactcggccatggtgaagtcgaagaagcaagagatcaataagaagctcaatacgcacaataggaatgagccggagtataacatcagccaacccggaactgagatctttaatatgccagcaatcacgggcaccggtctgatgacctatagaagccaagctgtccaggaacacgcctctacaaatatgggtctcgaagccattatccgaaaggccctgatgggcggtggaggcaaagccaaggtgtcaggccgtccttcctccagaaaggctaaatcccctgcacctgggctggcctctggagaccgtcctcctagtgtatctagtgttcactctgaaggggactgcaaccgacggactcctctgactaatagggtctgggaagatcggccttccagcgctggttctactccattcccctataacccactcatcatgcgcctgcaggctggcgttatggcctctccacccccacccggactgccagcaggttctggtcctcttgcgggtcctcaccacgcatgggacgaggaacccaaaccattgctctgctcacaatacgagacgctgtctgactcagagta

SEQ ID NO: 233125 - DNA, 7544 bp, Artificial Sequence
  Description of Artificial Sequence: Synthetic coding sequence
atgtccggcagtacgcagcccgtggctcagacttggagagcaaccgagcctcgttaccctccccactccctgtcttatccggtacagatcgctcggactcacactgatgtcggactcctagaatatcaacaccacagtagggactatgcctctcatctgagccccggaagcattatccaaccccagcgtcgacgaccatccctcttgtccgagtttcagcccggaaacgaaagatctcaagagctacatctgaggccagaatctcatagttatctcccagagttaggaaaatccgaaatggaattcattgaatctaagcggcctcgcctggaattgcttcccgacccgctgttgcgtcctagcccacttctggccacagggcagccagcaggatcggaagaccttactaaggatcggtcactgacgggtaagctggaaccagtgagtcctcctagtcctccccacactgatccagagctcgagttggtcccgcctcgactgtcgaaggaagaactaatccagaatatggacagggtggaccgggagattaccatggtagaacagcagatttcaaagctgaagaagaaacaacagcagctggaggaggaagcagcaaagcctccggagccagagaagcccgtcagtcctcccccaatagaaagtaaacaccgtagcttggtgcagattatctatgacgagaatcggaaaaaggcagaggccgctcataggatcctagagggactgggaccacaagtggagctgccactgtataaccagccttcagatactcggcagtaccacgagaacattaaaatcaatcaggcaatgcggaagaagttaatactgtactttaagaggcggaatcacgctcgcaaacaatgggaacagaagttttgtcagagatacgatcagctgatggaagcttgggagaagaaggtagagagaattgagaataatccacgacgccgtgccaaggagtcaaaggtccgcgagtactacgagaagcagtttcccgaaattagaaagcagagggagctccaagaaagaatgcaatcccgcgtggggcagagaggatccgggctgtccatgtcagctgcaaggtccgaacacgaggtgtctgagatcattgatgggctgtctgagcaggagaatctcgagaaacaaatgcggcaattggccgtaatcccaccaatgctctacgacgccgatcagcagcggatcaaatttatcaacatgaacggactgatggcagacccaatgaaagtctataaggatagacaggttatgaatatgtggtctgagcaggagaaggaaacattcagagagaagtttatgcagcatcccaagaattttggcctgattgccagttttttggagcgcaagacagtagctgaatgtgtcttatattactacctgactaagaaaaacgagaattataagagcctagtccggaggtcctaccggcgaaggggaaagagccaacagcagcagcagcagcaacagcagcagcagcagcagcagcaacagcagcccatgccacgctccagccaagaggagaaagatgagaaggagaaagagaaggaggctgaaaaggaagaagagaagccagaggtggagaatgacaaagaagaccttttaaaggaaaagaccgatgacacttccggggaggataacgatgagaaagaggccgtggcttccaaaggcagaaaaaccgccaattcgcagggcagacgtaagggtaggattactcgctcaatggcaaacgaggccaacagtgaggaagctattacacctcagcaatccgccgaactggccagcatggagttaaatgaaagttcaaggtggactgaagaggaaatggagactgccaagaaggggctcctggagcacggcaggaactggtccgctatcgccaggatggtggggtccaaaactgtgagccagtgcaaaaacttctattttaattataaaaaacgacagaacctggacgagatcctgcagcagcacaaactaaaaatggaaaaagaacgaaacgcacgacgcaagaagaaaaaagcacccgctgccgctagcgaagaggccgcattcccccctgtggtggaagacgaagagatggaggccagtggtgtctctggtaacgaagaagaaatggttgaggaggcagaagcccttcacgcctcagggaatgaggttccccgaggggaatgcagcgggccagccaccgttaacaattcctcggatacggaatcaatccccagcccccatactgaggccgctaaggacacgggacagaatgggccaaaaccccctgcaacattaggtgcagacggcccacccccaggaccaccgactccccctcctgaggatattccagcccctacggagcctacaccagctagcgaagccaccggagcgcctacacctcccccagcacccccatcacccagtgccccacctcctgtggtaccaaaagaggaaaaggaggaggaaaccgcagcggctccaccggtggaagaaggtgaggagcagaaacctccggcagccgaggagctggccgttgatacgggcaaggccgaggagccggtgaaatcagagtgtaccgaagaagccgaagagggacccgcaaagggcaaggacgctgaagcggctgaggcaaccgctgaaggggcactgaaagcggagaaaaaagaaggcggttcggggagagccactacagcgaaaagcagcggtgcacctcaggacagtgattctagcgcaacttgcagtgccgatgaggtggacgaggccgagggtggagataagaaccggcttctgtcccccagacccagcctgctgactcccaccggcgatccacgcgctaacgcctccccgcagaagccactagacttgaagcaacttaaacagagagccgcagctatacctcccattcaggtgaccaaggtgcacgaacctcccagagaagatgctgcaccgacaaagccagccccaccagcacctccgcctcctcagaatctccagcctgaatcagacgcgccacagcaacccggatctagccctcgaggaaaatcccgcagtccagcccctccagccgataaagaagcattcgccgctgaggcccagaagcttccaggcgaccctccttgctggacgagcgggctgcccttccccgtcccgcctcgcgaagtcatcaaagcaagccctcacgcacctgatcccagcgccttttcatacgcccctccaggccatcccctgccactaggcttgcatgatactgcgagaccagtactgccccgacctcccaccattagcaacccaccacccctaattagttctgccaaacaccccagtgtcctagaaagacagataggggcaatatcccagggcatgagtgtgcagctgcacgtgccatacagcgaacacgcaaaggccccagtgggacccgtaacaatgggcctgcccttacccatggacccaaagaaacttgcgcctttctccggcgtgaaacaagaacaattgtcacccagggggcaggcgggacccccagaatccttaggcgtccccactgcccaggaagcttctgtgctgaggggtacagctttagggagcgtcccgggaggctccataacgaagggcattccctctacacgcgtcccttccgacagtgccatcacctataggggatctattactcacggtacaccagcagatgtgctttataagggaaccatcacaagaataattggcgaggattcgccttctcgcctggatcgcggtcgggaagatagtctgcctaaaggccatgttatctatgaggggaagaaaggccatgttctctcgtatgagggcggaatgagcgtcacacagtgtagtaaagaagatgggcgatcatcttctggcccacctcacgagacagctgccccaaaacgtacctatgatatgatggagggtcgggtggggagagccatcagcagtgcatccatcgagggcctgatggggagggcaatccccccagaacgacattcaccacaccacctgaaagaacagcatcatatccgcggttcaattacacagggtattccaaggtcatacgtggaggcccaggaggattacctgagacgcgaggcaaagctgctcaagagggaaggcactcctccacccccacctccttcacgcgatctcactgaggcctataaaacccaggcccttggtcctctgaaactgaagccggctcacgagggacttgttgccactgtgaaggaggccggaaggtccatacacgagatacctcgggaggaattaagacatacacccgagctgccactggctcccagacccttgaaagagggatctatcactcagggcacccccctgaaatatgacactggagcgtccaccaccgggtcgaaaaagcatgacgttcgatcactgatcggctctcctggcagaacgttcccaccagtgcatccgctggacgtgatggctgatgcccgtgcccttgagcgcgcatgttatgaggagtcactgaaatcccgccctggaaccgcatcctcttcaggtggttctatagctcggggtgcacctgtgattgttcccgaactgggtaaacctcgccagtctcccctcacatatgaagatcacggggcaccgttcgcagggcacctacccaggggatcacctgtgactacccgcgagcctactcccaggctgcaggagggctcattgtcctcttcaaaggcatctcaggaccgaaagctgacaagcaccccaagggagatagccaagtcaccacattccacagtccccgaacaccatcctcaccccatttccccatatgaacacctgcttagaggcgtttctggtgtggatttgtacaggtcgcatattccgcttgcctttgatccaacgtctatacctagggggatcccattggatgctgctgccgcatactatctgcctcggcatctggcccctaaccctacgtacccccacttataccccccatatctcatcagagggtacccagacacggcagctttggagaatcgacagacaatcatcaatgattacattacaagccagcagatgcaccacaatgcggctactgcaatggcacaacgcgcagacatgctcagagggctcagccctcgcgaatccagtttggcactgaactacgcagcaggtccccgaggcatcatagacctgtcccaagtgccacacttaccagtcttggtgcctccaacacccggaacccccgctactgccatggacagactggcatatctccccacagctccgcagccattttcgtctcggcactcttcctcgcctcttagccccggtggacctactcacctcaccaagccgactactacctcttcctctgaacgggagcgcgatagggatcgggaacgggaccgcgatcgggagcgagaaaaatctatcctgacctcaaccacaaccgtggagcacgccccaatctggcgcccaggcaccgaacagagctccggctcctcaggaggtggcggtggatcctcctccaggccagccagtcacagtcatgcccaccagcattctccaatctctccccgaactcaggacgcactgcagcagcgccctagtgttctccacaacacagggatgaaaggaattatcacagcggtggaacccagcacccccaccgtgctgagatccacttcgacgagcagcccagtgcgcccagccgcaacctttcctccagcaactcattgccctctaggcggaaccctggacggtgtttaccctactctcatggaacccgtcctgttgcccaaggaagctcctcgcgtcgccagaccagaacgcccacgcgcagatacagggcacgcattcctggcaaaaccccctgctcgctctggcttggaaccagcaagcagtccgagcaaggggtcggaaccacgcccattagtccctcccgtgtcaggtcatgccacaatagccagaacccccgcaaagaatctcgcccctcatcatgccagccctgatccgcctgcaccccctgcatcggcttcagacccacacagagagaagacacagtccaaaccttttagcattcaggaactggaactacgatccctcggctaccatggctccagttattcccccgagggcgtggagcctgtcagcccagtatcctccccttccttaactcacgacaaaggcctgcctaagcacctggaagagctcgacaagagccacttggaaggcgagcttcggcctaagcagccgggtccagtcaagctggggggagaggccgcacatctgccccatctgcgaccgctccctgagtcacagccaagttccagtcctctgctgcagacagctccaggcgtcaaggggcaccagagggtcgtaaccctggctcagcatatttctgaagttataacccaagactatacccgccaccatccgcagcagttgtccgctccactgccagcaccactgtactctttccccggtgccagttgcccggtcctggaccttagaaggcccccatcggacctgtaccttccccctccagatcacggagcccctgctaggggaagcccacactcggagggaggcaagcggagtccagagcccaacaagacttcggtattggggggtggtgaagacggtatcgaacccgtgtccccgccagagggcatgacagaacccggacatagtagaagtgcggtgtatcctctcctctaccgagacggcgaacagacagagccaagtcggatggggtcaaaaagcccagggaatacaagccagcctccggcattctttagtaaacttaccgaatcaaattctgctatggtaaagtccaaaaagcaagaaattaacaaaaagctcaacacccacaaccgcaatgagccagagtacaatattagtcagccaggcacagaaatattcaacatgcctgccatcacgggtacaggcttaatgacctatcgctctcaggcagtccaggagcatgcatcaacaaacatgggactggaggcaatcatccgcaaagctctgatggggaagtacgatcaatgggaagagtcacctcctttgagcgctaatgctttcaatcccctcaacgcctcagccagcctaccagccgctatgccgatcacagccgctgacgggcgttccgaccacacactcacttcccccggaggtgggggtaaagctaaggtctctgggaggccaagcagccgaaaggccaagtcccccgctcctggcctcgcctccggagatcggccaccctcagtgagttcggtgcactccgaaggcgactgcaatcggagaacacccctgacaaaccgggtgtgggaggaccggccttcttccgcgggatccacgcctttcccatataatccacttattatgaggttacaagcaggcgtcatggctagcccacctccgcctggtctgccagccggaagcggaccattggccggaccccaccacgcttgggatgaagaacctaagccattgctgtgtagccagtacgaaacgctaagcgatagcgagta

SEQ ID NO: 233126 - DNA, 7514 bp, Artificial Sequence
  Description of Artificial Sequence: Synthetic coding sequence
atgagcgggtcaactcaaccagtggctcagacatggagggcaacggaaccacgttacccaccgcactcgcttagctacccagttcagattgcaaggactcatacggacgtcgggcttcttgagtatcagcaccattcccgggactacgcgtcacacctgtccccaggcagtatcatacagccccagcggcgaagaccttccctgctgagtgagtttcagccaggcaacgaacggagccaggagctgcacctgcgtccggaatctcatagttacctgcctgaactagggaagtctgagatggaatttatcgaaagcaagcggcctagattggagttgctccccgacccattgttacgcccttccccactcctcgccaccggtcaaccagctgggtccgaagacctgaccaaagaccgctctctgaccggcaaactcgagcctgtgagccccccaagtccccctcacaccgatcccgagttggaactcgtgccacccaggctgtctaaggaagagttgatacagaacatggacagagtggatcgtgaaatcacaatggtcgaacagcagatatctaaactgaagaaaaaacagcagcagctggaggaggaggctgcgaagccgcctgaacccgagaagcctgtttccccccctcccatcgagtcaaagcatagaagtctcgtccagattatttatgatgagaacagaaaaaaagccgaggcagctcatcgcattctggaagggttgggcccacaggtcgagctccccctgtacaaccagccaagcgacacccgtcagtaccatgagaacatcaaaatcaatcaggcaatgcgaaagaaactgatcctttatttcaagagaaggaaccatgccaggaaacagtgggaacagaagttctgccagaggtacgatcaacttatggaggcctgggaaaaaaaggtggaacgcattgagaacaaccctaggaggagagccaaggagtccaaggttcgtgaatactatgaaaagcaatttccggagatcaggaagcagcgcgaactccaggaaaggatgcaaagagtcggccaacggggaagtggtctttccatgtctgctgctcgttctgagcacgaagtttcggagataatagatggtctgagcgagcaggaaaatcttgagaagcagatgaggcagctggcagttatccccccaatgctatacgacgcagatcagcagaggattaaattcatcaacatgaacggtttaatggctgaccccatgaaagtctacaaagatcgacaagtcatgaatatgtggtctgaacaagagaaggaaactttccgcgaaaagttcatgcagcaccccaaaaatttcgggctgatcgctagctttcttgaaagaaagactgtggcagaatgcgtgctgtattattacctgactaaaaagaacgagaattacaagtcgctggtgcgacggtcctacagaaggagaggtaagtctcagcagcagcaacagcagcaacagcagcagcagcagcaacagcaacaacaaccgatgcctcggtcatctcaggaagagaaggacgaaaaggaaaaggagaaagaagcagaaaaggaggaggaaaaaccagaggtcgaaaacgataaggaggacctgcttaaagagaagactgacgacacttccggcgaggacaacgatgagaaggaagccgtcgcatccaaggggaggaagacggcgaactcgcagggtaggagaaagggcagaattacccggagcatggctaacgaggccaactctgaggaagccattactcctcagcagagtgctgagctagcatcaatggaattaaacgagagctcaagatggactgaggaggaaatggaaaccgctaaaaaggggctcctggagcacggcaggaattggagcgcgattgctcgcatggtgggttcaaagaccgtgagtcagtgtaaaaacttctattttaattacaagaaaagacagaacttagatgaaattctgcaacagcacaaactcaagatggagaaagagagaaatgccaggaggaagaagaagaaagcacctgcagcggcatccgaggaagctgccttcccacctgtcgtggaagatgaggagatggaagccagcggtgtgtcaggcaacgaggaggagatggtggaagaggccgaggcaaccgtaaacaactctagcgacaccgagagcattcccagcccccacaccgaggcagccaaagataccggtcagaacggacccaagccacccgctacgcttggcgcagacggcccacccccaggccctccgactccgcctccggaggacatccccgctccaacggagcctacgcccgcatccgaggccacaggggcacccactccccctcccgctcctccctcaccgtccgcgccaccccctgtggtgccgaaagaagagaaggaggaggagacagccgcagcccctcccgtggaagaaggggaggagcagaaaccaccagccgctgaagagctcgccgtggacacaggcaaagccgaggaaccggttaaaagcgagtgcacggaggaagccgaagagggacctgccaaaggaaaggacgcagaggccgctgaagctaccgcggagggtgcgctgaaagccgagaagaaagagggcggaagcggacgcgctactaccgccaagagctcaggtgcacctcaggattctgacagctctgccacatgtagcgcagatgaagtggacgaggccgagggcggtgacaaaaatcgactgctgtccccccgtccctccctgctaactccgaccggtgatccgagagccaacgccagccctcagaagcctttggatcttaaacagttgaaacagagggctgccgcaataccacccattcaggtcactaaagtgcatgagccccctagggaagatgcggcaccgaccaagccagcccctccagctccaccgcctccccagaatctacagcctgagagtgacgccccacaacagcctggcagcagccccagaggaaagagtcgatcccctgcaccgccagccgacaaggaagcagagaaacctgtattcttccccgctttcgcagctgaagcccagaaactgccaggggatcccccatgctggaccagcggcctgcctttccccgtcccgcctcgggaagtgatcaaagcctcccctcatgcacctgatccctcagctttcagttatgctcctcctggccaccccctgcctctaggtctacacgatactgctcgcccagtgctcccgcgaccgcctacaatcagcaatccaccacctcttatctcttccgcaaaacacccatcggtcctcgaacgccaaataggagcaatctcgcagggtatgtcagtgcagttgcacgttccttacagcgaacatgctaaggccccagtgggtcccgtgactatggggttacctctgcctatggacccaaaaaagctggctcccttcagcggggttaaacaagagcaactgtctcctcgaggccaggccggacccccagagtctctgggtgtcccaacagcgcaggaggcctcagtcctccgaggtaccgcccttggcagtgttccaggcggatccattactaagggaatcccatcaacaagggtcccctccgacagcgccataacatatcgaggcagcattacgcatggtacccccgctgacgtgctatataagggtacaattactcgaataatcggtgaagacagcccctcaagactggacagggggcgagaagattccctccctaagggacatgtcatctatgagggaaagaagggacacgtgctgtcttatgaaggtgggatgtctgtcacgcagtgcagcaaggaagacggcaggtcttctagcggaccccctcatgaaacagctgctcccaagaggacctatgatatgatggagggcagagtcggacgcgcaatcagctcggcctccattgagggccttatgggaagagccatcccgcctgagaggcatagccctcaccacctgaaggaacagcatcacatccgcggaagtataactcagggaattccacgcagttatgtcgaagcgcaagaggactatctgagaagggaagctaaactcttgaagcgtgaaggtactcctcctccaccacccccatctcgggacctgactgaggcatacaaaacgcaggccttgggcccactgaaactgaaaccagcccacgaagggctggtagcaaccgtgaaggaggctggcagatcaatacatgagattccaagagaggaacttcgtcacacccctgaacttccactcgcaccaagacccttgaaggagggtagcattacccaggggaccccccttaaatatgacacgggggcaagcactactgggtccaagaagcacgacgtcagatctctgataggcagtccagggagaacattccctcccgtccatcccttggacgtgatggcggacgccagagccctggagcgggcatgttacgaggagagtcttaagagtaggccaggaaccgcctctagtagcggcggtagcatcgcgaggggagcgcctgtaattgttcctgagctcggcaaaccaagacagtctccactgacttatgaggaccatggagctccctttgccggtcatctgccacgcggatcaccggttactacaagagagcccactcccaggctgcaggagggtagcctatccagctctaaggcatctcaagaccgtaagctgacatccacacccagagagatcgccaaaagtccccactcaaccgtccccgagcaccacccccatcctatttccccttacgagcacctcctgagaggcgtgtccggcgttgacctttataggtcgcatatcccgttggcattcgatccaaccagcatccctcggggaattcctctggacgccgcagcagcctactacctaccacgccatcttgctccaaaccccacatatccccacctttaccccccttatctgattagaggctatcccgacacagccgcacttgaaaataggcagactatcattaacgattatatcacctctcagcagatgcatcataacgctgctaccgccatggcacagagagctgacatgctacgcggtctgtcccctagggaaagttctttggcgcttaactatgcagctgggccacgaggcatcatcgatctctcgcaggtgccccatctccctgtgctggtgcctcccacgcccggaacgcccgcaacagctatggatagattagcctatctgccaaccgcgccacaacccttctctagtaggcacagctcttctccattgtccccaggcggacccactcacctgaccaagcctacgacaacctcctcatccgagcgcgagcgggatagagaccgcgagagagacagagatcgcgaacgcgagaagagtattttaacttccacgaccaccgttgagcatgctcccatttggaggcccggtaccgagcagagctcaggcagttccggaggaggaggcggatcctctagccgccctgcttcacattcacacgctcatcaacattctcctatatctcctcggacgcaggacgccctgcagcagaggccttccgtacttcataacactggtatgaagggcatcattacagcagtggaacccagtacacccacagtattgcgctccacttctacttctagcccggtgagaccggctgcgacgttcccacctgctactcattgccctctcggcggaacactggacggtgtctatcctactctgatggagcccgtgctgctgcctaaggaggcccctagagtcgctcgtcccgaacgacctcgtgcagacaccggacacgcctttctggccaaaccccctgccagatccggactcgagcccgcaagcagcccgtccaaaggaagcgagccaaggccactcgttccgcctgtaagtggacacgccacaatagcacggactccggcaaaaaacttggccccacatcacgcgagtcccgatcctccagctcctccagcttcggccagtgatccccatcgagagaaaacccaatctaagcccttctcaattcaagaactcgagctccggtcactagggtatcacggatcttcttactctcctgagggcgtcgagccagtgtcccccgtgagctctccttctctaacccacgataaggggcttccgaagcacctcgaggaactcgataagtcacatctggagggagaactgaggccaaaacagcccggtcccgtgaagttggggggagaagcggcacacctgccccatctacggccactgcccgagagccagccaagttcttcgcctcttctgcagactgctccaggggtgaagggccaccaacgggtggtaacccttgcccagcacatcagtgaggtgattactcaagactatactcggcatcatcctcaacaattgtccgccccattacctgccccattgtattcatttccgggagcaagctgtcccgtgctggatctgagaagacctcccagcgatctgtacctaccaccccctgatcatggcgcaccagccagaggatccccacacagtgagggcggaaaacggagcccagagcccaataagacttccgtccttgggggtggcgaagacggcatagagccagtaagtcccccagaggggatgacggagccagggcactcacgctcggccgtgtaccccttgttgtaccgtgatggagagcaaaccgagccctctagaatgggatctaagagccccggaaacacgagtcagccgccagcgttcttcagtaaattgactgagagcaacagcgctatggtgaagtcaaagaaacaagaaataaataagaaactgaacacccataatcggaacgagcctgaatacaatattagccaaccgggtaccgagattttcaatatgccagctataaccggcaccggactcatgacgtacaggtctcaggccgtgcaggaacacgcaagcacgaatatgggattggaagccattataaggaaggctctcatgggcaagtacgatcagtgggaggaaagcccacctcttagtgctaatgccttcaatcccctcaacgcgtccgcctctctgcctgccgcaatgccaattacagcggctgacggtaggtccgatcataccttgaccagccccggtggcggaggaaaagctaaagtctcaggtcgtccttcctctagaaaagccaaaagtcccgctccgggtctcgcctccggtgacaggcccccttctgtgagttctgtgcattcggagggcgactgtaacagaagaaccccactcacgaatagagtctgggaggatcggcctagttcagctggatcgacgcccttcccttataacccgttgattatgagactgcaggccggagtaatggccagtcctccccctccagggcttccagctggcagtggtcccttggctggtcctcaccatgcatgggatgaggaaccaaagcccctgttgtgtagccagtacgagactttaagcgatagcgaata

SEQ ID NO: 233127 - DNA, 7541 bp, Artificial Sequence
  Description of Artificial Sequence: Synthetic coding sequence
atgtctgggagtacccagccggtcgcacagacctggagagccaccgagcctcgctatcctcctcacagtctgtcctaccctgttcagattgctcgcacacacaccgacgtcggactgctagagtatcagcaccacagtagagattacgctagccacctttcccccggatcaattatccaaccgcagaggagacgtccctctttgctttcggagttccagccaggaaatgagaggtcgcaggaattacacctgcggcctgagagtcacagctatctaccagaactggggaagtccgagatggaatttattgagtccaagcggccacggctcgagctcctgcccgatcccctgttgcgaccgagccctcttctcgctaccggtcagcccgcaggtagcgaagatctgacaaaggatagatccctgaccggcaaactcgagcctgtaagcccccctagcccccctcataccgaccccgaactggaactggttccacccagactatctaaggaagaactgatccaaaatatggaccgtgtggaccgggaaatcactatggttgagcagcaaatatcaaaattgaaaaagaaacagcagcagctggaagaggaggcggctaagccacccgaacccgagaagcctgttagtccacccccaatagaatccaaacacaggtccctggtgcaaattatctacgatgaaaacaggaaaaaggccgaggcagcgcacagaatcctggaagggctgggcccacaggtggagctgcctctgtacaatcagccctcagatacccgacagtatcatgagaatataaagattaatcaggcgatgcggaagaaactcatcctctactttaaacgcagaaatcacgctcgtaagcagtgggagcaaaaattctgtcagaggtacgaccagctaatggaggcctgggagaagaaggtcgaacgaattgagaataatcctaggaggagggctaaagaaagcaaggtgcgagagtactatgagaagcaattccctgaaatcagaaaacaacgtgaactgcaggagcggatgcagtcgcgcgtcggacagagggggagtggactttcaatgtctgccgcacggtctgaacatgaggtgagcgagattattgatgggctgtcagagcaggaaaatctggaaaagcagatgaggcaactcgcagtcattccacccatgctctacgatgccgaccagcagagaataaaatttatcaatatgaatggccttatggccgatcctatgaaagtatataaagatagacaggtcatgaacatgtggtctgagcaggagaaagaaactttccgggaaaagtttatgcagcaccccaagaacttcggcttgatcgcaagctttctggagcggaagacggtggccgagtgcgtcttgtactattatttgactaaaaagaacgagaactataaaagtctcgtccgcaggtcctatcggaggcgcggaaaatctcaacagcagcagcagcagcagcagcagcaacagcagcagcaacaacagcagcctatgcccagatcctcgcaggaggagaaggatgagaaggagaaggagaaagaggcagaaaaagaggaagaaaagccggaggtagaaaatgataaagaggacttgctcaaggagaaaaccgatgacacttcgggtgaggataacgacgagaaagaagctgtggcctccaaaggacggaagaccgctaacagccaaggcaggaggaaaggtaggattactcgatccatggccaatgaggctaattccgaagaggcgatcacacctcagcagtccgccgagctcgcatccatggagctcaacgagtcatctcggtggacggaagaggagatggaaactgcgaagaagggcctccttgagcacgggaggaattggagtgccattgcacggatggtgggttctaagactgtgagccagtgtaagaatttctattttaattacaagaaaagacagaacctagatgaaatactgcagcagcataagcttaagatggaaaaagaacgcaatgcgcgacgcaaaaaaaagaaggcaccagctgccgcatctgaagaggcagcctttccccctgtcgttgaggatgaggagatggaggccagtggagtgagcggcaacgaagaagaaatggtcgaagaggctgaggccctgcacgccagtggaaacgaggtcccgagaggcgaatgcagcggaccagcaaccgtaaacaactcttctgatactgaaagtatcccatctcctcataccgaggccgcaaaggatactggacagaatggtcccaagcctccagctaccctcggagcagatggacctccacctggacctccaactcccccacgcagaaccagccgacctacagagcctacaccggcaagtgaggccactggcgcaccaacaccgccacccgcacctcccagcccatctgctccccctcctgtggtgcccaaggaagagaaagaagaagagacggctgccgctcccccagtggaggagggcgaggaacaaaaacccccagcagccgaggaattggccgtagatacggggaaagccgaggaacctgtaaagagcgaatgtaccgaagaggcagaagaaggacccgcaaaaggaaaggacgccgaagctgctgaggcgacagccgagggcgctctcaaagcggagaagaaggaagggggaagcgggagggcaaccacagctaagagtagcggagccccacaggatagcgattcctcggccacgtgtagtgccgatgaggtagatgaggccgaaggcggtgacaaaaacaggctcctttcaccaaggccctcattactcacaccaacgggggaccctcgagccaacgctagcccccagaagcctctcgacctcaagcagctcaaacagagggccgcagcaatcccacccatccaggttaccaaggttcatgagcctccaagggaggatgccgcacctaccaagcccgcacctccggcaccaccaccccctcagaacttgcagcccgagtccgatgcaccacagcagcccggaagcagccccagaggcaaatctcgttccccagccccacctgccgacaaagaggccttcgcggcagaagctcagaaactacctggagatcccccttgttggactagtgggctcccattcccggtgccacccagggaagtgattaaggcttcaccgcacgctcctgacccatccgccttctcatacgcacctcccggacatcccttacccctaggacttcatgatactgcacgtcctgtgttgcccagacctccaaccatttccaacccaccacccttgatcagtagcgcaaaacacccctctgttctggagcgccaaataggcgctatttctcagggaatgtcagtgcagttgcacgtaccctacagcgagcacgctaaagcccctgtgggcccagtcacgatgggactacctcttcccatggacccaaaaaaattggcccctttctccggtgtgaagcaggagcaactttctccaaggggccaggctggacccccagaatccctcggggtgccaacagcccaggaggcttcagttcttaggggaactgccctagggtctgtgccgggtggcagcattaccaaaggcattccatccactcgagtgccttcagacagcgccattacctatagaggttctatcacccatggtacaccagccgacgtgctctacaagggtaccattacaaggatcattggcgaggattcaccctctcggctcgaccgagggagggaggactctttacccaaggggcacgtcatttacgaggggaagaagggccacgtactgagttacgaagggggaatgagcgttacccagtgctccaaggaagacgggagaagttcctcaggccctccacacgaaacagctgccccaaaacggacctatgatatgatggaggggagagttgggagagccatcagttcagctagtatcgaaggcctcatgggtcgggctattccaccggagagacacagcccacaccacctaaaagagcagcatcacatacgcggaagcattacacagggtatccccagatcctacgtcgaggcccaggaagattatctccgtagagaagccaagctgctcaaaagagaaggaaccccccctccgccacctcccagccgcgatttgaccgaggcatacaaaactcaagcactgggacctcttaaactgaagcctgcacacgaaggcttagtggctacagtcaaagaggccggaagatctatccacgagattccacgagaggagttgagacacacaccagagctgccattagccccacggcctcttaaggagggctccattactcaggggactcctcttaagtatgataccggagcctcgaccacagggtccaagaagcatgacgtgcgctcactgatcggcagcccaggccgaacctttccccctgttcatccactggatgtcatggctgacgcacgcgcactggaaagagcttgttatgaggagagcctgaaatctaggccaggcaccgctagcagcagtggaggatcaatagcaagaggagctccagtcatcgtgcccgaactcggcaaaccgagacaaagtcccttgacctacgaggaccatggggctccctttgcgggacatcttcctcgaggatcacctgtgactaccagggagcccacacctcggctccaggagggatccctgtcaagtagcaaggcaagccaggaccggaaactcacctccactccccgtgaaattgctaaaagtcctcatagcactgtacccgaacaccacccacacccaatctctccctatgaacaccttctcagaggcgtatccggcgtagacctgtatcgcagtcacatcccattggcgttcgacccaacaagcatcccgaggggcatccctcttgatgccgctgccgcatactacttacccaggcaccttgcaccaaacccaacttacccccacctctatccaccttacctgattcgcggatatccagatacggctgcactggagaatagacagaccatcattaatgactatataacctcacaacagatgcaccacaatgccgctaccgctatggcccagcgcgcagacatgcttcgaggcctgtcaccacgggagagcagcctggctctcaactatgcggctggtcctagaggcattatcgacttatcccaagtgccacaccttccagtcttagtcccgcctacgcccggaacacccgctactgcaatggatcgtctggcatacctccccaccgcgcctcagcccttctcgtcccgccattctagctctccgttgtctccaggtggtccaactcacctaactaagcctactacaactagtagcagtgaaagggaacgcgaccgtgaccgagagcgagaccgtgaccgggagcgggagaagagtattcttacatcaactacaaccgtcgaacacgccccaatttggcgcccaggaactgagcagagctccggtagctccgggggaggcggtgggtcttccagtagaccagccagtcacagccacgctcaccaacattctcccatcagtcctagaacccaggacgctctgcagcagcggccttctgttctccacaatacaggcatgaaaggaatcatcaccgccgtcgagccaagcacacctactgtcctgaggagtacctcaacaagttctcccgtgagacctgcggcaacctttccgcctgccacacactgtcctttgggcggtaccttggacggtgtttatccaacattaatggagcccgtgttgcttcctaaagaggcccctcgtgtcgccaggcctgagaggcctagggcagatactggacacgcgtttctggccaaacccccagctagatctggattagagccggcatccagtccttcgaaaggtagcgagccgagacctctcgtcccgcctgtatccggccatgctactattgccagaacaccagctaagaatctggctcctcaccatgcttcaccagaccctccagcccctcccgcttccgcttctgacccccatagggaaaaaacacagagtaaacctttctctattcaggaactggaattgagaagcctgggataccatggtagcagttacagccctgagggcgttgagcctgtgagtccagtgtcgagtccctcgcttacacacgataagggactccccaaacacttggaagagctggacaagtctcaccttgaaggggagctgaggccaaaacaaccaggccctgtcaaactcggcggtgaggctgcacacctcccacacctgcgccctctgcccgaatcccagccctcctccagcccactcctccagactgccccaggagtgaaaggacatcagcgagtagtcactctggcccagcatatcagcgaagtgataacacaggactacactaggcaccatcctcagcagctgtccgcacctctgcccgcaccgctgtatagctttcccggtgcctcatgtccggtcctcgatctgcgcaggccaccttccgacctctatcttcctcctcctgaccacggggctcccgcaagaggatccccccatagtgaaggaggcaagaggtcacccgaacccaataagacatcagtgttgggcggaggtgaggatggtatcgaaccagtctcacctcctgagggcatgacagaaccaggtcatagccggagcgccgtatatccactgctatatcgcgatggggaacaaaccgagccctccaggatgggatccaaatcacccggaaacacttcccagccacccgcttttttttccaaactgaccgaatccaactcagccatggtaaaatctaagaagcaggagatcaacaagaagctaaatacgcacaatagaaatgagcccgaatacaacatcagtcagcccggaacagagatcttcaatatgcccgctatcacgggtacgggtctgatgacctatcggtcacaggccgtgcaggagcatgctagcaccaatatgggtttggaagccatcattcggaaggccttaatggggaagtacgatcagtgggaggagtctcctccactcagtgctaacgctttcaatccgcttaatgccagtgcctctctccccgcagccatgccgatcacagctgccgatggtcgatccgaccacaccctcacctcccctgggggtggcggaaaggcaaaggtgtcagggagaccgtcatctagaaaagcgaaatcaccagcacctggcctggctagtggggacaggcccccttcggtatctagcgtccattctgaaggagattgcaacaggagaacacctctaactaacagggtctgggaagatcgacctagctcagccggttccaccccattcccatacaatccactcattatgcgcttgcaggcaggcgttatggcttctccccctccgccaggtttgccagccggttcaggaccgctcgccggaccccaccacgcatgggatgaggaacctaaacctttactctgcagccagtatgagactctgtcggacagtgagta

SEQ ID NO: 233128 - DNA, 1821 bp, Artificial Sequence
  Description of Artificial Sequence: Synthetic coding sequence
ctgcaatccggtgctactcattgcccgttaggagggacactcgacggcgtttaccccaccctgatggaacccgttctgcttccgaaggaggcacctcgcgtcgcaagaccagaacggccacgggcagatacgggccatgcctttctggcaaagccaccggcaagatccgggctggaacccgcatcttcgccctcgaaaggatcggagcctagacccctggtgccacctgtgtcaggacatgccactatcgcacgaacacccgcaaaaaatttagccccacatcacgcttctcctgacccccctgcccctcccgctagcgcaagcgacccccatcgcgagaagacacagagcaaacctttcagcattcaagagcttgaactgagatccctgggctaccatggctcctcctacagccccgaaggtgtggagcccgtgtctcctgtctccagcccctcactaacacatgacaaaggtttgcccaaacatctcgaggaactggataaatcccatctggagggggagcttcgaccaaaacagccaggccctgtgaagcttggaggcgaggcagcacaccttccccatctgcggccattgcctgaatcgcaaccctcaagctcgcccctgctgcaaacagccccaggtgtgaagggccatcagcgggtcgtgaccctagcccagcacatttccgaggtgattacacaggattataccagacaccatcctcagcagctgagcgcaccgctgcctgcgccattgtactctttccctggagccagctgccccgttctggacttgagaaggccaccatcagatctgtatctgccacctccagaccatggtgctcccgctcggggaagcccccattcagagggaggaaaaaggtctccggagcccaacaagacttcggtgttaggaggaggagaggacggcatcgagcccgtgtccccacctgaagggatgaccgaaccaggacatagccgctcagccgtgtatccactcctgtatcgcgatggcgaacaaacagagcccagccggatggggtccaagagcccaggcaacacttcgcagccccctgcgttcttcagcaaattgaccgagagcaacagcgctatggtgaaatcaaaaaagcaggagattaataaaaagctgaatacccacaatcggaacgagcccgaatacaatatctcacagccgggaacagagatcttcaacatgcccgctataacaggaacaggactcatgacgtaccggtcccaagcagtccaagagcacgcatccaccaacatgggcctagaggccatcatacgaaaggctctgatgggcaagtacgatcagtgggaggaatctcctccactcagcgccaacgcgtttaatcctctgaatgcatcggcatctctgcctgcagccatgcccataactgctgcagacggacgcagcgaccacactctaacctctccaggtggcggtggcaaagccaaagtgtccggaaggcccagctcccgaaaggcaaaatcgcctgctcccggactagcgtcgggcgaccgccctcccagtgtttccagcgtgcatagtgaaggcgactgtaacaggaggacacctcttactaatagagtgtgggaggacagaccttccagtgcagggagcaccccttttccttataaccctttgatcatgaggctgcaagctggtgtcatggcttcccctccaccccctgggcttcccgcagggagcggcccactcgctggaccccaccatgcctgggacgaggagcctaagccattgctttgttcccagtatgagacgctgtccgattccgaatag

SEQ ID NO: 233129 - DNA, 726 bp, Artificial Sequence
  Description of Artificial Sequence: Synthetic coding sequence
atgttttatagcggactactgaccgaaggtgggaggaaagagaccgatatgcgcgaggctgcgtccctgagacagcagaggcgtatgaagcaagctgtgcaattcatacacaaggactcagccgacctacttcctctggacgggctgaagaaactgggcagttctaaggacatgcagcctcacaacatactgcaaagaaggctgatggagaccaacctcagcaagttgcgcagcgggccaagagtgccatgggcaagcaagaccaacaagctcaaccaagctaaatctgaggggttaaagaaatccgaggaggacgacatgatcttggtatcctgccagtgtgcagggaaagatgtcaaagctctggttgatacagggtgtttgtataacctcatttcgctggcctgtgtggatcggttaggcctgaaggagcacgtgaaaagccacaaacatgaaggggaaaagctaagtttgcctcgtcatctcaaagttgtggggcagattgagcacttagtgatcactttaggtagtctcagactggattgtcccgctgcagtggtagacgataacgagaagaatctttcactggggcttcaaacactcaggagcctgaagtgcattattaatctagataaacacaggctgatcatgggcaagaccgacaaagaggaaattccattcgtcgagaccgtcagcctgaatgaggacaacacttctgaagcctag

SEQ ID NO: 233130 - DNA, 774 bp, Artificial Sequence
  Description of Artificial Sequence: Synthetic coding sequence
atgtcaacatcccagccaggagcctgcccctgtcagggagcagcgtctagacctgctatactgtatgccctgctgagttctagtcttaaagccgtaccgcgaccacgctctcgatgtctttgtcgacagcatagaccagtccaactgtgcgctccccatcgaacatgtagagaagcactggacgtcttagcgaagacagtggccttcctgaggaacctacccagcttctggcagctgcctcctcaggatcagcgcaggctactgcagggctgctggggtccgttgttcctcctgggtctcgcccaggacgcagttacgttcgaagtggcagaagctccagtgccttctatactaaagaaaatactcttggaggagccatcgtcctctggagggagcgggcaactgccagataggccacagccttcactagccgcagtccagtggctccagtgttgcctcgaaagtttctggtccctcgaactctcaccaaaagagtatgcatgtcttaaagggacgattctgtttaaccctgacgtaccaggattacaggccgcttctcacatcggtcacctgcagcaagaggcccactgggtgctttgcgaagtcctggagccttggtgccccgctgctcaagggaggctcaccagggtactgctgactgcctcaactcttaagtcaataccgacatcactgctcggcgatttattcttccgcccaattattggtgacgtcgatatcgccggattgttaggggacatgctgctgctccgctag

SEQ ID NO: 233131 - DNA, 1845 bp, Artificial Sequence
  Description of Artificial Sequence: Synthetic coding sequence
atgactacacttgattctaataataataccgggggagtcatcacttatattgggtcctccgggtcttcgcccagccggactagtcccgagagcctgtatagcgacaatagcaacggcagctttcagtccctgacccaaggatgtccaacttacttcccgccaagtcccacaggctctttaactcaggacccagccagaagtttcgggtcaatacccccttcactatctgacgatggctctccttcctccagttcatcctctagctcaagtagctcatcattttacaacggatcacctcctggctccctccaagtggccatggaggactccagccgggtgtctccttctaagtctacttccaatattacaaaactcaatggcatggtgctgctatgcaaggtgtgtggcgatgtggcttccggttttcattatggtgtccacgcctgcgaaggctgcaagggcttcttccgccgaagcatccaacaaaatatacaatacaaaaggtgtctgaagaatgagaactgtagtatagtgcgcataaacagaaatcggtgccagcagtgccgctttaagaaatgcctgtcagtaggaatgtctcgcgatgctgtgcgattcgggagaattccaaaacgcgaaaaacagcgtatgctggccgagatgcagagcgcaatgaacctggccaacaaccagctcagctcgcagtgccccttagaaacttcgcccacacagcatccaacgccgggtcctatgggtcccagcccaccacctgccccagttcccagccctcttgtaggattttctcagtttccccagcagcttacccctcccaggagccccagtccggagcccacagtggaggatgtgataagccaggtagcaagggctcatcgggagatcttcacctacgctcacgacaagctggggagctcccctggaaattttaacgcaaaccacgcttcaggctcaccacccgctacaacaccacatcggtgggaaaatcagggctgccccccagcacctaacgacaataatactttggccgcacagaggcacaatgaagcgctgaatggactccgacaagcgccaagttcatatccccctacatggccccctggccctgcccaccactcttgtcatcaaagcaatagtaacggacatcgtctttgcccaacccatgtttatgccgcacccgaaggcaaggcacccgctaacagcccaagacagggtaactcgaagaacgtattgctggcttgcccgatgaatatgtatcctcacgggaggtcaggaaggactgtgcaggaaatttgggaagatttttcgatgtcatttactcccgctgtgcgagaggttgtagagtttgcaaagcatatacccggatttagggatctgtcccagcatgatcaggtgacattacttaaggcaggcacattcgaagtgctgatggtccggtttgccagcttattcaacgtcaaagatcagaccgtgatgttcctgagtagaacgacatatagtctgcaagaacttggtgccatgggtatgggtgacttgctgtccgctatgttcgatttctcggagaagctcaacagtctcgccctgacagaagaagaactgggtcttttcactgccgtagtgctggtctctgctgacagatcaggcatggaaaacagtgcctccgtggagcagttgcaagaaactctgttgagagccttgcgcgctttggtcttgaaaaacaggcctctggagacatcccggttcactaaactgctgcttaagctgccggaccttcgcactttgaacaatatgcacagcgagaaattgctcagttttagagttgacgcccagtag

SEQ ID NO: 233132 - DNA, 1383 bp, Artificial Sequence
  Description of Artificial Sequence: Synthetic coding sequence
atgtcctccccaacaaccagtagcttggacacccctttgccaggtaatggtcctccccagcccggagcccctagtagctctcccaccgtgaaggaggagggcccagagccttggcctggaggacctgatccagatgttcccggaaccgatgaggcgtctagtgcctgcagcacggactgggtgattccagatcctgaagaggagcctgaaagaaaacggaagaagggtccagctcctaagatgcttgggcatgagttatgtagagtttgcggggataaagcatcaggcttccattataatgttcttagctgtgagggctgtaaggggttcttcaggcggagcgtggtgagaggcggtgccaggaggtacgcgtgccgtggcggtgggacctgtcagatggatgcttttatgcgccgtaaatgtcagcaatgccggctgcgaaaatgcaaggaggcagggatgcgggagcagtgtgtgttgtcagaagaacagattcggaagaagaagattagaaaacagcagcaagagtcgcaatcacagtctcagtctccagtgggcccacaggggagtagttcgtctgcatcaggcccaggcgcttcccccggtgggtccgaggcagggtcgcagggctcaggagagggagagggcgtccagctgacagccgctcaggagctgatgattcagcagttagttgcagcacagctccagtgtaacaaacgttcctttagcgatcagccaaaggtaacaccttggcctctgggtgccgatccacaaagcagagacgcgaggcagcagcggtttgcccactttactgagcttgcgattattagcgttcaagaaattgttgactttgcgaaacaggtccctgggtttcttcagctggggagagaggaccagattgccctgttgaaggctagcactattgaaatcatgctcctggagacagccagacgttataatcatgagacagaatgtatcaccttcctaaaggatttcacctacagtaaggacgattttcatcgagccggtctccaggttgaattcatcaaccctatattcgagttttccagggcaatgagaagactagggctggacgacgccgagtacgcattgctgatcgctatcaacattttctcagcagataggcccaatgtgcaggaacccggtcgggttgaagcacttcagcagccgtatgtggaggcattgctgtcatacacaagaattaagagacctcaggatcaactgcggttccctcgcatgctaatgaaattagtgtctctgaggaccctctcttctgtgcactctgagcaggtttttgcccttaggctccaggataaaaaactgccgccactgctgtctgaaatctgggacgtacatgagtag

SEQ ID NO: 233133 - DNA, 1377 bp, Artificial Sequence
  Description of Artificial Sequence: Synthetic coding sequence
atgagctctcctactaccagcagcctggacaccccactgccaggcaacggaccaccacagcccggagcccctagctccagtcccaccgtcaaggaagaggggccagaaccatggccaggagggccagacccagatgtgcccggaactgacgaagccagctctgcctgctctaccgactgggttatccctgatcctgaagaggaacccgaacggaaacgcaaaaaaggcccagccccaaagatgctggggcatgaactgtgccgtgtgtgtggtgataaagcatcaggatttcattacaatgtgctgtcctgtgagggttgtaagggctttttccgtaggtctgtggtgcgtggaggggctcgcaggtatgcatgtaggggtggcggtacatgtcagatggacgctttcatgaggagaaaatgtcagcaatgcaggctccgcaagtgtaaggaagccggaatgcgagaacaatgcgtgctgtccgaagaacagatacggaagaaaaagatcagaaagcagcaacaggaaagccagtcacagtctcagagcccagttggtccacagggatcatcttcttctgcctctggaccaggcgcaagtccgggaggttctgaagccggtagtcagggctcaggcgagggtgaaggcgtccagctaactgctgctcaggagctgatgatccagcagttggtggccgctcaactgcagtgcaataagcgcagcttttctgaccagccaaaagtgaccccctggcctctcggagcagatccacagagcagggacgctagacagcagcggtttgcacacttcacggagcttgccatcatttcagtccaggaaatcgtcgattttgccaaacaggttccagggttcttgcaactgggtcgggaagatcagattgctttactgaaggcaagtaccatcgagataatgctgcttgagacggctaggaggtataatcacgagaccgagtgcatcactttcctcaaggattttacttattcaaaagacgattttcaccgagcagggctccaggtcgagtttattaatcccatatttgaattcagccgcgcaatgcggaggctaggcctggacgatgccgaatacgccctgctcattgccatcaacattttcagcgcagaccgacctaatggggctgggccacgcggaggggtagcggctgcactccgcggtggtgcagcagttcttcacgcccatcaagaagctgctgatcagctgagattccctcgaatgctgatgaaattagtgtcccttcgcacccttagctccgtccactctgaacaggtgttcgctctgaggctacaggacaaaaagctgcctccactactgtcggaaatctgggatgtgcacgaatag

SEQ ID NO: 233134 - DNA, 1092 bp, Artificial Sequence
  Description of Artificial Sequence: Synthetic coding sequence
atgagctcaccaacaacttcctcactggacaccccactaccaggaaacgggccacctcagccaggtgcgccttcaagttctccaaccgtgaaggaagaaggcccagagccgtggccaggcggtcccgatcccgatgtcccaggcaccgacgaggcaagttctgcctgcagcactgattggggggtgctttcagaagagcagatcaggaagaaaaagattagaaaacagcagcaggaatcccagtcccagagtcagtcacctgtgggccctcagggcagcagttcttcagcgtctggtccaggagcctcccctggaggcagcgaggcaggttctcagggcagtggagagggagagggggttcagctgacagccgcacaggaactgatgatccagcagttagtagcagcacagcttcagtgtaacaaacgatccttctccgaccaaccaaaggttactccatggcccttgggagccgaccctcaatcacgtgacgcacggcagcagcgttttgcacactttactgagctggccattatctccgtgcaagaaatcgtcgactttgcaaagcaggtcccaggctttcttcagttggggagagaggaccagatcgccttacttaaagcatccacaatcgaaatcatgcttctggaaactgcaaggaggtataaccacgagactgaatgcataaccttcctgaaagatttcacttatagtaaagacgatttccatcgagctgggttgcaggtcgagttcattaaccccattttcgagttctcaagagctatgcgcaggctcggattggatgacgcagagtacgcccttcttattgctattaacatttttagtgctgatcgtccaaacgtccaggagccgggtagggtggaggcattgcagcagccgtacgtcgaggcactcctgtcttatacccggattaaaaggccccaggaccaactgaggtttcctcgaatgctcatgaaactggtctccctgcgaactctgagctctgtgcactcagagcaagtgttcgcactgcggctgcaagacaagaagctgccaccacttctctccgagatctgggatgttcatgagtag

SEQ ID NO: 233135 - DNA, 576 bp, Artificial Sequence
  Description of Artificial Sequence: Synthetic coding sequence
atgattcagcagctggtggccgctcagctgcaatgcaacaagcgcagtttcagcgaccagcctaaagtcaccttgggtagggaagatcagatagctctgttgaaggcttctacaatcgagataatgctcttggaaaccgcacggaggtataatcacgaaacggaatgtataacattcctgaaggactttacttattccaaggacgacttccaccgggcaggcctccaggtagaattcattaatccgatatttgagttctccagggcaatgcgtaggctgggccttgatgatgcagaatacgccctgctgattgcgatcaatatcttttccgccgaccggccaaacgtgcaggaacccggaagagtcgaggcactgcaacagccttatgtagaagcacttcttagctacacgagaatcaaacgtccccaggaccagctcaggttccctaggatgctcatgaaattggttagccttcgaaccctgtcttcagtgcactcagaacaggtgttcgcattgcgactgcaagacaaaaagctccctccccttctgtctgagatctgggatgttcacgagtag

SEQ ID NO: 233136 - DNA, 1422 bp, Artificial Sequence
  Description of Artificial Sequence: Synthetic coding sequence
atgactgtgacacgcacccaccatttcaaggaaggctcccttagggcccctgcgattccactgcacagcgccgctgccgagctagccagtaatcaccctcgcggaccagaggcgaatcttgaggtgagaccaaaggagagctggaatcatgcagatttcgtgcactgtgaagatacggagagcgtccccggtaagccctcagtcaatgccgacgaggaggtgggcggaccacagatctgccgcgtctgcggggataaagctacaggataccactttaacgtgatgacctgcgaggggtgcaagggatttttcagacgcgctatgaaaaggaacgctcgcctgaggtgccctttccgcaagggagcttgcgagattacccggaaaaccaggcgtcagtgtcaagcttgcagattgcgaaaatgtcttgaaagcggcatgaaaaaagagatgattatgtcagatgaagccgtggaagagcggcgtgctctgattaaacggaaaaagagtgagagaactggcactcagcccctcggcgtccagggcctgaccgaggagcagcgaatgatgattcgtgagctcatggatgcccagatgaagacatttgataccacttttagtcatttcaaaaatttccggctaccaggggttctttcctcaggctgcgagctgccggagagcctgcaagctccaagtcgggaagaggcagctaagtggtcgcaggttaggaaggacttatgttctttaaaggtcagtctccagttaagaggtgaagatggaagcgtctggaactacaagccgccagccgattcgggaggaaaggaaatattcagcctgctgccccacatggccgacatgtcaacttacatgttcaaaggcataatctcctttgctaaggtgatttcatacttcagggatcttcccattgaggaccagataagcttattgaaaggcgctgccttcgagctgtgtcagctgagatttaatactgtattcaacgccgaaaccggaacctgggagtgtggaagactctcttactgcctggaggacaccgccggaggatttcaacagctactactggaacccatgctgaaattccactacatgttgaaaaagctacagcttcacgaagaagaatatgtgctgatgcaggcgatctctctcttttcacccgataggcctggggtcttgcaacacagagtggtagatcagctgcaggagcagttcgcaatcactctgaagtcttatatcgagtgtaacagaccccagcctgcacataggttcctcttcctcaagatcatggccatgctgacggagttacgctccatcaacgcgcaacatactcagcggttgctccgcatacaggatatacacccattcgccaccccactgatgcaggaactgtttggaattaccggctcttag

SEQ ID NO: 233137 - DNA, 1305 bp, Artificial Sequence
  Description of Artificial Sequence: Synthetic coding sequence
ctggaggttaggccgaaagaatcatggaatcacgccgattttgttcactgtgaagatactgagagcgtgccaggcaaaccctccgtgaatgcagacgaggaagtcggtggccctcaaatatgccgcgtttgcggcgacaaagccactgggtatcactttaatgttatgacgtgtgagggctgcaaagggttttttcgcagggccatgaagcgcaacgcccgtctgaggtgtccatttcgaaagggcgcttgcgaaattacaaggaaaacgcgccgacaatgccaggcttgccggcttcggaaatgcctagaaagcggaatgaaaaaagagatgatcatgagcgatgaggccgtcgaggaacgccgtgccctcattaagaggaagaagtccgagcgtaccgggactcagcctctgggtgtgcaaggccttactgaagaacagcggatgatgatccgtgagctgatggacgcccagatgaagacttttgatacgactttctcccatttcaagaactttcgtctgccaggcgtattgagcagtggctgtgagctgcccgagtccttgcaggcaccctcacgggaagaggctgcaaagtggtcccaggttcgcaaagacctctgtagcttgaaggtctccctgcagcttcgcggagaagatggcagtgtctggaactacaagcctccagccgactcgggtggcaaagagatatttagcctgctaccacatatggcggacatgtctacatatatgtttaaaggaattataagtttcgcaaaggtcatctcctacttccgtgacctccccattgaggatcagatctccctcctgaagggagcagccttcgagctatgccagctgcgctttaacaccgtatttaatgctgagactggtacttgggagtgcgggaggctgtcctactgcctggaagacaccgcaggcggatttcagcagctcttactcgagcccatgcttaagttccactatatgctcaagaaactccagctccacgaagaagagtatgtcctaatgcaagccatttctctgttcagccccgatcgccctggtgttctgcaacatcgggtggtggaccagctccaagaacagtttgccattaccctgaaatcgtacatcgagtgtaatcgccctcaaccagcccatcgcttccttttcttgaagatcatggctatgcttacagaactacgctcaataaacgcgcagcacacccagaggttgcttagaatacaggacatccacccgttcgccactccactcatgcaagagctcttcgggatcactggaagctag

SEQ ID NO: 233138 - DNA, 1194 bp, Artificial Sequence
  Description of Artificial Sequence: Synthetic coding sequence
ctggaggtgaggcccaaagagtcttggaatcatgctgactttgttcattgtgaggacaccgaatcagttccaggcaaacctagtgtgaatgctgatgaagaagtgggcggtccacagatctgccgtgtttgtggggataaagccacagggtaccactttaacgtcatgacctgtgaagggtgcaaggggttcttccggcgtgctatgaagcgcaacgccaggctccggtgtccattcagaaagggagcctgtgaaattacccggaaaacccgtagacagtgtcaagcatgccgcttgcggaagtgcttagagtctggcatgaagaaggaaatgatcatgtccgacgaagctgtggaggagcgaagggccctgataaaacggaagaaaagcgagcgcacaggcacacaacccctaggcgttcagggcctgactgaggaacagcggatgatgatccgagagctgatggacgctcaaatgaaaactttcgatactaccttcagtcactttaagaacttcagggtgtccctacagctcaggggtgaggatggatccgtgtggaattacaagccccctgccgactctggaggaaaggaaatcttcagtcttcttcctcatatggccgatatgtccacatatatgtttaagggaattatctcttttgctaaagtcattagctactttcgggatctaccaatcgaggaccaaatctccctgttaaaaggcgcagcatttgaattatgccagctgcgatttaacaccgtgttcaatgccgagaccgggacatgggaatgtggaaggctgtcttactgtctggaggatactgcgggtggttttcagcagctcctgcttgaacccatgttaaagtttcattacatgctcaagaaattgcagttacacgaggaagaatatgttcttatgcaggcaatttctctcttttcacctgataggcccggagtgctccagcatcgtgtcgtcgaccaactgcaagagcaatttgccattactctgaagagctacattgaatgcaatcggcctcagcccgctcatcggtttctgtttttgaagattatggcgatgctgacagagctgcggtcaatcaatgctcagcacacacagcgcctgctcagaatccaggacatccacccttttgccactcccctcatgcaggaattattcggaataacgggttcctag

SEQ ID NO: 233139 - DNA, 1848 bp, Artificial Sequence
  Description of Artificial Sequence: Synthetic coding sequence
atgacatcgcccagtcctcgcatccagatcattagcacggactccgctgtggcaagtccgcagcgtattcaggggtcagagcccgcttcggggcctctgagtgttttcacctcactcaacaaggaaaagatcgtgactgatcagcagacaggccagaagattcagattgttactgccgtggacgcatccggttccccaaaacagcagtttatattgaccagcccggacggagccggaacagggaaggttatcctggcgtcacccgagactagttccgcaaaacagcttatctttacaacctcagataatcttgtgcccggaagaatccagatcgttaccgatagcgcttccgtcgagcggttactaggaaagactgatgttcagcgcccacaagtggttgagtattgcgtggtctgcggagacaaggcttctgggaggcattacggggctgtgtcttgcgagggctgtaagggtttttttaagcgctcagtgcggaaaaatcttacctactcctgtcggtctaaccaggactgcattattaacaagcatcacagaaatcgttgccagttttgccggctcaaaaaatgtctcgagatgggaatgaagatggagagcgtccagtctgagcgcaaaccatttgatgtacagcgggagaagccttctaactgcgcagcctctactgagaagatctatataagaaaggatctccgctctccgctgattgctaccccaaccttcgttgccgataaagacggtgcacgacaaactgggttgctggatcctggcatgctggtgaatatccaacaacccctgatacgcgaggacggcaccgtgttactagcgacagacagcaaggccgaaacctcccagggagccctgggcaccctggcgaatgtggtaacgtctctcgccaacttgtccgaatcactgaacaatggggacacatctgaaattcagccagaggaccagagcgctagtgagatcaccagagcgttcgacaccctcgcgaaagcattgaataccaccgactccagctcatcccctagtctggccgatggaatagacactagtgggggagggtctatccacgttataagcagggatcagagcactccaatcattgaagtggaaggacctctcctctcagacactcatgtcacctttaaactgacaatgccttccccgatgcccgagtacctaaacgtgcattatatttgtgagtcagccagcagacttctgttcctgagtatgcactgggccaggagcatccccgcattccaggctctcggtcaagactgtaataccagcctggtgcgtgcctgttggaacgagttgttcaccctggggctggcccagtgtgctcaggtcatgagcctgtcgactattcttgccgcaatcgtcaatcatctccagaacagcatccaggaagacaaattgtccggcgaccgaattaaacaggtgatggagcacatttggaagctccaagaattctgcaacagtatggcgaaattggatatcgatggctatgagtatgcataccttaaggcaattgtgttgttctctcccgaccacccgggtctaacgtccacatcccagattgagaaatttcaagaaaaagcccagatggaactgcaggattacgtccaaaaaacctattccgaggatacctatagattggctcgcatcctggtacggcttcctgccctgcgccttatgtcgtctaatatcacagaagagctgtttttcaccggtctgatcggcaatgtctctatagattccatcattccctatattctcaagatggagacagccgagtataatggccaaattacaggagcatcgctctag

SEQ ID NO: 233140 - DNA, 1791 bp, Artificial Sequence
  Description of Artificial Sequence: Synthetic coding sequence
atgacctccccctcacccagaatccagatcattagcaccgattctgccgtggcctccccacagcggatccagattgtcaccgaccagcagacagggcagaagattcagatcgtaacagccgttgacgctagcgggagtcccaaacagcagtttatccttacctcgccagatggagccggtacaggaaaggtcatcctggcaagtcctgaaacttcgtccgccaagcagctgatctttactacgtccgataacttagtgcctggtcgcattcagatcgttactgattcagctagcgtggaacggctgctaggcaagaccgacgtgcagagaccgcaggtggtcgaatattgtgtggtgtgcggagacaaagcgagtggccgacactatggggctgtttcttgcgaggggtgtaagggcttttttaaacgcagcgtacgcaagaacctcacatacagttgcaggagcaatcaagactgcattataaacaagcaccatagaaacaggtgccagttctgcaggctcaaaaaatgtctagagatggggatgaaaatggaatcagtgcagtccgaacgcaagcccttcgacgtccagcgcgagaagccttctaactgcgctgcgtcaacggagaaaatatatatccgaaaagaccttcgctctcctttaatcgccacccccacttttgtcgcagacaaggatggggctaggcagaccggtctgctagaccccggaatgctggttaacatacaacaaccactaattagagaagatgggactgtcctgctggcaaccgactccaaggctgagacgtctcagggtgctctaggaacgctcgccaatgtagttacctctcttgccaacctgtctgagagcctcaataacggtgacacatccgaaatccagcccgaggaccagagtgctagcgaaatcacaagggccttcgataccctagccaaggccctcaataccactgacagctcttcatccccttcactagctgacggcatcgatacttccggagggggaagtatccatgtgatatcacgcgatcaatctacacctataatcgaggtggaggggccattgcttagcgacacacacgtgactttcaaactgacaatgccatccccaatgcctgaatacctgaatgtacactacatatgtgagtctgcctcaaggcttctgttcctttcaatgcactgggccaggtccattccggcttttcaggccctgggacaggattgcaacactagtcttgtgcgcgcttgttggaacgagctgttcaccctcggccttgcccaatgcgcacaggtgatgtccctcagcacaatccttgccgcaattgtgaatcatttgcagaattctatccaggaagacaagctctccggcgacagaatcaaacaggttatggaacatatatggaagctccaggaattttgtaattcgatggcaaagctggatatcgacggctatgaatacgcctatctgaaggcaatcgtgctgtttagcccggatcaccccggtctaacatcaactagtcagatcgagaagttccaggagaaagcacagatggagctgcaggattacgtgcaaaaaacctatagtgaggatacctaccggttagccagaatactggttcggctcccggcacttaggctcatgagttcaaatatcactgaggaactgttttttacagggctcattggtaacgtgtctatcgattctataatcccgtacatactgaaaatggagaccgccgagtacaatggccaaatcaccggcgctagcctgtag

SEQ ID NO: 233141 - DNA, 1791 bp, Artificial Sequence
  Description of Artificial Sequence: Synthetic coding sequence
atgactagtcccagcccacgcattcagatcatttccacagattccgcagtggccagcccccagcggattcagattgtcacagatcagcagactggtcagaagatacaaatcgtgacagctgtggacgcctccggcagccccaaacagcagtttattcttacatcccccgacggcgctggaacggggaaggtgattttggcatctccggagacctcatccgccaaacaacttatctttactacctccgataacttagtgcccggacggattcagatcgtcactgactctgcgagcgtggagaggctgctcgggaaaacagacgttcagaggccacaagtggtagagtattgcgtggtgtgcggagacaaagcttccggacgtcactacggtgcagtgagttgtgagggttgcaaaggcttctttaagcggagcgtcaggaagaacctgacttacagttgcaggagtaaccaggattgcattatcaacaagcaccaccgaaaccggtgccagttttgtagactgaagaaatgtctggaaatgggcatgaaaatggagtcagtgcagtccgaacggaaacctttcgacgtgcagagagaaaagccgtctaactgcgctgcaagtacagagaagatctatatcagaaaagacctccggtccccacttattgccacgcctacatttgttgccgataaggacggcgctcggcaaactggtttactggatccaggcatgcttgtcaatattcaacagccccttattagggaagacggaaccgtcctgcttgccacagattccaaagcggaaacaagccagggcgctctgggcaccctggccaatgtcgtgacttctctagcgaacctctctgaatcactgaacaatggcgatacaagtgaaattcagcctgaggaccagagtgcaagtgaaatcacaagagcttttgacaccttagctaaagccctcaacacgaccgattcttcaagtagcccctccctggccgacgggattgatacatctgggggtgggtcaatccatgtgataagcagggaccagtcaacgcccataattgaagtagaggggcctctgctaagcgacacacacgtgactttcaagttaacgatgccctccccaatgcccgagtatcttaatgtgcactatatctgcgagtctgctagtcggttactgtttctttctatgcactgggcacgaagcatcccagcatttcaagccctcggacaggattgtaatactagcctcgtgcgggcttgttggaatgagctgttcaccctgggacttgcgcagtgcgctcaggtcatgtcgctaagtacaatcttagccgctatcgtcaatcatctgcaaaactcaattcaggaagacaaattgtcaggcgaccgtattaagcaggtgatggagcacatttggaaactgcaggagttctgcaactctatggcaaaactcgacatcgacggttacgagtacgcatacctgaaggcaatcgtcctttttagtccggaccatcccggtttaacttctactagtcagattgagaagttccaggaaaaggcccagatggagctgcaggactatgtacaaaaaacttacagcgaggatacctacaggctggcgagaattcttgtgcggcttccagcccttaggctaatgagctctaatattaccgaggagcttttctttactggattgataggcaatgtgagtatagactccatcatcccatacattctgaagatggagacagctgagtacaatggtcaaatcacaggcgcatctctgtag

SEQ ID NO: 233142 - DNA, 1791 bp, Artificial Sequence
  Description of Artificial Sequence: Synthetic coding sequence
atgaccagcccttctccccgaattcagataatctcaactgattcagccgtcgcgtctccccagaggattcagatagtgactgaccaacagacaggacagaaaattcaaattgtgaccgcagttgacgcatctggaagtccaaaacagcaattcatcttaacaagccctgatggggctggcacaggcaaagtcattctcgccagtcctgaaactagttcagctaagcaacttatctttaccacctccgataacctcgttccgggaaggatacagatcgtcaccgatagcgcctctgtagaacggctgctcggcaagaccgacgtacagagaccgcaagtggttgaatactgtgttgtgtgcggagataaggcgtctggccgtcactatggtgctgtcagttgcgaggggtgtaagggtttctttaagagaagcgtgaggaaaaacctgacatacagctgccgctcgaatcaggactgcattattaataagcaccacaggaacagatgccagttctgcaggctgaagaaatgcctggaaatgggcatgaaaatggagtccgtgcagagcgagaggaagccgtttgacgtgcaaagagagaaacccagcaattgcgctgcctctaccgaaaagatttacatccgcaaggacctccgatccccgctgatcgctacaccaacatttgtggctgataaggacggcgctcgccagaccggcctgcttgacccaggcatgctggtgaatattcaacaacccctgataagggaggacggcacggtgctgcttgcaacggattccaaggccgaaacatctcagggcgcactgggaacactcgctaacgtggtgacgagtctcgcgaacctgtctgagagcctgaacaatggcgacaccagcgaaatccagccagaagaccagagtgcttcagaaatcaccagggcctttgacacactggctaaagccctgaatacgaccgactcaagttccagtccctccctagcagatgggatagatacatctgggggaggatcaatccacgttatctctcgagaccagtcaacaccaattatagaagtcgagggtccactactcagtgacactcacgttactttcaagctcactatgccctcccctatgcctgagtacttaaacgtgcactacatttgcgagagtgcttcaagactcctgttcctgagcatgcactgggctcggagcattcccgcattccaggcactgggccaagactgcaacacctccctcgtacgcgcttgctggaatgaactctttacgttaggattggcccagtgcgctcaggtgatgagtctgagcacaattttggcggctattgtgaatcacctccaaaattctatccaggaggataaattatccggggaccgaattaagcaggtgatggaacacatctggaaattgcaggaattctgtaatagcatggctaagctggatatagacgggtatgagtatgcgtacctgaaggccatcgtactgttttcccctgaccacccgggtctgacatcaacttcccaaatcgaaaaatttcaagagaaggctcagatggaattgcaggactatgttcaaaagacatacagcgaggacacctaccgactcgctcgcatcctggtgcgcttacctgccttgagactgatgagctccaacattacagaggaactgttcttcacaggactgattggaaacgttagcattgattcaatcatcccctacatcctgaaaatggaaacagccgagtataatggacagattaccggggcatcattgtag

SEQ ID NO: 233143 - DNA, 111 bp, Artificial Sequence
  Description of Artificial Sequence: Synthetic coding sequence
atgactagcccttcacccagaatccaaattatttcgaccgacagtgctgtggcatcaccacaaagaatccagggatcagagcccgcatccggacctctcagcgttttttag

SEQ ID NO: 233144 - DNA, 618 bp, Artificial Sequence
  Description of Artificial Sequence: Synthetic coding sequence
atgacctctcctagccccagaatccagatcatctctaccgattccgcggtggctagtccgcagcgcattcaggggagtgagccagcctcaggccctctgagtgtttttacatccctaaacaaggaaaagatcgtaacagatcagcagacaggacagaaaatacagatcgtaactgccgtcgatgcctcaggctcccccaagcagcaattcatccttaccagccccgatggagccggtactggaaaagtaatcctggccagtcccgagacttcttctgctaaacagctgatcttcacaacatccgacaatttagttcctggacgcatccagatcgtcaccgactctgcttctgtcgagcggcttctaggcaaaaccgacgtgcaaaggccccaagttgtcgaatactgcgtcgtgtgtggggataaagccagtggaagacactacggcgcagtatcatgtgagggctgtaaggggtttttcaaacgcagcgttaggaagaatctcacctatagctgcaggagcaaccaggattgcattatcaacaaacatcatcggaaccgctgccagttttgtaggctaaagaagtgtctggagatgggaatgaagatggaatgctag

SEQ ID NO: 233145 - DNA, 1269 bp, Artificial Sequence
  Description of Artificial Sequence: Synthetic coding sequence
atgtttcgagctggggctgagggagccgagaaagaaccttccccacggccagaatgccgggctgaccccggaccaggtctgggctttcctctggggtcagggctcccatggccatcccttttagaatcgccagggggtcggatactcgacattccttgcaaagtatgcggcgacagatccagcgggaagcattatggagtctacgcctgtgacggctgtagcgggttctttaagaggtccatcagacgcaacagaacgtacgtatgtaagagtggtaatcagggtggatgtcccgtggacaaaacccatcggaaccaatgccgggcttgccgtcttaaaaaatgtcttgaggttaacatgaataaggacgctgtccaacatgaacgcggtccacgcacttccaccatccgcaaacaggtggccttgtactttcgaggacataaggaggagaatggtgctgctgcgcactttccatctgctgccttgcccgcaccagccttctttaccgcagtgactcaacttgaaccccatggactggagttggccgctgtgagtacaaccccagaaaggcagactctggtgtctctggcgcaacccacccccaagtacccgcatgaggtcaatggcacccccatgtatctgtacgaagtggcaaccgagtctgtttgcgagtctgcagctagattgctctttatgtctattaaatgggcaaaatcggtgcctgctttctctaccctgagcctgcaggatcaacttatgctgcttgaggatgcctggcgggagttgttcgtgctaggcattgcccagtgggcaatcccagttgatgctaatactttgctagccgtcagcggaatgaacggcgacaatacagactcacagaagcttaataagataattagcgagatccaggccttgcaagaggtcgtcgccaggttcaggcaactgcgattagacgccacagagtttgcctgcctgaaatgcatcgtgacatttaaggccgtccccactcactcaggcagcgagttaaggagcttcaggaacgccgcagccatcgcagccttacaggacgaggcgcagctgactctcaactcctacattcacacccgttatcccacccagccgtgtcgctttggcaagctgcttttattactgcccgctttgagatctatcagcccaagtacaatcgaagaggtgttctttaaaaaaactatcgggaatgtcccaatcacacgtctgctcagcgacatgtacaaatcgtccgatatctag

SEQ ID NO: 233146 - DNA, 1158 bp, Artificial Sequence
  Description of Artificial Sequence: Synthetic coding sequence
atgagtaaaccggctggaagcactagccggatcctggacattccctgcaaggtctgcggcgacagatcaagcggcaagcactatggcgtgtacgcttgcgacggctgttccgggttttttaaaaggagtatccggaggaatcgaacgtatgtgtgcaagtctggcaaccaaggtggctgcccggtggataaaacccacaggaatcagtgtcgagcgtgccgcctaaaaaagtgcttggaagtaaacatgaacaaggatgcagtacagcatgaaaggggtccccgaaccagcacaatccgcaagcaggtggctctgtatttccgaggtcataaggaagaaaatggggctgcggcacatttcccatccgctgctctgcccgcaccggctttctttactgccgttacacagctcgaaccgcacggactggaactggctgccgtgtccacaacccctgagagacaaacactggtaagcctcgcacagcccaccccaaagtatccacatgaagtgaacggtactcctatgtatttatatgaagtggccaccgagagcgtgtgtgagagcgccgcaagattattatttatgtcaatcaagtgggccaaaagcgttcctgcatttagcacacttagtctgcaagatcagctgatgttactggaagacgcctggagagagctattcgttctcggaatcgctcagtgggcgatacccgtagatgctaacacgctgctggccgtaagcggtatgaacggggacaacacagactcacagaaactgaacaagattatttccgagatccaggccttacaggaggtggttgccaggttcagacaactccggctggacgcaactgaatttgcctgcttgaagtgcatcgtgacattcaaggccgttcctacccactcaggatctgagttgcggagcttcagaaatgccgcagctattgccgcactgcaagacgaggcgcagctcaccctcaatagctacatccacacacggtaccctacccagccatgccggttcggtaagctcttactgctgctgccagccctgaggagcattagcccctccaccatcgaggaggtctttttcaaaaagacaatcgggaacgtgcctatcactaggctcctgtctgacatgtacaaaagctctgatatttag

SEQ ID NO: 233147 - DNA, 141 bp, Artificial Sequence
  Description of Artificial Sequence: Synthetic coding sequence
atgaataaggacgccgtgcagcacgagcgaggcccaagaacatccactataagaaaacaagtcgctttatacttcaggggtcataaggaagagaacggcgctgctgcacactttcccagtgccgcattgcccgctccctag

SEQ ID NO: 233148 - DNA, 1272 bp, Artificial Sequence
  Description of Artificial Sequence: Synthetic coding sequence
atggctatggtggtgagctcttggcgtgacccacaggacgatgtagctggcggaaacccaggtgggcctaatccagcagctcaagcagctaggggcggagggggaggtgccggagaacaacagcagcaggcagggtccggtgctcctcatacgccacaaacccccggacagccaggggctccagccacccccggtactgccggagataaaggacaggggcctcccggtagtgggcagtcacagcaacatatcgaatgtgttgtgtgtggcgacaaaagcagcgggaagcactacggccagttcacatgtgaagggtgtaagtcattcttcaagaggagcgttcggagaaacctgacttacacttgtcgggctaaccgaaactgccccatcgaccagcaccatcggaatcaatgccagtactgcagactcaaaaagtgcctgaaggtgggtatgcgccgagaggctgttcaaagaggcagaatgcctcctacgcaacccaaccccggacagtacgccctgaccaacggcgatccactgaacgggcattgttatcttagcggctacatttctttactgctgcgcgcagagccctatcccacttcacgttatgggtcacagtgcatgcagcccaacaatattatgggaatcgaaaacatttgtgaactggcagcccgtctgctgttttctgcagtcgagtgggcacgcaacataccctttttccccgaccttcaaatcacagatcaggtctccctgcttcgtctcacgtggtctgaactttttgtcttaaacgccgcacagtgcagtatgccattacatgtcgccccactgcttgctgcggcaggcctgcacgcctccccaatgtccgctgatcgtgtggtggcttttatggatcacatcaggatctttcaggaacaggttgaaaaactcaaggctctgcacgtggatagtgccgaatattcctgccttaaggccattgtgctcttcacctccgacgcgtgcggtttaagcgatgctgcccacatagaaagcctgcaggagaaaagccagtgcgcccttgaggaatacgtgaggtcccagtatccaaaccagccaagcaggtttggcaaactcttgctgcgcctgccttcactccgcacagtcagcagctcagtgattgaacagctgttctttgtgcggctggtgggcaagactccgatcgagactcttattagagatatgctgttgtccggctctagttttaactggccttatatgtccattcagtgctcatag

SEQ ID NO: 233149 - DNA, 1245 bp, Artificial Sequence
  Description of Artificial Sequence: Synthetic coding sequence
atggcgatggttgtatccacctggcgcgatcctcaggacgaggtgcccggatctcagggaagccaagcaagccaggcccctcccgtacccggtccaccaccaggcgcacctcatacccctcagaccccagggcagggcggaccagcttctacccccgctcagactgctgcgggtggacagggaggccctggtggcccaggttcggataagcagcaacaacaacagcatatcgaatgcgtagtttgtggcgacaaatcttctgggaagcattacggtcaattcacatgtgagggctgcaaatctttcttcaagagatccgtccgtagaaacctctcctatacgtgcagggccaatagaaactgtcctatagaccaacatcatcggaaccagtgccaatattgtcggctcaagaaatgtcttaaagttggaatgaggcgcgaagccgtccagagagggagaatgcctccgactcagcccacccacgggcagtttgccctcaccaatggtgaccccctcaattgtcacagttacctgtccggctacataagcttgcttttgagggccgagccataccccacaagcagattcggttcacagtgtatgcagccaaataatattatggggatcgagaatatatgtgagctggccgcacggatgctcttcagcgctgttgagtgggccaggaacataccatttttccctgatttgcagattacagaccaggtggcactgctcaggcttacatggtctgaattgtttgtgctcaatgctgcccagtgtagcatgccattgcacgtggctcccctgctcgctgctgcaggcctgcatgcatccccaatgtccgccgaccgcgtcgtggccttcatggatcatatccgtattttccaagagcaggtggaaaagttgaaggccctgcacgtggattccgcagaatacagttgtctcaaggccatcgttttattcacgtcggacgcctgcggcttaagcgacgtggcacacgtcgagtctctgcaggaaaagtcacagtgtgctttggaagagtacgtgcgcagtcaatacccaaatcagcctactcggtttggaaaactgctcttgagactaccttcactgaggacagtgagctcaagtgtaatcgagcagctcttcttcgtacgcctggtgggaaaaacccctatcgagactctgatcagagacatgctcctgagcggaagctccttcaattggccatacatggcaatccagtag

SEQ ID NO: 233150 - DNA, 786 bp, Artificial Sequence
  Description of Artificial Sequence: Synthetic coding sequence
atgcctcccacccaacctacccacggccagtttgccctgacaaatggcgacccactgaactgccactcgtacctgtctggctatataagtctcttgcttagggccgagccttaccctacatccagattcgggtcccaatgtatgcagcccaacaatattatgggaattgaaaatatttgcgagctggcggcaagaatgctttttagtgctgtggagtgggctagaaatataccattcttccccgacttgcagattacagatcaggttgcacttctgcgcctgacctggagcgagctttttgtgcttaatgcagcacagtgctctatgcccctgcatgttgcccctctgttggccgcagcgggactccacgcttcacctatgagtgcggaccgcgtagtggcttttatggaccatatccgcatcttccaggaacaagtcgaaaagctgaaggccttgcatgtagattccgctgagtactcatgtcttaaggctatagttttgtttacctccgacgcttgcggattgtctgacgtagcccatgtcgaaagcttgcaggagaagtcccagtgcgctcttgaggagtatgtgcgatcacagtatccgaaccagcccaccagattcggaaaactgctactacgcctcccatctctacggactgtttcctcatccgtgattgagcaattgttttttgtccgattggtgggcaaaacccccatagaaacacttatccgcgacatgctgttatcaggttccagtttcaactggccctacatggctatacagtag

SEQ ID NO: 233151 - DNA, 846 bp, Artificial Sequence
  Description of Artificial Sequence: Synthetic coding sequence
atgcaggccgtgtgggatctggagcagggaaagtacggatttgcagtccagaggggtaggatgccaccgactcaaccaactcatggtcagttcgctctgactaatggcgatccactaaattgccatagttacctgtccgggtatatctctctcctgctgcgagccgaaccttatcccacctctcgtttcggctcacagtgtatgcagcccaacaacatcatgggtatcgaaaacatttgcgaactggcagccaggatgctgtttagcgctgttgagtgggccaggaatatccccttttttcctgatctccagatcacagatcaagtggcgttgttacgattgacttggagtgaactgtttgtgttaaatgccgcacagtgttcgatgccgctccacgtcgccccactgctcgctgcagccggtctgcacgcttcccccatgagcgccgatcgcgtcgtcgcatttatggaccacattagaatatttcaggaacaagtagagaagttaaaggcgttgcacgtcgactcagcagaatactcatgtctgaaggcaattgtcttatttacctcagacgcctgcggtctgagtgacgtggcccacgtggaaagcctccaggagaagagtcagtgcgctctggaggagtatgtaaggagtcaatacccaaatcagccaacaagattcggcaagctgttgctgagattgccctcacttcggacagttagtagttcagtcatcgaacagttgttcttcgttaggcttgtgggcaaaacgcctatagagactttaatccgcgatatgctgttgagcggttcctcttttaattggccctatatggccatacagtag

SEQ ID NO: 233152 - DNA, 786 bp, Artificial Sequence
  Description of Artificial Sequence: Synthetic coding sequence
atgcctccgacgcaaccaacacatgggcaattcgctctgactaatggagatcctttgaactgccactcttacctgtccggatatatcagcctcctgctcagggcagagccttatcctacttccaggtttggttcacaatgcatgcaacctaacaacataatggggatagagaacatttgcgaactggcggctcggatgctcttcagcgctgtggaatgggccaggaacatcccattcttccccgaccttcagattactgatcaagtcgccctcttgcgtttgacctggagcgagctgttcgtcttgaacgcggctcagtgctctatgcctttgcatgtggcacccctgctggccgcagccggtctgcacgctagccctatgagcgcagatcgtgtggtcgccttcatggatcacatccggatcttccaggaacaggtggagaaactgaaggcattacacgttgactctgcagaatacagctgcctcaaggccattgttctgtttacttcggacgcctgtgggctgagcgatgtggcccatgtggaaagtttgcaggagaagtctcaatgtgctctggaggagtatgtgcggagccaatacccaaaccaacccacccgtttcggcaagctcctcctccgactgcccagtctgcgcacagtgtcaagtagcgtgatagagcagttatttttcgtgaggttggtgggtaaaacacccatcgagacgctgataagggacatgctcctgtctggtagctcttttaactggccatatatggctattcagtag

SEQ ID NO: 233153 - DNA, 1215 bp, Artificial Sequence
  Description of Artificial Sequence: Synthetic coding sequence
atggccatggtgacgggtggttggggcggaccgggtggcgacaccaacggagtcgacaaagccggagggtaccccagagccgcagaggacgactctgccagccccccaggtgccgcaagcgacgccgagccaggcgatgaagaacggcctggcctccaagttgattgcgttgtatgcggagataaaagcagcggaaaacactacggagtcttcacttgtgaaggctgtaagtcattcttcaagcgatcaattagacgtaatctgtcgtacacgtgccgctccaatagggattgccagatcgatcagcaccaccgaaatcagtgccagtattgccgactcaaaaaatgcttcagggtcgggatgagaaaggaggctgtacaacggggaaggatccctcattcactgccaggagccgttgcggcaagttcgggtagccccccaggatccgcgttagcagctgtggcgagcggaggcgatctgttccctgggcaaccagtgtctgaacttattgcccagttgctgagagcagagccttacccagccgctgctggcagattcggtgcaggtgggggagccgctggcgctgtgctggggatagacaatgtttgcgagcttgcggctcgcttactgtttagcaccgtcgaatgggctagacacgccccattcttcccagagctgcctgtggccgatcaggtcgcgttactgaggctgagttggtcggagttgttcgttctaaacgccgctcaagcagctctccctctgcacaccgcacccctgttggccgctgccggtctgcacgctgctcctatggctgcagaacgcgctgtggccttcatggaccaggtgcgagctttccaagagcaggtggataaactgggtaggttacaagttgattctgcagagtacggctgcctgaaggctatcgccttatttacccccgacgcctgtggcctgagtgaccccgctcacgtggagagtcttcaggaaaaggcacaggtggccctgaccgaatatgtcagagcccaatacccatcacagccacagaggttcggcaggttgcttctgagactccctgcactgagggctgtgccagcatcattgatttctcagttattctttatgagattggtgggtaagacgccaatagagaccttgatccgtgacatgctgttatctggatctacatttaactggccatacgggagcgggcagtag

SEQ ID NO: 233154 - DNA, 1134 bp, Artificial Sequence
  Description of Artificial Sequence: Synthetic coding sequence
atggctatggttaccggagggtgggggggaccgggtggggacgccgagcctggagatgaggagcgacctgggctccaggtcgattgtgtggtctgtggcgataagtcatctggtaagcactatggcgtgttcacgtgtgaaggctgcaaaagcttctttaagcgatctataagacgcaatctaagttacacctgccggtcaaacagagactgccaaatcgaccagcaccaccggaaccaatgtcagtactgtcgtctgaagaaatgtttcagagtgggcatgagaaaggaagcagttcaaagaggaaggatccctcactctctgcccggtgccgttgcggctagtagcggaagccctcctggttccgccctggccgcagtggcctccggaggtgacctttttcccggtcagcctgtaagcgaactcattgcgcagctgctgcgagccgagccatatccagcggcagccggaaggtttggagctggcggtggagcagccggtgctgtgctcggtatagacaacgtttgtgagctagctgcacgtctgctgttctctaccgtcgaatgggcaaggcatgccccttttttccccgagctacctgtcgccgaccaggtggctttgttgaggctgtcttggtccgagttatttgtgttaaacgcagcccaggccgctttacccctgcatacggccccactgcttgcggcagcaggtctgcacgcagcgccaatggctgctgagagagcagtcgctttcatggatcaggtgcgagcattccaggaacaggtggacaaattgggtcggttgcaggtcgattcagctgagtacggctgtctcaaggcaatcgctttgttcacacctgacgcatgcggcctctccgaccctgcacacgtagagtccttacaggaaaaggcccaagtggcgctcaccgagtacgtacgcgcacagtatccatcccagccacaacggttcggtcgcctactgttgagattacccgcacttagagctgtgcccgcttctctcattagccagctgttctttatgcgacttgtcgggaaaactccgattgaaaccctcattcgagacatgttactaagcggatcaaccttcaactggccctatgggtccgggcagtag

SEQ ID NO: 233155 - DNA, 2121 bp, Artificial Sequence
  Description of Artificial Sequence: Synthetic coding sequence
atggagacaaagggttaccactcactgccggagggcttagacatggagcgcaggtggggacaggtatcacaagccgtggaacggtccagcctggggccaaccgaacgcactgatgaaaacaattacatggagatagttaacgtgtcctgcgtcagcggagctattccgaataattcaacccagggctccagcaaggagaagcaagaactccttccctgccttcaacaggataataacaggccgggtattttaacatcagacattaagacagaactggaatcaaaggaactgtcggccactgttgctgaaagcatgggcctgtatatggacagcgtgcgggatgccgattactcctacgagcagcagaatcagcagggcagcatgtccccggctaagatctatcagaacgtcgaacagttagtgaagttctacaaagggaatgggcatcgcccttccacacttagctgtgttaatacgcctcttaggtccttcatgtctgattccggctccagcgtgaatgggggagtcatgcgcgcagtggtaaaaagtccgatcatgtgtcacgagaaatctccatctgtgtgcagcccgctgaatatgactagtagcgtgtgcagccccgctggcatcaattcggtcagctcgaccacagctagcttcggcagttttcccgttcacagtcccattacccagggcaccccacttacatgtagccctaatgtggagaaccggggatcaaggtcacacagcccggctcacgcttcaaacgtcggaagtcctctctcctcccccctctcctctatgaaaagctctataagttcgccgccatcccactgctctgtcaagtcccccgtgtcctcgccaaacaatgtcaccctgaggtcctctgtgagtagccccgcaaatatcaacaatagcagatgcagcgtgtcttccccatcaaacaccaacaacaggagcaccctgtcttcgcctgcagctagtaccgtggggagtatatgttccccagtgaacaatgccttttcttataccgcctctggaacctccgccggtagctctactctgcgcgacgtagtgccaagcccagacacacaagagaaaggagcccaggaagtgccctttcctaagaccgaggaggtggagtcagccatttcgaacggggtaaccggacagttgaatattgtgcagtacattaagccagaaccagatggagcattttcttcctcttgcttgggcggaaattccaagatcaattccgatagcagcttcagcgtgccgattaaacaggagtcgaccaaacatagctgttcgggcactagtttcaaaggaaatcccacagttaatccttttccattcatggacgggtcttatttttcatttatggatgacaaggactattactctctctccggcatcctgggcccaccggtcccgggattcgacggaaattgcgagggttccggttttcccgtgggcattaagcaggaacctgatgacggatcttactatcctgaagcgtccatcccatccagcgctatagtaggggtaaactccggaggccaaagctttcactataggatcggggcacagggcacgatttcactgtcacggtctgcacgggaccagtcctttcagcaccttagcagcttcccccctgtgaatactcttgtagagtcctggaaatctcacggcgacctctcatctcgcagaagcgatggctaccccgtgcttgaatacattcctgagaatgtctcctcatcaaccctacgatctgtaagcaccggctcctctagacctagcaaaatttgccttgtctgtggcgatgaagcctccggatgtcattatggtgtggtgacctgtggatcatgtaaggtgtttttcaagcgtgccgtggaggggcaacataactacttgtgtgccggtcgaaatgactgcattatcgataaaattcgacggaaaaactgcccagcttgtagactccaaaagtgcctgcaggcaggcatgaatttgggggaacgcagatgtatttccctgccctgtatgaactatgctagaggctgcacaaaatcagcatttagctcattcgactgctcttccccgctcaagaataccccatcgtag

SEQ ID NO: 233156 - DNA, 2955 bp, Artificial Sequence
  Description of Artificial Sequence: Synthetic coding sequence
atggagacaaagggttaccattctttgcccgaaggtctggatatggagcggcgatggggtcaggtttctcaggcagtggaaaggtcttctctggggccaacagaaagaacagacgaaaacaattacatggaaattgttaacgtgtcctgtgtctccggcgctattccgaacaactcgacccaaggaagctcaaaagagaaacaggagctgctgccctgtctgcagcaagataacaatcgtcccggaatcttgacaagcgacatcaaaaccgagcttgaaagcaaagaactgtctgctaccgtggctgagtctatggggctgtatatggatagcgtgagggatgcggattactcctacgagcagcagaaccagcagggaagcatgagccccgcaaagatataccaaaatgttgagcaactggttaagttctataagggcaacggacaccgccctagtaccttgagctgcgtcaatacccctcttcgctcattcatgtccgacagcggcagttcagttaacgggggagttatgcgcgctgttgttaaatctccaattatgtgtcacgagaaatctccatctgtctgcagtcctttgaatatgacgagctctgtgtgcagccccgctggcataaattcggtgtccagtaccactgcgagtttcggttcttttccggttcattctcccatcacacaaggcacccccctgacatgtagccctaacgtcgagaaccggggatcacgttcgcatagccccgctcacgccagtaatgtaggaagccccctcagttccccactgtcatccatgaagtctagcattagcagtccgcctagtcactgttctgtcaagagtcctgtctcatcacctaataacgtgacactgcgctcctcagtttcctccccagctaacattaacaatagcagatgcagcgtttcctctccctccaataccaacaaccgaagtacactttcttcaccggcagcttctacggtcggaagcatttgtagtccggtgaacaatgctttttcttatactgcctccggcacttccgcgggttcgtctactcttcgcgacgtagtgcctagtcccgatacccaagaaaaaggcgctcaggaagtgccttttcctaaaactgaggaagtggaatcagctatctccaacggcgtgacaggccagctaaacatcgtacaatacatcaagcctgagccggacggcgctttttccagctcctgtctggggggaaactccaaaattaatagcgactctagtttcagcgtgccaatcaaacaggagagtaccaagcacagctgtagcggaacctcctttaagggcaatcctacagtgaacccatttccattcatggatggctcttatttctcctttatggacgacaaggattactacagccttagcggaatactcggccctcccgtccccggtttcgacggcaactgtgagggctcaggtttcccagtaggaatcaaacaggagcccgatgatggaagctactaccctgaggcaagtattccatcatccgccattgtcggagttaactcgggaggacagtcttttcattaccggataggagctcagggaacaatttctctgagtcgaagtgcgagagaccagagcttccagcacctgtccagttttcccccagtgaacactctggtggaatcatggaagtctcatggggaccttagttcaagacgctccgacgggtaccctgtgctcgagtacattcccgagaacgtttcctctagtaccctcagatctgtgtctacggggtcctcccggccatccaagatctgtttggtgtgtggtgacgaggcaagcggctgccactatggcgtcgtcacatgcggcagttgcaaggtgtttttcaaacgtgccgttgagggtcagcataattacctgtgcgccggacgcaacgattgtattattgataagatccgacgtaaaaattgtcctgcttgtagactccagaaatgcttgcaggccggtatgaacctgggtgcacggaagtcaaaaaaactggggaagctaaaagggattcatgaagagcagcctcagcagcaacagccccctccaccaccaccccctccccaatcccccgaggaaggaactacttatatagccccagccaaggaacccagcgtgaataccgcactggttccccaacttagtacaatttcacgagcgctcaccccctcacctgtgatggtccttgagaacattgagccggagatcgtgtacgccggttacgactcaagcaagcccgacacagcggagaatttactctctactcttaatcggcttgccggaaaacagatgatccaggtcgttaaatgggctaaagtgttgccaggattcaagaatttgccacttgaggatcagattactttaattcagtattcctggatgtgtcttagcagcttcgccctgagctggcgcagctataagcacacaaattcacagtttctgtatttcgccccagatttagtattcaatgaagaaaaaatgcaccagagcgccatgtacgagctgtgccagggaatgcaccagattagcctgcaattcgtgaggttacagctcactttcgaagaatatactatcatgaaggtgctgctgctcctaagcaccatccccaaggatggtctcaaatcgcaagctgctttcgaggaaatgcgcacaaactatatcaaggagcttaggaagatggtgacaaagtgccctaataattcgggccagagttggcagcggttctatcagctgaccaagctgctagactccatgcatgacctcgtcagcgatcttctagaattctgtttctacacttttagagagagccacgctcttaaggttgagtttcccgcaatgctcgttgagatcatctcagatcagctacctaaagtggaatcagggaatgccaagcccctgtacttccaccgcaagtag

SEQ ID NO: 233157 - DNA, 2967 bp, Artificial Sequence
  Description of Artificial Sequence: Synthetic coding sequence
atggagacgaaaggttaccatagcctgcctgagggcttggatatggaaagacgctgggggcaggtttcacaggcggtagaacgatcgagtctcggccctactgagcgaactgacgaaaataactatatggagattgtcaacgtctcttgcgtaagcggcgctattcccaacaattccacacagggctcaagtaaagagaaacaggagctcctgccttgtttgcaacaggacaataatcggccagggattctgaccagcgacataaaaaccgagctcgagtctaaggagctatccgcgactgtggccgaaagtatgggactgtatatggattccgtgagggacgctgactactcctacgagcagcagaaccagcagggaagtatgtctcctgccaaaatttaccagaacgttgagcagctggttaaattttataagggcaatggacacaggccgtcaacactaagctgcgtcaacactcctttgcgctcttttatgtctgattcaggcagttccgtgaacggaggcgtgatgcgagcagtagtcaagtccccaatcatgtgccacgagaaatctcctagtgtgtgctctccattgaatatgacctcctcagtatgttctccagccggtattaacagcgtcagttctaccactgcaagcttcggttccttccctgtgcattcccccattacacagggaactccccttacgtgctcgccaaatgtcgagaaccgcggatcgcgaagccattcccctgcgcacgcgtctaatgtgggcagcccacttagctctcccctcagctcaatgaagtcttccatttctagtcctccatcccactgtagcgtgaagagtcctgtctccagcccaaacaatgtaacactcaggtctagcgtctcaagtcccgcaaatatcaacaacagccgctgttccgtatcctccccgtccaacaccaacaatcgctccacactttctagccctgctgcctctacagtcgggagcatatgttctcccgtcaataacgcattttcatacactgcctctggcacctccgctggctccagcaccctccgcgatgtggtgcccagtcccgatacacaggagaagggcgctcaggaggttccttttccaaagacggaggaagtcgaatctgccattagcaatggggttactggccagcttaatattgtgcagtatatcaagccggaaccagatggggctttcagctcttcctgcctcggcggtaattccaagattaacagcgactcatcatttagtgtaccgatcaagcaggagagcactaagcacagctgctccggcacaagcttcaaaggtaacccaaccgtgaatccattcccatttatggacgggagctatttcagcttcatggatgataaagactattactctctgtccggcattctgggaccccctgtgcctggcttcgacggtaactgcgaggggtcaggttttcctgtcggaatcaagcaggagccagatgacggctcatattatcccgaggcatcaatcccttcatctgccatcgtcggagtgaattcggggggacagtcgtttcattataggatcggcgcacagggaaccatatcactctcgcggagtgctcgggatcagtcctttcagcacctcagttcattccctcccgttaacactctcgtggaatcctggaagtcccatggagatctctcttctcgtagaagcgacggttacccagtccttgagtacatccccgaaaacgtttccagcagtactctgcggtctgtgtcaaccggaagctcgcgacctagtaagatctgcctggtctgtggcgatgaagcgtccggctgccactacggcgtcgtgacgtgtgggagctgcaaagtcttcttcaagagagcagtggaagggaaatgcagctggcagcacaattatctttgcgccggtcggaacgattgtataatcgataaaattagaaggaaaaactgtccagcttgtagattacaaaaatgtcttcaagctggaatgaatctgggggctcgcaagtctaagaagctgggcaagctaaaaggcatacacgaggagcagccacagcagcagcaacctcccccacccccaccacctcctcaatcacccgaggagggaacgacttacatcgcgcctgctaaggagccttcagtcaacacggccctggtcccacagcttagtaccatttcgcgcgctttgaccccatccccggtaatggtcctggagaacattgaacccgaaatcgtgtacgccggttacgattcttcaaagcccgatacagccgaaaacctattgtccacactcaaccggttagctggcaagcaaatgattcaggtggtaaagtgggccaaggtcctaccaggattcaagaacctgcctctggaggatcagataacactgattcagtacagctggatgtgcctctcatcatttgccctgtcctggcgatcatataagcatactaatagccaattcctgtattttgccccagacctcgtgtttaatgaggagaagatgcatcagtccgccatgtatgagctgtgccagggcatgcaccagatctctctgcagtttgtgaggctccagctcacgtttgaggagtacactattatgaaggttctgttactgctgtctactattccgaaagatggactcaagtcgcaggccgcatttgaggaaatgaggaccaactacattaaagaactgaggaagatggtgactaagtgccccaataactccggccagtcatggcagcgcttttaccaattaactaagttattagattcaatgcacgacctggtgtccgacctgctcgaattctgcttctataccttcagggagtcccacgcactgaaggtagaatttcctgccatgctcgtggagatcatctccgatcagctaccgaaggtggagagcggcaatgcaaaacccttgtatttccatcgcaaatag

SEQ ID NO: 233158 - DNA, 2955 bp, Artificial Sequence
  Description of Artificial Sequence: Synthetic coding sequence
atggagaccaaagggtaccacagcttgcctgaaggactcgacatggagcggagatggggccaggtatctcaagcggtggaacggtcttctctaggtcctactgaacgcaccgatgaaaataactatatggaaatcgttaatgtttcatgtgtgagcggggcaatcccgaataactctacgcagggttctagcaaggaaaagcaggaactgctcccatgtctgcaacaggataacaatagacctgggatcctcacatctgacattaagactgagctcgagtccaaggaactcagtgctacggtggccgagagtatgggtctttacatggacagcgtgagggacgccgattacagctacgagcagcagaatcagcagggctctatgtctcccgcaaaaatctaccagaatgtcgagcagttagtgaaattctacaaaggaaatggccaccgacccagcaccctgagctgcgtcaacacccctctccgttcattcatgtccgatagtggatcctcggtcaacggaggcgtcatgagagccgttgtgaagtcccctatcatgtgccacgaaaagtctccatctgtgtgctcacctctgaacatgaccagtagcgtgtgctctccggcaggaatcaattctgtaagctcaaccacggcttcctttgggtcttttcctgtacactccccaataacacaggggacacctctcacgtgctccccgaacgtggagaatagaggttctcggtctcactccccggcacacgcttccaatgtgggtagcccactgagttcaccattgtcatctatgaagtcctcaatttcttctcccccttcgcactgttccgtgaaatcgcctgtgtcctcaccgaataatgtcactctgaggtccagtgtctcttcacccgctaacatcaacaattcccggtgctctgtgagttccccttccaacactaacaatcgatcaactctctcctcgccagccgcttcaaccgtgggatcaatctgttcccccgttaataacgctttctcctacactgcctctggcaccagcgccggatcttccactctgagggacgtagtcccatccccagatacccaggagaagggcgctcaagaggtgccattccccaaaacagaggaagtggaatcagcaatctcaaacggagtaaccggacagttgaacatcgtgcagtatatcaagcctgagccagacggagccttttctagctcttgtctgggaggtaattccaaaatcaattcagattccagcttcagtgttccgataaagcaggaaagtacaaaacactcctgtagcgggacctccttcaagggcaaccccaccgtaaacccattcccattcatggatgggtcttatttttcttttatggacgacaaggactattattcactgtccgggattttgggcccaccagtacccggatttgatggcaactgcgagggttcaggcttccctgtcgggataaagcaggagcccgacgatgggtcctattatcctgaagcctctatcccttcttctgctattgttggcgtcaactcagggggacaatcgtttcactaccggataggggcacagggtactatctctctgtcccggtccgctcgtgaccagtcctttcagcatctgagctctttccccccagtgaacaccttggtggaatcttggaaaagtcacggcgacctgagctccaggcgaagcgatggttatcccgtgcttgaatacattcctgaaaacgtgagctccagcaccctacgttcagttagtacggggtcctccaggccatccaagatttgtctggtgtgtggcgatgaggcatccggctgccactatggggtcgtcacctgtggatcatgtaaagtattcttcaagcgagccgttgagggtcagcacaattacctgtgcgctggacgcaacgattgtatcattgacaagatcaggagaaaaaactgccccgcatgcaggctgcaaaagtgtttgcaggctggcatgaacttgggggcaaggaagtcgaagaagttgggaaagctcaaaggcatccacgaggaacagccgcagcagcagcagcccccaccccctccccctccgcctcagtcccctgaggagggcaccacgtacatcgccccagccaaggagccttcagttaataccgccctggtgcctcagctcagtactatcagcagagccttgaccccaagtccggtcatggtgctggagaatatcgagccagaaatcgtgtacgcgggttacgactcctctaagcctgacaccgccgaaaatcttctgagcaccttgaacaggttggccggaaaacagatgatccaggtagtcaagtgggccaaggttttgccaggtttcaaaaacttgccattggaagatcaaatcactctaattcaatattcctggatgtgcctttcttctttcgctctgtcatggcggtcctacaaacataccaatagtcaatttctctactttgcaccggacctcgtttttaacgaggaaaagatgcatcagagtgcaatgtatgagttatgccagggaatgcaccagattagtttacagtttgttaggctgcagctcacctttgaagaatacaccatcatgaaagtgctcctgttactctccaccatcccaaaggatggtctgaagtctcaggcagcgttcgaggaaatgaggacaaattacataaaagaactcagaaaaatggtgaccaagtgccctaataactccggccaaagctggcagcgtttctatcagctcacaaagctgttggattccatgcatgacttggtgtccgatctgttagaattttgcttctataccttccgagagagccatgcccttaaagtcgagttccccgctatgctggttgaaatcatatcagatcagttgcctaaagtggaatctggaaatgcaaagcccctgtatttccatcgaaagtag

SEQ ID NO: 233159 - DNA, 2967 bp, Artificial Sequence
  Description of Artificial Sequence: Synthetic coding sequence
atggaaactaagggttatcattctctgcctgaggggctggacatggagcgacgctggggtcaggtttctcaggccgtggaacgctcctccctcggcccaaccgagcgcacagatgaaaacaactatatggaaatcgtgaacgtgagttgcgtttctggcgctatcccaaataactctacacagggatcttccaaagaaaagcaagagcttcttccctgcctgcaacaggataacaaccgaccgggtattctaacctcagacattaaaacggagctcgagtccaaggagttgtccgctaccgtagccgagagcatgggcttgtatatggatagcgtgagagacgcagattactcttatgaacagcagaatcagcagggctccatgtctcccgcaaagatctaccagaatgttgagcagctggtgaagttttacaagggcaacggccacaggccatccacgttgagctgcgtgaacactcccctgaggagctttatgtcagacagcggatctagcgttaacggtggggtgatgcgggcagtcgtgaaaagcccgattatgtgtcacgagaagagtccctccgtttgctcacctttgaacatgacctctagtgtgtgtagcccggctggaataaacagcgtgagctcaaccacagcgtctttcggctcgtttcccgtgcacagcccgattactcaggggaccccacttacatgttcaccgaacgttgaaaacaggggctccaggtctcactctccggcacacgcgtctaatgtcggatcccccctgtcaagcccactgagtagcatgaaatcctcaataagctccccaccttcacactgcagcgttaagtcgccagtgtcaagtcccaataacgtaacactccggtcatctgtctcatcccctgccaacatcaacaattctcgatgtagcgtgtcctcccccagcaatacgaacaacagatcaaccctgagcagccccgctgcaagtacggtcggcagtatatgctccccagtcaacaacgcattctcctacacagcatcagggacatctgctggcagtagtacactgcgagacgtggtgcctagcccggatactcaagaaaagggcgctcaggaggtgccttttcccaaaacagaggaagttgagtcggcgatatcaaatggcgtgactggccaattgaacatagtgcagtacatcaagcccgagccggacggggcattcagtagcagctgccttggcggaaactcaaagataaatagcgattcgtctttttctgtccccataaaacaagagagcacaaaacattcctgcagcgggacatctttcaaagggaaccctactgtgaatccttttccgtttatggatggttcctacttctcattcatggacgataaggactattacagtctgagtggtatcctggggcctccagtgcctggctttgatgggaactgcgaaggcagcggtttccctgttgggattaaacaagagcctgacgatggatcatattaccccgaagccagtattccctcctccgccatcgtgggtgtgaacagcggtggtcagtcttttcattatagaattggtgcacagggcaccatctcactgtcaagaagtgctcgtgaccagagcttccagcacctctcttctttccctccagttaataccttggtagagtcttggaaatcgcacggggacctcagttccagaaggtccgatgggtatccagtcctagagtacatcccagaaaacgtctctagctccaccctacggagcgtatctacaggcagctctcggccaagtaaaatttgcctcgtgtgcggcgatgaggcctcaggttgtcactatggagtcgttacctgcggttcatgtaaggtcttttttaagagagccgtggagggaaaatgctcctggcaacacaattatttgtgcgcgggtcgcaacgattgcatcatagataagatcagaagaaagaactgtcccgcttgtcgcctccagaagtgtctacaggccggaatgaaccttggggctcgaaaatctaaaaagttgggcaagctcaagggcattcacgaagagcagccacagcaacagcagccaccgcctccaccaccccctccccagtctccagaagaaggcaccacatacattgccccagccaaggagccttctgtgaataccgccctggtgccacaacttagcactattagcagagcgttgactcctagcccagttatggtgctagagaatattgagcctgagattgtgtatgccggttacgattcctcgaagcccgataccgcggaaaacctgctttcaaccctaaacaggctggcaggcaagcagatgatacaggttgtgaaatgggccaaagttttgccaggcttcaagaatttgcccttggaagaccaaatcacgcttatccagtactcctggatgtgcttgtctagctttgccctgtcttggaggtcatacaaacacaccaattctcagttcttatatttcgctcctgacctggtgtttaatgaggaaaagatgcatcagtccgcaatgtacgagctgtgccagggtatgcaccagatcagtctgcagttcgtaaggctgcagctcacatttgaagaatataccataatgaaggttttgctgctgctttcaacaattccaaaagacgggctgaaatcacaggccgctttcgaggaaatgagaacaaactacataaaagagctgagaaagatggtcactaagtgtcctaataactccgggcagtcctggcaaagattctatcagcttactaagctgctggactcaatgcatgatctcgtgagtgatctgctggagttttgcttttacacattcagagaatcacatgccctgaaggttgagtttcccgctatgctggtcgagataattagcgatcagctgcctaaagtcgagagtgggaacgctaagcccctgtatttccaccgcaaatag

SEQ ID NO: 233160 - DNA, 2604 bp, Artificial Sequence
  Description of Artificial Sequence: Synthetic coding sequence
atggagaccaaaggatatcattctttacccgaaggcctggacatggagcggcgatggggccaagttagccaggcggtggaaagaagcagcctgggacccactgagaggaccgatgaaaataactacatggaaattgtgaacgtttcctgcgtgagcggtgcaattcccaataattcgactcaggggagtagcaaagagaagcaggaacttttaccatgtctgcagcaggataataatcggccaggaatcctgacatccgacattaaaacggagctggagtctaaagagttatccgccaccgtcgccgagtctatgggcctgtacatggactcagtaagggatgccgattatagctacgaacagcaaaatcaacagggttccatgtcacctgccaagatttatcaaaatgtagaacagttagtcaaattctacaagggaaacggtcatagaccaagtaccttatcttgtgtcaacacaccactgcgatcttttatgagtgacagcggtagttcagtgaatggaggcgtgatgagagcagtggttaagtcgccaatcatgtgccatgagaaatcgccgtcggtctgttccccattgaatatgacttcctcagtgtgctctcctgccggaatcaactccgtgagttccaccaccgcgtccttcgggagctttcccgtgcacagtcccatcacccagggaactccgcttacttgttcccccaacgttgaaaaccgcggatctcggagtcacagccccgctcacgcttcaaacgtggggtcccccctttctagccccctgtccagtatgaagtcttccatttctagtcccccaagtcattgttcagttaaatcacccgttagttcacctaacaatgttaccctgagaagttcagtgtcgagtcctgcgaacataaataacagccgatgctctgtgtctagcccctccaacactaacaacagaagcaccctgtccagcccagccgcttcaacagtgggctcaatctgcagtcctgtcaataacgcttttagctatactgcatccgggaccagtgccggttcaagcaccttgagagacgtggttccatctcctgacacccaggaaaagggggcacaagaggtaccattccccaaaacagaggaagtggaatctgccatttctaatggcgttaccggccagttaaatattgtgcagtacatcaagcctgagccagatggcgcattcagttctagctgtcttggaggcaatagtaagatcaacagcgattcctcgttctccgttcctattaaacaggagtccactaaacacagctgcagcggcacatccttcaaggggaaccctaccgttaaccccttcccgtttatggacggaagttatttttcattcatggatgataaggattactactcactgagtggcatcctgggacctccggtgcctgggtttgatggcaactgcgagggaagcggcttcccggtgggaattaaacaggagcccgatgacggcagctactaccccgaggccagcattccttcatctgccatcgtgggagtgaacagtggcggacaatctttccactaccgcattggcgctcaggggaccatttccctgtctaggtccgctcgagaccagtcttttcagcacctttcgagtttcccgcctgtaaacaccctcgttgagtcttggaagtcccatggcgacctgtctagccgcaggagcgatggctatccggtgctggagtacatccccgaaaatgtatcttctagtacactacggtccgtgtctaccggttcctcaagaccaagcaagatttgcctagtgtgtggcgacgaagctagtgggtgccactatggtgtggtgacgtgtgggtcttgtaaggtttttttcaagcgcgcagtggaaggccagcacaattacttgtgcgcagggagaaacgattgtatcattgataaaatacgcaggaaaaactgtcctgcttgccggctccaaaaatgtttgcaagcgggaatgaatctgggcggattcaagaatctcccattggaggaccaaattacactgattcagtattcatggatgtgcctgtcaagctttgccctgtcttggcgaagttacaagcataccaattcacagtttctctatttcgcgcctgacctggttttcaatgaggagaagatgcatcaatccgctatgtacgaactttgccagggaatgcatcagattagtctccagtttgtccgtttgcagctcacattcgaggaatataccattatgaaggtcctgctgttactgagtacgatcccaaaggacgggcttaagagccaggctgcattcgaagagatgagaacaaattacatcaaggaactcaggaaaatggtaaccaaatgcccaaataactctggccagtcttggcaacggttttatcagctgaccaaactgctggactctatgcatgatctcgtgtccgacctcctcgagttttgcttttacaccttccgcgaaagccacgcattgaaggtggaattccctgccatgctcgtggagatcatcagcgatcagctcccaaaagtggagtcaggcaatgctaaacccctgtacttccacaggaagtag

SEQ ID NO: 233161 - DNA, 1920 bp, Artificial Sequence
  Description of Artificial Sequence: Synthetic coding sequence
atggaaacgaagggctatcacagtctgcctgaaggcctggacatggagcgcaggtggggacaagtatcccaggccgtcgagcgttcctctttaggcccaacagagcgtaccgatgaaaataactacatggagattgtaaacgtgagctgtgttagcggtgccataccgaataactctacacaaggatcctccaaggaaaagcaagagctgctgccttgcttacagcaagacaacaacagacccggtatactcacatcagacataaagacagagctcgagagtaaagagctgtctgcaacagtcgccgaaagtatgggcctttacatggattcggtgagggatgctgactactcctatgaacagcaaaatcaacaaggttccatgtccccggctaaaatttaccaaaatgtcgagcagcttgtcaaattctataagggcaatggacatcgtccctctactcttagctgcgttaatactccactgagatcctttatgagcgatagtgggtcatcagtcaatggcggtgtgatgcgggcagtcgtgaagtcaccaattatgtgtcacgaaaaatccccgagcgtgtgtagccccctgaatatgacctcatctgtgtgtagccctgccggaatcaattcagtgtccagtaccactgcgtctttcggcagttttccagttcacagcccgattacccagggcacgcctctgacctgctctcccaacgtggaaaataggggttctagatctcactcccccgctcatgcatccaacgtggggagccccctgagttcaccactctcatcaatgaagagctccataagcagcccaccttctcactgtagcgtcaaatcacctgtcagtagccccaacaacgtcactctgaggagctccgtctcgtctcccgcaaatatcaacaactcgcggtgctctgtgagctccccatccaatacaaataaccgcagtaccctctcatcaccggctgcatccaccgtgggttctatttgctcacccgttaataacgctttctcttacactgcttcagggacctccgcaggctcttccaccttaagagacgtcgtgccttctccggatacgcaagaaaagggcgctcaggaggtccctttcccaaagaccgaagaagttgagagtgcaattagtaatggtgtgacaggccaacttaatattgttcagtacatcaaacctgagccggacggtgctttcagtagctcatgccttgggggaaactcaaaaataaactccgactccagctttagcgtcccaattaaacaagagtctaccaagcacagttgtagcgggacctccttcaaggggaatcccacggtgaacccattccccttcatggacggctcctactttagctttatggatgataaggactactactctctctccggcatcctagggccaccggtcccgggtttcgacggcaattgtgaggggagtgggttccccgttggaatcaaacaggaaccagacgacggctcctattaccccgaagcgtccatcccttctagtgccattgtgggtgttaacagtggtggacaatcttttcactaccgtatcggcgcacagggcaccatcagtttgtcccggagcgccagggaccagtcatttcagcacctcagtagcttccccccagtcaacacactagtcgaaagctggaaatcccacggggatttgtcatctagaagatccgacgggtaccctgtactggagtatatccccgaaaacgtctcaagctccactctgaggtcggttagcactgggtcctcaagaccatccaaaaaaaacatctataggttcctgctgtgcaataaccgcacccgaggagtgggccagcagctgcctctgtctccccgatccagtaccgtgttctgtattactggaattcacactcgttag

SEQ ID NO: 233162 - DNA, 1797 bp, Artificial Sequence
  Description of Artificial Sequence: Synthetic coding sequence
atgccatgcattcaagcgcagtacgggacccctgcaccctcacctggacctcgcgaccatttggcctctgacccattgactccggagtttataaaacctaccatggacctggcatcccccgaagccgctccagccgcacccactgcacttccctcattctcaacattcatggatggttacacgggggagtttgatactttcctgtatcaactaccaggaacagtccagccctgctctagcgcctcctcttctgcttctagcacgtcaagcagtagtgccacatccccggcaagcgccagcttcaaattcgaggattttcaggtttatggatgttatccaggacccctctctggtcccgtagacgaagctctctcttccagcggatctgattactacggatctccgtgttccgctcccagcccctcaacccccagcttccagccccctcagctgagtccctgggatggaagctttggccacttctctcccagtcagacctacgagggcttgcgcgcttggacagaacagctaccaaaagccagcggtccaccacagccccctgcatttttctctttttctccacccactgggccatccccatccctggcacagtcccccctaaaactcttccccagtcaggcgacccatcagcttggtgagggcgaatcatactcaatgcctacggcatttccagggctcgctccaacatcccctcatctcgaaggctccgggatactggatacacccgtcacaagtacaaaggctagaagtggggctccgggtggctcagagggccgttgcgccgtctgtggagataatgcctcttgccagcattacggcgtgaggacgtgtgaggggtgtaagggattctttaaacggactgttcagaagaatgccaaatatatttgtctggccaacaaggattgcccagtcgataagcgcaggcgcaaccgctgccagttttgccgatttcagaagtgtctggccgtaggaatggttaaggaggttgtccggaccgacagcctgaagggcagaagggggagattgcccagcaagcccaaacagccgccagacgcttctcctgccaatttgcttactagcctggtaagggcacatctggacagcgggccatctacagcaaaactcgactatagcaagttccaggaactagtgttgcctcatttcgggaaagaggatgctggagatgtgcagcagttttacgacctgctcagtgggtcgcttgaagtgattagaaaatgggctgagaaaatcccaggatttgccgaactttcccccgcagaccaggacctattgttggaaagcgcgttcctggagctgttcatcctgaggctcgcttaccgctccaagccaggggagggcaaactgattttctgctcgggcttagtactgcacagactgcagtgcgctcgcggatttggtgattggattgacagcatcctagcatttagtaggtccctgcacagcttgcttgtcgacgtccctgcctttgcctgtttgagtgcactcgtactcatcaccgatcgacatgggctccaggaacctcgcagagttgaggaactccagaatcggattgcttcctgccttaaggaacacgtggccgcagttgctggggagccccagcctgcttcttgcttatcccggctgttaggaaagttacccgaattgcgcacactgtgcacacagggcctgcagagaatcttttacttgaagctggaggatcttgttcctcccccaccaatcatcgataaaatttttatggacacactgcccttctag

SEQ ID NO: 233163 - DNA, 1836 bp, Artificial Sequence
  Description of Artificial Sequence: Synthetic coding sequence
atgtggctggccaaggcttgttggtctatccagtccgagatgccctgtatccaggcccagtatggtaccccggcaccttcgcctggtcccagggaccacctcgccagcgatccccttacacctgaattcatcaagcctacgatggatctggctagccccgaggcagcccctgccgctcccactgctttgccctctttctccaccttcatggacgggtacacaggcgaattcgatacctttctctatcagctgcctggaacagttcagccctgttcatccgcttcgagtagcgcctctagcacatctagctctagcgccacatctccagcctcagcgtctttcaagtttgaggacttccaggtctacggatgttatcctggaccgctttcaggtcccgtggacgaggccctctccagtagcggttcagattattatggttcaccctgtagtgctccctccccaagcactccgtcgtttcagccaccacagttaagcccatgggacgggagtttcggccatttctcgccttcgcagacctatgaagggctgagagcctggactgaacagttgcctaaagcgtcggggcctccccaaccccctgccttcttttctttctctccccctactggcccaagtcccagcctggcacagtctcctctaaagttgttcccctcccaagcaacccatcagctcggtgagggggagagctatagtatgcccactgcatttcccggtttggctcccaccagcccgcatctggaggggagcgggattttggacactcctgtgacaagcaccaaagcgcgttctggcgctcccggaggaagcgagggtaggtgtgctgtctgcggtgataatgcatcatgccaacattacggggtgcgcacctgcgagggatgcaagggtttttttaagcgcactgttcagaaaaatgctaagtatatttgtctcgctaacaaggactgccccgtcgataaacgcaggcggaataggtgccagttctgcaggttccaaaaatgcctggccgtgggaatggtgaaagaagtagtgcgtaccgattctcttaaggggagaagggggagactaccatccaagcccaaacaaccgcctgacgcctctcccgctaacttgctgacctctctcgtcagggcacatctcgacagtggccctagtactgccaaactggattatagtaagtttcaggagctggtgctcccacactttggcaaagaagatgcaggggatgtgcaacagttttacgatctgttatccggatctctggaggtgatccgtaagtgggccgaaaagatcccagggttcgccgagctttcccccgcagaccaggatctgctgcttgagagcgcttttctagagcttttcatactacgtctggcttatcgatccaagcccggagagggtaaactcatattctgcagcggcctggtgcttcaccgattacagtgcgctcgaggctttggtgactggatcgactctatacttgcattctcccgctcactgcatagtttgcttgtggacgtcccagctttcgcctgtctctcagcgctggtcctgataacggaccgccatggattgcaggaacctcgccgagttgaagaattgcagaaccgaatcgcaagctgcctcaaggagcacgtggccgctgttgcgggagagcctcagcccgcttcctgcctatcccggctgctaggcaagctgcctgagctgcgtactttgtgcactcagggcctgcagcgtattttctacctgaagctggaggacttggtgcccccaccgccaattatcgataagatctttatggatacacttccattctag

SEQ ID NO: 233164 - DNA, 1797 bp, Artificial Sequence
  Description of Artificial Sequence: Synthetic coding sequence
atgccttgcattcaggcccaatacggtacgccagcaccctcaccagggcctagagaccatttggcatccgaccctctgacaccagagtttattaagccaacaatggatcttgccagcccggaagcagctcctgcagctcctacggctctgccatcgttttccactttcatggatggctacacaggagagtttgacacctttctataccagttacctgggacagttcaaccttgttcatcagctagctcttccgcctcttcaacgtctagcagtagtgcgacctcgccagcttccgccagttttaaatttgaggactttcaagtgtacggctgctatcctgggcctctctccggtccagtcgatgaagctctctcttcttctgggtccgactactacggatctccatgctcagccccttcaccctcaactccaagttttcaaccacctcagctgtccccctgggatgggtcctttggtcatttctctcctagccaaacatatgagggcctgagggcgtggacagagcagctgcccaaggcttcaggaccacctcagccgcctgccttcttcagctttagcccgccaaccggaccctccccctctctcgcccagtctccgctgaagttgttcccctctcaggcaactcaccagctaggggagggcgagagctatagcatgcccaccgccttcccgggtctggctccgacatccccacacctggagggttcaggaattctggacactccggttacttccacgaaagctcgcagtggagctcccggagggtctgagggtcgctgtgcagtgtgtggagacaatgcaagctgccagcattacggggtccgaacctgtgaaggctgcaagggatttttcaaacgcacagtccagaagaacgccaaatacatttgcctcgccaacaaagattgcccagttgataagcgcagacgcaaccgatgccaattctgtcgctttcagaagtgtctggccgttggcatggtgaaggaagttgtgaggacggactccctcaagggtaggcgcggtaggcttccttccaaacctaagcagcctccagacgcatcacccgcaaatttacttaccagccttgttcgcgctcacttagatagtggtccatctactgctaagttagactattcgaaatttcaagaacttgttcttccacatttcggaaaggaggacgctggtgatgtccagcagttctatgatctcctgtccggctccctcgaagtcattcgcaaatgggcagagaagatcccaggcttcgccgaattgtcacccgcagaccaggatctgctcctggaatccgcctttctcgagttgttcattctaagactcgcctaccgttccaagcctggagagggaaaactgatcttttgcagtgggctagttctgcatcgcctgcagtgcgccagagggttcggcgattggattgactcgatactggcatttagtaggagcctgcactccctgttagtcgacgttcccgcttttgcgtgcctgtcagctcttgttcttatcactgaccgtcatggactgcaagaacccagaagggtcgaagaattgcagaacaggatcgcctcatgcttgaaagaacacgtggccgcagtggccggtgaaccccagccggcatcatgtcttagccgactgctcggaaagttgcccgagctgcggaccctttgtacccaggggttgcagcgaattttctatctcaaactcgaggatctcgtgcccccaccgcctattatcgataaaattttcatggatacgctgcctttttag

SEQ ID NO: 233165 - DNA, 1797 bp, Artificial Sequence
  Description of Artificial Sequence: Synthetic coding sequence
atgccctgcatccaggcccagtatggcactccggctccaagcccagggccacgggatcacctggcctcggacccgttgacgcccgaattcatcaagccaaccatggaccttgcttcacctgaagctgctcctgccgcacccaccgcccttcccagcttctccaccttcatggacgggtacaccggtgaattcgatacgttcctataccaacttccaggaacagtgcagccatgctcttccgcatctagtagcgcatcttccacaagctcatcaagcgcgaccagccccgcttcagcgtcttttaaatttgaggattttcaagtgtatggttgttacccaggaccactctcaggcccagtggacgaagcattgagctcaagcggatctgactattacggtagcccgtgttccgcgcctagcccgagcacaccttccttccagccccctcagctcagtccctgggatggaagctttgggcacttcagtccaagccagacatatgagggtttaagagcttggactgagcaacttcccaaggcctcaggccctccgcaaccccctgcctttttttccttcagccctccgacggggccttccccatcactcgcgcaatcaccgctcaagctgttccccagccaggctacccatcaactgggcgagggtgagtcgtattccatgccaactgcatttcccggactcgcccctacctctccacacctggaaggttccggaattcttgacactcccgttacttccaccaaggcccgtagtggcgctcccggagggagcgaagggaggtgtgctgtctgcggggataatgcgagctgtcagcactatggagtgcgtacctgtgaaggctgtaagggcttttttaaaagaaccgtacagaaaaatgcaaagtacatctgtctcgcgaacaaggattgtccagttgataagagaagacgcaatcggtgccaattttgcagattccagaaatgcctggccgtcggcatggttaaagaggtggtgcgtacagacagcctgaagggtagacggggacgactcccttccaagccaaaacagccgccagatgcctctcctgccaacttactaactagtctggtgagggcccatctggatagcggcccatccactgcgaagctggattattccaagttccaggagctagtgctcccccatttcggaaaggaggacgcaggtgatgtgcagcagttttacgacctcctgtctgggtcactggaggtgatccgtaagtgggctgaaaaaatccccggatttgctgaactgtcacccgcagaccaggacctcttgctggaatccgcctttctggaactgttcatccttcggcttgcgtatcgctccaaacccggtgaagggaaactcattttctgtagcgggctggtgcttcatcggctgcaatgtgccaggggcttcggggactggattgacagcatactcgcgtttagccgtagcctccatagtctcctcgttgatgttcccgcattcgcctgtttaagcgcactcgttctgatcactgaccgacacgggctccaagaacccaggagagtggaagagcttcagaatcgtatagcaagttgtctgaaggaacatgtagcagctgtagccggtgagcctcaaccagcatcatgcctttcacgcctccttggcaagcttccagaactgcggaccctgtgcacccagggtctgcagaggattttttatctgaagttggaagacctggttcccccacccccaataattgacaaaatcttcatggatactctgcccttctag

SEQ ID NO: 233166 - DNA, 1959 bp, Artificial Sequence
  Description of Artificial Sequence: Synthetic coding sequence
atgactagtgcacagtataaaatcaagattttaatcgagggtctgcaccacggccagaggcctggtccagccccacccaggcagccgggatcattttgttgggcactcaaggccgacgggatcatgtggctggcaaaagcttgctggtctatccaaagcgagatgccatgcattcaggcacagtatggcaccccagccccttctcctgggcctagggatcacctcgcctccgaccccctgaccccagagttcataaagccaaccatggacttggcctcccctgaagctgcccctgctgcacctacagcattaccatccttcagtaccttcatggacggctatacaggcgaattcgacacctttttgtaccaactacctggcacagtgcagccatgcagttccgccagcagcagtgcttcatccacgagttcatctagcgcaacctctccagcctcagcttctttcaagtttgaggacttccaggtctacgggtgctacccaggacctctgtctggccctgtggatgaggccctgagttcttccggaagcgactattacggtagtccatgctctgcacctagtccttctaccccaagcttccagcccccacaactgagcccttgggatgggtccttcgggcacttttcgccatcccaaacttacgaaggcctgagagcctggactgagcagctgcctaaagctagtggtcctccccagccccctgccttcttctcattttctcccccaactgggcctagccccagcctggcacagagcccactgaagctgttcccttctcaggcaacccatcagctgggcgaaggcgaaagctattcgatgcctacagcttttcccggactggctcctacctctcctcacttagaaggctcaggtatattagacactccagttacctcaaccaaagccaggtccggcgcacccggaggaagtgaaggaagatgtgccgtgtgtggcgataatgcctcatgtcagcactacggagttcggacttgtgagggctgtaaaggattctttaaacggacagtccagaagaatgctaagtacatttgcctggctaacaaggactgccctgtagacaagaggcgacgcaatcgctgccagttctgcaggttccaaaagtgcttggccgtcggaatggtgaaagaggtagtcagaaccgactcgctgaaagggagacggggacggttgccatcaaagccgaaacagcctcccgacgccagccctgcaaatttacttacaagcttagtgagggcacatctggatagcggcccaagcacagcaaagctggactactccaagttccaggaactggtcctaccacacttcggtaaggaagacgccggagacgtccagcaattctatgacctgcttagcggatcgttggaagtaataaggaagtgggccgagaagatacctgggttcgctgaattgagccctgctgaccaggacctcctcctcgaatctgccttccttgaactgtttatcctgcgtttagcctatcggtctaagcccggagaagggaagctgatcttttgctcaggccttgtacttcaccgactccaatgcgcccgaggtttcggagattggatcgatagtatcctggcattcagtagaagtttgcactccctgctcgtggatgttcccgcattcgcttgcttgagcgccctggtgctcattaccgacagacacggccttcaggagccgagaagggtggaggagctgcagaacagaatagccagttgcctcaaagaacatgtcgcggcagttgcaggtgaaccccagccagcctcctgtctttctagattgttaggtaagcttccggagctacgtacgctgtgtacacaagggctgcagcggattttctacctgaagctggaggatcttgtgccgcctcccccaataatcgataaaatatttatggataccttacctttctag

SEQ ID NO: 233167 - DNA, 978 bp, Artificial Sequence
  Description of Artificial Sequence: Synthetic coding sequence
atgccttgcattcaagcccagtatggcacccccgcaccttctccaggtccccgtgaccatctggccagcgatcccctgaccccagaatttatcaagcctactatggaccttgccagtcccgaggctgccccagcggctcctacagcgctcccttctttttctactttcatggacggttacaccggggagttcgacacattcctttatcaacttcctggaacagtacagccttgctcttcagcatccagctccgcaagctcaaccagtagttccagcgccacctcacctgcttctgcttctttcaagtttgaggacttccaggtgtatggatgctacccaggtccactttctggaccggtcgacgaagccctaagcagcagcgggtccgattactacggaagcccctgttctgctcccagccccagcaccccttcatttcaacctccacagctctcaccgtgggacggaagttttgggcacttctcccccagccagacatatgagggcctaagagcttggactgaacagctgcctaaagctagcggcccaccccagccaccagccttcttcagttttagcccgcctacaggcccatcaccatccctcgcacagagtcctcttaaattgtttccttcgcaggcgacgcatcaactcggcgagggcgagtcctacagcatgccaactgcattcccgggactcgcacccacgtctccacacctggaggggagcgggatcttggatacccccgtgacgtcaaccaaagctcggagcggtgcccctggagggagcgaaggcagatgtgcggtgtgtggcgataacgcgagctgtcagcattacggcgtacgcacttgtgaggggtgtaaaggattctttaaggttcctcgatctccacgctggggccttctgctcgaaatggagaggggctggccccaccctattggcacctgtgggctccctctgggaagccctcctagctag

SEQ ID NO: 233168 - DNA, 1836 bp, Artificial Sequence
  Description of Artificial Sequence: Synthetic coding sequence
atgtggttggcaaaagcatgctggagcatccaatcggaaatgccctgcattcaagcccaatacgggacaccagccccatcacctggacccagggaccatctggcttccgaccccctgacgcccgagttcataaaaccgacaatggatcttgccagccctgaggctgcacctgccgcacccacggccctcccatccttttctactttcatggatggatacacgggagagttcgacaccttcttataccagctccccggtaccgtccaaccatgcagtagtgcatccagcagcgcctcttccactagtagcagcagcgccacctcccccgcttctgcgtcattcaaattcgaagatttccaggtgtatggctgttacccgggtcctttatcgggaccagtggatgaggctctgtcatcttccggctccgattactatggatccccctgttccgctccatctcccagtacaccgagctttcagccccctcagttatccccctgggatgggagttttgggcactttagcccttctcagacctacgaggggctgcgcgcatggactgagcagttgcccaaagcttctgggcctcctcagccgcctgcgtttttctctttttctccacccaccggcccaagcccttctctcgctcagtcccccctgaagctgttcccttcccaggccacacaccagctgggtgagggcgaaagctactccatgccaaccgcgtttccaggtcttgctcctacttcaccgcacctggagggatccgggattctcgacacacccgtgacttccactaaggccagatcaggggctcctggtgggtccgagggccgttgcgctgtatgtggggataatgcttcttgccagcactacggggtgaggacttgcgagggttgcaagggcttctttaagcgaaccgtccaaaagaacgccaagtacatttgccttgccaataaggactgccccgtggataagcggagacgcaaccgctgccagttctgcaggttccaaaaatgcctagccgtcggcatggtcaaggaggtggtgcggacagacagcctgaaaggaagacgcggtcgcctcccttccaaaccgaagcagcctccggacgcctccccagcgaacctgctaactagtctcgttagagcccatcttgactcagggccttccaccgccaagctggattactctaagtttcaggagttggttctgccccactttggtaaagaagacgctggcgatgtgcagcagttttatgatttgctgtctggaagcctagaagtgatacgcaagtgggctgagaagattcctggatttgcggagctctctcctgctgatcaggacctgctcttagagagcgcatttcttgagttgttcatcctgcgcctcgcctacaggtccaagcccggtgagggtaaactgatattttgtagtgggttggtactacacagactccagtgcgccagaggttttggcgactggattgactccatccttgccttttctcggtctctccacagcctgctagttgatgtgcccgcattcgcctgtctgtccgccttggtgctaatcacagacagacacggccttcaggaacctcgcagagttgaggagttacagaatcggattgcctcctgtctgaaggaacacgtggccgctgtagctggggaaccgcaacccgcaagctgtttaagccgactgctcggaaagctgccagagctccggacattgtgcactcagggattgcagaggatcttttacttgaaactcgaggacctggtgcctccaccaccaatcattgataaaattttcatggatactcttccattttag

SEQ ID NO: 233169 - DNA, 1797 bp, Artificial Sequence
  Description of Artificial Sequence: Synthetic coding sequence
atgccatgtgtccaggcgcagtacggtagcagcccacaaggcgcatccccagccagccagtcttatagctaccattcatcaggtgaatattcttccgactttctcaccccagagttcgtgaaattttccatggacttaacaaatacagaaattaccgccactacaagtctgccgtcattctctactttcatggacaattattctaccggctatgatgtgaaacccccatgcctctatcagatgcctctcagcggccagcaaagcagcatcaaggttgaagatattcagatgcacaactaccagcagcacagccacctgcccccacagtctgaggaaatgatgccccattccgggtctgtgtactacaaaccctccagcccaccgaccccaacgactcctggttttcaggttcagcatagccctatgtgggatgaccccggtagtctgcacaattttcaccaaaattatgtagcaacgacacatatgatcgaacagagaaaaacacccgtctcccgattgtcattgttctctttcaagcagagcccacccggaactccagtgtcctcttgccaaatgcgatttgatgggcctctgcatgtgcctatgaaccctgagcccgcaggctctcaccacgtggtggacgggcagacgttcgccgtgccaaaccccatccgaaagccagcttccatggggtttccaggcctgcagattggacatgcctctcaactcctggacacacaggtgcctagcccaccatcccgcggtagtccctctaacgagggcctttgcgccgtttgcggagataacgcagcgtgtcagcattatggagtacgcacttgcgagggatgtaaaggattctttaaaagaacagttcagaagaatgccaagtacgtgtgcctcgctaacaaaaattgccccgtggataagagaagaagaaaccgctgtcagtattgccggtttcaaaagtgtctggccgtggggatggtgaaagaagtggtccgaactgattcccttaaaggcaggagaggcagactcccaagtaagcctaagtctccccaggagccctcgcccccttccccccctgtgtccctgattagcgctctcgtacgcgctcatgtggattccaacccggctatgacctctctcgattactctcggttccaagcaaacccagattatcagatgtcgggggacgatacccagcacattcagcaattttacgacttgctgacaggcagcatggagatcattcgtgggtgggccgaaaaaatccccggatttgccgacctgccgaaagcagaccaggatctgttatttgagagcgcttttctggaactattcgtacttcgactggcctataggagcaatcccgtagagggaaaattgattttctgcaatggcgtggtcttgcatcgcttacagtgcgtgcggggattcggagaatggatcgactcgattgtcgagttctcctcaaacttgcagaatatgaacatcgacatcagtgctttttcctgtatcgcagccctagcgatggtgactgagcgccatggactgaaagaaccaaagagagtggaagagctgcagaacaaaatcgtaaattgcctgaaggatcacgtcacattcaataacggtggcctcaacagaccaaattacctctctaagctcctaggtaaattgcccgagttaaggacactgtgcacacaagggttacagcggattttttacttgaaactggaagatttggtgccaccacccgcaatcatcgataagttatttctggacactttgccattctag

SEQ ID NO: 233170 - DNA, 1797 bp, Artificial Sequence
  Description of Artificial Sequence: Synthetic coding sequence
atgccctgtgtccaggctcagtatggcagtagcccacagggggcttctccagcctcacagagttactcctatcattcatctggggagtattcctctgacttcctgaccccggagtttgtgaaatttagtatggacctcacaaacaccgagatcactgcaacaaccagcctgccatcattttccaccttcatggataactactccaccggatatgacgtgaaacccccatgtctctaccaaatgcctcttagtggacagcagtcttccatcaaggttgaggatatccagatgcacaactaccagcagcacagtcacctccctccccagagtgaggagatgatgccacactcggggtctgtttattataagccttcctcaccacctacgcctaccacccctggattccaggtgcagcattcgccgatgtgggacgaccccggttccctacacaacttccatcaaaattacgtggccaccacgcatatgatagagcaaaggaaaacaccagtctccagattatcacttttctcattcaaacagtcaccccctggcacccccgtgagttcctgtcaaatgcgattcgacgggccattacacgttccaatgaacccagaacccgctggatcccatcacgtggttgatggccagacttttgccgttccaaatccaattcgaaaacctgccagtatgggtttccccggactgcagatagggcacgcgtcacagctgcttgatactcaggtgccaagccccccaagtcgtggttcgccaagcaatgaagggctgtgtgctgtctgcggggataacgctgcctgccagcactatggagtccgcacatgcgaaggatgcaaaggattcttcaagcggaccgtgcagaagaatgccaagtacgtttgccttgccaataagaattgtccagtcgacaagcgcaggcgcaacagatgtcagtattgtagatttcagaagtgtctcgcagtggggatggtgaaagaagtcgtgcgtacagacagcctcaaggggcgtagggggcgtctcccctctaagccaaaaagcccacaggaacccagtcccccatccccccctgtgagccttatatcagccttggttcgcgctcatgtggactctaatcctgctatgacttcactggactattccaggttccaggcgaacccagactaccagatgtccggcgacgatacacagcacattcaacagttctacgaccttctcaccgggtctatggagatcatccgcggttgggcggaaaaaatcccgggattcgcagatttacccaaggccgatcaggatcttctctttgagtccgcctttttggagttattcgtcctccgcctggcttacaggagcaacccagtggagggcaaattaatcttctgcaatggcgttgtacttcatcgccttcaatgcgtcagaggtttcggcgagtggatcgacagtattgttgagttcagttcaaacctgcagaatatgaatattgacattagcgcattcagctgcatcgctgccctagctatggttacagaaagacacggcttgaaagagcccaagagagtcgaagagttgcagaacaaaatcgtgaattgcctgaaggatcacgttactttcaacaacggcggactcaacaggccgaattacctttcaaagctgctcggaaagctgcctgagctgcgcacactctgtacccaaggactgcagaggatcttctacctaaaattagaggatcttgtgccgccaccagcaatcatcgacaaactgtttctagacactctccctttttag

SEQ ID NO: 233171 - DNA, 1179 bp, Artificial Sequence
  Description of Artificial Sequence: Synthetic coding sequence
atggacaattattcaaccgggtacgatgtgaagcccccttgcctgtatcagatgcctctatccgggcagcagtccagtatcaaggtggaagatattcagatgcacaattaccaacagcacagccacctgccccctcaaagcgaagaaatgatgcctcactctggttctgtctactacaagcctagctctccgccaaccccaactactccaggcttccaagtgcaacatagccctatgtgggatgatcccggatccctgcacaacttccatcagaattacgtggctacgacccatatgatcgagcaacgcaagacacctgtctcacgactctccctattttcttttaaacagagccccccaggcacccctgtatcgtcttgtcagatgcgtttcgacggaccattgcatgttcccatgaaccctgaaccagccggttctcatcacgtggtggatggccagacattcgctgtccctaatcccatacgaaaacccgcatctatggggttcccaggcctgcaaatcggccatgcttcccaactcctggacactcaggtaccctcccccccttctagaggaagcccttctaacgaaggactgtgtgccgtctgcggcgacaacgctgcttgtcaacactatggagtgcggacctgtgagggctgcaaaggcttttttaagagaacggtgcaaaagaatgccaagtacgtgtgcttggcaaacaagaactgtccagtggacaagcgacggaggaaccgctgtcagtactgcaggtttcagaaatgcctggctgtgggtatggtgaaggaggtggtacgaacagattctttaaagggacgcagaggcaggctgcccagtaagcccaagagcccgcaggagcccagtcccccaagtccccctgtttctctgattagcgctctggttcgtgcccacgtagactcgaatccagcgatgacttctctcgattactcacggtttcaggccaatcctgattatcagatgtccggagatgacacacaacacatccagcaattctacgatctgctaaccgggtctatggagatcatacggggatgggcagaaaagatccccggatttgctgaccttcctaaagccgaccaggacctgctcttcgaaagtgcatttcttgagctgtttgtcctgcgtctggcatatagaatctag

SEQ ID NO: 233172 - DNA, 1179 bp, Artificial Sequence
  Description of Artificial Sequence: Synthetic coding sequence
atggataattactcaactggatacgacgtaaaacctccctgcctctaccagatgcccctgagcggtcagcagagttccataaaggtggaggacatccagatgcataattatcaacaacactctcacctgccacctcaatctgaggaaatgatgcctcattccggatccgtctactataagcctagttcccccccaacacccaccacacctggattccaggtgcagcatagccccatgtgggacgaccctgggtctttgcacaactttcaccagaactatgttgcgacaacccacatgattgagcagagaaaaacgccagtaagtcgacttagtttgttttctttcaagcagtctccacctggcaccccagtgtcttcctgtcagatgcgcttcgacggacctctgcacgtgccgatgaacccagagcctgcaggatctcaccatgtggttgatgggcagaccttcgccgtgccaaatcccattagaaagccagcaagtatgggatttcctgggctgcagattggccatgccagccagctgctagatacacaggtgccatcacccccaagccgtggcagcccgtctaatgagggactttgcgccgtctgcggagacaatgccgcatgtcagcattacggcgtcaggacatgcgaaggttgtaagggttttttcaaacggactgtgcaaaaaaatgccaaatacgtgtgtctggcgaacaagaattgtcccgtcgataaaagacgacggaatcgctgtcagtactgtcgcttccaaaaatgcctcgccgtgggcatggtaaaggaggtcgtccgaacggactctctgaaagggcgtcggggaagattaccatccaaaccaaaatctcctcaggaaccttcacctcctagcccccctgtgagcttaattagcgcactggtaagggcccacgttgactccaaccctgcaatgacctctcttgactactcacgcttccaggcgaatcccgattaccaaatgtcaggcgatgatactcagcacattcagcagttctatgacttgttgacagggtctatggaaattatcaggggctgggccgaaaagatcccgggatttgccgacctgcccaaagcggatcaggacctgctttttgaaagcgcctttctggaactgttcgtcctgcgtctggcataccggatatag

SEQ ID NO: 233173 - DNA, 777 bp, Artificial Sequence
  Description of Artificial Sequence: Synthetic coding sequence
atgccttgcgttcaggcccagtacggatccagtcctcagggggcttctcctgcgagtcagtcctacagctatcattcctccggagagtacagttccgactttctaaccccggagttcgtcaagtttagcatggacttaacgaatacagaaataactgccactacttctctcccttcctttagcacctttatggataattattctaccgggtatgacgttaagccaccttgcctgtatcagatgccattgagcggccagcagtccagtattaaggtggaggatatacagatgcacaactaccagcagcatagccacctcccacctcagtcagaggaaatgatgccacattcgggctctgtttactataagccctcaagcccaccgacaccaacaaccccagggttccaggttcagcactctcctatgtgggacgatcctggcagcctccacaatttccaccagaactacgttgccaccacccacatgatagagcagcgaaagactcccgtgagcagactcagcctgtttagctttaagcagagcccccctgggacacctgtatccagctgccagatgagattcgacgggccactgcatgtgcccatgaatcccgagcccgctggatctcatcatgtggtggatggtcagacattcgccgtaccgaatcccatacggaagcctgcgagtatggggttccctgggctccagatcgggcacgcgtctcagttattagatacacaagtaccaagccccccaagtcgtggaagtcccagttag

SEQ ID NO: 233174 - DNA, 1608 bp, Artificial Sequence
  Description of Artificial Sequence: Synthetic coding sequence
atggacaactattctacagggtacgacgtcaaaccaccatgcttgtaccaaatgcctctatcaggccagcagtctagcattaaagttgaggatattcagatgcataattaccagcagcacagtcacctgccacctcaatctgaagagatgatgccacacagcggctccgtgtactataaaccatcaagtccccctacccctacaacccctggcttccaggtgcaacattccccaatgtgggatgatccaggctcgctacacaatttccatcagaattacgtcgcgactactcacatgatcgagcagcgcaagactccagtgagccgtttgtcactgttcagcttcaagcagtctccgccagggacacccgttagctcttgccagatgcgttttgatgggcctttacacgtgcccatgaaccccgagcctgcaggatctcatcacgtcgtcgatggacagacttttgcagtccccaaccctattagaaaacccgcatccatgggctttccaggcctacagatcggccacgctagtcagctcctggacacacaggtcccatccccaccgagcaggggtagtccttccaatgaggggctatgcgcagtgtgtggagacaacgctgcatgtcagcactacggtgtgagaacttgcgaaggctgtaagggcttcttcaaaaggaccgtgcagaagaacgctaagtatgtgtgcttagccaacaaaaactgtccggtcgacaaaagacggcgtaatcgctgccagtactgcaggtttcagaaatgcctcgccgtgggaatggtaaaagaggtggtcagaaccgactccctgaaaggtcggaggggtaggctgccaagtaagccaaagtcaccccaggaacctagccctccatctcctccagtgtcacttatatcagccctcgttagggctcatgttgacagcaatcccgctatgaccagcctggactattctcgttttcaagccaaccctgactaccagatgagcggcgatgacacacagcacattcagcagttctatgacttgcttacgggtagtatggagattattagaggctgggctgagaagatccctggattcgccgacctgcccaaagcggatcaggacctgctctttgaatctgcattccttgagttatttgtattaagactggcctacagatcgaatccagtagagggaaaattaatcttttgcaatggcgttgtcttgcatcgcttgcaatgtgtcagggggttcggtgagtggattgattcaatcgtggagttctcaagcaacctacagaatatgaatattgacatctcggcattcagctgcattgcagcgctggctatggtgacggagcggcacgggctaaaagaacccaaaagggtggaggagcttcagaataaaatcgtcaattgcttaaaagaccatgtgaccttcaacaacggcggtctcaacaggcccaactatctgtcaaaactgctgggcaagctgccagaactgcgcacactctgcacccagggactccaaaggatcttttatctgaagctggaggacctggtacccccaccagcaatcatcgacaaacttttccttgatactctacctttctag

SEQ ID NO: 233175 - DNA, 1830 bp, Artificial Sequence
  Description of Artificial Sequence: Synthetic coding sequence
atgaacgaggacaggcggggagagctcctgacaatgccttgtgttcaggctcagtacggctcgtctccccagggcgctagccctgcgagccagtcatactcctaccactcttctggagaatactcctccgacttcctgactccagaattcgtgaaattttcaatggatctgactaacaccgaaattactgctaccactagcctgccttccttctcgactttcatggataactactccacaggttatgatgtgaagcccccatgtctgtaccagatgcctctgtctgggcagcagtcatctatcaaggttgaggatatccaaatgcacaattaccagcaacacagccacctgcctccacagagcgaggagatgatgccccactctggctccgtgtactataaacccagttcaccccctactcccacaacaccaggctttcaggtgcaacatagcccaatgtgggacgaccccggatccctgcacaacttccatcagaactacgttgctacaacgcacatgatcgaacagcgtaagacacctgtgtcacgcttgtccttgttttcttttaaacagtctccccctggcacacccgtttcctcctgtcagatgaggtttgacggacctctgcacgtgcccatgaatcccgagccagccggaagtcatcacgttgtggacggacagaccttcgccgtgcccaaccctatccgaaaacccgcatcaatgggatttcccggactgcagatcgggcatgcgtcacagttactggatacacaggtgccatccccccctagtcggggatcccctagtaacgaaggactgtgcgccgtttgcggggacaacgccgcatgccagcactacggggtccgcacctgcgaaggatgtaaaggtttctttaagcgcaccgtgcaaaaaaacgccaaatatgtctgtctcgcaaacaaaaactgcccagtggataaaaggcgcagaaatcgatgccagtattgtaggtttcaaaagtgtctagccgtcggtatggtcaaagaagtcgtccggaccgactcccttaagggccgtaggggcaggcttccatccaagcccaagagcccccaagagccctcccccccatctccccctgtttccctcatttccgccctcgtcagggcccacgtggatagcaatcccgcaatgacctccctggactatagccgctttcaggcgaaccccgactaccagatgagcggagatgacacacaacacatccaacaattttacgacttgctgaccggatccatggaaatcattaggggctgggccgaaaagatccctgggtttgccgatctcccaaaggcggaccaggacctactattcgagagcgcttttctggagctttttgtgctgcgattggcctatcgctccaaccctgttgaaggaaagctgatcttctgcaatggtgtagtcctgcaccggctgcagtgcgtgagaggtttcggcgagtggatcgactctatcgtagagttctcctcaaacctccaaaatatgaacatcgatatcagcgccttctcatgcatcgctgctcttgcgatggtgaccgagagacacgggttgaaagaacctaagagagtggaggagctgcagaacaaaatcgttaattgcctgaaagaccacgtgactttcaacaacggtggcttgaataggcctaattacctgagcaaattattggggaagctgcctgaactccgtaccctatgcactcagggcctgcagcgaattttctatcttaagctggaggacttggttccccctcctgccatcatagacaaactgttcctggatacattgcccttttag

SEQ ID NO: 233176 - DNA, 738 bp, Artificial Sequence
  Description of Artificial Sequence: Synthetic coding sequence
gttgaagaggagggggatgttagtaacaggggtgtagagttacttcaactcgagccggacgaggaccaagtacgagcaaggattctgggatgtctccaagaacctacaaaatcccgccctgatcagcccgctgccttcgggttgttgtgtagaatggccgaccagacatttatctccatcgtagactgggcacggaggtgcatggtttttaaagagcttgaagtggcagatcaaatgacactactgcagaattgctggagtgaattgctagtgtttgaccatatctacagacaggtccagcacggaaaagaaggaagtattctcctcgtcaccggacaagaagtcgagctgactaccgtcgccacccaggcagggtccttgctacattccctggtcttgcgtgcacaagagctcgtcctccaactgctggccctccagttggatcgccaggagtttgtttgtctcaagttcatcatcctgttttctctcgacctgaagtttctcaacaatcatattctcgtgaaagacgctcaggagaaggcaaatgctgcgctccttgattatactctgtgccattatccccattgtggagacaagtttcaacagctgcttctgtgcttggttgaagtgcgcgcactgagtatgcaggcaaaggagtacctgtaccacaagcatctgggcaacgaaatgcccagaaacaaccttttgattgaaatgctgcaggctaagcagacatag

SEQ ID NO: 233177 - DNA, 1386 bp, Artificial Sequence
  Description of Artificial Sequence: Synthetic coding sequence
atggactactcttacgatgaggatcttgacgagctatgtccggtttgcggggacaaagtgtcgggctaccattacggactgttgacgtgcgagagttgcaaggggttcttcaagcgcacggtgcaaaataacaaacactacacctgtaccgaatctcagagctgtaaaattgataagacccagaggaagcgctgtccattttgtagattccagaagtgtttgacagtgggaatgcgccttgaagctgtccgcgcagaccgcatgcggggagggagaaacaagtttggacctatgtataagagggacagggcccttaaacagcaaaaaaaggcacagattcgggctaacgggtttaagcttgagactggacctcccatgggagtcccgcctcccccaccacctgccccagactacgtgctgcccccttccctgcatggtccagagccaaagggactggccgcaggaccgcctgcaggtcccttgggggatttcggagcccctgccctgcccatggctgttccaggcgctcatgggcctctggcagggtacctttatcccgcttttccgggtagagccatcaagtctgaatacccagaaccatatgcttctccccctcagcctggactaccttacggatatccagaacctttctccggcggtcctaacgtgcctgaacttattctgcagctgctgcagctcgagcccgacgaagaccaggtgagggcccgaatactgggatgtttgcaagaacctacaaagtccaggcctgaccaaccggcagcttttggcctgctatgtaggatggcagatcagacctttatcagtatcgtggattgggctaggaggtgcatggtgttcaaggaactcgaggttgctgaccaaatgacccttctccagaactgctggtccgagctcctggtctttgatcacatctacagacaggttcagcacggaaaggagggatctatcttgctcgtgactgggcaggaagttgaacttactacggttgccacccaggccggttctttgctgcacagcctcgttctgagagcgcaggagctcgtcctgcaacttctggcccttcagttggaccgacaagaattcgtttgtctgaaattcatcattctctttagtctcgacctgaagtttctgaataatcacatcttggtgaaagacgcacaagaaaaggccaacgccgcactgctcgactatacactctgccactatccacattgcggagataagttccagcagctcctcctgtgcttagtggaggtgagagcgctgtctatgcaagctaaggagtacctgtaccataaacatttgggcaatgaaatgcctaggaacaatttactcatcgaaatgctgcaggctaagcagacttag

SEQ ID NO: 233178 - DNA, 537 bp, Artificial Sequence
  Description of Artificial Sequence: Synthetic coding sequence
atggattattcctacgacgaagacttagatgaactttgtcccgtctgtggggataaggtatccggctaccactatggacttctcacctgtgaatcatgcaaaggattcttcaaacgcaccgtacaaaacaataagcactatacctgtaccgagagccagagctgcaagattgacaaaacacagagaaagaggtgtccattttgtcggttccaaaaatgcctgactgttggcatgaggctagaggccgttagagctgataggatgagaggcggtagaaataagtttggtcctatgtataaacgcgatcgcgctctcaaacagcagaagaaagcccagattagagccaacggcttcaaattggaaaccggcccacccatgggcgtgccgcctcctccgcctccagctccggattacgtacttcctcctagtctgcatggcccagagccgaagggattagcagccggacctcctgctggtccattgggggatttcggtgcccctgccttgcccatggcagtgccaggagctcatggttag

SEQ ID NO: 233179 - DNA, 972 bp, Artificial Sequence
  Description of Artificial Sequence: Synthetic coding sequence
gatctcgaggaactgtgccccgtctgcggcgataaggtcagcgggtatcactatggcctcctgacttgcgagagttgtaagggcttcttcaagagaaccgtgcagaacaacaagcggtatacgtgcatagaaaaccagaattgccagattgacaagactcagcgaaagaggtgcccctactgtcgattccagaaatgtttgagtgtcggcatgaagctggaggcagttcgggctgatcggatgcgtggaggtcggaacaagttcggtccaatgtataaacgggatagggcgctgaagcagcagaagaaggctctgataagggccaacgggctgaaacttgaggctatgagtcaagtcatccaggccatgcccagcgacctgactatctcaagcgccattcaaaacattcattccgcaagtaagggactgcccctaaaccacgccgcactgcctcccaccgattatgacagatctccgttcgtgacctctcccatttcgatgacaatgcctcctcacggtagtttgcagggataccagacttacggacattttccctcacgcgctatcaagtcagagtaccccgacccttacactagctcacccgagtccatcatgggctattcttacatggacagctatcaaacatcaagcccagcctccattcctcacctgatcctggagctcctgaaatgtgagcccgacgagccacaggtccaggcaaaaatcatggcgtacctccagcaggagcaggcaaaccgcagcaaacacgagaagctctctacattcgggctcatgtgtaagatggctgatcagaccctcttttcgattgtcgagtgggcacgtagttctatcttctttagagagctgaaggggctgaccctgagcccatcattggagtgcagcggaagctggctgatggctacatcaacctcatgcatacaggtgatacggttgccacagccacctgagtag

SEQ ID NO: 233180 - DNA, 1488 bp, Artificial Sequence
  Description of Artificial Sequence: Synthetic coding sequence
atgagcagcaactccgatacaggcgatctgcaggagtcgctgaagcacggcttaacacccattgtgagccagttcaagatggtgaattattcatacgacgaagatctcgaggaattgtgccctgtttgtggcgacaaggtgtctggataccattatgggcttttaacatgtgaaagctgcaaaggtttttttaaaaggacagtccaaaataacaagcggtacacgtgcatcgagaatcaaaattgccagatcgacaagacccaacgcaaaagatgtccctactgtcgctttcagaaatgcctgagcgtgggtatgaaattagaagccgttcgtgctgacaggatgcggggagggaggaacaaattcggacccatgtacaaaagggatagggccctgaaacagcagaaaaaggcccttataagggctaatgggctgaagctcgaggccatgagccaggtgattcaggctatgcccagcgaccttacaatatcatccgctattcaaaatatccattcagccagcaaaggcctgccgctgaaccatgcagccttgcccccaacggactacgacaggtccccatttgtgacgagcccgatttcaatgactatgccaccacacggctctctgcaaggctaccagacttacggacacttccccagcagagccattaagtccgagtatcccgatccttatacctcatccccagagtcgatcatgggctattcctatatggactcataccagacttctagccctgctagtatcccacatctcattctcgagctgctgaagtgcgagccagacgagccacaggtccaagcaaaaatcatggcatatctgcagcaggaacaagcgaaccgttctaagcacgaaaagctaagcacatttggcctgatgtgcaaaatggctgatcagaccctgttttccattgttgagtgggcacggtccagcatctttttccgggaactgaaagtcgacgaccaaatgaaactactgcagaactgttggtccgaacttctgattctggatcatatctaccgccaggtggtacatggaaaagagggttcaatctttcttgtcaccgggcaacaggtggactactctatcatcgcctcacaggccggagccaccctcaataatctcatgtctcatgctcaggaactggtcgccaagttgcgatccctacaatttgaccaaagggagttcgtgtgtctgaaattcctggttctgtttagcctagatgttaagaacctggaaaacttccagctggtggagggcgttcaggagcaggttaatgctgcgctcctcgactacactatgtgcaactatccccagcagaccgaaaagttcggacaactgttgctccgcctgccagaaatcagggctatatctatgcaagcagaagagtacctgtattataaacatctgaacggcgacgtgccctacaacaatcttttgatcgagatgctgcacgcaaagcgtgcctag

SEQ ID NO: 233181 - DNA, 1134 bp, Artificial Sequence
  Description of Artificial Sequence: Synthetic coding sequence
tgagacctcgaagaactttgccctgtgtgcggggacaaagtttctggctatcactatggtcttctcacatgcgagtcttgcaaaggcttcttcaagagaacggttcaaaataataagcgatacacatgtattgagaatcagaactgccaaatcgataaaacccaaagaaagcgttgcccatattgtcgattccagaaatgcctgtccgttgggatgaaattagaggctgtgagggcagaccggatgcggggagggaggaacaagtttgggccaatgtataagagagatcgcgctctgaagcagcagaagaaggcgttaatcagagctaatggcctcaaactggaagctatgtcacaggtgatacaggccatgcctagcgacctgactatttctagcgccattcagaacatccactcagctagcaaggggctacccctcaaccacgcagcacttcctcccactgattacgaccgctcccctttcgtgacatcacctattagcatgacgatgccccctcacggaagtctacaagggtatcagacatatggacactttccatcccgcgctatcaaaagtgagtatcccgatccttacaccagcagtcccgagagcataatgggctactcatatatggatagctatcagacaagctccccagctagtataccccatctaatcctggagttactcaagtgtgaaccagatgagcctcaagtgcaggcaaaaatcatggcctacctccagcaggagcaggccaaccggagtaaacacgagaagctgtcgacatttgggctcatgtgcaaaatggccgaccagaccctattttctattgtcgagtgggccaggtcctccatattttttagggagctgaaggggctcacacttagtccttctctggaatgcagcggtacaattctcgcccacggcaacttacatctgttacattcttccgatagtcctgcctccgcaagccgggttgctggtattacgggcgttcatcataacacgcacctgatttttgtgtttctggtggagatgggtttttgtcacgtgggccaggccggtctgaagacgccagatcttagagtgatctgcttgccgcgtcctccaaaagtgctggggctgtgggcatag

SEQ ID NO: 233182 - DNA, 1626 bp, Artificial Sequence
  Description of Artificial Sequence: Synthetic coding sequence
atgtccagcaacagcgacacaggcgacctgcaggagagtctaaagcatggcctgacacccatcggggcaggattgccagataggcatggatcacctataccagcacgcggacgccttgttatgctgccaaaagtggaaacagaagcgctgggactcgcgcgatctcatggagaacagggccagatgcctgagaatatgcaagtatcccagttcaaaatggttaattactcctacgacgaggacctggaagagctttgtcccgtgtgcggggacaaggtgagcggctatcactacggactcttaacttgtgaatcttgcaagggcttctttaagcgaacggtgcagaacaacaaaagatacacctgtatcgagaatcagaattgccaaattgacaagacccagagaaaaagatgcccatattgtcgctttcagaaatgcctctcagtggggatgaagctcgaggccgttcgagcggaccggatgagggggggacggaataaatttggccctatgtataagcgggatcgcgcactgaaacagcagaaaaaggcactgattagagccaatggactgaagctcgaggccatgtctcaggtgattcaggccatgccgtctgatctgacaataagttccgccatccagaacattcactcagcctccaaaggacttcccttgaaccacgctgccctgcctcctacagattatgatcggagcccgttcgtgacaagccccatttctatgacaatgccccctcatggttctctccaggggtatcagacctacggtcattttcctagcagagcgatcaagagcgaatatccagacccctacacatcgtcccccgaatccatcatggggtactcatacatggatagttaccagacgtcctcccctgcttcaattccccaccttatcctggaactgttgaaatgcgagccagacgagccgcaggtgcaggcgaaaataatggcttacctccagcaagagcaggccaatagatctaagcatgagaaacttagtacctttggattgatgtgtaaaatggccgatcagactctgttcagcattgtcgagtgggcacgcagttccattttttttagggagctgaaggtcgacgaccagatgaagctgctgcagaactgctggtcagagctgctcatcctggatcacatctaccgacaggtcgttcacgggaaagagggctctattttccttgtgacaggacaacaggtagattatagtatcattgctagtcaggctggcgctacgctcaacaacttgatgagccatgcccaggagctggtagccaagttgcgatctcttcaattcgatcagagggagttcgtgtgcttgaaattcctggtgctgtttagcttggacgtcaagaatcttgagaacttccagctcgtggaaggggtccaggaacaagtaaatgccgctctactggactacactatgtgcaattatccccagcagaccgagaagtttggccagttgctgctccgcctgccggagatccgggctatatcgatgcaggccgaagaatatctctattacaagcacttgaatggcgatgtaccctataataaccttctaatcgagatgctccacgccaaacgggcttag

SEQ ID NO: 233183 - DNA, 216 bp, Artificial Sequence
  Description of Artificial Sequence: Synthetic coding sequence
taatccctaaagcatgggctaaccccaatcgatcgtggtaattgtcggagcggatgcttctcctttgcagccactctgagacagcggtcactgctgacatcttgtgcgggactcccagaccggcatggaagccctatcccagccaggggtagattggtgatgctgcccaaagtggagaccgaggctctgggactcgcccgttcccatggagagtag

SEQ ID NO: 233184 - DNA, 66 bp, Artificial Sequence
  Description of Artificial Sequence: Synthetic coding sequence
atgtctagtaatagcgataccggcgacctacaagagtcactcaagcacgggttgactcccatttag

SEQ ID NO: 233185 - DNA, 249 bp, Artificial Sequence
  Description of Artificial Sequence: Synthetic coding sequence
atgtcttccaactccgatactggagacctgcaggaaagtcttaagcatgggttgacaccaattgataggggaaattgcaggtccgggtgcttcagcttcgcagccacactgagacagcggtccctccttacatcctgcgcaggcctaccggacaggcacggctcaccaatcccagcccgtggcagactcgtcatgcttccgaaggtggaaactgaggctctgggattagcacgcagccatggggagtag

SEQ ID NO: 233186 - DNA, 1410 bp, Artificial Sequence
  Description of Artificial Sequence: Synthetic coding sequence
atggtgaactattcatatgacgaggacctggaagagttgtgccctgtgtgcggagacaaagtgtccggctatcactacggcttgttgacatgtgaatcctgtaagggctttttcaaacggaccgtccaaaacaataaacggtacacgtgtattgagaaccagaattgtcaaatagataagacccaaaggaagcggtgtccttactgccgctttcaaaagtgtctctcggtggggatgaagcttgaagccgttcgtgcagaccgcatgagggggggaaggaataagttcgggccaatgtacaagcgggaccgcgctctcaaacagcagaaaaaggctctcatccgcgctaacggactgaaattggaagcaatgtcccaggtaattcaggccatgccaagcgatttgacaatttcaagcgcgattcagaacattcattccgcttccaagggtctccccctgaatcacgcggcactcccccctaccgactacgatagatccccctttgtgacaagtccaatctcaatgactatgccccctcatggaagcctgcagggttaccagacttatgggcacttcccaagtcgcgctattaaatcagagtatcctgacccttatactagctcacctgagagcataatgggatactcctacatggattcttatcagaccagcagcccagcgtccatcccacacctcatcctcgaactgttaaaatgcgagccagatgaaccgcaagtacaagcaaaaatcatggcctatctgcagcaggaacaggccaatcggagcaaacacgagaagcttagcacctttggcctcatgtgtaaaatggccgaccagaccctgttttctattgtcgagtgggcgcgaagttccatcttcttccgggagttaaaagtggatgatcaaatgaagctcctgcagaattgctggtccgagctcctgatcttggatcacatatatagacaagtggtccatgggaaggaaggttccatctttctcgtgactggccagcaggtcgactactccatcattgctagtcaggccggagcgacgctgaacaacctgatgtcgcacgcccaagaacttgtagcaaaactgcgatccctacagttcgaccagcgagagttcgtgtgcttgaagttcttagtgctgttttccctggatgtaaagaatctggagaactttcagctggtggagggagtgcaggaacaggttaatgcagcattattagactacaccatgtgcaactatcctcagcaaaccgaaaaatttgggcagcttttactcaggctccctgaaatccgcgcaatctcaatgcaagcagaggagtacctgtactacaagcatctgaacggggacgttccctacaacaacttactgatcgagatgctgcatgcgaagagggcttag

SEQ ID NO: 233187 - DNA, 681 bp, Artificial Sequence
  Description of Artificial Sequence: Synthetic coding sequence
atgttgctccgtctcgtctcaaacagctggccccaggttattctgccccctaggcctccaaaagtcctggggctccaggcccctagaagggccaggaaacgagctgagggcacagctagctcaaacgtcttctctatgttcgatcagtcacagatccaggaatttaaggaatcactcgctctgagtcctaggctggaacgtaacggcatgatctccgctcactgcaacttatgcctgaccggcagctccaatagtccagcctctgcctcccaggctttcaccataatggaccagaaccgggacggattcattgacaaggaggacctcagagatacttttgctgcacttggtagaattaatgtcaagaatgaggaactggaagctatggttaaggaagccccagggccaatcaacttcaccgttttcctgaccatgtttggcgagaagctcaaggggaccgaccccgaggagaccattctccatgcctttaaagtcttcgataccgaaggcaagggatttgttaaagccgatgtgataaaggaaaagcttatgactcaggccgacagattctcagaggaagaggtcaagcagatgtttgcagctttccccccagatgtgtgcggtaacctagactacaggaatctttgttatgtcattacccacggtgaggaaaaggactag

SEQ ID NO: 233188 - DNA, 1569 bp, Artificial Sequence
  Description of Artificial Sequence: Synthetic coding sequence
atggaagagcacggcgtcacccaaactgaacacatggcaacaatcgaagcccacgcagtcgcccagcaggtgcagcaggtacacgttgcgacttatactgagcattccatgctctcagctgacgaagatagccctagcagccctgaggatacttcctatgatgactccgacatactcaattccaccgctgccgacgaggtgacagctcaccttgctgcggcagggcctgttggcatggccgcagccgcagccgttgcgacgggaaagaaacgcaaaaggccccacgtcttcgagagtaacccttcaattcggaagcgccagcaaacccgcctgcttcggaaactccgcgctacgcttgacgagtacactacccgcgtcgggcaacaggccatcgtcctgtgcatttctccttccaagccaaatcccgtgtttaaagtgtttggcgctgcaccgctggaaaacgttgtacgaaaatataaatccatgatcttagaagatctagaatcagcccttgctgagcacgccccagcgccacaggaagtaaactccgagcttcctcctctcactatcgacggaattccagtgagtgtggataaaatgacccaggcccagctgcgggctttcatccccgaaatgctgaagtactctacaggcaggggaaaacccggatggggtaaggagtcatgtaaacctatctggtggccagaagacattccttgggcaaatgtacgatctgatgtgcgcaccgaagagcagaagcagcgagtatcctggactcaagccctgcggaccatagtgaagaattgttataagcagcacggtcgtgaggacttgctatacgcctttgaggaccaacagacacagacacaggcaacagccacacatagcatcgcacatctggtcccttcacagacggtcgtacaaactttctccaatcctgatggcacagtcagcctgatacaggtgggtacaggagcaacagtcgccacactggcagacgcgagtgagctgcctactactgtgaccgtcgcccaagttaattacagtgctgtcgctgacggagaggtggagcaaaactgggctactctgcagggaggagagatgactattcagactacacaagcctcagaggcgacgcaggccgtagccagcctggcggaggccgcagttgccgcttcacaagagatgcagcaaggggctaccgtgaccatggcactcaacagcgaagccgctgcccacgccgtggccactctggccgaagctactttacagggcggtggacagatcgtactgtccggcgagaccgcggcagccgtcggcgcactgacaggggtgcaggacgccaacgggctatttatggctgaccgggcagggaggaagtggatcctcaccgataaggccactggcctcgtgcagataccagtttccatgtatcaaacagtcgtcacatcactggcacagggcaatggaccagtccaggtggctatggccccagtgaccaccaggatcagtgattcggctgtgacaatggacggacaggccgtggaggtcgtaaccctcgagcagtag

SEQ ID NO: 233189 - DNA, 1314 bp, Artificial Sequence
  Description of Artificial Sequence: Synthetic coding sequence
atggaagagcacggcgtgacacagaccgagcatatggctaccatcgaagcacacgctgttgcacagcaggtgcagcaggttcatgtcgcaacatataccgagcactcaatgttatcggccgatgaggactctcccagctcacccgaggacacctcatatgacgatagtgacatcttgaactctacagctgctgatgaggttacggcccacctcgcagctgcaggccctgtagggatggccgcagccgctgctgtggccaccgggaaaaagaggaaacgacctcacgtgttcgagagcaatccttcgattaggaaacggcaacagacacgcttactcaggaagttgagagccacgctcgatgagtataccacccgagttggacagcaggccattgttctgtgtatctctccctccaagcccaaccctgtatttaaggtcttcggcgctgcccctctggaaaatgtggtaagaaagtacaagtccatgatccttgaagacctggaatcggcgctggccgagcacgcacctgcccctcaggaggtcaactccgagctgccccctctcactattgacggaatacccgtgtcggttgataaaatgacccaagcccagcttcgcgcattcattccagaaatgctgaagtactccaccggtcggggtaagccaggttgggggaaggagagctgcaagcctatctggtggcctgaagatatcccttgggcaaacgtacggtctgatgttcgcaccgaagaacagaagcagcgcgtcggtaccggtgcaaccgtggccactctggccgatgcctctgagttgcccacgacagtgaccgtggcgcaggtaaattattccgccgtcgccgatggggaggtggagcaaaactgggcgacgctgcagggaggggaaatgacaattcaaaccactcaggcaagcgaggctacgcaggccgtggcctccctcgccgaggccgctgtggctgcctctcaagagatgcaacagggagcaactgtgaccatggccctcaatagcgaggcagccgcacacgcagtggctacactggccgaagctacactccagggtggcggacagatagtgcttagcggggagaccgccgctgctgtgggcgctctgactggcgtgcaggatgctaacgggttggttcagattcctgtctctatgtaccaaactgtggtaactagcctggctcaggggaatgggcctgtgcaagtggcgatggccccagttacaaccaggattagtgactccgcagtaactatggatggtcaagccgtcgaagttgtcacattggaacagtag

SEQ ID NO: 233190 - DNA, 1512 bp, Artificial Sequence
  Description of Artificial Sequence: Synthetic coding sequence
atggaagaacatggggtaacccagaccgagcacatggcaaccattgaggcacatgcggtagctcagcaggtgcagcaagttcatgtcgccacttacaccgagcactctatgctctccgctgatgaggacagcccgagctcccccgaggacaccagctatgacgactccgacatcctgaacagcaccgccgcagacgaggtgacagctcacctggccgctgccggacccgttggcatggctgccgcagccgcagtggctacaggcaagaaaaggaaaaggccgcatgtgtttgagagcaaccccagcatcaggaaaaggcagcaaacacgcctcttgcgtaagttacgggcaaccctagatgagtacacaacccgggttggccagcaggcaatcgttctctgcatttcgccctccaaaccaaatcctgtgtttaaggtgtttggggctgctccactggagaatgtagtgcgaaagtataaatccatgattctcgaagacttggaaagcgcactggcagaacacgctcccgcacctcaagaggtgaatagcgaattgcctcccctcaccatagatggaattccggttagcgtcgataagatgacccaagcccagctgagggcatttatccccgagatgctcaaatactccactggacggggaaagcctggatggggtaaggagagctgcaaacctatctggtggccagaggacatcccctgggcaaatgtgcgctctgacgtgcggacggaggaacaaaagcagcgggtgagttggacccaggccctgcgcactatagtgaagaactgctacaagcagcacgggagggaggatctgctgtatgcatttgaggatcagcagacgcagacccaagctacggctacccactctatcgcccacttggtgccatctcagaccgtcgtgcagactttctccaaccctgacgggacagtgtctctgatacaggtgggtaccggcgcaaccgtggccacattggccgacgcaagcgagctacctaccacagtcacagtcgctcaggtgaattatagcgccgtggccgacggcgaggtggagcaaaactgggccacactccagggtggggaaatgaccatacagaccacccaggcctccgaagccacccaggccgtggcctccttagctgaagctgcagttgccgcttcacaggagatgcagcagggtgctacagtaaccatggccctaaattctgaggccgcagcccacgcggtcgccactctggccgaagctactctgcagggcggtggccagatcgtcctgtctggcgagacagccgcagctgtgggggctctgacaggcgtgcaagatgcaaacgggttagttcagatccctgtatccatgtaccagaccgtcgttacatcactggcccaagggaatggcccagttcaggtcgctatggcaccagtgacgactaggatcagtgattctgctgttaccatggatggccaggccgttgaggtggtcaccctggagcagtag

SEQ ID NO: 233191 - DNA, 1569 bp, Artificial Sequence
  Description of Artificial Sequence: Synthetic coding sequence
atggaagagcatggggtcactcagacagaacacatggccaccattgaggctcatgctgtggcccaacaggtgcagcaggtccatgtggcgacctacacagagcactctatgctgagcgcagatgaggacagcccatcttctccagaagacacctcctatgatgatagcgatatactaaactccacggctgctgacgaagtgactgctcatctggccgctgctggtcctgtgggcatggccgcagcggctgctgtagccacgggtaaaaagcgaaagcgccctcacgtgtttgagtcaaatccatccatacgcaagcggcaacagaccaggcttttacgcaagttacgcgctacgttagacgagtataccacgagagtggggcagcaggccattgtcctctgcatcagtccttcgaagcccaaccccgtgttcaaggtgtttggtgcagcacccctggagaatgtggttcgaaagtataagtctatgattctcgaagacctggaaagtgctctcgcagagcacgccccagcaccccaagaggtgaattcggaactaccccctctgacaatagatggaataccggtgtccgtggataagatgacccaggcccaactgcgtgcttttattcctgagatgcttaagtactccaccgggagaggcaagcctgggtggggcaaagagagctgtaaacccatttggtggccagaggatatcccctgggcgaatgtgcgtagcgacgtgcgcacagaggagcagaagcagagagtgagttggacccaggcactgcgaacgattgtcaagaattgctacaagcagcatggcagggaagacctcctctacgcattcgaagatcagcaaacccagacccaggcgaccgctacacactccattgcccatttagtcccgtcacagaccgtggtgcaaacattctccaaccctgatggaacagtgtccctcattcaggtcggaacgggtgcaaccgtggccactttggctgatgcttctgagctgccaaccactgtgacggttgcccaggtgaactattcggcagtggcggacggagaagtggagcagaattgggctacgctccagggcggtgagatgactatccaaacgacccaggcatcagaggccacacaggctgtggcatccttagccgaagccgctgtggccgcttcccaggagatgcaacagggcgctaccgtgactatggccttgaattccgaggctgcagcgcacgctgttgccactctagctgaggctactctgcaaggaggcggtcagattgttctcagcggagaaaccgctgccgctgtcggtgcacttactggcgtgcaggatgctaatggtttattcatggcagatagggctgggagaaagtggatactgactgacaaggctacaggactggtccagatcccggtcagcatgtatcagacagtggtcacttccctggctcaaggcaatggcccagttcaggttgccatggcgcctgtgactacgcggatcagcgatagcgctgtcacgatggatggacaggcagtagaggtagtcacgctggagcagtag

SEQ ID NO: 233192 - DNA, 1512 bp, Artificial Sequence
  Description of Artificial Sequence: Synthetic coding sequence
atggaggagcacggcgtaactcagactgagcacatggctacaattgaagcgcatgccgtggcacaacaggtgcagcaggtgcatgtggcaacgtataccgagcattcgatgctgtcggcagacgaagacagtcccagttcaccagaggatacttcgtacgacgatagcgatattcttaattctacagctgccgacgaggttactgctcatctggctgcagccggacccgtgggcatggccgctgctgcggcagtggctaccggcaagaagagaaagcgtcctcatgtgtttgaatctaatccttcaattcggaaacgccagcagacccggttacttcggaagctgcgggctacattggacgagtacacgacaagggtgggccaacaagcgatagttctgtgcatatcccctagcaaacctaacccagtcttcaaggtgtttggagccgctcccctggaaaacgtggtcaggaaatacaagtctatgattcttgaagacctggaatcggctctggcggaacatgcgccagcccctcaggaagttaactcggagctcccaccgctgactattgatggaatccctgtcagcgtggacaaaatgacacaagcgcaattaagagcgttcatccccgagatgctcaagtattcaacgggtcgtggcaagccaggctggggtaaggagagctgtaaaccaatctggtggcctgaagacattccctgggcaaacgtgaggtcagacgtaagaaccgaggagcagaagcaacgcgtgtcctggacccaagcactcagaaccattgtgaagaactgttacaagcaacacggccgagaggatttgctgtatgcgtttgaggaccaacagacacagacccaggctaccgcaacccattctattgcacacctcgttccatcccagacggtggtgcagacattttcgaaccccgatggcaccgtaagcctgattcaggtgggcacgggtgctactgtagccaccctggccgatgctagtgagctgcctacgacagtgactgtggcccaagtgaattactcggccgttgccgatggcgaggtggagcagaactgggccactctgcagggtggggaaatgacgatccaaactactcaggcatccgaggcaacacaagcagtagcctctttggctgaggctgccgtcgcggcttcccaggaaatgcagcagggagctactgtaaccatggccctcaatagtgaggctgctgctcacgccgtggccactctggctgaggccaccctccagggcggtgggcaaatcgttctgagcggcgagactgcagccgcagtgggcgctttgaccggcgttcaggatgcaaatggtctagtacagatcccggttagtatgtaccaaactgtagtgacaagcctcgcccaggggaatggccctgttcaagttgccatggcacccgtaacaacccgaatcagcgattccgcggtgacaatggacgggcaggctgttgaagtggtgacactggagcagtag

SEQ ID NO: 233193 - DNA, 633 bp, Artificial Sequence
  Description of Artificial Sequence: Synthetic coding sequence
atggaggaacatggcgtcacccagacggagcatatggcaactattgaggcccacgctgtcgctcagcaggtacagcaagtgcatgtggctacctacaccgaacactcaatgttgagcgccgatgaagactcaccatcctcacccgaagatacatcatatgacgactccgacattctcaactcaacggctgccgatgaggtgaccgcgcatcttgcagcagcagggccagtgggtatggccgcagccgcagctgtggccaccggcaaaaagcggaaaaggccccacgtgttcgagtccaatcctagcatccggaagagacagcagacacgcctgctgagaaagctgcgtgcaactcttgacgagtacacgactcgtgtagggcagcaagcaattgttctgtgtatatctccgagtaaacctaatcccgtgtttaaggtgttcggggcagccccacttgaaaacgtggttcggaagtacaagagtatgatccttgaggatcttgaatctgccctggcagaacatgcccctgctcctcaggaagtcaactctgaactcccgccattgaccatcgacgggatcccggtgagtgtagacaagatgacccaggcccagctgcgcgcatttataccctag

SEQ ID NO: 233194 - DNA, 1029 bp, Artificial Sequence
  Description of Artificial Sequence: Synthetic coding sequence
atgattctggaagatctagagagcgccttagctgaacacgctccagctcctcaggaggtgaattcggagctccccccattgacaatcgatgggatccctgtgagcgttgacaagatgactcaggctcaactgcgcgcttttatccccgaaatgctgaagtattccaccgggagaggcaagcccggatggggcaaagagtcctgcaagccaatctggtggccagaagacatcccctgggccaacgtgcgcagtgacgtgcggaccgaggaacaaaaacagcgcgtatcttggacccaggctctgagaaccattgttaagaactgctacaagcaacatggcagagaagaccttctgtacgctttcgaggaccagcagacacagacacaggctacagccacacactctattgcacacttggtcccctcacagacagtggtgcaaaccttctccaatcccgatgggactgtcagccttattcaggtgggcaccggcgctaccgtggccaccctggccgacgcctccgagctgcccacaacagtgaccgtggcacaggttaattactcagcagtcgcagatggcgaggtggagcagaactgggccacgctgcagggaggagaaatgactatacagaccacccaagcttcagaggcgacgcaggcggttgcaagcttagccgaagccgctgtggcagcctctcaggaaatgcagcagggcgctaccgtcactatggcactgaacagtgaggctgctgcccatgctgtcgccacactggccgaagcaaccctgcaagggggagggcagattgtactgtccggcgaaactgccgctgcggtgggtgcacttaccggggtgcaggacgccaatggcttagtgcaaattccagtttccatgtaccagactgtcgtgacctccctggcgcagggcaacggaccggtgcaggtggcaatggctccagtgaccactaggattagcgacagcgccgtgacgatggatgggcaggccgtggaagtggtcacactggagcagtag

SEQ ID NO: 233195 - DNA, 1860 bp, Artificial Sequence
  Description of Artificial Sequence: Synthetic coding sequence
atggccgacgagggtaagtcatacagtgagcacgatgatgagcgggtcaacttcccacagagaaaaaaaaaaggacggggaccgttcaggtggaagtacggggaaggcaacaggcggtccgggagaggcggttctggcataagatcctctcggcttgaggaggacgacggcgacgtcgccatgagtgatgctcaagacggaccgcgtgtacggtataatccctatacgacacgccctaacagacgtggtgatacatggcacgacagagatcgtattcacgtaactgtgcgacgagacagagccccacctgaacgcggaggggcaggtacgtctcaagacggcacaagtaagaactggtttaagatcacaattccatatgggaggaagtatgacaaagcctggctgctctcgatgattcagagtaagtgctcggttcctttcacgcctattgagttccactatgaaaacacaagagcccaatttttcgttgaagatgcctcgacagcctcagccctgaaggcagtcaactataagatcctcgacagggaaaacagacgcatatctataatcataaacagttcagcccctcctcatacaatcttgaacgaacttaaaccagagcaggtagagcagttaaaactgattatgtctaaacgctatgacggctcacagcaggccctcgatctgaagggcctgcggagcgaccccgatctggttgcacaaaatatagacgtggtcctgaaccgtcggagctgcatggcagctactttgagaatcattgaagaaaacatacccgagctgctctctctgaatcttagcaataaccgactataccgcctggatgacatgagttcgattgtgcagaaggctcccaatctgaaaattctgaacctgtcagggaacgagcttaaatctgagcgtgagctggacaaaatcaaagggttgaagctcgaggaactttggttagatggcaattccctgtgtgacacctttcgggaccagagtacctatatctcggccatcagagaacggttccccaagttgctgaggctcgacggccacgagcttccaccccctatcgcattcgacgtcgaagcccctacaaccctccctccttgtaagggtagttatttcggaacagagaacctgaaatcattggtgttgcattttctccaacagtattatgccatctacgactctggggaccgccagggactgctcgacgcttaccatgacggggcatgttgctcattgtctatcccattcatccctcagaaccccgctaggtcatctctggcagagtacttcaaagactcacgcaacgttaagaaactgaaagatcccaccctgaggttccgtctgttgaagcatacacggctgaatgtagtggctttcttgaacgagctgccgaaaacccagcatgatgttaacagtttcgtggtagatattagcgcacagacttccaccctattatgtttcagcgtgaacggcgtctttaaagaggtggacggcaaatcaagggatagcttgcgagcattcacgcgcacatttatcgccgtacccgcttcaaattccgggctgtgcattgtgaatgacgagctttttgtcaggaacgcctccagcgaagagatacagcgcgcttttgccatgcctgcccctacacctagctcgtcccctgtccccacgctgtctccggagcagcaggagatgctccaagccttctctacccagtccggaatgaatttggaatggtcccagaaatgcttgcaggataataattgggactatacaagatcagcccaagcattcactcacctgaaagcgaagggagagatccccgaagtagccttcatgaagtag

SEQ ID NO: 233196 - DNA, 1071 bp, Artificial Sequence
  Description of Artificial Sequence: Synthetic coding sequence
atggccgacgagggaaaaagctactctgagcacgatgacgaacgagtcaatttcccgcaaaggaagaagaaagggaggggcccatttcggtggaagtatggcgagggtaatcgtcggagtgggaggggcggaagcgggatccggtcctcccggctggaggaagacgacggggacgtggccatgtctgacgctcaggacggtccaagggttaggtacaatccctacaccacaagacctaacagacgcggtgacacctggcacgatagggacagaatccatgtcactgttaggcgggatcgggctcccccagagaggggcggagcaggcacctcccaagatggcacgtcaaagaattggttcaagattacaattccctatgggaggaaatatgataaagcttggctcctttcgatgatacagagcaagtgctctgtgccttttaccccgatagagtttcactacgagaatacaagggctcagttcttcgtggaagacgcgtcaactgcaagtgccctgaaagctgtaaactataaaatactggatcgtgagaaccgcaggatttccatcatcatcaattcttccgccccaccacataccattctcaacgaattgaagccagagcaagtggagcagctgaagctgatcatgtctaagcgttatgatgggtcacagcaggcactggaccttaagggcttgcgatcagatccagacctcgtagctcaaaatattgacgtcgttttgaacagacgctcttgtatggcagctacactgcgcattattgaggagaatattcccgaactgcttagtctcaatctctcaaataaccgcctgtatagactggatgatatgtctagtatcgttcaaaaagccccaaacctaaaaattttgaacctctctggcaacgaactgaaatccgaacgcgagctcgacaagattaaaggcctcaagctggaagagctgtggcttgacgggaattctctttgcgataccttccgcgatcaatctacatatatacgctccgtggtggcctgcgtctccccgcctggcgacctgcacccgctggggggatag

SEQ ID NO: 233197 - DNA, 1071 bp, Artificial Sequence
  Description of Artificial Sequence: Synthetic coding sequence
atggcagatgagggcaaaagctacagtgaacacgatgatgagcgagttaattttcctcaacgcaaaaagaagggcaggggccctttccgttggaaatacggagagggcaacagacgaagcggacgcggaggctctgggatccggtcatctaggcttgaggaagacgacggagacgttgctatgtcagacgcacaggatggacccagggtaaggtacaacccatatactaccagacctaataggcgcggtgacacatggcacgatagagatagaatccacgttactgtgcggagggatagagcgccaccagagagaggaggtgctggcaccagtcaggacggaacctctaaaaattggtttaagatcactattccttacgggagaaagtatgataaagcctggctattatctatgatacagtctaagtgtagcgtgccattcactcctatagagttccactatgagaataccagggcgcaattttttgtggaagatgcatccacggcatccgccctgaaagccgtgaattataagattctcgaccgtgaaaatcggaggataagcatcatcatcaactctagcgcgcctccccatacaatcctcaatgaactcaaacccgaacaggtggagcagctcaaactgatcatgagtaaacgctacgacggatcgcagcaggctctcgatttaaaaggcttgaggagcgatcctgacctcgtcgctcaaaatatcgacgttgttctcaaccggaggtcttgcatggcagctaccctgcgcataatcgaggagaatatccctgaactcctcagcttaaatttatctaataacaggttgtatcggctggacgacatgagttccattgttcaaaaggcccctaacctgaagatcctgaatttgtccgggaatgagctaaaaagtgagcgagaacttgataaaatcaaaggactcaagcttgaggagctctggctcgatggaaacagtctttgcgataccttccgggatcagtctacgtatatcaggtctgtcgtggcgtgtgtctcccctccgggtgatctgcacccgctcgggggttag

SEQ ID NO: 233198 - DNA, 1860 bp, Artificial Sequence
  Description of Artificial Sequence: Synthetic coding sequence
atggccgatgaaggaaaatcctacagcgagcacgatgacgagcgtgtcaacttcccccagagaaaaaagaaaggcagaggacccttcagatggaagtacggagagggcaaccggaggtcagggaggggcggatcagggatccgcagttccaggctcgaggaggatgatggtgacgtggctatgtcagatgcacaggatgggccacgtgtgcgttataatccttacacaacacgcccaaaccggaggggcgatacatggcacgatcgggatagaattcacgtcaccgtaaggcgggatagagccccaccggagcgcggaggagcgggtacatcgcaggacggcacatcaaagaattggttcaagataactatcccatacggcaggaagtacgataaggcttggctgctcagcatgatccagtcaaaatgcagtgttcctttcaccccaatcgagtttcattacgagaacaccagagcgcagttttttgtcgaagatgcaagcactgcatcagcactgaaggcagtcaactacaagatcttggatagggaaaataggcggatatccattattattaatagtagtgcccctccccataccatcctgaacgagctgaagcctgagcaggttgaacagcttaaactgattatgagcaagcgatatgatggttcgcagcaggctctggatctaaaaggcttgaggagcgatccagatctggtggcacagaacatcgacgttgtactgaacagaaggagctgcatggctgcgactctcagaataatagaagagaacatcccagagcttctgagcttaaacctaagcaataaccgtctgtatagactggatgatatgtcctcaattgtgcagaaagcaccaaatctcaagatccttaacctctctgggaatgagctcaagtctgagagagaactggacaaaatcaaggggcttaagctggaggagctgtggctggatgggaacagcctgtgcgacaccttccgagaccagtctacatacatttctgccattcgagagcgattcccgaaactgctgagattggatggacatgaacttccaccccctatcgcgtttgatgtagaagctcctacaaccctccccccttgcaagggctcttattttggcaccgagaacttgaagtctctagtgctgcatttcctgcaacaatattatgccatctacgatagtggggaccgtcagggcttactggacgcataccacgatggagcgtgctgttcacttagcatcccttttataccccagaatccagcccgatcctcacttgctgagtattttaaggattcaaggaatgtaaaaaaactgaaggacccgaccctgcgattcaggctgttaaagcacacgcgcttaaatgtggttgcgtttttaaacgagcttcctaaaacgcagcacgacgttaatagctttgtggtcgacatctctgcccaaacttccacgttgctgtgcttttcagtgaacggcgtctttaaggaagtagacggcaagtccagagattcccttcgggctttcacccgcacctttatagccgtccccgcttctaacagcggactctgtatagtgaacgatgagctgttcgtaagaaatgcaagcagcgaggagatacagcgggcattcgccatgcctgccccaacaccaagtagtagtcccgtgcccaccctttcccccgagcagcaggagatgctccaggccttctctacacaatccgggatgaatcttgaatggagtcagaaatgcctgcaggacaacaattgggactacacacgttctgcccaggcctttacacatctaaaggctaagggcgagatccctgaggtcgccttcatgaaatag

SEQ ID NO: 233199 - DNA, 1881 bp, Artificial Sequence
  Description of Artificial Sequence: Synthetic coding sequence
atgtgtagcactcttaaaaaatgcgggacctatcgcaccgaggtagctgagtgtcacgatcatggttcgacgtttcagggccgaaaaaaaggcggaagctctttccgcgacaacttcgacaagaggtcttgtcattacgagcacggcggatacgagcggccaccatcccactgtcaggagaatgatggctcagtcgagatgagggacgtgcacaaagatcagcagctcaggcacaccccctactctatcagatgcgaacgcaggatgaaatggcactcggaggacgaaataagaattactacctggcggaatcggaaacctcctgagcggaagatgtcccagaacactcaggatggatatactagaaactggtttaaggtgactattccctacgggattaaatatgacaaggcatggctgatgaactctattcagagtcattgctccgaccgcttcacacccgtggacttccactacgtgaggaacagagcgtgcttcttcgtgcaggacgcttcggccgctagcgccctcaaagacgtgtcgtataagatctacgacgacgagaatcagaagatctgtattttcgtgaaccacagcacggcaccctatagcgttaaaaataaactcaagccaggacagatggagatgctgaagctcactatgaacaagagatacaacgtatcccaacaggccctggaccttcagaatctgcgctttgatccagacctaatgggaagagatattgacataattctcaaccgtcgaaattgtatggctgccactctgaagatcatagagcgtaattttcccgaactgctgtcccttaacctgtgtaataacaaactgtaccagctggacgggctctccgatataacagagaaagcccctaaagtaaagacattgaacctgagcaagaataagttggagtccgcttgggagctcggcaaagttaaagggttgaagttagaagaattgtggctggaaggcaatcccttgtgctctaccttcagtgatcagagtgcatacgtatcagcaatcagggactgctttccaaaattgcttcgactggacggaagagagctcagcgctccagttatcgtggatatcgattcaagcgaaacaatgaagccctgcaaggagaattttacaggcagtgaaacgctgaaacaccttgtcctgcagtttctgcaacaatactacagcatttacgatagcggagatcgccagggcctgcttggagcctaccacgacgaggcctgcttctcactcgcgatcccattcgacccgaaggactcggcaccgtcctccctgtgtaaatactttgaggatagccgaaacatgaagaccttgaaagatccatacctgaagggggagctcctacggcgaactaaacgggacatcgtggattccctcagtgccctgcctaaaactcagcatgacctgtcatctattctggtggacgtttggtgccagacagagcgcatgctgtgtttctccgtgaacggtgtgttcaaggaagtcgaaggacagagccagggttcagtgttggcattcacccgcaccttcatcgctacccctgggagttcctcttcactgtgcattgtgaatgatgagcttttcgtgcgagacgcttctccccaggaaacccagagcgcttttagcattcccgtgagcacactgtcgtcctccagtgagccaagtctcagtcaggagcagcaggaaatggtccaggccttttccgcacagtcaggcatgaaactagagtggtcccaaaaatgtcttcaagataatgagtggaactataccagggccggtcaagccttcacaatgctgcagaccgaaggaaagatacctgcagaggctttcaagcagatatcctag

SEQ ID NO: 233200 - DNA, 1881 bp, Artificial Sequence
  Description of Artificial Sequence: Synthetic coding sequence
atgtgctccacgctgaaaaaatgtggtacctataggaccgaagtggcagagtgccacgatcacggaagcaccttccagggcaggaaaaagggaggatcctctttccgcgataattttgacaaaaggagttgtcactatgaacatggagggtacgagcgcccaccgagccactgtcaggagaatgacggatccgtggagatgcgtgacgtgcataaagatcagcaacttcggcatacaccttacagcatcaggtgtgagcgaaggatgaagtggcattccgaagacgaaatccgtattactacgtggcggaatcggaaaccgccagaacggaaaatgagccagaatacccaagacggctacacgagaaactggttcaaggtcactataccatatgggataaagtacgataaagcctggctgatgaatagtatccagtctcactgttcagaccgattcacccctgttgatttccattacgtccgaaaccgagcatgcttttttgtccaggacgcaagtgctgctagcgcacttaaagacgttagctataaaatttacgatgacgagaaccagaagatctgcatttttgtgaaccactccaccgctccctactctgtcaagaacaagctgaaaccaggccaaatggaaatgttgaaactcacgatgaacaagagatataatgtctcacaacaggcgttagatttacagaatctgaggtttgacccagatttgatgggacgggatattgacatcattctcaaccgacgcaactgcatggctgctacacttaagatcatcgagcgcaactttcctgagctcctatcattgaacctgtgcaataataaactctatcagttagatgggctgtcggatattacggaaaaggcacctaaggtcaagactttgaacctgagcaaaaataagctcgagtccgcctgggagcttgggaaggttaaaggactgaaactggaagagttgtggttggaaggaaatcctctgtgcagcacattcagcgatcagtccgcttacgttagcgccatccgagattgttttcctaagcttctgagactggacggcagggagctctccgcacctgtcattgtggacatcgatagctccgagactatgaagccctgtaaggaaaactttactggttcagagaccttaaaacacctcgtgctacagttcctgcagcagtactacagcatttacgacagcggcgacaggcagggcctccttggcgcttatcacgacgaagcttgtttctcactggcgattcctttcgaccccaaagacagcgccccaagcagtttgtgcaagtattttgaggacagtcggaatatgaagacacttaaagacccctatttaaaaggtgaattgctgagaagaactaaacgggatattgtggattcactttcggccctcccgaaaactcagcacgacttgtcatcaatactcgtggacgtctggtgccaaacagagaggatgctgtgcttttccgtgaacggagtgtttaaggaggtcgaggggcaatctcagggaagtgtgttagcctttactaggacctttatcgccacgcctggaagctcgagcagtctctgcattgtcaatgacgagttgttcgtacgggatgcatccccccaagagacacagagcgccttcagcatccccgtgagtaccctctccagttccagcgaaccaagtttgtctcaggaacagcaggagatggtgcaggcattttctgcacagtccgggatgaaattagaatggtcccagaagtgtctacaggataatgagtggaattatacaagggctggccaggcattcacaatgcttcagacggaggggaagattccagcagaggccttcaaacagatatcctag

SEQ ID NO: 233201 - DNA, 1881 bp, Artificial Sequence
  Description of Artificial Sequence: Synthetic coding sequence
atgtgcagcaccctaaaaaaatgtggcacctaccggacagaagtcgccgagtgccacgaccacgggagcactttccagggaaggaagaagggcggtagcagctttagagacaatttcgacaaacgcagctgtcattacgagcacggcggatacgaaagacccccttctcactgtcaggagaatgatggatctgtagagatgcgggatgtgcataaggaccaacagctccgacacaccccttacagcatccgctgcgaacgaagaatgaaatggcacagtgaggatgaaattcgcatcactacatggaggaacaggaaaccacccgagaggaaaatgtctcaaaacacgcaggatggctatacccggaattggttcaaggtcacaataccctatggaatcaaatatgacaaggcatggctcatgaactctatccagagtcattgttccgacagattcacgcccgtagacttccattacgtgagaaatagggcgtgcttctttgtgcaggatgccagcgctgctagcgcgctgaaagacgtcagttacaaaatctatgatgatgaaaatcaaaagatctgtatctttgtgaatcattctacagccccatacagtgtcaagaacaaactgaagcccggtcagatggagatgttgaaacttacgatgaacaaaagatataacgtcagccagcaggccctggacctccaaaatctgaggttcgatccagatctgatgggcagggatattgatataatcctgaataggagaaattgtatggccgctacattaaagattatcgagagaaacttccctgaactcctcagcctaaatctctgcaataataagctttaccaactcgacggcttgagtgacatcaccgagaaggctccaaaagtaaagactcttaacctttcaaaaaacaaactcgaatccgcttgggagctgggaaaggtgaagggactcaaactggaggagctgtggttggagggcaaccccttgtgctccactttttcagatcagagcgcctacgtgtccgccatcagggattgctttcccaaactgttacgacttgacggaagggaactatcagctcctgttattgtggacatagatagctccgagaccatgaagccctgtaaggagaatttcacagggtcagaaactctcaagcacctcgtactgcagttcctacagcagtattactccatctacgattccggcgataggcagggactactcggcgcatatcacgacgaggcttgcttctcattggccattccttttgaccctaaggatagtgctccaagcagtctctgtaagtacttcgaggactcgcgaaatatgaagaccctaaaagatccttacttgaagggtgagctgttaagacgtacaaagcgagacatcgttgactctctgtctgcactgcccaagacccagcacgacttgtcttccatcctcgtggatgtatggtgtcagacagagcggatgctgtgcttctcagttaatggcgtatttaaggaggtagagggccagtctcaggggtctgtcttggcgttcacacgaacctttattgccacccccggtagttcttcgtcgctctgcatcgtcaacgatgaactgttcgtccgcgacgcaagcccccaggagactcagtccgcctttagcatacccgtgtccacactttccagctccagcgaaccatcactgagccaggaacagcaagagatggtgcaggcatttagtgcacagtccggcatgaagctcgagtggtcacagaaatgcctgcaggacaatgagtggaattatacaagggccggacaggcctttaccatgctccagaccgaaggaaagatacctgctgaagcattcaagcagatatcctag

SEQ ID NO: 233202 - DNA, 1230 bp, Artificial Sequence
  Description of Artificial Sequence: Synthetic coding sequence
atgaaatggcattccgaggatgagattcgcattactacgtggaggaatcgaaaaccaccagagaggaagatgagtcagaacactcaagacggatacacccgtaactggtttaaggtcaccatcccctacggcatcaagtacgacaaagcttggctcatgaacagtattcaatcacactgttccgaccggtttacacctgtggattttcactatgtcagaaacagagcgtgctttttcgtgcaagacgcgtccgccgcttctgctttaaaagatgtgtcctataagatatatgacgacgagaaccaaaagatttgtattttcgttaaccactccacggctccctactccgtgaaaaataaactcaagcccggtcagatggagatgctgaagctgacgatgaataagaggtataatgtcagtcagcaggctttggacttgcaaaatctgcgtttcgatccagatttgatgggcagagatatcgacatcatccttaaccggcgaaattgtatggctgctacacttaagattattgaaagaaactttccagaactactgtcgctcaatctgtgcaacaataagttgtaccagctggacgggctgtctgacatcactgaaaaagcccctaaggtaaaaacactgaacctctctaagaacaaactggagtccgcctgggaactgggtaaggtgaagggcctgaaattggaggagctctggttggaggggaaccccctgtgtagcacatttagcgatcaaagcgcctatgtctccgcaattagagattgttttcctaaactcctgagacttgacggcagagaattgtcagcaccagtgattgtcgacattgattctagcgagactatgaaaccctgcaaggagaattttacgggttctgagacgctgaagcatctggtgctccagttcttgcagcaatattacagtatttatgactcaggtgaccgtcaggggctgctcggagcctaccacgacgaggcctgtttctcactggccattccttttgaccccaaggactcagcaccttcctccctctgcaaatatttcgaggattctcgaaacatgaaaacgctcaaagatccgtatctcaagggggagctgctgagacgcaccaaacgcgatatcgttgattctttatccgccttgccaaagacccagcatgatctcagctctattttggtggacgtctggtgccagactgttcccagtggacaatag

SEQ ID NO: 233203 - DNA, 1881 bp, Artificial Sequence
  Description of Artificial Sequence: Synthetic coding sequence
atgtgctccacgcttaagaagtgcggaacatacagaacagaagtggctgaatgtcacgatcatggcagcacctttcaaggaaggaagaagggtggcagcagctttcgcgataacttcgacaaaaggagctgccactatgagcacggtggctatgagcgcccacctagccactgtcaagaaaatgatgggtctgtcgaaatgcgcgacgttcataaggatcagcagctgcggcacacaccttactctatacggtgtgaaagacgaatgaaatggcattcagaggatgaaatcaggataacaacatggaggaaccgcaagcccccagaaagaaagatgtctcagaatacacaggacggatatacacgtaactggttcaaggtcaccataccttacggcatcaagtatgacaaggcttggctcatgaattctatccagtctcattgttccgatcggttcactcccgtggatttccattacgttagaaacagagcgtgcttctttgtccaggacgcatccgccgctagcgccctgaaggatgtgagctataaaatttatgatgatgaaaaccagaagatttgtatctttgtgaaccatagtaccgctccttactcagtgaagaataagttgaaaccgggacagatggagatgctgaaacttaccatgaataagagatataacgtgtcccaacaggctctcgacctccaaaacctccggttcgatccggatctgatgggcagagatattgatataattttgaacaggagaaactgcatggcagcaaccctcaagatcattgagcgaaatttccccgagctgctgagtttgaacctgtgtaataacaagctctatcagcttgacggcctgtcagacatcaccgagaaagctcctaaggtgaagacactgaaccttagtaagaataaacttgagtctgcctgggagctgggcaaggtcaagggcctcaaacttgaggagctctggctcgaaggtaatcccctctgtagtactttcagcgatcagagcgcgtacgtgtctgctatccgagactgcttccccaagctcctgcgcttggacgggagggagctcagcgctccagttatcgtcgacatcgatagctctgagaccatgaaaccttgtaaagaaaattttacgggctcagaaactctcaaacacctggtcttgcagtttctgcagcagtactactcgatttacgatagcggtgatcgtcaaggactgctgggcgcttatcacgacgaagcatgtttctccctggccatcccctttgatcccaaggattccgcccctagctctctttgtaagtattttgaggacagtcggaacatgaagactctgaaagatccctatctcaaaggagagttgctacgcaggactaagcgtgacatcgtcgattcacttagcgccctgcccaagactcagcacgacctgtctagcatccttgttgacgtttggtgccagacagaaagaatgctgtgtttcagtgtaaatggcgttttcaaggaagtggagggccaatctcagggttccgtcctcgcttttacacggactttcatcgcaactcctggctcctcaagctcactttgcattgtcaatgacgagctgttcgtccgcgatgcctccccacaggaaacccagagcgccttttccattccggtcagcaccttgagctcatctagtgagccctcactctcccaggagcagcaggaaatggtccaggcattcagcgcccagtccggcatgaaactcgaatggtcacagaagtgtctgcaggataatgagtggaactacactagagccggtcaagcctttaccatgctccagacagagggcaagatcccagcggaggcttttaaacagattagctag

SEQ ID NO: 233204 - DNA, 1596 bp, Artificial Sequence
  Description of Artificial Sequence: Synthetic coding sequence
atgtctctcccttcaggccataccaccggacatactgatcaggtcgtgcagaggcgcgcacgctgctgggatatctatcaacgtaggttctcttcccgatccgaacccgtcaaccccggaatgcactccagctcccaccaacaacaggatggagacgccgctatgcacggagcccacatggattctcctgtccggtacaccccttataccatctctccttacaataggaagggctcgttccggaagcaggatcagactcatgtaaacatggagagagagcagaaacctccagagcggcgaatggagggcaatatgcctgatgggaccctggggtcatggttcaagataaccgtaccgttcggcatcaaatacaacgagaagtggctcttaaaccttatccagaacgagtgctctgtgccctttgtgccggtcgaatttcattacgagaacatgcacgcatccttttttgtcgagaatgcctccatcgcctacgccctcaagaatgtatcaggtaagatatgggatgaggacaacgagaaaattagcatctttgttaatcctgccggaattccacatttcgtccatagggagctgaagagcgaaaaagtggagcagattaaattggccatgaaccagcagtgtgacgtatctcaggaagctcttgacatccagaggttacccttttaccccgatatggttaaccgagacacaaaaatggcgagcaaccctaggaaatgcatggccgcatcactcgacgtccatgaggagaacattcctactgttatgagcgccggtgagatggacaagtggaaaggcatcgaacctggcgagaaatgtgctgaccgatccccagtttgtaccaccttcagcgatacctccagtaatattaatagcatattagagctgtttcctaagctgttgtgtttggacggccagcagagcccaagagccactctttgtggaaccgaagcccataaaagattacccacctgtaagggttcgtttttcggaagcgaaatgctgaagaatctggtcctccagtttctgcagcagtattatttgatctacgactcgggcgatcggcagggactgttgagcgcataccatgacgaggcttgcttttcactgtctattccttttaatcctgaagatagcgcccctagctctttctgtaagttcttcaaagacagtcggaacattaagattcttaaggatccctatctccggggagagctcctgaagcataccaagttggacattgttgatagtctgtcggcactcccaaaaactcagcacgacctttcatcttttttggtggacatgtggtatcagaccgaatggatgctttgtttttcagtgaatggcgtgttcaaggaagtagaagggcagagtcagggctccgttctggcgtttacccggaccttcattgcaacccccggtagctcttctagtctctgtatcgttaatgacaaactctttgtgcgcgacacctcacaccaaggcactcagtctgccctgttcacacttgtgccaaccgctttttccagtagtgtgcccgcattctcccaagaacaacagaaaatgttgccatcatag

SEQ ID NO: 233205 - DNA, 702 bp, Artificial Sequence
  Description of Artificial Sequence: Synthetic coding sequence
atggaacgcgaacagaagccaccggagcggcgaatggaagggaacatgcccgacgggacgctggggagttggttcaagattaccgtaccattcggtattaaatacaatgagaagtggctcctcaacttaatacagaacgaatgttccgtgccttttgtgccagttgaatttcactatgaaaacatgcatgcctctttttttgtggagaatgcttcaattgcctacgcgctgaagaatgtgagcggcaaaatttgggatgaggacaacgaaaaaatttccatcttcgtaaaccctgccggaattccacattttgtccatagggagttgaaatcggaaaaggtcgaacagatcaagctcgctatgaaccaacaatgcgatgtgtcacaagaggctttggacatccagcgtctgcccttctaccctgatatggtaaatagagatacaaaaatggcttctaatcccaggaaatgcatggctgccagcctagatgtgcatgaggagaacatccccacagtgatgtctgcaggagagatggacaagtggaaaggcattgagcctggcgagaagtgcgccgaccgctcccccgtgtgcaccacttttagcgatacatctagtaatattaaatctgtggtgcccagcgtgactacctgggatcccgacctgtgcttgattgccccattttgtcggcgtcggcaacattag

SEQ ID NO: 233206 - DNA, 612 bp, Artificial Sequence
  Description of Artificial Sequence: Synthetic coding sequence
atggcgtcttcccatccagaacagctatacgtggttctcaaacccactcgcggttaccagcccgtgcggtattacctaatctatgatagcggagacaggcaaggtcttctttccgcgtaccatgatgaagcctgcttttccctaagcatcccattcaatccagaagactcggcaccctcttcattctgtaagttctttaaggatagcagaaatatcaaaatattgaaagatccttatctccgaggggagctgttgaagcataccaagctggacattgtagacagtctgagtgcacttcccaaaacccagcatgacttgagttcattcctggtagatatgtggtaccagactgaatggatgctctgcttcagcgtgaacggtgtttttaaagaggtcgagggtcagagccaggggtctgtgctggccttcactcggacttttattgccactccagggtctagctccagtttgtgtatcgtgaacgacaagctgttcgtcagggatacctcgcatcaagggacccagagtgcccttttcactctggtcccaacggccttcagctcgtccgtgccagccttcagccaggaacagcagaagatgctgccctcgtag

SEQ ID NO: 233207 - DNA, 1086 bp, Artificial Sequence
  Description of Artificial Sequence: Synthetic coding sequence
tgaaacgagaagtggctacttaacctgatccagaatgaatgcagcgtgccctttgtgccggtcgaattccactatgagaatatgcacgcaagcttcttcgttgagaatgcgagcatcgcctatgcactgaagaacgtgagcggaaaaatttgggacgaggataatgagaaaatctctatctttgtgaatccagccggaattccgcattttgtgcacagagaactgaagagtgagaaggtcgaacaaattaaactggcaatgaaccagcagtgtgatgttagtcaggaagctttagatatacagaggctccccttttatcctgatatggtcaacagagacacaaagatggcaagtaatcctagaaagtgtatggccgcatcccttgacgtacacgaagagaatatacccaccgtgatgagcgctggcgagatggacaagtggaaaggcatcgaacctggggagaaatgcgctgacaggagtcctgtctgtacaactttcagtgacacaagctcaaatattaatagcattctggaattgttcccgaaactgctatgtctcgatggccagcagagccccagggcaacattgtgcggcacggaagctcataaaagactgcctacatgcaaggggagcttttttgggagtgagatgcttaagaatctggtcctccagttcttgcagcagtattatttgatatatgacagcggcgatcgccaaggcctcctcagcgcttaccacgatgaagcttgttttagcctgtctattccttttaacccggaggactccgcgccatcttctttctgcaagtttttcaaagattccaggaacataaagatccttaaggacccctacctgcgcggagaattacttaagcacaccaaattggatattgtcgattctctgagtgccctcccgaagacgcagcacgacctttcttcgttcttggtagacatgtggtatcagacagagtggatgctgtgcttcagcgtcaacggagtttttaaggaagttagtggattttgcagcaggctgcatccggacctccactgctacccatggcagcagttccagagcgtgcacagatag

SEQ ID NO: 233208 - DNA, 1194 bp, Artificial Sequence
  Description of Artificial Sequence: Synthetic coding sequence
atgcgccgaaacacacaggacgagaatatgagaaaatggttcaaagtcactattccttacggcatcaaatacgataaagcgtggcttatgaatagcatacaaagcaactgtagcgtaccctttacccccgttgactttcactacatcaggaaccgggcttgttttttcgtgcaagtggcctccgccgcttccgccctgaaggacgttagttataagatctacgatgacgaaaaccagaagatctgtatctttgttagtcacttcacagccccttatagcgtcaagaataagctgaagcccggacaaatggaaatgctaaagctcaccatgaacaagcggtacaacgtctcacagcaggccctggacctccagaacctgcgctttgatcctgaccttatggggagggacatcgatatcatccttaataggcgaaactgcatggccgcaactttgaaaatcactgagagaaactttcctgaactgcttagcctgaatctgtgtaataacaagctgtatcagttggacggtctctctgacatcacagaaaaggcccctaaagtcaagacccttaacctgtctaagaacaaattggagagtgcctgggagctgggaaaagtgaagggcttgaagcttgaggagttatggctggaaggaaacccgctctgctcaactttttccgatcagtcagcctacgtgagtgccatccgagactgttttccaaaactgttgcggttagatggcagagagctgagcgccccagttatcgttgatattgactctagcgagaccatgaaaccttgcaaggaaaactttaccggaagtgagactctcaagcacctggttttgcaatttcttcagcagagtaatctgtgtaagtactttaaggatagccgtaacataaagattctcaaagatccatacctacagcgcaaactgttgaagcatactaagtgcccaagaaacgtcgactccttatcagcactgccagaaacccagcacgacttcacatcaatcttggttgacatgtggtaccagactgtgaacacgtgcttcttgcctagagccggacccgagtctcagaggtggtggtgcctgctatcgctgaaatggaaagacggattgagagttttgatcctgccctcctgcggcccatcttcgctacctttggcagcaatcccagtgtgcgctagctag

SEQ ID NO: 233209 - DNA, 1194 bp, Artificial Sequence
  Description of Artificial Sequence: Synthetic coding sequence
atgcgaaggaacacccaggatgaaaatatgagaaagtggttcaaagtgaccatcccatatggcatcaagtacgataaagcatggctaatgaattcgattcagtcaaattgtagcgtgccatttaccccagtggatttccactatattaggaatagagcctgtttttttgtccaggtggcctcagctgcttcagccctcaaggatgtgagttacaaaatttacgacgacgaaaaccagaagatctgcatctttgtttcccacttcacagctccgtactccgtgaagaataagctgaaaccaggacagatggagatgttaaagctcaccatgaataaaagatataacgtgagccaacaggccctcgatttacagaacttgagatttgaccccgatctgatgggcagagacatcgatatcatactcaaccgcagaaattgtatggccgctaccctgaagatcacggaaagaaattttcccgaattgctgagcctcaatctgtgcaacaataagctttaccaactggacgggctgtcagacattacggagaaagctcccaaagtcaaaactctgaatttaagcaagaataagctggaatcagcatgggaactcggaaaggttaaggggctgaagctggaggagctttggctggaagggaatcctctttgttcaaccttttccgaccagtctgcttatgtttcggctattagggattgtttcccaaagctgctcagactcgatggtcgcgaactgagcgcccctgtcatagtggatatcgattcgtctgaaacaatgaaaccttgcaaagagaattttacaggcagcgagaccctcaagcatctggtactgcaattcttgcagcaaagcaacctgtgcaaatattttaaagacagccggaatataaaaattctgaaagacccttatctgcagcggaagttgctcaagcacaccaagtgcccaaggaatgtggattctctgagcgccctgcccgaaacacagcacgattttacatctatcttagttgacatgtggtaccaaacagtcaatacttgttttctgccgcgtgctgggcctgaatcccaacgatggtggtgtctgcttagcctgaagtggaaggatggcttacgcgtgctgatcctgccaagctgcggccctagcagcctgccactggcagctattcccgtatgtgcctcctag

SEQ ID NO: 233210 - DNA, 1098 bp, Artificial Sequence
  Description of Artificial Sequence: Synthetic coding sequence
atgcgtcgaaatacacaggacgagaatatgcgaaagtggttcaaggtgactattccctacggcatcaaatatgacaaggcctggctgatgaatagcatacagtcgaattgttctgtccccttcactccagtggatttccactatattcgcaacagagcgtgtttcttcgtccaggtggcctcggcggcttccgccctcaaagacgtatcatataagatctacgatgatgagaatcaaaagatatgcatatttgtgtcgcacttcactgccccatactctgtgaaaaacaagctgaagcctgggcaaatggagatgcttaagttaacaatgaataagcgatacaacgtttctcaacaagctcttgaccttcagaaccttcgcttcgacccagacctcatgggccgtgatatcgacatcatcctgaatcgacggaactgtatggctgcaactctgaagattaccgagaggaacttccctgagctgctgtctcttaatctctgtaacaacaaactgtatcagctcgacggactttctgatatcacagaaaaggcaccaaaagtaaagacactaaacctgagcaagaacaaactagagtctgcatgggagctgggcaaagtcaagggcctcaagttggaagaactctggctcgagggcaaccctctgtgttcaacattcagcgatcagtccgcatatgtatccgcgatacgagactgcttcccaaaactgcttaggttggacggcagagagctttctgcgcctgtaatagtcgacattgattctagcgaaacaatgaaaccctgcaaggagaactttacgggttcagagaccctcaaacatctggttctccagttcctgcagcagtccaacttgtgtaagtactttaaggactccagaaatattaagatactgaaagatccctacctgcaaagaaagctgctgaagcacacaaaatgccctagaaatgtcgactccctgtctgccctgcccgagactcagcacgactttacctctattcttgtggatatgtggtaccagacggtcaacacatgtttcctgcccagggccggtcctgaatctcagtccctgcgcccactgtag

SEQ ID NO: 233211 - DNA, 1098 bp, Artificial Sequence
  Description of Artificial Sequence: Synthetic coding sequence
atgagacgaaacacccaggatgagaatatgcgcaaatggttcaaggtcactatcccatatggcatcaagtatgataaagcatggttgatgaatagtatccaatctaattgtagtgtcccgtttaccccagtggatttccactatattaggaaccgggcttgttttttcgtgcaagtcgcatctgctgcttccgctctgaaagacgtttcctataagatctatgacgacgagaatcagaagatctgtatttttgtgagtcacttcaccgcaccttactccgtgaagaataagctaaagcccggacagatggagatgcttaagctcacaatgaataaacgctacaacgttagtcaacaggccttggacctgcagaacttgagatttgacccggacttgatgggtcgtgatattgatatcatcctgaacaggcgcaactgtatggccgctacactgaaaattacggagcgcaacttccccgaactccttagcctgaatctgtgcaataataaactgtaccagcttgatggtttgagcgacatcacagagaaggcaccgaaggtgaagactcttaacctatcaaaaaataaactcgaatcagcctgggaactaggcaaagtaaaggggctgaagcttgaggagctctggctcgaaggaaacccgttgtgttcaacgtttagcgaccagagcgcttacgtgtcagcaattcgggattgttttcccaaattgctgcggctcgatggacgggagctgagtgcacctgtgatcgtggatatcgatagcagcgagactatgaaaccatgtaaggaaaatttcaccggcagtgagactctgaaacatcttgtccttcagttcttacagcaaagcaatctgtgcaaatattttaaggatagcagaaatattaagatattgaaggacccctatctgcaacgcaaactgctcaagcacaccaagtgtcctcgaaatgtggattccttgagtgccctgccggagacccagcacgatttcacctctattctagtggacatgtggtaccagacagtgaacacatgttttctgccaagggccggaccggagtcacagtctctccgacctctgtag

SEQ ID NO: 233212 - DNA, 1044 bp, Artificial Sequence
  Description of Artificial Sequence: Synthetic coding sequence
atggagcagtacacagcaaactccaactcctccacagaacaaattgtggtccaagccggacagatccaacagcagcagcagggtggagtgacggctgtgcagcttcagacagaggcccaggtggctagcgcctcaggacaacaggtgcagaccctgcaggtcgtgcaagggcagccactcatggtgcaggttagtggcggacagctgattacctctaccggacagccaatcatggtgcaggctgtgcctggcggacagggccagaccatcatgcaggtgccagtttccggtacccaagggctgcagcagattcagctggtgccaccagggcagatccagatacagggaggccaggctgtgcaagtgcagggacagcagggccagacccagcagattatcatccaacagccacagaccgcagtgaccgcaggacagactcagacacagcagcagatagcagtacagggtcaacaagtcgcccagacggcggagggccagacaatcgtttaccagccagtgaacgccgatggcactatcttacagcaggtgacagttccggtgtcaggcatgatcaccatacctgctgcgtcactggcaggtgcacagatcgtgcaaaccggcgctaatacaaatacaacctcctctggccaaggcaccgtaaccgtgactctgcctgtggcagggaacgtcgtcaattctgggggtatggttatgatggtgcctggagctggatccgtgccagccatccaacggatccccctaccaggggctgagatgctggaggaggagcccctgtacgtgaacgctaagcaataccacaggatcctcaagagaagacaggcccgagcgaagcttgaagccgagggcaagatccccaaggaacgcagaaagtacctccacgaaagtagacaccgtcatgccatggccagaaagaggggagagggaggtcgatttttcagtccaaaggaaaaggacagccctcacatgcaggatcctaatcaagccgacgaagaagcaatgactcagatcattcgggtctcttag

SEQ ID NO: 233213 - DNA, 957 bp, Artificial Sequence
  Description of Artificial Sequence: Synthetic coding sequence
atggaacagtatacagccaattctaattcaagcacggagcagattgtggtgcaggcaggtcaaatccagcagcaggtccaaggtcagccgttgatggtgcaagtgtctggcggacaactcatcacttccacaggacagcctatcatggtccaggctgtgcccggaggacaggggcagaccattatgcaggtgcctgtgtcaggaactcagggcctacagcaaatccagcttgtgccccctggacaaattcagatccaggggggtcaggcagtccaggtacaggggcagcagggccaaacccaacagatcatcatccagcagcctcagactgccgtcactgcgggtcagacacaaacccagcagcagattgccgtgcagggacagcaggtcgcccagactgcagagggccagaccatcgtataccagcctgtgaacgcagacggtacaatccttcagcaggtgaccgtccccgtgagcggtatgatcactatccccgctgcttcccttgccggtgcccagattgtgcaaacgggcgctaacaccaacacaactagttccggtcagggcactgtgaccgtgaccctccccgtcgcaggaaatgttgtgaattcgggtgggatggtgatgatggtgcctggcgctgggtctgtgcctgccatacagaggatacctctcccgggtgccgaaatgctagaggaggagcccttatatgtgaatgccaaacaataccatcggattctcaagcgcagacaagcccgagcaaaactcgaggcagagggcaagattcccaaggagcgcaggaagtatttgcacgagtcaaggcacaggcacgctatggctaggaagagaggcgaggggggacgctttttcagccccaaggagaaagatagtccccacatgcaggatccgaatcaagcagacgaggaggcgatgacacagatcatcagagtgagttag

SEQ ID NO: 233214 - DNA, 624 bp, Artificial Sequence
  Description of Artificial Sequence: Synthetic coding sequence
atgacaatggacggtgattccagcaccacggacgccagccaactggggattagtgctgactatatcggcggttcccactacgtcattcaacctcacgacgacacagaggactccatgaatgatcacgaggataccaacggctccaaggaatctttcagggagcaagacatctacctccctattgcgaatgtcgctcggataatgaaaaacgcgattccccagactggaaagatcgcgaaggacgccaaagaatgcgtgcaggaatgcgtgtcggagtttattagcttcatcacaagcgaggctagtgagcgttgtcaccaggagaaacgaaagacaatcaatggtgaggacatactgtttgcgatgtccactcttggttttgacagttacgtcgaacccctcaagctctacctccaaaagttccgagaagccatgaagggggagaaagggatagggggtgcagtgactgctactgatggcctatccgaggagctcacagaggaagcatttacgaatcagctgcccgctggcctgattaccactgacgggcagcagcaaaacgtgatggtatatactacctcctaccagcagatctctggcgtgcagcaaatccagttcagttag

SEQ ID NO: 233215 - DNA, 624 bp, Artificial Sequence
  Description of Artificial Sequence: Synthetic coding sequence
atgacaatggatggcgactctagtacaacagatgcctcccagttaggcatcagcgctgattacatcggaggatcccactacgtgatccagccccacgacgacacagaagactcaatgaacgaccacgaggacactaatggaagcaaagaaagctttcgtgagcaagatatatacctccctatagcaaatgtggctcgcataatgaagaatgctattccccagacagggaagatcgctaaggatgccaaagaatgtgtacaggaatgcgtgtctgagttcatctccttcattacaagcgaagcaagcgaacgctgccaccaagaaaaacgaaaaaccatcaacggagaagacatcctgttcgcaatgtctactctaggatttgatagttacgttgagccactcaaactgtatctccagaaattccgcgaggccatgaaaggggaaaaggggataggcggtgcagtgaccgctacagatggcctatccgaagaactgaccgaggaagccttcactaaccagctgccagctggactcatcacaacggacggacagcagcaaaacgttatggtttacaccaccagctaccagcagatttccggtgtacagcagattcagttttcttag

SEQ ID NO: 233216 - DNA, 1377 bp, Artificial Sequence
  Description of Artificial Sequence: Synthetic coding sequence
atgtctacagagggtgggtttggcggaacttcatcttctgacgcccagcagtccctgcagtctttctggccaagggtgatggaagagattaggaacttaactgttaaggatttcagagttcaggaactgcctctggccaggatcaagaagattatgaagctcgacgaagacgtaaaaatgatttcggccgaggcccctgtcctgtttgccaaagccgcacaaattttcatcaccgaacttacactgcgcgcatggattcataccgaggataataaaaggagaaccctccagcggaacgacatcgctatggccatcaccaaattcgaccagtttgacttcctaatagatatcgtgccacgcgacgaattaaagcctcccaaacggcaagaggaagtgagacagtcagtgaccccggctgaacccgtgcagtattacttcactctggcccagcagcctacggccgttcaggtgcaggggcaacagcagggacagcaaaccacttcctctacaaccaccattcaaccaggacaaatcataatagcccagcctcagcagggccagaccaccccggtgacaatgcaggtaggtgaaggtcagcaggttcagatcgtgcaggcacagccccaaggtcaggcccagcaggcgcagagcggcaccggccagactatgcaagtgatgcagcagatcatcaccaataccggagagatccagcagatccccgtgcagttaaacgctgggcagctgcagtatatccggttggcccagcccgtttctggtacccaggttgtgcagggccagatccagactcttgcaaccaacgctcagcagggacagcggaatgcaagccagggcaagcctcgcagatgtctcaaagaaacgcttcagattacccagacagaggtgcagcaggggcaacaacagttttctcagttcactgacggacagcgcaactcagtccagcaagcgagggtgagtgagcttacgggcgaagctgaacctcgagaagtcaaggccacaggaaactccacgccatgtacaagcagccttcctacaacgcatcctccttctcatcgggcaggcgcttcgtgcgtgtgttgtagccaaccccagcagtcctcaaccagccctccaccttctgacgcattgcaatgggtggtggttgaggtgagcgggacccccaatcagctcgagacgcatcgggagttacacgcgcctctcccaggtatgacctcactgtcacccctccatccgagtcagcagctgtaccagattcagcaggtaacaatgcctgccggtcaggacttggctcagcccatgttcattcaatccgccaaccagccatccgacggtcaggcccctcaggtcactggcgattag

SEQ ID NO: 233217 - DNA, 1008 bp, Artificial Sequence
  Description of Artificial Sequence: Synthetic coding sequence
atgtccacggaaggtggctttgggggaacatcaagttcggatgcccagcaatctcttcagtctttctggcctagggtaatggaagagattcggaacctcactgtgaaggatttccgagtgcaggaactgcctctggccagaataaagaagatcatgaagctcgatgaggatgtgaaaatgatttctgctgaggccccagtgctgtttgccaaagccgctcaaatctttatcacagaactgaccctgcgcgcttggatccataccgaagataataaaaggagaacattacagagaaatgacattgccatggccatcacaaaattcgaccagtttgacttcctcattgacatcgtccccagggatgaactgaagcctcccaagaggcaagaggaagttcggcaatccgtgactccagccgagccagttcagtattactttaccttggctcaacaaccaaccgctgtgcaggttcagggccagcagcagggacaacaaaccacctcttctacaacaactattcagcccggacaaataatcatcgctcagccacaacagggtcaaacaactccggtgaccatgcaggttggagaagggcagcaagtgcaaatcgtccaggcacagccccaggggcaggcccagcaggcgcagtccggcacaggccagactatgcaagtgatgcaacagatcattacaaacacgggagagattcaacaaattccggtacagctgaatgcgggtcagctccagtatattagactcgcccagcctgtgtctggtactcaggtggtgcagggtcagatccagacattggccacaaatgctcagcagatcactcagacagaagttcagcaaggacagcaacagttttcacagttcacagacggacagcagctgtaccagattcagcaggtcacgatgccagctgggcaggacctggcccagcccatgtttattcagtctgcaaaccaaccctcggatggccaagctccgcaggtaactggcgattag

SEQ ID NO: 233218 - DNA, 1320 bp, Artificial Sequence
  Description of Artificial Sequence: Synthetic coding sequence
atgtcgacagagggtggatttggaggtacctctagtagtgacgctcagcagagtctgcagagcttctggccccgagtgatggaggagatccgtaatctgactgttaaggacttccgggtgcaagagcttcctctggctcggataaagaagatcatgaagctggacgaagatgtgaaaatgatcagcgccgaggctccggtactgttcgcaaaggccgctcaaatattcattaccgagcttacactgcgcgcttggatccacaccgaagataacaagagaagaaccttgcagaggaacgatatcgctatggccattaccaagttcgaccagtttgactttttgatcgacatcgtgcctcgggatgaacttaagccgccaaaaagacaggaagaggttaggcagagcgtgacccctgctgaacctgttcagtactattttacacttgcccagcagcccaccgccgtgcaggttcagggtcaacagcaaggccaacagaccacatcctccaccacaaccattcagcccggtcagattatcattgcccagcctcaacaaggtcagaccacacctgtgaccatgcaggtgggcgagggccaacaggtccagatagttcaagcgcagcctcaggggcaagctcaacaggcacagagcggaacaggccaaaccatgcaggtgatgcagcagattatcaccaataccggcgagatccagcagattcccgtacagttgaacgctgggcagctccagtacattcggctggcccagccggtcagcggcacccaggtggtacagggccagatccagaccctggcaaccaatgctcagcagatcacccaaactgaggttcagcaaggacaacagcaatttagtcagttcaccgacggacagaggaattcagttcagcaagctcgcgttagcgaacttactggagaggctgaacctcgagaagtcaaggccaccggcaactccactccctgcacctccagcctccctaccactcacccgccaagccatagagcgggtgcgagttgtgtctgctgctctcaaccacagcagtcctccacatcccccccaccttccgatgcactgcagtgggtagtggtggaagtgagcggaacccctaaccagctggaaactcacagggagttgcatgcccctctcccgggaatgacctctctctccccacttcacccaagccaacagttgtaccaaatacagcaggtcacaatgcccgcagggcaggatttggcacaacccatgttcatccagagcgcaaaccagccaagtgatggccaggccccacaggtgacaggtgactag

SEQ ID NO: 233219 - DNA, 906 bp, Artificial Sequence
  Description of Artificial Sequence: Synthetic coding sequence
atgagcaccgaggggggtttcggaggcacttctagcagcgacgcccagcagagtcttcagtccttttggcctagagtgatggaagagataaggaatctgactgtcaaggactttagggtccaggagcttcctctcgccaggatcaagaagattatgaagctggacgaggacgttaagatgatcagtgccgaagctccggtactgtttgctaaggcagctcagatctttatcaccgaattgactctgcgagcctggatccataccgaggacaacaagcgcaggactctgcaaagaaatgatattgcaatggccataaccaaatttgatcagtttgactttctcatcgacattgtgccaagggatgaactcaaaccacccaagcggcaggaagaggtgcgccagtcggtgacgccagccgagcctgtgcagtactatttcactcttgcccagcagccaaccgcagtacaggttcagggccaacagcagggacagcagaccacctcgtccaccaccactatccagccaggacagatcatcatagcacaacctcaacaagggcagaccatgcaagtcatgcagcagataatcacaaacacaggcgaaatccaacagatcccggtccagctgaacgccggtcaactgcagtatatccggcttgcccagccggtgtccggcactcaggtggttcagggacaaatccagaccttggccaccaacgcccaacagatcacccagactgaagtccagcaggggcagcagcagttctcgcaattcaccgatggccaacagctgtatcagatccagcaagtgacaatgcccgcaggtcaagatctagcccaacccatgtttattcagagcgccaatcaaccatccgatgggcaggcaccacaggtgaccggggactag

SEQ ID NO: 233220 - DNA, 1008 bp, Artificial Sequence
  Description of Artificial Sequence: Synthetic coding sequence
atgtccactgaggggggattcgggggaactagttcttccgacgcccaacaaagtttgcagtcattctggcctagagtgatggaggagattaggaatctcaccgtcaaggattttcgggtgcaggaactgcctctagctcggattaaaaaaatcatgaagctggacgaagatgttaaaatgatatcagccgaagccccagtactgtttgccaaagccgctcaaattttcatcaccgaattaacactcagggcctggattcataccgaagacaataagcggcgtacattgcagcggaacgacatcgctatggcaatcacaaaattcgatcagttcgatttcctgatcgacattgtccctcgggatgaactgaagccgcctaagcgacaggaagaagttcgccaatctgtcactccagccgagccggtgcaatactacttcaccctggcacaacaacccactgccgttcaagtgcagggccagcagcagggacagcaaaccaccagctcaaccactaccatccagccgggtcaaatcatcatcgctcaaccccagcaggggcagaccacaccggttacaatgcaggtgggagagggtcaacaggtgcaaatcgtgcaggcccagcctcaaggacaggcccagcaggcccagtctggaacaggccagacgatgcaggtgatgcaacagattataaccaacacaggggaaattcagcaaatcccagtgcagctgaacgcaggtcagctccagtacattaggctcgcccagcccgtgtctggcacccaggttgtgcagggacagatccagactttagcaaccaatgcccagcagattacacaaacagaggtgcagcagggtcagcagcaattttcccagttcactgatgggcagcagctataccagatccagcaggtgactatgcccgctggccaggatttagctcaacctatgtttatccagtctgcaaaccagccctcagacggacaggcccctcaggtgacaggcgattag

SEQ ID NO: 233221 - DNA, 702 bp, Artificial Sequence
  Description of Artificial Sequence: Synthetic coding sequence
atggccattaccaaattcgaccaattcgacttcttgattgacattgtgcctcgggatgaacttaagccacctaaacggcaggaggaggttcggcagagcgtgactcccgctgagcctgtgcagtactactttactctagcacaacagcccacagccgtccaggtgcaagggcagcagcagggccaacagacaacctcatcaacgaccactatacagcctggtcaaatcatcatcgcacagccacagcaaggccagacaacacccgtgaccatgcaggtgggcgagggccagcaggtccagatcgtacaggctcagccacaggggcaggctcaacaggcacagtcaggcacgggtcagactatgcaggtaatgcaacaaatcataacaaatacgggggaaatccaacagattcctgttcagcttaatgcagggcagttgcagtacatccggttagcccagccagtctccggaacccaggtcgttcagggccagatccagacactcgcgaccaacgcgcagcagattactcagaccgaggtgcagcagggccagcagcaattctcccagttcactgacggccaacaactctaccaaatccagcaagtgacaatgagggccagaaccagcccctccccctgttcatcttcccaacctacctcacctcctacaggcccacctggggacaggcgactccgtgcttag

SEQ ID NO: 233222 - DNA, 606 bp, Artificial Sequence
  Description of Artificial Sequence: Synthetic coding sequence
atggctatcactaaattcgatcagtttgatttcctgattgacattgtgccacgggacgagctgaaaccccctaaacgacaagaggaagtgcgacagtccgtcacaccagccgagccagtgcagtactacttcactcttgcccaacaaccaaccgccgtacaggtccaaggacaacagcagggtcagcaaactacatctagcacaaccaccattcaacccggacagatcattattgcccagccccagcagggccaaactacccccgtcactatgcaggtaggagaggggcagcaagtccagatcgttcaggcccagcctcagggtcaggctcaacaagcccagtccggcaccgggcagacgatgcaagtgatgcagcagatcattaccaataccggggagattcagcagatccccgtccagctgaatgccggtcaattacaatacattcggttggcacagcccgtgagtggaacacaggttgtgcagggacagatacaaacccaggcaatggaaacattctttgcattcaagagacagatttatagcctctggagggtagggggtttcattgctactctgttctcaccacgtgacccaggaaattag

SEQ ID NO: 233223 - DNA, 942 bp, Artificial Sequence
  Description of Artificial Sequence: Synthetic coding sequence
atgagcacagagggaggatttgggggaacatcgagctctgacgcgcagcagagtctgcagagtttctggccgagagtaatggaagagattcgcaacctgacagtgaaggactttagggttcaagagctccctctggccaggattaagaaaatcatgaaattggacgaggacgtgaagatgatctccgccgaggcccctgttctgttcgccaaggcagctcagatattcattacagagctgactctgcgagcctggattcacaccgaagataataagagaagaaccttgcagagaaatgatattgctatggctataacgaaatttgatcagtttgacttcttgatcgatatcgtgccacgggatgaactgaaaccacccaagcgccaggaggaggtgagacagagcgtcactcccgctgagcctgtgcagtactactttacgctcgctcagcagcctaccgcagttcaggtgcaggggcaacagcagggccaacaaaccaccagtagcaccacaacaattcaacccggtcagatcattatcgcccagccccagcagggacagacaactcctgtgaccatgcaggtgggtgagggtcagcaggtgcagatcgtgcaggcacagcctcagggacaggcccagcaggctcagagcgggacgggccaaactatgcaggtaatgcaacagatcatcaccaacacaggtgagattcaacaaattcctgagaccgggctcgcggtttctttacggctgatgaagtgctccggactcatctctgcgcactgcagcttccggctgcctggcagctccgacagccccgctagcgcaagccgggtggcaggcattattggagcagcagaatgtcgccctgcagccgtgtaccctctgagcccagcttgtatccgtcactcatcttgtgcaggtactgacccagacacatgttag

SEQ ID NO: 233224 - DNA, 543 bp, Artificial Sequence
  Description of Artificial Sequence: Synthetic coding sequence
atgtccactgaaggtggcttcgggggtacatcgagctctgacgcacagcagagtctgcagagtttttggccaagagtaatggaggagataagaaacctcactgtgaaagatttccgggtgcaggagttgcctttagccagaataaagaaaataatgaagctcgacgaagacgtcaagatgatcagcgccgaggcaccggtgctgttcgccaaggccgctcagatatttataacagagctgactctccgggcatggatccataccgaggataacaaacggaggacactgcaggaagaggttagacagtccgtgacacccgctgagcccgttcaatactactttactctggctcagcaacctacagccgtccaggtgcagggccaacagcaagggcaacagacgacttcttctactacaacaattcagcccggtcagatcataatagcccagccacagcaaggccagaccacgccggttaccatgcaggttggcgagggacagcaggtacagattgtgcaggcacagccccagggacaggcatag

SEQ ID NO: 233225 - DNA, 1065 bp, Artificial Sequence
  Description of Artificial Sequence: Synthetic coding sequence
atgtcaaccgaaggtgggtttgggggaacatcatcaagcgatgcgcaacagagtctgcaaagcttctggcctagagtgatggaggagatccgtaacctcacggtgaaggactttagagtgcaggaactccccctggctaggattaaaaagatcatgaagcttgacgaggatgtgaaaatgattagcgcagaagcccctgtgctgttcgcaaaagccgcacagatttttataaccgagctgacactgagggcatggatacacactgaagacaataagcggagaaccttgcagaggaatgatattgccatggctatcactaagtttgaccagttcgacttcttaattgacatcgtacccagggatgaactaaaacctcctaaaagacaagaggaggtcaggcagtctgtcactccagccgaacctgtacaatactattttaccctagcgcagcagccgacagccgtgcaggtccaagggcagcaacaggggcagcagactaccagcagcaccacaactattcagccaggacaaataatcattgcacaaccccagcagggacagacaacaccagtcacgatgcaggtaggggaaggtcagcaggtgcagatagtgcaagcacagccccagggccaggcccaacaggcccagagcgggacgggccagaccatgcaggtgatgcagcaaataattaccaacactggggaaattcagcagatcccagtacagttgaatgcgggacagttgcagtacattcggttggctcagccagtctcgggtactcaggttgtgcagggccagatccaaactctggctacgaatgcccagcaggggcaacgaaacgcttcccagggaaaacctagacgctgtcttaaagaaacactccaaatcactcagacagaggttcagcaggggcagcagcagttctcccagttcacagatggccagcaactctaccaaatccagcaggtaactatgccagcgggacaagacctcgcccagcctatgtttatccagagcgcaaatcaaccatcagatggacaggctccccaggttacaggggattag

SEQ ID NO: 233226 - DNA, 894 bp, Artificial Sequence
  Description of Artificial Sequence: Synthetic coding sequence
atgagcactgaaggcggttttgggggaacttcctcttccgacgcccaacagtctctccaatcattctggcctcgagtgatggaagaaattcgtaacctcaccgtgaaggactttcgagtgcaagagttgccactggcccgtattaagaagataatgaagctggatgaagatgtgaagcgcaatgatatagctatggccatcactaagttcgatcaattcgattttttgattgatattgttccaagagacgagctcaagccccctaagaggcaagaagaggtgaggcagagcgtcaccccagctgagccagtgcagtactacttcacccttgcccagcagcccaccgctgtccaggtgcaggggcaacagcaggggcagcaaactacaagtagtacgacgacaatccagccaggacagataatcatcgcacagccacagcaggggcaaacgacacccgtaaccatgcaagtcggtgagggccagcaggtgcagatcgtgcaggctcagcctcagggtcaagcccagcaggcccagagcggaaccgggcaaacaatgcaagtcatgcagcagattatcactaacactggagaaattcaacagattcccgtgcagttgaatgccggacagctgcagtacataaggctggcgcagcctgtgtctggcacacaggtcgtgcagggtcagattcagactttggccaccaatgcccagcagataacccaaacagaggtccagcagggccagcaacagttcagccagtttactgacgggcagcagttgtaccagattcagcaggtgaccatgcctgcaggccaggacctcgcacagccaatgtttattcagtcagctaatcaaccttccgatggtcaggcaccccaagtaactggagactag

SEQ ID NO: 233227 - DNA, 1008 bp, Artificial Sequence
  Description of Artificial Sequence: Synthetic coding sequence
atgtccactgaaggaggttttggcggaaccagtagctcagatgcgcagcagagtcttcaaagcttttggccaagagtgatggaggaaattcgcaatctgacggttaaggatttcagagttcaggaacttcccttagcaaggattaagaagattatgaaattggatgaggacgtaaagatgatttctgccgaggcccctgtgcttttcgcaaaagctgctcagatattcatcaccgaacttaccctcagagcctggattcatacagaggataacaagcgcaggactctgcagcggaacgacatcgctatggcaattacaaagtttgatcagttcgatttccttattgacatcgtccctcgagatgaactgaaacccccaaagcggcaggaggaggttcggcagtctgttactccagccgagcctgtgcagtactatttcacactggcccagcagccaaccgcggtgcaggtgcagggccaacagcaaggccaacagacaaccagctccaccaccactatccaacctggtcagatcattatcgcccagccgcagcaaggccagactacacccgtgaccatgcaggtgggagaaggccagcaggtccagattgttcaggcacagccccagggccaagcccagcaggcccagagcgggacgggccaaacaatgcaagtgatgcagcaaattatcacaaacaccggcgaaatacaacagattcccgtccagctgaatgcgggacagctgcagtacatcagactggctcagcccgtgtcaggcacacaggtggtgcagggacaaatacaaacactagccaccaacgcacagcagattacgcaaacagaagtccagcagggacaacagcaattctcccagtttacagacggccagcagctgtaccaaatccagcaagttaccatgcccgcaggccaagatctggcccagcctatgtttatccagtccgcaaatcagccctctgacggccaagctccacaggtgactggtgattag

SEQ ID NO: 233228 - DNA, 1008 bp, Artificial Sequence
  Description of Artificial Sequence: Synthetic coding sequence
atgagcaccgaggggggatttggtggcacctcaagttctgacgcccagcagtctctgcagtccttctggccccgtgtgatggaggagatcaggaatctgactgtaaaagactttagggtccaggagctgcctctggcccgaattaaaaagattatgaagctggacgaagacgtgaagatgattagcgcagaagctcctgtgctgtttgccaaagctgcccaaatctttataactgaactgactctcagagcgtggatacatactgaggacaacaaaaggagaacgctccagagaaatgacatcgctatggccataactaaattcgaccagttcgattttttgatcgacattgtacccagagacgagctgaaacccccaaagcgacaggaggaggttaggcaatccgtaacacccgcagaacctgtgcagtactacttcaccctagctcagcagccgactgccgtacaggtgcagggacagcagcagggacagcagactacctctagtaccacaacaattcagccaggccagattatcatagctcagccacagcaagggcagacgacccctgtcacgatgcaggtaggagagggccagcaggtgcagattgtccaggcgcaaccacagggtcaagcgcagcaggcacaatcgggcaccggacaaaccatgcaagtgatgcagcagataatcaccaatacgggggagatccaacagattccggtccagttgaacgctgggcagctacagtacatccgcctggctcagcccgtgagtggaacacaggtggtccaaggacaaattcagaccctggcaaccaacgctcagcagattacgcagacagaagtccagcagggccagcagcaattctcccagtttacagacgggcagcagctgtatcagatccagcaggtcactatgcccgcaggccaggatctcgcccagccaatgtttattcagtctgcgaatcaacctagcgacgggcaagcgccacaggtgacaggtgactag

SEQ ID NO: 233229 - DNA, 390 bp, Artificial Sequence
  Description of Artificial Sequence: Synthetic coding sequence
atgtccaccgaagggggattcggaggtacaagtagctctgacgctcagcagtctctgcagagtttctggcctagggtgatggaagaaatccggaacttgactgtgaaagacttcagggtgcaagaactgcctctcgctagaattaagaagatcatgaaactcgacgaagacgtaaagatgatttccgcagaggcgcctgtgctgttcgctaaagcagcacaaatctttatcacagagctcacactgcgcgcttggatccataccgaggacaacaagcggaggacccttcagaggaatgatattgccatggcaataacaaaatttgatcaatttgattttctgattgacatcgtgcccagagacgagctgaagccaccaaagcgccaatag

SEQ ID NO: 233230 - DNA, 1005 bp, Artificial Sequence
  Description of Artificial Sequence: Synthetic coding sequence
atgagcacagagggcggtttcggcggaacatctagctcggacgcccagcagtcgcttcagagcttctggccacgtgtgatggaggaaataagaaatctgacagtgaaagactttagagtccaagagttgcccctggccaggataaagaagataatgaagctggacgaagatgtgaagatgatttctgctgaggctccagtgttgttcgccaaagccgctcagatttttatcacagagcttacattgagggcctggatacatacagaggataacaagaggaggacgctccagaggaatgacatagcaatggctatcacaaaatttgaccagtttgatttcttgatcgacatcgtgccacgcgatgagctcaagcctccaaaaaggcaggaagaagtaaggcagtctgtgacgccagccgagcccgtccagtattattttactctcgcacagcagccaacggccgtgcaggtgcaggggcaacaacaaggtcaacagaccacaagctctaccaccaccatccagcctggacagataatcatcgcccaaccccagcaggggcaaaccacacctgtcactatgcaggttggggaagggcaacaggtgcagatagttcaggcccagccacaggggcaagctcaacaagctcagagcgggaccgggcagactatgcaggtcatgcagcagatcattaccaataccggagagatccagcagatccccgtgcaactgaatgcgggacaactacagtatattcgattagctcagcccgtctccgggacgcaagtggtacaggggcagattcaaacgctggccaccaatgctcagcaaatcacacagactgaagtgcaacagggccagcagcaattctctcagtttaccgatggtcagctgtaccagattcagcaagtcacaatgcctgccggacaggatctggcccagcctatgtttatccagtcagctaatcagcctagcgacggacaggccccacaggtgaccggagactag

SEQ ID NO: 233231 - DNA, 426 bp, Artificial Sequence
  Description of Artificial Sequence: Synthetic coding sequence
atgtctaccgaggggggtttcggtggtacatcgagcagcgacgcacagcaatccttacaatcattttggccccgtgtgatggaggagatcagaaaccttacagtgaaagattttcgagttcaggaactgccgctggctcggatcaagaaaattatgaagctcgacgaagatgtaaagatgatttcagcagaggctccagtgctcttcgcaaaggctgctcaaatctttattactgagctgacgttacgagcctggatacacacagaggataacaagcggagaaccctgcagagaaacgacattgctatggctatcactaaattcgatcagtttgactttcttatcgatattgtgcctagagatgaactcaaacctcccaaaagacaggaggtccggcagagcgtgacccctgctgaaccagtgtag

SEQ ID NO: 233232 - DNA, 288 bp, Artificial Sequence
  Description of Artificial Sequence: Synthetic coding sequence
atgagtacagaaggcggatttggcggtacctcatcctctgatgcccaacaatcgctgcagtccttttggccaagggtcatggaagagatccggaacctgacagttatgatttccgccgaagcgccagtcctgtttgccaaagctgcccaaattttcattacagagctgacactccgggcatggatccatacagaagacaataaaaggagaaccttacagcggaatgatatagcgatggccataacgaaattcgaccagtttgacttcctgatagacatcgtaccttag

SEQ ID NO: 233233 - DNA, 183 bp, Artificial Sequence
  Description of Artificial Sequence: Synthetic coding sequence
atgagtactgagggtggattcggtgggacatcctctagtgatgcccagcaaagccttcagagtttctggcccagagtaatggaggagattagaaatttaacagttaaggactttagggttcaagaactgccccttgcacgcatcaagaagatcatgaaattggacgaagatgtgaagatgtag

SEQ ID NO: 233234 - DNA, 159 bp, Artificial Sequence
  Description of Artificial Sequence: Synthetic coding sequence
atgtctactgaaggagggtttggcggaacttcttcctcggatgcacaacagtctctgcaatccttctggcccagggttatggaggaaattaggaatctgaccgttaaggactttcgcgttcaggagcttcctctggctcgcattaaaaaaatcatgtag

SEQ ID NO: 233235 - DNA, 555 bp, Artificial Sequence
  Description of Artificial Sequence: Synthetic coding sequence
atggctaggagtttggtccacgacacagtgttttactgcctgtccgtctaccaggtgaagattagtcccacccctcagcttggcgctgcttcgtcagctgaggggcacgtggggcaaggggcaccaggcctgatgggaaatatgaaccccgaagggggagttaaccacgagaacggcatgaacagggatggcggtatgataccggagggcggaggcggaaatcaagagccgcgacaacagcctcagccacctccagaggagcctgctcaggcagccatggaggggcctcaaccagagaatatgcagccccgaactcgccgtactaaatttaccctcctgcaggtggaagagctcgaatctgtgtttagacacacccagtaccccgacgtgcccactaggcgtgagcttgcggagaacctcggagttaccgaagataaggtgagagtctggttcaaaaacaagagggccagatgcagacgccaccagcgagaattgatgttagcaaatgaacttagggccgaccccgacgattgcgtttacatcgtggtggactag

SEQ ID NO: 233236 - DNA, 345 bp, Artificial Sequence
  Description of Artificial Sequence: Synthetic coding sequence
atggacaagcgtagaagagccttaacacgtctgtacttggacaaggccacccttatctggaacggcaacgctgtctcaggattggatgcactgaacaattttttcgatactctcccatcttccgagtttcaggttaacatgctggactgccaacccgtgcatgaacaggctactcagtcacagaccaccgtactggtggtaacctctggcactgtgaaatttgatggcaacaagcagcactttttcaaccagaactttctgctaactgcacagtccactcccaacaacacagtttggaaaattgcaagcgattgctttagattccaggattggtcgagctcttag

SEQ ID NO: 233237 - DNA, 429 bp, Artificial Sequence
  Description of Artificial Sequence: Synthetic coding sequence
atggctaccagcttagatttcaaaacatatgttgatcaggcctgtcgggctgccgaagagtttgtgaatatctactatgagactatggataagcgcagacgggctctgaccagattatatctggataaggctaccttaatttggaatgggaacgccgtctccggacttgatgcgctcaataatttcttcgacacgctgccaagttcagaatttcaggtaaacatgttagattgccagcccgttcacgaacaggcgactcaatctcagacaaccgttctggttgtaacatcaggtacagtgaaatttgacggtaacaagcagcactttttcaaccagaatttcttactgacagcccagtccactcctaataacactgtgtggaagatcgccagtgattgtttccgatttcaggattggagcagtagctag

SEQ ID NO: 233238 - DNA, 345 bp, Artificial Sequence
  Description of Artificial Sequence: Synthetic coding sequence
atggataaacgccgaagggctctcacgcggttgtacctcgacaaggccacattgatatggaacggtaatgccgtttccggtctggatgctttgaataacttttttgacaccttgccatcctcagagttccaggtaaacatgctggattgccaaccagtacatgagcaggcaactcagtcgcaaactacggttttggtcgtgacaagcggaacagtgaagttcgacggtaataagcagcacttttttaatcagaactttctcctcaccgcccagtccacccccaacaataccgtatggaagatcgcttcagactgcttcagattccaggactggagttcctcatag

SEQ ID NO: 233239 - DNA, 882 bp, Artificial Sequence
  Description of Artificial Sequence: Synthetic coding sequence
atgacaggcctgtacgagctcgtgtggcgagttctgcatgccctactttgtttacatcgtacgctgacgagttggctgcgggtcaggtttgggacctggaattggatctggcggaggtgctgtagggctgcatctgcagcggtgctcgcaccactcggctttactctgagaaaacctcccgctgtgggcaggaaccgccgacatcacagacaccctcggggtgggtcgtgcttagctgccgctcatcaccgaatgagatggagagcagatgggaggtctcttgagaaactgccggtgcacatgggcctggtcatcacagaggttgaacaggagcccagcttcagcgacatagcctctcttgtggtctggtgtatggccgtgggcataagctatattagtgtatacgatcaccaaggaatctttaagcgaaacaattcaaggctgatggacgaaattctcaaacaacagcaggaactgctgggactcgactgcagcaaatacagccccgaattcgccaacagtaacgacaaagacgaccaggtgttgaactgtcacctggcagtgaaggtcctttccccggaggacggaaaagctgacattgttcgcgcagcccaagatttttgccagttagtggctcagaaacaaaagcgccctacggacctggatgtcgataccctggcaagcctcctgtcgtccaatggctgtccagaccccgacctcgtactgaagttcggccctgtggacagcacactgggctttctgccttggcacatcaggctgaccgaaattgtgagccttccctctcatctcaatatttcctatgaggacttcttctcagccctgagacaatacgctgcatgcgagcagcgactaggcaaatag

SEQ ID NO: 233240 - DNA, 2571 bp, Artificial Sequence
  Description of Artificial Sequence: Synthetic coding sequence
atgaagccaaggcccgctggcttcgtcgacaataagttaaagcagcgggtgatccaatacctgaccagtaataaatgtggtaaatacgtggacattggcgtcctggcctccgacttgcagagagtatatagcatagattacggccgacggaagaggaatgccttccgcatccaggtggaaaaggtgttttctattatcagctctgagaaggagctgaaaaatctgaccgaactggaagatgaacatctcgcaaaacgtgcaaggcagggagaggaagataacgagtacaccgaatcctattcagacgatgacagtagtatggaggactaccccgatccacaaagcgcgaatcatatgaactcatccctgctttctctgtatcgcaaaggcaaccctgattcagtgtcaaacactcctgagatggaacagagagaaactactagcagtaccccccgtatatcctcaaagaccggttctataccattaaagaccccggctaaggactcagagggtggctggttcatcgacaagactcctagtgttaagaaggacagcttctttttggatctgtcctgcgaaaaatctaacccaaagaaacctatcacagaaatacaggattccaaagactcctctctgttggagagcgatatgaagagaaaggggaagctgaagaataagggctccaaacggaaaaaggaagacctccaggaggtcgacggtgaaattgaggccgtacttcagaaaaaggccaaggcgaggggccttgaatttcagatctctaatgtgaagtttgaagatgtgggaggcaacgatatgacccttaaagaagtttgtaaaatgctgatccacatgaggcaccccgaggtttaccatcacctgggggttgtacctccaagaggggtcctcctacacggccctccaggctgcggaaaaaccctcctggcacatgccatagccggagaactggatctgcccatcctgaaggtcgcagctcccgaaatcgtgtccggagtcagtggcgagtctgaacagaaactgagagagttgtttgaacaggctgtctccaacgccccttgtattatatttattgatgagattgacgcgatcacaccaaaaagggaggttgcctcaaaggacatggaacgacgtatcgttgcgcaacttctaacttgtatggatgatctaaacaacgtggccgctaccgcacgcgtgcttgttatcggcgctaccaaccggccagatagcctcgaccccgcattacgacgagccggaaggtttgacagagaaatttgtttgggcatcccggacgaggcttccagggagcgcatccttcaaacactgtgtaggaaattgagactcccccaggcatttgatttctgccatcttgctcatctcacccccggatttgttggggcagacctcatggctctatgtcgagaagccgctatgtgcgcagtaaacagggtcttaatgaaattacaggaacagcagaagaaaaatcctgagatggaggaccttcctagtaagggcgtgcaggaagagcgccttggtaccgagcccacaagcgagacccaagatgagctgcagagacttctgggccttctgcgcgaccaggacccactgagcgaggagcagatgcagggactgtgtattgagctgaacgacttcattgtggcgttgagctctgttcaaccaagcgctaagagagaggggttcgtcactgtgcccaatgttacatgggccgatattggtgcattagaggacatccgcgaggagctgaccatggctattctcgctccagtgaggaaccccgatcagtttaaagcattgggactcgttaccccagccggagttctactggccggtcctccaggatgcggcaagacactgctagccaaagccgtcgctaatgagtctggcttaaacttcatttccgtcaaaggcccagagctgctcaacatgtacgtgggggagtcggagcgggcagtgcggcaggtgttccaacgcgcaaaaaactcagctccctgcgtgatattcttcgacgaagtggacgccctgtgcccccgtagatccgaccgggagacgggggcatccgtgagggtcgtgaaccagttgctcaccgagatggatggtttggaggctcgacagcaggtctttatcatggcggctactaacaggccagatattatagatcccgcaatcctgagaccagggagattggacaaaacgctcttcgtaggcctgccaccacccgctgacaggctcgccatcttaaagaccattacaaagaacggcacaaagccacccctcgacgcagacgtgaatcttgaggccatcgccggagacttgagatgcgactgctacaccggggcagacctttccgcactcgtgcgggaggcgtctatttgcgctctgcgccaggaaatggctaggcagaaatcaggtaacgaaaagggggagctgaaggttagccacaagcacttcgaagaagccttcaagaaggtgcgatcctccatatctaaaaaggatcagataatgtatgagcgacttcaggagtctctaagtcggtag

SEQ ID NO: 233241 - DNA, 2004 bp, Artificial Sequence
  Description of Artificial Sequence: Synthetic coding sequence
atgaagcgcaaggggaagctaaaaaacaagggaagtaaacggaagaaagaggaccttcaggaagttgacggagagattgaggccgtgcttcagaaaaaagccaaagcacggggtctggagttccagatctctaatgtgaagttcgaagatgtaggaggcaacgatatgactcttaaggaggtttgcaaaatgctcatacatatgcggcaccctgaggtgtatcatcatctgggtgtggtgcctccacggggtgtgcttctgcatgggcctccgggatgtggcaaaactctgctggcccacgctatagctggggcagaatgctcaggaatgatcacggcacactgcagttttgacttttcaggtagcaacgaccccccagcaagcgcgagccaagagcttgatcttcctattctgaaagtcgctgctccagagatagtctccggggtgtctggtgagagcgagcagaagttgcgcgaactctttgaacaggctgtgtccaatgcaccatgtatcatcttcatcgatgaaattgacgccattactccgaagcgcgaagtcgcgtcgaaggatatggaacgtcgcattgtggcccagttactgacttgtatggacgatctgaataatgtggccgctaccgccagagtcctggtgatcggcgctacgaaccggccagatagcctggatccggcattgagacgggcaggcagatttgatcgggaaatctgtttagggattcccgatgaggcttctcgagagaggatacttcagaccctgtgcaggaaattgcggctgccccaagcatttgacttttgccacctggctcatcttacacccggatttgtgggagccgacctcatggcgctgtgtcgggaagcagcaatgtgtgcagtgaacagggtgctcatgaagctccaggagcagcagaagaagaaccccgagatggaggatctgccatccaagggggtgcaggaggaacgcctcggcacggagccaacctctgagacccaggacgaactccaacgccttttgggtctgttaagggaccaggaccctctgagcgaggaacaaatgcagggcttgtgcattgagctgaatgatttcatagtggccctcagctccgtccagcccagtgcaaaaagggaaggattcgtcaccgtgcctaacgtgacgtgggcagacattggagccctggaagatattcgtgaggaactgactatggcgatcctggccccagtgcgtaatcctgatcagtttaaggctttaggattagtcacaccagccggtgttctcctcgccggacctcctggatgcggtaaaaccctgctggcaaaggcagtagccaacgagtcaggcctgaatttcatcagtgttaagggccctgagttgctgaatatgtacgtgggggaatccgagcgtgctgtcaggcaggtttttcagcgggctaaaaatagtgctccatgcgtgatcttttttgatgaagtcgacgcactttgtcctagacgcagtgacagagaaaccggagcgtctgtgagagtggtcaaccagcttttgacggagatggacggtcttgaggccaggcagcaggtgtttattatggcagccaccaacagaccagatatcatcgaccccgctattcttcggccaggaagactggacaaaactttattcgtgggtctgcctccccctgctgacaggctcgccatcctgaaaacaatcacaaaaaatggcacgaagccaccattggacgcagacgtgaatttggaggccatcgccggtgatctgcggtgcgactgttatactggggcagacctctccgctttagtgagggaggcgtctatctgcgcgctcagacaggaaatggctcgacaaaaatctgggaatgaaaagggggagcttaaggtctcccacaaacactttgaagaggcattcaaaaaggtaagatccagcatcagcaagaaggaccagattatgtacgagcgtctgcaagaatctctctccagatag

SEQ ID NO: 233242 - DNA, 1770 bp, Artificial Sequence
  Description of Artificial Sequence: Synthetic coding sequence
atggaagattatcccgaccctcagtctgctaaccacatgaatagttccttgcttagcctgtatagaaaaggcaacccagattcagtttctaatacgcccgagatggagcagcgcgagaccacaagttcaacacctcggatctcctctaagaccggctctattcctttgaagacccccgcaaaagacagcgaaggcggttggttcattgataagacccctagtgttaaaaaagattctttttttctcgacctgagctgtgagaagtctaaccctaagaagcccatcacggaaatccaggactccaaggattcctcactcttggaatcagatatgaaacgcaaggggaaacttaagaacaaaggcagcaagcgaaagaaagaagatcttcaagaagtggacggtgagattgaggcagttttacagaaaaaggctaaggcacggggacttgagttccagatttccaatgtgaaatttgaggacgttggaggaaatgacatgacccttaaagaggtgtgtaagatgctgatccatatgagacaccccgaggtctatcaccatctcggcgttgtgcctccccgaggcgttctgctccatggcccaccaggctgcggcaagacactgctggctcatgcgatcgcaggagaactggaccttcccatcctcaaggtcgctgctcccgaaatagtttccggcgtttccggcgagagtgagcaaaaactgcgtgaactgttcgaacaggcagtgagcaatgcaccatgcatcatctttatcgacgagatcgacgctattaccccgaagagggaagtcgcctcgaaggatatggagaggcggattgtagcccagctgctgacatgcatggatgaccttaacaatgtggccgcaaccgcgagggtgctggtcataggcgctacaaaccggccagacagtctagatcccgctcttcggagggcgggtagatttgatagagagatctgcttaggcattccagatgaagcgtcccgtgagcgaattctccaaaccctctgtcgtaagctgagattgccacaggcttttgacttctgccacctggctcacttaacccccggatttgttggagcagatctcatggctttatgccgggaggctgccatgtgtgccgtgaaccgagtcttaatgaagctccaggagcagcagaagaaaaatcccgagatggaggatttgccatccaaaggggtgcaagaagaacgtctgggaacagagccgaccagcgagactcaggacgaacttcagagactgttggggctcctgcgcgatcaggatccgttgtcagaggagcagatgcagggattgtgtatagagctcaacgactttatcgtggcactttcatccgtgcagcctagcgcaaagcgggagggctttgtgaccgtgccaaatgtcacatgggcagatattggagccctcgaggatattcgagaagagctgactatggcaatattagcacccgtccggaatcccgaccagttcaaagccctggggctcgtgacccctgccggagtcttattagccggacccccaggctgcggaaaaaccctcctggccaaggccgtggccaacgagtctgggctcaatttcatcagcgtgaagggacctgaactgttgaatatgtatgtgggcgagagcgagcgcgctgtccgtcaggtgttccagagggctaagaactcagccccttgtgttatctttttcgatgaggtagacgctctatgtccaagaaggagcgatagagagatttag

SEQ ID NO: 233243 - DNA, 2253 bp, Artificial Sequence
  Description of Artificial Sequence: Synthetic coding sequence
atggaggactaccctgatcctcagagcgctaatcatatgaatagttctctgctgagcctgtatcggaaaggcaacccggattctgtttccaatacacctgagatggaacaacgcgagactacgagcagtaccccacgcatcagctccaaaaccggctctattcccctgaagacccccgcaaaggatagtgaagggggatggttcatcgataagacgccctccgtcaagaaagactctttctttctggatttgtcctgtgaaaaatccaaccccaagaagcccatcaccgagatccaggattcgaaggattcatcactcctggaaagtgacatgaagagaaaagggaagctgaagaataaagggtctaaacgcaagaaggaagatttgcaagaggttgatggtgaaattgaagccgtgctgcagaaaaaagctaaggcccgtggacttgaatttcagatctcgaatgttaagttcgaagatgtgggtggcaatgacatgaccttaaaggaagtgtgtaagatgctaattcatatgcgccaccctgaggtctaccaccacctcggtgtggttccaccccgaggggtcctactccatggaccccctggctgtggcaaaacacttcttgctcacgctatcgccggagagctcgacctgcccatcctgaaagtggcggctcccgaaatcgtatcaggagtatctggcgaatcagagcagaaactcagggaactgttcgagcaggctgtttccaacgctccctgtattattttcatcgatgaaatcgacgccataactccaaaaagggaggtggcttccaaggacatggaacgacgcattgtcgcgcagctgctgacttgtatggacgacctgaacaacgtggccgcaaccgctcgggtgctcgtcataggcgctactaacagaccggattccctcgatccagcgttgcgtagagccggtcggttcgaccgggagatctgcctcggtatcccagatgaagccagtcgcgaacgcattctgcagacactgtgcaggaagttgcgtttgccgcaagccttcgatttttgtcatctggcccacttgactcccggatttgtcggcgcagatctcatggccttgtgccgggaagctgcaatgtgcgcagttaatcgagtcttgatgaagctccaagagcagcaaaaaaagaaccctgagatggaggacctgccctccaaaggggtgcaagaagagagactcgggaccgagccaacgagcgagacccaggacgagttacagaggttgttaggacttttgcgtgatcaggatccgctaagcgaggaacagatgcagggcctgtgtattgagcttaatgacttcattgtggctctctccagtgtacagccgtccgcaaaacgtgagggattcgtaacagtgccgaacgtcacttgggcagatataggcgctcttgaagacattagggaggaattaactatggcaatcctggctcctgtgcggaacccagaccagtttaaggccttaggattggtcaccccagctggggtcctgctcgccggtcctccaggatgtggaaaaacgctgttggccaaggccgttgcgaacgagagtggattaaattttataagcgtgaagggtcccgaattgctaaatatgtatgtgggggagtctgagcgcgcagtgaggcaggtgttccagcgggctaagaattcagcgccttgtgtgatcttttttgatgaagtggatgccctgtgccctcgacggtcagaccgcgagaccggggcttctgtgagggtggtgaaccaactgttgacggagatggatggcctggaggctcggcagcaagtgtttataatggcagcaactaataggcccgatatcattgatccagcaatcctacgcccagggcgattggacaagacactcttcgtcgggcttcctcctcccgctgacaggctcgctattctgaaaaccatcaccaagaatggcactaagccaccgctggacgccgacgtgaatctggaagctattgctggagacctaagatgcgactgttatacaggcgcagatctgtccgccctagtgcgagaggctagcatctgcgccctgcgacaagaaatggctcggcagaaatcgggaaacgaaaaaggcgaactgaaagtgtcacacaagcatttcgaggaggccttcaaaaaggtcaggagttccatttcaaagaaggatcagattatgtacgagcggttgcaagaatctctgtcaagatag

SEQ ID NO: 233244 - DNA, 2298 bp, Artificial Sequence
  Description of Artificial Sequence: Synthetic coding sequence
atgaaacctaggccagctggcttcgtcgacaacaaactaaaacagcgcgtcattcagtacctgacctctaataaatgtggcaagtacgtagacattggcgtcctggcctccgatctgcagcgagtgtactcaatcgactatgggcgtcgcaagcgaaatgcattccgaatacaggttgagaaagtgttcagcattatttcttctgagaaggaactgaaaaatttgaccgaattggaggatgaacacctggccaagcgcgctaggcagggggaggaagataacgaatacacggaatcatatagtgacgacgatagttcgatggaggactatcctgacccgcaggattctaaagatagctcactgctggagtctgatatgaagaggaaagggaagttaaagaacaagggatctaagagaaagaaggaagacctgcaggaggttgatggagaaatcgaggccgtgctacaaaagaaggccaaagcccgaggtcttgaattccaaatttcaaacgtgaaatttgaggatgtcggtggaaacgatatgacactgaaggaggtctgcaagatgctgatccacatgaggcatcctgaggtgtaccatcatttaggcgtcgtgcccccaagaggggtgttgttacatggtccgcctggctgtggcaagacgttgctggcacacgctatcgccggagaactagatttgccaattctcaaggtggcagctccggagatcgtgtcaggagttagcggcgaatcagaacaaaaactacgcgaactgtttgaacaagcagtctcaaacgccccatgcataatctttatcgacgagatcgatgctatcacccctaaacgtgaggtcgcctctaaagatatggaaaggaggatcgttgcccagctcttaacatgtatggacgatttaaataacgtcgccgcaactgctagagtccttgtgatcggggcaactaacagacccgacagtcttgacccagcgctccggagagccggtagatttgaccgggagatttgtctcggaatcccagatgaagcgagccgggagcgaatcttacagaccctctgccgcaagctaaggctgcctcaagccttcgacttttgccatttggcccaccttacgcccggttttgtcggagctgacctgatggcgctctgtcgggaggcagctatgtgcgccgtgaaccgagtcctaatgaagttgcaggagcagcagaagaagaacccagagatggaagatctgccgagcaagggtgtccaagaggagcgattaggcacagaacctacctccgagacacaagacgagttgcagagactgctaggcctattacgcgatcaggatcccctgtcagaggagcagatgcagggcttatgtattgagctcaatgactttattgtcgctctgtcatctgtccagccatcagctaagcgggagggcttcgtgaccgtacccaacgtcacctgggccgatatcggcgctctggaggatatcagggaggaattaacaatggccatcctagcgcctgtgaggaacccggatcagttcaaggcacttgggctcgtaacccccgctggcgttctcttggcagggccacctggatgcggcaagaccttgttggctaaggccgtcgcaaacgaatctggcctgaactttatttctgtcaagggccctgagctgctcaacatgtacgttggcgagagcgagagggctgtgagacaggtgtttcagcgggcaaagaattcggcaccttgtgtgatcttcttcgacgaagttgacgctttgtgccctaggagatccgacagagagactggcgctagtgttcgagtggttaaccagttgttaacagagatggatgggcttgaggcaagacagcaggtctttatcatggcagctaccaaccggcctgatatcatcgatccggcaatcctacgtcctggccgtttggacaaaactttatttgtggggctacctccgccagccgaccggttggcgatcctgaagaccatcactaaaaacggcactaagccaccactggatgcagatgtgaacctggaggctatcgcaggcgatttaagatgcgattgctacactggggctgatttgagtgccctggtgagggaggcttcaatatgcgccctcaggcaagaaatggctcgtcagaaaagcggaaatgaaaagggcgaactcaaagtgagtcataaacatttcgaggaagcctttaaaaaggttcgtagctccatctcaaagaaggaccaaattatgtatgaacgcctccaggaatccctgtctagatag

SEQ ID NO: 233245 - DNA, 1386 bp, Artificial Sequence
  Description of Artificial Sequence: Synthetic coding sequence
atgcctccctctgggccaagagggacactgctcctgttgcctctcttgctcttactgctgctgagggcggtgttggcagttccactcgaaaggggcgctcccaacaaagaggaaaccccagctaccgaatctccagatacgggcctgtattaccacaggtatcttcaggaggtaatcgacgttctcgagactgacggccatttcagagagaaactgcaggccgcaaacgccgaggacatcaagagcggtaagttgtcccgcgagctggacttcgtgagtcaccatgtgcgaacaaagctcgacgaactgaaacggcaagaagtgtctcgtttgaggatgttactcaaagcaaagatggacgccgagcaggatccaaacgtgcaggtggatcacctgaacctcctgaaacagttcgagcacctggatccccaaaaccagcataccttcgaagccagggacctcgaactcttgatccagaccgccaccagagacctagcacaatatgatgctgcccatcatgaagagtttaagaggtatgaaatgctgaaggaacacgagaggcgaaggtaccttgaatctctgggcgaggagcagcgcaaggaagcagaacgaaaactggaggagcagcagcggagacatcgcgagcaccccaaggtgaatgttcccggttcacaagcacagctcaaggaggtttgggaagagttagacgggctggaccccaaccgcttcaatcctaaaactttctttatacttcacgacattaactccgacggcgtgctggacgaacaggagctggaagctctgttcactaaagagctcgagaaagtttatgatccaaaaaacgaggaagacgacatgcgagagatggaagaggagaggctaaggatgagagagcacgtgatgaagaatgttgatacaaaccaggatagactggtaaccctcgaagaatttcttgctagcacccaacggaaagagttcggcgacaccggcgaggggtgggaaaccgtggaaatgcaccctgcctacactgaggaagagctaaggcggtttgaggaggagctggctgctagggaggctgaactcaacgcaaaggcccaacgcctctcccaggagactgaggcattaggcagatcacagggtcggctagaggcccagaagagggagctccagcaagccgtgcttcacatggagcaaagaaaacaacagcagcagcagcaacagggacacaaggcccctgcggctcaccctgaaggccaactgaagtttcatcctgatacggatgatgtgcctgtgccagctcccgcaggcgaccagaaggaagtggacacttctgaaaagaagctcctggagaggctccccgaggtggaagtaccacagcatctctag

SEQ ID NO: 233246 - DNA, 1386 bp, Artificial Sequence
  Description of Artificial Sequence: Synthetic coding sequence
atgcctcctagcggccctagaggaacgttgttattgttgcccctactgctgctgcttctgctgcgagctgtcctggcagtccccttggagagaggggcacccaacaaggaggaaactcctgctaccgagagtcctgacaccggcctctattatcatagatacttacaagaagtgatcgacgttctggagaccgatggccatttccgggagaaactgcaggccgctaatgccgaggatatcaaatcaggcaagctgtcacgggaactggactttgtctcacatcacgtgcgaacaaaattggacgagttaaagcggcaggaagtcagccggctccgaatgctgcttaaggccaaaatggacgctgagcaggaccctaatgttcaggtcgatcatcttaacctactaaagcagttcgaacacctggacccacaaaatcagcacacctttgaagcacgtgacctagagctcctgattcagaccgcgacacgggacctggcacaatatgatgctgcgcatcatgaagaatttaaaagatacgagatgttgaaggagcacgagcgacgaagatatctcgagtctcttggggaggaacagcgaaaagaagccgaaagaaagcttgaggaacagcagcgtagacatagggaacaccccaaggtcaacgttccaggtagccaggcacaactcaaggaggtgtgggaggaactagatggcctggaccccaatcgatttaatcccaagacgttttttatcctgcacgacataaattctgacggcgtgctcgacgagcaggaactggaggccctgtttaccaaggaactggagaaagtctacgacccaaagaacgaggaagacgatatgcgggagatggaagaagagaggctgaggatgagggagcatgtcatgaaaaacgtggatactaatcaggatagacttgtgacgctcgaggagttcctggcttctacacagagaaaggaatttggagacacgggagagggatgggaaacagtggagatgcaccctgcgtacacagaggaggagttgaggcggttcgaggaggagttggccgcacgtgaagctgagctaaacgcaaaggcccagcggctttcccaggaaacagaggccctaggaagaagccaaggccgactggaagcacagaaaagggagttgcagcaggcagtactgcacatggaacaaagaaaacagcaacaacaacaacaacagggacacaaagccccagctgcacatccagaggggcagctgaagttccatccagacacagatgatgtgcccgttcccgctcctgcaggagaccaaaaggaagtggatacttctgagaagaagctgctcgagcggctccctgaagtggaggtccctcagcacctgtag

SEQ ID NO: 233247 - DNA, 1386 bp, Artificial Sequence
  Description of Artificial Sequence: Synthetic coding sequence
atgcctcccagtggcccacgcggaaccctgttactgctacctctgctgctattgttactgctcagagctgtgctggcagtgccgttggaaagaggggcaccgaacaaagaagagacccctgctaccgagtctccagacaccggtctgtattaccacagatatctccaagaagtgatcgatgtgctggaaacagacggtcattttagagagaaattgcaggcggctaacgccgaggatattaaatctggtaagctgagtcgagaactggacttcgtgtcccatcatgtacgaaccaaattggacgaattgaagagacaagaagtgtcccgcctcagaatgcttctgaaggctaaaatggatgccgagcaggatcccaatgtccaagttgaccaccttaatctgctgaagcagttcgaacatctcgatccccaaaatcaacacacttttgaagcccgtgatcttgaacttctgatccagacagctaccagggacctcgcgcagtacgacgcagctcaccacgaagagttcaagcgctacgaaatgctcaaagagcacgagaggagaagatatcttgagtcactgggcgaagagcagagaaaggaagccgaacgaaagctggaggaacagcagcggagacatcgcgaacaccccaaggtcaatgtgcccggatcccaggcccagctgaaagaggtgtgggaagagctggatggtctggaccccaacaggtttaatccaaagacgttctttatccttcacgacatcaatagcgacggtgtcctcgacgaacaagagctggaggccctgtttactaaagagctggagaaggtctacgatccgaagaatgaagaggatgatatgagggaaatggaggaagagaggctccgcatgagggaacatgtgatgaaaaacgtcgataccaatcaggacaggctggtgacattggaagagtttctggcatctacgcagagaaaagagttcggggacaccggtgagggatgggaaactgtcgagatgcaccccgcttataccgaagaggaactccgacggttcgaagaggagctggccgctagagaggccgagttgaatgctaaagcccagaggcttagtcaggaaacagaggccctcgggagatcccagggacgtttagaggcccagaaacgtgagctgcagcaggcagtgctgcacatggaacagcggaagcagcagcagcagcagcagcaggggcataaggccccagcagcgcatccagagggccagctgaaatttcaccccgacacagatgatgtacccgtccccgctcctgcgggagatcagaaagaggtggacacttcagaaaaaaaactcctagaaagactcccagaagtcgaagtccctcagcatctctag

SEQ ID NO: 233248 - DNA, 375 bp, Artificial Sequence
  Description of Artificial Sequence: Synthetic coding sequence
atgccaccctctgggccacgaggcaccctcctcctcctcccacttctgctgctactgcttctccgtgccgtactagctgtgccattggagagaggagcaccaaataaagaggagacaccagctacggaaagcccagataccggactctactaccacagatacttacaagaggtgatagacgtgctggaaactgatgggcattttcgcgaaaaacttcaggctgccaacgctgaggacataaagagcggaaaattatcccgtgaacttgacttcgtgtcacatcacgtgcgcactaagctggatgaactgaagcgccaggaagtgagcaggctgcgaatgctcctgaaagctaaaatggacgcagagcaggattag

SEQ ID NO: 233249 - DNA, 336 bp, Artificial Sequence
  Description of Artificial Sequence: Synthetic coding sequence
atgccaccctccggccctcggggtaccttgctgctgttgcccctcttactgctccttctcctcagagctgtgctggccgtgcccctggagagaggtgctccaaataaggaagagacgcccgctactgaaagccccgataccggcctctactatcacaggtatttgcaggaagttatagacgttttagagaccgacggacactttagagaaaagttgcaggctgccaacgccgaggacatcaagagtggaaagctgtcccgagagctggacttcgtttcccatcatgttcggactaagttggatgagctgaaacgacaggaggtgagcaggctctag

SEQ ID NO: 233250 - DNA, 1263 bp, Artificial Sequence
  Description of Artificial Sequence: Synthetic coding sequence
atgcgctggagaactatcctgctgcagtactgcttcctgcttatcacctgccttttaacagctctagaggctgtgcccatagatatagacaaaactaaagtgcaaaacatacatccggtggaatctgcgaagatcgaacctccggacacaggtttgtactatgacgagtatctgaagcaagtgatcgatgtgcttgagaccgacaagcacttcagagagaagctgcagaaggcagacattgaggaaattaagtccggcaggctatctaaagaactagacctcgtgagccatcacgtgagaacaaagttggacgagctgaagcgacaggaggtgggaaggcttagaatgctcatcaaagctaagcttgacagcctccaagacatcgggatggatcatcaggccttgctaaaacagttcgaccatcttaaccacctgaaccctgacaaattcgaatcaactgacctggatatgcttatcaaagccgctacttcagatctggagcactacgacaaaacacgtcacgaggagttcaagaaatatgagatgatgaaggagcatgagcgacgggaatacctgaagaccttgaacgaagagaaaagaaaggaagaagagtctaaatttgaagagatgaagaagaagcacgagaaccaccccaaggtcaaccatcctggctcaaaggatcagctgaaggaagtctgggaagagactgatggtcttgatcctaacgattttgacccgaaaacatttttcaaactgcacgatgtgaacagcgacggatttctggatgagcaggagttagaggccctttttacaaaggagctcgagaaggtctacgacccgaaaaacgaagaagatgacatggtggagatggaggaggaacgactcagaatgagagaacacgtgatgtccgaggtagacaccaataaagataggctcgtaacactcgaggagttccttaaggctaccgagaaaaaggaattccttgagcctgactcttgggagactctggaccaacaacagtttttcactgaagaagaactcaaagagtacgagaatataatcgccctacaggaaaacgaactaaaaaagaaggccgatgagctgcagaagcaaaaggaggagctccagagacagcacgatcaactggaagcccagaaactggaataccaccaggttatccagcaaatggaacagaagaagctccagcaaggcattccccctagtggccctgcaggcgagctgaaattcgaacccagggtctag

SEQ ID NO: 233251 - DNA, 1173 bp, Artificial Sequence
  Description of Artificial Sequence: Synthetic coding sequence
atgcgctggcggactatcctacttcagtactgttttctgctgatcacatgccttttgaccgcactggaggctgtccccatcgatattgataagactaaggtgcaaaacatacacccagtggaatctgctaaaattgaaccccctgacaccgggctttattatgacgagtatcttaaacaggtgatagacgtgctcgaaacagataaacattttcgcgagaagctgcagaaagcggacatcgaggaaatcaagtccggcagactctctaaggagttggacctggtgtctcaccatgtccgaaccaagctcgacgagcttaagaggcaggaggtcggtcgcttgcggatgttgattaaggctaaactggacagcctgcaagatatcggaatggaccaccaggcacttctaaaacagttcgaccatctgaatcacctgaatcctgataagttcgagtcgaccgacctggatatgctgattaaggcagccacgtctgacctggagcactatgacaagacgcggcacgaagaattcaagaagtacgagatgatgaaagagcacgagcgtagggagtatctgaagaccttgaacgaggagaaacgcaaggaggaggagtctaaatttgaagaaatgaagaagaagcatgagaatcacccgaaagtgaaccatcccggttcaaaggaccagcttaaagaggtttgggaggagacagacggacttgacccaaacgacttcgaccccaagacattctttaagctgcacgatgtgaatagcgatggcttcttggacgagcaagagctggaggcactctttaccaaggagttagaaaaggtgtacgatccaaaaaacgaggaagacgatatggtggaaatggaagaggaaagactaagaatgagggaacatgtgatgtccgagaccctggatcaacagcagtttttcaccgaggaagagctcaaagaatacgaaaatattatcgcccttcaggaaaacgagctaaaaaaaaaggccgatgagttgcagaaacagaaggaggagctccagcggcagcatgatcagcttgaggcacaaaaactggagtatcaccaggtgatccaacagatggaacagaaaaagctccagcaaggcatccccccaagcggaccagccggtgaactaaagttcgaaccacacatctag

SEQ ID NO: 233252 - DNA, 210 bp, Artificial Sequence
  Description of Artificial Sequence: Synthetic coding sequence
atgcgctggcgcaccattctgctgcagtactgcttcctcctgatcacctgtcttctgacggcactggaagccgttcccatcgatatcgacaagacaaaggtccagaacatccaccccgtagagagcgcaaagattgaaccacccgacacggggctttactacgacgaatacttgaaacaagtgatagatgtcctcgaaaccgacaaatag

SEQ ID NO: 233253 - DNA, 105 bp, Artificial Sequence
  Description of Artificial Sequence: Synthetic coding sequence
atgcgatggcggacaattctgctgcaatattgcttcttgctgattacctgcttgctgacagcactggaagcagtcccaattgacatcgataagaccaaagtatag

SEQ ID NO: 233254 - DNA, 1263 bp, Artificial Sequence
  Description of Artificial Sequence: Synthetic coding sequence
atgcgttggcggacaatcctgcttcagtattgttttttgctcatcacctgtctgctcacagccctggaggccgtgccaatcgacatcgacaagacaaaggtccagaacattcatcccgtcgaaagcgcaaagatcgaacctccagataccggcctctactatgacgagtacctaaagcaagttattgacgtgctcgagacagacaagcatttccgcgaaaaactccagaaggccgatattgaggaaattaagtccggcaggctgtcaaaagagctggacctcgtgtctcatcacgtacgcactaagctagatgaactgaagcgccaagaggtggggagattgaggatgttgatcaaagcaaagttagatagtttgcaagacatcggtatggatcaccaggcacttcttaagcagttcgaccacctgaaccacttaaaccctgacaaattcgaatcaactgatctcgacatgctcattaaggcagcaacatccgatttggaacattacgataagacaagacacgaggagtttaaaaaatacgaaatgatgaaggaacacgaaagacgtgagtatttaaagacattgaatgaggagaaacgtaaagaagaggagtctaagttcgaggagatgaagaaaaagcatgagaaccacccaaaggtgaaccaccccggatcgaaggaccagctgaaggaggtttgggaggagacagacggattggatcctaacgattttgaccctaaaactttttttaaacttcacgacgttaattctgacgggttcctggacgagcaggaactcgaggctctctttacgaaagagcttgaaaaagtgtatgaccccaaaaacgaggaagatgatatggtcgagatggaggaggagcggctgcgtatgcgcgagcacgtgatgtctgaggtggacactaacaaagatcgtctggtgactcttgaggaattcttgaaagcaaccgagaagaaggaatttctcgagccagactcttgggagacattagatcagcaacagtttttcaccgaagaggagttgaaggagtatgaaaatattatagctcttcaggagaatgaactgaaaaagaaggctgacgaattacaaaagcagaaagaagaactccagcggcaacatgatcaactagaggcacagaaactggaataccatcaggttatccagcagatggagcagaagaagctgcagcagggcattccacccagcggaccagccggagaactgaaatttgaaccccatatatag

SEQ ID NO: 233255 - DNA, 588 bp, Artificial Sequence
  Description of Artificial Sequence: Synthetic coding sequence
atgcgatggcggacaatacttctacagtactgctttctgctaattacctgtctcctgaccgctttagaagcagtgcctatagacattgacaagactaaggttcagaacatccatccagtggagtcagcaaagattgagccacccgacaccggtttgtattatgatgagtatcttaaacaagtgattgatgtgctggaaaccgacaagcatttcagagaaaaactgcagaaggccgacatcgaagaaatcaagagcggacgcctctctaaagagcttgacctggtatctcatcatgtcaggaccaagctggatgagcttaaacggcaggaggttgggaggttacgaatgctaatcaaggcgaagctcgactcattgcaggatatcgggatggaccatcaagccctcttgaaacagttcgatcacctgaatcaccttaaccccgataagttcgaaagcactgatttggatatgctgattaaagcagccactagcgatcttgagcactatgataaaaccagacatgaggaattcaagaaatatgagatgatgaaggaacatgagaggcgcgaatacctgaaaaccttatag

SEQ ID NO: 233256 - DNA, 597 bp, Artificial Sequence
  Description of Artificial Sequence: Synthetic coding sequence
atgaggtggagaactattctgcttcagtactgttttttgttaattacttgtctactaactgctctggaggctgtgcctattgatatagacaaaactaaagtccaaaatatacatccagtggagtcagctaagattgagcctcccgacacaggcctctattatgatgagtaccttaagcaggttatagacgtcctggagactgataaacatttcagggagaagctgcagaaagcagatatagaggagatcaaaagcggaaggctgtcaaaggagcttgaccttgtttcccaccatgttaggaccaagctggacgagctgaagcgccaggaggtcgggagattaaggatgcttattaaggcaaaactcgacagtctgcaggacattggaatggaccatcaggccctgctgaaacagttcgaccatctgaaccatctgaatccagataaattcgagtccacagatctggatatgctgattaaggccgcaacaagcgatcttgaacactatgataagacacgccacgaagaattcaaaaaatatgaaatgatgaaagagcatgagaggagggaatacctcaaaaccttaaatgaggagtag

SEQ ID NO: 233257 - DNA, 105 bp, Artificial Sequence
  Description of Artificial Sequence: Synthetic coding sequence
atgagatggcggactattctgcttcagtactgctttctgctgatcacctgcctgctcacggcgctcgaagccgtgccaattgatatcgacaagactaaggtgtag

SEQ ID NO: 233258 - DNA, 120 bp, Artificial Sequence
  Description of Artificial Sequence: Synthetic coding sequence
atgcgctggcgtactattcttctgcagtactgttttctcttgatcacgtgtctccttaccgccctggaggccgtccccattgatattgataaaacaaaggtgcaaaatatccacccgtag

SEQ ID NO: 233259 - DNA, 210 bp, Artificial Sequence
  Description of Artificial Sequence: Synthetic coding sequence
atgaggtggcgaacaatacttctgcagtactgctttctgctcattacatgcttactgacggctttggaagctgtcccaattgatatagataaaaccaaggttcagaacattcatcccgtagagtccgccaagatcgagccacccgacacagggctatattatgacgagtatctcaaacaggtaatcgacgtgctggaaaccgacaagtag

SEQ ID NO: 233260 - DNA, 273 bp, Artificial Sequence
  Description of Artificial Sequence: Synthetic coding sequence
atgcgctggcggaccatcctgttgcagtactgcttcttgctaatcacttgtttactgacagcactggaggccgtgccaatcgacatcgataagacgaaagtgcaaaatattcatccggtggagtccgccaaaattgaaccgcctgacaccgggctgtactacgatgagtacttaaaacaggtcattgatgttctcgagactgataaacatttccgggagaagctccagaaggcagacatcgaggagattaagtctgggaggctctccaaatag

SEQ ID NO: 233261 - DNA, 1323 bp, Artificial Sequence
  Description of Artificial Sequence: Synthetic coding sequence
atgattatcccttcattggaggagctggactctttgaagtactcagaccttcagaacctggccaagtctcttggactgcgggcaaacctcagagcaacgaagcttttaaaagctctcaaagggtacattaagcacgaggcaagaaagggcaatgaaaatcaggatgagtcacagacatctgcatcctcctgcgatgagaccgagatccagatttccaatcaagaggaggccgaacgtcaacctctgggacacgtgaccaagactaggcggagatgtaagaccgtccgggtggatcccgatagtcagcagaatcattctgagatcaaaatctccaatcccacagaatttcagaatcacgaaaagcaggagtctcaagatttgcgggctacagctaaggtgccaagcccacccgatgaacatcaggaggccgagaatgctgtctctagtggtaatagagatagcaaagtcccttccgaggggaagaaatccttatatacagatgaaagctcaaagccaggaaaaaacaaaaggactgcaatcactacccccaactttaaaaagttacatgaggcacatttcaaggaaatggagagcattgaccagtatattgaaaggaaaaaaaagcatttcgaagagcataactcgatgaacgaattgaaacaaccgataaataagggcggagtacgtaccccggtgccacccaggggtcgtctgtctgtcgctagcacacccattagccagcgcaggtcccaagggagaagctgtggcccagcaagccagtcaaccttggggcttaaaggctccctgaaaaggagtgcaatcagcgccgcaaagacaggtgtgcgtttcagtgccgcaacaaaagacaatgaacataaacgaagcttaacgaaaacccccgcacggaaaagtgctcatgtaactgtcagcggcggaacgccaaagggagaggctgtcctcgggactcacaaactgaagaccatcacgggaaactccgccgctgtgattacaccatttaagctgacgacggaggccacccaaacaccggtctccaataaaaaacccgtgttcgatcttaaggccagtcttagcaggccgctaaactacgagccacacaaaggtaaactgaaaccatgggggcagagcaaggaaaataattatcttaatcaacacgtcaataggattaacttttacaagaagacttacaaacagccccacttacagactaaggaagaacagaggaagaagcgtgagcaggaaaggaaagaaaaaaaagccaaggtgctggggatgcgaagaggacttattctagctgaagattag

SEQ ID NO: 233262 - DNA, 1209 bp, Artificial Sequence
  Description of Artificial Sequence: Synthetic coding sequence
atgattatccccagtctggaggaactggactctctgaagtatagcgaccttcagaatttggccaaatccttgggcttgagggcgaatctccgggctaccaagctcctcaaggctctcaagggctacataaagcacgaggccaggaaaggcaatgaaaatcaggacgaatcacagacatccgcttcatcatgcgatgagactgaaattcagatcagcaaccaggaggaagctgaaagacagccattgggtcatgtgacaaagacccggagaagatgcaagaccgtcagggtggaccctgattctcagcagaaccacagcgaaattaaaattagcaacccaaccgaattccagaatcacgaaaagcaggaaagccaggatttgcgggctactgctaaagtccccagccctcctgatgaacatcaggaggcagagaacgccgtgtcttcgggcaacagggactccaaagtgccttcagaaggcaagaagagtctctacaccgacgaaagtagtaaacctggcaaaaataagaggaccgcaattacaacgcctaattttaaaaaactgcacgaggcccactttaaggaaatggagagtatcgatcagtatatagagagaaaaaaaaaacatttcgaggaacacaactcaatgaatgaactcaagcagcagccaattaacaagggtggcgtccggactccagtcccgccaaggggtagactctccgtcgcgagcactccaatttcacagcgaaggtctcagggtcgcagttgcgggcctgcttcacagagcacccttgggctgaagggcagcctgaagaggtctgctatatccgctgctaagacgggcgtccgcttttcagctgctacaaaggataatgagcacaagaggtcactaaccaaaaccccagcaaggaagagcgctcatgtgaccgtgtcaggaggaacccccaaaggagaggccgtgctcggcacgcacaagttgaagacgatcacaggcaactctgcagctggaaagttaaagccttggggccagtccaaagagaataattatctgaaccaacatgtcaatcgcatcaatttctacaaaaagacttacaaacagccccacctccagacaaaggaggaacagagaaaaaagagggagcaggaacggaaagagaaaaaggcaaaggtgctcggaatgcggcgagggctgattctggccgaggactag

SEQ ID NO: 233263 - DNA, 1326 bp, Artificial Sequence
  Description of Artificial Sequence: Synthetic coding sequence
atgataattcccagccttgaggagctggattctcttaagtactcagatctccagaacttggccaagtctttgggcctccgagccaacctccgcgcaacgaaattgctaaaggctctaaaagggtacatcaagcacgaagcgagaaaaggcaatgagaaccaagatgaatcacagacttccgcatcttcctgtgatgagacagagatccagatttcaaaccaggaggaggctgaaagacagcctctcggtcacgtaacaaaaacacgaaggaggtgtaaaacggtacgcgtagaccctgatagccagcaaaaccactctgagatcaagatatcaaaccccaccgaattccagaatcatgaaaagcaggagagccaggacctgcgagccactgcaaaggttccctctccaccagacgaacatcaggaggcagaaaacgctgtttcttcaggaaatagggattcaaaagtgccttccgaaggcaaaaagagcctgtacaccgacgagtcctcaaaacctgggaagaacaaaaggaccgctattaccacccccaactttaaaaagctgcatgaagctcactttaaagaaatggaatctatagatcagtacatcgagcgtaaaaagaagcacttcgaggagcacaatagcatgaatgagctgaagcaacagcctattaataagggcggagtgagaaccccagtacctcctcgtggccgtctgagcgttgcttccacccctatctcgcagaggcgtagccaaggcaggtcatgcggccctgcctcccaaagtaccctgggcctgaaaggtagcttaaaaaggtctgccatatctgccgctaagacaggtgtgcgttttagcgccgctacaaaggacaacgaacataagcggagtcttactaagactcccgctcgcaagtctgcacacgtaaccgtctccggcggtacccccaagggcgaggctgtgctggggacacacaaactaaagactattaccgggaattcagccgcagtcataacaccttttaaactgacaacggaggccacacaaactccagttagcaataaaaagcccgtctttgatctgaaggcatctctgagcaggcctctgaattatgaacctcataaagggaagcttaagccctgggggcagtctaaagagaacaattacttaaaccagcacgtgaaccgaatcaatttctacaagaagacttacaaacagcctcacttgcagactaaggaagaacaaaggaaaaagcgggagcaggagaggaaggagaaaaaagctaaggtgctaggaatgaggcgcggtctgattcttgccgaagactag

SEQ ID NO: 233264 - DNA, 1323 bp, Artificial Sequence
  Description of Artificial Sequence: Synthetic coding sequence
atgatcattccttccctggaggagctggacagccttaagtactccgacctccaaaatctggcgaagtcactggggctccgggctaatctgagagctaccaaactgctaaaggctcttaagggctacatcaagcacgaggcacggaaagggaatgaaaatcaagatgaatcgcagacttccgccagttcctgcgacgagacagaaattcagatttccaaccaagaagaggccgagagacaacctctgggccatgttaccaaaactcgcagacgttgtaagacagttcgtgtggaccctgattctcagaatcactcggaaattaagattagcaaccccacagagttccagaaccacgagaaacaagaaagtcaagatctgcgggctactgccaaagtgcctagccccccagatgagcaccaggaggctgaaaacgccgtgagctccggaaatcgggattctaaggtgccatccgagggaaagaagtctctttatacagacgagtcttccaagccaggcaaaaataagcgaacagccatcacgacacccaactttaaaaagctgcacgaggctcactttaaagaaatggagtctatcgatcagtacatcgagcgcaaaaaaaagcatttcgaagagcacaactcaatgaacgaactgaaacagcaacctatcaacaaggggggagtgcggacacccgttccaccaaggggccgactgtcggtggcctctacacccatttctcagcggcgttcccaaggaaggtcatgtggcccagcatcacaatcgacactgggtctgaagggctcgctgaaacgctcagcaatatctgcggctaagacaggtgtgcggttctcggctgccaccaaggacaacgaacacaaaaggtctctcacaaaaaccccggctaggaagtccgcgcacgtgaccgtttctggcggtacccctaagggtgaggctgtcctcgggacccataagctgaagacaattaccggtaactccgccgcagttataactccatttaaactgacaaccgaggctactcagacccctgtgagtaacaagaaaccagtcttcgatttgaaagcatcgctgagccgtcctctgaattatgagccccacaagggaaagttgaaaccctgggggcagagtaaagagaacaactaccttaatcagcacgtgaacaggatcaacttttataaaaaaacttacaaacagcctcatctgcaaaccaaggaggagcaaagaaagaaacgggaacaggagcggaaggagaagaaggcgaaggtattggggatgagaaggggactaatcttggcagaagactag

SEQ ID NO: 233265 - DNA, 1320 bp, Artificial Sequence
  Description of Artificial Sequence: Synthetic coding sequence
atgatcatccctagcctcgaagaactcgattctcttaagtacagcgacctacagaatttagccaagtctctggggctccgcgctaacctgcgtgcgacaaagctactgaaggccctgaaagggtatattaagcatgaggctcgaaagggtaacgaaaatcaggatgaaagtcagaccagcgcttcctcctgcgacgagacagaaatccagatttccaaccaggaggaggccgaaagacaaccactgggccacgtgaccaaaacccgcaggaggtgtaaaactgtgagagtggatccagattctcagaatcactcagagatcaaaatctcaaatcccactgagttccagaaccatgagaaacaggaatcacaggacctcagggccaccgctaaggtcccctcacccccagacgagcatcaggaagctgagaatgctgtaagctctggtaatagagacagcaaggttcctagtgagggtaagaagtcactgtacaccgacgaaagcagcaagccaggcaaaaacaagcggactgccattacaacacctaactttaagaagctgcacgaagcccacttcaaggagatggagtccattgatcagtatattgagaggaagaaaaaacacttcgaggaacataactcgatgaacgaactgaagcagcctatcaataaggggggtgtgaggacgcctgtgccacctcgcggaagactgtcagttgcatccaccccaatctcacaaaggcgttcacaaggcaggagctgcggccctgcctcacagtctacgctgggattaaagggcagtcttaaacggtctgccattagtgccgcaaaaactggggtccggttctctgccgctacaaaagacaacgagcacaagcggagtttaacaaaaacacctgccagaaagagcgcccacgtgaccgtttccggcggaacaccaaaaggcgaagccgtcctagggacacataaactgaaaacaatcactggtaattccgcagcagtgatcactccattcaaactgaccaccgaggccacccagaccccagtcagcaacaagaaacctgtgtttgacttgaaagcgagtttatctagacctttgaactatgaaccccataaaggtaagttgaaaccctggggccagagcaaagagaataattacttgaatcagcatgtaaaccgaataaatttttacaagaaaacttataaacagccgcacctacaaactaaggaggaacaacggaaaaaacgcgaacaggagagaaaagagaaaaaggcgaaagtgctgggtatgcgtcgcggtctcattctggccgaggactag

SEQ ID NO: 233266 - DNA, 1281 bp, Artificial Sequence
  Description of Artificial Sequence: Synthetic coding sequence
atgataatccccagtcttgaagaactagacagcctgaaatactcggatttacagaacttagcaaagtctctggggctcagagccaacctacgggcaactaaacttcttaaggcactcaaaggttatatcaaacatgaagctagaaaggggaacgagaatcaagatgagagtcagactagcgcttcatcctgcgacgaaaccgaaatccagatatctaaccaagaggaagccgagagacagccactggggcatgtgaccaagactcgccgacgctgcaagactgtgcgtgtggatccagattctcagaatcacgaaaaacaagaaagccaggacctgagggcaactgcgaaggttccatcccccccagatgaacaccaggaagctgaaaacgccgtgtcatcaggcaaccgtgatagcaaggtcccctctgaaggaaaaaagtctctctacactgatgagtccagcaaacctggtaagaataagcgaaccgctattacaacccctaacttcaagaaactccacgaggcgcattttaaagaaatggaatcaattgatcaatatatcgaaagaaaaaagaagcattttgaggagcacaattccatgaatgaacttaagcaacagcctattaataaggggggtgtaagaacaccagtgccaccaagggggcgactcagtgttgcttcaaccccgatctcacagcgaaggagccagggtagatcttgtggaccggcttcacagtccacactgggtctcaaaggatcactaaagagaagcgccatctcggcagcaaaaacaggggtgcgtttctccgccgctactaaggacaacgagcacaaaagatctctgaccaagaccccagcacgcaagtccgcccacgtgacggtcagcggtgggactccgaaaggggaagcagtgctgggaacacataagttaaagacaatcacaggcaactctgccgcagtcatcaccccttttaagctcacaaccgaagctacccagacccctgtcagcaataagaagcccgttttcgatctgaaggccagcctgtcccggccactgaattacgaacctcataaagggaagttaaagccatggggacaatcaaaggagaacaactacctcaatcaacacgttaaccggattaatttctataaaaagacctacaaacagcctcatctgcagaccaaggaggagcaacggaagaaaagggagcaggaaaggaaagaaaagaaggcaaaagtgctgggtatgaggcgaggacttatcttggcagaggattag

SEQ ID NO: 233267 - DNA, 2250 bp, Artificial Sequence
  Description of Artificial Sequence: Synthetic coding sequence
atggccgctgctggaagccggaagcggaggttggcggagttaaccgtggacgagtttctggcgtcgggattcgactccgaatccgagtctgagagcgagaacagcccacaggccgagaccagggaagccagagaagctgcacggtctcccgataagcccggaggcagcccatccgcaagtaggagaaagggacgtgcttcagagcataaagatcagctgtctagactgaaagacagagatcctgaattctataagtttcttcaggaaaacgaccagagtctgctgaatttctccgactctgatagtagcgaagaggaggagggccctttccactccctacccgacgtgttggaagaggccagcgaagaggaggacggggctgaagagggtgaggatggcgaccgggtgccaaggggactaaagggaaagaaaaacagcgtcccggtgacggtggcaatggtggaacgctggaagcaagcggctaaacaacgattgaccccaaagctgtttcacgaggttgtgcaggcctttcgggctgctgttgcaaccacccgcggtgaccaggaaagcgctgaagctaacaaattccaagtaaccgactccgccgctttcaacgcactggtgactttctgtatccgcgatcttattggatgcctgcagaagctgctgttcggaaaggtggctaaggatagtagccgcatgttgcagccctcctcttcgcctctgtgggggaagctgcgggtagatatcaaggcctacctgggcagcgcgattcaactggtaagctgtttgagcgagaccacggtgctggcagcagtcctgaggcatatctccgttctggtcccctgtttcctgacctttccaaaacagtgtcggatgctgctgaaacggatggtgattgtgtggtcaactggtgaagaatccctgcgtgttctcgcctttctggtcctgtctcgcgtgtgcaggcacaagaaagatacgtttcttggacccgtccttaaacaaatgtacataacgtacgttcggaattgcaagtttacttcgccaggagccctcccttttatctcgttcatgcagtggacactgaccgagttgctggctctggagccaggcgtcgcctaccagcatgcctttctctacatccggcaactagctatccatctgcggaacgccatgacgactagaaagaaagagacatatcaaagtgtgtataattggcaatatgtccattgtttattcctctggtgtcgcgttctttcaaccgccggtccatccgaggccttgcagcccctcgtgtacccgctggcccaggtgattatcggttgtattaaactcatccctacagcaaggttttacccgctccggatgcactgtattcgcgctctaaccctgttgtcaggatcaagcggtgctttcatacccgtgctaccctttatactggagatgttccagcaggtagattttaatagaaaaccagggaggatgtcttccaagccaatcaacttttctgtcatccttaaactcagcaacgtgaacttacaagagaaggcataccgagacggtcttgtggagcagctgtatgacctcacactggaataccttcactcacaagcccactgcattgggttccccgagttggttctccccgttgtcctgcagctgaagtcattcctcagggagtgtaaggtcgctaattactgtaggcaagtacagcaattactgggaaaggttcaggaaaattccgcctatatttgctccagaaggcaacgcgtgagttttggcgtcagtgaacaacaggcagtggaggcttgggagaaacttacccgggaggaggggaccccattaaccctctattactcacattggcgtaagctgcgggatagagaaatacagctggagatatccgggaaggaacgcctggaggatttgaactttcctgaaattaaaagaagaaagatggctgatagaaaagacgaggatcgaaaacagttcaaggacttgttcgaccttaactccagcgaagaggacgacactgagggattttccgaacgcggtatcctgcgaccactatccacgcgccacggcgtggaggatgacgaggaggatgaggaagaaggcgaagaggatagctctaactccgaagacggggacccagacgctgaagcaggactcgcccctggggagctgcagcagttggcccaggggccagaggatgagctggaggacctccagctctctgaggatgactag

SEQ ID NO: 233268 - DNA, 2403 bp, Artificial Sequence
  Description of Artificial Sequence: Synthetic coding sequence
atgaagttcaggcgaaacaagaaacagatcccttcgtttcgaaagctgataaagacttcaaaggtgaaactagaaaataaactgaaaaataaacaattcaagcaacagtccactttgaagaagtataggaaggagcagcggaaactccggcaggcagttaaagacgccgtgtccaaaaaacccattccattggagaaccctaaagaaaagaggcccggaaagaggatcgaacgagaagaagaagaagaggaggaagctctacctttagatatgatggacgaggacgacctccagctgatgaaggacctgggtcaacgcgtctcattcctgacgagagacctctctagctcggagccagtgcacgctaaaaaacggaaacacgagcgaatcatagacaaatatgaaaagatcccaaggacactgcagaccgcacctgagaaagaactcattcatctgttgcctatcaaagacaagagtgggattataccacagacccgtgagaaacccgttacagattccaataaagacgaggaagaccaagaggaggagagggagctggaagaggagataatcgaggaccccatccaggagctcaccatcgaggaacacctgattgaacggaaaaagaaactacaagagaaaaaaatgcatattgctgccctggcatcggcaatattgagcgaccccgagaacaatatcaagaagctcaaagagcttcgttctatgctgatggagcaagatcccgacgtcgcagtcaccgttaggaagctggtcatcgtgagcctcatggagcttttcaaggatattaccccatcctataagattcgaccactgacagaggcagagaagtcaacaaagacacgcaaagagacccagaagctgcgtgagtttgaggagggcctggtctcccagtacaagttctatctcgaaaatctagaacagatggtgaaagattggaagcagaggaagctgaagaaaagcaatgttgtgagtctgaaagcttacaaaggtctggctgaggtggccgtgaagtcactctgtgagctgctggtagcgctgccccatttcaacttccataacaatatcatcgttctgattgttcccctgatgaacgacatgtctaagctgatttcagagatgtgttgcgaagccgtgaaaaagctgttcaagcaggataagctcggacaggcctccctaggcgtgattaaggtcatttccggcttcgtgaaggggagaaactacgaggttagaccagaaatgctcaagacctttttgtgccttagaatcaaagaggtagaagtcaagaaggacaccgaagatatcaataagcccaagaagttcatgacgtttaaagagaagagaaagagcctgtctagaatgcagcggaagtggaagaaggctgaggagaaattggaacgcgagctgcgcgaagctgaggcttccgaatcaactgagaaaaaactcaaattgcacacagaaaccctcaatattgtgttcgtcacttactttcgaattttgaagaaggctcaacgctctcctctgttaccggctgtgctggaggggctggctaaatttgcccaccttatcaatgtggagttctttgacgacctgcttgtagtacttcataccttaatcgagtccggcgatctgagttaccaggagtccctgcactgcgttcagacggcttttcatattctatccggccaaggagatgtattgaacatagacccacttaagttctatacccatctttacaagactctgtttaagctacacgccggagctactaacgagggagtggaaattgttctccagtgtctggacgtaatgctaactaaacgcagaaaacaggtatcccagcaacgggctctcgcgtttataaagaggctgtgtactctggcgctgcatgtcctgcccaatagctccattggaatactggcaactacgcgcattctaatgcacaccttccctaagacagatctgctgttggatagcgagagtcagggctccggagtattcctgccggagctcgatgagcccgaatattgcaacgcccagaataccgctctgtgggaactgcatgcattacgtcgccactaccacccaattgtgcaaagattcgcggcacaccttatcgcgggtgctcccagcgaaggcagtggtgctttaaaacctgaattaagtcgccgaagcgctacagaattatttgaagcctatagcatggctgagatgaccttcaatcctcctgttgaaagctctaacccgaaaattaagggcaagtttttgcaaggggacagttttctcaacgaggacttaaaccagctgatcaagcgctattcttcggaggtggccaccgagtccccgctggacttcactaaatacctaaagacctcgctgcattag

SEQ ID NO: 233269 - DNA, 2403 bp, Artificial Sequence
  Description of Artificial Sequence: Synthetic coding sequence
atgaaagccaggagaaataaaaagcagataccaagctttaggaagttgatcaagacctccaaggttaagttagaaaacaagctgaaaaataagcagtttaagcagcagagtactctcaaaaaataccgaaaagagcaaaggaaacttcggcaggctgtaaaggacgccgtctctaaaaaaccgatcccactagaaaaccctaaagaaaaaaggcccggaaagcggattgaaagagaggaagaggaggaagaagaggctcttcccctcgacatgatggatgaggatgatttgcagctgatgaaggatttggggcaacgcgtctcttttttaacaagagacttatcaagttccgagccggtgcacgcgaaaaaaaggaaacacgagaggatcatcgataagtatgagaaaatcccgaggaccctgcagaccgcccctgaaaaggaactgatacacctgctgccaataaaggacaagtctggcattatcccacagactagagaaaaacctgtcaccgactccaacaaggatgaagaagatcaggaagaagagcgcgaactggaagaggagattatcgaagaccccatacaagaattgacaatagaagaacatctgatcgaacgcaagaaaaagctgcaagaaaagaagatgcatatagcggctctcgcttcagccattctttcagatcctgaaaacaacatcaagaaactgaaagaattgaggagcatgctgatggagcaggatcccgatgtggcagtcactgtaaggaaacttgtgattgtgtccctgatggagctctttaaagatataactcctagttataagatcagacctctgaccgaggccgagaaaagtaccaaaacccggaaggaaacccagaaacttcgggaattcgaagagggtctggtctcgcagtacaagttttatctggaaaatcttgagcaaatggtcaaagactggaaacagcgcaaactgaagaagtcaaacgtcgtcagtctcaaagcatataaaggcctggccgaagtggctgtgaaatcactctgcgaactgcttgtggcactgcctcattttaatttccataataacatcatcgtgctcattgttcccctgatgaatgacatgagcaaacttattagtgagatgtgttgcgaagcagtgaaaaaactgtttaaacaggacaaattgggtcaggcctcacttggcgtaatcaaggtgatctccgggtttgttaaagggcgtaattacgaagtcagacccgagatgctaaagacttttctctgcctgaggatcaaggaggttgaggtgaaaaaggacacagaagacatcaacaagcccaagaaatttatgacgttcaaggaaaaaagaaagtccctgagtcgcatgcagcggaagtggaaaaaggccgaggaaaagctggagagagaacttcgagaagcagaagcctcagaaagcaccgagaaaaagcttaaactgcacacagagacgctgaatatcgtcttcgtcacgtacttccgtatcttgaagaaggcgcagcgtagtcccctactgccagcagtattggagggcctggccaagttcgcacatttgataaatgttgaattctttgacgatctcctggtggtgctccacactctcattgaatccggcgacctgtcttatcaggaaagtcttcactgcgttcagacagcctttcatattttgagtggccagggcgacgtactgaatatcgatcctcttaagttttatactcacctgtataaaactttgtttaagctgcacgcgggtgccacaaacgagggggtggagatcgtgcttcagtgcctggatgtcatgctgactaaacgacgaaaacaggtgagccaacagcgcgcattggccttcattaaaaggctgtgcacattagctttacacgtcctccctaatagctctattgggatcctggctaccacgcgcatccttatgcacacattccctaaaaccgatcttctcctggatagcgaatcccagggcagcggcgtgttcctcccagagctcgatgagcctgaatactgtaatgcgcagaatactgctctgtgggagctgcacgcccttcggcgacattaccatccaatcgtgcagagatttgccgcacacctaattgcaggagccccaagcgagggcagtggcgcactgaagcccgagctctctcggaggagtgccaccgaactgtttgaagcatactctatggcagagatgaccttcaatccacctgtggagtccagcaaccctaagatcaaaggaaaatttctgcaaggagattcttttttgaacgaagatctcaaccaactcataaaacggtactcctccgaagtagctaccgaatccccactggattttacaaagtacctgaagacttcactgcattag

SEQ ID NO: 233270 - DNA, 1506 bp, Artificial Sequence
  Description of Artificial Sequence: Synthetic coding sequence
atggaactgttcaaagacataaccccttcatacaagatccggcctctgaccgaagctgaaaagagtacaaagacacggaaggagacccaaaagctgagggagtttgaagaagggctcgtcagtcaatacaagttctacctcgaaaatctggaacagatggtgaaagattggaaacagcgcaaactgaaaaaatctaatgtggtgagcttgaaggcctacaagggccttgccgaagtcgcagtcaaatccctttgcgaactacttgtcgcactgccccacttcaacttccacaacaatattatcgtcttaatcgttccattgatgaacgacatgtccaagctaatcagtgagatgtgttgcgaggcggtgaagaagctgttcaagcaagataaactcggtcaggcctccctgggcgttatcaaggtgataagtggattcgtgaaaggcaggaattacgaagtgcgcccagagatgcttaagacctttctgtgtctccgaattaaagaggttgaagtcaaaaaggacacggaggacatcaataagcctaagaaattcatgacattcaaagagaagagaaaatccctgagtcgtatgcagcggaagtggaagaaggctgaggagaagttggaaagggaacttcgcgaagcggaggcttccgagagcacagagaaaaaattgaaactccatactgagactctaaacatcgttttcgtgacgtattttagaatcctcaagaaggcacagcggagccctctcctccccgcagtgctggaggggcttgccaagttcgctcatctgatcaatgtcgaattcttcgacgatctgctggtagtgctacacaccctcatagagagcggtgatttgagctatcaggagagccttcattgtgtgcaaacagccttccacatcttaagcgggcagggggatgtcctcaatatcgatcctctgaagttctacacgcatctttacaaaaccctgtttaagttgcacgccggtgccaccaacgagggcgtggagatagtgctgcagtgcttggacgtgatgttgactaaacgtaggaagcaggtttctcagcaaagggcccttgcattcattaagagactctgcaccctcgcgctccacgtgctgccaaatagttccattggtatcctagccaccacgagaatactgatgcatacgtttcccaaaacagatctgctgttggattcggagagccagggatccggggtatttctccctgagctggacgaaccagaatactgcaacgcccagaacactgcattgtgggagcttcacgccttgcgcagacattatcaccctattgttcaaaggttcgcggctcacctgattgccggtgccccaagcgaaggatctggcgctcttaaaccggagctgtctcgacgcagcgcgaccgagctgtttgaagcctactccatggctgagatgaccttcaatccgccagtcgagtcttccaaccccaaaataaaagtgaccactaagggttag

SEQ ID NO: 233271 - DNA, 1551 bp, Artificial Sequence
  Description of Artificial Sequence: Synthetic coding sequence
atggaacgagaacccggtgcagccggtgtgcggcgagccctgggaagaagattggaagcggtgctggcctcccggagcgaagccaatgcggtcttcgacattttggctgtgctgcaatctgaagatcaagaggaaattcaagaggctgtcagaacgtgttcgaggttgtttggcgcattgctggagaggggagagctgtttgtcgggcagctgccctcagaagagatggtgatgacaggctcacagggagccacccgaaaatacaaggtgtggatgaggcataggtaccattcgtgttgcaaccgtctgggcgaactcctgggacacccatcttttcaggttaaggagcttgctctgagtgccttactaaaattcgtgcagctggagggtgcccaccctctagagaagtctaaatgggagggcaactacctgttcccaagagaactttttaagctagttgtcggtggactcttgtcacctgaggaagaccagtcgttgctcttgagccagttcagagaatacttggactatgacgataccaggtatcatactatgcaggctgctgtggatgcagtcgcgcgagtgaccggtcaacatccagaggtgcccccagctttttggaataacgctttcactttactgagcgcagtcagcctgccacgacgcgagccaaccgtgtcaagcttttatgttaagcgcgctgagctctgggacacctggaaggtggctcacttaaaggaacaccggagggtgtttcaggctatgtggctctccttcctgaaacataagttgcctctgagcttgtacaaaaaggtcctcttaatcgtccacgacgcaatcctgcctcagctggctcaaccaacgttgatgatcgattttctgacacgggcttgtgacctcgggggtgccctgtccctcctggctctgaatggactcttcatcctcatccataagcacaatttagaataccctgacttctaccgaaagttgtacgggttgctagacccatctgttttccacgtgaagtatcgcgctaggttctttcaccttgcagatctctttctgagcagtagtcacctgcccgcatacctggtggccgctttcgccaagcggctggccaggctcgctctcacggctccaccagaagcactgttgatggtgttgccattcatctgcaatctattgaggaggcatcccgcatgccgcgtcctggtccaccgcccacatggccctgagctagacgcggatccttacgacccgggagaagaggaccccgctcagagcagagcactggagagctccctgtgggaattacaggcccttcagcgacactatcaccctgaggtttccaaggccgcttctgtgatcaaccaagcgctgagtatgcccgaggtatccattgcccctctgctcgagttgaccgcatatgaaattttcgaaagggatctgaagaaaaaggggcctgagccagtgcccctggaatttatacccgctcagggactgttaggtcgcccaggggaactgtgcgctcagcactttaccctgagctag

SEQ ID NO: 233272 - DNA, 252 bp, Artificial Sequence
  Description of Artificial Sequence: Synthetic coding sequence
tgacccgaagagcttaccttcgcctctgctcaagctgaagcgagagaggaagagagacgggtgcgagagacagttcgcagagacaagactctactcaaagagaaacggaaacgtagggaagaactcttcatcgagcaaaagaagcgaaaactgctgcctgacaccattttggagaaattgactactgcgtcccagactaatataaagaaaagtcctggtaaggtgaaggaaggcatgacgatcctgatttag

SEQ ID NO: 233273 - DNA, 774 bp, Artificial Sequence
  Description of Artificial Sequence: Synthetic coding sequence
atggtgcaactgcgccctagggctagccgtgctcccgcaagcgcagaagccatggtcgacgagggacagttggcctcagaggaggaggaggcagaacacggactgttactgggtcagccgtcatctggggcagcggctgagccactcgaagaggacgaggagggtgatgatgaatttgacgacgaggcacccgaagagttgacatttgcttcagctcaggcggaggccagagaagaggaacgtagagtgagggagaccgtgagacgagataagactctgttgaaggagaaacggaagagacgcgaagaactcttcatcgagcagaagaaacgcaaacttctgccagataccattctggagaaactcaccactgccagccaaacgaacatcaaaaaaagccccggaaaagtgaaagaagtgaaccttcaaaagaaaaatgaagactgtgaaaagggcaacgattctaagaaagtcaaagtacagaaggtgcagtccgtgtctcagaacaagagctacctcgcggtacggctgaaggatcaagatctccgggattcacgtcaacaggccgcacaagcctttatccacaactctctgtatggacccggaacaaacagaaccaccgtgaacaagtttctgtcgctagctaataagcgactgcctgtgaagagggcggcagtccaatttctcaacaatgcatgggggatccagaagaaacagaatgccaagcggttcaaacggagatggatggtgcggaagatgaaaactaagaagtag

SEQ ID NO: 233274 - DNA, 3300 bp, Artificial Sequence
  Description of Artificial Sequence: Synthetic coding sequence
atgtccgtcctgaataagacaaagtggaagggcggaaccctccagatccagcttgccaaggagtcctttcttcaccggttagcccaggagagggaagctgctaaggccaagaaggaggagtcaacgactggaaatgccaacctgctcgaaaagactggtggtgtggacttccatatgaaggccgttccgggaacagaggtccccggtcacaaaaactgggtcgttagtaagtttggacgcgtcttgcctgtattacacctcaaaaaccagcacaagagaaaaattattaaatacgatccgtcaaagtactgccacaaccttaaaaagatcggggaggacttcagtaacactattcctattagtagtttgacgtgggaacttgaaggaggtaacgatccaatgtcaaagaagagaaggggggagttcagcgatttccatgggccacctaaaaaaatcataaaagttcagaaagacgagagttccacggggagtctcgcaatgagcaccaggcccagacgggtcatcgagaggccaccattaacccagcaacaagctgctcagaaacggacatgtgacagcatcaccccaagcaagagtagccctgttcccgtttccgacactcagaagctgaaaaacttgccattcaagacaagtggattagagactgctaagaaacgcaattcgatcagcgacgatgacactgattcggaggacgaacttcgcatgatgattgcgaaggaggagaacctgcagcgaaccacccagccctccatcaatgaatctgagagcgatccattcgaggtagtgcgggatgacttcaagagcggtgttcataagctccactcactcattggattaggcattaaaaatagggtgtcttgtcatgacagtgacgacgacatcatgcgtaatgacagagagtatgactctggtgacaccgacgaaatcattgccatgaaaaagaacgtcgccaaggttaaaaactcaacggaattttcgcagatggagaaatcaacaaaaaagacctcgttcaaaaatagggagaactgcgagttatctgaccactgtatcaaattgcaaaagaggaagagtaacgtggaaagcgccttgagccacggtctgaagagcctgaatcgtaaatcacctagtcattcatcatcatcggaagacgccgattctgcgtctgaacttgctgatagcgaagggggtgaggagtacaacgcaatgatgaagaactgtctccgcgtgaaccttactctcgccgatctagaacaactagcgggttcggacctgaaggtgccaaatgaggataccaaatccgacggacccgagacaactacacagtgtaagttcgacaggggaagcaaaagtccgaagacccctacaggattacggaggggccgacaatgtatcaggccagcggaaatagttgcaagtctgttagaaggggaagagaatacctgcggtaagcaaaaaccaaaggaaaataacctcaagccgaagtttcaggcttttaagggtgtgggctgcctgtatgaaaaggaaagtatgaaaaagtccctcaaagactctgttgcaagtaataataaggatcagaacagtatgaagcacgaggacccttccatcattagcatggaggatggctctccatacgtcaacggctccttgggcgaggtgaccccctgccagcacgctaagaaagccaacgggccaaattacattcaaccacagaaaaggcagacgacgttcgagtcacaggacagaaaggcagtgagcccaagctcatctgagaaaaggagtaagaaccccattagccgtcccctggagggcaaaaagagcttgtcactctcggctaaaacccacaatatcggatttgataaggacagttgccattccaccactaagaccgaagcctctcaggaggaacgctcagacagcagtggcctgacatccttaaaaaaatcccccaaggtaagcagcaaagatacgcgggagattaagactgatttcagcctgagcatttccaatagttcagacgtgtcagccaaagacaagcatgccgaggataatgagaagagactggctgctctggaagctagacagaaagcgaaggaggtgcagaaaaaacttgttcataacgcgctcgccaatcttgacggtcatcctgaagacaaacccacccacatcattttcggaagcgacagtgagtgcgaaactgaggaaacgagcactcaagagcagtctcaccctggggaggagtgggtgaaggagtccatgggtaagaccagcgggaaactctttgattcatccgacgacgacgagagtgacagcgaggacgattctaataggttcaagataaagccacagttcgaaggacgcgctggacagaagctgatggacctccagtctcatttcgggaccgatgatcggtttcgtatggattcaagattcctggaaaccgactcagaggaagagcaggaggaggttaatgagaagaagaccgccgaagaggaagaactcgccgaagaaaaaaagaaagccttaaatgtggtgcagtcagtcctgcagataaatcttagtaactccactaaccggggatccgtggccgctaaaaagttcaaagacattatccactacgaccccactaagcaggaccacgccacctatgagaggaaacgcgatgataagcccaaagagtcaaaagccaaaagaaagaaaaagcgagaggaggcagagaagcttccagaggtctccaaggagatgtattacaacattgctatggatctgaaggagattttccagacaacaaagtacaccagtgaaaaggaggaaggtaccccatggaacgaagattgcgggaaagagaaaccagaggaaattcaggatccagcagctctgacctcagacgccgagcagccgtcaggctttactttttcattctttgacagcgataccaaggacatcaaagaggagacgtaccgggtcgagactgttaaaccaggcaagatagtgtggcaggaggatccacggctgcaggatagttccagcgaagaggaggacgttactgaagaaacagaccacagaaacagttcacctggtgaggccagtttgctggaaaaagagaccacccggttttttttctttagtaaaaacgatgaacgactccaagggtcagatttgttttggcggggtgttggatccaacatgtcccggaattcctgggaggcgcgtactaccaatctgaggatggactgtagaaaaaaacataaagacgctaagcggaagatgaaacccaagtag

SEQ ID NO: 233275 - DNA, 3396 bp, Artificial Sequence
  Description of Artificial Sequence: Synthetic coding sequence
atgaaggtgaatagagagactaagagactgtacgtcggtgggctgtcccaggatatcagtgaagctgacctgcagaatcagttctccagattcggcgaagtgagcgatgtcgaaattataacacggaaggacgatcaggggaatcctcagaaggtcttcgcctacattaatatttccgttgcagaagctgatctcaaaaaatgcatgagcgtgctcaataagacgaaatggaaggggggaacgctccaaatccagctggctaaggagagcttcctgcacagactcgcacaagaacgggaggctgctaaggcaaagaaggaagagagtaccactggcaatgctaatcttcttgaaaagaccggaggagtggacttccacatgaaagcagttcccggaacagaggtccccggtcataaaaactgggtggtgtcaaagttcggacgagtgttgccagtgctacacttaaaaaaccagcacaaacacctgcgtaacatcattaaatatgacccctccaagtactgccacaatctgaaaaaaattggcgaggacttctccaatacaatccctatcagctctcttacctgggagttagagggcggaaacgaccctatgtccaagaaaaggcgcggtgaattctcagacttccatgggccacccaaaaagatcatcaaagtgcagaaggatgagtcctcgacgggctctctggccatgagtacccgtcccagaagagtgattgagcggccacccctgacccaacagcaagcagcacagaagaggacctgcgattctattacgccctccaagtcaagccctgttcctgtctccgatacgcaaaagctgaaaaacctgccctttaagacatctggcctggagactgcaaaaaaacgaaatagcatctccgacgatgacactgattccgaggacgaactgcgcatgatgatagctaaagaagagaatctgcagcgcactactcagccctccatcaacgagtcagaaagcgaccctttcgaggttgtgagggacgacttcaagtctggagtccacaagctgcactccttgatcggtctaggcattaagaatagagttagttgtcatgatagtgacgatgatatcatgcggaacgaccgagagtacgattccggcgacacagacgaaataatcgcaatgaagaaaaacgtggccaaggtgaagaatagcacagaattctcccagatggagaagtccacaaagaagacatcatttaagaacagggagaattgtgaactctctgatcactgtatcaaattacagaagagaaagagtaatgtcgagagtgccctgagtcatggactcaagtccttgaacagaaaatctccgagtcacagctcctcctccgaagatgctgactccgcctctgagctcgcggattccgaggggggagaggaatataatgccatgatgaaaaactgcttaagggtcaacctgactctggcggatctggagcaattagcgggaagcgatctcaaagtgcctaacgaggacacaaaaagtgatggacctgagactacaactcagtgcaaattcgatcgcggatctaagtctccaaaaactcctaccggccttagacgcggtcggcagtgtattcggcctgccgagattgtggcatctctgctggagggggaagaaaatacctgtggaaagcagaagcccaaggagaataaccttaaaccaaagtttcaggcttttaaaggggtgggatgcctgtacgaaaaggagtcaatgaaaaagtcactcaaagattcggtcgcctctaataataaagaccagaatagtatgaagcacgaagatccaagtatcatttcaatggaggacggatcgccgtacgtaaacggatctctgggtgaggttaccccgtgtcagcacgccaagaaagccaatgggcctaattatattcagccccagaagcgccagaccacttttgagagccaagatcgaaaagctgtgagtccatcctctagcgagaagagaagcaaaaatccaattagcaggcctctggaaggaaaaaagagtctgtctctgagtgctaagactcacaacatcggtttcgacaaggactcttgtcacagcaccacaaaaactgaagcatcgcaggaggagcggtccgatagtagcgggctcacctcactgaagaagtccccgaaagtgtctagtaaagacacccgagagatcaagaccgattttagcctgtcaatcagtaatagctccgatgtgtccgccaaagacaaacacgccgaggataacgaaaaacgactggccgctttggaggctagacaaaaggcaaaagaagtgcaaaaaaagttagttcacaatgctctggctaacctggagagtatgggaaagacctcggggaagctgttcgactcttcagacgatgacgaaagcgattctgaagatgacagtaacagatttaagatcaagccccagttcgaaggtagggctggccagaagctcatggacctgcaatctcatttcggaaccgacgatcgtttccgcatggacagtcgcttcctggagactgacagcgaagaggaacaggaggaggtcaacgagaagaaaactgcggaagaggaggagcttgccgaggagaagaagaaggctctcaacgtggtgcagtctgttttgcagatcaatctgtccaactctacaaatcggggttcagtggccgctaaaaaatttaaagacattattcactatgacccaacaaaacaggaccatgctacctacgaaaggaaaagggacgataagcctaaagagtccaaagctaagcgtaagaagaaacgcgaagaagcagagaagctgcctgaagtctctaaagagatgtattacaacatagcaatggacctgaaggaaattttccagacaactaagtacacatcggaaaaagaggaagggaccccatggaacgaggactgtggcaaggagaagccagaagagatacaggaccctgctgcgttaaccagtgacgcagagcaaccctctgggttcacattctcattcttcgatagtgacaccaaggatatcaaggaagagacgtaccgtgtggagactgtcaagcccggaaaaattgtttggcaagaggatccgaggttgcaggactcttcttcggaggaggaagacgtcacagaagagaccgaccacaggaacagctcccctggcgaagcgagcctcctggaaaaggaaaccacgaggtttttcttcttctctaagaacgatgaacgcttgcagggatctgatttgttctggagaggcgttgggtctaatatgagtaggaacagttgggaagctagaactactaacctccgcatggactgtcgcaagaagcacaaagacgccaagagaaagatgaaacctaagtag

SEQ ID NO: 233276 - DNA, 777 bp, Artificial Sequence
  Description of Artificial Sequence: Synthetic coding sequence
atgaaggtaaaccgcgaaaccaaacgtctgtacgtcggtggcttgtcacaagacatttctgaggctgacttgcagaaccagtttagccgattcggcgaggtgtccgacgtcgaaattattaccagaaaggatgatcaaggaaacccccagaaagtttttgcttacattaatatttctgtggcggaggctgacctgaaaaaatgcatgagtgtactgaacaagaccaaatggaagggcggtaccctgcagatccagttggccaaggagtcattcctgcatagactggcccaggaaagggaagcagccaaggcaaagaaggaagagagcacgactggcaacgctaatctgctggaaaaaaccgggggagttgactttcacatgaaggctgtgccaggaactgaggtccccggacacaaaaattgggttgtatccaagtttgggagagtgctgcctgtcctgcacctgaagaaccaacataaaaggaagattattaaatatgatccctccaaatactgccacaacttgaagaagatcggcgaggatttcagcaacactatcccaattagtagcctgacatgggagttggaagggggtaacgatccaatgagtaaaaagaggcggggtgagttcagcgacttccatggtcctcctaagaagatcatcaaggtgcaaaaggacgaatcaagtactggtagcctggcaatgagtaccagacctcgtcgcgtgatcgagagaccaccactgacccagcagcaggccgcacagaagcggacatag

SEQ ID NO: 233277 - DNA, 2913 bp, Artificial Sequence
  Description of Artificial Sequence: Synthetic coding sequence
atgaaggtgaatcgagaaacaaagagattatatgtgggcggactaagccaggacatctctgaagccgatcttcagaatcagttctctagatttggggaagtctctgacgtcgaaatcatcacccgaaaggatgatcaaggaaatccgcagaaagtgtttgcttacatcaatatcagcgtcgccgaagccgatctcaaaaaatgcatgtccgtgctgaacaaaactaagtggaaaggaggaactctgcaaatccagcttgccaaggagtcatttctgcatcggctggcacaggagagagaagctgctaaggccaaaaaagaggaaagcacgaccggtaatgcgaacctgcttgaaaaaacaggcggagtggactttcatatgaaggcagtgccagggacagaggtgccaggccataagaattgggtcgtcagcaaattcggaagagtgctacccgtgctacatctgaagaaccagcacaagcggaagatcattaagtacgacccttccaaatattgtcacaatttgaagaagattggagaggatttttccaacacaattcctatatcgtctctgacttgggaacttgagggcggaaacgatcctatgtctaagaagcggagaggtgagtttagcgatttccatggacctccaaagaagatcattaaggtacagaaagatgagtcatcaacaggatctcttgccatgagcacacgtcctaggagggtcattgaaaggccccctctgactcagcagcaggctgcacagaagaggacatgcgactccatcactccatcaaaaagctccccagtccccgtttcggatactcagaaacttaagaatctgccatttaaaacttctggtttggaaaccgccaagaagcgtaacagcatttccgacgatgataccgactccgaagacgagctgagaatgatgatcgcaaaggaggagaatctgcaaaggacaacccaacctagcatcaatgagtcagagagcgacccatttgaggttgttagagatgattttaagtcaggcgtgcataagctgcattcgttgatcggactgggaattaagaacagggtgagctgtcacgattcagatgacgacattatgcgcaatgatagggagtacgacagcggggacacagatgagattatagctatgaagaaaaatgtggctaaagttaagaatagcaccgaattctcacagatggagaaatcaactaaaaagacttcttttaaaaatcgagagaactgcgagttgtcagaccattgcatcaagctccagaaacgtaaaagcaacgtcgaaagtgccctcagtcacgggttaaagtccttgaatcgcaaaagccctagccattcttcctctagcgaggacgcagatagcgcctccgagttggcagattctgagggaggcgaggagtacaacgctatgatgaagaattgcctgcgcgtgaacttgacgctggccgatctagagcagctcgcaggtagcgatctgaaagtacctaatgaggacaccaagtctgacggaccagaaaccactacacagtgtaagttcgaccggggaagtaagagccccaagaccccgacgggccttagacgaggccgtcaatgcatcaggcccgcagaaatcgtcgcctccctgctcgagggagaggagaacacatgcggtaagcagaagccaaaagaaaataatttgaagcccaaattccaggcatttaagggagtcggatgtctctatgagaaagaatccatgaagaaatccctcaaggacagcgtggcatccaataataaagaccaaaactccatgaagcatgaagacccttccattatatctatggaggacggaagcccctatgttaacgggagtctcggggaggtgactccttgccagcacgcaaaaaaggcaaacggacctaattacatccaaccacagaagcgacagaccacttttgaaagtcaggacagaaaagctgtgtctcctagctcttccgaaaagcgcagcaagaatcccatctcccggcctctggagggtaaaaagtcactctcactgtctgctaagacccataatattgggtttgacaaagactcttgtcattcaacaactaaaacagaagcatcccaggaggaacggagtgattcatcaggtttgacctctctcaagaagagccccaaggtaagtagtaaggatacaagggaaatcaaaaccgacttcagcctctcaatcagcaacagcagtgacgtttccgccaaggacaagcacgctgaagataacgaaaagaggcttgccgcacttgaagcccgtcagaaggctaaggaagtgcagaagaaactagttcataatgctttagcaaacctcgatggacaccctgaggataagcctacccatatcattttcggatctgactccgaatgtgagaccgaagaaacctccacccaggaacagagtcacccaggggaggaatgggtgaaagagtccatgggcaagacctccgggaagctgttcgatagttcagatgatgacgagtcagattctgaggacgattccaaccgcttcaagattaagccacaattcgagggaagagcaggacagaaactcatggacttgcagagccattttggcacggacgacaggttccggatggacagccgctttctcgaaacagatagcgaggaggaacaggaagaagttaacgaaaaaaagactgcagaggaagaggagctggccgaagagaagaaaaaagccctgaacgttgtgcagtcagtactgcagatcaaccttagcaatagcacaaatagagggtcagtagccgcaaaaaagtttaaggacattatccactatgacccaacaaagcaagatcacgcgacctacgaaaggaagcgcgatgacaagcctaaggaatctaaggcatag

SEQ ID NO: 233278 - DNA, 1242 bp, Artificial Sequence
  Description of Artificial Sequence: Synthetic coding sequence
atgaaagttaatcgggaaacaaagcggctctacgttggcggactgtcacaagacataagcgaggctgatctgcaaaaccagttctcccgctttggcgaagtgagcgacgtggaaatcatcacaaggaaggacgaccagggaaatcctcagaaggtgttcgcttacataaatatcagtgtcgcagaggcagacctcaagaaatgtatgtccgtgctgaacaagacaaaatggaaagggggaaccctccagattcagttggccaaggaatcgtttttgcatagactagcccaggaaagagaggccgctaaagccaagaaagaagaaagtactactggcaacgccaatctgctggagaagacaggcggagttgattttcatatgaaggcggtgccgggtacagaagttcctggccacaaaaattgggtggtcagtaagtttggcagggtgctcccagtcctgcatctgaagaaccagcacaaacgtaaaatcatcaaatatgaccctagtaagtattgccacaacctgaagaaaatcggggaagattttagcaatacgatccctataagctctctgacttgggaacttgagggcggtaatgatcccatgagtaaaaaaagacggggagagttctctgattttcatgggccaccaaagaagattatcaaggtacagaaggacgagagctctacaggctctctggcaatgagtacacgaccccgaagggttatagagagacctccactgacccaacagcaggccgctcagaaacggacttgtgacagcatcaccccatcgaagagttcacctgtccctgtgtctgatacacagaagctgaaaaatctccccttcaaaacaagtgggctggagaccgccaagaagaggaattcaatatcagatgacgatacagactcagaggatgagctccgcatgatgattgctaaagaggagaatctgcagcgtactacgcagccgtctatcaacgaatcagaaagcgatccgttcgaagtggtacgggacgacttcaagtccggggtacacaaactacatagcctgataggattgggcattaagaaccgggtgtcttgtcatgatagtgatgatgatatcatgagaaatgatcgagaatacgactccggggacacggacgaaatcatagcaatgaaaaagaacgtcgcaaaggtgaagaatagcacggaattttcccagatggagaaatccaccaaaaaaacctcgtttaagtag

SEQ ID NO: 233279 - DNA, 3504 bp, Artificial Sequence
  Description of Artificial Sequence: Synthetic coding sequence
atgaaggtcaaccgagagacaaagcgactgtacgtcgggggactaagccaagatatctccgaggcagaccttcaaaaccaattctcacgatttggggaggtaagcgatgtcgagattatcacccgcaaagatgatcagggcaacccccagaaagttttcgcgtatatcaacatatccgttgcagaggccgacctgaagaaatgtatgagcgtcttgaataagactaagtggaagggtggtacactgcagattcagctggccaaggagtccttcctgcaccgtctggcccaggaacgggaggccgcaaaggccaagaaagaggaatctacgaccggcaatgctaacctcctcgagaagactggaggcgttgatttccatatgaaggctgtcccgggaaccgaggtgcctgggcacaagaactgggtggtgtctaaatttggcagggtgctccctgtcctccatctgaaaaaccagcacaagaggaaaatcataaagtacgacccatctaagtattgccacaatctgaagaagataggcgaagacttctccaacactatccccatctccagtctcacttgggagctggagggcggtaatgatcccatgagtaagaagaggaggggcgaattttcagactttcacggccctcctaagaagataattaaagtccagaaagatgagtcttccaccggaagcttggcaatgagcacccgcccaagacgggtgattgagcgcccaccactcacacaacagcaggcagcccagaagaggacatgcgattcaattacaccgagtaagagcagccctgtacccgttagcgacactcagaaactgaagaaccttccctttaagacctccggcctggagaccgccaagaagcgcaattccatttccgatgatgataccgactcagaagatgaactgcggatgatgattgctaaagaggagaatctgcagcggacaactcagcctagcattaatgagagtgaaagcgaccctttcgaggtagtgcgcgacgattttaagtcaggggtgcacaagcttcactcgttgatcggtctgggaattaagaatcgggttagttgccatgactcagatgacgatatcatgcggaacgaccgtgagtatgacagcggcgacactgatgaaattatcgcgatgaaaaagaacgtggcaaaggtcaaaaacagcaccgaattcagccagatggaaaagagtactaaaaaaacttcttttaagaatagggaaaattgtgaactgtctgaccactgtatcaagctacagaaaaggaagtcaaacgtggagtccgcccttagtcacggcctcaaaagtttaaatcgtaaaagcccatcccactccagtagtagtgaagacgccgacagcgcttcggaactggcagactcagaggggggtgaggaatacaatgcaatgatgaagaactgcctaagagtcaacctcaccttagctgacctagagcaactggccggatcagatttaaaagtgccaaatgaagacactaaatccgatgggccagagaccacaacccagtgcaaatttgatcgcggttcgaaatctccaaaaacaccaacgggactgaggagagggagacagtgcattaggccagctgaaatcgtggcttctttgctggagggggaggaaaacacctgcggcaagcagaagcccaaggaaaataacctgaagcccaagtttcaagcatttaagggagtgggctgcttgtacgagaaagagtccatgaagaagagtcttaaggactccgtcgcttcaaataacaaggatcagaatagcatgaaacacgaagatccatctatcatttctatggaagatggttctccatacgtcaatgggtcattgggagaggttactccatgtcagcacgcgaaaaaggccaacgggccaaactacattcagccccagaagaggcaaaccacatttgagtctcaggatcgtaaagccgtcagcccgtctagtagcgagaaaagaagtaagaatccaatcagccggccactcgaaggcaagaaatccctctcattgagcgctaaaacccataacatcggttttgacaaggacagctgtcactccacaacaaagacagaagcttcgcaggaagagcgatctgattcttcaggacttacctccctcaaaaagtcgcccaaggtgtcctcgaaggatacaagggagatcaagacagatttttccctgtctattagcaactcaagtgatgtgagcgccaaggataaacatgctgaagacaatgaaaagcgactagccgctctcgaggcgcgacagaaagccaaagaagttcagaagaaattggtgcataacgccctggcaaacttagacggccaccccgaagataagcctacacacatcatcttcggtagcgacagcgagtgcgaaacagaagaaacatctactcaggagcagagtcacccgggagaggaatgggtgaaagaaagcatggggaagacaagcggcaagttgttcgatagctccgacgatgacgagtccgactccgaggacgactccaatcgattcaagattaaacctcaatttgagggcagggcaggacaaaaacttatggatctgcagtcccattttgggactgacgaccgcttcagaatggattcaagattcctggaaacggatagtgaagaggagcaggaggaagttaatgagaagaaaaccgccgaggaggaggagctcgccgaagagaagaagaaggcgcttaacgttgtccagtctgtgctacagatcaatctgtccaattccaccaaccgtggctccgtagccgcaaaaaagtttaaggacattattcactacgatccaaccaaacaggaccacgccacctacgagcggaagcgggatgacaagccaaaggagagcaaggctaagagaaaaaaaaagcgggaggaggccgaaaagctcccagaggtttccaaagagatgtattataatatcgcaatggatctcaaggagatctttcagacaaccaagtacacctccgagaaggaagagggcactccatggaatgaagactgtgggaaagagaaaccagaagagatccaggacccggcagccttgactagcgacgccgagcagcccagcggctttacattcagcttcttcgattctgacacaaaagacatcaaagaggagacatacagagtggagacagtgaaacctggtaagattgtttggcaggaggatccccgactgcaagatagctcgagcgaagaggaggacgtgactgaggagacggaccatagaaactcctctcccggtgaagcatctttgctggagaaagagacaacacggttcttcttcttttccaaaaatgatgagcggctgcagggctcagatctgttctggagaggcgtcggatccaacatgtctagaaattcttgggaggctcgtacaactaacctgagaatggattgtcgaaaaaagcacaaagacgccaagaggaaaatgaaaccaaagtag

SEQ ID NO: 233280 - DNA, 438 bp, Artificial Sequence
  Description of Artificial Sequence: Synthetic coding sequence
atgaaggttaatcgcgagaccaaaaggctgtacgtcggtgggctgagtcaggatatcagcgaagctgacttgcagaaccagtttagccgctttggtgaggtttctgatgtagagattattacccggaaagacgaccagggcaacccgcagaaggtcttcgcctatattaatatctctgtggcagaagccgatcttaaaaaatgtatgtccgtgctgaacaagacaaagtggaaaggagggaccctgcagattcagctggccaaggagtcattcttacatcgcctggcccaggagcgggaagccgcaaaggcgaagaaggaagaatccacaacagggaacgccaatctcctcgaaaaaaccggaggggtggattttcacatgaaggcagtaccaggtacagaagttcctggtcacaagaattgggtcgttagcaaatag

SEQ ID NO: 233281 - DNA, 3504 bp, Artificial Sequence
  Description of Artificial Sequence: Synthetic coding sequence
atgaaggtaaacagagagacaaagagattgtatgtaggaggcctgagtcaagatatctctgaagcagaccttcagaaccagttttcgcgttttggagaggtttcagatgtcgagattatcacccgcaaggacgatcaggggaatccccaaaaagtgttcgcttacattaacatctctgttgcggaagcagatcttaagaaatgtatgtcggtgctgaacaagactaagtggaagggaggcacccttcagatccagctcgccaaggaatccttcttgcaccgattggctcaggagcgggaggcagcaaaggccaaaaaagaggaatctacgacaggaaatgccaatttgctagaaaaaaccggtggagtggactttcacatgaaagcagtgcctggcactgaggtgcctggccacaagaactgggtggttagcaagtttgggcgtgtccttccggtgttgcacctgaagaatcagcataagcggaaaataatcaagtacgacccatccaaatattgtcataatctgaagaagataggggaggatttctcgaacaccatcccaatttctagcctcacgtgggagctggaagggggtaatgacccaatgagcaagaagagacgcggtgaattttctgactttcacggacctcccaaaaaaatcattaaagtgcagaaagacgagtccagcaccggtagcctcgctatgtccacccggcctcggagggtcatagagagacctccgctgacccagcagcaagccgcacaaaaaaggacatgcgactcaataacaccctccaagtcctcccccgtgcccgtgtcggacacacagaaactcaagaatctgcctttcaaaacttcaggcctcgaaaccgccaaaaaacgaaacagtatcagtgatgacgataccgacagcgaggacgaactgcgcatgatgattgctaaagaagagaatttgcaaagaaccacacagccctctattaatgaaagtgaatctgatccatttgaagtggttcgcgatgatttcaagtcaggcgtgcataaactccacagtctgattggtttgggcatcaagaatcgagtgtcctgccacgattccgacgacgatattatgagaaacgatcgggagtatgattccggcgacacagatgaaataatcgcaatgaagaaaaatgtggccaaagtgaaaaactccaccgaattctctcagatggaaaagtccaccaagaaaacttccttcaaaaatagagagaactgtgaactgtcagaccactgcataaagctgcagaagagaaagagcaacgtagaaagcgcactctctcacggcctgaagtcactgaatagaaagtctccctctcactcttccagtagcgaagatgccgactccgccagcgaactcgccgattctgagggaggcgaggaatataacgcgatgatgaaaaattgcctgcgtgtgaatctaactctagccgacctcgaacagttggccggtagcgatttgaaagtcccaaacgaggacacaaaaagcgacggtccagagacgaccacacaatgtaagttcgaccggggaagcaagtcaccgaagacacccaccggcctgaggcgcggacgtcaatgtatccgcccagcagaaattgtcgcaagtctcctggagggcgaggagaatacctgcggcaaacagaaacccaaggagaacaacctcaagcccaagtttcaggcctttaaaggagtgggctgcctatacgagaaagagtcaatgaaaaagtcacttaaagattctgtcgcttccaataacaaagatcagaactccatgaaacacgaggacccatctataataagtatggaggatggttccccctatgtgaatgggtctctgggcgaagttacaccctgtcagcacgccaagaaagccaatggaccaaattatatacagccgcagaagcggcaaacaaccttcgagtcccaggataggaaagcagtgtcaccctcctcctcagaaaaacgcagcaagaatccgatttctagacccttagagggcaaaaagtccctgagcctgtctgcaaagactcataatattggctttgacaaagactcctgtcactccacaaccaagaccgaggcatctcaggaagaaaggagcgattctagtggcctcacatccctgaagaagtcaccgaaggtcagctccaaggacacacgggaaatcaaaacggacttttcactgtctatctctaatagtagcgacgtgagcgctaaggataagcatgcagaggataacgagaagaggctagctgctctcgaggctcgccagaaagctaaggaggttcagaagaaacttgtccataatgcactagcgaatctggacgggcaccctgaggataaacctactcacatcatattcggcagtgactctgagtgtgagaccgaggagacgtcaacacaggagcagtctcacccaggtgaggagtgggttaaggaaagcatgggtaagacctctggtaagctttttgattcgagtgacgacgatgaatccgactcagaagacgatagtaaccggtttaagattaaaccccaattcgagggcagggctggccagaaactgatggacctgcagagtcatttcgggacggacgaccgattcagaatggactcaagatttttagaaacagatagtgaggaagagcaggaggaagttaacgaaaagaaaacggcggaggaggaggagctcgccgaagagaagaagaaggccttgaatgtggtgcaaagcgtactccagattaaccttagcaatagcaccaaccggggtagcgtggcggctaaaaaattcaaagatattattcactacgatcccacaaagcaggatcacgccacgtacgagcgcaagagggacgataagcctaaggagtctaaggccaagaggaaaaagaaaagagaggaggcagaaaagttgccagaggtgtctaaagagatgtactacaatattgccatggacctgaaggagatttttcagactactaaatatacttcagagaaggaggaagggaccccttggaatgaggactgcggtaaagagaagccggaggaaattcaggaccctgccgcactcacctccgatgccgaacagcctagtggttttactttttctttcttcgattcagacaccaaagatatcaaagaggagacataccgtgttgagacggtcaagccaggtaagatcgtttggcaagaggacccacgccttcaagactcttcatccgaggaggaagacgtgacagaggaaacggaccacagaaatagcagccctggagaggccagcctcttggagaaagagacgactcgattcttcttttttagtaagaatgacgaaaggctgcaggggtccgacctattttggcggggagtggggtccaacatgtcgcggaactcttgggaggcccgaacaacaaatctcagaatggactgtaggaaaaagcataaagacgctaagcgcaaaatgaagcctaagtag

SEQ ID NO: 233282 - DNA, 261 bp, Artificial Sequence
  Description of Artificial Sequence: Synthetic coding sequence
atgaaagtgaaccgggagaccaagaggctgtacgttggcggactttctcaagatatctcagaggcggatttgcagaatcagttctctaggttcggggaggtcagtgacgtcgaaatcatcactagaaaagacgaccagggtaaccctcagaaagtgttcgcctacatcaatatcagcgtggctgaggctgaccttaaaaaatcaatcttccatgtgatccaaagggattcaagcgacgaggagaacagctccattgtttag

SEQ ID NO: 233283 - DNA, 3441 bp, Artificial Sequence
  Description of Artificial Sequence: Synthetic coding sequence
atggggcctgcaccggcaggtgaacagttgcggggtgccacaggagagcccgaggtcatggagcctgcgctcgaggggactggaaaagagggcaaaaaggctagcagccgaaaaaggaccctcgcagagccccctgccaagggccttctgcagccagtgaaactgagccgggctgagctgtacaaagagcctacaaacgaggaactgaatcggctgcgggaaacagagattttgtttcattcctctctacttcggttgcaggtggaagagttgctcaaagaggttcgactttccgaaaagaagaaggatcggattgacgcttttctccgggaagttaatcagagagtggttcgagtgccttcggtacctgagaccgagctgacagatcaggcttggcttccagccggagttcgcgtccccctccaccaggtcccctatgctgttaagggttgcttccggttcctgcctcccgcacaggtgaccgtggtcggctcatatctgctgggcacctgcattcggcctgatatcaatgtcgacgttgcgttaacaatgcctagggagattctccaggacaaggatggactgaatcagcgatatttccgaaagagggcactctacttggcccatctggcacaccacctggcccaggatccattgtttgggtccgtctgtttcagttacacaaatggctgccatttgaaaccctccctgttgttgcgaccgaggggcaaggacgagaggcttgtgactgtcagattacacccctgcccccctcccgatttctttcggccatgtcgcttactgccgactaaaaacaatgtcagatcagcctggtataggggtcagtccccagccggagatggaagtcccgaaccgcctacacccaggtacaacacctgggtgcttcaagatacggtgttggagtctcacctgcagcttctcagcaccattctttcaagtgcgcaagggctgaaggatggagtcgcactccttaaagtgtggctacgacagcgagagctggacaaaggtcaaggaggctttactgggtttctggttagtatgttggtggtgttcctggtgtctactcgcaaaatccataccaccatgtcaggctatcaggttctcagatctgtcctgcaatttcttgcaacaacagacctgacagtgaacgggataagtctgtgtctcagctccgacccctccctcccagcactggcagacttccaccaagccttcagtgtggtatttcttgactcatctgggcacttaaacctatgcgccgacgtgacagcctctacttatcaccaggtccagcatgaagccagactctcaatgatgctgttggatagtagggcagacgacggcttccacctcctgctaatgactcccaaacctatgatccgggctttcgatcacgtgctgcatcttagaccgctgtcccggctgcaggccgcatgtcaccggctgaaactgtggcccgagctccaggacaacgggggagactacgtgtctgccgcactgggtcccttgactacactgttggagcaaggcctcggcgcacgccttaacttgctcgcccatagcagacctcccgttcccgagtgggatattagccaggatccacctaagcacaaagactccgggaccctcaccctcggcctcttgctccggcctgagggtctcaccagtgtcctcgagcttggccctgaggcagaccagcccgaagccgctaagttccgtcagttctggggatctcgtagcgagcttaggagattccaggatggggctatacgggaagcagtggtgtgggaggcagcctcaatgtcccagaagagactgattccccatcaagtggtgacgcatcttttggccctccacgccgatatcccagaaacctgtgtacattacgtggggggaccccttgacgcactcatccagggcctgaaggagaccagctccacaggggaggaggcactggttgctgccgttcgatgttacgatgacctatcgagactactgtggggtcttgagggcctgccactgaccgtgtccgcggtccagggtgcgcaccctgtcctgcgttacaccgaagtatttccacctactccagtcaggcctgcattctcattctacgaaaccttgcgagagcgaagttctctcctgccaagactggacaaaccgtgtcccgcttatgtggaaccaatgaccgtggtctgccatcttgagggctccggtcagtggccccaggacgcggaagccgttcagagagtcagagctgcctttcagcttcgcctggccgaactgctgactcagcagcatggcctccagtgcagagcgacggcgacccacactgacgtactcaaagacggttttgtctttcggattcgggtggcgtaccagcgcgagcctcaaattcttaaggaggtacagtcccccgaggggatgatttctctgcgagataccgcagcttcccttcgattggagcgcgatactaggcagttacctcttctgacttcagccctgcacgggctgcagcagcagcatccagcatttagcggagtggccagactcgccaagcgctgggtcagagctcagttgctgggggagggcttcgctgacgagtccttggacctggttgctgccgctctgtttctccatcctgagccctttacgccgccttcatccccgcaggtcggtttcctccgctttttgtttctggtcagtacttttgattggaagaataaccctctgtttgtgaatctgaataatgaacttacagtggaggaacaggtggaaattcggtctggattcctcgcagctcgcgctcagctgccagtgatggtcatcgtcacacctcaggaccgaaagaatagcgtctggacacaggacggtccgagcgcccagatccttcagcaactggtagtgcttgcagccgaggcactgccaatgctggagaaacagcttatggatcctcgaggacccggagatatccggacagtgttcagacctccactcgatatctatgatgtcctcatcaggctgtcaccacgtcatatacctcgacacagacaggctgtggattctccagccgcttctttctgtcggggtctcctgtcccaaccaggccctagctccctcatgccggtcctcgggtacgacccccctcagctgtaccttacccagctcagggaggcctttggcgacctggccttgttcttctacgaccagcacgggggtgaagtgataggggtactgtggaagccgacttcatttcaaccccagcctttcaaggcgagttccacaaaaggacgcatggttatgtcacgagggggagagttagtcatggtacctaatgtcgaggctatcctggaggatttcgccgtcttgggagagggtctggttcagactgtagaggctcgcagcgagaggtggaccgtatag

SEQ ID NO: 233284 - DNA, 3024 bp, Artificial Sequence
  Description of Artificial Sequence: Synthetic coding sequence
atggggcctgcacccgctggtgaacaactgaggggagccaccggcgagccggaggtcatggaaccagccctggaggggaccgggaaggaaggcaagaaagcttcttcgcgcaagagaacacttgccgagcctccagctaaaggtctgctgcagcccgttaaactgtcacgagccgaattgtataaggagcctacaaatgaggagttgaacaggctgcgggagacggaaatcctgttccattcaagcctactccgacttcaggtggaagaactcctcaaggaggtgagactgtcagagaaaaaaaaggacaggattgacgctttccttcgcgaagtgaatcagcgggtggtgcgggtgccgagtgtcccagagacagagcttaccgaccaggcttggttgcctgcaggagtgcgagtgccattgcaccaggtaccttatgccgtgaagggttgctttcgcttcttaccaccagctcaggtgaccgtagttggatcctatttgttaggcacctgcattaggccggacataaacgttgatgttgcgctcaccatgccacgggagatccttcaggataaagacggattgaaccagcgctattttcgtaagagagcgttgtaccttgcacacttagcgcaccatctggcccaggatcctctctttggcagtgtgtgtttctcctacaccaatgggtgtcatctgaagccatccctcttacttagacccaggggtaaggatgagcgcctggtgactgtccgcctacatccctgcccccctcctgattttttcagaccctgtcggcttcttccaaccaagaataatgtcagatccgcttggtatcgagggcagtcccctgccggtgatggttctcctgaacctcccaccccgcgatacaatacgtgggtcttgcaggatacagtgctggagtcacatctgcaactgctgtcaaccatcctctcaagtgcacagggtcttaaggatggggtggccttgctgaaggtgtggctgcggcagcgcgaactcgacaagggccaggggggttttacaggttttcttgtctctatgctggtggtcttcttagttagcaccaggaaaatccacaccacaatgtccggctaccaagtcctgcgctctgtactccaattccttgccactactgacctgacagttaacggcattagtttatgtctgtcctccgatcctagcctacccgcattagcagactttcaccaggcttttagtgtggtgtttttggatagttccggccatttaaacctctgtgctgacgtaactgcctccacttatcaccaggtgcagcacgaggcacgactgtccatgatgctgttggattctcgggctgatgacgggttccacctcctgttgatgacacccaaacccatgatcagagcgttcgatcatgttttacacttacggcctctttcaaggctacaagccgcttgtcatagattaaagctctggcccgagttgcaagataatggaggggattacgtgtccgctgctctggggccactgacgaccctgctggagcagggcttgggcgcacgactgaacttgttagcccacagtagacccccagtgccagaatgggacatctctcaggatccgcctaagcacaaggactcaggtaccctgaccctcgggctcctgctgcgtcctgaaggtcttacgagcgtgttggagttgggccctgaagctgatcagcctgaggccgctaagtttcgccagttttgggggagtagatccgagttgcgtcggttccaggacggcgcaattagagaggctgttgtgtgggaggccgcaagcatgagtcagaagagactgataccacaccaggtggtgacacatcttctcgctttacacgcagatatacccgagacctgcgttcactacgtggggggtccgctggatgctctgatccagggtctgaaggagacatcaagcaccggggaagaggctctggtcgccgctgtccgatgctatgacgacctgagcaggctgctctggggcttggagggcctgcctttgactgtgtctgccgtccagggagctcatcccgttctgagatatactgaagtgttcccccctacccctgtccgacccgctttcagcttctatgagactcttagggagcgtagtagtctgctgccgagactagacaaaccatgtccagcctacgtggagcccatgaccgttgtctgccatctcgagggctcgggacagtggccacaggatgctgaagcagtccagagagtgagagcagctttccagttgcgcttagcagagctcctgacacagcagcatggactccagtgcagagcgaccgccacacataccgatgtcctcaaggatgggttcgttttcaggatccgagttgcctaccagcgcgagccgcagatcctcaaagaggtgcaaagccccgagggtatgatctcattacgagatacggctgctagtttaagattggaacgcgacacccgccagctgccccttctgacttccgcacttcacggcttgcagcaacagcatcccgcttttagcggggtggcacggctggctaagagatgggttcgagcacagttgctaggcgagggatttgccgatgaatcattagatctcgtggcagccgctctgtttctccatccagaaccttttacaccaccctcctctcctcaggttggatttctgcgcttcctgttcttagtgagtacatttgactggaaaaacaatccactgttcgtaaacctgaataatgaattgacggtggaggaacaggtcgagatacggagcggctttctggccgctagggcccagctgcctgtgatggttattgtcacaccgcaagaccgaaagaatagtgtctggacgcaggatggaccaagtgcacagattctgcagcagctcgttgtccttgccgctgaggccctccccatgttagaaaaacagctcatggatccacggggtcccggagatatcagatgggatccagctaaaatgtggccgttctag

SEQ ID NO: 233285 - DNA, 2100 bp, Artificial Sequence
  Description of Artificial Sequence: Synthetic coding sequence
atggggcctgcgccagccggagaacaactgcggggagcaactggggagccagaagtgatggagccggctctggagggcaccggtaaagaagggaagaaggcctctagtcggaagcggaccctagccgagcctcccgctaaggggctgctgcaaccggtgaaactgagccgggcagaactgtataaggagcccactaacgaagagctgaatcgcctcagagaaaccgagatcctgtttcattcttccctgttacgccttcaagttgaggagctgctgaaagaagtgaggttgtctgagaagaaaaaggatcggatcgacgcctttttgcgggaggtgaatcagcgcgtcgtaagggtcccttcagtgccggagacggaactaactgaccaggcttggttaccagccggagtgcgagtgccactacatcaggtgccgtacgccgtgaagggttgttttagatttctgccacctgctcaagttaccgtggtgggttcctatttactggggacttgtatcaggcctgatatcaatgtggatgtggcgctcacgatgcccagagaaatcctccaggacaaagatgggctcaatcagagatacttcagaaagcgagcactgtatttggctcatctggcacatcatttagctcaggatccactattcggaagcgtctgtttctcatataccaatggctgtcatcttaaaccttctctgctgctgcggccaagaggcaaggatgaaaggctggtgaccgtgcggctccatccctgccctcccccagattttttccgcccttgtcgtctgttgcccacaaagaataacgtgcgctcagcttggtatcggggtcaaagtccagctggcgacggctcccccgagccgccaacgccaaggtataacacatgggtgcttcaggatactgtgctcgaatctcatctccagctcttgagcaccatcttatcaagtgcccaggggctcaaggatggagttgcgctgctgaaggtgtggctgcgacagagagaactggataagggccagggcggttttacgggatttctggtgagcatgttagtggttttcctggtgagcactagaaaaattcacacgactatgagtgggtaccaggtgttgagatcggtactgcaattcttggccacgacggacttaacagttaacgggatcagtctgtgtctttccagcgatccctccttgcccgctctggccgactttcaccaggcattcagtgtcgtattcctggattcatcaggtcatctcaatttatgcgcagacgtgaccgcaagtacttatcatcaggttcagcatgaggccaggttatctatgatgcttctggatagccgggcagacgacggattccatcttctgctaatgactccaaagccaatgattcgggctttcgatcatgtgctccaccttcggccactcagtcgtcttcaagctgcttgtcatagactaaagctctggcccgagctccaggacaacggcggagactacgtttcagctgctcttgggcctctgacaacacttctcgaacaaggacttggcgctcggttaaacttattagcacatagtcggccaccagttcctgagtgggatataagtcaggacccgccaaaacacaaagactcagggacattgacattggggctgcttctgcgacctgagggcctgacttcagttttggagctgggaccagaagccgatcagccagaggccgcaaaatttcgtcagttttggggctctcggagtgagctgcgtcgctttcaggacggcgcaatcagagaggcggttgtgtgggaagcggcatccatgtcccagaagagactcataccacaccaggtagtgacccatttgctagccctccacgcggacatccccgagacctgcgtgcattacgtgggcggtcctttggacgccttaattcagggactgaaggaggctagctctaccaaaggacgaatggtaatgtcccgcggaggagagctggtgatggtacccaacgtggaagcaatcctcgaagacttcgccgtcctcggcgagggattggtccagactgtagaggctcgaagcgagcggtggaccgtctag

SEQ ID NO: 233286 - DNA, 603 bp, Artificial Sequence
  Description of Artificial Sequence: Synthetic coding sequence
atggtgatcgtcaccccacaggatcggaaaaactcggtgtggacccaggatggcccatcagcccagattttgcaacaattagtggtcttagcagctgaagcacttcccatgctggaaaagcaactcatggaccctcgtggtccaggcgatatcagaactgtgttcaggccaccactagacatttacgacgtgctgatccggctctctcccagacacatccccagacaccggcaagccgtggattcccccgcagcatcgttctgcaggggactactaagccagcctggacccagttcacttatgcctgtcctgggttacgaccctccacagctttacctgactcagctgcgcgaggcgttcggggatttggcactattcttctacgaccagcatggtggagaagtaatcggggtactgtggaagcccacctcattccaacctcagcctttcaaagcatcttccaccaagggcagaatggtcatgagcagaggtggcgagttagtgatggtgcccaacgtggaggccatcctcgaggactttgctgtcttaggtgagggcctggttcagacagtggaggcacgctctgaaaggtggacggtctag

SEQ ID NO: 233287 - DNA, 3072 bp, Artificial Sequence
  Description of Artificial Sequence: Synthetic coding sequence
atgggtcccgcacccgctggcgagcaattaagaggtgccactggcgagcccgaagtgatggagcccgcactggaaggaactggtaaagaaggtaagaaggctagttctaggaagaggacgctggccgagccaccagccaagggcttgctacaacccgtgaaactgtcccgcgcagagctttacaaggaacccactaatgaggaactcaaccggttgcgcgaaaccgagatcctgttccactcgtcgctccttagactgcaggtggaagaactcctcaaggaggtccggctgtcagagaagaaaaaggacaggattgacgcttttcttagagaggtgaaccagagagtggtgcgagtaccgagcgtgccagagaccgagttaactgatcaagcttggttgcctgccggtgtgagagtgcccctccaccaagtaccctacgcagtaaaaggctgcttccgcttcctgcctcccgctcaggtcacggtggtggggtcatacctgctcggcacctgcataagaccagatatcaacgtggatgtcgctctcactatgccaagagaaattctacaggacaaggacggcttgaatcagaggtactttcgtaagagagccttgtatttggcccacttagcgcaccatcttgcacaggaccctctgtttggcagcgtatgtttttcctatactaatggctgtcacctgaaacccagtttgctcctgaggccacggggaaaagacgagcgtttggtcaccgtcagactgcatccctgccctccacccgattttttcaggccttgtcggctactgccaaccaagaacaacgtgcggtctgcatggtacagaggacaatctcccgcaggcgatggctcgccagagcctcccacgcctcggtacaatacctgggtgttacaagacacagtcctggagagccacctccagctccttagtacaattctcagctcagcacaggggctgaaggatggggtggctctgctgaaagtgtggcttcggcaaagggagttggacaagggccagggaggtttcaccggttttctggtgagtatgctagtggtgtttctcgtaagtacccgaaaaatccacactactatgtcagggtaccaagtcctccgctccgtgttacaatttctcgccacaaccgacttaacagtgaacggaatctcactttgtctctccagtgacccgtcactgcctgcactggccgatttccatcaggccttctcagtggtgttcctggattcctccggacatttgaacctgtgtgccgacgtcacagcctccacgtaccaccaggtacagcacgaagccaggctgtccatgatgctgctggacagccgcgcagatgacggattccacctgctgcttatgacgcccaaacccatgattagggccttcgatcatgttcttcatcttcgccctctctcccgactacaggcagcctgccacaggctcaaattgtggccagagctgcaggacaacgggggtgactacgtgagtgctgccctggggcctctaaccactctgctagaacagggccttggcgctagactgaatctgttagcccactcccggccacctgttcccgaatgggatatctcccaggaccctccaaaacacaaagattccgggacattgactctgggactgctgctgagacctgaaggactcacatcagtgctggagctaggtccagaagctgatcagcctgaagcagctaaatttcggcagttttgggggtctagaagtgagcttcgaagattccaggacggggcaatcagagaagctgtggtttgggaagcggcttcaatgagtcagaaacgattaattcctcatcaggttgtcacccacttactggcactccacgcagacattcccgagacatgcgtgcactatgtaggtggccctctcgacgctctgattcagggcttaaaggaaactagcagtacaggcgaggaagctcttgtcgcagcagtgcgctgttacgatgatttgagccgcctcctatggggactggaaggcttgcctttgaccgtctctgccgtgcagggggctcacccggtactgagatacacggaggtgtttcctcccacacccgttagacctgcatttagcttttacgaaacgttgcgagagcgtagttccttgcttccacgtctcgacaaaccttgccccgcatacgtggagccgatgacagtcgtgtgtcaccttgagggctccgggcaatggccacaggatgccgaagctgtgcagcgcgtgcgcgctgcctttcaattgcgcctcgccgagttgttgactcaacagcacggcctgcagtgcagagcaaccgcaacccataccgacgtcctaaaagacgggttcgtgttccgtattcgcgttgcataccagcgcgagcctcagattttgaaggaggtccagtcgccagagggaatgatctctctgcgcgacacagctgcctctctgcgtcttgagcgcgacactcgccagttgcctcttctgactagcgccctccatggcctgcagcagcagcatccagccttctcgggggtggctagactggcgaagcgctgggtgagggcccagctgcttggtgaaggattcgccgacgagtcacttgacctcgtggctgccgctctttttctgcatccggagccattcacgcccccttcttcccctcaggtcgggtttctaagatttctttttctggtctccactttcgattggaagaataatcccctgtttgtgaaccttaataacgagcttaccgtggaggagcaggtcgaaatcaggtcaggatttttagcagcccgagcccagctgcctgtaatggtgatagttacgcctcaggataggaagaactccgtgtggacacaagacggcccttcagcacaaattttacagcaactggtcgtgctggcagcagaggcactcccaatgctggagaaacagctcatggatcctaggggccctggtgatattcgcatgggtccttctgaaaacgttgctctgctgtctcacataacggatactgagcagtggaagggggctatctgtgtgtag

SEQ ID NO: 233288 - DNA, 3285 bp, Artificial Sequence
  Description of Artificial Sequence: Synthetic coding sequence
atgggcccagccccagccggagagcagctccggggagctacaggagagccggaggtcatggaacccgcattggaaggaactgggaaagaagggaaaaaggcctcttcgcggaaacgcacactggcagaacctccggctaagggattgcttcagccagttaaacttagcagggcagaactatataaggagccaacaaacgaggagcttaatcgcctgcgggagaccgaaatcctgtttcactctagtcttctgcgtctccaggtcgaggagctgctgaaggaggtccgtcttagcgagaagaaaaaggataggatcgacgctttcttgagagaggttaaccagcgcgtggtgcgggtgcccagcgttcccgaaactgaggaaattctgcaagacaaagatggacttaaccagcggtactttcggaaaagagccctttatttagcccatctggcacatcacttagcacaagaccctctgttcggcagtgtctgctttagctacacgaacggctgccacctgaaaccttcactcttactgaggccaagagggaaggatgagagacttgtgactgtgagacttcacccttgtccgcctcccgacttttttagaccgtgtaggctcttacccacaaagaataatgtgcgctctgcgtggtaccgaggtcagagcccagctggtgatggttccccggaaccgcctacaccaagatacaatacatgggttcttcaggataccgtgctggaaagccacctgcagctgctctcaaccatcctgagttccgcgcagggtttaaaggatggcgtggctctgctgaaggtgtggcttaggcaacgggagttggacaaaggacagggcggtttcaccggtttccttgtttccatgcttgtcgtattcctggtctccaccagaaagatccacaccacaatgtcaggttatcaggtgctgcggtctgtgcttcagttcctcgctactaccgatcttacagttaacgggatttccctgtgtcttagcagcgatccaagtctccctgccctcgccgactttcaccaggcattctctgtggtatttctggactcttcaggacatctcaacctgtgtgcggacgtaactgcgtctacctaccaccaggggtggagtctgctgtggctgcaagtccaacacgaagcaagactctccatgatgctccttgacagtagggccgacgatgggtttcacctcctcttgatgaccccaaaacctatgattagagcttttgaccacgtcctccacctgagaccattgagcaggctgcaggctgcttgccaccggttaaaactatggcccgaactgcaggacaatggaggagattatgtgagcgcagccctgggcccactgaccaccctcttagagcagggcttgggcgctagacttaacttactggcccacagcaggcctccagttcccgaatgggacatttctcaggaccccccaaagcataaagacagtggcacccttacgctgggcctccttctccggcctgaaggattaaccagcgtgctcgagctggggcctgaagctgaccagcccgaggcggctaagtttcgtcagttttggggatccagatccgaactgcggaggttccaggacggcgctattcgagaggcggtggtatgggaagccgcttcaatgtcgcagaagcgactgattcctcaccaggttgttacacatttactggcactgcatgctgatatcccggaaacatgtgtccactatgtgggtggcccactcgacgccctgatccaaggactcaaggagacatcaagcactggggaagaggcgctggtcgcagcggtccggtgctacgatgatctttcacggctactctggggtctggagggtctgcctttgaccgtgtcagctgtccagggtgcccatcctgtccttaggtacactgaagtgttccccccaacacctgtgcgaccggctttttccttttacgaaactctccgcgagcggtcctcactactcccccgtctggataagccctgcccagcctatgtggaacctatgaccgtggtctgccatctcgagggcagcgggcaatggccccaagacgccgaggcagttcagagagtacgcgcagctttccagctaaggcttgctgagctcctcactcagcagcatggtttgcagtgtagggctaccgccacccacactgatgtcctgaaggatgggtttgtgttccgtatccgcgtggcttaccagcgagaaccccagattcttaaggaagttcagtctccggagggcatgattagtttgagggatacagccgcatcactgagactggaacgcgataccaggcaattacctctgctaacttccgctctgcacgggctccaacagcagcatcctgccttttctggcgtggcacggctagcgaaaagatgggtcagagctcagctcctcggtgagggcttcgctgacgagtctttagatttagtggctgccgctttattcttacatccagaaccttttacgccaccatctagccctcaggtagggttccttagatttctgtttctggtgtccacttttgactggaaaaataatccacttttcgtgaacctcaataatgaactgaccgtggaggaacaggttgagatccggagcggcttcctggcagcaagggcacagctcccagtcatggtaatcgttacaccacaggataggaagaattcggtttggacacaggatggcccttccgcccagatactgcagcagttggttgtgctggctgctgaggcccttccaatgctggaaaaacagctcatggacccaaggggacccggagacatccggacagtatttaggcccccattggatatctatgacgtgttgatacgcctttcccctaggcacatacctagacaccgacaggctgtggattcaccagctgcctcattctgcaggggtctactgtcccagcccggaccctccagcttgatgccagtgctggggtacgatcccccacagctgtacttaacacaattgcgggaggcctttggtgatctcgcactgtttttttacgatcagcacggcggagaagtgatcggggtcctttggaagccaacaagtttccaaccgcagccttttaaagcatcttccactaagggacgcatggtcatgagcagagggggagagttagtcatggtcccaaacgtggaggcaatcttggaggactttgcagtgcttggagaaggattagtccagactgtcgaggcacgatcggaacgatggacggtgtag

SEQ ID NO: 233289 - DNA, 2109 bp, Artificial Sequence
  Description of Artificial Sequence: Synthetic coding sequence
atgatgcttctggacagccgggcagatgatggattccacctactcttaatgacaccaaaacccatgatccgggctttcgaccacgtattgcatctacggccactgtcccgtttacaggccgcatgccacaggctgaaactgtggcctgagcttcaggacaacggaggcgactatgtcagcgccgcactggggccactcactacattgctggagcagggactcggggctaggctcaatctgctggctcactctcggccaccggtgcctgagtgggatatctcccaggacccaccaaagcacaaagacagtggcacgctcaccctcggcttgctcctgcgacccgagggactcacaagcgtgctggagctcgggcctgaagccgatcagccagaggcggctaaatttagacagttctgggggagtagatcagaactacggaggtttcaggacggggcaataagagaagctgtcgtgtgggaggccgcatctatgtctcagaaacgcctgatcccccatcaggtggtcacgcacttgctggcactccacgctgacattcccgaaacctgtgtgcattatgtgggtggtcccctggatgcattgatccaggggctcaaggagacatcatctactggagaggaagcattagtggcagcggtcagatgctacgacgatctgagcagactcctgtggggactcgagggattaccgttgactgtctccgccgtccagggtgcccaccctgtgcttcgttatacagaagtctttccacctacgcccgttagaccagccttttcattctatgaaacccttcgagaaaggtcatccctgttgcctaggttagataagccttgccccgcttatgttgagcctatgaccgttgtttgtcacctggagggctctggccaatggcctcaggacgccgaggcggttcagcgagtgcgagccgcattccagctccggttggcagagctgcttacgcaacagcacggcttgcagtgtcgagccacggcgacccacacagacgttttgaaggacggattcgtctttcgcattcgggtcgcgtatcagagagaaccacagatcctaaaggaagtccagagcccagaagggatgatcagtctcagagacaccgcggcttctctaagactagaacgagacacgcgccagcttcctctactgacttctgcactccatgggctgcaacagcagcatccagcgttctccggggtggcaagactagcgaagcggtgggtgagggctcagctcctgggcgaagggtttgctgatgaatcgttggacctcgttgctgccgctctgtttctacatcccgagcccttcactcctccttcaagcccgcaggtggggttcctccggttcctgtttctcgtgtcaacattcgattggaaaaacaatcctctcttcgtgaatcttaacaacgagttaacggttgaagagcaggtggaaattagatcagggttcctagctgcacgcgcacagctgccagttatggttatagtaaccccacaagaccgcaagaatagtgtgtggacgcaggacggcccatctgcccagatactccagcaactggttgttttagccgcagaggccttaccgatgctggagaaacagttgatggatcctcgcggaccgggtgatatccggaccgtgttcaggcctcctctggacatctacgatgtgctcatccgcctgagtcccaggcacatccccaggcatagacaggccgtcgactctcccgctgcatccttctgccggggattattgtcacagccgggtcctagcagcctcatgcccgtgctgggatacgatccccctcagctttacttaacgcagttgagagaggcattcggggacctggctctgtttttttatgatcaacacgggggagaagtgataggcgtactgtggaagcccaccagcttccagccccagccattcaaagcatcttccaccaagggcaggatggtcatgagcagaggtggcgaactggtcatggtgcccaacgtcgaggccatcctggaagactttgcagtcctgggagaaggcctcgtgcagactgtcgaagctaggtctgaaagatggaccgtctag

SEQ ID NO: 233290 - DNA, 645 bp, Artificial Sequence
  Description of Artificial Sequence: Synthetic coding sequence
atgaacctgtccagcgccagcagcactgaggaaaaagccgtcaccacggtcctgtggggttgcgagctgagccaggaacgcagaacctggacttttcggcctcaactcgaagggaagcagtcctgtcgcctgctactgcacaccatctgcttgggcgagaaggcaaaagaagagatgcaccgagtggaaattttaccaccagccaatcaggaggataagaagatgcaaccagtgacaatagccagcctccaggcctccgttttgccaatggtgagcatggtcggtgtacagctgtctcctccggtcactttccagctgcgcgcaggatcaggacctgtattcctgtcaggtcaggaaaggtacgaagcaagcgatttgacgtgggaagaagaagaggaagaagaaggcgaagaagaagaggaggaggaggaagatgatgaagatgaggacgcggacattagcctggaagagcagtctcccgtgaaacaggtcaagaggctggtgccacagaagcaggctagcgtcgcaaaaaagaagaaattagagaaagaggaggaggaaatccgggcaagcgtccgcgacaaaagcccagttaagaaggctaaggccactgccagagctaaaaaaccaggcttcaaaaagtag

SEQ ID NO: 233291 - DNA, 411 bp, Artificial Sequence
  Description of Artificial Sequence: Synthetic coding sequence
atgaatctctcttcagcatctagcactgaagagaaagccgtaactaccgtgctgtggggttgtgagctgtcacaagaaagacggacctggacctttcggccacagctagaggggaaacagagctgtcgcttactgctgcatactatttgcctcggcgagaaggctaaagaggagatgcaccgcgtagaaatccttccccctgccaatcaggaagataagaagatgcagcctgtaactatagccagtctgcaagcctctgttctgcctatggtatccatggtcggagtccagctatccccaccagtcacctttcagctaagggctgggagtggacccgtttttctctcaggccaggagagatatgagaaaaaggctggaaaaagacgtcggggtaacaagagtcagaggtag

SEQ ID NO: 233292 - DNA, 645 bp, Artificial Sequence
  Description of Artificial Sequence: Synthetic coding sequence
atgaatctaagttccgcctcctccaccgaagagaaggccgtgacaaccgtgctgtggggatgcgaactctctcaggagcgcaggacatggacctttcggccacagctggagggtaagcagagctgtaggctgctgctgcacactatctgcttgggagagaaagctaaggaggaaatgcaccgcgtggaaatcctgcccccagcaaaccaagaagacaagaagatgcagcctgtgaccatagcaagcctccaggcctcagtcctgcccatggtgagtatggtgggggttcaactgagcccacccgttaccttccaactgagggctggtagcggccctgtgttcctgtccgggcaggagaggtacgaggcctcagacctgacatgggaggaggaggaagaggaggaaggagaggaggaagaagaagaggaagaggatgatgaggacgaagatgctgatatctccctagaagaacagagccccgtgaaacaggttaaaaggctggtcccccagaagcaggcgtcggtagcaaaaaagaagaagctagagaaggaagaagaagagatacgcgctagcgttcgggataagtcccctgttaagaaggccaaggccactgcccgagccaagaaacctggttttaagaaatag

SEQ ID NO: 233293 - DNA, 645 bp, Artificial Sequence
  Description of Artificial Sequence: Synthetic coding sequence
atgaaccttagtagtgcctcatctacagaggagaaagcggtcacgaccgtgctgtggggctgtgagctgagtcaggaaagacggacatggacatttaggccacagttggaagggaagcaaagttgccgactcttgttgcatactatttgccttggagaaaaggccaaggaagagatgcaccgcgttgagattcttcccccagcaaaccaggaagacaagaagatgcagccggttaccatagctagtctacaggccagcgtactgccaatggtgagtatggttggagtgcagctatcaccacccgttactttccaactgagggcaggcagcggaccagtgtttctgagtggccaggagaggtacgaagcttctgatctcacctgggaggaagaggaggaagaggagggcgaggaagaagaggaagaagaagaagatgatgaggacgaggatgctgacatatccctggaggagcaaagccccgttaaacaagtgaagcgacttgtgccccagaaacaggcctcagtcgccaagaagaagaaactggagaaagaagaagaggaaattcgagcttcagtgcgtgacaagtcccccgttaagaaggccaaggccactgctcgtgctaagaaaccaggcttcaagaaatag

SEQ ID NO: 233294 - DNA, 645 bp, Artificial Sequence
  Description of Artificial Sequence: Synthetic coding sequence
atgaatctctcatctgcatcctccacggaggagaaggccgtgacaacagtactctggggatgtgagctgagtcaagaacggcgaacctggacattccgcccacagctagagggcaagcagagctgtcggttgctcctgcatactatttgcctcggggagaaggccaaagaagagatgcaccgagtggaaatcttaccgcctgcaaaccaagaggacaagaaaatgcaacctgtaacaattgcttctctgcaggcttccgtgctccccatggtcagcatggtgggggtacagctttctccacccgtgacatttcagttgcgcgctggatctggaccagtctttctgagtgggcaggagcgatacgaagcgtctgacttgacttgggaggaagaagaggaagaagaaggcgaagaggaagaagaagaggaagaagacgacgaagatgaggacgcagacatatccttggaggaacagagcccagtgaaacaggttaaaagactcgttcctcagaagcaggcctccgtcgccaagaaaaagaagctggagaaagaggaagaagagattagagcatcagtacgggataagtctccggttaaaaaggcgaaagcaactgcccgtgcgaagaagcctggtttcaagaagtag

SEQ ID NO: 233295 - DNA, 537 bp, Artificial Sequence
  Description of Artificial Sequence: Synthetic coding sequence
atggccgctgggaccgcagcggctctggctttcctgagccaggagagcagaacccgcgcagggggagttggaggactcagggtgccggctcccgtgactatggactcttttttttttggctgtgaactgagtggccacacaaggtctttcactttcaaggttgaggaagaggatgatgcagaacacgttctggcattaactatgttgtgcttaacagagggagctaaagacgagtgtaatgtggttgaagttgttgcacgcaaccatgatcaccaggagatcgccgtaccggtcgctaacctcaaacttagctgccagccgatgctgtccctcgacgacttccagctgcagcccccagttaccttccgactaaaaagcggctcaggtcctgtgaggatcacaggtaggcatcagattgtgaccatgtcaaacgacgtgtccgaggaggaatccgaagaggaggaggaagacagcgatgaagaagaggtagaactgtgtccaatcctccccgcaaaaaagcaggggggtcgtccttag

SEQ ID NO: 233296 - DNA, 501 bp, Artificial Sequence
  Description of Artificial Sequence: Synthetic coding sequence
atgaagtatacaagctatattctggcctttcagctgtgtattgtgctggggtcattgggctgctactgtcaagatccttacgtgaaggaggctgagaacctgaagaaatatttcaacgctgggcacagcgatgttgccgacaacggcacgctcttcctgggaattttgaaaaactggaaggaagaatccgaccgaaagattatgcaatcacagattgtgagtttctacttcaagttgtttaaaaacttcaaagacgatcagtcaattcagaaatctgttgaaacaatcaaagaggacatgaatgtcaaattctttaattctaataaaaagaaacgggatgatttcgagaaactcacaaactattcagtgaccgacttgaacgtgcagagaaaggctatccatgagctgatccaggtcatggccgaattaagccccgcagctaaaaccggcaagcgtaagagaagccagatgctattcagaggcagaagggcgtctcagtag

SEQ ID NO: 233297 - DNA, 2061 bp, Artificial Sequence
  Description of Artificial Sequence: Synthetic coding sequence
atgagcatgttctccgattttcttcagtcctttctgaagcactcatcctcaacagtcttcgacctggtggaggaatacgagaatatctgcggctctcaggtcaatattctttccaaaatcgtaagccgtgcaactcctggactgcagaagttttccaagaccgccagcatgttgtggctcctgcagcaggagatggtcacttggaggctgcttgcgtctctgtacagggatcgcattcagtctgcacttgaggaggaatccgtgttcgctgtgactgctgtgaatgctagcgagaaaacagtggtcgaggcactgtttcaacgtgatagtctggtgagacagtctcaactggtcgtcgactggttagagagtattgccaaagatgaaattggggagttcagtgacaatatagagttctacgccaagtcggtctattgggaaaatacccttcacaccctgaaacagagacagctcactagttatgttggatctgtaaggcccctggtgactgagctagatcctgacgcccctatccgccagaagatgcccctggacgacctagaccgtgaggacgaagtcaggctgttgaagtacttgttcactctgatccgcgcagggatgaccgaagaagcacaacggctctgtaagcgctgcgggcaagcctggagagcagccacacttgagggatggaagctgtaccatgacccaaacgtcaacggaggtaccgaacttgagcctgtggaaggaaacccataccgacgcatctggaaaatcagctgctggcgaatggctgaggatgagctgttcaataggtacgaacgcgcaatctacgccgcactgagcggcaatctgaagcagcttctacctgtgtgcgatacctgggaggacacagtgtgggcatatttccgggtcatggtagactcgctggtggagcaggagattcaaacctcagtggctaccctggatgaaacggaagagctgcctcgggagtacttaggggcaaactggactctggagaaggtgtttgaagagctgcaggccacggacaagaaaagggtactcgaggagaaccaggaacattaccacatagtccagaagttcctcattttgggggatatcgacgggttaatggatgagttctcaaagtggctgtctaagagcagaaacaatctccctggtcaccttttacggttcatgacacacctcatcctgttcttccgaaccctcggcttgcagacaaaggaggaagtaagtattgaagtactgaagacttacattcaggaggatagattaaagattgacgtcatcgattggctggtgttcgaccctgcccagagagcagaggctctgaagcagggcaatgcaataatgcgtaaattcctcgcatctaagaaacatgaagcggctaaagaagtgtttgtcaagattccacaggatagtatcgcagagatatacaatcagtgtgaggagcagggtatggagtctcctctgcctgcagaggacgacaacgcaattagggagcacttatgtatccgagcctacctggaagcacacgaaacttttaacgagtggtttaagcacatgaatagcgtgcctcagaagcccgcattaattccacagccgacctttacggagaaggttgcgcatgagcataaagagaaaaagtatgagatggattttggaatttggaaaggtcacttagacgccctcactgccgatgtcaaggagaagatgtataacgtcttactgttcgtggacggcggttggatggtcgacgtcagagaggacgctaaggaggaccacgagcgcacccatcagatggtgcttctccggaaattgtgtctgcctatgctttgcttcctactgcatactatcctgcacagcactggtcagtaccaagaatgtcttcagttggcagacatggtgtcaagcgagcgacacaaactctacttggtctttagcaaggaggaacttcgaaaactgctccagaaattgagagagtcatctctgatgttgctagatcagggactagacccgcttggatatgaaattcagctgtag

SEQ ID NO: 233298 - DNA, 2691 bp, Artificial Sequence
  Description of Artificial Sequence: Synthetic coding sequence
atgaaaattctcgtgatcttgcatcaagagaccaggctgtctttggagctgttggcccacttcgactctctggtccttagcaccaacctcctgtttatagttactccaacaagccggtcgctgctgcggcagcctgacatctcatgtattctaggtacaggaggaaaaagtcccaggcttactcagtcctccggatttttcgggaacctgtctatggtgacgaacttggacgatagtaattgggcggctgccttttcctcacagagatccggattgtttaccaacaccgagccccactccatcacagaagacgttactatcagtgctgtgatgctgagagaagacgaccccggagaagctgcttcaatgtccatgttcagtgactttttgcagtcttttcttaaacactcatcctctaccgtatttgatctggtggaggagtatgaaaatatctgcgggagtcaggtcaatatcctctctaaaatagtgtctcgggcaacaccaggcctgcaaaagttttctaaaacagctagtatgttatggctccttcaacaagagatggttacttggaggctgctcgccagtctgtacagggataggattcagtctgctttggaagaagagagcgtcttcgccgttaccgcagtgaatgcctctgagaagaccgttgtggaggccttattccagagggacagcctggtccgccagtcccagctcgtcgttgattggctcgagtctatagctaaggacgagatcggcgaattctctgacaacatcgaattttacgccaagagcgtgtactgggagaacacgctgcatacattaaagcagcgacaactaacctcctacgtggggtcagtgcgcccactggtgaccgagcttgatcctgacgctcccatccggcaaaagatgcccctcgacgacttggatagggaggacgaggtaaggctcctgaaatacctgtttaccctcattcgtgctggtatgaccgaagaggcgcagaggctgtgcaagagatgtgggcaagcctggcgagccgctacgctggaagggtggaaactgtaccatgaccccaatgtgaacggcggaaccgagttggagcccgtcgagggcaacccatatcggaggatctggaaaatttcatgttggaggatggcagaggacgagctcttcaacagatacgagcgggctatctacgcagccctatccggaaatttgaaacagttactgcctgtgtgcgacacatgggaggacaccgtatgggcttactttcgtgtcatggtcgatagtctggtcgagcaggaaatccagacgtccgtggccactctcgacgaaacagaggagctgccacgggagtatttaggcgctaactggacgctggagaaggtgtttgaagagctgcaggccacagacaaaaaacgggtgctggaggagaatcaggagcattatcatatcgtgcagaagttcctgatactgggggacatcgatgggctgatggacgagttcagtaagtggctgtcaaagtccaggaacaacttacccggacatctcctgcggttcatgacacatctgatcctcttctttcgcactttgggtttgcagaccaaggaagaagtgtccattgaggtattgaaaacctacatccagctactgatccgagagaagcacaccaatctgattgcattctacacctgccacttaccacaggatctggccgttgcccaatacgccctcttcctggagtctgtgaccgaattcgagcagcggcatcactgtctagaattggctaaggaggctgatctggacgtggccacgattaccaaaacggtggtagaaaacatccgaaaaaaggacaatggagagttttcccatcacgacctggccccagctttggatacaggaacaaccgaggaggatcggctcaaaatagatgtcatcgactggctagtttttgatccagcacagagggctgaagcgttaaaacagggcaatgcaataatgcgcaagtttttggcgtccaaaaagcacgaagcagccaaagaagtatttgtcaaaattcctcaggacagtatcgcggaaatttacaaccagtgcgaggagcaagggatggagtccccgttgccagccgaggatgacaacgctatacgagaacacctttgcatccgagcatacttggaagcccacgaaaccttcaacgagtggttcaagcacatgaacagtgtgccgcagaaaccagctctgatcccacagcctacattcactgaaaaggtcgcccacgagcacaaggagaaaaagtatgagatggatttcgggatctggaaggggcacttagacgcgctcacagccgacgtgaaggagaagatgtacaatgtgcttctctttgtggacggaggctggatggtagacgttcgggaggatgctaaggaggaccatgaacggactcaccaaatggtcctgttacggaagctatgtctccctatgttgtgtttcctgttacacacgatcctgcacagcactgggcagtatcaggagtgtctgcagctcgccgatatggtatcctccgaacgacacaagctgtaccttgtgttcagcaaagaggagctccggaaactcctccagaagcttcgcgagtcaagtctgatgctcctcgatcagggtttggaccccctggggtatgagatccagctttag

SEQ ID NO: 233299 - DNA, 3471 bp, Artificial Sequence
  Description of Artificial Sequence: Synthetic coding sequence
atgttccccgctgccccaagcccacgtacaccaggcaccggaagtaggagaggtccactcgccggactcgggccagggtccactcctaggacggccagcagaaaagggctgccactaggttctgctgttagctcgcccgtgttattcagccctgtcggcaggcgctcatccctttcctctcgcggaacccccacccgtatgttcccacaccactcaatcaccgagtccgtaaactacgacgtcaaaacctttggctcaagcctgcctgtgaaagtcatggaagcgcttacactggccgaagttgacgatcaattaactataaacatcgacgagggcggatgggcatgcctggtctgcaaggaaaaactaatcatttggaagattgcgttatcgcccatcaccaaactctctgtctgtaaagagcttcagctccctccaagcgattttcactggtcagccgatttggtggcactgtcatattcttcaccctctggggaggcccattctacacaggcagttgcggtaatggttgccacaagagagggctccatacgatactggccaagcctggccggagaagatacatacacagaggctttcgtagactcagggggagataagacctatagctttctcaccgctgtgcaaggtgggtccttcatcctctcttcttccggctctcagcttatccgcctcatccctgagtcaagcggcaagatccatcaacacatcttgccacaggggcagggtatgctgagcggcattggccgtaaagtaagctccctctttggaattttgtcaccgagctctgacctgaccctgtccagtgtcctgtgggaccgtgaacgcagctccttctactccctgacaagcagcaatatcagtaagtgggagctcgatgattcttctgaaaagcatgcctacagctgggacatcaatcgggcactcaaagagaacatcaccgatgcaatatggggctcagagtcaaactacgaggccattaaagaaggtgtgaacattaggtatctggatctgaagcaaaactgcgacgggctggtgatcctcgctgctgcctggcactcagctgacaacccttgcttgatttattactcacttatcaccattgaagacaacggctgccagatgtccgatgctgtgaccgtggaggtgactcaatacaacccgccattccagtcagaggatctgatactgtgccagctcaccgtccccaattttagtaatcagaccgcgtacctctataatgaatccgcagtatacgtatgctccactggaacaggcaagttttccctcccccaggaaaagattgtcttcaacgcacaaggcgacagtgtcttaggagctggggcttgcggaggggttcctatcattttctcgcggaatagcggactcgtgagcatcacctcacgcgaaaacgttagcattttggccgaggatttggagggcagccttgcatcttctgtggccggtcctaactctgaatcaatgattttcgaaaccacaacaaaaaacgagactattgcacaggaggacaaaatcaagctgcttaaggcggctttcttgcaatactgtcggaaagatctcggtcacgcacagatggtggtggacgaactcttctcctcacattctgatctcgattcggatagcgaacttgacagggcggtgacccagatttcagtcgatctgatggacgattacccagcaagtgacccccgatgggccgagtctgtgccggaggaagctccaggattctccaacacttctctaatcatcctgcaccaactcgaggataaaatgaaggctcactcctttcttatggatttcattcaccaggttggactgttcggacgtttgggaagtttccccgtgaggggcacccctatggccacgcgcctgctcctatgcgagcacgcggagaaacttagcgccgctattgtgcttaagaatcatcattctaggctgagcgaccttgttaataccgccatcctgatcgccctaaacaagcgtgagtacgagataccgtcaaatttaacacctgccgatgtcttttttcgcgaggtgagccaagtggataccatttgtgagtgcctgctggagcatgaggagcaggtacttcgcgacgcccctatggatagtattgaatgggccgaagtcgtcataaatgtgaacaatatcctaaaggatatgctgcaggccgcatctcactataggcaaaaccgcaactccttgtacaggcgcgaggaatctctcgaaaaagagcccgaatacgtcccgtggactgctacatctggaccaggcggaatccgtactgtgatcattcgccaacacgaaatagtgctcaaggtcgcttatccacaagccgatagtaacttaagaaatattgttacagaacagcttgtggccctgattgactgttttcttgacggatacgtgtcccagctgaagtcggttgacaagtcttcaaatcgggaacggtacgataatctggaaatggaatatctgcagaagcgaagcgacttactctctcccctcttgtccctgggccaatacttgtgggccgcaagtctggcagaaaaatattgtgacttcgacatattagtccagatgtgtgagcaaaccgacaaccaatccaggctgcagaggtatatgactcagttcgctgatcagaatttctcagatttcctcttcaggtggtacctggagaagggaaaaaggggcaagttgctatctcaaccaatttcccagcatggtcaactggctaattttctgcaggcgcacgagcatctctcctggctacacgagatcaacagccaggaactggaaaaggcccatgccacactgttaggtttggctaacatggaaacgcggtactttgcaaagaagaagaccctcctgggcctttctaaactggctgcactcgctagcgacttttcggaggatatgctacaggaaaagattgaggagatggcagaacaagagagatttctactgcaccaggagacactgcctgaacagctgttggcggagaaacagcttaacctttcggccatgcctgtgctaacagccccacagttaatcggactctatatttgtgaggaaaatcgtagggctaacgaatacgacttcaaaaaagctctggatctgctcgaatacatagacgaggaggaagacatcaacataaatgaccttaaactcgaaatcctctgtaaggcactgcagcgggacaattggtcttctagcgatggcaaggacgaccctatagaagtatctaaggactctatattcgtcaagattcttcagaaactccttaaggacgggattcagctttctgagtatttgccagaggtgaaagatttgctccaggccgaccagctgggaagtctcaagagcaatccgtattttgaatttgtgttaaaagccaactacgagtattatgtgcaggggcagatttag

SEQ ID NO: 233300 - DNA, 675 bp, Artificial Sequence
  Description of Artificial Sequence: Synthetic coding sequence
atgttccccgctgcaccctcaccacggactcccggaactggatcccgcagagggcctttggccggtctgggacccggaagtaccccacggactgcttcaagaaaaggactacccctgggttcagccgtcagctctccagtgctgttcagtcccgtgggaagaagaagttcactgtctagtagggggactcctacccggatgtttcctcatcacagtatcaccgaatccgtgaactacgacgttaagaccttcgggtcatccctgcctgtcaaagtgatggaggccctgaccctggccgaagtggacgaccagctgacaattaatatcgatgagggcggatgggcttgcctggtgtgcaaggagaagctgattatatggaaaatcgccctgtcgccaataactaagctaagcgtgtgcaaggagctacaattaccacctagtgacttccattggtctgcagacttggtggcgttgtcatatagcagcccctccggtgaggcccattctacacaggcagtggcagttatggttgcaaccagggaaggaagtatcaggtactggccgtctctagccggagaggacacctacactgaggcttttgtggactccggaggggataaaacctattcatttctgaccgcggtgcaggtgcacaaagaaacaaagtcaggctag

SEQ ID NO: 233301 - DNA, 3207 bp, Artificial Sequence
  Description of Artificial Sequence: Synthetic coding sequence
atgttccctgccgcaccttcgcccagaacccctggtaccggttctaggcgtggcccactggcgggactcggccctggatcaaccccgagaacagcctcacggaaaggtctgccacttgggtctgccgtatcaagcccggtgctgtttagccccgtggggaggaggtcgagcctgtcatccaggggcaccccaacccggatgttcccccatcattctatcacagagtctgtgaactacgacgtgaaaacattcgggagttcactcccagttaaggttatggaagccctcacacttgccgaggtggacgatcagctgacaataaatatcgacgagggtggatgggcctgccttgtgtgtaaggagaaattgattatttggaaaattgccctctccccaataacgaaactgtcagtgtgtaaggaattgcaacttcccccttctgacttccactggtccgccgacctggtcgccctcagctactcatcaccatcaggagaagctcatagtacccaggccgtggccgtgatggtcgcaacgcgcgaaggatcgatcaggtactggccgagccttgctggggaagatacctatacagaggcttttgtggactccgggggagataagacttattcttttttaactgccgtgcagggtgggtctttcatcctgagtagcagcggctcccaactgattcgcctgattcccgagagttctggaaaaatacatcagcacattctgccgcagggacagggaatgctcagcggtattggacgtaaggtttcttcgctgtttggtattcttagtccctcgagtgacctcacattaagctcggttctgtgggatcgagaaagaagctccttttattcgctgacatcgagcaatattagtaagtgggaactggacgacagtagcgaaaaacacgcctatagctgggatatcaaccgggctctgaaggagaatatcaccgacgcaatctggggcagcgaaagtaattatgaagctataaaagaaggcgtcaacattcggtaccttgatctcaaacagaattgcgacggactggtcattcttgccgcagcctggcatagcgccgataacccatgcctcatctattactcacttatcacaatagaagacaacggctgccaaatgagcgacgccgtgacagttgaagtcacccagtataatcccccattccagagcgaggatctgatactttgtcaactgactgtgccgaattttagcaatcagaccgcatatctgtataatgagtccgccgtttatgtgtgctccacaggtaccggcaaattttcactgccccaggaaaaaatagtctttaacgcccagggcgactccgttctgggggctggcgcatgtgggggtgtgcctatcatcttcagtcgcaatagcggcctcgtaagcataacatccagggaaaatgtaagcattctggccgaagacctggagggatcgctagcttctagcgtagccggacctaacagtgagagtatgatcttcgaaacaacaactaagaacgagacgatcgcgcaggaggataagattaagctcctaaaggccgcttttctgcaatattgtcgtaaggatctggggcatgcacagatggtggtcgacgaactcttttcaagtcacagcgacttggacagcgactccgagctggatagagctgtcacacagatctccgtcgacctgatggacgattacccagcctctgacccccgatgggcagaaagcgtgccagaggaagcaccgggatttagcaacacctcgttaatcattctgcatcagctcgaggacaagatgaaggctcatagcttcctgatggactttatccaccaggtaggtcttttcggccgtctgggaagtttccccgtacgcggaactcccatggcaacccgccttctgctttgcgagcacgctgagaagctgagcgccgctatcgtgctaaagaaccaccattctcggctgagtgatcttgtaaatactgctatattgattgcccttaataagcgggagtatgagataccctccaatctgacgccagccgacgttttttttcgcgaggtgtcccaggtagataccatttgtgagtgcctcttggaacacgaggagcaggtgctaagggacgctcctatggattcaatcgaatgggcagaagtggttattaatgtgaacaatatcttaaaggatatgctccaggccgcatcacattaccgacaaaatagaaactcattgtaccggagggaggaatctctggagaaggaaccagagtacgtgccatggaccgctacctcaggtcctggcggaatcagaacagtaatcatcaggcagcatgagattgtcctgaaagtcgcgtacccgcaagctgattctaacctcaggaacatcgtgactgagcagctcgtcgccttgattgactgcttcctcgacggatatgtcagtcagctcaagagcgttgacaagagctcgaatcgcgagaggtacgacaacctcgaaaaaggaaagaggggtaagcttttgtctcagcccatttcccagcatggacagctcgcaaacttcctgcaagctcatgaacatctgagctggctgcacgaaataaattcacaggaattggaaaaggcgcacgctacactgctgggattggccaacatggaaaccaggtatttcgcgaaaaagaagaccctccttggcctgagtaagctcgccgctctggcatccgacttcagcgaggacatgctgcaagagaaaattgaggagatggcagagcaagagaggttcctactgcaccaagagacgctacccgaacagctcctggctgagaaacagctgaacctttctgcgatgccagtgctgaccgcaccccagctcatcggcctgtatatctgtgaagagaatagaagagccaatgaatacgatttcaaaaaggctctagatctactggaatatatcgatgaagaggaggacataaacattaacgatttgaaacttgagatactatgcaaagcacttcagagagataattggtcctcttctgatgggaaggacgatcccattgaggtgtccaaagattccatttttgtaaaaatattacagaagttgctgaaagacggcatacagttgagcgaatatttacctgaagttaaagatctgttgcaggcagatcagctcggaagtatcaacgtcaatttttgttag

SEQ ID NO: 233302 - DNA, 3258 bp, Artificial Sequence
  Description of Artificial Sequence: Synthetic coding sequence
atgtttcccgctgcccctagtcccagaaccccaggcacaggatccagacggggacctcttgctggactgggtcctggatctaccccaagaacagctagtcgaaagggcttgcctctcggatctgccgtcagttctcctgtgctgttctctccggtgggcagacgcagctccctgtcaagcagaggtactcccacccgcatgttccctcaccactcaatcactgaatcagtgaactacgacgtcaagacatttggttcttcactgccagtgaaggtcatggaggctctcaccctcgccgaggtagatgatcaactgaccattaatattgacgagggcggatgggcgtgcttggtgtgcaaggaaaagctaattatctggaagattgccttatctccaatcaccaagttgagcgtgtgcaaggaattgcagttacccccaagtgatttccattggtccgccgatttggtggctctttcatattcatccccatccggggaagcccactccacacaggccgtggccgtcatggttgccactagagagggtagtatccgctactggccaagcctcgccggtgaagatacctacacagaagcgtttgtggacagcggcggagacaagacctatagcttcctcacagccgttcaggggggttcgttcatcctcagctcaagtgggtcccaattaatacgattaatcccagagagcagcgggaaaattcaccagcacatcctcccccaaggacagggtatgctttcaggtatcggcaggaaggtatcctccctctttgggatcttaagtccatcctcggaccttactctgtccagcgtgctatgggaccgcgaacggagctccttctactccctcacgtcctcaaacatatccaagtgggaactcgacgattcaagtgaaaaacacgcctactcctgggacataaaccgcgcactcaaggagaatatcacagatgctatctggggcagtgaatcaaattacgaggctatcaaggaaggcgtgaatataaggtacctcgacctcaaacagaactgcgacggtctggtgatcctggcagccgcttggcacagcgcggataacccttgcctgatctattactccctgatcacgatagaggataacggctgccagatgagtgacgcagtgacagtagaggtgacccagtataaccccccattccaaagcgaggacttaatcctctgtcaattaacagtgcccaacttctccaatcaaacggcctacctgtataacgaatctgccgtgtacgtgtgctccaccggaactggcaagttctccctgccacaagagaagatcgtgttcaacgcacagggggattctgtgcttggagccggtgcctgtggcggagtccctatcatattttcaaggaattctggcctggtgtcaattacgagcagggagaacgtgagcatccttgccgaggacctggagggtagtcttgcctcttcagtggcagggccaaacagcgaaagtatgatttttgaaactacaaccaagaacgagactatagctcaggaggataagattaagctgcttaaagccgcttttttacagtattgtcgaaaggacctcgggcacgctcagatggtggtggacgagctgttttcttcacacagcgacctggattcagactctgaattggaccgagcggtgactcaaattagcgtcgacctgatggatgattatccagcttcggatcctcgatgggctgaatccgtcccagaagaagcacccggtttttctaacacttccctcattatcctccatcagttagaagataaaatgaaggcacactcattcttgatggactttatacatcaggtagggctattcggccgtcttggttccttccccgtcaggggaacgccaatggcaacccgcctattactatgcgaacatgccgagaagttatctgccgcaattgtcctgaaaaaccaccatagccgcctatcggatctggtgaacactgctattttaatcgccctgaacaaacgcgagtacgagattccctctaacctgaccccggcagatgtctttttcagagaagtgagccaggtggataccatatgcgagtgcctgctggagcacgaggagcaggtcctgcgcgacgccccaatggacagcatcgaatgggcagaagtggttattaatgtaaataacattcttaaggacatgcttcaagccgcttctcattaccgccagaataggaatagcctataccggcgagaggaaagtcttgagaaggaacctgaatatgtgccctggaccgccacttcgggacctggcggaatccgaaccgtcattattcgtcaacacgagattgtgctaaaagtcgcttatcctcaggcggacagtaatctcagaaacatcgtgacagagcagctggtggcactgatcgactgtttcctggacggatatgtgtcacaattaaagagtgttgacaagtcctcgaatcgggaaaggtacgataatctcgaaaaggggaaacgcggaaagttactctcacaacccatatcacagcacggacaacttgccaactttctccaagcccacgagcatctgagctggctgcatgaaatcaattcccaggagctcgagaaagctcacgcaacgctcctgggcttagcgaacatggagacaaggtatttcgccaaaaaaaaaaccctgcttggtctgagtaaacttgcagccctggcaagcgacttctctgaagatatgttgcaggagaagatcgaggaaatggccgaacaggagcggttcctgcttcaccaggagaccttgcctgaacagctcctggctgaaaaacaactgaatctgagcgcaatgcctgtcctcaccgctccccagctgatcggtctctatatctgcgaagagaatagaagggccaatgaatatgacttcaagaaggccctcgatctcctggaatacatcgatgaggaggaagacataaacataaatgatcttaaactcgagatcctttgtaaggctcttcagcgggataattggtcttcctccgatgggaaggacgatcctattgaagtgtctaaggattccatattcgtaaagattctgcagaagctactgaaggatgggatccagctttctgagtatctccctgaggttaaggatctgttacaggcggaccagctgggctcactcaagagtaatccttacttcgagttcgtgcttaaagctaactatgagtactacgtgcaaggccagatctag

SEQ ID NO: 233303 - DNA, 3423 bp, Artificial Sequence
  Description of Artificial Sequence: Synthetic coding sequence
atgggcccactggccggacttgggccaggatcgacaccacggactgcatctcgcaaggggcttcccctgggctccgctgtctcgagtcctgtgctattttctcccgtggggcgtcgatcatccttgtcctccaggggaaccccaacaagaatgtttccccatcattctattaccgaatctgtgaactacgatgttaaaacttttggcagcagtctcccagtgaaagtgatggaggctctcactctcgcagaggtggacgatcagctgactataaatatcgatgaaggcggatgggcttgcctagtgtgcaaagagaaacttataatttggaaaattgcgctttcacctatcacaaagctgagtgtctgtaaggagttacagctgccaccttctgattttcactggtctgccgaccttgtcgcacttagctattcatctccttccggcgaggctcattctactcaggccgtggccgtgatggtggctacacgagagggctcgatacggtattggccctccttggccggtgaggacacatataccgaagcattcgtcgactccggcggtgataagacctactcattcctcacagccgtgcagggagggagtttcattttaagcagcagcggctcacaactgatccggctgatccctgagagctccgggaaaatccaccaacacatcctgccgcagggccagggtatgttgtccggcattggacgcaaagtttcttcgcttttcggaattctcagcccttccagtgacctgactctgagttccgttctttgggatagggaaaggagttccttttacagtctcacctcctcaaatataagtaaatgggaattggacgactcatcggagaaacacgcttattcatgggacataaatcgcgctctgaaggagaacattactgacgctatttggggaagtgagagtaattacgaggcgatcaaggagggcgtgaatattaggtatctggacctgaagcaaaactgcgatggtcttgtcatccttgctgccgcttggcactcagcggacaacccttgcctgatctactactcactgattacgattgaagataatggctgtcaaatgtccgacgctgttactgtagaggtgacacagtacaacccgccttttcagagcgaggatctcatcctttgccagctgaccgtccccaattttagtaaccaaactgcatatctgtacaacgagtctgccgtgtacgtctgtagcaccggcacaggcaagttctctctccctcaagaaaagatcgtgtttaacgctcagggcgactctgttctaggggctggcgcatgtggcggtgtccctatcatcttttcacggaacagtgggttggttagcattacctcccgtgaaaacgtgtcgatcctggccgaggaccttgaagggagtcttgcctctagtgtagccggacctaacagtgaaagtatgattttcgaaacaacaacaaaaaatgagaccatagcccaggaggacaaaataaagctgctgaaagccgcttttctccaatattgcaggaaagacctgggccacgcccagatggtcgtcgatgaactgttctcctcacactccgatctggactctgatagcgagttagatagggcagtgacacagatcagtgttgacctgatggacgattatccagcttcggacccaaggtgggcagagagtgtgcccgaggaagcgccagggttttccaatacatctctcatcatcttgcatcagctggaagataagatgaaggcacattcattcctaatggattttatccaccaggtggggctcttcggtcgactgggttccttccctgtcagaggaaccccaatggctacacgattgcttctttgcgaacacgccgagaaactgtccgccgcaatcgtgctgaagaatcatcacagtcggctttccgatcttgtcaatacggctatactgatagcattgaataaaagagagtacgaaatcccttccaacctgacccccgctgacgtgttcttcagagaagtcagtcaagtcgataccatctgtgaatgtctgctggagcatgaagagcaggtcctcagagacgccccaatggacagcatcgagtgggctgaggtagtcatcaatgttaacaatatcctgaaggatatgcttcaagcagcgagccactatcgacagaacaggaacagcttgtatcgacgagaggaaagcctggaaaaggagcccgaatacgtcccatggactgctactagtggcccagggggtatccggactgtgatcatccggcagcacgagatcgttctgaaggtggcctaccctcaagcagactccaacctccgcaacattgtaactgagcagcttgtcgccctgatcgactgctttcttgatgggtatgtgtcccagctgaagtccgtggataagtcaagcaatcgagagcgctatgataacctggagatggagtacctgcaaaagagatcagatttactgtccccgcttctctcccttggtcagtatttatgggctgcgtccttggccgagaagtattgtgactttgatattttggtgcagatgtgcgagcaaaccgacaaccaatccaggctccaacgctacatgacacagttcgccgaccaaaatttctcagatttcctgtttaggtggtacctggagaaggggaaaagaggcaaacttctgtctcagcctatctcacaacatggacaattggccaatttcctccaggctcatgagcatctctcttggctgcacgagattaattcacaagaattagagaaagcgcacgctacccttttggggctcgccaacatggagacgagatatttcgctaaaaagaaaacactactgggattatctaagttggcggctcttgccagcgatttttcagaggatatgttgcaggaaaagatcgaagaaatggcggagcaggagagattccttctgcatcaagaaaccttgcccgagcagttactggcagagaagcaacttaacctaagcgcgatgcccgtgctcacagctccccaacttattggactgtatatctgcgaggagaaccgcagggccaacgaatatgacttcaagaaggcccttgacttattggaatatatagacgaagaagaagacattaacataaatgaccttaagctcgagatcttgtgtaaggccctacagagagacaattggtcctcatctgatggaaaggacgatcctatagaggttagcaaggacagcatatttgtgaagatcctgcagaagttactcaaggatgggattcagctctccgaatatttacctgaagttaaagacctgttacaggccgatcagctggggtcactcaaaagcaatccttactttgagttcgtcctgaaggccaactatgagtactacgtccaaggccagatttag

SEQ ID NO: 233304 - DNA, 4428 bp, Artificial Sequence
  Description of Artificial Sequence: Synthetic coding sequence
atggcaagcggcgcaggtggagtaggcggaggcggtgggggtaagataagaacaaggcgttgtcatcagggcccaatcaagccgtaccaacaaggtcgacaacaacatcaggggatcttaagcagggttactgaaagcgtgaaaaatatagtgcctgggtggctgcagcgttacttcaacaagaatgaggacgtctgctcctgctccactgatacctcagaggtcccaaggtggccagagaataaggaggatcatttggtgtatgcggacgaagagtcaagtaatatcacggacggacgcatcaccccggagcccgcagtcagtaatactgaggaacctagcacaactagcacggcttcaaactaccccgatgtgcttacccgtcccagtttacatcgctcccatttaaacttctctatgctcgaatcacccgcactacattgccaaccttcgacgtccagtgccttccccattggtagtagtggattctccctggtaaaggagatcaaggattccacttcccagcatgacgatgacaatatcagcaccacaagcgggtttagtagtagagccagtgacaaggatattaccgtctcaaaaaacacatctctcccccctttatggtcaccggaagccgagaggagtcactcgctaagccaacacacagcgacatcctcgaagaagcccgcttttaacctgtcagctttcggaaccttgtcaccttctcttggaaactcatccattctgaaaaccagccagcttggcgatagccccttctatccaggtaagacaacctacggaggagcagccgcagccgtgcggcagtcgaagcttaggaataccccgtaccaggctcccgttaggaggcaaatgaaggcaaagcagttgagtgcccaaagttatggcgtgactagctctacagcgagaagaatactccaatccttggagaaaatgtctagtcccctggccgatgcaaagcggattccttccatcgtctcttctcctttgaactcacccctggaccggagtgggattgacataacggacttccaggccaaacgggagaaggtggactctcagtacccccctgtacagagactgatgacgcccaaaccagtgtccattgcaacaaacaggtctgtatacttcaagccctccctcaccccatccggcgagttcagaaaaacgaatcagcgtatcgacaataagtgttccactgggtacgaaaaaaacatgactccagggcagaaccgggagcagagggagtccggtttctcatatcccaactttagtttgcccgctgccaacgggctgtcctctggcgtaggcggtggcggagggaagatgcggcgagaacgcacccgattcgtagcctcaaagccactggaagaggaagagatggaagtccccgtactgccaaagatctctctgccaataacaagcagtagcctgcctactttcaatttttcaagccctgagataacgactagttcaccatccccgattaacagtagccaggcgttgactaacaaggtgcagatgacgagtcccagctccacaggctctcccatgttcaagttctcatcaccaatcgttaagagcaccgaagccaatgtcttgcctcctagctcaattggcttcacctttagtgtgcccgtcgctaaaaccgccgagctgtccggcagttcctccacacttgaacctatcatatcttccagcgcgcaccatgtgacaacggtgaatagcactaactgcaaaaagacacctcccgaagattgtgagggaccctttaggccggctgagatattaaaagagggctcagttctggacattctgaaatcccctggctttgcttcgccaaaaattgattcagtggctgctcagccaaccgcaacttccccagtcgtgtacactagaccggcaatttcttccttcagttcctctggcattggcttcggcgagtccctgaaagccggatcatcatggcagtgtgacacctgtcttcttcagaacaaggtgactgacaacaagtgcatcgcttgccaggccgctaaactgtcgcctagggacactgcgaaacagactggcatcgagactcctaacaagtcaggaaagaccactcttagtgcctccgggactggctttggtgataaattcaaacctgtgatcggcacgtgggattgcgatacatgcctagtccagaataaaccagaggctataaagtgcgtcgcatgcgagacacctaaacccggaacttgtgtcaaaagagcgctcacactgacagtcgtgtccgaaagcgcggagaccatgaccgcctcttcatcatcatgcactgtgactacaggaaccctgggattcggcgataaatttaaaaggccaatcgggagctgggagtgtagcgtttgttgtgtcagtaacaacgctgaggataataagtgcgtgagctgtatgtcagaaaagcctgggagctccgtccctgcttcaagtagctcaactgtgcccgtgtcattacccagcggtggatccctcggcctggaaaaatttaaaaaacccgagggctcatgggattgtgagctgtgcctagtccagaataaggccgactcaaccaaatgtctggcctgtgagtcagcaaaacctggcacaaaatctggattcaagggattcgacacgagcagctcttcctcaaacagcgcggcatcctcttccttcaagttcggcgtttcgtcatcctcttcaggcccttcccaaactctgacatccaccggcaatttcaaatttggcgaccagggcggattcaaaataggagttagctccgacagcgggagcattaatcccatgagcgagggtttcaagttctctaaacccatcggtgacttcaagtttggcgtctcttcggaatcaaagccggaagaggtcaaaaaagacagtaagaatgacaacttcaagttcgggctctcaagcggcttgtccaaccccgtgagtctgacgcctttccagtttggtgtctccaatcttgggcaagaggagaagaaagaggagttaccgaagtcctctagtgccggattttcattcggcactggtgtgatcaactctacaccagcacccgcaaatacgattgtcacctctgagaacaaatcttcctttaatcttggtacaatcgaaactaagtcagccagcgtcgcaccttttacatgtaagacctcggaggctaaaaaggaagaaatgccagccactaaagggggattttccttcggcaatgtcgagcccgcatctctgccgtccgctagcgtttttgtactcggcagaacagaggaaaaacagcaggagcccgtcacttcaacttccctagtgttcggaaagaaagccgacaacgaggaacccaagtgccagcccgtctttagctttgggaactctgagcagaccaaagacgaaaactcctcgaagagtactttttcatttagtatgactaaaccctccgagaaggaatccgagcagccagccaaagctaccttcgccttcggggctcagacaagtactacggcagatcaaggcgctgcaaagccagtgttctcctttctgaataatagcagtagctccagtagtactccagctacaagcgcgggagggggaatcttcggaagtagtacgagcagcagcaatccccctgtggcaacattcgtcttcgggcagtcatcaaaccctgtatcatcatctgcgtttggcaataccgccgagagcagtactagccagtcattgttattttcccaggattctaagttggccacgaccagcagtaccggcacggcggttacaccttttgtttttgggcctggtgcttcatcaaataatacaacgacctccgggttcgggttcggggctacaactacctcgtcctccgcagggagctctttcgtattcggcaccggcccttccgctccatccgcatccccggctttcggcgctaaccagacacctacatttgggcagtcccagggcgcatctcaacctaatcctcccggatttggttccatcagttcctctaccgctctgtttccaaccgggtcacagccagctcctcctacatttggaactgtgagctcatcctctcagcctccagtgtttgggcaacagccttcccagtcagcattcgggagcggcacaacacctaactctagttcagccttccagttcgggtctagtacgacgaatttcaatttcaccaacaatagcccctccggcgtctttacttttggggcaaacagctccacacccgctgcgtccgcccagcctagcggcagcggcggatttccgttcaatcagtcccctgccgcattcactgttgggagcaatggtaaaaacgtgtttagttcatctgggacaagcttctctggtcggaaaataaagactgcagttcgacggcgaaagtag

SEQ ID NO: 233305 - DNA, 4368 bp, Artificial Sequence
  Description of Artificial Sequence: Synthetic coding sequence
gggctaagattgtgtctgtcacgtcctctgactcggcctggagctggctcaggcggagggtccgccatggcctcaggagccggaggagtagggggaggcggtggcggtaagattcgcactcgccgatgccaccaaggccctatcaaaccttaccaacagggaaggcagcaacaccaaggaatactctcaagagtgaccgaaagcgtgaaaaatattgtgcccggatggctccaaaggtacttcaacaagaatgaagatgtttgttcatgtagcactgatacctccgaggtaccacgatggcccgagaataaggaggaccatcttgtgtatgccgacgaggaaagcagcaacatcactgatggaaggatcacgcctgagccggctgtgtccaatacagaggaaccatccacaacttctactgcctccaattatcctgacgttttgacgaggccatctcttcaccgcagccacctgaacttttctatgttagagagtccagccctacactgccaaccgtcgactagcagtgcctttccgattggcagttccgggttcagtcttgtcaaggagataaaggactcaacatcacaacatgacgatgataatatctcaacaacctctggcttcagcagtcgggcatcagacaaggacatcaccgtcagtaaaaatacatctctgcctcctctgtggtccccagaggccgaacgatctcattctcttagtcagcataccgcgaccagctccaagaagcctgcctttaatctgagcgcgtttggtacactgtcccccagcctggggaacagctcaatcctgaaaacatcccaattgggagactcccccttctacccgggtaaaactacctacggcggagccgcagccgcagtgaggcaaagcaagctgaggaatactccctatcaggccccagtaagaagacagatgaaagctaagcagttgtctgcccagagctatggggtcacgagctcaacagccagacgaattttacagtctctggaaaagatgagcagccccttagctgatgccaaaaggattcccagtatcgtctcctcacctctgaattctcccctggaccggagcggcatcgacatcacagactttcaagccaagcgtgaaaaagtcgatagccaataccccccagtacagcgcctaatgacccctaagccagtgtctatagcgaccaacaggagtgtatattttaagccctctctgacgccatccggagaatttcgcaaaaccaatcagagaatcgacaacaaatgtagcaccggttacgagaagaatatgacccctggtcagaaccgcgagcaacgcgaatccggattctcttacccgaatttctcactgcctgccgcaaacggactgtcaagcggagtcggcggaggaggagggaagatgcggcgagaaagaacccgatttgtagcatccaaacccctggaagaggaagagatggaagtaccagtgttgcccaagatcagcttaccaattacttcaagctcacttcctacgttcaatttcagttcccccgagattaccaccagctcaccatccccaataaactcgagccaagccctgactaacaaggtgcaaatgacctctccttcctctacaggcagccctatgtttaaattctcttctccgatagtgaaatccacagaggccaacgtgttgcccccttcctcgatcggtttcaccttttcagttcccgttgcaaaaacggctgagctctccggctccagctctacattagagcctattataagcagctcaggcttcgcaagtccaaagattgacagcgtggcagctcagcccaccgccacctctccagtggtctatacacggccagctattagcagcttttcttcctccggaatcggctttggcgagtcgctgaaagccggaagctcttggcagtgcgacacctgcttgctccagaataaagtaacagacaacaaatgcatagcctgccaggccgcaaagctgagtcccagagatacagccaagcagacaggtatagaaacaccgaacaaaagcggcaaaactaccctctcggcctctggtaccgggtttggggacaagtttaagcccgtcataggcacatgggattgcgacacctgcctggtgcagaataaaccagaggcaataaaatgtgtggcctgtgagactcctaagccaggcacttgcgtcaagagagctctcactctgaccgtggtgtctgagagcgctgagactatgacagctagcagcagttcttgcaccgtgacaaccggaaccctcggtttcggcgacaagtttaagagacccattgggagctgggagtgcagtgtttgctgtgtcagcaataatgcggaggataacaaatgcgtttcatgtatgtctgaaaagccaggaagctcggttcccgcaagcagctcttctaccgtgcccgtcagccttccctccggcggaagtctgggtttagagaagttcaaaaaacctgaaggctcttgggactgtgagctgtgcttggtgcagaataaagccgactctaccaaatgtctggcttgtgagagcgccaaaccgggtactaaatccggatttaagggctttgacacctccagctctagtagcaacagtgctgcctcgtcctcattcaaatttggggtgtcgtcctcttcttctggaccaagtcagacattaacctctaccggcaacttcaaattcggcgatcagggaggatttaaaatcggtgtcagctcggactccgggagcatcaaccccatgtccgaagggtttaaatttagcaagcctattggtgattttaagtttggtgtgagcagcgaatccaagcccgaagaggttaaaaaggatagcaagaacgacaatttcaagttcggactgtcttctggtttgtcgaatccagtatccttgacgccatttcaatttggggtgtccaatctcggacaagaggagaaaaaggaggagcttccaaaaagctcatctgcgggtttctcattcggaaccggcgtcatcaactccacccccgcacccgctaatacgatagttacctccgaaaataagtccagtttcaatctgggcacaatcgagacaaagtctgccagcgttgcgccatttacctgtaaaaccagcgaagccaagaaagaggagatgcccgcaactaaagggggattctcctttgggaacgtagaacctgccagcctgccgtctgccagcgtgttcgtgctcggccgtacggaggagaagcagcaggaaccagtgacttccacatccctcgtgttcggtaagaaagccgacaacgaagagccaaaatgccaacccgtattctcattcggaaatagtgaacaaaccaaagacgaaaatagctccaagtctactttcagcttctccatgacgaagccttcagagaaggagtcagagcagcccgctaaggctacgtttgccttcggcgctcagacttccaccaccgcggaccaaggtgcggctaagccagtgtttagctttctcaataactcttcctccagctcgagtacccctgccacctctgccggtgggggtattttcggctctagcacatcgtccagcaacccccctgtggccacattcgttttcgggcagagttcaaaccccgtcagttcttctgcttttggcaacacggcagaaagctctacatcccagagcctactcttctcacaagattcaaagttggcaaccacgagctcaacaggcaccgctgtaacccccttcgtgtttggacccggagcttccagtaataacaccaccacaagtggcttcggcttcggtgctaccactaccagcagctcggcaggatcaagttttgttttcggaacgggcccttcggccccttctgcatcgcccgcatttggcgcaaaccagacacccacattcggacagagtcagggggcttcccaacccaatcctcctggatttggaagcatctcctcatctactgccctttttcctacggggtcccagccagctccacccaccttcggaaccgtgagctcttcgagtcaaccgcctgtgttcggccagcagccgagtcagtctgcctttggctcaggcacaaccccaaatagctctagtgcctttcagtttggctccagtactaccaattttaacttcaccaataactccccctctggagtattcacttttggcgctaattcttcaacccctgccgctagtgctcagccctctggcagtgggggtttcccttttaatcagtcgcccgctgcgtttacagttggctctaacggcaagaatgtgtttagctcgagtggcacctcatttagcggacggaaaattaaaaccgccgtgcggcgacggaaatag

SEQ ID NO: 233306 - DNA, 4521 bp, Artificial Sequence
  Description of Artificial Sequence: Synthetic coding sequence
atggctagcggcgctgggggtgtggggggtggcggaggcggaaaaataagaacccggagatgccaccaggggccaattaaaccgtaccaacaagggaggcaacagcatcaggggatcttgtcccgggtcaccgaatctgttaagaacatagtgcctgggtggctgcagcgctattttaacaagaacgaggacgtgtgctcctgtagcacagatacgtcggaggtccctcgttggcccgaaaacaaggaggaccacctggtctacgcagacgaggagagttccaacatcactgacgggaggatcacacccgaaccagcagtcagcaatactgaggagcccagcaccacgtccaccgcctcgaactatcccgatgtcttgacacgcccttcccttcaccgatcacacctcaacttctcaatgctggaatcccctgcacttcactgtcagccttccactagtagcgcatttcctattggctcttcggggttttccttagtgaaagagatcaaggactctacatcacagcacgacgacgacaacattagtaccacttccgggttctcctcgagagctagtgacaaagatattactgtgagcaagaacacctccttgccacccttgtggtccccagaggctgaaaggtcacacagcctgtcccagcacactgcaacatcctccaaaaagcccgcttttaacttaagcgctttcggaactctttcaccgtcactgggaaatagcagcatactgaaaacaagtcagctgggggattctccattttatccaggtaagactacatatggcggtgcagccgcagcagtgaggcagtccaagttgcgcaacactccctaccaggctccggtccggaggcagatgaaagccaaacagctcagcgcccagagttacggtgtcacatcctctacggctcggcgtatcttacagagcctggagaagatgtcctcacctctggccgatgcaaagcgaataccaagcattgtctctagccccttgaacagcccactggaccggtctggcatagacattacagacttccaggccaagcgggagaaggtggatagccagtacccgcctgtccagagactgatgaccccaaagcctgtctctattgcaacaaaccgatctgtgtattttaagccatcgcttactccaagcggagaattccggaaaacaaaccagcgtattgacaataagtgctctactggctacgagaagaatatgactcccggacagaatagggagcaacgagaaagcggtttttcttatcctaattttagcctgcctgccgcaaatggcctctccagtggcgtggggggtggaggcggaaaaatgagacgtgagaggacgaggtttgtggccagcaagcccctcgaggaggagcgccagggacttaccgttctaccaaagctgatcagcagttcttgtgctcaggccattatcccatcgtggccccttaaggttcttcgcttgcaggaaatggaggtccctgtcctgccaaagattagtctacctatcactagcagctctctccccactttcaatttctcctcaccagaaatcaccacatcaagtccctcacctatcaactccagccaggcactgaccaacaaagtgcaaatgacctcaccatctagcactggctcccctatgtttaaatttagtagccccatcgtcaagtctactgaggccaatgtcctacccccaagtagcataggctttacgttttctgtacctgtcgcaaaaacagctgaactgtccggctctagctctaccctagaacccattatcagtagctctgctcaccacgttactaccgtcaattccactaattgcaaaaagacgccaccagaagactgtgaagggccatttcgtccggctgagatcctcaaagaggggtccgttctggacatactgaagtctccaggcttcgccagtccgaaaatcgactccgtggcagcccagccgactgccacatctcctgtcgtatacacgaggcctgccatctcatccttcagcagctccggcatcggtttcggcgaatctttaaaggccggatcttcttggcagtgcgacacatgtctactgcagaacaaggtgactgataacaagtgtattgcctgtcaagccgcaaagctctcccccagagacactgctaaacaaaccgggattgaaacacctaataagagcggcaaaaccacactaagtgcatccggcacgggattcggggataaattcaaaccggtgataggtacctgggactgcgatacctgcctggtgcagaataaacctgaagccatcaaatgtgtcgcctgtgagactccgaaacctggtacttgcgtcaaaagagcattaaccctcacggtggtgagcgaatccgccgagactatgactgcatcaagtagctcatgcaccgtgactaccggcacactgggtttcggtgacaagttcaaacggcctatcggctcttgggagtgttcggtctgctgtgtgagcaacaacgctgaggataataaatgtgtgtcctgtatgtccgaaaagccagggtccagcgtccccgctagttccagctctactgtgccagtgtccttaccctcaggcggtagcctggggctggaaaaatttaagaaacccgaggggagctgggattgcgaactatgcctcgttcagaataaagcggattcaactaagtgtcttgcttgtgagtccgcaaagcccggaaccaaatccggattcaaaggttttgacacttccagttcttcaagtaactcggccgctagctcttctttcaaattcggcgtttcgtcttcctccagtgggcctagccagactttaacgtctaccggaaattttaaattcggcgatcagggtggcttcaagattggggtctcctctgacagtgggagcatcaacccgatgtcagaggggttcaagttttctaagcccatcggagattttaagttcggagtatcctctgagagcaaaccagaggaagtgaaaaaagactccaaaaatgacaatttcaaattcggcctttctagtgggctctccaaccccgtttcactgactccatttcaattcggggtttcaaatctggggcaagaagagaaaaaggaggagcttcccaagtccagctccgcaggcttttcttttggcaccggtgttatcaacagcactccagcccctgctaacacaattgttacctcagaaaataaaagctcctttaacctgggcacaatagagactaagtccgccagcgtagcaccttttacctgcaagacatcagaggcgaagaaagaagagatgcccgctacaaagggtgggttctcttttgggaatgtggaaccagcctccctcccgtctgcttccgtctttgttcttggacgcactgaagaaaaacaacaagagccggtcacatctacctctctggtattcggtaagaaggccgataacgaggagccaaagtgccagcctgtcttctcatttgggaacagtgagcagaccaaggacgagaactcctccaaaagtacctttagcttttccatgactaaaccctcggaaaaagagagtgagcagcctgctaaggcaacctttgccttcggggcacagacgagtactactgccgatcagggagccgcaaagcccgtattctctttcctgaacaatagctcatcttcaagttcaacccctgccactagtgccggtggcggtatatttgggtcctcaactagtagttcaaacccacctgttgctacctttgtttttggccagtcctctaacccagtttccagcagtgcttttgggaacaccgccgaaagttcaacctcacaatcattattatttagtcaggacagtaagcttgccacaacgtcttctaccggaacggccgtcacaccattcgtgttcggccctggtgcttcttccaacaatactaccaccagcggctttggcttcggtgcaaccaccactagctcatccgccggttcttcatttgtcttcgggactggcccatcagcccctagcgcatccccagccttcggcgcaaatcaaaccccgacgttcggccagtcccagggcgcttctcagcccaatccccctggctttggtagtatctctagctccaccgctctgtttccaactggcagccagcccgcaccccctaccttcggcaccgtatccagcagtagccagcctcccgtatttggacaacagccatcgcagtctgccttcggaagcgggacaactcccaatagtagcagcgccttccaattcggttcctcaaccactaacttcaacttcacgaacaactctccctccggggtgtttactttcggcgctaatagcagtactcccgcagcaagcgcccagccaagtgggagtgggggatttccatttaatcagagccccgcagcattcaccgtcggcagtaacggtaaaaacgtattctcgagcagcggaacatcgttttctggacgtaaaattaagaccgccgtgaggcgaaggaagtag

SEQ ID NO: 233307 - DNA, 3555 bp, Artificial Sequence
  Description of Artificial Sequence: Synthetic coding sequence
atgatgcagctacttcagctgttgttaggattacttggtcctgggggttatctcttcctgctgggcgattgccaagaagtgaccacgctaacggttaagtaccaggtgtcagaggaagtgccatctggaaccgtgattggtaaactcagtcaggaactcggtcgggaggaacggaggcgacaagccggtgctgctttccaggtactccaattaccacaagctctcccaattcaagtggactccgaggagggactgctgagtaccggccgtcggctcgacagggagcaactatgtagacagtgggacccctgcctggttagcttcgacgtactggcaaccggggacctggccctcatccacgttgagattcaagtgctcgacattaacgaccaccagcccaggtttccaaagggggagcaggagctggaaatcagcgagtcggcctccctcagaacgaggatccctctggatagagccttggaccctgacaccggtcctaataccctgcatacctacactctgagccccagcgaacatttcgcattggatgtgattgttggccctgacgagacgaagcacgcggagttgattgtggtaaaagaactggatcgtgaaatccacagcttcttcgatctggtgctgactgcttatgacaacggcaaccccccaaagtctggcacttcactcgtgaaggttaacgtcctcgactctaacgacaattcccccgctttcgcagagtcttcgctcgccctcgaaatccaagaggatgctgcaccaggcactctcttaataaaattgactgcaacggatcctgatcagggcccaaatggggaggtggagtttttcttgtccaagcacatgcctccggaggtattagataccttcagcatcgacgccaaaaccggccaggtgattttgagaaggcctctggactacgaaaaaaatcccgcttacgaagtcgatgtgcaggcccgtgacttgggaccaaatcccatacctgcacattgcaaagtgctaattaaggtccttgatgtcaacgataacatcccctccatccatgtcacctgggcatcccagccgtcactcgtgtctgaggcattacccaaagactcgttcatcgctctggtgatggctgatgacctcgattcaggtcataacggccttgtccactgctggctctctcaggaactgggacatttcagactgaagagaacaaacggaaatacctatatgcttctgacgaatgctaccctcgaccgcgagcagtggcctaagtatacactgacgctgctggcccaggatcagggcctgcaaccgctatccgccaagaaacagctaagcatccagatttccgacattaatgataacgcacccgttttcgagaagtctcgttatgaggtgagcaccagagaaaacaacctgccctcactgcacttgatcacgattaaggctcatgatgcagatttagggattaatggcaaagtcagttatcggatccaagacagcccagtggcacatctggtggccattgatagcaacacaggggaagtaacagcgcagagatcactaaactatgaagagatggccggtttcgagtttcaggtgatcgccgaagatagcggccagccaatgctggcctccagcgtcagcgtgtgggtctccctgctcgacgctaacgacaatgctccagaggtggtgcagcctgtgttaagcgacggaaaggcgtctctgagcgttctggtcaatgcctccacaggccaccttttagtgcctattgaaacaccaaatggactcgggcctgctgggactgacactccacctctggccacgcacagctcccgtccattcctgctaactacaatcgtggccagggacgccgactctggcgctaatggcgagccgttatactcaatcagatcgggcaacgaagcacacctcttcatactaaatccacacactggccagctgttcgtaaatgtgaccaacgcctctagcctgataggcagcgagtgggagctggaaattgtggtggaagaccagggatctcctcccctgcagacaagagctctgctccgggtaatgttcgtgacttccgtggaccacttacgggactccgcaaggaaacctggcgctttgagtatgtcaatgctgacagtgatctgtttggcagtcttgttagggatattcgggctgattctcgccttattcatgagcatttgccggacagaaaagaaagataaccgggcatataattgtagagaggccgagtctacatatagacagcagcccaagcgcccacagaaacacatccagaaagccgacatccatctggtgcccgtgctcaggggtcaggccggagaaccatgcgaagtcggtcagtctcataaggatgtagataaagaggcaatgatggaagcaggatgggacccatgtctacaggctccttttcacctgacacctaccctgtatcgcaccttacggaatcaaggaaaccaaggggctccggcagaaagtcgagaggtgctgcaggatactgtgaatttgctgtttaatcacccaaggcagaggaacgcctcacgggaaaatcttaacctgccagagccccaacctgccacgggtcagccaagatcaagaccgctgaaggttgctggtagccctactggtcgcctagcaggcgatcagggatccgaagaggcgccacagcgacccccagcatccagtgccaccctcagacggcagaggcacctgaacgggaaggtcagccctgagaaggagtctgggcctcgtcagattctgcggtctctggtccggctgtctgttgccgcatttgccgagaggaaccccgtggaggaactcacagtcgattcccctcccgtgcagcaaatttcccaacttctcagtctccttcatcaggggcaatttcaaccaaaaccaaaccatcgaggtaacaagtatctcgccaaacctggcggatcacggagcgcgatcccagacacagatggtcccagtgctagagctggaggccaaacagaccctgagcaggaggaggggccactggatcctgaggaggacctttcagtcaagcagttgctagaggaggagctgtcatccctgctggatccatcgactggactcgccctggaccgtttgtctgctcccgacccagcctggatggcaagattgtcactcccactcaccacaaattatagggataacgtcatttcacccgacgccgctgctacagaggaacccagaacgttccagacctttggtaaagccgaagcccctgaattgtcacctaccggtactcgccttgccagtacatttgtaagtgaaatgtcatctttgctggagatgcttctagagcagcggtcctcaatgcctgtggaggcagctagcgaagcgctgcggcgactcagcgtgtgcggtaggacactctcactagaccttgctacttctgccgcttctgggatgaaagtccagggggacccaggaggcaaaactggcaccgagggaaagtccagggggtctagcagttctagcaggtgtctctag

SEQ ID NO: 233308 - DNA, 3999 bp, Artificial Sequence
  Description of Artificial Sequence: Synthetic coding sequence
atgtctgacatggactaccctcttcaagggccaggcctcctttcggttcccaatctccccgagatcagttctatccgcagggtgccgctccctccagagctagtggaacagttcggtcacatgcagtgcaattgcatgatgggcgtatttccccctataagccgcgcatggttgactatcgacagtgatatttttatgtggaactatgaagatgggggagacctcgcctactttgatggtctgagcgaaacaatcctcgcggtggggctggtgaagcccaaggccggtatctttcaaccccacgtgcggcatctgctggtccttgccacacctgtggatatcgtaatcctgggtctctcatatgccaatctgcagacaggctccggagtgctgaacgatagcctttccggcggtatgcagctactgccggacccactctattccctgcctacagataacacctatctccttacgattacatctaccgataatggcaggatttttctggcaggtaaggatggatgcctgtacgaggtcgcataccaagctgaggccggttggttctcccagaggtgtagaaaaatcaaccattccaaatccagcctttcttttttggtgccttcgctactccaattcaccttcagcgaagacgaccccattctgcagatagccatagataattcacgcaatattctgtacactaggagtgagaaaggcgtgatccaggtgtatgatctgggacaggatggccagggaatgtcccgagtggcgtcagtgtcccagaatgcgatagtgtccgctgccggtaatattgcccgaacaattgaccggagtgtgtttaaacccatcgtgcaaatagcagttatcgaaaattctgaatctctggactgtcagctgttagccgttacgcacgctggggtccgtttatacttctcaacttgccccttccggcagcccctggccagacctaataccctgacccttgttcacgttcgactgcctcctggattctcagcaagttctacagtcgagaagccctccaaggtacatcgagccctctactcaaaggggatactgttaatggccgctagcgaaaacgaggacaacgacatattgtggtgcgtgaatcacgatacatttccttttcaaaagcccatgatggagactcagatgaccgccggagtggatggccattcttgggcgctttccgcgattgatgagctcaaggtagataagatcattacccccctgaataaggaccatatcccgatcaccgatagtcctgtcgtggttcaacagcacatgttgccgcctaagaagtttgtactgctctctgcgcagggcagcctgatgtttcacaaactgcgacctgtggatcagctgcggcatctgcttgtcagtaatgtcggcggtgacggagaggagatcgaacgattcttcaaactgcaccaggaagaccaggcatgcgctacgtgtctaatcctggcctgcagcacagcagcttgtgaccgggaagtttccgcgtgggcgactagagcattttttcgctacggcggagaagcccagatgcgtttccccacaacacttccgccacctagcaacgtaggccctatactgggaagccccgtttactccagctcccccgtgcccagtggaagcccctatccaaatccttccttcctggggacgcctagtcatggcatacagcctccggctatgtcaactccggtgtgcgcactagggaatccggcaactcaagcgacgaatatgagctgtgtgacgggtccagaaatcgtctacagcgggaaacataacggaatatgcatttatttctccaggatcatgggcaacatttgggacgccagcttggtggtggaaaggattttcaagtcagggaacagagagatcacggcaatcgagtccagtgtcccctgtcagctcctggagagtgtcctccaagaacttaaaggtttgcaggaattcttggataggaattcccagtttgcaggtggaccactgggcaacccaaacaccaccgcgaaagtacagcaacggctgataggcttcatgcgccctgagaatggcaacccgcagcagatgcaacaggaactgcagcgtaaattccatgaggcacaactgagtgagaaaatctcgttgcaagctatccagcagttggttcggaaatcctaccaggccctggcgctgtggaagctgctgtgtgagcaccagtttactatcattgtggccgagctgcaaaaggaactgcaagagcagctcaagattaccaccttcaaggacctggtgatccgggacaaagagctcaccggggctctgatcgcctccttgattaattgttacatacgggataacgcagctgttgatggaataagcctccatctacaggacatttgccctttgctgtactctacagatgacgccatatgcagcaaggctaacgagctgttacagcgatcccgacaggtacagaacaagaccgaaaaggaaaggatgctgcgggagagtttgaaagaataccagaaaatctccaatcaagttgacctgtcaaacgtttgcgcgcagtatcgacaggtccgattctatgagggggtggtcgagttgtctttgacagctgctgagaaaaaagacccgcaaggcctcgggttgcatttttacaagcacggggagcctgaagaggacattgttggcctgcaggcctttcaggagcggctgaacagctataaatgcattacagatacactccaggaattggtcaatcagagtaaagcagcgcctcagagcccctctgtccccaaaaagccaggccctccagtgctatcttctgatcccaatatgctgagtaatgaggaggctggccaccacttcgagcaaatgctgaagttatcccaaaggtccaaagacgaactcttctccatcgcgctttataactggctgatccaggtggatctggccgataagctgctgcaggtggcttccccgtttttagaaccgcacctggtgaggatggctaaagtcgaccagaaccgggtgaggtacatggacttactgtggagatattacgagaaaaataggagcttctccaacgctgccagagtgctctccaggttggcagatatgcacagcacagagatcagcttacagcagagactggaatatatcgcacgggcaattctcagcgctaagtcctctactgcaatctccagtatcgcagcagatggtgaatttcttcacgagctggaggaaaagatggaagtcgcaagaatccaactgcagatacaggaaaccctccaacggcagtactcacatcactcaagcgtccaagatgctgtctctcagttagactccgagcttatggacattaccaagttatatggggaattcgcagatccttttaaactcgcagaatgtaagcttgcaattatccattgcgcaggctattctgaccctatcttggtccagaccctgtggcaggacatcattgagaaagaacttagcgactcagtgacacttagtagttcagaccgcatgcatgccctatcgttgaagatcgtgttactgggcaaaatctatgccggtactcctcgctttttcccgctcgactttattgtgcaatttctggagcagcaagtctgtacgctgaattgggacgtagggttcgtgatacaaaccatgaacgaaatcggagttccattgccacgactcttggaggtctatgatcagctatttaagagccgtgacccattctggaacaggatgaagaaacccttgcacctcttggattgcatccatgtgctgctgattagatacgtggaaaacccctcgcaggttttgaattgtgagcggaggcgctttacaaacctgtgcctggacgccgtatgtggctatctggtggaattacagtctatgtcttcgagcgtggccgtgcaggcgattacagggaacttcaaatccttgcaagcgaaactcgagaggctgcattag

SEQ ID NO: 233309 - DNA, 4062 bp, Artificial Sequence
  Description of Artificial Sequence: Synthetic coding sequence
atgtacccggatctgagcgagcttctcatggtcagtgcgccaaataatccaaccgtgtccggaatgtctgacatggactatccgctccagggccctgggctcctgagtgtccctaacttgcccgagatctcctccattagacgggtgcccctccccccagaacttgtagaacagtttgggcatatgcagtgcaactgtatgatgggcgtgttccctcctataagtcgcgcttggctgacaatcgattcagatatttttatgtggaattatgaggacggaggtgaccttgcatacttcgatggcctgtcagagacaatcctggctgtcggactggtaaagccgaaagctggcatttttcaaccacatgtgcggcatctgctggttttggccacaccagtggacattgtaatactgggattaagctacgctaacttgcaaacagggtcaggggtgctgaatgattcacttagcgggggaatgcagttgctcccggaccccctgtatagccttccgacagacaatacatacctgcttactattacatcgactgataatgggaggattttcctggccggaaaagacggatgtctctacgaggtcgcataccaggctgaagcaggctggtttagccagcgttgccgtaagataaatcattcgaaaagctccctgtcgttcctggttcctagtctcctacagttcacctttagcgaggacgatcccatccttcagatcgccatcgataactctcgcaatattctctacactcggagtgagaagggggtgatccaagtatacgacctgggccaggatgggcagggaatgtctcgagtggcttcagtgtcacagaatgctattgtctccgctgctgggaacatcgccagaactatcgaccgcagtgtcttcaaacctattgtgcagatcgctgttatcgaaaattctgagagccttgactgccaattgctggccgtcacccacgcgggtgtgagactgtacttctccacatgtccgtttaggcagcccctggccagaccaaacaccctgacactggtccacgtacggctgccgcctggctttagcgcctcctccaccgtcgagaaaccctctaaagtgcacagggccttatatagtaagggcatactccttatggctgccagcgaaaacgaggataacgatatactctggtgcgtgaaccacgatactttcccattccagaagcctatgatggagacacagatgaccgcaggagttgacggccactcctgggcactctccgcaattgatgaattgaaagtggacaagattataaccccactgaacaaggatcacataccaattaccgactcccccgtagtggtgcagcaacatatgctacctcccaagaagtttgtcctgctgtcagctcaaggatctctgatgttccataagctgaggccggtggaccagttgaggcatctgctggtgagcaacgttggaggagatggcgaggaaatcgagagattcttcaaactgcatcaggaagaccaggcatgcgcaacgtgcttaattctagcatgcagcacagcagcatgcgaccgggaagtctcagcatgggcaaccagggccttctttcggtatggtggcgaggcccaaatgcggtttccaactacacttcctccacctagcaacgtagggcctattctgggcagccccgtatacagtagctccccagtgccgtccggctcaccttatccaaatccttcttttttgggtaccccgtcccatggtatccagccacctgccatgtctacaccagtctgcgcactcggaaatcctgcaacccaggccaccaacatgtcctgtgtgaccggacctgaaattgtgtactctggaaaacacaacggcatttgcatctacttctcccgcatcatgggtaatatatgggatgctagcctcgttgttgagaggatattcaagagcggtaatcgcgaaataaccgcaattgaatcttctgtcccctgccagctgctagagagcgtattacaggaactgaagggactccaagaatttttagatcgtaactctcagttcgccggaggccctctggggaatccaaacacgacagccaaagtccagcaacgattaatcggatttatgcgccctgaaaacgggaatccccagcagatgcagcaggaactccagcgcaaatttcacgaggcacagttgagtgagaaaatcagcctgcaagccattcagcagctggtcaggaagtcataccaggccttagccctttggaagctgttgtgtgaacatcaattcaccattatagtggctgagttacaaaaagagctccaagagcagttgaaaattactacgtttaaggacctcgtgatccgcgacaaggaactgaccggggctctgatcgcctcattaatcaactgttatatcagagacaacgctgccgttgatggcatatccctgcatctgcaggatatttgccctttattatattccaccgacgatgccatctgcagcaaggccaacgaactgctgcaaagatctcgccaagtacagaataagactgaaaaggaacgcatgcttcgtgagagccttaaagaataccagaagatttccaatcaggttgatctcagcaatgtgtgcgctcagtaccggcaggtcaggttctacgaaggggtggtggagttaagcctgacggccgctgagaagaaggaccctcagggcctgggcctgcacttctacaagcacggcgagccagaagaggatattgtcggcttgcaggctttccaggaacgtttgaactcctacaagtgtattacggatacgttgcaagagcttgtcaaccagtcgaaggccgcaccacagtctcccagcgtgccaaagaagcccggtcctcctgtgctgagttcagaccctaatatgttgtcaaatgaggaggccggacatcactttgagcagatgctcaaactgtcacagcgaagtaaggatgagctgttcagcatcgccctttacaactggttgattcaggtagacctcgctgacaaactcttgcaggtcgcgtccccctttttggagccacacctggtgaggatggccaaggtggaccagaaccgcgttaggtacatggacctgctttggcgatactacgagaaaaacagatctttctcaaacgctgccagggtcctgtccagactggccgacatgcacagcacagaaattagcctgcagcagcggcttgagtacatcgcaagggcgatcttgtccgccaaatcatccaccgctattagtagtatagcagccgatggcgagtttctacacgagctggaggagaaaatggaagtggccaggattcagctgcagatccaggaaacattacagagacagtactcccaccacagtagtgtgcaagatgccgtatctcagctggattccgaactcatggatattactaaactatatggcgaattcgcagatcccttcaagctggccgaatgtaaactggcgattattcattgtgctggttattctgaccctattctggtccagacactttggcaagacataattgagaaagagctttccgattccgtgactctgtcctccagtgacagaatgcacgccctcagcttgaagatcgtactcttgggcaaaatctacgccggaacacccagatttttccctttggacttcattgtgcaatttttggaacaacaggtttgcactctgaattgggacgtggggtttgtcatacagaccatgaatgagattggtgtccctcttcctcggctgctcgaggtgtacgaccagctgtttaagagccgcgaccctttctggaaccggatgaaaaaacctctccatctgctggattgtattcacgtcttattgatacggtatgtggagaacccctcccaggtcttgaattgcgaaagacggcgattcactaatttgtgtctcgatgccgtttgcggctacctggttgagcttcagagcatgtcttcgtccgtcgcagtacaagctataacgggtaatttcaaatcccttcaggctaagctggagagactgcattag

SEQ ID NO: 233310 - DNA, 3984 bp, Artificial Sequence
  Description of Artificial Sequence: Synthetic coding sequence
atgcccagctccctgctgggggcagccatgcctgccagtacttctgcagctgcactgcaggaggcactggaaaatgccggaaggttaatcgaccggcagttacaggaggacagaatgtatcccgacttgagtgagttgctgatggtgtcagcacccaacaatcccacagttagtgggatgtcggacatggactatcctcttcagggcccagggttactgtctgtgcccaatttgccggagattagttcaattcgccgtgtccctctcccacccgaattggtcgaacaatttggccacatgcaatgcaattgtatgatgggggtctttcctcctatatcgcgggcttggctaaccattgacagcgatatcttcatgtggaattatgaagacggcggtgacttagcctattttgacggactgtccgaaaccatactggctgtcgggcttgtcaagcctaaggcaggaattttccagcctcacgtcagacatctccttgtgttagctaccccggtggacatagtcatcctcgggctgtcgtacgcaaacctccagacaggatcaggagtcctaaatgactcgctcagcgggggtatgcagttattgcccgatcccctttattctctccccactgacaatacatatctgttgacaattacttccactgataatggcaggatctttctggccggtaaagatggctgcctctacgaggtggcctaccaggctgaagcaggatggttttcccaaaggtgccggaagatcaatcacagtaagagctctctgtcatttctcgtaccctcactactgcagtttaccttctctgaagatgatccaatcttgcaaatcgccatagataatagcaggaacatcctctatactcggtccgagaaaggggtcatccaagtctatgacctggggcaagacgggcaggggatgagtcgcgttgctagcgtcagtcagaacgctattgtgtcagctgctggcaacattgcacgcacaatagatcggagcgtttttaagcccatcgtccaaattgcagtaatcgaaaacagtgagagtctcgactgtcagctcctggccgtgacccacgcaggcgtcaggctctatttcagcacatgtccgttcaggcagcctctggcaaggcctaatacactgaccctagtgcatgttaggctcccgccaggcttttcagccagctcaacagttgagaagccgagcaaggtccacagagccctttactcgaaggggatcttactgatggcagcctccgagaacgaggacaacgatatcctgtggtgtgtaaatcatgacacattcccatttcagaaaccaatgatggagactcagatgactgctggagtggatgggcactcatgggcactgtccgccatcgacgagctgaaagtcgataaaattatcacccccctgaataaagaccacattcctatcacggactcaccggtcgtggttcagcagcatatgctgcccccaaaaaagttcgtgttactgtcggcccaggggagcttaatgtttcataagttacgccctgtggaccagctccggcatctgctcgtgtccaacgtggggggagacggcgaggaaatcgaacggttcttcaaactgcatcaggaagatcaggcgtgtgctacatgcctgattctggcctgttctacagcagcctgcgaccgggaagtgagcgcttgggccaccagggcgtttttccgatacgggggagaggcccaaatgagatttcccacgacgcttcctccaccaagcaacgtcggacccatcctaggctcccccgtttactcatcttcacccgtcccaagcggaagcccctacccaaatccctcattcctgggaaccccgagtcacggtattcagcctcccgctatgagtacccccgtttgtgccctcggcaaccctgccactcaggctactaatatgtcatgcgtaacagggcctgagattgtgtactccggaaaacacaacggaatttgcatctactttagcaggattatgggcaatatttgggacgcctctctggttgtggagaggatcttcaagagcggaaaccgggagatcactgctatcgaatcctccgtcccatgtcagctgctggaatccgtgctacaggagcttaagggattgcaggaattcctggaccgaaacagtcagttcgccggaggacctctgggaaatccaaatactacggcaaaggtacagcaacgtttgatcggatttatgcggcctgaaaatggaaatcctcagcaaatgcaacaggagctacaaagaaagtttcatgaggcccaattgtcagaaaagatatccttacaggccatccaacagctagtccgaaaatcttatcaggccttagctctgtggaagctcctgtgtgagcaccagttcacaatcatcgtggcagagctccaaaaagctaacgaactgttgcagcgctcccgccaggtacagaataagacagagaaggagcgtatgttgagagagagtctcaaagagtaccaaaaaatcagcaaccaagtcgatctctctaatgtgtgcgcacagtaccggcaggttcggttttatgaaggagtcgtggagctgagcttaaccgccgctgaaaagaaagacccccaagggctgggactacacttctataaacacggcgagcccgaagaggacatagtagggctgcaggctttccaagaacgccttaactcttataaatgcataacagatactttgcaggagctggtgaaccaaagtaaggcagcaccccaatctccgtctgtaccaaagaaacctggcccacccgtgctgtcttctgatccgaacatgttgtccaacgaagaagccggtcaccacttcgaacagatgctcaaactgtcccaaagatcaaaggatgaactcttttctatcgctctctacaactggctgatccaagtggacctagctgacaaactacttcaggtggcttcccccttcctcgagcctcacctggtccgcatggcaaaagtcgaccaaaaccgtgtccggtacatggacctgctatggaggtattacgaaaagaaccggtcgttcagcaatgcagcgcgagtgctgtctcgcctggcagacatgcactccaccgagatttctcttcagcagcggctcgagtacatcgctagagccatcttaagcgctaaatcctcaacagctatctcatcaattgccgcagatggcgaattcctacacgagctcgaggaaaaaatggaggtggctagaattcagctacagattcaagaaactcttcagcggcagtactctcaccacagctccgtgcaggatgccgttagtcaattggactctgagctgatggatatcaccaaattgtatggagagttcgccgatccgtttaagctggcagaatgcaaattggcaattatccattgcgctgggtactctgaccctattctggtccagacgctctggcaagacataatagagaaagaactgtccgattccgtgaccctatcttcgagcgatcgcatgcacgctttaagtctcaaaatagtcctgctgggtaaaatttatgcaggcacccccaggtttttcccccttgacttcatagtgcagttcctggaacagcaggtatgtacattaaattgggatgtcggtttcgtgatccagactatgaacgagattggtgttcctctgccgagactattggaggtttatgaccagctgtttaagtctagggatccattttggaacagaatgaaaaagcccttacacctgctcgactgtattcacgtcctcttgattcgctacgtcgagaatccctctcaagtgctaaattgtgaaaggcggagatttacgaatctctgtctggacgctgtttgcggctacctcgtcgaactgcaatctatgtcttctagcgtcgcagtgcaagctattacaggcaattttaagagcctgcaagcaaaactggaacgtttgcattag

SEQ ID NO: 233311 - DNA, 4311 bp, Artificial Sequence
  Description of Artificial Sequence: Synthetic coding sequence
atgttacatctgtctgctgcacctccagcccctccccctgaggtgactgctaccgccaggccctgcttgtgcagcgtgggtcgccgtggcgacggcggaaagatggccgcagcaggggctctggagcggtctttcgtggaactttcgggagcagaaagagaaaggcccaggcatttcagggagttcaccgtgtgttcaattggtacggccaatgctgtggctggagccgtgaaatatagtgaatcagcgggtggcttctattacgtggaatccggtaagctgttttccgtgacccggaataggttcattcactggaagacttctggagataccctggaactcatggaagagtctcttgatattaatttactcaataacgcaattcggcttaagtttcagaattgctctgtgctgccaggtggtgtgtacgtgtcggagactcagaaccgagtgatcatccttatgctgacaaatcagaccgtacaccggctcttactgccccacccatcacggatgtatcgttccgagctggtagttgattcccagatgcaatctatatttacggatatcggtaaagtggacttcactgacccctgtaattaccagctgataccggcagtgcctggtatctcacctaacagtacagcttcaacagcatggctgtcttcagacggcgaggcactgtttgccctgccctgcgccagcggcggaatcttcgtgctaaagctccccccatacgatatccctggtatggtgagtgtggtagagctaaagcagagcagtgtaatgcaaagactcctgaccggatggatgcctactgcaatacgcggtgaccagagcccttcggaccggccactgtcgctcgctgtccactgcgtcgaacacgacgcatttattttcgccctgtgtcaagaccataaactccgaatgtggagttacaaagagcaaatgtgtcttatggtggcagatatgcttgaatacgtcccagtaaagaaggatcttaggctcaccgctggaacaggacacaagcttagactggcttactcccctaccatgggcctttatctcggaatctacatgcacgcccctaagcgtggtcagttttgtattttccagctggtgagtacagaaagcaacagatatagtctggaccacatatccagtctgttcactagccaagaaacactgatcgactttgcccttaccagcacggatatctgggctctgtggcacgatgctgagaaccagaccgtggtgaaatacatcaattttgaacacaatgttgcgggacaatggaatcccgtctttatgcagcccctccctgaagaagagattgtcattcgagatgatcaagatcccagagagatgtatctccagtcacttttcactccgggacaattcactaatgaggctctatgcaaggcattacagattttttgtcggggaaccgagcgaaatttggacctctcttggtcagagctcaagaaggaagtgactcttgctgttgagaatgagcttcagggctccgtgaccgagtatgagttttctcaggaagaatttcggaacctccagcaggaattctggtgcaaattttatgcctgctgtctgcagtaccaggaggcactgagccacccactggccctgcatctcaacccacacaccaatatggtgtgtctgctgaagaagggatatctgagtttcctgatccccagtagcctagttgatcatttatacttgcttccctatgagaatcttctgaccgaggatgagactacaatttctgacgacgtcgatatcgccagagatgtgatctgtttaattaagtgcctccgcctgatcgaggaatcagtgactgttgatatgtctgtgattatggaaatgtcttgttacaatctccagtcccctgagaaagccgctgagcagattctcgaggatatgatcacaatcgacgttgagaatgtgatggaagatatttgttcaaagcttcaggaaatcagaaacccaatacacgccatcggactcctcatccgcgaaatggactatgaaacagaggtggagatggagaaaggtttcaatccggctcaacccctcaatatcagaatgaacctaacccagttatatggatcaaataccgccggatatatcgtatgtcggggtgtccataagatagccagcaccagattcttgatctgccgcgatttgctcatcctgcagcaactattgatgagactgggggatgccgttatatgggggaccggccagttgtttcaggcccagcaggatctgctgcaccgaactgcaccgctgctactgagttactatctgatcaagtggggatccgagtgcctggccaccgacgttccattggataccctcgaatccaatctacagcacctgagtgtgctagagctgacagacagtggagccctaatggcaaatcgattcgttagtagcccacagaccatagtcgaactgtttttccaggaagtcgcgcgaaagcatatcatcagtcatctcttttcacaaccaaaagcgcctctgtcccaaaccggattgaactggccagaaatgatcaccgctatcacttcttacttgttgcagttgctctggccttcaaaccccggatgcctcttcctggaatgtcttatgggtaactgccagtatgtacagttgcaggattacatccagttgttacatccgtggtgccaggtaaatgttgggtcatgccggtttatgttgggacgttgctatctcgtaactggggaaggacagaaagccttagagtgcttctgccaggccgctagcgaggtaggcaaggaggaatttctggatcggctaatcaggtctgaggacggcgaaatcgtgagcactcctaggcttcagtactacgacaaagtgcttagactcctcgatgttattgggctgcccgagctcgtgatccaactggctacatccgccataactgaggcaggtgacgattggaaatcacaagcaacgctgaggacttgcatctttaaacaccacctagacctaggccataattctcaggcttatgaagccctaacacagatcccagacagttccagacagctcgactgtttacggcagctggtcgtggtgttgtgtgaacgcagtcaacttcaagatctggtagaattcccttacgtaaatttgcataatgaggtggtcgggattatcgaaagccgcgcaagggccgtggatctgatgacccataattattatgaacttctctatgcattccacatctacagacataactaccggaaagctggcacagttatgtttgagtacggcatgcggctcggtcgtgaagttagaactctacgaggactcgagaaacaggggaattgctacctggccgcattgaactgtctccgccttatccgccctgaatacgcctggatcgtgcagcccgtgtccggagccgtgtacgacagaccgggtgcttcacctaagagaaatcacgacggtgagtgcacagccgcaccaaccaatagacaaattgagatcctagagctcgaggatctggagaaagagtgcagtctcgctaggatcaggctgacactggctcaacacgatccctcagccgtggcggtggccggatcttcaagcgccgaggagatggtgaccctcctcgtgcaggccggtcttttcgatactgccatcagcctgtgccagaccttcaagttgcctctgacccccgtttttgaaggattggcttttaaatgcatcaaacttcaatttgggggagaagccgcacaagctgaggcctgggcttggctagccgcaaaccagttatcatcagtcatcacaactaaagagtctagcgcgactgacgaggcctggcgcctcctcagcacctatcttgagagatacaaggttcaaaataacctctaccaccactgcgtcataaacaagctgctgagtcacggcgtacccttaccaaattggttgatcaactcatacaaaaaggtcgacgcagctgaacttctgcgactgtatcttaattatgaccttctggaggaggcagtggatttagtgtctgagtatgtggatgctgtgctcggcaaaggacatcagtatttcggtatcgagtttcccctctcagccacagctcctatggtttggcttccttactcctccatcgaccagctgcttcaggctctcggggaaaactcagccaacagccacaacatagccctgtcacagaagattctcgacaagttggaagattaccagcagaaggtcgacaaggctactagagaccttctttacagacgcacactatag

SEQ ID NO: 233312 - DNA, 1452 bp, Artificial Sequence
  Description of Artificial Sequence: Synthetic coding sequence
atggtgagcgttgtggagctgaagcaatcctcagtgatgcagcgcctactgaccggctggatgcccacggcaatccgcggagatcagagtccaagcgaccgtcccctcagtctggccgtgcactgcgttgagcatgacgccttcatctttgctctctgccaggatcacaagctccgcatgtggtcctacaaggagcagatgtgtcttatggtggccgacatgcttgaatacgtgcccgtgaagaaagacctacgtctgacggccggtaccggccacaaactcagacttgcatactcgcccaccatggggttataccttggaatatatatgcatgcgccaaaacgcggtcagaggagaggctttgccatgctacctggcctgaagctgctgtcaagcagcagtccccctaccagtgcttcccagtgtgctgggatcacgagtgtgaaccattccacacagccagaattctttttttgcattttccagctggtgtctacagaatcaaaccggtatagcctcgatcacatttccagccttttcacctctcaggagaccctcatcgactttgccctgaccagcacagacatctgggccctgtggcacgacgccgaaaaccagacggtggtcaaatacatcaattttgaacataatgtcgctgggcagtggaatcctgtatttatgcaacccttgcccgaggaagagatcgttatccgggatgaccaggacccgagggaaatgtacttgcaatcactgtttactccgggacagtttactaacgaggctctctgtaaggcacttcagattttctgtcggggaaccgagcgcaatctcgacctctcttggtcggagctgaaaaaggaagttactctcgcagtggagaacgagttgcaggggtcagtcaccgagtacgagttctcccaggaggaatttaggaatctccagcaggagttttggtgcaagttctacgcctgttgcttgcaatatcaagaggccctgtctcatcccttagctttacacctgaatcctcacaccaatatggtgtgccttctcaaaaagggctatctgtctttcctcatcccatcgtcactggtcgaccacctctatctcctgccctatgagaatctgctaaccgaggacgaaaccacgattagtgacgatgtcgacattgctcgcgatgtgatctgcctcatcaagtgcctgcgcctgattgaggaaagcgtcaccgtggacatgtctgtgattatggaaatgagctgctacaatctgcagagtcctgagaaggcagctgagcagatcttagaagacatgattaccattgatgtagaaaatgtcatggaggacatctgttctaagctccaggaaataaggaacccgatccatgccatcgggctgctgatacgcgaaatggactatgaaactgaggtagagatggaaaaagggttcaacccttag

SEQ ID NO: 233313 - DNA, 675 bp, Artificial Sequence
  Description of Artificial Sequence: Synthetic coding sequence
atgctccatttgtcagccgcaccacctgcaccccctccagaggtcactgcaacagcaaggccctgcttgtgcagtgttggcaggaggggggatgggggaaagatggcagctgccggtgcactggagaggtctttcgtggagctgtctggggctgaaagggaaagacctaggcactttagggagttcacggtctgctcaatcggcacagctaatgcggttgcaggcgcagtcaagtatagcgagtctgccggtggattttattatgtcgaatccggaaagctgttcagcgtgactaggaatcgttttatccactggaagacctctggcgacacactggaattgatggaagaaagtctggatataaatctgctcaataatgctattcggttgaaattccagaactgctccgttctgccgggaggcgtttatgtttcagaaacacaaaacagggtcatcatcctcatgctcacaaaccagaccgtccaccggctcctcctgcctcacccctctcgcatgtaccgtagcgtgtcatggctgagcgccatttcttttatatcacagatcacactcggagtgaccaacgtggttcttgagcggtgcctgctggagctgaaagaaatttggatcctggttatccctcatcaagcctatttcgacagctacaggctgaagtag

SEQ ID NO: 233314 - DNA, 6039 bp, Artificial Sequence
  Description of Artificial Sequence: Synthetic coding sequence
atggcaacgcctctcgcagttaatagcgccgctagcttgtggggcccttataaagacatatggcataaggtgggaaacgcgctgtggcggagacagcctgaggcagtccatctgctggacaagatcctgaaaaagcacaagccagacttcatcagcttatttaaaaatccacccaaaaatgttcaacagcatgaaaaagttcaaaaggctagcactgagggggtcgccattcaggggcagcagggaactcggttgttgcccgagcaactgatcaaggaagcctttatactgagtgacctctttgatattggcgagttggctgccgtcgaattgcttctagccggagagcaccagcagccgcactttccgggtctgactcggggtttagttgccgtgttactctactgggacggcaaaaggtgtattgctaacagcctgaaagcactgatccagtctcgacgcggtaaaacctggacactggagttgtcccctgagctggcctctatgactacgcggttcaccgatgaattgatggaacaggggctgacctacaaggttcttacgctggtctctcaaattgacgtgaataatgagttcgaaaagctccaacgggagagaggtcttggctccgagaaacatagaaaggaggtctctgacctgattaaagagtgtcgacaaagtctggccgaaagtctgtttgcctgggcctgccagagcccactcggcaaggaagacactttactattgattggccatctcgaacgggtgaccgtcgaggcaaatggcagcctggatgccgtgaatctggcactgctgatggcccttctgtattgcttcgatatctcctttatcgagcagtcaacagaagagagggatgacatgatacatcagctgcctctgttgactgagaagcagtatatcgccacgattcactcacgcttgcaagattcccaactgtggaagctgccgggattgcaggcaacggtccggttagcatgggcccttgcacttcgagggattagtcagctacccgacgtcaccgcactggctgaattcaccgaggcagatgaggccatggcagagttggccatcgccgataacgtgttcctgtttctaatggaaagcgtcgtagttagcgagtacttttaccaggaggagttctatataaggcgggtgcacaatcttattaccgattttcttgccctcatgcctatgaaggtgaagcagctgagaaacagagcagacgaagacgcccgaatgattcatatgagcatgcaaatgggaaacgaacctcccattagtcttcgaagagacttagagcatctgatgctgctgattggagaattatacaagaagaaccccttccatctggaactggctctggaatattggtgcccaactgagccacttcagacgccaaccattatggggtcctatctgggtgtggcccaccagcgaccccctcaaagacaggttgtgttgtcaaaattcgtgcggcagatgggagatctcctgcctcccaccatttatatcccttacctgaaaatgttacagggtctggccaacggtcctcagtgcgcacactactgcttctctttgctaaaggtgaatggttcatctcatgtggagaatatacaaggtgctggcggttcccccgtcagctgggagcatttttttcactcgctgatgctctatcacgaacacctccgcaaggacctgccatccgccgactctgttcaatacagacacttaccctccagggggatcacccaaaaagaacaagatggtctgattgcgtttctgcagctcactagcacaatcattacatggagcgaaaacgcaagactggccttgtgtgaacacccgcagtggactccggtggtagtcatcctcggtctgttgcagtgtagcatacctcctgtgcttaaagccgagttgctcaagacccttgctgctttcggcaaatctccagagattgctgcaagtctgtggcagagcctggagtacactcagatcctgcagactgtgcgcataccaagtcagagacaggctatcgggatcgaagtcgaacttaatgaaattgagagtcgatgtgaggagtacccactcacacgagcgttctgccagcttatttccactcttgttgagagctccttcccttccaatctgggagcagggctgcgaccacccggatttgacccctatctacagttcctgcgagatagtgtgtttttacgcttccgtacccgcgcatatagaagagccgctgagaagtgggaagttgccgaggttgttcttgaggtgttttacaaacttctccgagactatgagccacaactggaagacttcgtggaccagtttgtggagctgcagggggaagaaattattgcatacaaacctccaggcttctctttgatgtaccacctgctcaacgaaagccctatgctggagctcgcactgagtttattggaagaaggagtaaaacaacttgacacctacgccccattccccggtaagaagcatctcgagaaggctgtccagcactgtttagccttgttaaatttgaccctgcagaaagaaaatttgttcatggatctgctaagagagtcccagcttgccttaattgtttgcccactggaacagcttctccaaggcataaaccccagaaccaagaaagctgataatgtggttaacatcgcccgttacctctatcatggtaacaccaatcctgagctggcctttgagtccgccaagatcttgtgctgcattagctgcaattccaacattcaaattaaactggttggggacttcacacacgaccagtcaatttcccagaagttaatggctggcttcgtggaatgcctggactgcgaagacgcggaggagtttgtgagactggaggaaggtagcgagctggaaaagaagctcgtggctattaggcacgaaacaagaatccacattctcaatttactgattacgtcgttggaatgtaaccccccaaatctggcgctctacctgttgggcttcgaactaaagaagccggtttcaacaacaaacttgcaagaccctggcgttctgggttgtcctagaacctgcctgcacgccattttaaacatactagagaaagggacagaaggcaggaccggccctgtggcagtgcgggaatcaccccaactggccgagttatgctaccaggttatctaccaactctgcgcatgcagcgatacatccggtccaaccatgagatacctcagaacttcccaggactttctgtttagtcagctgcagtaccttcccttttccaataaagagtatgagattagtatgcttaaccagatgagttggttgatgaaaaccgcttccatagaactgcgggtgacctcactgaatcggcaaagatctcacactcaacgcttgttgcacctcctgctcgacgacatgccagttaagccatactccgacggagaaggagggatagaagatgagaaccggtccgtttctggcttcctccatttcgacaccgcaaccaaggtacggagaaagatactgaacatcctggattctatcgatttttctcaggagatcccggaacctcttcagcttgatttttttgaccgagcccagatcgagcaggtcatcgcaaactgcgaacacaagaatctaagggggcaaacggtgtgtaatgttaaactgctccacagggttttagtagctgaggtgaatgccttacaaggaatggctgctattgggcagagaccactgcttatggaagagatctccaccgtgctgcagtacgttgtagggaggaacaagctgttacagtgtctgcacgcaaaacgtcacgccctcgagtcctggcgacagctggttgaaataatcctgacagcatgtccacaggacctcattcaggctgaagatcgccagttgattattagggacattctgcaggatgtgcatgataagatattggacgacgaagccgcacaggaactgatgcccgtagtcgccggtgccgttttcactctgacggctcacctttcccaggccgtgctgacagaacagaaagagaccagtgttttaggccctgccgaagcccactacgcctttatgctagacagttgtttcactagcccgcctccagaggagaacccgttggttgggtttgccagcattggagacagctccctgtacatcatcttgaagaaacttttagactttattcttaagaccggcggaggtttccagcgtgtgagaacccatctgtacggtagcctcctgtactacctgcaaatcgcccagcgtcctgatgagcccgatacattggaagcggcaaaaaagacgatgtgggagcgactaacagccccagaggacgtgtttagtaagctccaacgggagaatatcgcaatcatcgagagctatggggctgccctcatggaagtcgtatgtagggatgcatgtgatggtcacgagatcggcaggatgctcgctcttgcccttctggatagaatcgtctctgttgataaacagcagcagtggctgctgtacctgtctaattccggatatcttaaagttctggtcgactccctggtcgaggacgatagaaccttacagtctctgttaaccccccaaccacccttgctcaaggctctttacacttatgagtctaagatggcgtttttgacacgagtagcgaagattcagcagggagcgctggagcttctcagaagtggcgtgatcgtgcgcctggcgcagtgtcaggtgtatgacatgcgccctgagactgatccacaaagcatgtttggcatgcgagaccctcctatgtttatccctacgcctgtggacaggtatcggcaaattctcctcccagcactgcagctttgccaagtcatcttgacatccagtatggcacagcatttgcaggcagccggtcaggtgctgcagtttctgatctcccactccgataccatacaggccatactgagatgccaagacgtgagcgctggctctttacaggaactcgcactgcttactgggataatcagtaaggctgccctgcccggaatactgtctgagttggacgtcgatgtgaacgagggttcacttatggagttgcaaggacacatcggacgttttcagagacagtgcctggggctgcttagccgctttggagggtccgacagacttcggcagttcaagtttcaggacgacaacgtcgaaggagataaggtctccaaaaaagacgaaatcgaactcgcaatgcaacaaatttgcgccaacgtcatggaatactgccagtctctcatgctccagagttctccgaccttccagcatgccgtgtgcctgttcacaccttccctgtctgagacagtgaaccgcgatggaccgcgtcaagatacacaggcaccggtggtgccttactggaggctgcctggccttggcattatcatctatctactcaaacagagcgctaatgactttttctcctattatgactcacacaggcaaagcgtatctaaattgcagaacgttgaacaattgccgcctgacgaaattaaggagctgtgtcagtcagttatgccagcgggagtcgacaagatcagcaccgcgcagaagtatgtgctcgccagacggaggctggtaaaggtcatcaataaccgggcaaagctactcagcctgtgtagctttattatcgagacttgcctgtttattctgtggcgccatttagaatactacctgctgcattgcatgcctaccgatagtcaagattctttgttcgcatcaaggaccctgttcaagagtcgcaggctgcaggattcattcgcctccgagacaaacctggactttcggtccggacttgccatcgtgtcacagcacgacttggatcagctgcaggccgacgctattaatgcgttcggggagtcgctgcaaaagaaactgctcgatatagaaggcctgtatagcaaggtaaggagtcgctatagcttcatacaggcgctggtccggagaatcagggggctcctgcgaatatcaaggaactac

SEQ ID NO: 233315 - DNA, 750 bp, Artificial Sequence
  Description of Artificial Sequence: Synthetic coding sequence
atgtcactgcgcaactactccgaaagggaggtttcggaccttatcaaggaatgccgccagtcccttgcagagtcactgtttgcctgggcctgtcagagcccactaggcaaggaggacacacttcttctcatcggacatctggaacgcgtgacggttgaggcaaacggaagcctcgatgccgtgaacctcgcactcctgatggcactcctatactgttttgacatctcctttatcgaacaaagtacagaagagcgggacgacatgattcatcagctcccactgttaaccgaaaagcaatatatcgcaaccattcactctcgcctccaggattcacagttatggaaacttccgggtctgcaagccacggtgcgcctggcatgggctctggcactacgcggtatttcacaactcccagatgttactgccctggctgagtttacggaggcagacgaggctatggccgaacttgccatagctgataatgtgttcttgtttctgatggagagcgtagtggtgtccgagtatttttatcaggaggagttctatattaggcgagttcataatttaataacggatttcctcgctctcatgccaatgaaggtgaagcagctgaggaatcgcgctgacgaagacgcccgtatgatacacatgagcatgcagatggggaatgagcctcctattagtcttcgccgtgaccttgagcacttaatgctgctggtatcaaagctgctggtcctgcggcttaattag

SEQ ID NO: 233316 - DNA, 5664 bp, Artificial Sequence
  Description of Artificial Sequence: Synthetic coding sequence
atggccgctaggggtagaggtctcctgctcctgaccctgtcagttttgctcgccgcagggccttctgccgcagccgcaaaattgaatatccccaaagttctcctccctttcacgcgtgcgaccagagtaaactttactcttgaagcttccgaaggatgttatcgctggctaagcaccaggcccgaggtggcgagcatcgaaccacttggactcgacgaacagcagtgcagccagaaggcagtagttcaggctagacttactcagcctgccagactgacatcaatcattttcgccgaggatattacaaccggtcaggtcctccgttgtgacgcgatagttgacctgattcacgatatacagattgtgtctactactcgggagctgtacttagaggactccccccttgagctgaagatccaggcccttgatagtgagggcaacacattctcaactctggccggtctggtgttcgagtggactatcgtcaaggatagcgaagcagatcgtttcagtgatagccacaatgcgctgaggatccttacatttttggaatcaacttatatacctccatcttacattagcgagatggaaaaggcagcaaaacagggagatacaatactagtatcaggaatgaaaacaggctcttctaaactgaaagccaggatccaggaagccgtatataaaaatgttagacccgctgaggtgcgcttacttattctggagaacatcctcctgaatcctgcatacgatgtgtatttaatggtgggtacatctatccactataaagtgcaaaagattcgccagggtaagattactgagctatcgatgccttcggaccagtacgagctgcagctccagaatagtatccctggcccagagggggatcctgcacgccctgtcgctgtccttgctcaagacacgtcaatggtaactgctcttcagctgggacagtctagtttggtgctcgggcaccggagcatccggatgcagggggcaagcaggctcccaaatagtactatctatgttgtcgagccgggatacttgggcttcactgtgcaccctggtgataggtgggtactggaaactggcagattatacgagataacaattgaggtgttcgataaatttagcaataaagtgtatgtgtctgacaacattagaattgaaaccgtgctgcccgcagaattttttgaggtgctcagttcaagtcagaatggaagttatcatagaataagggctctaaagcgaggacaaactgccatcgacgccgcactgacctccgtggtggatcaggacggtggggtacacatattgcaggtacctgtttggaatcagcaagaggtggagatccacattccgatcacactgtacccttctatactcacctttccttggcagcccaaaacgggggcttaccagtatactatcagagctcacggcggtagcgggaacttcagctggagctccagctctcatctcgttgccaccgtcaccgttaagggagtcatgactacgggaagcgatatcgggttctctgtgattcaggcacacgacgttcagaaccctctccactttggtgaaatgaaagtgtacgtcattgaacctcattccatggagttcgctccctgtcaagtcgaggccagagtcggtcaggccctcgaactgccgctgcggatcagcggactgatgcctggaggcgcttctgaggtggtaaccttgtcagattgctctcactttgaccttgctgttgaggtggagaatcagggcgtttttcagcccctgccagggcgacttccgcctgggagcgagcattgttctggcattcgcgttaaggctgaagcacagggctctacgactttactggtctcttaccgccacggacacgtgcacctgagtgccaagatcacaatcgccgcttatctgccgttaaaagccgtcgaccccagcagtgtagcattagtgacgctgggctcttccaaggaaatgcttttcgagggtgggcctagaccttggattctggagccaagcaaattcttccagaatgtgactgcagaagatacagactcgattggactggccctgttcgcgcctcatagctcaaggaattaccagcagcactggatcctagtgacttgtcaggccctgggcgaacaagtcatcgcgcttagtgtcggcaataaaccatctttgactaatcctttccctgctgtcgagcccgctgttgtgaagttcgtctgtgcccctcccagcaggctaactctggcgccagtctacacaagtccccagttggacatgagttgcccattgttacagcagaataaacaggtcgtgcccgtctcctcccatagaaatcccagactcgacctggcggcttatgatcaggagggaagacggtttgacaacttttcctccctgtccatccagtgggagagtactaggcccgtcctcgcatcaattgagcccgaattaccgatgcagctggtgagtcaggacgatgaatccggtcagaagaagctgcacgggctgcaggcgatcctggtgcacgaagccagtggaactacggcgattacagccacagccactggctaccaagaaagccacctttcttcagctcgtactaagcagccccatgacccactggtgccgctgtctgcttccatcgaactgatccttgtggaggacgttcgggtgagcccggaggaagtgacgatctataatcatcccggaatacaggctgagttgagaattcgggaggggtccggatattttttcctcaacactagcacagccgacgtggtcaaggtggcttatcaggaggcacgcggtgttgctatggttcaccctttgttgccgggatcctccacaattatgatccacgacctttgcctggtgtttccagcccctgcaaaagctgttgtgtatgtcagcgatatccaagaactgtatattcgcgtcgtcgataaagtggagattggcaaaacagtgaaagcctacgtcagagtcctggacttgcacaaaaaaccattccttgcaaagtattttccctttatggaccttaagctccgcgcagcttcgcccattattaccttggttgcattggatgaggccctggataactacaccataacattcctcatcaggggtgtcgccatcgggcagacctctcttacagcctcagtgactaataaagcaggacagcgcatcaattccgcaccgcagcagattgaggtgtttccgccattccgactgatgccacgcaaagtgacccttctgatcggggctaccatgcaagtaactagcgagggcggtccccaaccccagtccaatattcttttcagcatttccaacgagtcggtggccctggtgagcgctgccggactcgttcagggtctggccattggaaatggcacggtcagtggcttggtgcaggcagttgatgccgagacgggcaaggtggtgattatcagccaagatctagtgcaggtggaggtactactgttaagagctgtgaggattagagcaccaatcatgagaatgaggaccgggacacagatgccgatttatgttaccggtattacaaaccatcaaaatccttttagcttcggcaacgccgttccaggtctgacattccactggtccgtgacaaaacgtgacgtccttgacctccgtgggcgacatcatgaggcttctattcggctcccaagccagtacaactttgccatgaatgtgttaggaagggttaaagggagaactgggctccgagtcgtcgtaaaggcggtcgaccccacaagtggccagttgtacggcctcgcaagagagctgtccgacgagatacaggtgcaggtgttcgagaagttgcagctcttaaacccagaaattgaggcagaacagatcttaatgagcccaaacagttatatcaaacttcagacgaaccgcgatggagctgcgagcctgtcataccgggtcttggacgggcctgagaaagtgcctgtggttcacgtggatgagaagggctttctcgcatccggcagcatgatagggacaagcactattgaagtcatcgcccaggagccattcggggcaaatcagaccattattgtagccgttaaagtctcccccgtgagctatttaagggtttcaatgagccccgttcttcatacgcagaataaagaggccttagtggccgtgcctctggggatgacagtgacattcacagtgcactttcatgacaactctggggatgtgtttcacgcccacagcagtgtcctgaacttcgcaacgaatcgcgacgatttcgttcagattgggaagggccctacgaacaatacttgtgttgtaaggactgtgtccgtcggattgactctcctccgtgtatgggacgcagaacacccaggactgtccgacttcatgcctctgccagtcctccaggcaatctcccctgagctgagtggtgctatggtggtcggagatgtcctttgtcttgccacagtcctgaccagtctcgaaggcctctccggaacctggtccagtagcgccaactcgatcctccacatcgacccaaaaactggtgtagctgttgctagggccgtgggatctgtcaccgtatattatgaggtggcgggtcacctgcgcacctacaaggaagtcgtggtctccgtacctcagcgcatcatggcccgtcaccttcatccaatccagacctcgttccaggaggctacagcatccaaggtaattgttgcggtcggagatcggtcttccaacctgagaggcgagtgtacccccacacagagagaggttattcaggccttgcatcccgaaaccctgatttcatgccagtctcagtttaagcccgcagtgttcgattttccatcacaggacgtctttactgtggagccacaattcgacaccgctctgggacaatacttttgctccattacgatgcaccgactgacagacaagcagcgaaaacacttaagcatgaagaaaactgcgctcgtcgtgagcgcgtctcttagcagttcacactttagcactgagcaagtgggcgctgaggtccctttttcacccggtctctttgcagatcaggccgagatcctgctttcaaaccattacactagctccgaaattagagtgttcggcgctccggaagttttggagaacctcgaagtcaaaagcggttctccggcagtgctggctttcgcgaaagagaaaagctttggttggccatcatttattacctacaccgtgggtgtgctggatccagccgctggctcccagggtccgctatcgacaacactgacttttagcagcccagttaccaatcaggccattgcaatccccgtgaccgttgcttttgtcgtggataggcggggtccgggtccgtacggagctagtctgtttcagcattttctggactcgtatcaggttatgttcttcaccctcttcgccctcctggccggaacggctgtgatgatcattgcatatcacaccgtctgtacccctcgcgacctggccgttcctgcagctctgacacccagagcaagtcctgggcatagcccccactacttcgccgcaagcagccctacatctcccaacgcactacccccagcccgtaaagcgagcccaccgagtggactgtggtcccctgcttacgcatcccattat

SEQ ID NO: 233317 - DNA, 6272 bp, Artificial Sequence
  Description of Artificial Sequence: Synthetic coding sequence
atgggggacgagatggacgccatgatccccgagagggagatgaaagacttccagttccgtgcacttaaaaaagtgaggatattcgactcacctgaagagctcccaaaggaaagaagctcactcttagccgtatccaacaagtacggactggttttcgccggtggagcctccgggctccaaatttttcccacgaagaacctgctgattcagaataaacccggtgacgatcctaacaagatcgtcgacaaagtgcaggggcttctggtgccgatgaagtttcctatccaccatctggccctgtcatgtgacaatctgacattatccgcttgcatgatgagttccgaatacgggtcaatcatcgcgttcttcgatgtgcggacttttagcaacgaagctaaacagcagaagcggccattcgcatatcacaaattattgaaggatgccggaggcatggtgatcgacatgaaatggaaccctacggtgccgtctatggttgcggtgtgtctggcagatgggtccattgctgtcctgcaggtgaccgaaacagtgaaagtgtgtgcgacactgcctagcaccgtggctgtgacctctgtgtgctggtcacccaaaggaaagcagctcgccgtaggcaaacagaatggtactgtcgtgcagtacttacctaccctgcaggagaagaaggttatcccttgtccccctttctatgaatctgatcacccagtgagagttttggatgtcctgtggattggaacttatgttttcgcaatcgtttacgcggcagccgacggaactttggaaacatcacccgacgtagttatggccctcctgcccaagaaagaggagaagcatcccgaaatcttcgtcaatttcatggaaccttgctatgggtcttgtacagaaaggcagcaccactactacctgtcctacatagaagaatgggatctggtgctcgctgcgagcgctgccagtacagaggtgagcatcttggccaggcagtcagatcaaattaactgggagtcctggttactggaagattcaagcagggccgaactgcccgttacagataaatctgatgatagtctcccgatgggggtggttgtggactacacaaaccaggtggagatcactattagcgatgagaagaccttgccccctgcccctgtcctgatgctgttgtcgactgatggagtcttgtgtccattttacatgatcaaccaaaacccaggggtcaagagtctgattaagaccccagaacgcttgtcactagagggcgagcggcagcccaaatccccaggcagcactcccaccacgccaacatcatcccaggcaccccaaaagctcgatgcctctgcagcagcagctcctgcgtcacttccaccaagttctccagcggcaccgatcgctacattttctttgctgcccgctggaggagcaccaacggtgttcagcttcgggagttcaagcctaaaatcgagtgccactgtgacaggggagcccccatcctatagcagcggcagcgattcgtccaaggctgccccaggacccggtccatcgaccttttctttcgtgccccctagcaaagcttctctcgctcctacccccgctgcaagcccagtggcccctagcgcagcatccttttccttcggatcctctggattcaaacctacgctcgagtccacaccagttcctagcgttagcgctcctaatattgctatgaagccgtcttttccaccaagtacatctgcagtgaaagtgaacttaagcgaaaagttcactgctgccgctacctctactccagtatctagctcacaatcagctccccctatgagccccttttcatcggccagcaaacccgcagctagtggacccctgtcccacccaacccctttgtccgctcctccctctagcgtcccccttaagtcatctgtgctcccctcccccagcggacggtccgcacaaggcagttcctctccagttcctagcatggtgcaaaagtcacctcggataacgccgcctgccgcaaagccaggatcacctcaggcgaaatcccttcagcccgctgtggcggaaaaacaagggcaccagtggaaagacagcgatccagtgatggccggaatcggcgaagaaattgcccattttcagaaggagttggaggagctcaaggctcgcacttctaaagcctgtttccaggtaggcacctccgaggagatgaaaatgctgagaaccgagtcagacgaccttcatacattccttctggagatcaaagagaccaccgaaagtctccatggggacatctcctcactgaagaccacgctgctggaaggtttcgccggtgtggaggaagcgagagaacagaacgagcgtaacagggatagcggatacttgcatctgttgtacaaaaggccgctggatccaaagtccgaggcccagctgcaagagatcagaaggctgcaccagtatgttaagttcgcagtccaggatgtcaacgacgttcttgatctcgagtgggatcagcacttggagcagaagaaaaagcagcgccacttgctggttcctgagagggagaccctcttcaacaccctggccaacaaccgcgaaatcattaaccagcagcgaaaaagactcaaccacctcgtggacagcctccagcagctgcggttgtacaaacaaacgtcattgtggtccctatcttccgccgtgccttcccagagtagcattcattcattcgatagcgatctcgaatcactgtgtaacgcacttttgaaaactaccattgagtcgcacactaagagcttgcctaaagtgcccgcaaaactgagcccaatgaagcaggcacaactacgtaacttcctggcaaagcgaaaaacccctccagtacgctccacggcacctgcatccctcagcaggtcagccttcttaagccagcgctactacgaggatctggacgaggtatcttcaacttcctctgtctcgcagtccctcgagtcagaagacgccagaacttcttgcaaagatgacgaggcagtcgtgcaagccccaagacacgcacctgtcgttcggactccatccattcagccgagccttctgccacatgctgcaccattcgctaagagccaccttgtccacgggtcaagtcctggcgtcatgggtacaagtgtcgccacgagcgcaagtaagattatccctcaaggagccgacagcacaatgttggccacaaaaacagtgaaacacggagccccatccccctcccatcccatctctgctccccaggccgctgctgcggctgccttaagacggcaaatggcttcccaggccccagctgtgaatacactgaccgagtccaccttgaaaaatgtcccccaagtggtgaatgtgcaggagctaaagaacaatccagccactcccagcacagcgatgggctccagcgttccctactctaccgcaaagactcctcatcccgtgctgactcctgtggctgccaaccaagccaaacagggaagcttgatcaattcactgaagccatccggtcctacacccgcaagcggacagctttcttcaggtgataaggcctccgggacagccaagatcgaaacagccgtcacttccaccccgagcgccagcgggcaattcagcaagcccttcagctttagtccctcaggtactggattcaactttggcatcattacacccacaccttccagcaacttcacagcagcacagggcgctaccccctctactaaagagtcttcccagcccgacgccttttccagcgggggagggtccaagccaagctacgaggccattccggagagtagccccccttctggaatcacttccgcctcaaacaccacccccggagagccagcagcgtctagcagcagacctgtcgcacccagtggcacagctttgtctactacaagctcaaaactggagacacctccatctaagctaggcgagcttttgtttccatcttcattagcgggagagactcttggctctttttctggcctacgggtgggtcaggccgacgactctaccaagcccactaataaagcctctagcaccagtctgacttctacacaaccaaccaagacttctggcgtgccctccggatttaactttactgcccctccagtgctggggaaacacaccgaaccaccggtgacctcctccgcaacaaccaccagcgttgcgcctcccgcagccacttctacctcttctactgctgttttcggcagtctgccggttacatccgccggaagctctggtgtgatttcattcgggggaacgagcctgtctgctggcaaaacatctttttcatttggaagccaacagactaactccaccgttccacccagtgcccctccacctacgacagcggcaacgccccttcctacttcgttcccaacccttagtttcggaagtctcctgagctcggcaaccacaccctctctgcctatgagtgccggacggtccacagaagaggccacatcgagtgccctgcccgaaaaaccaggggactccgaagtcagcgcttcagccgcatccctgctcgaggagcagcagtcagcgcaacttcctcaggccccaccacagacctctgactcagttaagaaagagccagtcctggcccagcccgctgtgtctaactctggaacagctgcgagctctacctctctcgtggcattgtcagcggaagccacacctgcaacaacaggcgttccagacgcgaggactgaggccgtaccgccagctagttccttcagcgtgcctggacagactgccgtgacagctgccgctatcagctcagcaggtcctgtggctgtcgagaccagttccacccctattgcctccagtactactagcatcgtagcgccaggcccatcagccgaggccgctgctttcggaaccgtgacatcaggttcttccgttttcgcccagccccctgccgctagcagcagtagtgcctttaaccaacttactaataatactgccactgcaccaagcgctactcctgtgtttggccaggtagccgctagcaccgcaccaagcctgtttggacagcagacggggtcaacggccagtacagccgcagcaaccccacaggtgagctcctccggattttcaagtccagcttttgggactacagccccaggcgtgttcgggcagaccacattcggacaggctagcgtgttcggacagagcgcctcctccgctgcttctgttttcagcttctcccaacccggtttttctagcgtgcccgcttttggacagcccgctagcagtacccctactagcaccagcggaagcgtttttggggcagcttcctcaacatcctcatcgtcaagcttcagttttgggcagtcatcccccaacaccggcggaggcctgttcggccagagcaatgctccagctttcggacagtccccgggatttggtcaaggcggaagcgtttttgggggtacttctgcggcaacgacgacagcagctactagcggctttagcttttgccaggcatcaggcttcgggagttctaatactgggtccgtgttcggccaggccgcaagtactggcggtatcgtgttcggacaacagtctagcagttccagcggctctgtgttcgggagcgggaacacgggtcggggtggcggattcttcagcgggctcggaggaaagcctagtcaggatgctgccaacaaaaaccctttcagcagtgcctcaggcggtttcggctcaactgccacctccaataccagcaacttgtttggtaactccggagccaaaacttttggaggattcgcgagttccagttttggagagcagaagcccactggcacattttcctctgggggtggatcagtggcgtcccagggttttggcttcagcagtcctaacaagacgggcggattcggagccgctcccgtgtttggctcacctccgacctttgggggaagccctggcttcggaggagtccctgcctttggctctgcccctgcctttacctctccccttgggtcaacaggtggtaaagtcttcggggaagggacagccgctgcgagcgcaggaggcttcggattcggcagcagctcaaacacaacatcttttggaacactagcaagtcagaatgcaccaacgtttgggtctcttagccagcaaacttcaggcttcggcacacagagttcaggcttttccggatttggtagcggcacggggggatttagctttggatcgaataattcatcagtgcagggctttgggggatggagaagcta

SEQ ID NO: 233318 - DNA, 6242 bp, Artificial Sequence
  Description of Artificial Sequence: Synthetic coding sequence
atgggcgatgagatggacgccatgattcccgaacgagagatgaaagacttccagtttagagccctgaagaaagtccgtatattcgatagccccgaagagcttccgaaggaacgatccagccttctggcagtgtctaataagtatggccttgtattcgcgggaggagcatccgggctgcaaatttttccaaccaaaaatctcctgatccagaacaagcccggagatgatcccaataaaatcgttgataaggttcagggtctgctggtgcctatgaaattcccgatccaccacctggctctttcatgtgacaacctaactctgagtgcctgtatgatgagcagcgagtatggttcaatcattgcttttttcgacgttaggacatttagtaacgaagccaagcagcagaaacgtccctttgcctatcacaaactactgaaggatgctggcggtatggtcattgacatgaaatggaatcctactgtgccatccatggtcgcggtctgcctggccgatgggagtattgcggtcttgcaggtcactgagactgtgaaagtctgcgctaccctcccatccaccgtggccgtgacttccgtgtgctggtcaccaaaaggtaagcagttagctgtgggcaagcagaacggcacggttgtgcagtacttgcccacactgcaggaaaaaaaagtaataccttgtccccctttctacgaaagcgatcatcctgttcgggttctggatgtgttgtggattggaacgtatgtctttgctatcgtgtatgccgctgccgatggtacattggagacctcgcccgatgtggtcatggcattgctgcccaagaaggaagaaaagcacccggaaatctttgtcaacttcatggaaccttgttacggctcttgtactgaacgccagcaccactattacctttcctatattgaggaatgggatctagttcttgcagcttccgcagccagcaccgaagtgtccatcctggcacggcaatccgatcagattaactgggagtcctggctgttggaggattccagtagagccgagctgccggtgacggacaagagcgatgattcccttcccatgggagtggtggtggactacaccaaccaggtggagattaccatttcagacgaaaagaccctgcccccagccccagtactgatgctgctcagcacagacggcgttctttgccccttttacatgatcaaccagaaccccggtgtgaaaagtctgatcaagactcccgagcgattgtcacttgagggggaaaggcagcccaaatctccagggtccactccgacaacccctacctcttctcaggcgcctcagaaactcgacgcatccgcggctgccgctcccgcaagcctgccgccaagttcccccgctgccccaattgctacttttagtcttcttccggctggtggggcaccgacagtattctccttcggcagcagcagcttgaagtccagtgctactgtaactggcgagccgccaagctacagctcaggaagcgacagttcaaaagcagctccaggacctggacctagtacgtttagcttcgtccctccgtccaaggcttctcttgcccctacaccagccgcttcgccggtggcgccttctgccgcttccttttccttcggctcttcagggttcaagccgacactggaaagtactcctgtcccttccgtcagtgccccaaatatcgcaatgaagccatcatttcctcctagtaccagtgcggtaaaggtgaacctgtccgaaaactctagtcaatccgccccacctatgagccccttcagcagtgcgagcaagcccgcagcctctggcccactgtctcaccctacgccacttagcgcaccaccgagttctgtgcccctgaagagctctgtgctcccgtccccctccgcgggtagatctgcgcagggatcctccagccctgtacccagcatggtgcagaagtcgccccgaatcacaccccctgcagcaaaaccaggctccccacaggctaagagtctccagccggctgttgccgagaagcagggacatcagtggaaagattctgaccctgtcatggccggaattggcgaggagatcgcgcacttccagaaggaactggaggagttaaaggccaggacaagcaaagcttgttttcaggtagggacatccgaggagatgaagatgttgaggaccgaaagtgacgatttacatactttcctgctcgagatcaaggaaactacagaaagcctgcacggggacatatcatcattgaaaaccaccttactggagggatttgcaggagtcgaagaagcccgagagcagaatgagaggaatcgggactccggttacctgcacctcctgtataagcgccctctggaccccaaatcagaggcccagctgcaggagatccgtagattacatcagtacgtcaagtttgcagtccaagacgttaacgacgtcttggatcttgagtgggatcaacacctggagcaaaagaaaaaacagcgacatctgttagtgcctgagagagaaacattgtttaacaccctggccaacaatagagagattattaatcagcagagaaaaagactgaatcacctcgtcgacagtctgcagcagctgcgattatacaagcagacgagcctctggtccctgtctagtgccgtgccctcccaatctagcattcatagtttcgattcggatctggagtcgctgtgcaatgccctgctgaaaacaacgatagaatctcacaccaaaagcctgcctaaggtgcccgcaaagttatcgcccatgaagcaggcccagctccggaactttctggcgaagcggaagacacccccagttagatcaaccgctccggcatctctcagtaggagtgctttcctcagccagaggtattatgaagacctcgacgaagtgtccagcacaagctccgtgtcacagtcattggagtcagaggatgctagaacttcttgtaaagatgacgaggccgtcgttcaggcccctcggcacgctccggtagtgcgcacccctagcattcagccctccctacttccgcatgcggctccatttgctaaatcccatctagtgcacgggtccagcccaggtgtgatggggacctccgtcgccacttctgcctcaaaaattatcccccagggggctgattccacaatgctggctaccaagactgtcaagcacggggcaccttccccctcccatcccatctccgcgccacaggccgcagcagccgcagcacttcgccgtcagatggccagtcaggctcctgcggtcaatacattaacagagagtacacttaagaacgtgccccaggtagtgaatgtccaagagctcaagaataatcctgccactccaagcaccgccatgggcagcagtgttccttatagcaccgctaaaactcctcaccctgtgttaacacctgtcgcggcaaaccaggcaaagcagggcagcttaatcaattcacttaagccgtctggcccaacacccgcttcaggacagctcagctctggggacaaagcttctggtaccgccaagattgagaccgcagttacctctacacccagcgcaagcggccagttcagcaaaccatttagtttctccccttccgggaccggcttcaattttggcatcatcactcccaccccgagctcaaattttactgccgctcagggcgctacccccagcactaaagagtctagccagcctgacgctttctcttccggaggaggctcgaaaccatcctacgaagcaatccccgagagttctcctccgtctggcatcacatctgccagtaataccacacccggtgaacccgcagcctcatctagcagaccagtagctcctagcgggactgccctctccactacatccagcaagctggagacacctccctctaagttaggcgaactgctcttcccttccagcctggctggagagactctggggagctttagcggactgcgcgtaggacaggcagacgactctacaaaacccaccaataaggcctcttctacaagcctcacatcaacacagcccaccaagacatccggcgtgccctctggctttaacttcacggctcctccagttttgggaaaacacactgaacctccggtgacttcttctgctaccacgacatccgttgccccaccagccgcaacctctacttcttccaccgcggtattcggatcccttccggtcacaagtgctgggtccagcggggttatttcatttggcggaacttcactgagcgccggaaagactagcttctcctttggctcgcagcagacaaattccacagtgcccccttcggcccctcctcctacaactgctgccactccacttccaacttcttttcctacactcagttttggctcactgctttcaagtgccaccacaccaagcctccccatgagcgcgggacgaagcactgaagaagctacatcatccgccttaccagagaaacctggagacagtgaggtctccgcttccgcagcgagtttattggaggaacagcaatctgctcagttgccacaggcgccaccgcagaccagtgactccgtcaaaaaggagcccgtccttgctcagccggcagtgagcaacagtggtacggccgcatcctcaacatcgctggtggctctttcagccgaagccacacctgctacaacgggagtgcctgacgctcgcaccgaggcagtgcctcccgcaagttcattcagtgtacccggtcagactgcagtcactgctgcagcgatcagttctgcaggcccagtcgccgtggaaacaagtagtacgcctatcgctagctctaccacttcaatagttgcacctggccctagcgccgaggcggcagcttttggcacagtcacctccggttcctctgtgtttgcccaacctccagcagcctcctcctctagtgctttcaaccagttgactaataacaccgctacggctcccagcgctacacccgtgtttggccaggtggccgcaagtacagccccatctctgtttgggcagcaaacaggcagcaccgccagcacagcagctgccactcctcaggtgagcagctccggattctcttcaccggcatttggaactaccgctcctggcgtgtttggccagacaacatttggtcaggctagtgtatttggacagtccgcttcttccgcagcttccgtatttagtttcagccaacctggctttagtagcgtgcccgcatttggtcaacccgcttcgtctacaccgacatctaccagcgggagtgttttcggcgcagcctcttctacatcttcatcctcgtctttttctttcggacagagtagcccaaatacaggcggaggtctttttggccaatcaaatgcgcctgccttcgggcagagtcccggtttcggccagggaggctccgtgttcggaggcacgagcgccgctaccacaacggcagccacgtccggtttcagcttctgccaggcttccggcttcggctccagcaacactggaagcgtgtttggacaggccgcatccactgggggtattgtcttcgggcagcagtcaagttccagcagcggtagtgtgttcgggagtggcaacactggcaggggtggcggtttcttcagtgggctgggaggtaagccctcccaggacgcggctaataagaacccatttagcagtgccagcggtggatttgggtctaccgccacatccaatacaagcaatctttttggcaattcaggggctaagaccttcggcggttttgccagtagctccttcggcgaacagaagcctaccgggactttcagtagtgggggagggtcggtagcctcccaaggcttcggcttcagcagccccaataaaaccggaggttttggagctgccccagtttttggctcaccaccgactttcggcggatcacccggattcggcggtgtccctgcttttggatccgctcctgcgttcacaagtcctctcggaagtacgggaggaaaggtgttcggagagggcactgctgctgcatccgccggaggcttcggtttcggaagttccagcaacaccacatcgtttggcacactggcgtctcagaatgctccaacattcggatcgctgtctcaacaaacgagtggatttggaacccagagtagcggatttagtggatttggctcagggaccggagggttttccttcggatcaaacaattcatctgtgcagggttttggcggatggaggagtta

SEQ ID NO: 233319 - DNA, 4560 bp, Artificial Sequence
  Description of Artificial Sequence: Synthetic coding sequence
atgaaacctagcttccccccttccaccagtgctgtgaaggtaaatctctctgagaagtttaccgctgctgccaccagtactcccgttagttcttcacagagtgcccctcctatgagtcccttttcctccgcctcaaagcctgctgcatccgggcctttgagtcacccgacccccttgtctgcgcctccctcctctgtgcctctaaaatcttcagtcctgccctctccgagcggcagatcagcccaagggtccagtagccctgtgcctagtatggtgcagaagtccccaaggattactcctccggcagccaaaccaggttctccccaggccaaaagcctccaacccgcagtcgcagagaagcagggccatcaatggaaggattctgaccccgtcatggcaggaattggggaggagatcgcacacttccaaaaggagctggaggaacttaaagccagaacctccaaagcctgtttccaagtcggaaccagcgaggaaatgaagatgctgagaactgaatcggatgatcttcacacctttttgctagagatcaaggaaactaccgaaagtctgcacggggacatcagctcactcaaaacaacactgcttgaggggttcgcgggagtggaagaggcgcgtgagcagaacgagcgtaatcgcgactcaggctacctgcaccttttatacaagagaccattggacccaaaatccgaggcacagctacaagaaataaggaggctgcatcagtatgttaagtttgccgtgcaggacgtaaacgacgtcctcgaccttgaatgggaccagcatcttgagcagaagaagaaacagcgtcaccttcttgtccctgagcgtgaaaccctatttaacacactggctaacaaccgagaaatcatcaatcaacagaggaagcgactcaatcacctggttgactcccttcagcagctcaggttgtataagcagacctccctgtggtcactttcttcagctgtcccctcacagtccagtatccattcttttgatagcgacctggaatctctatgtaacgctctcctgaaaactactatcgaaagccacaccaagtctcttccaaaggtccctgcgaagctcagccccatgaaacaggctcagctgaggaacttcctggccaaaagaaaaacacctccggtgagaagcaccgcaccagcttctctgtctagatcagcctttttgtctcagagatactacgaggatctggacgaagtctcgtccacttcttccgtgagccaaagccttgaaagcgaggacgcgaggacctcttgcaaagatgacgaagctgtggttcaagcaccaagacatgctccagtggttagaacaccctcgatccagccaagtctccttccacacgctgcgccattcgctaagtctcatctggtgcacgggagttctcctggcgtgatgggcacgagtgtggcgacttctgccagcaaaatcataccacagggagccgatagcaccatgctggctaccaagacggtcaagcacggggcaccaagtcccagccatccaatttctgcccctcaggcggcagctgccgctgccttacggcgacagatggcctcacaggctcccgctgtcaatacactcactgagtccacactgaagaatgtcccgcaggtggtgaacgtgcaagagctcaaaaacaaccccgctacccccagcacggccatgggctcttcagtgccttactctaccgccaagacaccacatccagtgttaacccctgttgccgctaatcaggcaaagcaaggcagtctgattaacagcctcaagccctccggacccacgccggctagtgggcaactcagttccggcgacaaagcctccggaaccgctaagattgagaccgccgtcacaagtacccccagcgcatcgggccagttctctaaacctttctctttcagtcccagtggcacaggattcaatttcgggattattacccctacccccagtagtaatttcacggctgcacagggcgcaactcccagcaccaaagagtcttctcagcccgacgcattttcctccggagggggttccaaacccagttatgaagcgatcccagagtcaagtcccccttctggcattacctctgcctcaaatacaacccccggtgagcctgccgctagcagctcaagacccgtagccccttccgggactgcgctgagtaccaccagcagtaagcttgagacacctccaagcaaactgggcgaactcctgttcccttcttctttagctggtgaaactctcggctcattctccggactgcgagtgggtcaggctgacgacagcaccaagcctacaaataaggcatcaagtacctcactgacatctactcaacccaccaagacgtcaggtgtcccctctgggttcaattttactgccccacctgtattaggcaaacacaccgagcctccagtgacttccagcgccactaccacttcggttgcacccccagcggctacatccacatcatcaaccgcggttttcggctcgctgccagtgactagtgcgggatcctccggtgtgatctcatttgggggtacctcattgtcagcaggtaaaacatctttctctttcggctcacagcagacaaattcaaccgttcctcctagcgcacctccaccaacaaccgctgccacacccctcccaacttcatttcctaccctgtcttttggatcgctcctatccagcgccacaacacctagcctccctatgtccgctggtcgatctactgaggaagccacctccagtgcattgccagaaaaaccgggtgattcggaggtctctgcctctgccgcttctctgctggaggagcagcaatctgcacagctccctcaagcacctccgcagacctctgactcagtgaagaaggaaccggtgctggcccagcctgctgtgagtaactcgggaacagctgcctcatctacttcactcgtcgcactgtccgcggaggcgactccggctacgacaggtgtgcctgacgccagaaccgaagcggtaccccctgccagcagcttctccgtgcctgggcaaacagcagtcaccgctgctgccattagctccgccggtccagtcgccgtggagacatcctccaccccgattgccagctccaccacatcgattgtcgcccctggaccctctgccgaggctgctgctttcgggacagtgacatcagggtcaagcgttttcgcacagcctccggcagcatctagcagctccgcattcaaccagctgactaataataccgccaccgcaccctccgccacacccgtgtttgggcaggttgccgcttcaactgctccctctttgttcggccaacagaccgggtctaccgcatccactgccgctgcaactccccaagtcagcagtagcggattctcttctcctgcctttggaaccaccgcccctggggtgtttggacagaccacttttgggcaagcctcagtctttgggcaatcagctagctcagcggcatccgtcttttcgttctcccagccaggtttcagttccgtgccagcttttggacagccagccagcagcaccccgacaagcacaagcggctctgtattcggggctgcttcatcaaccagctcctcttcctctttttcattcggccagtcctcacccaacaccggtggaggactcttcggtcagtcaaacgcaccagccttcggccagtcccctggctttgggcagggaggctcggtgtttggaggcacttccgctgctacaaccacagccgcaacttcagggttctctttctgtcaggcaagcggattcggttcttcgaataccggaagcgtatttggtcaggctgcatctactggcggaatcgtcttcggccagcagtcttcatcatcctccggaagcgtgttcggaagcggaaacactggcaggggagggggattcttctctggcctcggagggaagccctctcaagatgctgctaataagaatccttttagctcagcatctggaggtttcggaagtacggcgactagcaatactagtaacctcttcgggaattccggcgcaaagacatttggaggcttcgcctcatcttcatttggcgagcagaagcccacaggcaccttcagtagtggaggcggaagtgtcgcttcacagggtttcggcttctctagcccgaataaaaccggtggtttcggagcggcacctgttttcggatccccaccaacattcggcggtagccctgggttcggaggagttcccgctttcggcagcgcccctgccttcacttctccgctagggtccacggggggaaaagtgttcggggagggcactgctgccgcttccgccggtgggtttggttttggctcatccagcaatacaacatcgtttggcaccctcgcgagccagaacgcaccaaccttcgggtcactgagccaacagacttctggatttggtacacaaagcagcggcttttcaggctttggatctggcacgggcggattctccttcggctccaacaacagttccgtgcagggattcggtggctggaggagctag

SEQ ID NO: 233320 - DNA, 6275 bp, Artificial Sequence
  Description of Artificial Sequence: Synthetic coding sequence
atgggggatgagatggatgccatgattccggaacgggaaatgaaggattttcaattccgggctctgaagaaagtgaggatttttgattccccggaggaacttcctaaagagcgttctagtctcctcgccgttagcaacaagtatggactggtttttgctgggggagcctctggcttgcaaatttttccgactaagaacctgctcatccaaaacaagccaggcgatgatcctaacaagattgtggataaagtgcaaggcctactggttccaatgaaatttccgatccaccatctggccttgtcttgcgacaaccttactttgtcagcctgcatgatgagcagcgaatatggttctatcattgcattttttgatgtgcggactttttcaaatgaggcaaagcagcagaaacgcccttttgcttatcacaagctgctgaaggatgccggaggcatggtgatcgacatgaagtggaatcccactgtgcctagcatggtggccgtgtgtctagcagatggaagcatcgctgttctccaagttacggagacggtgaaggtatgtgccacccttcctagcactgtcgccgtgacatctgtgtgttggtcacccaaggggaaacagctagccgtgggaaagcagaatggtactgtggtccagtatctccctaccctacaagagaaaaaagttattccatgcccaccattttacgaaagtgatcatccagtcagagtattggatgtgttatggattggcacctatgtctttgcaattgtctatgccgctgccgatggaacccttgaaaccagcccagacgtggtgatggcgctgttgccaaagaaggaggagaaacatccagaaatcttcgttaatttcatggaaccttgttatggctcttgcactgagcgccagcaccattactaccttagctatattgaagaatgggacctagtgctggcagcgtccgccgcaagcacggaggtgtctatcttggctcggcagagcgaccaaataaactgggagagttggctgctggaggactccagcagagctgagctgccagtcaccgacaagagcgacgactccttgccaatgggcgtggtcgttgactatacaaatcaggtggaaattactatcagtgatgagaagacactcccacctgccccagtgttaatgttactcagcaccgatggagtactctgccctttttacatgatcaaccagaaccccggtgtgaaatcgttaattaagactcctgagcggctttccttagagggcgaacgtcagcccaagagtccaggatccacacctacaacacccacatcctcccaggcaccgcaaaaactggacgcttcagcggcagcggcacctgctagtctgccacccagctccccagccgctcccatcgccacgttcagcctgctgcccgctggaggtgccccaacggtgtttagtttcggaagcagctctttgaaatcttcggctacagtcaccggagagccgccaagttacagttctggaagtgatagtagcaaggcagcccctgggcctggccctagcacatttagcttcgtgccaccttcaaaggcttcactggctccgacaccagcagcctctccggtagctccgtcagctgctagtttctctttcgggagctctggattcaaacctacactggagtccactccggtaccctcagtgtccgctcccaacatcgccatgaagccatcattccctccaagcaccagtgccgttaaagtgaacctaagtgagaagtttaccgcagctgctacatctacccccgtgtcttccagtcagtcagctccaccaatgtcaccctttagttccgccagcaagcctgccgcttccggcccactctctcacccaacccctttgtccgcgccaccttctagcgtgcctttaaaaagttctgttttgccctccccctcagccggacgatctgctcagggatctagttccccggtcccttctatggtccagaagagtccacgcatcactccaccagctgccaaacctggttctcctcaggctaagtccctgcagccagctgtggctgaaaagcagggtcaccagtggaaggacagcgaccctgtgatggcaggtatcggggaggagatcgcccacttccagaaggaactcgaggagctgaaggcacgaacatccaaggcctgtttccaggtagggaccagcgaggagatgaagatgctgcgcacagaaagcgatgaccttcataccttcctgttagaaattaaggaaacaaccgaaagcctgcatggcgatattagctccctgaaaacaaccctcctcgaggggtttgcgggagtggaagaggccagagagcaaaatgaacgcaatcgagatagcgggtacctccatctgctctataagcgccctctcgacccaaagagcgaagcccagctccaagagatccggagactgcatcagtacgtgaaattcgccgttcaggacgtgaacgacgtgctggacttagaatgggaccaacatctcgagcagaagaaaaagcaacgtcacttgttggttcccgagcgcgaaaccttgttcaacactttggctaacaacagagagataatcaatcagcaaaggaaacgcctgaatcacctcgttgactccttacagcagctgaggctctacaagcagacaagcttgtggagcctttcctccgcggtgccctctcagtcttctattcatagcttcgactccgacctggagtccctgtgcaatgccctcctgaagacaacaatcgagagccacaccaagtctcttcccaaagtacccgcaaagttgtcccctatgaagcaggctcagctcaggaacttccttgctaaaaggaagacgccacccgtccgctccacagccccagcgtccttatccagaagtgctttcctgtcccagcgatactacgaagatctggacgaagtgtcaagtacttcatctgttagtcaaagcctggaatccgaggatgcccgaacatcatgtaaggacgacgaagccgtcgttcaggcccctaggcacgcaccagttgtcaggaccccctctatccagccatctctcctgccacatgcagcaccctttgctaagtcgcacctagtgcatggatcctcacctggcgtcatgggcacaagtgtcgctacaagtgcttcaaaaattatcccgcaaggagccgattctacgatgttagccaccaaaaccgtgaagcatggtgccccaagcccctcccatccgatcagtgcacctcaggccgctgccgcagcggctctacggaggcaaatggcctcacaggccccagcagttaacacactcactgaatcaactctgaaaaatgttccgcaagtggtaaatgtgcaggaattgaaaaataatcccgcaaccccatccacagccatgggctcaagcgtgccttacagcaccgcaaagaccccccatccagttcttacacccgtggccgctaatcaagcaaagcaaggttccctcatcaattcccttaaaccaagtggtcctacacctgctagcggccagctgtctagtggagataaagcaagcggcaccgccaaaatcgagaccgccgtcacctctaccccttcagcctccgggcagttcagtaaaccattctcattttcaccaagcgggactgggtttaattttggaatcatcacgccgacccctagtagtaacttcacagccgcacagggagcgacacccagtaccaaggagtcatctcagccggacgctttcagtagcgggggtggatctaaacctagctatgaagccatacccgagtcctctccaccatctgggatcacatccgcaagcaacaccactcctggagagcctgccgctagctcatcccgacctgttgcaccctccgggacagctctatctaccacatcctcgaagcttgagacaccaccgagcaagttgggtgaactcctcttcccttcatccctggctggtgaaactctgggttccttctccgggttaagggtagggcaggccgacgattctacaaaaccgaccaataaggctagctccacatccctgacttccacccaacccactaagacttcaggggtgccttctggctttaactttactgcgccacccgtactaggcaagcacactgaaccacccgtcacgagtagcgccaccaccacatcagtggctccgcctgccgcaaccagcacttcctctacggcggtgttcggatcattgcccgtgacaagcgctggatctagcggtgtaatcagttttgggggaacaagtcttagcgctggtaaaacctcttttagtttcgggtcacaacagactaattccacagtaccaccgagcgcgcctccgcctacaactgcggctacacccctgccgacctcttttcccaccttgtcttttgggagcctcctatcatccgccaccacaccttcgctcccaatgtcagccggacggagcaccgaggaggcgaccagctcagctcttcctgaaaaacccggagattccgaggtgtcggcttctgcagctagcctgctggaagagcaacaatctgctcagctgccacaggcaccgcctcagacatccgattctgtcaagaaggagccagttctcgcacagccagccgtgagtaattccgggaccgcagcctcttctactagcttggtcgccttgagcgccgaagcgacacccgcaactacaggggttcctgacgcacgcaccgaggcagtgccacccgcaagcagtttctctgttccgggtcagaccgccgttacagcggctgctatctcctccgccggtcccgtggcggtggaaacgtcttctactcccatagccagcagcaccaccagcatcgtggcccctggcccatcagcagaagctgcggcttttggcacagtgacatctgggagctctgtcttcgcgcagccacctgccgcaagtagctcaagcgccttcaatcagttgaccaacaataccgccaccgcaccaagtgctactccagtattcggccaggtggcagcaagcaccgcaccctcacttttcggacaacagaccggatccactgcttccaccgcagctgctactccccaggtgtcctccagcgggttctcatctcccgcatttgggaccacagcgccaggtgtatttgggcaaaccaccttcgggcaggcctccgtgttcgggcagagcgcctcctccgcagcctccgtattcagcttttcccagcccggattcagctcagtcccggctttcggacaacctgcttcctccactccgacctcaacaagtggctccgtttttggcgctgctagctccacttctagctctagcagtttttccttcggccagagttctcccaacacaggcggagggctgttcggacagtctaatgctccggcattcggtcagtcgcccggttttggccagggaggctccgtttttggcggaaccagcgctgccaccaccactgctgcaacatctgggttcagtttctgccaggcatcgggctttgggagcagtaacacaggcagcgtgttcggacaagcagccagtaccggcggtattgttttcgggcagcagtctagtagttcctccggaagtgtgtttggtagtggcaataccgggagaggaggagggtttttcagtggactgggaggcaaaccttctcaggatgccgctaacaagaacccttttagcagcgccagtggcggttttggctctacagccaccagtaacacctcaaacttgttcggaaacagcggagccaagacatttggtgggtttgcttcttctagttttggagagcagaagccgacaggaacattttcctcaggcggaggctcagtagcaagtcaggggttcggcttcagctccccgaacaagacgggaggcttcggagcagcgccagtgtttgggagcccacctactttcgggggttccccaggcttcggcggagttcctgcatttggatctgctcccgcatttaccagtcccctggggtccaccggaggcaaagtgttcggtgaggggaccgcagccgctagcgccggtgggttcggcttcggctcctcgtcaaataccacatccttcggaaccctcgccagccaaaatgctccaacgtttgggagcctgagccaacagaccagcggattcgggacccagagttccgggttcagcgggtttggaagcggcacagggggattctccttcggaagtaacaattctagcgtgcagggattcggcggttggaggagtta

SEQ ID NO: 233321 - DNA, 237 bp, Artificial Sequence
  Description of Artificial Sequence: Synthetic coding sequence
ggtgaagggaccgctgcagcttcagcaggcggatttgggtttggaagctctagtaatactacatcctttgggacactggcctctcagaatgcaccaacatttggaagcctgtcccagcagacttctgggttcggaacccagtctagcggattttctggtttcggatcggggacaggtgggtttagcttcggaagcaacaacagctcggtccaggggttcggcggttggagaagctag

SEQ ID NO: 233322 - DNA, 5055 bp, Artificial Sequence
  Description of Artificial Sequence: Synthetic coding sequence
ggggcagaaggcaggaaattcgctgtcgagaggcctggttttcggggacagggcagaggtaggcagaggtggctgttgaggcacactacccccacttcaagccaagcgcctcagaaactcgacgcttccgccgctgcagcgccagcctccctgccaccgtcgtctcctgcagcgcctatcgccactttcagcctgctccctgcaggcggtgctcccacagtctttagtttcgggtcctcctctctcaaaagctcggctacagtgaccggcgaacctccgagttacagtagtggaagcgactctagtaaggccgcaccaggccctgggccaagcaccttcagctttgttccaccgagcaaggcttccctagcacctacacctgccgctagtccagtcgccccatctgcagcttcattctccttcggatccagtggcttcaaacctactctcgaaagcacgcctgtgccatccgtgtccgcaccaaacattgcgatgaagccaagctttccaccttccacttccgccgtgaaggtcaacctctctgaaaagttcacagccgctgcaacttctacccctgtatcatcttcacaatccgctcctccgatgagtccgttctcctctgcttccaaacccgctgcaagcgggccactgagccaccctactcctttgtcggccccaccctctagcgtgcctctcaaatccagcgtcctgccctccccatctgctggaagatcagctcaaggctcgagttcaccggtgccctccatggtacagaagtccccgaggatcacaccccctgccgcaaaaccaggctccccgcaggcaaaatccttacagcctgcagtcgccgaaaagcaaggccatcaatggaaagacagtgatcctgttatggctggcattggggaagagattgcccatttccagaaagaactggaggagcttaaagccaggacctccaaggcttgcttccaggtcggaaccagcgaggagatgaaaatgctgaggactgagtcggacgatctgcacactttcctgctcgaaattaaggagaccaccgagtccctgcatggcgacatctcgagtctgaaaacaacactgttagaggggtttgccggagtggaagaggcccgagagcagaacgagagaaatcgcgactcgggatacctccatctgttatataaaagacctctggatcctaaatctgaagctcaattgcaagaaataagacgactgcatcagtacgtgaagttcgcagtacaggacgttaatgacgtcttagaccttgagtgggaccagcacctggagcagaaaaagaagcaaaggcaccttttagtgccggagagagaaaccctgtttaataccttggcaaataatcgtgaaataataaatcagcagcgcaagcggttgaaccatttagttgacagcctacagcagttgcggctctacaaacagacttcactgtggagcctgtcatcagccgtaccctctcagtcttcaatccacagctttgactcagatctggaatccctgtgtaacgctctgctgaagaccaccatcgagtcacacactaagtcccttcccaaggttcctgctaagctgtcgcccatgaagcaagcccagctacggaacttcttggctaaacggaagacaccaccggttcgaagcactgccccagcctctcttagtaggagcgcatttttgtcccagcggtactacgaagacctggatgaggtgagctctacttcaagcgtctcacaaagcctagagagtgaggatgcgagaacttcttgcaaagatgacgaggccgttgtccaagctccccgacacgccccagtagtgaggacacccagtattcagcccagcctgttgcctcatgcagcccctttcgccaagagtcacttagtgcacgggtcaagtccaggagtgatggggacctccgtcgctacatctgccagcaaaatcattccccagggagctgattcaaccatgctcgccaccaagacagtgaagcacggtgcgccttcccctagccaccccatctcagctccccaggcagccgcagctgcggctctacgtaggcaaatggcctcccaggcacccgcagttaacacgctgacagaatctactctaaagaatgtgccacaagtcgtgaacgtgcaggagctgaagaacaatcctgcaactccttcgaccgcaatgggctcctcagttccgtactccacagcaaagacaccacatccagtcctgacccctgttgccgcaaatcaggctaagcagggttcactaattaactctcttaagccctcagggcctactcctgcgagtggacagttgagttccggagacaaggcgagcggcaccgccaagattgaaactgcagtcacctctactccatccgctagcgggcagttcagcaagcctttctcattctctcctagtggaacggggttcaacttcggaatcatcacccccaccccctcttctaacttcacggcagctcaaggcgctacaccgagcactaaggaatcctcacagcctgatgcgttctcatctgggggagggagcaagccttcttatgaagccatccccgagagcagcccgccttctggaattacttcagcttccaacacgacccctggggagccggcagctagcagttcgaggccagtggctcccagcggcaccgcgctaagcaccacaagctccaaactcgaaactccgccatcaaaattaggagaactgctcttcccgagctcgctggccggagaaacactggggagcttctccggcctccgagtggggcaggccgatgactctaccaagcctactaataaagcttccagcacctctttgacctcgacacagcccacgaagacatctggtgtgccctccgggttcaattttactgccccacctgttctgggaaagcatacagagcccccagtgacaagctctgcgacaactaccagcgttgctccacccgcagcgaccagtacaagcagtacagccgtttttggaagcctgccagttacaagcgccggaagctccggagttatcagtttcgggggaacctctctcagtgctggcaaaaccagcttctccttcgggagccaacaaacaaactcaacagtcccgccatccgcacctccaccaacaacagctgccactcctctgcctacaagtttcccgaccctgtcttttgggtctttactctcctctgccactacccccagtttacccatgagtgccggacggtcaacggaggaggctacctcgagcgcgctcccggaaaaacctggggactcagaggtcagtgcatctgccgcaagtctgctggaggaacagcagagcgcccaactgcctcaagctcctccccagactagcgatagcgtaaagaaagagcccgtgcttgctcagcctgccgtgtcgaattcggggaccgcagcctccagtacttcactggtcgcactttccgccgaggccacccctgcgaccacaggggtgcccgatgccagaactgaggctgtgcctccagcgagcagcttctcagtgcctggccagactgccgttactgccgcagccatcagcagcgccggacccgtcgcggtcgaaaccagctccacccccattgcatcatccacaacctcaatcgtcgcgccaggtccctctgccgaagctgctgcttttggcacagttacttctggaagctcagtgttcgcacagccccctgccgcttcctcatcttccgcttttaaccagttgaccaacaataccgcaacagccccttctgccacccccgtattcggccaggtagccgctagcactgcgccttccttgttcggccaacaaactggctccaccgctagtaccgcggctgctaccccgcaggtaagtagcagtggattctcttctcccgcattcggcactactgccccaggagtgtttggccagactacgttcggacaggcttccgtattcggtcaatccgccagctctgccgcttccgtgttcagctttagccagcctgggttcagttccgtcccagccttcggccagcctgcctccagcacacctactagcactagcggcagtgtttttggtgccgcaagctcaacctctagttccagttccttttcttttgggcagtcttcaccaaatacaggaggtggactcttcgggcaatccaacgctccagccttcgggcagagtccaggctttggccaaggaggctccgtgttcgggggtacctccgctgcaacaaccaccgccgctacaagcgggttctcattttgtcaggccagcggattcgggagttcgaacaccgggagtgtgtttggacaggccgctagcaccggtggcattgtttttggccaacagtcctcctcgtcatcagggagtgtgttcgggagcgggaacactggtcgcggagggggattcttctctggtttggggggaaagccctcacaggacgctgccaacaaaaacccatttagtagcgccagcgggggtttcggctctaccgcgactagtaacacctctaatctcttcggaaacagtggcgctaaaacattcggaggcttcgctagcagctcctttggagaacagaagcctaccggcacattttcatccgggggaggatccgtggcctcccagggatttgggttctccagtcccaacaaaaccggaggcttcggagccgctcctgtgtttggctcccctcccacttttggtggatcccccggatttgggggagttccagccttcggttctgctcccgctttcacctctcctttgggatccacgggcggaaaggtgtttggcgagggaaccgcagcagcctcagccggaggatttggatttggttccagctcaaacacgacctcgttcgggacactcgcctcccagaatgctccaaccttcggctcactgtcccagcagactagcggcttcggtactcagagcagtggtttcagtggattcggcagcggaactggtggcttttcctttggcagtaataattcttctgttcaaggatttggaggctggcggtcctag

SEQ ID NO: 233323 - DNA, 6281 bp, Artificial Sequence
  Description of Artificial Sequence: Synthetic coding sequence
atgggagacgagatggacgccatgatcccggaaagggagatgaaggatttccagttccgcgctctgaagaaagtcaggatatttgattcccccgaagagctgcctaaggaacggagctctctgttggccgtttctaacaagtatgggctggtgttcgcaggaggcgcaagtggattacagatctttccaacaaaaaacttgttgatacagaataagccaggagacgatcccaacaaaatcgtggacaaagtccaagggttgctggtgcctatgaaattccctattcatcatctcgctctttcctgtgacaatcttacactatctgcctgcatgatgtcttccgagtatgggagcattattgccttctttgatgtaaggaccttctctaatgaggcaaagcagcagaaacgaccattcgcttaccacaaactgcttaaagacgcaggcggtatggttatagacatgaagtggaaccctactgtgccgtccatggtggctgtgtgcctcgccgatggctcaattgcagttttgcaggtgacagaaactgtaaaagtgtgcgcaacgcttccatctactgtggccgtcacctcagtgtgttggtcgcctaagggtaagcagctcgcagtaggaaagcagaacggcaccgtcgtgcagtacttgccaaccctccaggagaagaaagtgatcccttgccctcctttctacgagagcgatcacccagtccgcgtcttggatgtgctttggataggaacctacgtgtttgccatagtctatgcagcggctgacgggacattggaaacgagtcctgacgtggtgatggccctgcttcccaagaaggaggaaaagcacccagagatatttgtgaattttatggaaccatgttacggctcatgtactgagcgacaacaccactactacctgagttatatagaagagtgggatctggtcctagctgcatctgctgcatctaccgaggtctccatcttagccaggcagagcgaccagatcaactgggaaagctggcttctggaagactcgtctagagccgagctacccgtgacagacaagtccgacgactccctgcccatgggggtggtggtggactacaccaatcaggtggaaatcactatctctgacgaaaagacgctgcctcccgctccagtcttaatgctcttgtctaccgacggtgtactctgtccattttatatgattaatcaaaacccaggagtgaaatcattaattaagacaccagaaagactgtctctggaaggggagaggcagcccaaatcacctggatccactcccacaactcccacatcttctcaagcgcctcaaaagttggatgcgagtgcggctgccgcacctgcttccctgccaccctcctctccggctgccccaattgctacgttctctctgctgccagcgggtggcgctccgaccgtgtttagctttggcagctcctctctcaaatcctcagcgacagtaacaggagagcccccaagctactcttccggatccgattcatcaaaggctgcaccaggcccaggtccctccaccttttcctttgttccccctagtaaagcatccctcgcaccgacccccgcagcgtctccagtggctccttccgccgcaagctttagcttcggtagcagcgggtttaagccgacactagagtctacccctgtgccatccgtatctgcccctaacatcgccatgaagcccagctttccaccatccacctctgcagttaaggtgaatttgagcgaaaattctagccagtcagctcctcccatgagcccttttagtagcgcgtccaaacccgcagcaagcggtcccctaagccatccaactccactcagtgcccctccaagctctgtgcctctgaagtcctctgtgctcccatcgcccagcggtaggtcagcccagggatcaagctccccggtgccctccatggtccaaaaatcccctagaataaccccgccagctgccaaaccagggtccccacaggccaagtccttacagccggcagtggcagaaaaacaggggcaccagtggaaggatagcgacccagttatggccggaattggtgaagagatcgctcatttccaaaaagaactggaagaattgaaagccagaactagtaaggcctgtttccaagtgggaacctcagaagagatgaagatgctacggaccgagtcggatgatctgcacacatttctgctcgaaatcaaggaaacaaccgaaagcctccacggagacatcagctcattgaaaactaccctgctcgaggggttcgccggagtggaggaagcacgcgagcagaatgaaagaaaccgagactctggctacctgcatcttctctacaagagaccattggaccccaaatccgaggctcagttgcaggagatacgccgtctgcaccagtacgttaaattcgccgtgcaggatgtgaacgacgtactggatttagagtgggatcagcatctcgagcagaaaaaaaagcagagacatttactggtcccagagcgggagaccctctttaacaccctagctaacaatcgcgagattattaaccagcagcgcaaacgcctgaatcatctggtggattctctccagcagttacggctctacaaacaaacctccttgtggtccctgtcttccgccgtcccttcccaatcctcaattcattcgttcgactcagacctcgagtccttgtgcaacgcccttttaaagaccactatagagagtcatactaagagcctgccgaaagtaccagcgaaactgtccccgatgaagcaggcccagctgcgcaattttttggcaaaacgcaagactcccccagtgagatcgacagcccctgcttccttgagtagatcggcctttctttctcagcgctattacgaggacctagacgaagtcagttccacaagctctgtgagccagtcattggagagcgaggatgccagaacatcctgcaaagacgacgaggcggtggtgcaggctccacgccacgcaccagtggtgaggaccccttcaatccaaccaagtctcctaccacatgctgcgccattcgctaaaagtcacctggttcacggttctagccccggagttatggggacttccgtcgctacaagcgccagcaagattattcctcagggggctgactctactatgctggccactaaaacagtcaaacatggcgctccttcaccatcccatcccatcagtgcaccccaggcagccgcagctgctgctcttcgtcgacagatggctagccaagccccagccgtcaataccctgaccgaatcaactcttaagaatgtgcctcaggtggtgaacgtacaggagttgaagaataaccccgctaccccatcaactgccaaaaccccccatcccgtgctgacaccggttgccgcaaaccaggccaaacagggctctctgatcaattctttaaagccatccggcccaacccctgcatctggccagctgtcctctggggataaggcatctggaacagctaagattgagaccgccgtaacatccacccctagcgcctctggccagttctccaagccattttccttttctccgagtggtacagggtttaacttcggcattatcaccccaacaccttcttctaacttcacggccgctcagggagctacgccaagcacaaaggaatcatcacagcccgacgccttctcatccggaggtggcagcaaaccctcgtacgaggccatccccgaaagcagccccccttcggggatcactagtgcatcaaacactacccccggagagcccgctgcaagttcaagtcgcccagtggcaccctccggtactgctctgtctacaacctccagcaagttggagaccccacctagcaagctcggagagctcttatttccatcctcactggccggagaaacgcttggatccttcagcggactgcgggtgggacaagctgatgacagcactaagccaacaaataaagcctcatctacctctctcacctccacacagccaacaaaaacctctggcgtaccctctggcttcaattttaccgcccctcctgtactcggcaagcataccgagccccctgtcacctctagtgccacaacaacaagcgtggcgccacccgctgctactagtacttcgagcacggcagttttcgggtccctgcccgttacttcagcaggctcgtctggtgtgatttcgtttggaggaacatcattgtctgccggaaagacttcttttagttttggttctcagcagactaatagcaccgtgcccccatccgcacctccacctaccacagctgccacacccttacctacctcctttccaactctgtcttttggatccctgctgagcagcgctaccactccatcccttcccatgtcagcgggtagaagcactgaagaagcaacgtcaagtgccctgccggagaaaccaggggacagcgaggttagtgcttcagctgccagtctcctcgaggagcagcaaagtgcacagctcccacaggcccctcctcagacaagtgactcagtgaaaaaggagcccgtcctggcacagcccgcagtgagcaattcaggaacagctgcatcctccacaagcctcgtagccctctccgcagaggcaactcctgcgaccacaggggtgcccgatgctagaaccgaggccgtgccgccagcctcctcctttagcgttcctgggcaaacagcagtgacagcagctgcaattagttcagccggaccggtggcggtagagacttcgagcactcctattgcatctagtacaacctcaatcgtggctccaggaccatcagcggaggccgcagcatttggaactgtgactagcggcagttccgtgtttgcccagcctcctgccgctagtagcagttccgcattcaatcagttaacaaataacaccgcaactgcacctagtgccacgcccgtcttcgggcaggtcgccgcatccacagctcctagcctgttcgggcagcagaccggatctacagcctctactgcggctgctacccctcaggtttcaagcagtggattttcttcaccagcttttggcaccacagcgcctggcgtattcgggcagaccactttcggccaggcttcggtctttggccagagcgcgagttccgccgcatccgtgttctcgttttctcagccaggtttctcaagcgttcccgcattcggacagcctgccagctcaacacccacctccactagtggcagtgtgttcggagccgcatcttctacatcaagcagctcttctttttcattcggacagtcgagcccgaataccggagggggtttgtttgggcagtcaaacgctcctgcgtttggtcagagtcctggcttcgggcagggcggtagtgtatttggaggtaccagcgcagctactactacggcagcgaccagtggattttctttctgccaggccagcggctttgggtcttccaatacagggtcggttttcggccaggccgctagcactggaggcatcgtgtttgggcagcagtcttccagttcatcgggcagcgttttcggctcaggcaataccggtcgcggaggcggatttttctccggccttgggggaaagccatcgcaggacgccgctaataaaaatcctttttccagtgcatctggaggatttgggagtacagcaactagcaacacgtctaatttgttcggtaattccggcgctaagacattcgggggatttgcttcctcttctttcggcgagcagaagcccaccgggacattctcatcagggggtggtagtgtggcctcacagggcttcggattttcttccccaaataagaccggtggatttggggctgccccagtctttggctccccaccgaccttcggagggagccctgggttcgggggtgtgcccgcttttggaagcgcgccagcattcacctcaccactgggttccaccggcggtaaggttttcggcgagggcactgcagccgcttccgccggaggtttcggaagtctagcaatgtccctttcccccacactgaagggccgactcctcctcatgcggcctaaggccggagggggtagggaacaggcagcccctggaagaaagtccaacgaatcaaggtcgcttgggcacttgtgtatggaacgagccctgactagcccactaaaggtctgggaacaacaacagcaccacatcctaaggcatgctcgcgagtccgagtgcccccacttcagaattaccgtccctaccgacttttggttttgggatccggaata

SEQ ID NO: 233324 - DNA, 1308 bp, Artificial Sequence
  Description of Artificial Sequence: Synthetic coding sequence
atgaaaagtagtctcctgctccgcggagtgcatttctgcttccacttgcctggcgctacccctagtaccaaggagagcagccaacccgatgcgtttagcagcggaggtggctctaagccttcctatgaggcgattcctgagagctcacccccttccggtattactagcgcttccaacaccacgcccggagagcccgcagctagtagttcacggcctgttgccccttcaggaacggccttgagtacaacctcctcaaagttagaaactcctccctctaagttaggcgaactgctgtttccttcaagtctagcgggagaaaccttgggctctttttcaggcctacgcgttgggcaagcagacgattcaactaaacctactaacaaggcctcaagcactagtctcacctctacacaacccaccaaaacgagtggagtcccctcgggctttaacttcacggcccctcccgtgctgggaaagcacaccgagccccctgtgacgtcaagtgcaaccacaacctccgtggcaccccctgccgcaacctctactagctctactgccgtctttgggagtctccccgtgactagcgccggttcctccggcgtcatctcattcgggggtacctccttgtcggccggtaagacctctttctcgtttggatcccaacagaccaattcaacagtgcccccatcggctccacctcctacgaccgcagccacccccctgcccacttcttttccaactctttccttcggtagtctcctgagttccgccacaacccccagtctgccaatgtccgccggaaggagcactgaggaggcaactagcagcgccttaccggagaaaccgggtgattctgaggtgtcggcatccgccgcttccctattagaggagcagcagtcagcccaactgccccaggcacccccacagaccagcgactcggtcaagaaagagccagttttagcacagccagccgtgtctaattctggcacagcagcttcttctacaagcctggtcgcattaagcgcagaagcgactcctgcaaccactggtgtgcccgacgcaaggaccgaagccgtcccaccagcttcctccttctccgtgccaggccagacagctgtgaccgccgctgccatctcctccgcgggaccagttgctgtagagaccagttcaacacccatagcgtccagcaccacaagtatagtggccccaggcccttctgctgaagccgctgccttcggtacggtgacgagcggatcctccgtgtttgctcaaccacccgcagcaagcagtagctcagccttcaactag

SEQ ID NO: 233325 - DNA, 981 bp, Artificial Sequence
  Description of Artificial Sequence: Synthetic coding sequence
atggcagctttcgcagtcgaaccccaggggcctgcactgggtagtgagcctatgatgctgggctcacccacaagtcccaaacccggagtaaatgcccagtttctgcctggctttctgatgggtgatctgccagccccagttaccccccagcccaggtccatttccggacccagcgtcggtgtcatggagatgagaagcccattactcgccggaggatcaccccctcagccagtggtgccggctcataaagacaagtctggcgcacccccagtcaggtccatctacgacgatatctcttctcccggactgggctccacgccactgacatcacgtcgccagcccaacattagcgttatgcaaagccccttggtgggggtgaccagtacaccaggaaccggacaaagcatgttcagccctgcctctataggacagccacgcaaaactaccttgtccccagcccagctggacccattttacacacagggagactcgctaacttctgaagatcaccttgacgacagctgggtgaccgtgttcgggttcccacaggcttcagccagctacatcttactgcagttcgcccagtacggtaatattttgaaacatgtgatgtccaacacaggaaattggatgcacatcagataccagagtaagctgcaggcgagaaaggccttgtccaaggacgggcgtatttttggtgagagcattatgatcggtgtgaagccctgcatagataagtctgtgatggaaagttccgaccgttgcgccttgagtagcccctccttagcctttacccctcctatcaagacactgggcacgcccactcagcctgggagcacgcctcgtatcagtacaatgcggcctctcgccaccgcttacaaagctagtacatccgactaccaggttatttccgacaggcagactccaaagaaggacgagtcgctcgtttcgaaagccatggagtacatgtttggttggtag

SEQ ID NO: 233326 - DNA, 930 bp, Artificial Sequence
  Description of Artificial Sequence: Synthetic coding sequence
atgatgctggggtcacccaccagtcctaagccaggggtgaacgcccagttccttcctggctttctaatgggcgatctgcctgcgccagtgactccgcagccacgcagtatctcagggccttctgtcggcgtgatggagatgcggtcgcctctcttggctggaggatctcctcctcagccagtggtgcctgctcacaaagacaagtcaggtgccccacctgtcaggtccatttacgacgacatcagctcccctgggttgggatcaacaccactgacgtcccgtaggcagcccaatataagtgtcatgcagtcaccactcgtgggcgtcactagtacccccggaacgggtcagtcaatgttctcaccggctagcatcggacagccacgaaaaactactttatccccagcacagctcgaccctttctacacacaaggggattccctgacttctgaagaccacctcgacgactcttgggtcacagtgttcggatttccccaagccagcgcctcctatatcttgctgcagtttgcgcagtacggcaatattttgaaacacgtgatgtctaataccgggaattggatgcatattcgttatcaatcgaagctgcaggcgaggaaggctctgtctaaggatggcaggatcttcggggagagtatcatgataggggttaaaccttgtatcgataagtctgttatggagagctcagatcgatgtgctctgtcttccccatcccttgccttcactcccccaatcaaaacgctaggaacacccacccagcccggaagcactccccgtatatctacaatgcggcctctggctactgcctataaagcttctacatcagattaccaggttatctccgatagacagacccccaaaaaggacgaaagccttgtgagcaaggcgatggagtatatgttcgggtggtag

SEQ ID NO: 233327 - DNA, 576 bp, Artificial Sequence
  Description of Artificial Sequence: Synthetic coding sequence
atgttcagccccgctagcattgggcagcccagaaaaactacactgtcaccagctcaattagatcctttttatacgcaaggagattccctgacctcggaagatcaccttgacgactcttgggtcaccgtgttcgggtttcctcaggcatctgcttcatacatcctcctgcagttcgcccagtatggtaacattctgaaacatgtcatgagcaacaccggtaactggatgcatattagatatcagtctaagctccaggctaggaaagcgctttctaaggatgggcgtatctttggggaaagcatcatgataggcgttaaaccttgcattgataaaagtgtcatggagtcttccgatcgatgcgctctctcctctcctagtctggctttcacaccacccattaagaccctcggcacccccacacagcccggttccacaccccgaatttcaacgatgcggccactcgctacagcgtacaaggcttcaacctctgactatcaggtgatcagcgaccgccagacgccaaagaaagacgaaagcctggtcagcaaggcaatggagtatatgttcgggtggtag

SEQ ID NO: 233328 - DNA, 981 bp, Artificial Sequence
  Description of Artificial Sequence: Synthetic coding sequence
atgaagcaagatgcaagtaggaatgcggcttataccgtggattgtgaagattacgtgcacgtcgtcgagttcaatccattcgaaaacggcgatagcggcaatctgatagcctatggcggaaataactatgtggtgatagggacgtgtaccttccaggaggaggaagcagatgtcgagggcatccagtataaaacactgcgcaccttccatcatggtgttcgcgtcgatggcatcgcatggtctccagagacaaggctggattcattgcctccggtgataaagttctgcacttctgctgcggatatgaagattcggttgtttaccagcgatcttcaggacaaaaatgagtacaaggtcttggaggggcacactgatttcatcaacggactcgtgtttgaccctaaggagggccaggagattgctagtgtcagtgatgaccacacatgtaggatttggaacttagagggcgtgcagaccgcacacttcgtgctgcatagcccgggtatgtcggtatgctggcacccagaagagacattcaaattaatggtcgccgagaagaatgggacaatccgcttttacgaccttctcgcgcagcaagctatcctaagcctagagtcagaacaggtgccgctgatgtcggctcactggtgcttgaagaacacgttcaaagtcggagctgtcgccggtaatgattggctgatttgggatataacaagatcaagctacccccagaataaaaggccagtccatatggacagggcctgtctcttccgctggtctactattagtgagaatctattcgccacaaccggctatcccggaaagatggctagtcagttccaaatccatcacctcggccacccacagccaatactaatggggtctgtggcggttggctccggtttgtcatggcatcggactctcccgctgtgcgtcatcgggggtgatcacaaactgctgttttgggttaccgaagtttag

SEQ ID NO: 233329 - DNA, 156 bp, Artificial Sequence
  Description of Artificial Sequence: Synthetic coding sequence
atgaaacaggacgccagccgaaacgcggcatacacagtcgactgcgaagactacgttcacgtcgtcgagtttaatccttttgagaacggtgattctggaaatttaattgcctacggcggaaacaattatgtcgtcatcggaacctgcacattctag

SEQ ID NO: 233330 - DNA, 981 bp, Artificial Sequence
  Description of Artificial Sequence: Synthetic coding sequence
atgaaacaggatgcttctcggaatgccgcttatactgtagattgtgaagattatgttcatgtcgttgagtttaacccatttgagaatggcgattctggtaaccttatcgcgtacggaggaaacaactatgtggtaatcgggacttgcactttccaagaggaggaagccgacgtcgaaggaattcagtacaagacactccggacctttcatcacggcgttcgggtggatggcatagcttggtctcccgaaacgcgtctggattccttgcccccagtgattaagttctgcacaagtgcagctgacatgaagatccgcctatttacatctgatctgcaggataaaaatgagtataaagtgcttgaggggcatacagatttcattaatggtctggtcttcgacccgaaggaggggcaggaaattgcaagcgtatcagatgatcacacttgcaggatctggaatctcgagggcgtgcagaccgcccactttgttctccacagtccaggtatgtcagtctgctggcatccagaagagaccttcaaactgatggtggccgagaagaacggtaccatacgtttttatgacctcctggcacagcaggctattctgtccttagaatccgagcaagtaccattgatgagcgcacactggtgtctgaagaatacgttcaaagttggcgcagtggccggaaacgattggttgatctgggatataactagaagttcatacccccagaataagcgacccgtgcatatggaccgcgcatgcctcttcagatggtctactatcagtgagaacctcttcgcaacgactgggtaccccggaaaaatggcctctcaattccagattcaccatctcggacacccacagcctattctgatggggagcgtggctgtgggatccggcctgtcatggcacagaactctccctctttgcgtgatcgggggtgatcataaactgctattctgggtgacagaggtctag

SEQ ID NO: 233331 - DNA, 1143 bp, Artificial Sequence
  Description of Artificial Sequence: Synthetic coding sequence
atggaagagatctacgccaaattcgtgagccagaagatctccaagactcgttggcggcctttacccccagggtcacttcaaacagccgagacttttgccacagggtcctgggataatgaagagaattatatatctttatggtcaataggcgactttggaaatctggacagcgacggtggattcgagggagaccatcagctgctgtgcgatattcgccaccacggagacgtgatggaccttcagtttttcgaccaggagagaattgttgccgctagttcaacaggttgcgtgacagtgtttctgcaccatcctaataaccaaaccctgtccgtgaaccagcagtggaccacagctcactaccacaccggccctggcagcccctcctattccagcgctccatgtactggggtggtctgcaacaacccagagattgtcaccgtgggagaggacggtcgtattaatctgtttagggctgaccacaaggaagccgtgagaactatcgacaatgccgatagcagtaccctccacgccgttacatttctcaggactccagaaatcttgacggtcaactctataggtcaattgaaaatctgggacttcagacagcaggggaatgagccatcccagattctgagcctgaccggggaccgggtgccactccactgtgtggacaggcacccaaatcagcagcacgtggtagcaacaggtggccaagatgggatgttaagtatctgggatgttaggcagggcaccatgcccgtttcccttttaaaagcccatgaggccgagatgtgggaggtgcattttcacccgtccaatccagagcaccttttcacatgctccgaggatggctctttgtggcactgggacgcaagtacggatgtgcctgagaagtcaagcctatttcaccaggggggacgatccagcacttttctgtcacactctatcagcaatcaggctaatgtacatcagtccgtcattagctcttggctgtctaccgatccggctaaagaccgtattgagatcacctctttactcccgagccggtctctgtcagtgaataccctggatgtattgggcccttgtcttgtttgcgggactgacgccgaggctatttacgttactcgccacctgttcagttag

SEQ ID NO: 233332 - DNA, 747 bp, Artificial Sequence
  Description of Artificial Sequence: Synthetic coding sequence
atgggtggcccactatctctgggcacagattgcgcccatacgggctaccgaagagaattgacattgtgttcacaccggctgcgccctaaagtgccgagcaatcagggttctgccggacgtggtggcgcagagagaagggtgctgtgtttgctttttgccgtgcccgcagccgcagcctttggaatggaagagatttatgcgaagtttgtgagtcaaaagatctcgaagacgcggtggcggccactccctcccggttcgttgcagaccgcagaaactttcgcaactggatcctgggacaacgaggagaactatatcagcctctggagtatcggcgacttcgggaatttagatagcgacggcggattcgaaggcgatcaccagttattgtgtgacatcaggcaccacggcgatgtcatggacctccagttcttcgaccaggaaagaatagtggctgcctcttccactgggtgcgtgacagtttttttacatcatccgaacaaccaaacactgagtgtgaatcagcagtggaccaccgctcactatcacaccggtccagggagcccaagctactctagcgccccatgtaccggagtggtgtgcaacaacccggaaattgtcaccgtgggcgaggatggccgaataaatctctttcgcgcagatcacaaggaagctgttaggacgattgggctcgtgaccgaatgccacagcacagtcctgattgacatcccgaccaacagtatgctgtag

SEQ ID NO: 233333 - DNA, 1143 bp, Artificial Sequence
  Description of Artificial Sequence: Synthetic coding sequence
atggaggagatttacgcgaagttcgtgtcccagaagataagcaagactcggtggcgtcctctcccgcctggctccctgcagacagcagaaacctttgccacaggatcctgggataatgaagagaactatatatccttatggtcaattggggattttgggaacctagactcagacgggggatttgaaggggatcatcagctcctgtgcgatattcggcatcacggtgacgtaatggatttgcagttcttcgaccaggaacggatcgttgccgcatcatctacaggttgtgtgaccgtgttcctccaccatccgaacaatcaaaccttgtctgtcaaccagcagtggacgactgcccactaccataccgggcctggctccccgtcttattccagtgcaccatgtacaggtgtcgtgtgcaacaatcccgaaatagtgactgttggggaagacggtaggataaacctatttagggcggaccataaagaagcggttcgcaccatcgataatgcggactcctccactttgcatgctgtgacgtttcttcggactccggagatccttacagtgaatagtatcggccagctgaagatctgggacttcagacagcaagggaacgaaccatcccagatcctgtctctgactggcgaccgagtccctctgcactgcgtagatcgacaccccaaccagcagcacgtcgtggctactggcggacaggatggaatgttatccatttgggatgtcagacaggggactatgcccgtttctctgttgaaggcccatgaggcagagatgtgggaggtccattttcacccgtcaaaccctgagcacctctttacatgctccgaggatgggagtttgtggcattgggatgcctccacggatgtacccgagaaaagcagcctgttccaccagggaggtcggtcaagtacttttctgtctcacagcattagcaatcaagcaaacgttcatcagagcgtgatctcctcttggctctcaacagatcctgcgaaggatagaattgagattacatcgctgctgcctagccggtccttgtctgtaaataccttggacgtgttggggccttgccttgtctgcggaaccgatgcggaagccatctacgtcactcgacatctgttcagctag

SEQ ID NO: 233334 - DNA, 1407 bp, Artificial Sequence
  Description of Artificial Sequence: Synthetic coding sequence
atggcgaaacgcaatgccgagaaggagctgactgatagaaactgggatcaggaagatgaggcggaggaagtcggtacctttagcatggcaagcgaagaggtcttaaaaaatagagctatcaaaaaggctaagcgtaggaatgttgggttcgagagcgacactggaggagccttcaaagggttcaagggtcttgtagtaccatcgggaggcggtcggtttagcggattcggaagcggggcaggagggaagcctctggaggggctgtccaatggcaacaacatcacctccgcccctcccttcgcctcggcaaaggccgctgccgatcccaaggtggcctttggctcactggcagcaaacggccctactacactggtggacaaagtgagcaatcccaaaacgaacggagactctcaacagccaagctccagcggccttgcaagtagtaaggcctgcgtggggaatgcctaccacaagcaactggctgcccttaattgcagtgtccgggactggattgttaagcacgtgaacaccaaccccctatgcgatctaactccaatcttcaaggactacgagaagtacctagccaacatagagcagcagcacggtaattctgggaggaattcagaaagtgaaagcaataaggtggcagccgagacccaatctcctagtctcttcggcagcaccaagctccaacaggagtctacctttctcttccatggcaataagacagaggacactcccgataagaaaatggaagtggcttcggaaaaaaagactgatccgtcctcccttggcgctacctccgccagctttaacttcgggaaaaaggtggattctagcgttttgggtagcctgtcatcagttccgctgacgggtttttccttctcacctggcaactccagtctgttcggcaaggacacaacgcagagtaagcctgtgtcatctcccttccctactaagccactcgaggggcaggcagagggagattctggagagtgtaagggaggcgacgaagaggaaaatgacgaaccaccaaaggtcgtagtgacggaggtgaaggaggaggacgccttctattcaaaaaaatgcaagttattctataagaaggacaatgaattcaaggaaaaaggcattggaactttacatcttaagccaacggccaaccagaagacccagctgttggtgcgcgctgatacaaacctgggaaatattcttctgaatgtcctgatcccccctaacatgccctgtactagaaccggaaagaataatgtcttaattgtgtgcgtgccgaatcctcctatagatgagaaaaatgcaactatgccagtaacgatgcttattcgggtgaaaacaagcgaagatgccgacgaactgcataagattctgctcgaaaagaaagatgcctag

SEQ ID NO: 233335 - DNA, 1323 bp, Artificial Sequence
  Description of Artificial Sequence: Synthetic coding sequence
atggccagcgaagaagtgttaaaaaacagggccattaagaaagcgaaacggaggaatgtggggtttgagtcagataccggcggtgccttcaaagggttcaaagggctagtggtacctagcgggggaggcaggttctctggattcggctccggtgccggaggcaagccccttgaagggcttagcaacgggaacaacataacatccgcgccaccctttgcaagcgcaaaagcggcagccgatcccaaggtggcatttggatcgcttgccgcaaatgggcctacgactctggtcgataaggttagcaatcccaaaacgaatggcgacagccaacagccctcaagctcagggctagcatcaagcaaggcatgcgtcggaaacgcatatcacaagcagttggccgcactgaactgttccgttcgggactggatcgttaagcacgtcaatactaatccactgtgcgatctgacgccaatctttaaagattacgaaaaatacctggcgaatattgaacagcagcacgggaattccggccgaaattccgaaagtgagtccaacaaggtcgcagcagagactcagagcccatccctgttcggaagcacgaaactgcagcaggaatccacttttctcttccacggaaacaagaccgaggacactcctgataagaagatggaggtggctagtgagaaaaaaactgatccatcctcccttggggctacttctgcatctttcaacttcggaaagaaggtcgacagctcggtcctggggtccctgagcagcgttcctcttaccgggttctcgttctcacctggaaattcctcactcttcggaaaagacactacccagagcaagccagttagtagcccattccccaccaaacctcttgaaggccaagctgagggcgatagtggcgagtgtaaagggggagatgaggaggaaaatgatgagcctccaaaggtcgtggttactgaggtgaaagaagaggacgccttttactcaaaaaagtgtaaactcttctataaaaaggataatgagtttaaagaaaagggcatcggcactctacacctcaaacctaccgctaaccagaaaactcagctcctggttcgggctgacactaatctgggcaatatcttactcaatgtgttgatcccgccaaatatgccatgcacccggaccggtaaaaataacgttttaattgtatgcgtccccaatcctcctatcgatgagaagaatgcaacgatgccagtgaccatgttaatccgggtgaaaacatcagaggacgctgatgagctgcacaagattctactcgagaagaaagacgcttag

SEQ ID NO: 233336 - DNA, 1323 bp, Artificial Sequence
  Description of Artificial Sequence: Synthetic coding sequence
atggcctccgaggaagtgttgaagaatcgagccatcaaaaaagcaaagagaaggaatgtcggctttgaatcagacactggaggggctttcaaaggttttaagggcctagtagtgcctagtgggggtggacggtttagtggctttggtagcggggcaggaggaaagcctctggaggggctgtctaatggcaacaacattacctccgcgcctcccttcgcttctgcaaaggctgcagccgatcctaaggttgctttcggctctctagcagcgaacggcccaaccactctggtggacaaggtatctaatcccaaaacaaacggcgactctcagcagccttccagctctggcctggcctcctctaaagcttgcgttgggaatgcctatcataaacagcttgctgcactcaattgctccgtgagagattggatcgtaaagcacgtgaatactaaccccctctgcgatttgacacctatcttcaaagattacgagaaatacctggctaacatcgagcagcagcacggcaattccggcagaaacagtgagtcagaatcaaataaagtggccgctgagacacagtccccctccttgtttggatctacgaagcttcagcaggagtccacttttctcttccatggaaacaaaacggaggacaccccggacaagaagatggaagtggcaagtgagaagaagaccgacccaagttcacttggcgcaacctcagctagtttcaacttcggcaaaaaggtggactcttctgtgcttgggagcctgtcttcggtgccgctcaccggctttagcttctcgccaggaaattcgtcactgtttggaaaagacacaactcaaagcaagcccgtgagctccccctttcccactaagcctcttgaaggacaggccgagggtgattcaggtgaatgtaaaggcggagacgaggaggaaaatgatgagccccctaaggtcgttgttacggaagtgaaggaagaagacgccttttattctaagaagtgcaaattattttataaaaaggataatgagtttaaggagaaggggattggcaccctgcatttaaaacctaccgctaatcagaagacccagctactggtacgcgctgatacaaatctggggaatattctcctcaatgtactgataccaccgaacatgccctgtactcgcactggaaagaataatgttctgatcgtctgcgtgccaaacccacccatcgacgagaagaacgctacaatgccagtcaccatgctgatcagggtgaaaaccagtgaagacgctgatgagctgcacaagatccttctagaaaagaaggacgcatag

SEQ ID NO: 233337 - DNA, 27 bp, Artificial Sequence
  Description of Artificial Sequence: Synthetic coding sequence
atggcaagcgaagaggttttgaaatag

SEQ ID NO: 233338 - DNA, 537 bp, Artificial Sequence
  Description of Artificial Sequence: Synthetic coding sequence
atggccaaacggaacgctgagaaggaactcaccgacagaaactgggaccaggaggatgaagccgaggaagtgggcacatttagtatggctagcgaggaagtgctgaaaaacagagctattaagaaagctaagcgacggaatgtgggctttgaaagtgacaccggaggagcctttaagggatttaaagggctggttgttcctagtggcggaggcaggtttagcggtttcggcagtggagctgggggaaagccactagaggggctgagcaatgggaacaacatcacatctgcaccaccattcgctagcgctaaggcagccgcagatccaaaggttgcctttggaggggacgaagaagagaacgacgaaccccctaaggtggtggtcactgaggtaaaagaggaggatgcgttctattccaagaaatgtaaactattttacaagaaggataatgagttcaaagagaaaggtatcggcacgttgcatctcaaacctactgccaaccagaaaacccagctcctcgttcgggcagacacgtag

SEQ ID NO: 233339 - DNA, 138 bp, Artificial Sequence
  Description of Artificial Sequence: Synthetic coding sequence
atggcaaaaaggaatgccgagaaggaattaacagaccggaattgggaccaagaagacgaggctgaagaggtgggaacattttccatggcatccgaagaggtcttgaagaatcgagctataaaaaaggcgaagcgctag

SEQ ID NO: 233340 - DNA, 657 bp, Artificial Sequence
  Description of Artificial Sequence: Synthetic coding sequence
atggaagtggcgtctgagaaaaagactgaccccagttccctgggtgctacctccgccagcttcaactttgggaagaaggtggacagttctgtattagggtctttgagcagcgtacctcttactgggttttccttctcccctggcaactcttcattgtttggcaaggacactacccaaagcaaacctgtgtcttctccatttccaactaaaccacttgagggacaagccgaaggcgattcaggggaatgcaaaggcggagacgaggaggagaatgatgagccccctaaggtggtggtcaccgaggtaaaggaagaggacgccttttacagcaaaaaatgtaaactgttctacaaaaaggataacgagttcaaagagaagggcattgggaccttgcacctcaaaccaaccgccaatcagaaaactcaattgctggtgcgagccgatactaacctgggaaatatcttattgaatgtcttaatacctccaaacatgccttgcaccagaacaggtaaaaacaacgtgctgattgtctgtgttccaaatccccctatcgacgaaaaaaacgcaacaatgccagtgaccatgttgattcgcgtcaaaaccagtgaggatgcagacgagctgcacaaaatccttctggagaagaaggacgcctag

SEQ ID NO: 233341 - DNA, 231 bp, Artificial Sequence
  Description of Artificial Sequence: Synthetic coding sequence
atggcaaagaggaatgcagagaaagagctgaccgaccgcaactgggatcaggaggatgaggccgaagaagtagggacatttagcatggccagtgaagaagtgctgaaaaatcgagctattaaaaaggcaaagcgacgtaatgtgggtttcgaagtcttgctactccaaatggccctccccccttggctgataaaattccaaattcctaaattgatgggcacggtttcatag

SEQ ID NO: 233342 - DNA, 15 bp, Artificial Sequence
  Description of Artificial Sequence: Synthetic coding sequence
atggctaaaagatag

SEQ ID NO: 233343 - DNA, 33 bp, Artificial Sequence
  Description of Artificial Sequence: Synthetic coding sequence
atggcaaaacgaaacgcggaaaaagagctatag

SEQ ID NO: 233344 - DNA, 1524 bp, Artificial Sequence
  Description of Artificial Sequence: Synthetic coding sequence
atggccttcaactttggggctccttctggcacatccggaactgcagctgccaccgccgctcctgcaggcggatttgggggattcgggaccacaagtaccaccgcgggttccgccttcagtttcagtgccccaaccaacacaggcaccacagggctttttggcggaacgcagaataagggattcgggtttggcaccgggtttggcactaccacagggacgagtactggactggggaccggcttgggaaccggcctaggctttggcggatttaacactcagcagcaacagcagaccacgctcgggggacttttttcccagccaactcaggcccctactcagtccaatcagctgataaataccgcctctgcactgtcggcgccaacacttctcggcgacgaacgtgacgctatcctggctaagtggaaccaactacaggctttctggggaaccggtaagggctatttcaataacaacatcccgcctgtagagtttacccaggaaaatcctttttgccgcttcaaggctgtcgggtactcttgtatgcccagcaacaaggatgaggacggtctggtggtcctcgtgttcaataaaaaggaaaccgagatacgcagccagcaacagcagctggtggagagcctccacaaagttcttgggggaaatcagacgcttactgtcaacgtggaaggtaccaaaactcttcccgatgaccagaccgaagtggtgatctatgtggttgagcgatcgcccaacggaaccagtagacgcgtgccggctacaacgttgtacgctcacttcgagcaagctaacatcaagacacagctacagcagctgggcgttacgctgtctatgacacgcacagaactttcccccgctcagatcaagcagctgctgcagaaccccccagctggggtggatccaatcatttgggagcaagcaaaagtagataatcccgattctgagaaactcattcctgttcccatggttggcttcaaggagctgctccgacgcctgaaagtgcaggatcagatgaccaaacagcaccagactaggctggacatcatttctgaagacatctccgagcttcagaaaaatcagaccacgtctgtcgccaagatagctcagtacaaaagaaagctgatggatctctctcatcgcacactccaggtcctcatcaaacaggaaatccagaggaagtccgggtacgcaattcaggccgatgaagaacagctccgggtacagctcgataccatccagggagagctaaacgctccaacacaattcaagggcaggcttaacgaactcatgtctcaaattagaatgcagaaccacttcggcgcagtgcggagcgaggaaaggtattacattgatgccgacttgcttcgagagatcaaacagcacctgaaacagcagcaagaaggtttgagtcacctcataagtatcatcaaggatgacttagaggacattaaactcgtggagcacggactaaacgaaacaatacatatcagggggggtgtgttcagttag

SEQ ID NO: 233345 - DNA, 876 bp, Artificial Sequence
  Description of Artificial Sequence: Synthetic coding sequence
atgcctagcaacaaggatgaagacggcctggtcgtcctcgtatttaataagaaggagaccgaaatccgctctcaacagcagcagctcgtcgagtcactccataaagtcctgggaggcaatcagacacttaccgtgaacgtggagggcaccaaaacattgcctgacgatcagacagaggttgtgatctatgtcgttgagaggtccccaaacggaacctcgagacgagttcctgcaacaactttatacgcgcattttgagcaggcgaatatcaaaacccagttgcagcaattgggcgtcacgctctccatgacaaggaccgagctttcacccgcacagatcaaacagcttctacagaaccccccagcgggtgtggatccgattatttgggaacaggcaaaagtagacaacccagacagcgagaagctcattcccgttcccatggtaggttttaaagaactactgagaaggctgaaggtccaggaccagatgaccaagcaacatcaaactcggttggacgttctcatcaaacaggaaatccaaaggaagtctggctatgcgattcaggccgacgaggagcagctgcgggtacagttagatacaatacagggagagctcaatgcccctacccagtttaaaggacgcctgaacgaattaatgtcacagattaggatgcaaaaccacttcggagccgtgcgaagcgaggagaggtattatatcgacgccgatctgctacgggaaattaaacagcacctgaaacaacagcaggaagggctctcacatttaattagtattataaaggatgacctggaggacattaagctcgtcgaacacgggctaaacgagactattcatattcggggaggtgtcttttcctag

SEQ ID NO: 233346 - DNA, 984 bp, Artificial Sequence
  Description of Artificial Sequence: Synthetic coding sequence
atgccttccaataaggacgaggacggactggtcgtgctcgtgttcaataagaaggaaactgagatacgctcacaacagcagcagctggttgaaagcctgcataaagtgctcggcggaaaccagaccctaactgtgaacgtggagggcaccaaaactttacccgacgatcagacagaggtggtgatttacgtggttgagcggtctccgaacggtacttctcggagggtaccagccaccacgttatatgctcacttcgagcaagcaaacattaagacccagctgcagcaactgggtgtgacactttccatgacccgaaccgaactcagtcctgcgcaaataaaacagttactccagaatccgcctgcaggcgtcgacccaataatctgggagcaggctaaggtggacaatcctgattccgaaaaactgatcccagtgcctatggtcggattcaaggaacttctgcgcaggctgaaagtgcaagaccaaatgactaagcagcaccagacacgtctcgacatcattagcgaggacatcagcgagctgcagaagaatcagacaacctctgtggccaaaatcgcccagtacaaaagaaagctgatggacctgtcgcatagaactctccaagtgcttataaaacaggagatacagcggaagagtgggtatgctatccaagccgatgaagagcagctcagggtgcagctcgacacaatccagggcgaactcaacgctccaacccagttcaaaggtagacttaacgagctcatgtcacagattcggatgcagaatcactttggtgctgtccgctccgaagaacggtattacatcgacgcagacctgctgagagaaatcaagcagcatcttaagcagcagcaggagggactgtcccatctgataagcataattaaagatgacctggaagatatcaagctggtggaacatggactgaatgaaaccattcacattagggggggagtctttagctag

SEQ ID NO: 233347 - DNA, 1380 bp, Artificial Sequence
  Description of Artificial Sequence: Synthetic coding sequence
atggccttcaactttggtgcgcctagcggtacctctggcactgcagctgctacagcggctccggcaggcggattcggcggtttcgggactacatctaccaccgccggatccgcctttagctttagcgctccgaccaacaccggcacgactgccttgggcggactgttctctcagcctactcaggcccctacccagtctaatcaacttattaatacagcttccgccctctccgcacctacgttgctgggcgacgaaagagacgcgattctggcaaagtggaatcaacttcaagccttttggggcacaggcaaagggtatttcaacaacaacatcccaccagttgaattcacacaagaaaacccattctgcagatttaaagctgtgggttatagctgtatgccttctaacaaggatgaagacggccttgtggtgctggtgtttaacaagaaggagaccgaaatcaggtcccagcagcagcaattggtcgagtctttgcacaaggttctgggcggtaaccagaccctgactgtcaatgtggaagggaccaagactctgccagacgaccagactgaagtggtgatctatgtggtggaacgcagtcctaatggaacgtcaagacgcgtgcccgctactacgctctacgctcactttgagcaagccaacatcaaaacccaactccaacagttgggggtcacgttgtcaatgactcggacagaactaagccccgctcagatcaagcagctgctgcaaaatccacccgctggggtcgacccaatcatttgggagcaggctaaggtcgacaatcctgattcagaaaaactgattcccgtgccaatggtcgggtttaaggagctgctgcggagattgaaggtacaggaccaaatgaccaagcagcatcagacccgacttgacataattagcgaagacattagcgagctgcaaaagaaccagacgacatccgttgctaagattgcccagtataagcgaaaactgatggacctgtctcaccgcacactccaggtgctcattaaacaggagattcagaggaagtcaggatacgctatccaggccgatgaagagcagttgagggtacagcttgacacaattcagggggaactaaatgctcctacccaatttaaaggcaggttgaacgaactgatgagtcagattaggatgcagaatcactttggcgctgtgaggtctgaggaacggtactatatcgatgccgacctattgagggagatcaagcagcacctgaagcagcagcaggagggcttgtcccatcttatatccattataaaagatgatctcgaagatattaagctggtggaacacgggctgaacgagaccatccacattaggggaggtgtcttctcatag

SEQ ID NO: 233348 - DNA, 582 bp, Artificial Sequence
  Description of Artificial Sequence: Synthetic coding sequence
atgagcggtttcaactttggaggtaccggcgcacccactgggggattcaccttcggcacggccaagactgcaacaaccacacccgctactggatttagtttcagtacctcgggcaccggagggtttaatttcggtgccccttttcagccagccacctccacaccttcaacgggccttttttctctggctacccagacccctgccacacaaacaacaggcttcacttttgggactgctacgctcgcctctggagggacaggtttcagcctcggaatcggcgcatctaaacttaatttgtcaaacactgccgcaacaccagccatggcaaacccatctggttttgggctgggcagctccaatctgacgaatgcgattagctccacagttaccagtagccagggcactgcacctaccggctttgtatttggtccttcaacaactagcgtggcacctgcgactacctccgggggattctccttcactgggggatcaactgcccaacccagcggcttcaatatcgggagcgcagggaactcggcgcaacctaccgctcccgcaactttgccgttcactccagcttag

SEQ ID NO: 233349 - DNA, 1569 bp, Artificial Sequence
  Description of Artificial Sequence: Synthetic coding sequence
atgtcgggttttaattttggcggaacaggagctcctacaggtgggttcaccttcggtacagcgaagaccgcgacaactacaccagccacaggctttagtttcagtacttctggtaccggagggtttaatttcggcgctcctttccagcccgcaaccagcacgcctagtactggactattttctctggctacacagacgcctgctactcagaccacaggcttcacatttggcacggcaacacttgcatcagggggtaccggattctcacttggtattggagccagcaaactcaatctctccaacactgccgcaacccctgctatggcaaacccctctggctttggattagggagcagcaacctgaccaacgcgattagtagcaccgtcacttcttctcagggaacagcaccaactgggttcgtgtttggtccgtccacaaccagcgttgctcctgctacaacttccggaggcttctccttcacagggggatcaaccgcacaacctagtgggtttaatattggcagcgcgggaaactctgcccagccaaccgcccctgcaaccctgccatttacccccgcaactcccgcagctaccacagcaggcgctactcaaccagctgcccctaccccaacagctaccatcacttctactggccctagcctgtttgcctccattgctacagctcctacaagtagcgctacaaccgggctatctctgtgcacacccgtgacaaccgcaggagccccaactgctggtacccagggcttttctctgaaggcgcctggggctgctagtggcacttccaccacaactagtaccgctgcaacagccaccgctaccacaacttcatcatcttcaaccacaggcttcgctctgaatttgaaaccactggcccctgccggaattccatccaacacggccgcagctgtcacagcacccccaggccctggcgcagctgccggagcagccgcatctagcgccatgacgtatgcacagttagagtctctcattaacaaatggtctcttgagctggaagatcaagagcggcatttcctgcagcaggccactcaagtcaacgcgtgggacagaacactgatcgaaaacggagagaagatcacttcgctccatcgcgaagtggaaaaggtcaaattggaccagaagagactggatcaggagcttgatttcatcctttctcagcagaaggaactggaagacctcctgtctccccttgaagagctcgtcaaagagcagagcgggacgatatatctgcagcacgctgacgaagaacgcgaaaagacatataagctcgccgaaaacattgacgctcagctgaagcggatggcccaagacttgaaggacattatcgaacacctgaacaccagcggcgctcctgctgacacttctgatcccctccagcagatctgtaagattctgaatgcccatatggactcccttcagtggattgatcagaactctgcgctgctgcagaggaaagtggaggaggtgacaaaagtctgcgaggggagaaggaaagaacaggaacgaagtttccggatcacttttgattag

SEQ ID NO: 233350 - DNA, 1569 bp, Artificial Sequence
  Description of Artificial Sequence: Synthetic coding sequence
atgagcgggtttaacttcggaggcaccggtgctccaacgggcggttttacatttggcaccgccaagacggccaccacaacacctgccactggtttctcatttagcaccagtgggacaggcggattcaatttcggtgctcccttccagcctgccacaagcacaccctccacaggcttattcagcttggctacacagaccccagcaacacagactactggcttcacctttgggactgcaaccctcgcgtcaggcggaactgggttctcactcgggattggagcctccaagttgaacttgagcaataccgccgcaacacccgctatggccaacccgagtggattcggcctggggtccagtaacttaacaaacgcgatctcatcaaccgtaactagttcccaaggaactgccccaactggctttgtgtttgggccttctacaacgtcagtggctcccgcaacaacctcagggggattcagcttcacaggcggaagcaccgcccagccgtcagggttcaatattggatcagctggcaacagcgctcaacccactgccccagctactctaccctttacccccgcaaccccagcagcgaccacggctggggctacccaacctgccgctcctactcctactgcaacgattacaagcactggtccatcgttgtttgcatcaattgctacagctcccactagctcagctaccaccggcctcagcctgtgcacccctgtgaccacggccggtgcccctactgccggtacgcagggcttttccctgaaggcacctggcgctgcatccggtacttcaacaacgacatccacagcagctaccgcaaccgccaccacgacgagtagttcgtccaccaccggttttgccctcaacctaaaaccgctagcccctgccggaatcccttcaaatacggccgcagccgtgacagcccctccaggacctggcgctgccgctggggctgctgcttcctcagcgatgacatatgcccagctggagtcccttataaacaaatggagcctggaactagaggaccaggaaaggcactttctccagcaagcaactcaggtgaacgcatgggatcgaacactgattgaaaacggggagaaaatcacttctctgcaccgagaggtagaaaaggtcaaactagatcaaaaacgtctcgatcaagaactggacttcatactgtctcagcagaaggagctcgaggatctcttgagccctctcgaagagctcgtaaaggagcaaagcggcaccatttatttgcagcatgcagacgaagaaagagagaagacgtacaagctggccgaaaacatcgacgctcagttaaagagaatggcacaggatttaaaggatatcatcgagcatctgaacaccagcggggctccagcagacacatccgaccctttgcagcagatctgcaaaattcttaatgcccacatggattccctccagtggatagaccaaaattctgctctgttgcagcgaaaagtcgaagaggtgacgaaggtctgcgagggaaggcgaaaggagcaggaacgctctttccgaattacttttgactag

SEQ ID NO: 233351 - DNA, 1569 bp, Artificial Sequence
  Description of Artificial Sequence: Synthetic coding sequence
atgtcaggcttcaactttggcggtacgggcgctcctactggcggtttcaccttcggcaccgccaaaacagccaccacgacccctgcaactgggttctcattcagtacatcgggaaccgggggttttaatttcggggcaccttttcagcctgcaacctccacaccatccacgggcctgttctctttagccacacagactcccgctacccagactacgggatttacctttgggaccgcaaccctcgctagcggcggaactggcttttctttaggaattggagccagcaagttaaatctgtccaacactgccgctactcccgctatggcaaatccgtccgggttcggacttggaagttctaatctgacgaacgccatttcctctactgtgactagttcccagggcacagcccctaccggctttgtctttggcccttccacgactagtgtcgctccggctactactagtggcggtttttctttcactggcggatcaaccgcccagccaagtggttttaatatcggctccgccggtaacagtgcgcagcccaccgctcctgccaccttacctttcacccctgccacgcctgctgcaaccactgctggtgccacccagcctgcggcacccaccccaaccgccacaatcacaagtaccggccctagcctctttgccagcatagccactgcaccaaccagctccgctactacaggactgtcgctgtgtacaccagtcacaacagctggtgccccaacagcagggactcaaggatttagcctgaaggctcctggcgcagcctccggcactagcacgacaaccagcacggctgccactgccaccgccacgaccacaagttcctcttctaccacagggttcgcactaaacttaaagccacttgctcctgccggaatcccaagcaacactgccgctgctgtgaccgccccaccgggtcctggcgctgccgcaggcgctgccgctagttcagccatgacctacgcccagttggagtccctgataaacaaatggtcgctggagctggaggaccaggagcggcacttcctgcagcaagcaactcaggttaacgcctgggaccgaactctcattgaaaatggcgagaagattactagtctccacagggaggtcgaaaaagtcaaactggatcagaagaggctggatcaagagctggattttattctgtctcaacagaaggagctggaggaccttctcagccctctcgaggaactggttaaggagcagagcggcacgatttacctgcagcacgccgacgaggagcgcgaaaaaacttataaactcgcggagaacattgacgcacaactcaagcgcatggcccaggatctaaaggacatcattgaacaccttaacacatcaggtgctcctgccgatacgtctgaccccttgcagcaaatctgtaagatccttaatgcgcacatggactccctgcaatggatcgaccagaactctgcgctcttgcagcgcaaggtcgaagaagtgactaaagtgtgcgaagggagacgaaaggagcaggagagaagcttcagaatcacctttgactag

SEQ ID NO: 233352 - DNA, 1971 bp, Artificial Sequence
  Description of Artificial Sequence: Synthetic coding sequence
atggaggaactggacggtgaacctacagtgactttaatcccgggagttaacagcaagaaaaatcaaatgtatttcgactggggaccaggggagatgctcgtgtgtgaaacatcgttcaacaaaaaagagaaatccgaaatggtcccctcttgcccctttatttacattatcagaaaggatgtggacgtctacagccaaattctgcgtaaattgtttaatgagagccacggcatattccttggtctgcagaggatcgacgaggaacttactgggaaaagtcggaagtcccagcttgttcgagtatctaaaaattacagaagtgttatccgcgcatgtatggaggaaatgcaccaggtggcgatcgctgccaaggacccagccaatggcagacaattcagcagtcaggtgtcgattctcagtgccatggagttaatttggaacctgtgcgaaatcctttttatcgaggtagcccctgctggcccattacttcttcaccttctagactgggtccgcctgcatgtgtgtgaagtcgattccctaagcgcggatgtactggggagcgagaaccccagcaagcacgacagtttctggaacttggtgaccatactggtactccagggcaggctggatgaggccagacagatgctttctaaagaggcagatgcaagtcctgcttctgcgggaatttgtcggatcatgggagatctgatgaggaccatgcctatactgtcgcctggtaacacacagaccctcaccgagcttgagctgaaatggcaacattggcatgaagaatgcgagcggtatctgcaggactccacttttgctacttcaccccacctggagtccctactcaaaatcatgcttggcgacgaggcagccctcctggagcaaaaggagctactgagtaactggtaccattttctggttaccagattgctatactctaatccgaccgtgaaacccattgatctgcactactacgcccaatcaagcttagatctgttcctaggcggagaatccagtccagagccactggataatattttactcgctgcgttcgagtttgacatacaccaagtcatcaaagagtgcagtatcgctctgtccaactggtggtttgtggctcacctgactgacctgcttgatcactgtaaactcctccaatcgcacaatctgtactttggatctaatatgagggagttcctgctgctggagtacgcttctggcttgttcgcacatccgagcttatggcaactaggagtggactacttcgattattgcccagagcttggcagggtctcacttgaactacacattgagaggatccccctcaacactgagcagaaggccttgaaggtgcttcggatttgcgagcagcggcaaatgaccgaacaagtgagatcaatctgtaagatcctggcaatgaaagcggtgcgcaataataggctgggttctgctctgtcttggtctatccgggctaaagacgccgcattcgctacgttggtgtctgaccggtttcttagagactattgtgaaaggggatgtttttctgacttagaccttatcgataatctgggaccagccatgatgctttccgatcgactgacttttttagggaagtatagggaatttcatcgcatgtacggtgagaaaagattcgccgacgctgcgtcactcctactctccctgatgactagtaggatcgcacccaggtctttttggatgacactgctgactgacgcactaccccttctggagcaaaagcaggtcatcttctctgctgagcagacttatgaactcatgcgatgtctggaagatcttacctcgaggagacccgtacacggtgaatccgacactgagcagcttcaggatgatgatatcgaaactactaaagtggagatgttacgcctgtccctcgctagaaacctcgccagagctatcataagagaggggagcctggaaggcagctag

SEQ ID NO: 233353 - DNA, 1389 bp, Artificial Sequence
  Description of Artificial Sequence: Synthetic coding sequence
atggccgcttcctccgctgcaaggagccccttctgtcaacagtggtccagcagcggcacctgcgtgagattctttttgctcaaatggccccaggtcaccatcctggttctgcagggccgtctcgacgaagcccgacagatgctgtcaaaggaggccgacgcttcccctgctagcgctggcatctgtcggataatgggcgacctgatgcgcaccatgcccattctttcacctggtaatacacagactcttaccgaactcgagctcaagtggcagcattggcacgaggaatgcgagcgctaccttcaggattctacttttgctaccagcccacatctggagagcttgctgaagatcatgttaggtgacgaagccgcactactcgaacagaaggaactgctgtcgaattggtaccatttcctggtgaccaggctgctgtacagtaatccgaccgtaaagcctattgatctgcactattacgcgcagtcctccctagatttattcttaggcggtgaatcctctccggagccattggacaatatcctcttagccgcatttgagtttgatatccatcaggtgataaaagagtgttctattgccctgtctaactggtggtttgtagctcatctgactgatttactagatcactgtaaacttctacaatctcacaatctgtatttcggatcaaacatgagagaatttttgctgttagaatatgcttccggcctgtttgctcatcccagcctctggcagctgggcgtggattactttgactattgtccagaattgggccgtgtgtcgctggagctgcacattgaacgtattcctctgaacaccgaacagaaggctctcaaggttctgcgcatctgcgaacagagacagatgactgagcaagtccgaagcatctgtaaaatactggccatgaaagcggttcgcaacaacaggctcggtagcgcactgagttggtcgatacgggcaaaagacgctgctttcgccaccctcgtgagtgaccgatttcttcgtgactattgtgagcgcggatgtttctcggacctagatctcattgataacttaggccctgccatgatgctatcagatcgcctcacctttctgggtaagtatcgcgagtttcaccgcatgtatggcgaaaagcgcttcgcagacgccgcatctttattgctatccctgatgacctctaggattgctccccgttctttctggatgacccttcttaccgacgccctcccactcctcgaacagaaacaggttaaggtcgcggctgcagtcgtgttttttgcttgtcagtctctgctggagctttcctgcatcgctgtggctgacgtgagggtgtcaagtttcgtagtgttgccagtgagagtgtactctccctag

SEQ ID NO: 233354 - DNA, 975 bp, Artificial Sequence
  Description of Artificial Sequence: Synthetic coding sequence
atggtgccaagctgtccattcatttatatcatccggaaggacgtcgacgtttactctcaaatccttcgcaaactatttaacgaatctcatggcatctttttgggactgcaacgaatagatgaggagctgacagggaagagccgtaagagtcagctggtcagagtcagcaaaaattatcgctcggtcataagggcctgtatggaagaaatgcaccaagttgccattgccgctaaggaccccgctaatggacggcaattctctagccaagtgagcatattatctgcgatggaattgatctggaatctttgtgagatcctgtttatcgaggtggcccctgccggtcctctgctcctgcacctccttgattgggttcggctgcatgtgtgtgaggtggactccctgtcggcagacgtgctggggagtgagaacccctccaagcacgactccttttggaaccttgtcaccatcctcgtgctgcaaggcaggttggacgaagctaggcagatgctgtctaaagaagccgatgcttcccctgccagtgccggaatttgccgcattatgggagatttgatgcgtacaatgccaatcttgagtccaggcaacacccagacattgactgaactggagctcaagtggcagcattggcacgaggaatgtgagaggtacctgcaggattcgacgtttgccacttccccccaccttgaatcactcctcaagattatgcttggagatgaagccgctttgttggagcagaaggaattgctatccaactggtatcactttcttgtaacgcggcttctgtactcaaatcccacagtgaagccgattgatctccactactacgcccagagttccctggacctattcctcggaggggaaagctctccagaacccctagacaatattttgctggccgcttttgaattcgatatccaccaggtaatcaaggaatgcagggatgtacatctgaagtag

SEQ ID NO: 233355 - DNA, 780 bp, Artificial Sequence
  Description of Artificial Sequence: Synthetic coding sequence
atgcgggagtttttgctgttggagtacgccagcggactcttcgcccacccatccctttggcagttgggggtggactattttgattactgtcccgaactgggacgtgtgtctctggagctacacatcgaacggattccgctcaacacagaacagaaagcactgaaagtgctaagaatctgtgagcagagacagatgactgaacaggtccgaagtatctgcaaaatccttgcaatgaaagctgtccgtaacaaccggctgggtagtgcactgtcctggagcattcgggcaaaagacgcagcattcgcaacgctggtatccgataggtttttacgggactattgcgagcggggttgcttcagcgatctggatctcatcgataatctgggtccggcaatgatgttatccgacaggctcactttcctcggcaagtatcgcgagtttcaccggatgtatggagagaagagatttgcagacgccgcttctctcctcctttcactgatgaccagccggattgcacctagaagcttctggatgacactcctcacagacgctctgcctctcctggaacagaaacaggtgattttttcagctgaacaaacatatgaactcatgcggtgtttggaagacctcaccagccggagacctgtccatggtgagagcgatacagagcagcttcaggatgacgacatcgagacgaccaaggttgaaatgctccggctgtctcttgcaagaaatctggctcgggcaattatcagagaaggttccctggaaggctcatag

SEQ ID NO: 233356 - DNA, 1833 bp, Artificial Sequence
  Description of Artificial Sequence: Synthetic coding sequence
atggtccctagctgccctttcatctatattatccggaaggacgtggacgtttacagtcaaattctgagaaagctgtttaacgaaagtcacggcattttcctgggactgcagcggatcgacgaagaactcactgggaaaagcaggaagtctcagcttgtcagggtctccaagaactatcggtcggtgatacgcgcttgtatggaagaaatgcaccaggtggcaatcgcagctaaagaccctgctaatggtaggcaattcagcagtcaggtgtcaatcctctcagctatggaacttatttggaatctgtgcgagatcttattcatcgaagttgctcccgctggcccacttctactacacctgttggattgggtgaggcttcatgtttgcgaagtcgactctcttagtgcggacgtacttggctccgagaatccttcgaaacacgattcattctggaaccttgtgacaatcctggtgctgcagggccgtttggatgaggcacggcaaatgttgtcgaaggaggccgatgcttctccagctagcgccggaatttgccgaattatgggagacctcatgcgtaccatgcctatcttatccccgggtaacactcagacactgacagaactcgagctcaagtggcagcattggcatgaagagtgtgaacggtatctacaggatagcactttcgctacatcaccccacttggagagcctgctgaaaatcatgctgggcgatgaggccgctctactggaacagaaagaactgctgtccaactggtaccattttctcgttacacgcttgctgtacagcaacccaacagtcaagcctattgacttgcattactatgcccaaagttccctcgacttgttcctgggcggagagtcctcccccgagcccctagataacattctgctggccgcatttgaattcgatatacaccaggtgatcaaagaatgcagtatcgctctcagtaattggtggttcgtggcgcacttaacagatctgctggatcactgcaagctgcttcagtcccataatctctactttggctctaacatgcgggaattccttcttctggagtatgcctctgggctgttcgctcatccaagcctctggcagctaggagtggattatttcgactattgccctgagctcggtcgggtcagtctggaactccacatcgagcgtattcccctgaatacagaacaaaaagccctcaaagttctcaggatatgtgagcagcggcagatgaccgagcaggtcagatctatctgcaagatcctggccatgaaggctgtcaggaataatagactaggcagtgctctgtcatggagtatccgtgctaaggacgcggctttcgcaactttggtgtccgacaggttcctgcgggactactgtgaaagaggctgtttcagcgacctggatctgatcgacaatctgggacctgcaatgatgctgagcgaccgactgacgttcctgggaaaataccgcgagtttcacaggatgtacggcgagaaaagattcgcggatgcagcctcacttttattgtcactgatgacaagccggattgcccctaggtctttttggatgacactgcttactgatgcactacctcttctcgagcaaaaacaggtaattttttcagctgagcagacctacgagctcatgcggtgcctcgaagaccttaccagcagacgcccagtgcatggcgaaagtgacactgagcagctgcaggacgatgacattgaaactaccaaagtggagatgttgagacttagtctagctaggaacctggcacgggctatcatccgagaagggagccttgagggaagttag

SEQ ID NO: 233357 - DNA, 846 bp, Artificial Sequence
  Description of Artificial Sequence: Synthetic coding sequence
atgaagctggctgcgatgattaagaagatgtgcccaagtgacagcgaactaagtatcccagctaaaaattgttacaggatggtgatcttggggtcttctaaagtggggaagacggccattgtctcccgcttccttacaggcaggttcgaagacgcgtatacccctaccattgaagatttccaccggaaattctactcaatcaggggcgaggtctaccagcttgacatactcgatacttcagggaaccatcccttcccagccatgagacgtctgagcatattgacgggcgatgtgtttattttggttttttcgttggacaacagagacagctttgaagaggtgcagcgcctgaggcagcagatactggacacaaaatcctgccttaagaacaagaccaaggagaacgtcgacgtccccctggtgatctgtggaaataaaggcgatagagacttctacagggaagtggatcagagagagattgagcaacttgtaggggacgatccccagagatgtgcatatttcgagatttctgctaagaagaacagcagcctcgaccagatgttcagagcactgtttgctatggcaaagctccccagcgagatgtctccggaccttcaccgaaaagtctccgttcagtactgcgacgtacttcacaaaaaggccttacggaataagaagctcctcagggcaggctcaggcggaggcggtggagatcccggtgatgccttcggcatcgtagccccttttgcgaggagaccatccgtgcattctgacttaatgtatataagggagaaggctagcgctggtagccaggctaaggacaaggagcgatgcgtgattagctag

SEQ ID NO: 233358 - DNA, 1881 bp, Artificial Sequence
  Description of Artificial Sequence: Synthetic coding sequence
atggttttggagctgccgaagcgttggggtaaaaattctgagtttgagggcggtaagtctacagttaactgctctaccaccccagtagcagaacgtttcttcaccagctcgacatcccttaccttaaagcacgccgcatggtatcccagcgagatcctcgaccctcacgtggtgctcctgacatctgataatgtgatcagaatctattcactcagggagccacagacaccaacaaacgtaatcattcttagcgaagctgaggaggagtctctggttcttaataagggaagggcctacaccgcctcactcggcgagactgcagttgcctttgattttggccctctcgcagccgtgcctaagacccttttcggtcagaatggtaaggatgaggtggtggcttaccctctttatatcttatatgaaaatggggagacctttcttacatacatatcactgctgcattcccccggaaacataggaaaactacttggcccactgccaatgcatcctgccgcagaggacaactatggctatgacgcatgcgctgttttgtgtctgccgtgtgttccaaacattctggtcattgccactgagagtggcatgctttaccattgtgtggtcctcgagggcgaagaggaagatgaccatacatcagagaagtcttgggatagtcgcatcgacctgattcctagcctttatgtcttcgaatgcgtggagctagagctggcactgaagctggcttcgggtgaagacgatcctttcgactcagacttttcttgccctgtaaagctgcacagagatccaaagtgcccaagccgctatcactgcacacatgaagcaggagtgcactcagtgggacttacctggatccataaattgcacaaattcctaggaagcgatgaggaggacaaggatagcctgcaggaactgtctaccgaacagaagtgcttcgttgagcacattctctgcacaaaacccctgccttgtcgtcagcccgcacctatccgtggcttctggattgtaccagacatcttaggaccaaccatgatctgcattaccagcacctatgagtgtctgatttggcccctactgagcaccgtccacccagccagtccccctctcctctgtacaagagaggatgtggaagttgcagagagtcctctgcgagttttggcagagacacctgattccttcgaaaaacacattcgttccatcctgcagagaagcgtggccaaccctgccttcctgaattgcttcacccaactccgaaagattaaggttgaaactctttttttgcgggcttctgaaaaggatatagcgcctccccctgaggaatgtcttcagctgctgagcagggccacccaggtgtttcgagaacagtacattcttaaacaggacttggcaaaggaagagatacagagaagagtcaagctcttgtgcgaccagaagaagaagcagctggaggatctaagctattgccgcgaggagcggaagagtctcagggaaatggccgagaggctcgccgataaatacgaagaggccaaagaaaagcaggaggacataatgaacagaatgaaaaagctgctgcactccttccactccgagctccccgtcctttccgattctgaaagggacatgaaaaaggaattgcagctgattccggaccagctgcgccacctcgggaacgccattaagcaggtgactatgaagaaggattaccagcagcagaagatggagaaggtgctcagcctgcctaaacctacaattattctgagtgcgtatcagcgcaagtgcattcagagtattttgaaggaggaaggggaacacattagggagatggtcaaacagattaacgacataagaaaccatgttaatttttag

SEQ ID NO: 233359 - DNA, 2226 bp, Artificial Sequence
  Description of Artificial Sequence: Synthetic coding sequence
atggccgctgctgaaggcccagtgggagatggtgagttatggcagacctggttacccaaccacgtagtttttctacgcttaagggaaggcctgaagaatcagtcccccactgaggctgagaagccagcttcctcctcgcttcctagcagtccaccaccccagcttctcacccggaacgtcgtatttggtctcggaggagaattgtttttatgggacggcgaagattcttcattcctcgtagtgagactgcggggaccctccggcggaggggaagagccagccctatcacagtaccaacgtctgttatgcatcaatcccccactatttgagatatatcaggtcctcctcagtccaacgcagcaccatgtggctctgattgggatcaagggcctcatggtgctggagttacccaagaggtgggggaagaacagcgaattcgagggaggtaaatctacagtgaactgcagcactacccccgttgccgaacgcttttttacttcatcaaccagcctcactctgaagcatgcagcttggtacccatcagagatcctggaccctcacgtggtgctgctgacctcggacaacgtgattcgaatttatagcttacgggagccgcagacaccaacaaacgtcattatcctgtctgaggctgaagaggaatcattggtcttgaacaaaggacgggcatacacggcaagcctcggtgagactgctgttgcgtttgatttcggacctctcgccgctgtacctaaaacgctttttgggcaaaatggaaaagacgaggtggtggcatatccactgtatatcctttatgagaatggagagacatttctgacttacatcagtctcctgcactcaccgggaaacatcgggaaactgcttgggcctttgccgatgcacccagcagccgaagacaactacgggtacgacgcctgtgcggtcctatgtcttccatgtgtgccaaacatcctggtcatcgctacagaatcaggcatgctctaccattgtgtggtactcgagggtgaagaggaggatgaccacacgagcgagaagagttgggatagtcggatcgatctgataccaagcctctacgtgttcgagtgcgtggaactcgagctggcacttaagcttgctagtggggaagacgacccctttgattctgatttttcttgtcccgtgaagcttcacagagatcctaaatgcccaagccggtaccattgtactcacgaagccggtgtgcatagtgttgggctcacctggatccacaaactccataaattcctcggatccgatgaggaagataaggactccctccaggagctaagcacagaacagaagtgcttcgtagaacatattctgtgtacgaagccactaccttgtcgccagcctgctcccattaggggtttctggatcgtccccgatatattaggtccaacaatgatctgcattacaagcacatatgagtgcctgatttggccacttctgtcaacagtgcaccccgcttccccgccactgctttgcactagggaggatgtagaggtggccgagtctccccttcgggtgctggcagagaccccagattccttcgagaagcacattcgcagtattctgcaacgatctgtagcaaatccagcttttctgaaggcatccgaaaaagatatagccccacctccggaggagtgtctgcagctgctaagccgagctacacaggtcttcagagaacagtatattctgaagcaggaccttgctaaggaggagatacagcgaagggtgaagctcctgtgtgaccagaagaagaagcagctggaggacctgtcctactgtcgggaagagaggaagagcctgagggagatggccgaacgtctggccgacaaatatgaagaggctaaagagaagcaggaagatatcatgaatagaatgaaaaaacttttacactcttttcatagtgagctgcctgtgttgagtgactccgaaagggacatgaagaaagagttgcagttgattccagaccagctgaggcacctggggaatgcaatcaaacaggttacaatgaagaaagactaccaacagcagaaaatggaaaaggttctctccctgccgaaacctaccattattctcagcgcctatcagcgcaaatgcatccagtccattctgaaggaggagggcgaacatatccgggaaatggtcaagcagattaacgatatcagaaatcacgttaacttctag

SEQ ID NO: 233360 - DNA, 2460 bp, Artificial Sequence
  Description of Artificial Sequence: Synthetic coding sequence
atggatacagaaggcttcggggagcttctccaacaggctgagcagctggctgccgagactgagggcatcagtgagttacctcacgttgagagaaatctgcaagaaattcagcaggcgggtgaacgattaagaagccggactctgaccagaacatcccaggaaaccgctgatgtcaaagcctcagttctactaggcagccggggactcgacatatcccacatcagtcagagactggagagtctctctgccgcaacaacgttcgaaccccttgagcccgtcaaagataccgatatccagggctttctgaagaatgaaaaggacaatgccctactgtcagccattgaagagagccgtaagcgaacattcggaatggctgaggagtaccatagagaatctatgctggttgagtgggaacaggtcaaacagaggatccttcacaccctactggctagtggggaggatgccctcgactttacacaagagtctgaaccatcttatatcagtgacgtgggcccacctggacgctcatccctggacaacatcgagatggcatatgctaggcagatctatatctataatgagaagatcgtgaatggccacctgcagcctaacttggttgacctgtgtgctagcgttgcggagctggacgataagtccattagtgatatgtggactatggtaaaacagatgaccgacgtgttgttgacaccagccactgatgccctcaagaatcgttccagcgtcgaggtgagaatggagttcgtgaggcaggccttggcatacctcgaacagtcctataaaaactatacactggtaaccgttttcggcaacttgcaccaggctcaattagggggtgtgcccggaacctatcagcttgtgaggtccttcctaaacattaaactccccgcacctcttccgggactccaggacggggaggtggagggtcacccggtgtgggccctgatctactactgcatgaggtgtggtgacctgctggctgcatcacaggtagtgaatagagcgcagcaccagctgggagagttcaaaacctggttccaggaatacatgaattccaaggaccgacgcctgtcccctgccacagagaacaaactacggttgcattaccggcgtgccttgcgcaataatacagacccttacaaacgggctgtatattgtattataggtaggtgtgatgtaactgacaaccagtccgaagtcgcagacaaaaccgaggactatttgtggcttaagttgaatcaagtgtgttttgacgacgatggcactagctctccccaggataggctgaccttgtctcaattccaaaagcagctgcttgaggattatggcgaaagtcactttacggtgaatcagcagccttttctgtacttccaggttctctttctcacagcccaattcgaggccgctgtcgccttcctcttccgcatggaacgactgaggtgccatgccgtgcacgtagccctcgttctgttcgaacttaagctcctgttgaagtcgtctgggcaatccgcccaactcctcagccatgaacccggtgatccaccatgcctgagacggctgaattttgtccgcctgttgatgctgtacactcgtaaattcgagtccaccgaccctagggaggcacttcagtatttttattttcttagagatgaaaaagattcccagggcgaaaatatgttcttgcgttgcgtctcagagctggtgattgagtcccgcgagtttgacatgatcctcggtaagttggaaaatgacggatcgaggaaacctggcgttatcgacaagttcacatccgatactaagcccatcattaacaaagtggcgtcagtagccgaaaataaaggccttttcgaagaggccgctaagctgtacgacctggccaaaaacgccgacaaagtgttggaactaatgaataagctcctcagcccagtggtgccccagattagcgccccacagtccaataaggagaggcttaagaatatggccctgagcatagccgaaagataccgggctcagggtatcagcgcaaacaagttcgtggatagtacattctatttgttgcttgatcttatcacattcttcgacgagtaccactctggccacattgacagagcctttgacatcattgagcggcttaagttagtgcctttgaatcaggagtccgtagaagagagggttgctgcattcaggaatttctccgacgaaatccggcataatctgtcagaggtgctgctcgcaaccatgaatatcctgttcacccagtttaagcggctgaaaggcacctcgccctcctcttcctcacggccacagagggtgatcgaagaccgtgacagccagctaaggtcccaggctcgcacacttataactttcgccggaatgatcccctatcgtacatctggtgatactaacgcacgacttgtccagatggaggtgcttatgaattag

SEQ ID NO: 233361 - DNA, 2091 bp, Artificial Sequence
  Description of Artificial Sequence: Synthetic coding sequence
atggctgaggagtaccaccgcgagtctatgcttgtggagtgggagcaggttaaacaacgaatcctgcacactctgttagcgtccggcgaagatgcgctggatttcactcaagaaagtgaacccagctacatcagcgacgtcggccctccgggtagatccagtctagataacattgaaatggcctacgcccgacagatctatatctataacgaaaagattgtgaacggccacctgcagcctaacctggtggacctctgtgctagtgttgcggagctggatgacaagtctatctcagatatgtggaccatggtcaagcagatgactgacgtcctgctgacaccagctactgatgcactcaaaaaccgttctagcgtcgaggtgcggatggagttcgtgcggcaagcgttggcatacctagaacagagttacaaaaactatacactcgtgacagtctttggcaacctgcatcaagcccagctgggaggtgtcccgggtacgtatcagttggtgcgctcttttctcaatattaaattgccagctccattgcctggacttcaggacggcgaggttgaaggacacccggtatgggcactgatatactactgcatgagatgtggagatttgctcgccgctagtcaggttgtgaacagagcacagcaccagttgggcgagttcaagacatggttccaggaatatatgaactccaaagatagaagactaagcccagcaacggaaaacaaactgcgcctccactacagacgggctttgcggaacaacactgacccctacaaacgagctgtgtactgtataattggccgttgtgatgtcacagataaccaaagcgaggtggcagacaaaaccgaggattacctatggttaaagctcaaccaagtctgcttcgacgacgatgggacttcttctcctcaggacaggctcacactgtcccagtttcaaaagcagttgctggaagattacggggaaagccacttcacagtcaatcaacaacctttcctgtactttcaggtcctattcctcacagcccagttcgaagctgccgtggccttcctttttcgaatggaaagactgagatgtcacgcagtgcatgtagcattagtactttttgagttaaaactactcctcaaatctagtggccagtcggcccagctcttatctcacgaacccggtgaccccccttgcctgcggaggctgaacttcgtacggctcctgatgctgtacaccagaaagtttgagtctaccgacccacgtgaggccctccagtacttttactttctgagagacgaaaaagattcacagggggagaacatgttcctaaggtgtgtctccgaactcgtaattgagagtcgggaattcgacatgatactgggcaaactcgaaaatgacggctccagaaaaccaggcgtaatcgacaaattcaccagcgacactaagcccattatcaataaagtcgcgagcgtcgccgaaaataagggcttgttcgaggaggcggctaagttgtatgacctcgccaagaatgcagacaaggtgttggagctgatgaacaagttactgagtcccgtcgtgcctcaaatttcagcccctcagtccaataaagagcggctcaagaatatggcactgtctatcgccgagaggtacagagctcagggcatatcggcaaataaatttgtagatagtacattttacctcctcctggacttgattactttcttcgacgaatatcactcgggccacatcgatcgggcattcgacattattgagcggctcaaactcgtgcccctgaatcaagagtcagttgaagagcgcgttgcagccttccggaacttctccgacgagatccgacataatttgtctgaagtcttattagccacaatgaatattctgtttacacagttcaagaggctcaaggggacctcgcccagcagctcctcccgtccccaaagagtaatcgaggacagggattcgcagttacgtagccaggcccgtactttaatcacattcgcagggatgatcccataccgaaccagtggcgacacaaacgctcggctggtgcagatggaggtcctgatgaactag

SEQ ID NO: 233362 - DNA, 2091 bp, Artificial Sequence
  Description of Artificial Sequence: Synthetic coding sequence
atggcagaagagtatcacagagagtccatgcttgttgagtgggagcaggtaaaacagcgcatcctgcacactctgctcgcttccggcgaggacgccctcgacttcacccaggaatccgagccctcttacattagtgacgtgggccctcccggacgatcttctcttgacaatattgagatggcatatgctcgacagatatatatttataacgaaaagatcgtaaatggccacctgcaacccaatctcgtggatctgtgtgcctcggtcgctgaactggatgataaaagcatttccgacatgtggacaatggtgaaacagatgacggatgtgctcctcacacctgctaccgacgccctgaagaatagaagctcagttgaggttcgtatggagtttgtacgacaggctctggcttatcttgagcaatcctacaagaattataccctcgtgactgtcttcggaaaccttcaccaggcccagttggggggagtgccgggaacttaccagctggtgagatcatttctgaacatcaaactcccagcccctctgcccggattacaggacggcgaagtggaaggacatccagtctgggcccttatctactattgcatgcgctgtggagacctgctggcggcttcccaagttgtgaaccgggctcagcaccagctcggtgagtttaagacttggtttcaggagtacatgaatagcaaggatcggaggctcagccccgctaccgagaataagttgagactccactaccggagagctttaagaaataacactgacccttataagagagccgtgtattgtatcattggtcggtgcgatgtgaccgataatcagagcgaagttgcagataagacggaagactacttatggctaaaactgaatcaggtgtgcttcgacgacgacggaacttcatcccctcaggacaggctgacactttcccagttccaaaaacagttgctggaagactacggggaaagtcacttcacagtgaatcagcagccgttcttgtattttcaagtgcttttcctgaccgcccaattcgaagccgcagtggcgttcctatttaggatggaacgtctgcgttgccacgccgtacatgtggcgctggtgctgttcgaactcaaacttctgcttaagagctccgggcagtccgcacaattgctgtcccacgaaccaggggaccctccgtgtctcaggagattgaatttcgtgaggctgcttatgttgtatactaggaaatttgaatcgacggatcctagagaagcgttgcaatacttttattttctcagagacgagaaagattcccagggcgagaacatgttcttaagatgcgtctccgagctggtgatcgaaagtcgcgagttcgatatgatcctgggcaaattagagaacgacggctcccggaagccaggggtgatcgataagttcacctccgacacaaagccgattattaacaaggtggcttcagttgccgaaaacaaaggtctgtttgaggaggcggcaaagttgtacgatctggctaaaaacgccgacaaggtgttagaactcatgaacaaattactttcacccgtggtcccacaaatctcagcacctcaaagtaacaaagaacggcttaaaaatatggctctgagcatcgctgaaagatatcgagctcagggcatctcggccaacaagttcgtggacagcacattttacctcttgcttgatctgatcaccttcttcgatgagtaccatagtggccatatcgatcgagctttcgatatcatcgaaaggttgaaactggtgcctctaaaccaggaatctgttgaagagcgagttgctgcattccgcaacttctctgacgaaattaggcataatctatctgaggtgctgttggcaactatgaatatccttttcacccagttcaaacgcctgaaaggcacttctccttctagctcctcaaggccacagcgggtgattgaggatcgagactctcagttgaggtcacaggcaagaaccctgattacttttgctggcatgatcccttacagaacttcaggcgatacaaatgccagactggtccagatggaagttcttatgaactag

SEQ ID NO: 233363 - DNA, 5402 bp, Artificial Sequence
  Description of Artificial Sequence: Synthetic coding sequence
atgttcaacaagtctttcggaaccccgtttggtggcggaacgggcggatttggtaccacatcaaccttcggacaaaatacaggcttcgggaccacttctggtggagccttcggcacatccgcattcgggtccagcaataataccggagggttgttcggaaactcccagaccaaacccggaggattatttggtacaagctcgttctcgcagccagctacctctacctcgacgggatttggtttcggcaccagtactggcactgcaaacacactgtttggcactgcttcaactgggacgagcctcttttcctctcagaacaacgcctttgcgcagaacaagcccaccggttttggcaattttggtactagcacctctagcggcggattgtttggaaccacaaatacaacaagtaaccctttcggctccacctctggctcactttttggtccatctagcttcactgcagcaccaacagggacaaccatcaagttcaaccctcctacaggaactgacaccatggtcaaggccggagtaagcaccaacataagcacaaagcatcagtgcataaccgcgatgaaggagtacgagtccaagtctttggaggaactgaggctggaggattatcaagcaaaccgtaaaggcccacaaaaccaagtcggcgcagggaccaccactgggttgttcggctcttccccggctactagcagtgccactggtctgttcagcagctccacaaccaacagtggcttcgcttacggccagaacaagacggcttttggaacctctaccacaggcttcggcacgaacccaggcggactgtttggccaacagaaccagcagaccaccagtctgttcagcaaaccatttggccaggcaacaaccactcagaataccggctttagttttggcaacactagcaccatcggtcagccctcaactaataccatgggcctgttcggggtgacacaggcaagccagccaggaggcctgtttggcaccgccacaaatacgtcaactgggactgctttcgggactggaactggactgtttggccagacaaatactgggttcggcgcagtcggttctaccctcttcggaaacaataagctgacgactttcgggtcttccaccacatccgcccctagtttcggcaccacgtccggaggtctgttcggctttggaacaaacacctcgggtaactccatcttcggatccaaacccgctcctggtactcttggcaccggcctaggagcaggcttcgggactgccctgggcgcaggacaggccagcctctttggcaataatcagcctaaaatcgggggtccactgggcacaggcgcttttggcgcaccaggtttcaacactacaaccgccacgctaggctttggagcaccacaagcacccgtcgctctgaccgacccaaacgcctcagcagcccagcaagccgtattgcagcaacacattaactctctaacctacagtccatttggtgattcccctctgttccggaatcctatgtccgatcctaagaaaaaggaagaaaggctaaagccaacaaatcctgctgcccagaaagctttgacaactccaacacattataaactcactccacgtcctgccacccgcgtgcgccctaaagctttacagactactggtacggctaaatcccacttatttgatgggttggacgacgacgagccgtctctggccaatggcgcttttatgcccaaaaaatctatcaaaaagctcgtgctgaagaacctgaataactctaatctgttctcacctgtaaaccgggatagcgaaaatctggcctctccctccgagtacccggaaaacggggaacgcttttcattcctgtcaaagcccgtcgatgaaaaccatcagcaggacggggatgaggattctttagtcagccacttttacacaaacccaattgccaagccgattccccaaacccccgaatctgccggaaataaacatagcaattcaaactctgtggatgataccatcgttgccctaaatatgagagccgctctccgaaatgggctagaggggagctcggaagagacctcatttcatgacgagagccttcaagacgaccgggaggagattgaaaataacagttaccatatgcatcctgccggaataattctgaccaaagttggctactatactattccgagtatggatgatttagcaaagattactaatgagaagggcgaatgcattgtgagcgatttcaccatcggccgtaaggggtatggatcaatatactttgagggagacgtcaaccttaccaacctgaatctggatgatattgtgcacatccgcagaaaagaggtggtggtgtacctggacgacaatcagaaacctccggtcggggaggggctcaaccgaaaggcagaggtgaccctggacggggtatggccaaccgacaaaacatccagatgcctgattaagagcccagacagactcgcagatatcaactacgaaggaagactcgaggcggtctcacgaaagcaaggagcacagtttaaggagtaccgcccagagactggctcgtgggtgtttaaggtgagtcatttctccaagtatggcctgcaggattctgacgaggaggaggaagagcatccaagcaaaacctcaaccaagaagctcaagacagctcccctcccccctgctagtcagactactcctttgcagatggccctgaatggaaagcctgctccccctcctcaatctcaatcacctgaggttgaacagttgggccgtgttgtggagctcgacagcgatatggtcgacatcacacaggagcccgtgttggataccatgttggaggaatctatgcccgaagaccaggaacccgtaagtgcttctactcatattgctagtagtctcggcataaatcctcatgtccttcagatcatgaaggcttcactgttgacagacgaggaggatgtggacatggccctagaccagcgcttctctcggttaccaagtaaggcagacacttctcaggagatctgctctccacgactgccaatctccgcgtctcatagctccaagactcggtccctggtcggaggactactacagagtaagtttaccagtggagcgttcctgtcaccatctgtgagtgtgcaagaatgtaggaccccacgcgcagcctcactaatgaatataccttcaaccagcagctggtcagtgccccctccccttacgagtgtgttcactatgcccagtccagctcctgaagttcctttaaaaactgtggggacacggcgtcagctgggcctggtgcccagggagaagtctgtgacatacggcaaaggtaaactgttgatggacatggccctgttcatggggagatcatttcgggtggggtggggccctaattggactttagccaacagtggtgagcaattaaatggaagccacgagctggagaatcatcagatcgccgactccatggaattcgggtttttgcctaatcccgtggccgtgaagcctctcactgagagcccatttaaagtccatttagaaaaactttccctgagacagaggaagccggacgaagacatgaagttgtaccagacgccgttggagcttaagttgaaacacagcaccgtccatgtcgacgagctttgccctctgatagtgccaaatctgggcgtggcagtgatccacgattatgcagattgggtgaaggaagccagcggcgatctccccgaggcccagatcgttaaacattggtccctgacctggactctttgtgaagccctgtggggccacctgaaggagttggatagtcagttaaacgagcccagagagtatattcagatcttagagcgtcgacgagcttttagtcggtggttgtcctgtacagcaacgcctcagatcgaagaagaggtgagcctgacgcagaagaactcaccggtggaggccgtgtttagttacctgaccggcaagcgaatctctgaagcctgtagtcttgcccagcagtccggcgaccaccgccttgctcttctgctgtcccagttcgtggggagccagtctgtaagggaactgctaaccatgcagcttgtcgactggcatcagctgcaggccgactcctttattcaggatgaacggctacgcatctttgccctgctagccggtaaaccagtgtggcagctgagcgagaagaaacagattaacgtgtgctctcagcttgactggaaacgctcactcgccatccatctctggtatctgctgcctcccacagcctcgatctctagagcgctcagcatgtacgaggaggcatttcagaataccagcgatagtgaccggtatgcctgctctccattaccatcttatttggagggctctggatgcgttattgcggaggagcagaattctcagaccccactccgtgacgtgtgcttccaccttcttaaattgtacagcgaccggcactatgatctcaatcagctcctggaacccagaagtatcacagccgatccattagactacagattgtcatggcacctgtgggaggtgctaagagcccttaactatacacacctttcagcacagtgtgagggcgtattacaggccagctatgccggacagctggaatctgagggcctctgggagtgggccatcttcgtgcttttgcatattgataacagtggtatccgcgagaaggccgttagggagcttctaacacggcattgccagctgctggagacaccagaatcctgggcaaaggagacttttctcacccagaaactccgtgtcccagccaaatggatacacgaagccaaggcagtgcgtgctcacatggaaagcgataagcacctggaagccctttgtctgttcaaggcagagcactggaacagatgccataagctgatcatcaggcacctcgcctcagacgccatcatcaacgaaaattacgattacttgaaaggatttctggaagaccttgcccctcctgaacggtcttctcttatccaggattgggaaacttctggcctcgtttatctggactatatccgggtgatcgaaatgctgcgccacattcagcaagtggactgcagtggcaacgacctggagcagctccacataaaggtgacatcactctgcagtcgtatcgaacagattcagtgctatagtgccaaggatcggttggcccagtcagatatggctaaacgggtggccaacctgctgagggtcgtgctcagtctccaccatccacccgaccggacatctgacagcacccctgaccctcagagggtgcccttgcgcctgcttgccccacatataggaagactccctatgccagaagattacgcaatggacgaactacgatcccttacgcagtcttaccttagggagctcgcagttggatcactgta

SEQ ID NO: 233364 - DNA, 5180 bp, Artificial Sequence
  Description of Artificial Sequence: Synthetic coding sequence
atgtttaataagtctttcgggaccccattcggcggagggaccggaggcttcgggaccacttcaacctttggtcaaaacactggtttcggaactacttcagggggagcctttggcacatcagcctttggaagctctaacaacactgggggtctcttcgggaattcgcaaaccaagcccggagggctcttcggaacatctagtttctcacagccggcaacttcaactagcacaggctttgggtttggaacctccaccggcaccgctaatacgctgtttggaaccgcttcaactggaacctcccttttctcaagccaaaataacgctttcgctcagaataagccaaccggatttggcaacttcgggactagcacttctagtggtgggttattcggtactaccaataccacttctaatccatttggcagtacaagcggcagccttttcggtcctagtagtttcaccgctgcgccaaccggaacgacaattaaatttaatccacctacgggcactgataccatggtcaaagccggtgtgagtacgaacatctcaacaaagcatcagtgcattacggccatgaaggagtatgaatccaagagtctggaggagttacgtctcgaagattatcaggctaatcgcaaaggaccacagaatcaggtgggggctggtacgaccacaggcctgtttgggtcatctccagcaactagttctgccacaggcctcttttcctcctctacgactaacagtggattcgcttacgggcagaataagaccgccttcggtacctccactactggctttgggaccaatcccggtggcctctttggccagcagaatcagcagaccacttctctgttctccaagcctttcggacaggcaactactacccagaataccggtttctcattcggcaatacaagcaccattgggcagcctagtacaaacaccatggggttattcggggtgacacaggcctctcagccaggtggactctttggtactgcgactaatacaagcacaggtactgctttcggcacgggaacgggactattcggtcagaccaatactgggtttggtgccgttggctctaccctgtttggcaacaacaagcttacaacatttgggtcctccacgacttcagctccaagcttcggaaccacttccggagggctgttcggattcggtaccaataccagcggaaacagcatcttcgggtccaagccggcacctggcaccctgggcaccggactgggggcaggctttggcactgccctaggggcagggcaggcctcactgtttggtaacaaccaacctaagatcggcggacctctgggcaccggagcattcggtgccccaggtttcaataccacaaccgccactctcggctttggggctcctcaggcaccggtcgcactcactgatccaaatgcctcggctgctcagcaggctgtgttacaacagcacataaactcactcacatacagtccctttggagacagtccactgttccgtaatcccatgtcggatcccaagaaaaaggaggagaggctcaaacccaccaatcctgccgcacagaaagcactgaccacgcccactcactataagttaacacctaggcccgcaactcgcgtccggcctaaggccctccagaccaccgggaccgccaagtcgcacctcttcgatggacttgacgacgatgagccttccctggccaatggcgcatttatgccaaagaagagtatcaagaaactcgtcctaaagaatctgaacaactccaatctcttcagtcctgtgaatcgggattccgaaaatctggccagtcccagtgagtaccccgaaaatggcgagcggttctcctttctatcaaagcccgtcgacgagaaccatcaacaggatggggatgaagactcactggtgtcacatttttacactaatccaatagcaaagccaatcccgcaaacccccgagtccgccggtaataaacacagcaatagcaattcagtggatgatactattgtcgctcttaatatgcgtgccgctctccgaaatggcctggaaggtagtagtgaagagacctccttccacgacgagagcctgcaggatgaccgggaggaaatcgagaataactcttaccatatgcaccccgctgggattatcctgactaaggtaggatattatactatcccatcgatggacgacttagctaaaattaccaatgagaaaggcgagtgtattgtatccgattttaccataggacgcaaggggtatggctcgatctacttcgaaggggacgttaatctcaccaatctgaatcttgacgacattgtgcatatcagaagaaaggaagtggtagtgtatctcgatgacaatcagaagccgccagtcggtgaaggactcaaccggaaagcagaagtgacactggatggagtatggcccacagataagacaagtcgctgtctgatcaaatcgcccgacaggcttgccgatattaattacgaaggccgattggaggcagtcagccggaaacagggcgctcaatttaaggagtatcgccctgagacaggcagttgggtctttaaggtctcccatttctctaagtacggactccaggattcagacgaagaggaagaggagcacccatcaaagacttctacaaaaaagctgaagacggccccactcccacctgcctctcagaccacaccactgcaaatggctctcaatgggaaacccgcaccaccaccccaatcccagagtcctgaagtagagcaattgggtcgggtagtcgagctcgactcagacatggttgatatcactcaggagccagtgcttgatacaatgttggaggagtcaatgccagaggatcaagaacccgtgtcagcttccacccacatcgcttcctctctaggcattaaccctcacgtcctgcagattatgaaggcttctctcctaaccgatgaagaggacgtggacatggcattggatcagcgcttctcccggctgccctctaaagctgacactagccaggagatttgttcacctaggctgcccatctccgctagccactccagcaagaccaggagccttgtgggcggattgctgcagagcaaattcacgagcggagccttcttgagtccctccgtcagcgtgcaagagtgtaggacccctagagccgcatcactcatgaacatcccctctactagttcctggtcagtgcccccacccttgacctctgtatttaccatgccatccccggcacccgaggttcccctgaagactgtgggcactcgcagacagttagggctggtgcccagggagaaatctgtgacctacggcaaggggaagctcttgatggacatggcactgtttatgggacggtctttccgggtcggttggggccctaactggactctagccaatagcggtgaacagcttaacggctctcacgagctcgaaaatcatcaaattgcagacagcatggaatttgggttcctgcccaatccggtagccgtcaagccactgacggagagcccattcaaggtccatctcgagaagttgtcactgcgccaaaggaagccagatgaggatatgaaactgtaccaaactccattggagctgaagctgaagcacagcacagttcacgttgacgagctgtgcccactcatcgtgcccaacttaggcgtggccgtgatccatgactacgctgattgggtcaaggaagccagcggcgacctgccagaagcccagattgtgaaacattggagcctgacatggacgttatgtgaagccctgtgggggcaccttaaggaactcgacagtcaactcaatgagcctcgcgaatacatccagattttggagcggcgaagggccttctcgcgctggctgtcttgcaccgcgaccccacagattgaagaagaggtctcactgactcagaaaaactcacctgtggaggcagtgttctcctaccttaccggcaaacgaatttcagaagcctgtagtctagctcagcagtctggggaccatcggctggcccttctactctcgcagttcgtaggttcacagtcagtaagagagcttttgacaatgcagctcgtggactggcaccagctccaggctgatagttttattcaggacgagagactgaggatttttgctctcttggctggcaagcccgtgtggcagttaagtgaaaagaagcagataaacgtgtgtagccagctcgattggaaacgatcattagctatccacttgtggtacctcctgccacccacagcctccatcagcagggctctgtccatgtatgaggaagcattccaaaatacctcggacagcgaccgatatgcctgctctccccttccatcctaccttgagggttccggctgcgtgatcgcagaagagcagaattcccagacgcccctgcgggatgtttgttttcatctccttaagctttatagcgacagtattagagaaaaggcagttcgcgagctgctgacccgacattgtcagttgctggaaacaccagaatcctgggctaaagaaacgtttctcacccagaagctgcgcgttcccgcaaagtggatacatgaagccaaggctgtccgagcacatatggaaagcgacaaacacctcgaggcactctgcctattcaaggccgagcactggaaccgatgccataaactaatcattaggcatctggccagcgatgccatcatcaacgagaattacgattatctaaagggtttcctggaggatcttgctccaccagaacgatcttctctaatacaagattgggaaacatccggacttgtctatctcgattatattcgggtgattgagatgctaaggcacattcagcaggtggactgctctggaaacgacctggaacaattgcacattaaggtcacatctctgtgctctcgcattgagcagatccaatgctattccgctaaagacagacttgcccagtcagatatggctaagcgggtggcaaacctgctcagagttgttttgagccttcaccatcctccagatagaacctcagacagcacacctgacccacagcgggtacctctccggttactggccccacacattggccgactgccaatgcctgaggattatgctatggacgaattgagaagcctgacccaatcctatctcagagaactggctgtgggaagtttata

SEQ ID NO: 233365 - DNA, 4916 bp, Artificial Sequence
  Description of Artificial Sequence: Synthetic coding sequence
atgttcaacaagtccttcggcacaccatttggtgggggtaccggaggattcgggacgacctccacttttggacagaatactggcttcggaactactagcggcggagccttcggaacctctgcattcggcagcagtaacaatacaggagggttgttcgggaacagccagacgaagcctggcggtctgtttggaacaagcagctttagccagcctgcaacttctacctctacaggcttcggattcgggaccagcaccggcacagcgaatactcttttcggcacggctagcactgggaccagcctcttctcatctcagaacaatgcattcgcccagaataaaccgacgggattcggaaattttggcacttctacctcatctggcggactattcgggacaacaaacactacatctaatccattcgggtccacctccggctcacttttcggtccgtctagcttcacagccgcacctaccgggactaccattaaattcaacccaccaaccgggactgacaccatggtcaaagccggagtgtcaactaatataagcaccaagcaccagtgtataacagccatgaaggagtacgagagtaagagcctggaagaattacggttagaggattatcaggccaacagaaagggcccacagaatcaggtgggagccggaaccacaaccggcttatttggatcctctcctgcgacttcaagcgccaccggtctgttcagttcctctacaaccaattcaggatttgcttatggccagaataagacggcattcggcacatcaaccacaggctttggtacaaacccgggtggtttattcggtcaacaaaaccaacagaccacaagtctttttagtaagccctttggccaggccacgaccacgcagaatactggattttctttcggcaacactagcaccattggccagcctagcaccaatacaatgggactatttggcgtgacacaggccagccagcctggaggactattcggcacagctacaaacacatccaccggcaccgcattcggaaccgggactggcctgttcggccagacaaacaccggatttggtgctgtcggaagcaccctatttggcaacaacaaactgaccactttcggcagcagtactacgtcagcaccaagtttcggtactacctccgggggtctgtttggcttcggaacgaacacgagtgggaacagcatattcggtagtaagccagcaccaggaaccttgggaactgggctcggggctggttttggcaccgctctgggagctggacaggcttcactgtttggcaataaccagccaaaaataggcggaccactcgggacaggcgcattcggcgctccaggctttaacacgacaactgctaccctgggcttcggggcaccccaggcccctgtcgccctcaccgatcccaacgccagcgctgcacagcaagccgtactgcagcagcatatcaactcgttgacgtatagtccgtttggggattccccccttttccggaatcccatgtcggatcccaaaaagaaggaagagcgactgaaaccaacgaaccctgctgcacagaaggccctgacaacacccactcactacaagctaacaccaaggcctgccacccgtgtgaggcctaaggctttgcagaccacaggaactgccaaatcccatcttttcgacggactggacgacgacgagccaagccttgcaaatggagcatttatgccgaagaagtcaatcaagaaactcgtactgaagaacctgaataattccaatttattttctcccgtcaatagagactcagaaaatctggcatcaccttcagagtacccagaaaacggtgagcgtttttcttttctgtcaaagccagtggacgagaatcaccagcaggacggcgatgaggattcattagtttctcatttttatacaaaccccatcgcaaaaccaatcccacagactccagagagcgctgggaacaaacattctaacagcaatagcgtggacgacacaattgtcgcactcaatatgagagccgcactgcgaaatgggctcgagggatcttcagaggagacatccttccacgatgaaagtctccaagatgatagagaagagatcgaaaacaactcctaccatatgcatcctgcgggtatcatccttacaaaagtggggtactacacaataccctctatggacgaccttgcaaaaataaccaacgaaaaaggcgaatgtattgtatcagatttcactatcggtcgtaaaggctacggttcaatttacttcgagggagacgtcaacctcaccaatctaaacctggacgatatcgtgcacatcaggagaaaggaggtagtagtgtatctcgacgacaatcaaaagccgcctgtgggtgaggggttgaatcgcaaggctgaggtgactctggatggcgtgtggccgacggacaagacgagtcgttgccttatcaaaagcccggacagactggcggatatcaactatgaaggacggctcgaagctgtgtctcgtaaacagggtgcccaatttaaagagtatcgccctgaaacaggcagctgggtcttcaaggtcagtcacttctcgaagtacggactgcaagacagtgatgaggaggaagaagaacaccctagtaagacgagtaccaagaagcttaagaccgctccccttccccctgcgtcccagacaacgcctttgcagatggcactgaatggtaaaccagcccctccgcctcagtctcagagtccagaagtcgaacaacttgggagggtagtggaactcgattcagacatggtcgacattacacaggaacctgtcctggacactatgttggaggagtccatgccagaagaccaggaaccggtgtccgcttccacacacatagcctctagtctgggcatcaacccacacgtcttacagatcatgaaggcttctcttctgacagatgaggaagacgtagacatggctctagatcaaagatttagtaggctgccctccaaagctgacacatcgcaggaaatctgtagccctcgattgcccatttccgcatcccattcctcaaagactagaagtctggtaggcggactgctccaaagcaagttcacgtctggtgcctttctgtccccatcagtatcggtacaggagtgtaggaccccaagagcggcttcactgatgaatattcctagtacctccagctggagtgtccctccccctctgacttcagtgtttactatgccttctcccgcaccagaggttcctctgaaaactgtgggaacaagacgtcagttaggcttggtgccacgagagaaatcagtgacttacggtaagggaaagcttctgatggacatggcactgtttatgggaagatcctttagggtcggctgggggccaaactggaccttagcaaacagtggtgaacaactgaacggttcgcatgagttggagaaccaccagattgcggacagtatggagtttggattcctcccgaacccggtcgcagtcaaaccactcacagaatcgccatttaaagtgcacttggagaagctgtctctgagacagagaaagcctgatgaagatatgaaactttatcaaaccccactcgaactcaagttgaagcacagcactgtgcacgtggacgagctgtgccccctgatcgtgcctaatttgggcgtcgcagtcatacacgattacgccgactgggtcaaggaagcttccggggatctcccagaagctcagattgtcaaacactggtcactaacctggaccctctgtgaagcactgtggggtcacttgaaagaacttgattcccaactgaatgaaccacgcgagtacatccagatactggaaagacggagggctttttcccgctggctgtcatgtaccgcaaccccccaaatagaggaagaggtatccttgactcagaaaaatagtccagttgaagccgtgttttcatatctgacaggcaagcgcatcagtgaagcttgctctcttgctcagcaatcgggcgatcatcgactcgctctcttgctgagtcagttcgttggatctcagtcggtgcgtgagctcctgactatgcagctggttgactggcatcagctgcaggcagatagcttcatccaggatgagagactgcgaatctttgctctgctggccggtaagccagtctggcagctgtccgagaagaagcagataaatgtctgcagccaactcgattggaagagaagcttggctattcacttatggtaccttttgcccccaactgcatctatctcaagagccctttccatgtatgaagaggcatttcaaaatacctcggattcagaccggtatgcctgcagtccattgccatcttacctggaagggagtggatgtgtcatcgcagaagagcagaacagccaaacgccactgcgggacgtatgcttccacctcctcaagctctacagtgacagcattagagagaaagccgtgagggagctgttgacacgacactgtcagttgttagagacacccgagtcctgggcgaaggaaacattcctgactcagaagttgagagtgccagccaagtggatccacgaagcaaaggcagtgcgggcacacatggaaagtgacaagcatctcgaagctctgtgcctgtttaaggccgagcactggaacagatgccataagctcattattagacacctggcttccgacgccatcatcaatgagaactatgattacctgaagggtttcctcgaggacctggcacccccagagagatcaagtttgatccaggattgggagaccagcggcttggtttacttagattatattcgggtcattgagatgctcaggcacatccagcaaatagctttgttttgcgtggagtggattgctcaggtgatgacttggagttcatacacatcaaagta

SEQ ID NO: 233366 - DNA, 2763 bp, Artificial Sequence
  Description of Artificial Sequence: Synthetic coding sequence
atgtttaataaatctttcggcacaccattcggtggcggaactggaggctttggaaccacgagcacgttcggacagaacactggctttggaaccacgtctggcggagccttcggtaccagcgccttcggtagcagcaataatactggtggcctgttcggcaactctcagactaaaccagggggactgtttgggacaagttcgtttagccagccagccaccagcacttctactggcttcggatttggtactagcacagggaccgctaacaccctcttcggcaccgctagcactgggaccagcttgttttcttcacagaacaacgcgttcgcacagaataagcctaccggctttggaaacttcggcacatctacatcctcaggagggttgtttggaaccacaaacactactagtaacccgttcggttctacaagcggatctcttttcggcccatcgtcattcaccgctgctcctacaggcacgactattaaattcaacccacctacagggaccgacaccatggtcaaggcaggagtttcgacaaacatcagcacaaagcaccagtgcatcactgccatgaaagagtacgagagtaaatctttggaggaactgagactggaggactaccaagcgaatcgtaagggccctcagaatcaagtgggtgccggtactacaaccgggcttttcggatcatcacccgctacatcaagtgcgactggcctgttctccagctccacaacaaactccggctttgcctatgggcagaacaaaaccgctttcgggacttctaccacaggcttcggtacaaaccccggagggttgttcgggcagcaaaaccaacaaactaccagtttgttttcaaagccttttggccaagccaccacgacgcagaacaccggatttagtttcgggaatacatctaccattggtcagccatcgacaaacaccatgggcctgttcggggtgacacaggcatcccagccagggggactctttgggaccgctactaatacatcaacgggtacagcctttggcacagggactggcctcttcggacagacaaatactggatttggagccgttggtagcacactgttcgggaacaacaagttaacaacattcggaagcagtactacaagcgctccatcctttggtaccacaagtggaggcctgtttggcttcggcacaaatactagcggtaacagtatctttggatcaaagcctgcacccggtaccctgggcacgggactaggagcagggtttggaacagctttaggtgcagggcaggcctctttgtttggcaataatcagccaaagattggcggtcctttgggcacgggcgctttcggggctccgggatttaatacgactactgcgacccttggatttggagctccacaagccccagtcgccctgaccgatcctaacgcgagcgctgcccagcaagctgtgctgcagcagcatatcaattcgctaacatacagcccttttggggatagtccactgttcaggaacccgatgtctgaccccaagaaaaaagaggagagactgaaacccaccaatccagctgcccagaaagccctaacaactccaactcactataagctgacgcccagaccagccacgagagtaaggccaaaggccctccagaccacaggcactgctaaatcccacctgtttgacggactggacgatgatgagcctagcctcgccaacggcgcattcatgccaaagaaatccatcaagaaactcgtcctgaaaaacctgaacaactccaacctcttcagcccagtgaaccgggacagcgagaatttggcctctccctcagagtaccccgaaaatggagagcgattttccttcctgagcaaacctgtggatgagaaccatcaacaggatggggacgaagatagcttggtgtcccatttctatacaaaccctatcgcgaagcctatcccgcagacaccagagagcgcgggtaataaacattccaattctaattcagtggatgatactatcgtcgcactcaatatgcgagcagcactccgaaacggtctagaagggtcttcagaggagactagtttccatgacgaatccctccaggatgaccgtgaggagatagagaacaattcgtaccacatgcatcccgctggcattatcctgactaaggtgggctactatacaattcccagtatggacgacctcgccaagattaccaatgagaagggtgagtgtattgtttccgatttcaccatcggtcggaaagggtatggctccatctactttgagggggacgtgaatctgaccaacctgaacctggacgatattgtgcacattcggcgaaaggaggtagtggtctatcttgatgacaatcagaagccacccgtgggggagggactcaataggaaggctgaggtcacactcgatggtgtgtggccaacagacaaaaccagccgctgtcttatcaaaagcccagatagattagcggacatcaactacgagggaaggctagaggccgtgtccagaaagcagggagcgcagtttaaggagtatagacccgaaactgggtcatgggtcttcaaggtctctcattttagcaagtatggcctgcaggacagcgatgaggaagaagaggagcacccttctaagacatcaaccaagaaactgaaaaccgccccactccccccagcctctcagactacccccctgcaaatggccctcaatggtaagcccgctcctccgccacaggtggagaagaagggacagtag

SEQ ID NO: 233367 - DNA, 2814 bp, Artificial Sequence
  Description of Artificial Sequence: Synthetic coding sequence
atgttcaacaaatcctttggaacaccattcggaggcggtactggcggtttcgggacaacatcaaccttcgggcagaacaccggttttggcacgacttctggaggggctttcggaacctctgcattcggatcatcaaacaacacaggcggtctcttcggcaacagtcagactaagcccggagggctcttcggcacatcatcctttagtcaaccggctacctcaacctccactggtttcggcttcggaacgagtaccggcaccgctaacacacttttcgggaccgcatctacaggcacatccctgttctccagtcaaaataacgcctttgcccagaataagcctacagggttcggcaacttcggaacctccaccagcagcggcggactgtttggaactacgaacacgacctccaatcccttcggctccacttcaggcagcctttttggaccttccagcttcaccgccgcacctaccgggaccactatcaagttcaaccctcctaccggaactgacacaatggtgaaagccggtgtgtcgaccaatataagtacaaagcatcagtgcattaccgcaatgaaggaatacgaaagtaagtccctggaggaactgcgcctggaggactaccaggccaaccggaaagggccacagaaccaggttggcgcagggacaaccactgggctcttcgggtcttcccccgcaacatccagcgccaccgggttgttctctagctcaacgaccaattctgggttcgcatacggtcagaataaaacagcctttggaacatccaccactggatttgggaccaacccagggggactgttcggccaacagaaccagcagacgacttccctgttttcaaagcccttcggacaggccaccacgacccagaataccggctttagcttcggcaatacatccactattgggcagccttcaaccaacacaatggggctgttcggggtgacccaggccagccaacccggaggactgtttgggaccgccacgaacacctcaactgggactgctttcgggacaggaaccgggttgttcggccagaccaatacaggatttggggctgttggctcaaccctcttcggaaataataaacttaccaccttcggcagttcaaccacttctgccccttcctttgggacaactagcggcggtcttttcggaaataaaccgacgcttaccctcggcactaacactaacacaagtaacttcggttttgggacaaatacgtccggaaacagcatttttgggagcaagcccgcaccaggaactttagggacaggacttggggcaggctttggcacagctctgggagcaggccaagccagtctgttcggtaataatcagcccaaaatcggaggaccactcggaaccggcgcttttggcgctcctgggtttaatacaactacggccaccctggggtttggggcaccgcaggcaccagtggccctgaccgatccaaatgcatccgcggctcagcaggccgtgttacagcagcatattaattccctgacatactccccctttggtgattcacctctcttcagaaatcccatgtccgaccctaagaagaaagaagagaggcttaagcctacaaaccccgcagcccaaaaagctttgactacaccaacccactacaaactcacccccaggccggctactcgggtacggcctaaggcactgcagacaacaggaacagccaaaagccacctgtttgacggcttggacgatgatgagccaagcctggctaatggtgccttcatgccaaagaagagcatcaaaaaacttgtgctgaagaatcttaataactctaatctcttttctcctgtgaatagagattcagagaacctggcttcacccagcgagtatcccgaaaacggcgagagatttagctttctttccaaacctgttgatgaaaatcatcagcaggacggtgatgaggattcactggtatcgcatttctataccaatccaattgctaaacccattccccagaccccagaatctgcgggaaacaaacattcaaactcgaactccgtggacgatacgatagttgctctgaatatgcgcgctgcattgcgcaacggtctggaaggatcatccgaggagacaagcttccatgatgaatcattgcaggatgatcgggaggagatagagaataattcctaccatatgcatccggcagggattattctcacaaaagtgggttactacaccataccgtctatggatgatcttgccaagatcacgaacgaaaagggggaatgcattgtgtcggactttacgatcggacgtaaaggctacgggtctatctacttcgagggcgacgtgaatctgacaaatctcaatttggatgatatcgtgcatatacgcagaaaagaagtcgtcgtatatctggatgacaatcagaaaccgccagttggggaaggcctgaacagaaaggccgaggtgaccctggacggagtgtggcctacagataagactagtcgctgtctcatcaagtcacctgaccgtctagccgacattaactatgagggcaggctggaagctgtgtctaggaagcaaggggctcaatttaaggaatacagacccgaaacaggcagctgggttttcaaagtctcccacttttcgaaatatggactccaggactccgacgaggaggaagaagagcaccccagcaagaccagcactaaaaaactgaagaccgccccactccccccagcgtcccaaactacacctctgcaaatggccttgaatgggaagcctgccccacccccacaggtggagaaaaaaggccagtag

SEQ ID NO: 233368 - DNA, 1731 bp, Artificial Sequence
  Description of Artificial Sequence: Synthetic coding sequence
atgtccacagggttttctttcgggaccggggctagtagcaacccaagcgttggcttgaattttggaaatctgggctctacctcgacacccgcaaccacatcagccccatcttctggtttcgggaccggtctcttcggctctaagcctgctactggcttcaccttggggggaaccaataccggaatcgcaacgaccatcacaacagggctgactctgggaacgccagcgaccaccagtgccgctacgaccgggttctcgttgggcttcaataagcctgccgcaagcgccacaccatttgcattgcccataacgagtacatcagcatccggactgactctatcctctgcgctgacctcgacgcctgcagccagcaccgggtttactctgaacaacttaggagggacaaccgctaccacaactaccgcgtcaacaggtttgtctctgggcggagccctcgctggcctcgggggatccctgtttcaaagtaccaacactggcacctctggcctcggacagaacgctctcggcttaactctcgggaccaccgccgctacaagcacagcagggaatgaagggctcggcggaatcgatttttcctcgagttcagataagaagtctgataagacaggcacccggcctgaagacagtaaagcacttaaggacgaaaacctgccacctgtcatttgtcaagacgttgagaacttgcagaagttcgtgaaggagcagaagcaggtccaggaggagatctcgcgcatgagctccaaagccatgctgaaggtccaagaagacataaaggccctcaagcagctgctgagcctggccgcaaatgggatccagagaaatacattaaacatcgataagttgaaaatagagacagctcaggagctgaagaacgcggaaattgcgctccggacgcaaaaaacaccaccaggcctgcagcatgagtacgccgcacctgccgactattttagaatccttgtccaacagttcgaggtccaactgcaacaatatcggcagcagattgaggagcttgaaaaccacctagccacccaagccaataattcccacatcaccccacaggacctgagtatggccatgcagaaaatctaccaaaccttcgtcgccctggctgcccagctgcaatccattcacgagaatgtcaaagtgttgaaggaacagtacctagggtaccggaagatgtttcttggcgacgctgtggatgtgtttgagacacgcagggccgaggccaaaaaatggcagaacactcccagagtgacgaccgggcctacgccgttttctaccatgccaaacgcagcagccgtggcgatggctgccaccctgacccagcagcagcagcccgcaacaggaccccagccctccctgggcgtctctttcggtacaccattcggcagcggaatagggaccggactgcaatctagcgggctgggcagctctaatttggggggtttcggaacttctagcgggttcggatgttctactaccggcgcatctactttcgggttcggcacgaccaacaaacctagcggctctctgtcagcagggtttggatcctcctccacctcaggattcaacttctccaaccccggaattacagcttcagcaggcctgacattcggggtctccaatcccgcttccgcaggctttggcaccgggggacagctactgcagttaaagaagcctccggcagggaataaaagaggcaagcgctag

SEQ ID NO: 233369 - DNA, 1764 bp, Artificial Sequence
  Description of Artificial Sequence: Synthetic coding sequence
atgagtacaggcttttctttcggttccggcactctgggaagcaccacggttgctgcagggggtacctccacaggcggagtattctcatttgggactggtgcctccagcaatccctccgtaggcctgaattttgggaatttaggcagtacctctacccctgcaaccacctcagcacccagcagcggctttggtactgggctgtttggatctaagccggcaacaggctttaccttggggggtaccaacaccggtactccggctacaaccagcgctgcaacaacagggttctcccttggttttaacaagcctgctgcctcggctactccctttgcactcccaatcaccagcacaagcgccagtggtctgacattgagttccgctctcacttccaccccagcagctagtacaggcttcactctcaacaacttggggggaaccacggccaccaccacaacggctagcaccggtctcagcctggggggagcgctggcaggtctcgggggtagccttttccagagcactaataccggcaccagtggtctgggtcaaaacgcccttgggcttaccctgggcaccaccgccgctacatcaacggccggtaacgaaggactcggaggaattgactttagtagttcatcagataaaaaatccgacaaaaccgggacccggccagaggactccaaggccttgaaagacgagaatctgccacctgtgatttgtcaggacgtggagaatctgcagaaattcgtgaaagagcaaaagcaagtgcaggaggagataagtagaatgtcatcgaaggccatgctgaaggtgcaagaagacatcaaagccctgaaacagttgctgagcctggctgccaacggcatccagcgaaatacactaaatatcgacaagctcaagattgagactgctcaggaactcaaaaacgcagagatcgcactcaggacccagaaaacacccccaggtctgcaacatgagtacgctgctcctgccgactacttccggattctggttcagcagttcgaagttcagttgcagcaatacagacagcagatcgaagagctggagaaccacctggctacacaggctaacaattcccacatcaccccccaggatttatccatggctatgcagaaaatttaccagactttcgtggccctggccgctcagttacaaagcatccatgaaaatgttaaggtcttaaaggagcagtacttgggatatagaaaaatgttcctgggcgacgccgtggacgtttttgaaacacgacgtgcggaggcgaagaagtggcagaacacaccaagagtcacaacagggcctactcccttcagcactatgcctaacgcagccgcagtggctatggcagctaccctgacccagcagcagcagcctgcaacgggacctcaaccatcactgggagttagtttcggcacacccttcgggagtggtattggcactggcctgcagtccagtggtctcggatcctccaatctggggggattcggtacatcctctggtttcggctgctccactactggcgctagcacatttggatttggtacgactaataaaccatcaggaagcctcagtgctggtttcgggtcctcgagtacatctggatttaatttttctaatcccggaatcacagcttctgccggtctcactttcggtgtcagcaatcctgctagtgcaggctttgggaccgggggacagctgctgcagcttaaaaaacctccagccggtaataagcgaggcaagcgctag

SEQ ID NO: 233370 - DNA, 1800 bp, Artificial Sequence
  Description of Artificial Sequence: Synthetic coding sequence
atgagcaccggcttctcgttcggctccggcaccctgggctctacaaccgtggccgcaggtgggactagcaccggcggtgtctttagtttcggcaccggtgcgtcctcaaatccatcagtcggcctgaatttcggtaatctgggctccacttcaacccctgccaccacaagcgcgccatctagtgggttcgggacagggctgttcgggtccaagcccgctaccggcttcaccctgggcggtactaacactggtatcgccacaacgatcacaacggggcttacccttggcaccccagccacaacatcggccgctacaactgggttcagcctgggcttcaacaaacccgcagctagcgcaaccccttttgcgctgccaataactagcacaagcgcttcggggctgaccttgtcaagtgctctgacatcaactccagccgcttccactggattcaccttgaataatctcggcggaacaacagccactaccacaacggcctctaccggcctatctctaggcggagcactcgccggactggggggaagcctgttccaatctactaataccggcacaagtggactaggacagaacgctttaggtctcactctcggcaccaccgccgctacttccacagctgggaatgagggcttgggcggtattgatttcagctctagctcggataagaagtcagacaagaccggcacgcggccagaagattctaaagcgctcaaagatgagaatctccctcccgttatctgtcaggacgtggaaaacctgcagaaatttgtgaaggaacagaaacaagtgcaagaggagattagtaggatgtcaagtaaggcgatgcttaaagtgcaggaagatataaaggccttgaaacaactgctgtccctcgcggctaatggtattcaaaggaacactcttaatatcgataaactgaagatcgaaactgcacaagagttaaaaaacgccgaaatcgctcttcggacgcaaaaaacacccccagggctccaacacgaatacgccgcacctgccgattattttcggatcctcgtgcaacagtttgaggtccagcttcaacagtacaggcagcaaattgaggagctggagaatcatctcgcaacccaggcgaataattcacacataaccccccaggacctgtctatggcgatgcaaaagatttaccagacattcgtcgccctagccgctcagctgcagagtattcacgagaatgtgaaggtgttaaaggagcagtaccttgggtaccgaaagatgtttcttggggatgcggtagacgttttcgagacgcgtcgggctgaagctaaaaaatggcagaacacgcccagagtaactaccggacctacacccttctctactatgccgaatgcggcagccgtagccatggctgccacactcacgcaacagcagcagcccgctacaggaccacagccgagtctgggcgtcagttttggaacccccttcggctccggcatcgggacaggtctgcagtccagcggattaggaagttctaatttgggaggcttcggaaccagcagcggattcggatgctcaactacaggcgcttccacatttggattcggaactaccaataaaccttctggttcactttcagccggtttcggctcctcctctacctctggttttaacttcagcaatcccggaattacagcgagcgctggtctcaccttcggagtgtcaaatccagcttccgctggatttggaacaggtggtcagcttctacagcttaagaaacccccagccggtaacaaacgcggaaagcggtag

SEQ ID NO: 233371 - DNA, 1515 bp, Artificial Sequence
  Description of Artificial Sequence: Synthetic coding sequence
atgtcaaccgggttctctttcggctcggggactttaggaagcacaactgtcgctgccggaggcaccagcaccggcggagttttcagttttggcacaggcgcatcaagcaatcccagcgtgggcctgaatttcggcaacctggggagtacctcaacccctgccaccacgagtgctccaagcagcggatttggcaccgggctgttcggttcgaagcccgctacaggctttacactggggggaactaacaccgggacaccggctacaacatcagccgcaaccactggtttttcactaggattcaataaaccagcagcgtcggccacccctttcgcactgcctattacaagcacaagcgcctctggtttaacactgagttccgcccttacatccaccccagctgcttccactggctttaccctgaataaccttgggggaactactgcaaccactaccactgcgtctaccggccttagccttggcggtgctctagcgggattagggggatctctcttccaaagcacaaacaccggcacctcgggcctcgggcagaatgcattgggtctgaccctgggcaccactgctgccaccagcaccgcagggaatgagggtctgggtggtatcgatttttctagtagcagcgacaaaaagtctgacaagacaggcacaaggcccgaggactccaaagccctgaaggacgaaaacctcccacctgtcatctgccaggacgtggagaacctgcagaagttcgttaaagagcagaagcaggtgcaggaggaaataagtaggatgtcaagcaaagcgatgcttaaggtccaagaggacatcaaggctttgaaacaactgctgagcctagctgctaatgggattcagcgcaataccctgaatatagacaaactgaagatcgagacagcccaggagctgaagaacgccgagatcgccctgcgaacacaaaagactccccctggcttgcaacacgaatacgctgcaccagctgactatttccgcattctggtacaacagttcgaagtgcagctgcagcagtaccggcaacagattgaagagctcgaaaaccatttggccacacaggccaataacagccacatcactcctcaggacctatctatggccatgcaaaaaatttatcagacattcgtggcccttgcagcccaattgcagagtattcatgagaatgtgaaagtgctgaaagaacagtacctgggatataggaaaatgtttctcggggacgccgtggatgtcttcgagacacgacgcgcagaagccaaaaagtggcagaacactcctcgagtgacgacaggtcccaccccattttccacaatgcccaacgccgctgcagtggctatggcagccacactaacacagcaacagcagcctgcaaccggggacaagtggtgtaacgtggccgaacttaagaatcgcactcagctgtcactttttgtgaataagttggaactctcctgttactgcgtcattgatctgttatacaacgaacaatag

SEQ ID NO: 233372 - DNA, 1458 bp, Artificial Sequence
  Description of Artificial Sequence: Synthetic coding sequence
atgtctacgggtttctcattcggctcaggtacacttggaagcaccactgtggctgctgggggaacttccacgggcggtgtcttctcatttggcactggggctagttccaacccaagtgtaggactaaacttcggcaatctcggttccaccagcacgcccgcaaccacgagtgctccaagctcagggtttggcacgggattatttggctccaagccagctaccggttttactcttgggggaaccaatacaggcattgccacaactatcacaacaggcctgactctaggcactcctgcaactacttcggcagccactactggcttctccctgggtttcaataaacctgcagcatcagctactccttttgccttgccaatcaccagtacttccgccagcggacttaccctctccagcgccctgactagcacccccgcagctagcacaggcttcactctgaataatctgggagggacaaccgctactactaccacggcctccaccgggctgtcgctggggggtgccctggccggtttgggcggttcgctttttcaatctacaaataccggcacttccggtctgggccaaaacgcgctgggcctgaccctaggcactactgccgcaacctccacggcgggaaatgaagggctggggggaattgatttcagttcttcctcggacaagaagtccgataagactggcacccggcctgaggactcaaaggccctaaaggatgaaaacttacccccagtgatatgccaggatgttgagaatctgcagaaattcgtgaaggagcagaaacaagtacaggaggaaatctcgcgaatgagcagtaaagccatgctgaaagtgcaggaagacatcaaagcgttgaaacagctgctgtctttggccgctaacggcatacagcgcaacactctgaacatcgacaaactcaaaattgagacagcacaggaattgaagaacgcagagatagctctgcgcacccagaagaccccgcctggcctccaacacgagtacgccgctcccgctgactactttcggatcctcgtacagcagttcgaggtgcaacttcagcagtatcggcagcagatcgaagaacttgagaatcacctcgcaactcaggccaataacagccacattaccccacaggacctgtctatggcaatgcaaaaaatataccagaccttcgtcgccctggccgctcaactgcaatctatacacgagaacgtgaaagtccttaaagaacagtaccttggatatcggaagatgttcctcggagacgctgttgacgtgttcgaaactagacgggcagaggctaagaaatggcagaacaccccgcgtgtgaccacagggcctactcctttctctacaatgcctaacgcggcagcagtggcaatggcagccaccctcacccagcagcagcagcctgccacaggcctgaacgccttcaaactgtag

SEQ ID NO: 233373 - DNA, 1308 bp, Artificial Sequence
  Description of Artificial Sequence: Synthetic coding sequence
atgagcggattcctggaagaactactcggtgagaagctcgtgacaggtggaggcgaagaggtagatgtccactctctgggtgctcgtgggatctctctgttagggctttactttgggtgctccctgtctgccccatgtgcgcagttgagcgcgtctctggccgctttttatggtcgtttacgcggagatgcagccgctggaccaggccctggcgcaggcgctggcgctgcagccgagccagaaccacgtcgacgtctcgagatcgtttttgtgtcgtccgaccaagatcagagacagtggcaggatttcgttcgggatatgccttggttagccctgccatacaaggagaaacacagaaagcttaagctgtggaacaagtacaggatatccaatatcccatccctgatttttctcgatgctaccacaggaaaagtagtgtgccgtaatgggcttttagtcatcagagacgaccccgaaggattagagtttccatggggccctaagccttttagggaggtgatcgcaggtccccttttgcggaacaatggccagtctctggagagttcaagtctcgagggaagtcacgtcggggtgtatttctccgcacactggtgtcctccctgcagaagccttacgagggtgctggtggagagctatcggaaaattaaagaggccggacagaattttgagatcatttttgtgtcagcagatcgcagcgaagaatcgtttaagcagtatttttctgagatgccgtggctagccgtgccctatactgacgaagccaggaggagcagactgaaccgtctttatgggatccaaggcattccgacactgatcatgctcgatcctcagggagaagtcattaccagacagggacgcgtcgaggtactgaatgatgaggattgtcgagagtttccatggcaccctaagccagttctggaactttccgatagtaacgccgcacagctgaatgaagggccttgtttagtgcttttcgtggactcagaggatgatggcgagtctgaggctgctaagcagttaatccaacccattgccgagaagataattgccaagtacaaagctaaggaagaagaagctcccctgctgtttttcgttgcaggcgaggatgacatgaccgattctctgagagattatactaacctcccggaagcagcccctctcttgaccattctagacatgtcagcacgagccaaatatgtcatggacgtcgaagagatcactccagcgatcgtcgaagcttttgtgaatgacttcctggccgagaaacttaaacccgaacctatttag

SEQ ID NO: 233374 - DNA, 984 bp, Artificial Sequence
  Description of Artificial Sequence: Synthetic coding sequence
atggccgacgtatcactccacagaaacccggctacacttaagctatggaacaagtacaggatttcaaacatcccgagccttatatttctggacgccaccacagggaaggttgtctgccgcaacggtcttctggtaattcgggacgatccagagggcctcgaattcccgtgggggcctaaacccttccgggaggtgatagccggacccctgctaaggaataacgggcagagtctagaatcatctagtctcgaaggtagtcatgtgggagtgtatttctctgcccattggtgccccccatgtcggagccttacgcgcgttttggttgaatcttaccggaaaatcaaagaagccggtcaaaatttcgagatcatctttgtgtcagccgatcggtcagaagagtcgtttaaacaatacttctctgaaatgccttggcttgcggtgccatataccgacgaggctagacgcagccggctgaacaggttatacggcatccaaggtatcccaactctgataatgttggacccacaaggcgaagtaataactcgacaaggaagagttgaggtgttgaatgacgaggactgcagggagttcccctggcatccgaagcctgtactcgagctttcggattctaacgccgctcagttaaacgaagggccatgcctggtacttttcgttgattccgaggacgatggggaaagtgaggccgcaaagcagctgatccaacccatcgccgagaagattattgccaagtacaaagccaaagaggaggaggcaccactgctgttcttcgtggccggagaggatgacatgaccgattctctgagggactatactaatctccccgaagccgcacccctgctgactatcttggatatgtcagcacgggctaagtatgtcatggacgtcgaagagattaccccggcaatagtggaggcattcgtcaacgatttcctggcagagaaactgaagcccgaaccgatttag

SEQ ID NO: 233375 - DNA, 381 bp, Artificial Sequence
  Description of Artificial Sequence: Synthetic coding sequence
atgccctggctagcggttccgtacacggacgaagcgaggcgatccagattaaatcgtctgtatggaattcaggacagtgaagatgacggtgaaagtgaagccgcaaagcagctgatccagcctatcgccgagaaaattattgccaaatacaaagcaaaggaggaagaagccccactgctgttctttgtggccggtgaagacgacatgacagacagtttgcgagattatactaacctcccagaggctgcccctctgcttaccattttagacatgtccgctcgggctaagtacgttatggacgtcgaggagatcactcccgctatagtggaagcgttcgtcaatgacttccttgcggagaagctcaaacccgagccaatttag

SEQ ID NO: 233376 - DNA, 984 bp, Artificial Sequence
  Description of Artificial Sequence: Synthetic coding sequence
atggccgacgtgagcttgcacaggaatccagcgacactgaagctttggaacaagtaccgcatctccaatattccttctctgattttcctggacgcaaccactggaaaggtggtgtgcagaaacggcctccttgtgatcagagacgatccagagggtcttgagttcccatggggaccgaaaccatttagagaggtgattgccggacccctcctgcggaataatgggcagagtctggagtcttccagcctggaaggttcccatgtgggggtatacttctccgcccactggtgcccgccttgcaggtctctcaccagggtcctcgtcgaatcttaccgcaaaatcaaggaggctggacagaactttgaaatcatcttcgtttccgccgacaggtctgaggaaagctttaagcagtactttagtgagatgccttggctggcggtgccttacaccgacgaggcacgccgatcccgactgaatcgtctctatgggatccaaggtattcccacacttattatgctcgatccccagggggaggttatcacacgccaggggagagtggaggttttaaacgacgaggactgcagagaatttccatggcaccccaaacccgtgctggagctgtccgattccaacgcagcgcagctaaacgaagggccatgcctggtgttgtttgtggactccgaagatgatggcgaaagtgaggccgctaagcaactcatacagccaattgcggagaaaataatcgcaaagtataaggcaaaagaagaggaagcacccttgctattttttgttgctggcgaggacgatatgaccgacagcttacgcgattacaccaacctcccagaagcagcaccactgcttacaatcctggatatgtcagccagggccaaatatgttatggatgtggaggagattacgccggctattgttgaggcctttgtgaacgattttctagccgagaagctgaaacctgagcccatctag

SEQ ID NO: 233377 - DNA, 1176 bp, Artificial Sequence
  Description of Artificial Sequence: Synthetic coding sequence
atggccgacattgataacaaggaacagagcgaactggaccaggacttagacgacgtcgaggaagttgaagaggaagagactggcgaggagacaaaattaaaggctcgccagctgaccgtacagatgatgcagaatccacagattctcgcagccctgcaggagagattagacggattagtggagacgccaacaggatatatagagagtttgcctcgggtggttaaaagaagagtgaacgctcttaagaacctccaagttaagtgtgctcagatcgaagccaaattctacgaggaagtgcacgatctggaaagaaagtatgcagtcctgtaccaaccactcttcgacaagcggttcgaaattatcaacgctatctatgagcccactgaagaggaatgcgagtggaagcccgacgaagaagacgagattagtgaagaacttaaggagaaagctaaaatcgaggacgaaaaaaaggacgaagaaaaagaggaccctaagggcattcccgagttctggctaacagtgttcaagaacgttgacttgttgagcgatatggtccaagagcacgacgagcctatcttgaaacacctcaaagatatcaaagtgaaattttccgatgccggtcaaccaatgagttttgtgttagagtttcacttcgaaccaaacgagtatttcaccaatgaagtactgacaaagacatacagaatgaggtcagagccagatgactcagatccgtttagctttgacggccctgagattatgggctgcacaggttgccagatagattggaaaaaaggaaagaatgtgactctgaagacgattaagaagaagcagaaacacaaggggagaggtactgtgcggaccgttacaaaaacagtgagcaatgattcattcttcaatttcttcgcccctcctgaggtccctgaaagcggcgatcttgacgacgatgctgaagcgattttggccgcagactttgagatcgggcacttcctccgcgagcgcatcatacccagatccgttctctatttcacgggggaggcgattgaggatgacgacgacgattacgatgaagaaggcgaagaagcagacgaggagggtgaggaagagggggacgaagaaaatgatcctgactacgacccaaaaaaagaccagaacccagcggagtgcaaacagcaatag

SEQ ID NO: 233378 - DNA, 1176 bp, Artificial Sequence
  Description of Artificial Sequence: Synthetic coding sequence
atggccgatattgataataaagagcaatctgaattggatcaggacctggatgatgtggaagaagtcgaggaggaagaaacaggcgaggagacaaagctcaaagctcgccagttaactgtgcagatgatgcaaaatccccagatcctggctgctctgcaggagcgccttgacggcctggtcgaaacgcccaccggatacattgagagccttccgcgtgtggtgaaaaggcgggtcaatgcattgaagaacctgcaggtgaagtgtgctcagatagaggcgaaattctatgaggaagtccacgatctcgagcgaaagtacgcggtgttataccagcccctcttcgataaacggtttgaaattattaacgctatttacgagcctaccgaggaagaatgcgagtggaaacctgatgaggaggatgagatttctgaggagcttaaggaaaaagctaagatcgaggacgagaagaaagatgaggaaaaagaagaccccaagggtattcccgaattctggctgacagttttcaaaaatgtggatttactgagtgacatggttcaggaacacgacgaacccattctgaaacacctcaaagacatcaaggtgaagttctcagatgctgggcaacctatgagcttcgtactggagtttcacttcgagcccaacgagtacttcaccaacgaagttctcactaaaacctatcggatgcgaagtgagccggatgactcagatccttttagtttcgacggcccagaaattatgggctgtaccggatgccagatcgactggaaaaaaggtaaaaatgtcacactgaagactattaagaagaaacagaaacataaggggcgtggtactgttagaaccgttactaagacagtgtcaaacgacagcttcttcaatttcttcgccccacccgaggtgccagagtctggcgacctcgacgatgacgcagaggctatcttggccgcagactttgaaattggacatttccttagagaaaggattattcccaggtccgtgctttacttcaccggggaagccattgaggacgatgacgatgactacgacgaagaaggcgaagaagcagacgaggaaggcgaggaggagggagacgaggagaacgaccctgattacgaccctaagaaggaccaaaatcccgcagagtgtaaacagcagtag

SEQ ID NO: 233379 - DNA, 972 bp, Artificial Sequence
  Description of Artificial Sequence: Synthetic coding sequence
atgatgcagaacccacagattctggctgctttacaagagcggctggacggcttggtagaaactccgacgggatatatagagtcccttccacgagttgtgaagaggcgtgttaacgcacttaaaaatctacaggtaaaatgcgcccaaattgaggcaaaattctatgaggaagtgcatgatctcgaaagaaaatacgccgtcctctaccagcccctgttcgataaggaagagttgaaggaaaaggccaagattgaggacgagaagaaggacgaggagaaagaggaccccaagggcatcccagagttctggcttaccgttttcaaaaatgttgatctcctctctgacatggttcaggaacacgacgaacccatactgaaacacctgaaagatattaaagtgaagttttcagatgctggacagccaatgtcgtttgtgctggagttccattttgaacccaatgaatactttactaatgaggtcttgaccaaaacctaccgtatgagatccgagccagacgactcagaccctttctctttcgacgggccagagattatgggctgcaccggctgtcaaatcgattggaaaaaaggaaaaaatgtcacactcaagactattaagaaaaagcagaaacataagggtaggggtactgtacgcacagtgactaagacagtgtcaaatgactccttttttaactttttcgcacctccggaggtgcccgagagcggggaccttgacgatgacgccgaagcaatcctggctgccgattttgaaataggacattttctacgggagcgcatcatcccacgctccgtgttgtacttcaccggggaggctatcgaggacgacgatgatgactatgacgaggagggcgaagaagccgacgaagagggagaggaggaaggcgacgaggagaacgaccccgactatgacccaaagaaggaccagaatcctgcagaatgtaagcagcagtag

SEQ ID NO: 233380 - DNA, 1050 bp, Artificial Sequence
  Description of Artificial Sequence: Synthetic coding sequence
atgatgcagaatccccagatactggctgctctgcaggagaggctggatgggctggtggaaacacctaccggatacatcgagagtctccccagagttgtgaaaagacgggtaaacgcgctgaaaaaccttcaggtcaagtgtgctcagatcgaggccaaattttacgaagaggtacatgatttagagaggaaatacgccgttctgtaccagcctttgtttgacaagcgcttcgagatcataaatgccatctatgaacctacggaagaggagtgcgagtggaagccagatgaggaggatgaaatctccgagttgaaagagaaggctaaaattgaggacgaaaaaaaggacgaggagaaggaggatcccaaaggaataccagagttctggctaactgtgttcaagaatgtggacttactgtcggacatggttcaagagcacgacgaaccaatcctgaaacatctgaaggatattaaggtgaagttttccgatgctgggcagccaatgtcttttgtgttggagtttcacttcgagcccaacgaatactttactaacgaagtgttgaccaaaacctacaggatgagatctgaaccagacgacagtgatccctttagcttcgatgggcctgagattatggggtgtacagggtgtcagatcgactggaagaaaggtaaaaacgtcaccttaaagacaatcaaaaaaaaacaaaaacacaagggccgtggaacagttcgtacagtgacaaaaactgtctccaacgatagttttttcaatttctttgcaccacccgaagtcccggagagtggagatctagatgacgacgccgaagctatcctggcagcagattttgagatcggtcactttctgcgggagcgtataatcccacggtccgttctgtacttcacaggtgaggctattgaagatgacgatgatgactacgacgaggagggagaggaggcggacgaagagggcgaagaggagggggatgaagagaatgacccagattacgatcccaagaaggatcagaatcctgccgagtgcaaacaacagtag

SEQ ID NO: 233381 - DNA, 627 bp, Artificial Sequence
  Description of Artificial Sequence: Synthetic coding sequence
atggtacaagagcacgatgagcctattctgaaacatttgaaagatatcaaggtcaagtttagcgatgccggacagccaatgtcatttgtcctcgaattccatttcgagcctaatgagtacttcaccaatgaagttctgactaaaacataccgcatgagatccgaacccgatgactctgatccgttttctttcgatggaccagaaattatgggctgcactgggtgccagattgactggaaaaaaggtaaaaatgtgacgctcaagacgattaagaagaagcaaaagcacaaaggccgagggaccgtgcgcaccgttaccaagacagttagcaatgattcattcttcaactttttcgccccaccggaggtgcctgagtccggggatctagatgacgatgccgaagcaattctggctgctgattttgaaattggtcattttctgagagagcgcattatcccacggtctgtgctgtacttcactggcgaggcaatcgaggacgatgatgatgactatgacgaggaaggagaggaggccgatgaggagggggaggaggagggggacgaggagaacgaccccgactacgaccccaagaaggaccagaatcccgcagaatgcaagcaacaatag

SEQ ID NO: 233382 - DNA, 987 bp, Artificial Sequence
  Description of Artificial Sequence: Synthetic coding sequence
atggccgatattgacaatctccccagagtggtgaagcgcagagtcaacgccctgaagaacctccaggtcaagtgcgcccagatagaagcaaagttctacgaggaagtgcatgatctcgagcgtaaatacgccgtgctgtatcaaccactgtttgacaagcgcttcgagatcatcaatgcaatctacgagccaacagaggaagagtgcgagtggaagcctgacgaagaggatgaaatttccgaggagctcaaagaaaaagcaaagatcgaggacgagaagaaggatgaggagaaagaagacccgaaggggatccccgagttctggctgacagtgtttaagaatgtggacctacttagtgacatggtccaggagcacgacgaaccaattcttaaacatttgaaagacatcaaagtgaaatttagcgatgccggacagccgatgagttttgtcctcgaattccacttcgaaccaaatgagtattttaccaatgaagtccttaccaagacctaccgcatgaggagcgaaccagatgactccgaccctttttcctttgatggcccagagataatgggctgcaccggctgtcagatcgactggaaaaagggtaaaaacgttacactaaagacaattaagaaaaaacagaagcataaaggtaggggaacagtgagaactgttactaaaactgtctccaacgacagcttcttcaatttctttgccccacctgaggtgcccgaatcaggcgacctagatgatgacgcagaggccattctggcagcagattttgagatcggacacttcctgagggagcggatcattcccagatctgttctgtacttcacaggagaggctatcgaagatgatgatgacgactacgacgaggagggtgaagaagccgacgaggaaggcgaagaggaaggagatgaggagaacgatcctgattatgaccctaagaaagaccaaaaccctgcggagtgtaaacagcagtag

SEQ ID NO: 233383 - DNA, 1107 bp, Artificial Sequence
  Description of Artificial Sequence: Synthetic coding sequence
atggcagatatcgacaataaagaacagtcagagttggaccaggacctggatgatgtcgaagaagtggaggaagaagagacaggcgaggaaaccaaactgaaagctagacaactgacggtgcaaatgatgcaaaacccgcagatcctggccgcactgcaagagcgtctcgatgggctggtggaaactcctaccggctacattgagtccctgcctcgcgtggtgaagcgcagagtgaatgccttgaaaaacctccaagtgaagtgtgctcaaatcgaggcaaagttttacgaggaggtgcatgacttagaaagaaaatatgcagtgctttatcaacccttatttgacaagagatttgagatcattaacgctatttatgaacccacagaggaggaatgtgaatggaagcccgatgaggaagatgaaatctccgaggagcttaaggagaaggccaagattgaagacgagaagaaggacgaggaaaaggaagaccctaagggcattcctgaattctggctcacagtcttcaaaaatgtggacctcctctcagatatggttcaggaacacgacgagcctatacttaagcacctgaaagacataaaggtcaagttcagtgatgcaggtcaaccaatgagcttcgttctagaattccatttcgagcctaacgaatattttactaacgaagttctgacaaaaacctatagaatgaggagcgaaccggatgattctgatccgttctcttttgacggaccagaaatcatggggtgcaccggttgccagatcgactggaagaagggaaaaaatgtgacactgaagacgattaagaagaagcagaagcataagggacgagggacggttcgcacagtcactaagacggttagtaatgattctttcttcaatttcttcgctccccctgaagtgcctgagtctggggacttggacgatgacgccgaggccatcctggctgcagattttgagattggccactttttgagggaaaggatcatccctaggtccgtgctgtactttactggcgaagctattgaggacgacgatgacgactacgatgaggagggcgaggaagcagatgaggtgatgttcaccaaatag

SEQ ID NO: 233384 - DNA, 795 bp, Artificial Sequence
  Description of Artificial Sequence: Synthetic coding sequence
atggctgacatagataataaggaacagagtgagctggaccaggacctggacgatgtggaagaagtggaagaggaagaaacaggggaggaaactaaacttaaagcgagacaacttactgtgcaaatgatgcaaaaccctcagattctggccgctctgcaggagcgactggatggactggtggagacgcctacaggatacatcgagagcttgcctagggtagttaagaggcgggtcaatgctctgaaaaatctgcaggtgaagtgtgcccagatcgaggccaaattttatgaagaagtccatgacttggagcgcaagtacgctgtgctgtaccagcccctctttgacaagaggtttgagatcattaacgcaatctatgagcctacggaggaggagtgcgaatggaaaccagatgaggaggacgagatatccgaggagctcaaagagaaagccaagattgaggatgaaaagaaagatgaagagaaagaggatcccaagggcatccctgagttctggctgaccgtgttcaagaatgtggatctgctcagcgacatggtgcaggaacacgatgaacccatcctgaagcatcttaaagacattaaagtaaagttttctgacgctgggcagccaatgtcgttcgtcctagagtttcacttcgagcctaatgaatacttcactaatgaagtcttgacaaagacttatcggatgcgcagtgagcctgatgatagcgaccctttctcctttgatgggcctgagattatgggctgcaccggatgccagattgattggaagaagtag

SEQ ID NO: 233385 - DNA, 1158 bp, Artificial Sequence
  Description of Artificial Sequence: Synthetic coding sequence
aaggaacagtccgagctggaccaggaccttgatgacgtggaagaagtggaggaggaggagaccggggaggagacgaagctcaaggctagacagctcactgtgcagatgatgcaaaacccgcagattctggccgcacttcaggagaggctggatggcttagtggagactcctaccggctacatcgaatccctcccaagggtggttaaaaggcgcgtgaatgccttgaagaaccttcaggtgaagtgtgcccagatcgaggcaaagttctacgaagaggtgcacgatctggaacgcaaatacgcagtgttgtatcagcctctgttcgataagaggtttgagataattaacgcgatttacgaacctaccgaggaggagtgcgaatggaaacctgatgaagaagacgagatttctgaggaattgaaggagaaggccaaaattgaggatgaaaaaaaagacgaagagaaggaggatccaaaaggcattcccgaattttggttgactgtctttaagaatgtggatctcctctctgacatggttcaggaacatgacgaacctattctcaaacacttgaaagacataaaggttaagttttctgatgcagggcagcctatgagcttcgtgctagagtttcactttgaaccgaacgaatacttcacaaatgaggtgttaacgaagacctaccgtatgcgctccgaaccagatgactctgaccccttttccttcgatggccctgagattatgggctgtacgggttgtcaaattgactggaagaagggcaagaacgttaccttaaagaccatcaagaagaagcaaaagcacaagggccgaggcactgtcagaacagtgaccaaaacagtgtcaaatgattcgttctttaatttctttgctcctccagaagtccctgaatctggtgacctcgatgacgacgcagaagctatcctggcagccgatttcgaaatcggccactttttaagagaacgcatcatcccacgttccgtgttatattttaccggggaggcaattgaggacgacgacgacgactatgacgaggaaggagaggaggccgacgaggaaggcgaagaggagggagatgaggaaaacgaccccgactatgatcctaaaaaagatcagaatcccgcagagtgtaagcagcagtag

SEQ ID NO: 233386 - DNA, 1521 bp, Artificial Sequence
  Description of Artificial Sequence: Synthetic coding sequence
atggcagaagctgacttcaagatggtgtctgagccggtggcccacggagtggcagaggaagagatggcatctagcacatcagacagcggagaagaatctgattccagctcctccagcagctccacatcagactcctccagcagtagttcgacctccggctcctctagcggctccggcagcagctctagcagcagcgggtccactagctcccggtcgcggctctaccgcaaaaaacgcgtgccagagccttccagacgagccagacgcgcacctctgggcaccaactttgtggaccgactcccacaagctgtaagaaatagggttcaggccctccgcaatattcaggacgagtgtgacaaggttgacaccctattcctgaaagcaattcatgatctggaaagaaagtacgccgaactgaataagcctctgtatgaccgcaggttccaaatcatcaatgcagagtatgaacccacagaggaggaatgtgagtggaactctgaggatgaagaattcagttccgacgaagaagtgcaggacaatactcccagcgagatgcctcctctggagggagaagaagaggaaaatccaaaggaaaaccccgaggtcaaggccgaggaaaaggaggtacctaaagaaattccagaagtgaaagacgaggaaaaagaggttcctaaggaaattcctgaggtgaaagccgaagagaaggcggacagcaaggactgtatggaggcaactcctgaggtcaaagaggaccccaaggaagttcctcaggtaaaggctgacgataaggaacagcctaaagcaactgaggctaaagctcgagccgcagtacgcgaaacacataagcgggtacccgaagagaggttgcaagatagcgtggatcttaagagagctcgtaaaggaaagcccaaaagggaagacccgaaaggcatcccggattactggctgatcgtgttaaaaaacgttgataaactcggaccaatgatccagaaatatgacgaaccaattctgaagttcctatccgacgtgagtttaaagttcagtaagccgggacagccggtctcctacaccttcgagttccactttctgcccaatccctacttccgcaacgaggtccttgtgaagacatacatcatcaaagcaaaacccgatcataacgatccatttttttcctggggatgggagattgaagactgtaaagggtgtaaaatcgattggcgacgcggtaaggacgtcacagtgactaccacccagagccggaccacagctaccggggaaatcgagatccagcccagagtcgtgcctaatgcaagcttctttaatttcttctcccctccagagatccctatgattggcaagcttgagccacgagaggatgctatcctggatgaagattttgaaattggacagatacttcatgacaacgtaattctgaaaagtatctattattatactggagaggttaatggcacatattaccaattcggcaagcattacggaaacaagaagtatagaaagtag

SEQ ID NO: 233387 - DNA, 1500 bp, Artificial Sequence
  Description of Artificial Sequence: Synthetic coding sequence
atggttagtgaaccagtcgctcacggagtggctgaagaggaaatggcttcaagtaccagtgactctggtgaagagagcgatagctcctccagttcttccagcacgagcgattcgtcctctagttcgagtacctccggttcatcttcaggctccggatcatcttccagctcctcaggttcaacaagtagtcgttccaggctgtacagaaaaaagcgggtgcctgagccatcaaggcgagccaggcgggctcccctggggaccaatttcgtggacagactgcctcaggcagtccgcaacagagtgcaggcattgcgaaacatccaggacgagtgtgataaggtcgatacgcttttccttaaagccatccatgacttggagcggaaatatgctgaacttaacaaaccgttatatgaccggaggttccaaataatcaacgcggaatacgaaccaacggaagaagagtgcgaatggaactctgaggatgaagaattcagcagtgacgaggaggtgcaggacaacacgccatctgaaatgccacccttggaaggagaggaagaagagaatcccaaggaaaacccagaagtgaaggcagaggaaaaggaggtgcccaaggagatcccggaagtcaaggatgaagaaaaagaggtgccaaaggagattcctgaggtgaaggctgaagagaaagctgattcgaaggactgcatggaagccaccccagaggtgaaagaggatcccaaggaggtcccccaggtcaaagcagatgataaggagcagccaaaagccacggaggcaaaagctagagcagcggttagggaaacccacaaaagagtccccgaggaacgactgcaagattcagtcgatctcaaaagggcaagaaaggggaagccgaagcgcgaagacccaaaagggatccctgactattggcttatcgtgcttaagaacgtggataaactggggcctatgatccagaaatatgacgaacctattctaaagtttctgagcgatgtttccctgaagttttctaaaccaggccagccagtgtcctatactttcgaatttcacttcctgccgaatccatactttcgaaacgaagtgctggttaaaacctatatcataaaagcgaagcctgatcacaacgacccgtttttctcttgggggtgggaaattgaggactgcaagggctgcaagatcgactggagaaggggtaaagacgtgaccgtcactaccacccagagtcggacgacagccactggggagattgaaatccagcctcgggtggtgcctaatgccagcttcttcaacttcttttccccccctgaaattcctatgattggtaagctggagcctcgtgaagatgcaattcttgacgaagactttgagattggccaaattctacacgacaacgtgatactgaagagcatttactactatacaggcgaagtgaacggaacgtattaccagtttggaaaacactacggtaacaagaagtatcggaaatag

SEQ ID NO: 233388 - DNA, 1128 bp, Artificial Sequence
  Description of Artificial Sequence: Synthetic coding sequence
atggccgaccacagtttcagtgatggcgtgcccagtgattccgtcgaggccgctaaaaatgcatccaacaccgagaagctcaccgaccaagtgatgcagaatcccagagtccttgccgcactgcaagagagactggataatgtgcctcatactcccagcagctacatagagactcttccaaaagcagtgaaacgtcggattaatgcactgaagcaattgcaagtgaggtgcgcacacatcgaagcgaagttttacgaggaggtacacgatctcgagcgaaaatacgcagccttatatcagcccctattcgataaacgaagggagtttatcaccggcgacgtggaaccaacagacgccgagtctgaatggcactctgaaaacgaggaggaggagaagctggccggagatatgaagagtaaagtggtggtcaccgaaaaagcggcagcgacagccgaagagccagacccaaaaggtatacctgaattttggtttacaatttttcggaacgtggatatgctgagcgaactcgtccaggaatatgatgaacccattcttaaacaccttcaagatatcaaggttaagttcagcgacccaggacagcccatgtcttttgtgttagaatttcactttgagcccaacgactattttacaaatagtgtgcttacaaagacttataaaatgaagtctgagcccgacaaggccgaccccttttctttcgaaggacctgagatcgttgactgtgatggctgcactattgactggaaaaaaggaaaaaacgtgactgtgaagaccatcaagaaaaaacagaagcacaaagggcgagggacagtgaggaccatcactaagcaggtacctaacgaatctttttttaacttttttaatcccctcaaggctagtggagacggggagtccctggatgaagactcagaattcacacttgcctctgacttcgagattgggcacttttttcgggaacggatcgtgcctagggccgtcttatatttcacaggagaagctatcgaagatgacgacaattttgaggagggcgaggaaggagaagaagaggagctggagggggatgaagagggggaagacgaagacgacgcggagatcaacccaaaggtctag

SEQ ID NO: 233389 - DNA, 1161 bp, Artificial Sequence
  Description of Artificial Sequence: Synthetic coding sequence
atggctgaccacagctttagtgacggagtgcccagcgatagcgtcgaagccgctaagaatgcctccaatactgagaaacttaccgatcaggtgatgcaaaaccctcgagtgttagcagcattacaggagcgactcgacaacgtgccgcatacaccttcgagctatatcgagaccctccctaaagcggttaagcgtaggattaatgccctgaagcagcttcaggtgcgctgtgcccatatagaagcaaaattttatgaagaggtgcacgacctggagaggaagtacgcagcactctaccaacccctcttcgacaaaagaagagaatttatcaccggagacgtcgaacctactgacgcagaaagcgagtggcactcagagaacgaggaggaggagaagctcgctggggatatgaaatccaaggtggttgtaactgagaaagccgctgctactgccgaagaaccagatcctaagggaatcccggagttttggttcactattttccgcaacgtagatatgcttagcgagctggtccaagagtacgatgaaccaatcctgaaacacttacaagacatcaaggtgaagttttccgacccaggtcagcctatgtcctttgttttggaatttcattttgaacccaacgattacttcacaaatagtgtcctcacgaagacatacaagatgaagagtgagcccgacaaagctgacccattttcttttgagggtccggagattgtcgattgcgatgggtgcaccatcgactggaagaaaggcaagaacgtgaccgtcaaaaccatcaaaaaaaagcaaaagcataaaggacgtggcaccgtccggacaataaccaagcaggtgcctaatgaatctttctttaactttttcaacccccttaaaggtaagggccagtccaaatctaaagacgaagatagtgagtttacccttgcaagcgattttgagatcggacacttttttagggaaagaatcgtgccacgcgctgtgctgtacttcaccggcgaggctattgaggacgatgacaactttgaagaaggagaggagggcgaggaggaagagcttgaaggggacgaggaaggcgaggacgaggacgacgctgaaattaacccaaagaaggagccttcacaaccagccgaatgtaagcaacagtag

SEQ ID NO: 233390 - DNA, 537 bp, Artificial Sequence
  Description of Artificial Sequence: Synthetic coding sequence
atggccgatcacagcttttccgacggcgtcccctcagactccgtggaagctgctaagaatgcctccaacaccgagaagctgaccgaccaggtcatgcaaaatcccagagtattagcggcactgcaggagagactggacaatgttccacacacaccttcctcatacattgagacactacctaaggccgtaaaacgacgcatcaatgccctgaagcaacttcaggtgagatgtgcacatattgaggcaaagttctatgaggaagtacacgatctggagagaaaatacgctgcgctctaccagccccttttcgataagcgcagggagttcattacaggggacgtagagccaactgacgcggagagcgagtggcactccgagaatgaggaggaagagaaattggcgggagacatgaaatctaaagttgtggtcacggaaaaggccgctgcgaccgccgaggagcccgatccaaaaggtattccagagttctggtttactattttcaggaacgtcgatatgctgagcgagctggtgcagtag

SEQ ID NO: 233391 - DNA, 1161 bp, Artificial Sequence
  Description of Artificial Sequence: Synthetic coding sequence
atggccgaccactccttctctgacggggttcccagcgactctgttgaggcagctaagaatgccagtaatactgagaagttgacggaccaggtgatgcagaacccccgtgtgctggcagcgttacaggagaggttagacaatgtgcctcatactccatctagctacatcgagaccctgcccaaggctgtgaagagaaggattaatgcgctaaagcagctgcaggttcggtgtgcccatattgaagctaaattctacgaagaggtacacgatttggagcgcaagtatgcggctctgtaccaacccctgttcgataagcggagagagttcatcaccggagacgtggagccaacggatgccgagtcagagtggcattccgaaaatgaggaggaagaaaaactcgcgggagacatgaagagcaaggtggttgtcaccgagaaggcggcagcgactgccgaggaacctgatccaaaggggattcctgagttttggtttaccatatttcgcaacgtggatatgctgagcgaactggtgcaggaatacgatgagccaattctgaagcacttacaggacattaaggtgaaattcagtgatcccggacagccaatgtcctttgttcttgagtttcactttgagccaaatgattattttacaaatagcgtgcttacaaagacttacaagatgaagagcgagccagataaagcagaccctttcagcttcgagggccctgaaatcgtggactgcgacggttgcactatcgattggaagaaaggcaagaacgtgaccgtaaaaaccataaagaagaaacagaaacataaggggaggggaactgtgcgaacgattaccaagcaagtgccaaatgagagcttctttaatttctttaaccccctcaaagccagcggggatggagaaagcctcgacgaagattctgaattcactctggcatcggattttgaaatcggccatttcttccgtgaacggatcgtacctcgcgcagtcctttattttacaggagaagctatcgaggacgacgacaattttgaagaaggtgaggaaggcgaggaagaggaactggaaggggatgaggaaggagaagacgaagatgacgcagaaattaatcctaagaaagaaccctcacaacccgcagagtgcaagcagcaatag

SEQ ID NO: 233392 - DNA, 387 bp, Artificial Sequence
  Description of Artificial Sequence: Synthetic coding sequence
atggccgaccacagtttctccgatggggttccatcagattccgtggaagcagctaagaacgcatccaatacagaaaagcttacagatcaggtcatgcagaatccacgagtgttggccgctctccaggaacggcttgacaacgtaccgcacacaccctccagttacatcgaaactctgccaaaagccgtcaagaggaggattaacgcactaaaacagcttcaggtcaggtgtgctcacatcgaggccaagttctacgaagaagtgcatgacttggaaagaaaatacgccgctctgtaccagcccttatttgacaagcggcgtgagtttatcaccggcgatgtggagcccacagacgccgaaagcgagtggcactctgagaatgaatag

SEQ ID NO: 233393 - DNA, 423 bp, Artificial Sequence
  Description of Artificial Sequence: Synthetic coding sequence
atggccgaccatagtttttcggatggtgttccatccgacagcgtggaagccgcaaagaacgcatcaaacactgaaaagttaacggaccaggtgatgcagaacccccgtgttctggccgctctgcaggagagactggacaacgttccccacacaccaagctcctatatcgaaacactccctaaagccgtgaagcgccgaatcaatgccctgaagcagctgcaggtccgatgcgcccatatagaggctaagttctacgaggaggttcacgacctcgaaaggaagtatgctgcactataccagccactttttgacaagcggagagagttcataaccggcgacgtggaacctaccgatgccgagtccgaatggcacagcgaaaatgaggaagaggagaagttggccggagatatgaaaagcaagtag

SEQ ID NO: 233394 - DNA, 402 bp, Artificial Sequence
  Description of Artificial Sequence: Synthetic coding sequence
atggcggaccactccttttccgatggagtcccttccgatagcgtggaggccgcaaaaaacgcctctaataccgagaagctgaccgaccaagtcatgcagaatcccagggtcctggctgccctgcaggagcggctggacaacgttccccacaccccctccagttacatcgaaaccctgccaaaggcggttaaacggagaataaacgctctaaaacagctgcaggtgcgttgcgcccacattgaggccaaattctacgaggaagtgcacgacctggaaagaaaatacgcagccctgtaccaacccctgtttgacaaacgcagagagtttattactggcgacgtggaacctacagatgcagagtcggaatggcactcagaaaacgaggaggaggagaagctgtag

SEQ ID NO: 233395 - DNA, 324 bp, Artificial Sequence
  Description of Artificial Sequence: Synthetic coding sequence
atggcggaccacagttttagcgacggggtaccctccgattctgttgaggctgctaagaatgcctctaataccgaaaagctcactgaccaggtaatgcagaacccacgggtccttgcggctcttcaggagcggttagataacgtgcctcacacaccctcctcctatatcgagacactacctaaggccgtcaagcgccgtattaacgccctgaagcaactgcaagtgcgctgtgcccatatagaagccaaattctatgaggaagttcatgacctggaaaggaaatacgccgctctgtatcaaccgctgttcgacaaacgacggtag

SEQ ID NO: 233396 - DNA, 237 bp, Artificial Sequence
  Description of Artificial Sequence: Synthetic coding sequence
atggctgaccactctttcagcgacggagtacccagtgatagcgtagaggcggctaaaaatgccagtaacacagaaaaattgaccgaccaagtgatgcagaatccacgcgtcttagctgccctccaggagcggctcgacaacgtaccccatactccatcttcctacattgagacgttgccaaaggccgtcaagcgacggattaatgccctgaagcagcttcaggtgaggtgcgcatag

SEQ ID NO: 233397 - DNA, 549 bp, Artificial Sequence
  Description of Artificial Sequence: Synthetic coding sequence
atggctgattccgaaaaccagggacccgcagaacctagtcaagccgctgccgctgcagaggccgcagctgaagaagttatggccgagggaggagcccaaggcggtgactgcgattcagctgcaggggaccccgattccgccgctggacagatggccgaagagccacagacgcctgccgaaaatgcaccaaagcccaaaaatgattttattgaaagccttcccaattctgtcaagtgtagggtactcgctctgaagaaactgcagaagaggtgtgataagatcgaggctaaattcgacaaagaattccaagccctggagaaaaagtacaacgacatctacaaaccactcctggcaaagatacaggagcttaccggcgagatggagggctgcgcatggaccctcgagggtgaagaggaagaggaagaagaatacgaggacgacgaagaagagggggaggatgaagaggaggaagaagcagccgcagaagcggcagcaggagcgaagcacgatgatgcccatgcggagatgcctgacgacgccaaaaagtag

SEQ ID NO: 233398 - DNA, 438 bp, Artificial Sequence
  Description of Artificial Sequence: Synthetic coding sequence
atggctgattccgaaaaccaagggccagccgaacctagccaggccgcagccgcagcagaggccgcagccgaagaagtaatggccgaaggaggagctcaaggtggagattgcgattcagccgctggcgaccctgatagcgctgccggacaaatggccgaggaaccccagaccccagcagagaacgcccctaagccaaaaaacgactttatcgagtccctgcctaactctgttaaatgcagggtcctcgctctgaagaaactccagaagcggtgtgataagatcgaggccaagttcgacaaggaattccaggcactcgagaagaaatacaatgacatttacaagccccttctggctaagattcaagagttgacaggggagatggagggatgcgcatggacgctggagggtgaagagcgacggaagagagtgcggggttag

SEQ ID NO: 233399 - DNA, 963 bp, Artificial Sequence
  Description of Artificial Sequence: Synthetic coding sequence
atggaggaggtacctcatgattgccctggtgccgacagtgcccaagctggtagaggtgcttcatgtcagggctgtcccaatcagcgtctttgcgcatctggagctggcgctacccccgacactgctatagaggagataaaggagaagatgaagacagtaaagcataaaattctagtcctgagcggcaagggtggcgtagggaaaagtaccttttcggcacatctggctcatggcctggcagaggacgaaaacacccaaatcgccctgttagatatcgatatttgtggtccatcaattcctaagattatgggactggaaggcgagcaggtccaccagagcggctcgggttggtccccagtctatgtggaagataacctgggagtgatgtctgttggattcctactgagttcccccgatgacgcagtaatctggaggggtccaaaaaaaaacggcatgataaagcagtttcttagagacgtggactggggagaggtggactacttaatcgtagacacaccaccaggtacatctgacgagcacctgtcagtagtgagatacctagctaccgctcatattgatggagccgtcatcatcacaacgcctcaggaagtcagcttgcaggatgtgaggaaggaaataaatttctgtcggaaagtcaaactccccataattggcgtcgttgagaatatgagcggcttcatttgccccaagtgcaagaaggagtcgcagattttccctcccacgactggcggtgctgaactgatgtgccaggatcttgaagtgcctctgctggggagagtccctctggacccactgattgggaagaactgcgacaaggggcagtctttctttatcgacgccccagatagtcccgctacactggcatacagaagcatcattcagcgaatccaagaattctgcaacctgcatcagtcaaaggaagagaaccttatctccagttag

SEQ ID NO: 233400 - DNA, 930 bp, Artificial Sequence
  Description of Artificial Sequence: Synthetic coding sequence
atggaggaagttcctcacgactgccccggagctgactcagcccaggcaggtaggggcgcttcctgccagggctgtcctaaccagagattatgcgcgagtggagcaggcgctacaccagacaccgctatcgaggaaattaaagaaaaaatgaagaccgtcaagcacaaaatcctggttctgtctgggaagggcggagtcggcaagtccaccttcagcgcccatctggctcatggactcgcggaggatgagaacacccagatcgccctcctggacattgatatatgcggcccttcaatccctaagattatgggtctggaaggcgagcagtatgtcgaggacaacctgggcgtcatgagtgtcgggttcctcctgagtagtccagacgacgccgtgatctggagaggccctaaaaaaaacgggatgataaagcaattcctgcgggacgtggattggggtgaagtggactatctgatcgttgacacccccccaggcaccagcgatgaacatctgagcgttgtgaggtatctggccacagctcacatcgatggggctgtcatcattaccacccctcaagaggtcagcctgcaggacgttcgcaaggaaataaacttttgtcggaaagtgaaattgccgattataggcgttgtggagaatatgtccggatttatatgtcccaagtgcaaaaaagagagccagattttccccccaacgactggaggagccgaactgatgtgccaagacttagaggtccccctgttggggcgagtgcctctcgaccccttgatagggaaaaactgtgataaggggcaatcgttcttcattgacgcgcctgattccccagcaaccctagcttacaggtccatcatacagaggatacaggagttttgcaatcttcaccagtccaaggaagaaaatttaatttcttcctag

SEQ ID NO: 233401 - DNA, 816 bp, Artificial Sequence
  Description of Artificial Sequence: Synthetic coding sequence
atggaggctgccgcagagccagggaacctggcaggcgtcaggcatataatcttagtgctgagcgggaaaggcggagttggaaagtccacaatatctacagaactggcactagctctccgccatgccggtaagaaggtgggtattctggatgtcgatctgtgcggtccctcaattcctagaatgttaggcgctcagggtagagccgtgcatcaatgcgatagaggctgggctccagttttcttggatagggagcagagtatctctctcatgagtgtgggatttcttcttgagaagcccgacgaggcagtggtctggcgtggtcccaagaaaaatgcactgattaaacagttcgtatcagatgtggcctggggagaattggactatctggttgtagacactccgcctgggacaagtgatgagcacatggcaaccatcgaggcgctcaggccctatcagcccctgggagcactggtagttacaactccacaggcagtgagtgtgggagacgtgaggagggaattaaccttctgccgtaaaaccgggctgcgggtcatgggaatcgttgagaatatgtccggctttacttgcccgcactgtaccgaatgcacctccgtattttccagagggggaggggaagagctagctcagcttgccggagttccattcctgggatcagtgcctctggacccagccttaatgagaacacttgaggaaggccacgacttcattcaagaatttcctggatcacctgcttttgcagccctgacctcaatcgcccagaagatactggacgcaactcccgcatgcctgccatag

SEQ ID NO: 233402 - DNA, 393 bp, Artificial Sequence
  Description of Artificial Sequence: Synthetic coding sequence
atggctacgatcgaggcactgaggccctatcaaccactgggggcactcgtggtgaccaccccgcaagccgtctctgtaggcgacgtgcgccgagaactcacattttgccgtaagactggtctgagggttatgggtattgtcgaaaatatgtccggattcacttgtcctcactgtactgaatgtacctcagtcttcagtagaggaggcggagaagagcttgcacagctggccggtgtgccatttctgggtagcgtgccattggatccagctttgatgcgcactctcgaggaaggacacgacttcatccaggagttccccggtagtcctgcatttgccgctctgacgtctattgcccagaaaatcctggacgcaactcccgcttgcctcccatag

SEQ ID NO: 233403 - DNA, 960 bp, Artificial Sequence
  Description of Artificial Sequence: Synthetic coding sequence
atgggcatttggcaacggctcttactcttcggaggcgtctcgctgagggctggtgggggtgccaccgcaccattaggaggatcaagggccatggtgtgtggaaggcagttaagcggtgctggctcagagacgctgaaacaaaggcggacccagatcatgagtagaggcctgccaaaacagaagccgatagagggtgtgaaacaggtgatcgtagtcgcgtccgggaaggggggtgtcggcaagtccaccaccgcagtgaacctggccttagctctggccgcaaacgactcttccaaggctatcgggctgcttgacgtcgacgtttatggacccagcgtaccgaaaatgatgaatcttaagggcaatccggaactctcgcaatctaatttaatgaggccgctccttaactacggaattgcttgtatgtcaatgggatttctggtggaggaatcagaaccagtggtctggcgaggactgatggttatgtctgcaatcgagaagctgctgcggcaggtggattggggacagctcgactacttggtggtggacatgccacctggaacaggagatgtgcagttgtcggtctctcaaaatattcctattacaggcgctgtgatcgtttctactccacaggatatagccctcatggacgcccacaaaggagccgagatgttccggagggtgcacgtgcctgtactgggtttggtgcagaatatgtcagtcttccaatgccctaagtgcaaacacaagacacacatcttcggcgcagacggggctagaaagctcgcccagacactggggttggaagtgttaggcgacatccccctgcaccttaacatccgcgaggcttccgacaccgggcaaccaattgtattttctcagcccgagagtgacgaagcaaaagcctatctgagaattgccgtagaggtggttcgaagacttccatccccatctgagtag

SEQ ID NO: 233404 - DNA, 672 bp, Artificial Sequence
  Description of Artificial Sequence: Synthetic coding sequence
atgagtaaggcaattgggcttcttgacgtagacgtctacgggccttccgtccctaagatgatgaatttgaaaggcaatcccgaattgtcccaaagtaacttgatgaggcctttgctcaattacggaatcgcgtgcatgtccatgggcttcctggtcgaggagtctgaaccagtcgtgtggagagggttgatggtcatgagtgctatcgaaaagctcctgcggcaggttgattgggggcagttggattatttggtagtggatatgccccctggaaccggcgacgttcagctgtccgtgagtcagaatatccctatcaccggcgcagtcattgtgagcacaccacaagacattgccctgatggatgcacataagggggctgaaatgtttaggcgtgtgcatgtaccagtgctgggactcgtgcagaatatgtcagtattccagtgccccaagtgcaagcacaagacacatatcttcggcgcagacggagccaggaagctcgcgcaaacactgggcttggaggtcctaggtgatataccactacatctgaatattcgcgaggcttcggacaccggtcagccgatcgttttctctcagcccgaatcggacgaagccaaggcctacctgcggatcgcagtagaggtagtgcgacgtctgccctccccttccgagtag

SEQ ID NO: 233405 - DNA, 3123 bp, Artificial Sequence
  Description of Artificial Sequence: Synthetic coding sequence
atgggggaggaggggggttcagccagccatgatgaggaagagcgcgcttccgtgttactgggccacagcccaggctgtgagatgtgttcacaggaggcgtttcaggcacaaaggtcacagctcgttgagcttctggtatccggttctctggaagggttcgagagcgtcctggactggctgctctcctgggaggtattgtcatgggaggactacgaaggctttcatctgctgggccaacctttatcccacttagccaggcggctcctggatacagtctggaataaggggacgtgggcatgtcagaaactcatcgctgctgctcaggaagctcaagctgactcacaaagccccaagttacatggctgctgggatccgcactctctgcatccagccagggacctccaaagccaccggccagccatcgtgaggcgcctccatagccacgtggagaatatgttagatctggcctgggagaggggatttgtgtctcaatacgaatgtgacgagatccggctcccgatattcacacccagtcagcgtgcaaggagactactggatctggcaacagtgaaagctaacggcctggctgcatttttattacagcatgtgcaggagctacctgtgcctctggcccttcccctggaagctgctacctgcaagaagtatatggccaagttacgcaccacagtatccgctcagtctagattcctttccacctacgatggcgcagagacactgtgccttgaggacatttacacggagaatgtgctcgaagtgtgggccgacgtgggaatggcagggcctcctcagaagtccccagcaacactcggccttgaagagctgttctccacccccggacacttaaacgatgatgccgatacagtcctcgtcgtaggggaggccggatccggcaagtctacattgcttcaaagacttcacctactttgggcagctggccaggatttccaggaatttctgtttgtcttccccttctcgtgcagacagctgcagtgtatggcgaagcccctctccgtgaggactctcttgtttgagcactgttgttggccagacgtagggcaagaagacatctttcagcttctgctagaccatcctgacagagtgctcctgacctttgacggcttcgatgagttcaaattcaggtttacagaccgtgaacggcattgctctcccaccgaccctactagcgttcagaccctgttgttcaacctgctccagggcaatctgttgaagaatgctagaaaggtggtaacctctcgcccagcagcagtctctgcgtttcttcggaaatatattaggaccgaattcaatttgaaaggattctcagagcagggcattgaactctacttgagaaagcgccaccatgagccaggcgtggccgataggctgattaggctgctgcaagagacgagcgccctgcacgggctgtgccacctgcctgtgttctcctggatggtttccaagtgccaccaggagctactgttacaagagggcggttcaccaaaaaccacgacagatatgtatctgttgattctgcaacacttcctcctgcatgccacccctcccgactccgcctcccagggcctggggccttccctcctgcgcggaaggctgccgactcttctccatctaggcaggctggcactttggggactgggcatgtgctgttacgtgtttagtgcgcagcagctacaggctgcccaggtcagcccggacgacatctcactcgggtttcttgttcgtgctaaaggcgtggtgccaggatccacagcacctttggaattcctacatattactttccaatgtttcttcgccgcattctatttagctctgagcgccgacgtgccccctgcactgctgcgccaccttttcaactgcggtcggccagggaatagccccatggccaggctcctgccaaccatgtgcattcaggcatctgaaggaaaagattccagtgtggctgccctgctccagaaggccgagcctcataatttgcaaatcacagcagcctttcttgctgggctgctttccagggagcactgggggctgctagctgaatgccagaccagcgagaaagccctacttaggcggcaggcttgcgccaggtggtgccttgcaaggagtctccgcaagcactttcactccattcccccagcagccccaggggaggctaagtcagtccatgcgatgcccggatttatctggctaatccgatccctgtacgagatgcaggaagagagactcgcccgaaaggccgcacggggattaaacgtagggcacttaaaactcacattctgctctgtaggcccaaccgaatgcgccgctcttgcgtttgttctgcagcatctacgcaggccagtggctctgcaattggactataactccgtgggcgacatcggggtggaacagctcttaccttgcctgggagtttgcaaggctctgtacttgcgggataataacatctcggatagaggaatctgtaaactcattgaatgtgctctccattgcgagcagctgcagaagttggccttgttcaataacaagctcacagatggctgtgcacacagcatggccaaattgctggcctgtaggcagaattttttggcccttcggctcggaaataattatattaccgcagccggtgcccaagtgctcgcagaagggctgagaggtaacacatctctccagttcctgggattctggggaaatagggtgggcgacgaaggcgctcaagcactggccgaagctctgggcgaccatcaatctctgcgctggctcagtttggtgggtaataatatcggaagtgtgggagctcaggcgctcgcactgatgctggcgaaaaatgttatgctggaagagctgtgtcttgaagagaatcacctgcaggatgaaggggtctgctccctcgctgagggtctcaaaaaaaacagttctctgaagattcttaaactgagtaacaattgcatcacttaccttggcgcagaggctctgttgcaagcgctggaaaggaatgatacaatcctggaggtatggttacgtggcaacaccttctctctagaagaagtggataaactgggatgtcgggacacccggctgctgctttag

SEQ ID NO: 233406 - DNA, 543 bp, Artificial Sequence
  Description of Artificial Sequence: Synthetic coding sequence
atgtggctgctacccccaggccaggtttttaacgccttcttcccatccagactaggaaataactacatcacagccgcaggggcacaggtgctcgccgagggcttgcgcggaaacacgtcactacagttcttaggcttttggggcaacagggtaggagatgaaggagcccaggcccttgccgaggccttaggcgatcaccaatctttaaggtggctctcacttgtgggcaacaacattggctccgtcggggcacaagcactggctctgatgttggctaagaatgtcatgctggaggagctgtgcctggaggaaaaccacctgcaggacgagggagtgtgcagtttagcagaaggccttaagaagaatagcagtctcaagatactgaaactgagcaacaattgtatcacatatttgggggcagaagcccttctgcaagctttggagcgaaacgacaccatcctggaagtgtggctgcggggaaacaccttctctctggaggaggttgacaaactgggctgccgcgatacgcgccttctgctttag

SEQ ID NO: 233407 - DNA, 1008 bp, Artificial Sequence
  Description of Artificial Sequence: Synthetic coding sequence
atggaggattccgggaagacattctcatctgaggaggaggaggcgaactattggaaagaccttgctatgacctacaagcagcgggcagaaaatacgcaagaggaactgcgcgaattccaggaaggatcacgcgaatacgaagccgagctcgagacacagcttcagcaaatcgaaacaaggaacagggacctgctctcggagaacaaccggttgagaatggagctggaaacaattaaggagaaatttgaagtgcagcattcagagggttaccgacaaatctcagccctggaggatgatctggcgcagactaaggccatcaaggaccaactacagaaatacatcagagagcttgagcaggcaaatgacgacttagaaagggccaagagagcaaccatcatgagcttggaagactttgagcaacgcttgaaccaggccatcgagcgaaatgccttcttagaaagcgagctggatgagaaagagaacctccttgagagcgtgcagcgattgaaggacgaagccagggacctgcgccaggagctggctgttcaacagaaacaggagaaacctcggacacccatgcctagtagcgtggaggccgagcggaccgatactgcggtgcaggccaccggatctgtcccaagtacgcctattgcccataggggtccttcaagctcccttaatacaccaggaagcttccgcagaggactcgatgatagcaccggcggtacacccctgactcccgctgccagaattagcgctttaaatatagtcggagacctcctgcggaaggtgggtgctcttgaaagtaaactcgcttcatgtcgtaatctggtgtatgaccagagccctaaccgaactggcggaccagctagtggcagaagttccaaaaaccgggacggtggagagaggaggccaagtagcacttcagtccctcttggcgacaaggggctggacacaagctgccggtggctaagtaaatcaacaacccgcagtagctcctcctgctag

SEQ ID NO: 233408 - DNA, 1041 bp, Artificial Sequence
  Description of Artificial Sequence: Synthetic coding sequence
atggaggattcaggtaagacgtttagctcagaagaagaggaagccaactactggaaagacctcgctatgacgtataaacagcgggctgaaaatacgcaggaagagttgagggagtttcaagagggtagtcgcgagtatgaagctgaactagagacccagcttcaacagatcgaaacccgaaaccgcgatctcctaagcgaaaacaatcgcctgagaatggaactggaaactatcaaggagaagttcgaggtgcagcactccgaagggtaccgccagatctctgcactggaggacgatctagctcagaccaaagccatcaaggatcagctgcagaaatacattagagagctcgaacaagcaaacgacgatttggagagggccaagcgagccacaattatgtccctagaagactttgaacagcggctgaatcaagctattgagaggaatgcattccttgagtcggaactggatgaaaaggaaaacctgctcgagtcggtgcaacgactcaaggatgaagcaagagaccttcgccaggaactcgctgtgcagcaaaaacaggagaagcccagaaccccaatgcccagcagcgtggaggcagaacgcactgatacggcggttcaggctaccggctcagttccttctacccccatcgctcatcgcggacctagcagctcccttaatacccctggatctttccgtagggggctggatgactccaccggaggaacacccttaacaccagctgccagaataagcgctttgaacattgtaggggacctgcttcgcaaggtgggggcactggagtccaagctcgcatcttgccgtaatcttgtttacgatcagtcccccaacagaactgggggacccgctagtggtaggtccagcaaaaatcgcgacgggggtgagaggaggccttccagtacatccgtccccctgggggacaaggggcttggtaaaaggctggaatttggcaagccgccaagccacatgagttcgtctcctctgccgtctgcccaaggcgtcgtgaagatgctgctctag

SEQ ID NO: 233409 - DNA, 1008 bp, Artificial Sequence
  Description of Artificial Sequence: Synthetic coding sequence
atggaagattctggcaagactttcagctcagaagaggaagaggcaaactactggaaggacctggccatgacatacaaacaacgggctgaaaacactcaggaggagttacgtgagtttcaagagggctcccgagaatacgaggcagagctcgagactcagctgcagcagatcgagacgagaaacagagacctgttgtctgaaaataatagactgcgcatggagctggaaactattaaagagaagtttgaggtccagcatagtgaggggtatcggcagatttcagcactggaagacgacctggcccaaacaaaggctattaaggatcagcttcaaaaatacattagagagctggagcaagctaacgatgatctggagagggctaaacgcgcaaccatcatgtcactggaagatttcgaacagcgactgaaccaggccatcgaacggaatgcctttctagagtcagaactagacgagaaagaaaatttactcgagagcgtacaacgcttgaaggatgaagcacgggatctgcgacaagagctggctgttcagcagaaacaggaaaagcccaggactcccatgccaagttcagttgaagccgaaagaacagataccgctgtgcaggcgacaggcagcgtgccgagcactccgattgctcatcgtgggccatcatcatccttaaacacgccaggctcgttcaggcggggactggacgactcgaccgggggaactccgttaactcctgccgcacggattagcgctctcaacatagttggtgatctgctgcgaaaggtaggggctctcgagagcaagctggcctcttgtagaaacctggtctatgatcagtcccccaacagaaccggcggaccagcctccggccgttctagtaaaaaccgcgacggaggcgagcggagaccctcctctaccagcgttccacttggagataaaggactggatacatcatgtaggtggcttagtaaaagcacaactaggagcagctccagctgctag

SEQ ID NO: 233410 - DNA, 1008 bp, Artificial Sequence
  Description of Artificial Sequence: Synthetic coding sequence
atggaggactccggaaagacctttagctccgaagaggaagaggcaaactactggaaagatctcgctatgacctataagcagagggccgagaatacccaagaagagctccgagagttccaggagggatctcgcgaatatgaggccgaactcgaaacgcagcttcagcagatcgaaacccggaacagggacctgctttccgagaacaacaggttacggatggagctcgagaccatcaaggaaaaattcgaagtgcagcacagcgagggttatagacagatatctgctctagaggacgatttggcacaaacaaaggcaatcaaagaccaattacaaaagtatataagggagctcgagcaggccaacgacgatctggagcgggcaaaaagagcaacaatcatgtcattggaagacttcgagcaacgcctcaatcaggccattgagaggaatgcattcctggagtcagagctcgacgagaaggagaatttgctcgaaagcgtacagaggttgaaggatgaagctagagatctgagacaggagctcgctgtccagcagaaacaagaaaagcctcgaacccctatgcccagctctgtggaagcggaacggaccgacactgctgtacaggcaactggctccgttcccagtactccaatcgcccacaggggaccatcgagcagcttaaacacacccggatccttcaggaggggcctcgacgacagcaccggcggaactcctctcacacccgcagccagaatctcagcccttaatattgtgggcgacctcctgagaaaagtgggcgctctggaaagcaaactggcctcctgtaggaacctcgtttacgatcaaagtccgaaccggactggaggtcctgcttctggcaggagctctaagaacagagatggcggagagcgaaggcccagctccaccagtgtcccgttaggcgacaaggggttagacacatcatgtcggtggctttcaaagtcaacaaccagatctagctccagttgttag

SEQ ID NO: 233411 - DNA, 471 bp, Artificial Sequence
  Description of Artificial Sequence: Synthetic coding sequence
atgggcgcaagtagactatatactctcgtgctagtcctgcaaccacagagagtgctgctgggaatgaaaaagcgcggattcggagcaggtaggtggaacggtttcggagggaaagtgcaggagggcgaaaccattgaggatggcgctagacgagagctccaagaggagagcgggctgaccgtggatgccttgcacaaggtcggacaaatcgtgtttgagtttgtcggggagcccgagctgatggacgtgcatgtcttttgtacagactcaattcaaggaacaccggtggagagcgacgagatgagaccttgctggtttcagctcgaccagatcccctttaaggacatgtggcctgacgactcctactggttcccgttgctgctgcaaaagaagaagttccatggatactttaaatttcaggggcaggatacgattctggactatacactccgtgaggtggatacagtgtag

SEQ ID NO: 233412 - DNA, 540 bp, Artificial Sequence
  Description of Artificial Sequence: Synthetic coding sequence
atgagtggcatcagccctcagcagatgggtgagcctgagggttcatggtccggaaaaaacccaggtacgatgggcgctagccgcttgtacaccctagtgttagttcttcaaccccagcgggttctgctcgggatgaaaaagcggggattcggggctgggcgatggaacggatttgggggaaaagtgcaggagggagagacaattgaggatggggctagaagagaactgcaagaagaatccggacttacagtcgatgcccttcacaaggtagggcagattgtttttgaattcgttggcgagcccgaactgatggatgtgcacgtgttctgtaccgacagcattcagggaactcctgttgagagtgacgaaatgcggccttgttggtttcagctggatcagattcctttcaaggacatgtggcctgatgatagctattggttcccactcttgctgcagaagaaaaaatttcatggctacttcaaattccagggccaggatactattttggattacactcttcgggaagtggatacagtctag

SEQ ID NO: 233413 - DNA, 471 bp, Artificial Sequence
  Description of Artificial Sequence: Synthetic coding sequence
atgggtgcgtcccggctgtacaccctggtgctagtcttgcagccacagcgcgtgctgttgggtatgaagaaaagagggtttggcgctggtcgctggaacggatttggcggaaaggttcaggaaggggagacaatcgaagatggtgcccgtagagagcttcaggaagagagcgggctgacggtggatgccttgcacaaggtagggcagatcgtgtttgaatttgtcggtgagcccgaactgatggacgttcacgtgttctgcacggatagtattcagggcacaccagtcgagtccgatgagatgcgcccttgctggttccagctggaccagatacctttcaaagacatgtggccagatgattcctattggttcccactgctgttacagaagaagaagtttcatggctactttaagtttcagggacaggatacaatcctggactataccctacgggaggttgataccgtgtag

SEQ ID NO: 233414 - DNA, 471 bp, Artificial Sequence
  Description of Artificial Sequence: Synthetic coding sequence
atgggcgctagcagactgtacacactggtgctcgttctacagccgcagagggtccttctcggtatgaagaagagaggattcggtgcgggacgatggaacggcttcggtgggaaagtacaggaaggagaaacaatcgaggacggtgctcggagggagttgcaggaggagtctggcctgactgtggatgccctgcacaaagtgggacagattgttttcgagttcgtgggggaaccagagctgatggacgtgcatgtgttctgcaccgacagcattcaagggaccccagtggagagcgacgagatgagaccctgttggtttcaactggaccagatcccctttaaggatatgtggcctgacgacagctactggttccctctgctgcttcaaaaaaaaaaattccatggatactttaaatttcaaggtcaagacacgattctggactacaccttgcgcgaagtcgatacagtttag

SEQ ID NO: 233415 - DNA, 540 bp, Artificial Sequence
  Description of Artificial Sequence: Synthetic coding sequence
atgagcgggattagcccacaacagatgggcgaacctgagggatcatggtctgggaaaaacccaggcacgatgggcgctagtcgactgtacacgctggtccttgttctccaacctcagcgcgtgctgctgggtatgaagaagagaggctttggcgcaggtagatggaacggcttcgggggaaaggtccaggagggcgaaactatagaagacggagccagacgcgaattgcaggaagagtcaggtctcaccgtcgacgctctccacaaagtgggtcagatcgtattcgaattcgtcggggaaccagagctaatggacgtgcacgtcttctgcaccgactccatccagggtacgcctgtagagtcggatgagatgagaccctgctggttccagcttgatcagattccattcaaggatatgtggcctgacgactcgtactggtttcctttattgcttcagaaaaagaaattccacggttactttaagttccagggtcaggacactattctggactacaccctgcgggaagtagatacagtgtag

SEQ ID NO: 233416 - DNA, 540 bp, Artificial Sequence
  Description of Artificial Sequence: Synthetic coding sequence
atgagcggaattagccctcaacagatgggcgagcccgagggatcctggtcagggaaaaacccagggacaatgggggcttctagactttacacgttggtgcttgttctgcagccacagcgggtcctcctgggcatgaaaaaacgagggtttggggcaggaagatggaatggattcgggggtaaggtccaggaaggtgagaccatagaagacggcgctagacgtgaactgcaggaggaaagcggcctgactgtcgacgccttacataaggtcgggcagatcgtctttgagttcgtaggtgaacccgaactcatggacgtgcacgtattttgcactgattctatccaaggaaccccagtggaatcagacgagatgcggccatgctggtttcagctggaccagatccctttcaaagacatgtggcctgatgacagctactggttcccacttctcctgcagaagaagaaatttcacggctattttaagttccagggacaagacaccatactggactatacactgcgtgaggtagatacagtgtag

SEQ ID NO: 233417 - DNA, 114 bp, Artificial Sequence
  Description of Artificial Sequence: Synthetic coding sequence
atgggcgcaagccgactgtataccctcgtgttggtactgcagccccagagagtactcctgggcatgaaaaagcggggatttggcgcaggaagatggaatggttttgggggatag

SEQ ID NO: 233418 - DNA, 495 bp, Artificial Sequence
  Description of Artificial Sequence: Synthetic coding sequence
atgaagtgtaaacccaaccagacaaggacctacgatcctgaaggattcaaaaagagggccgcatgcctgtgcttcaggagcgagagagaagacgaagtcctcctggtatcctcaagcaggtaccccgacaggtggatcgtacctggtggcggaatggagcccgaagaagaacctgggggagctgccgtgagagaagtgtacgaggaagctggagtaaaagggaagctcgggcgtttgttaggagtctttgaacagaatcaggacccaaagcaccggacctacgtatacgtgcttacagtaaccgaacttttagaagattgggaagatagtgtgtccataggaaggaagcgggagtggtttaaggtagaggatgcaatcaaagtactccagtgccacaagccggtccatgctgaatacctggagaagctgaaacttggtggatctccaacgaatggtaattcgatggccccttcaagcccggactccgatccctag

SEQ ID NO: 233419 - DNA, 495 bp, Artificial Sequence
  Description of Artificial Sequence: Synthetic coding sequence
atgaaatgcaaacctaatcaaactcggacctacgatccggaaggattcaaaaaaagagcagcctgcctgtgtttcagaagcgagcgagaagatgaagtgttactggtcagctcaagccggtatcccgatcgttggatcgtcccaggcggtggtatggaacctgaggaggagcctggcggagcagctgtgcgggaggtctacgaggaagccggtgtgaaaggcaagcttggccgtctcctgggagtgtttgagcaaaaccaggacccaaagcatagaacctatgtatacgtcctaactgttaccgagttattggaggattgggaggacagcgtcagcatagggaggaaacgggagtggtttaaggtggaggacgctatcaaggtgttacagtgccataaacccgtgcatgctgagtacctcgagaagctaaagttgggcggttcgccaacaaacggtaactctatggccccaagctctcctgacagtgacccatag

SEQ ID NO: 233420 - DNA, 444 bp, Artificial Sequence
  Description of Artificial Sequence: Synthetic coding sequence
atggcactgcgcgcatgcggcctgattatcttcaggcggtgcctgatacctaaagtggacaataatgccatcgagtttcttctgcttcaggcgtctgatgggatccatcactggaccccacccaaggggcacgtggagcctggcgaagacgacctcgagaccgcgcttagagaaacacaagaggaggctggaattgaggcaggccagttgactattattgagggttttaagcgtgagctgaactacgtggcaagaaacaagcccaagaccgtgatttattggctcgcagaggtgaaggattatgacgtcgagatacgtctctctcacgaacaccaggcttacagatggctcggacttgaagaagcatgccagctggcacagtttaaggagatgaaagccgcactccaggaaggacaccagttcttatgcagcatcgaggcctag

SEQ ID NO: 233421 - DNA, 444 bp, Artificial Sequence
  Description of Artificial Sequence: Synthetic coding sequence
atggcgctgagagcctgtggtctgattattttccgtcggtgtttaatcccaaaagtggacaacaacgcaattgaatttctcctcctccaggccagcgatggaatacatcactggacaccacccaagggacacgtagagcccggagaagatgacttagaaacagccttgagggagactcaggaagaggcgggtatcgaagcaggtcagctgaccattatagagggatttaagcgcgagctgaactacgtcgcaagaaataaaccgaagaccgtgatctattggctggccgaggtgaaggactatgatgtcgagatcagactaagccacgagcatcaggcctatcggtggctcggattggaggaggcatgccagctcgcccagtttaaggagatgaaagccgctctgcaggaaggacaccagtttctatgtagcattgaggcttag

SEQ ID NO: 233422 - DNA, 444 bp, Artificial Sequence
  Description of Artificial Sequence: Synthetic coding sequence
atggcattgcgggcttgtggactcattatcttcaggcgctgcctgattcctaaagtggataataatgcgattgaattcttactcctccaagcgtccgatggcatacaccactggacgccccctaaaggacatgtggaacccggtgaggatgacctggagacagccttaagggaaacgcaggaggaagccggaatcgaggctgggcagctaacaatcatcgagggatttaagcgcgaactgaactacgtcgcacggaacaaacccaagactgtaatctattggttggcagaggtaaaggactacgatgtcgaaatccggctttctcacgagcatcaggcttaccgatggctgggactggaagaagcctgtcagctggcacaattcaaagaaatgaaggcagccctccaggagggacaccagttcctttgcagtatcgaggcttag

SEQ ID NO: 233423 - DNA, 444 bp, Artificial Sequence
  Description of Artificial Sequence: Synthetic coding sequence
atggccctgcgggcttgcggtctgatcattttcagaaggtgcttgatccccaaggttgacaacaatgctattgagtttttgctgcttcaagcctccgacggcatccatcattggacccccccaaaaggacatgttgagccaggcgaagacgacttagagaccgcgcttcgcgagacgcaggaggaggcaggtattgaagccggacaactgactattattgaaggcttcaaaagggagctcaactatgtcgccaggaacaaacccaagaccgtcatttattggctcgctgaagtgaaggactatgacgtggagattcggttaagccacgagcaccaggcttatcgctggttaggtctggaggaggcgtgtcaacttgcacagttcaaggagatgaaagccgctttacaagagggccaccagtttctatgtagtattgaagcctag

SEQ ID NO: 233424 - DNA, 444 bp, Artificial Sequence
  Description of Artificial Sequence: Synthetic coding sequence
atggccctccgcgcttgcggactgattattttcaggcggtgtctgattcctaaggtggataataacgcgatagagttcctgctcctacaagcatctgatggcatacaccactggacgccgccaaaagggcatgtggagcctggagaagacgacctcgagacagcactgcgcgagacccaggaggaagctggcatagaagcagggcaattgactatcatcgaaggattcaaacgcgagttgaactacgtagcccgtaataagcctaagacggttatctattggctggccgaagtaaaggactacgatgtggagatcagactgagtcatgagcaccaggcgtacaggtggttgggactcgaagaggcttgccagctagcacagtttaaagaaatgaaggcagcgctacaggagggccaccaattcctctgctcgattgaggcgtag

SEQ ID NO: 233425 - DNA, 1395 bp, Artificial Sequence
  Description of Artificial Sequence: Synthetic coding sequence
atggagaccctgagctttcctcggtacaacgtggccgaaatcgtgatccacatcagaaacaagatcctgactggtgctgatggcaaaaacctcaccaagaatgacctctacccaaacccgaagcctgaagtccttcacatgatttatatgcgcgctctgcagattgtgtacgggattcgcctggagcacttctacatgatgccagtcaatagtgaagtcatgtatccgcaccttatggagggatttctgcctttctctaacctggtcactcaccttgattcgtttttgccaatctgccgggtcaacgacttcgagaccgcagacattttgtgtccaaaggcgaagcggactagcaggttcttgtccggcatcatcaatttcatccacttccgcgaggcttgtcgggaaacctacatggaatttttatggcaatacaagtcctccgccgataaaatgcagcagttaaacgccgctcaccaagaagcccttatgaagttggagcggctcgacagcgtgcctgtagaagaacaggaggagtttaagcagctgtctgacggaatacaggagctgcagcagagcctaaatcaggactttcaccagaagactatcgtcctgcaagagggtaacagccagaaaaaatccaacatatcagagaagactaagcgccttaacgagctaaaactatcagttgtgagtctgaaagagatacaggagagtcttaaaaccaaaatcgtagacagtcccgaaaagttgaagaactacaaggagaagatgaaagataccgtacagaagctgaagaatgctaggcaggaggtggtagagaagtatgaaatctatggcgatagtgtcgactgcttgccaagttgccaattggaggtgcagctttatcaaaaaaaaatacaggatctgtcagacaacagagagaagctagcctccatcctaaaggaatcactgaacctagaagaccagatcgaaagtgatgaaagtgaactgaagaagctcaaaacagaggagaatagctttaagcgcctcatgatcgtaaagaaagaaaaactcgccaccgcccaattcaaaattaataaaaaacacgaggacgtgaaacagtataagagaaccgtgatcgaggattgtaataaggtgcaagagaagcgaggcgcagtatacgagcgagtgaccacaattaatcaggaaattcaaaagattaaactgggaattcagcagttaaaagacgcagccgagcgcgagaaactcaagtcacaagagatcttcctgaacctcaaaactgccctggagaagtaccacgacggcattgaaaaggctgccgaggacagctatgccaagattgatgaaaaaactgctgagctaaagagaaaaatgttcaagatgtctacctag

SEQ ID NO: 233426 - DNA, 1395 bp, Artificial Sequence
  Description of Artificial Sequence: Synthetic coding sequence
atggagaccctgtcatttcctaggtataacgtggccgagatcgtgatccacattaggaacaaaatcctaacaggggcagacggtaaaaacttgactaaaaatgatctgtacccaaaccccaagcccgaagtgctgcacatgatctatatgcgagcactccagatcgtgtatggaattcggctggaacacttttatatgatgcctgtgaacagcgaggtcatgtacccacatctgatggaagggttcctgccattcagtaatctggttactcatctggacagtttcctgcctatctgtagggttaatgattttgagactgcagatattttgtgtcccaaggcaaagcgaaccagcaggtttttgtcaggaataatcaactttattcatttcagagaggcctgcagagagacgtacatggaattcttgtggcagtataaatcatccgccgataagatgcagcagttaaatgctgcccaccaggaggcactgatgaagttggaacgtttagactctgtgccagtggaagaacaagaggaatttaagcagctgtcagacggcatacaggagctgcagcagtccctgaaccaggatttccatcaaaagactattgtgctacaagaaggtaactctcagaagaagtccaacatcagtgaaaaaacaaagagactgaatgaactcaaactgtccgtggtctcattaaaggaaatacaggaatctctcaaaacaaagatagtcgacagcccagagaagcttaaaaactacaaagagaaaatgaaagataccgtccagaagctgaagaatgccagacaagaggtggtcgaaaagtacgagatttacggagacagcgtagactgccttcccagctgccagcttgaggtacagctctaccaaaaaaaaattcaggacctctctgacaacagagagaagttagcgtccatactaaaggagtctctcaatcttgaggatcagatcgaaagtgacgagtctgagctgaagaagctgaaaaccgaggaaaattccttcaaaaggcttatgatcgtgaaaaaagagaagctggctactgcccagtttaagatcaacaaaaagcacgaggatgttaagcagtataaacggacggtgatagaggactgcaataaggtgcaggaaaagcggggagcagtctatgagcgggtaaccacaatcaaccaagagatacagaagattaaactgggaatacaacagctcaaggacgcggcagaacgtgaaaagttaaaaagccaagagatattcctgaacctgaaaactgctcttgagaaatatcatgacggtattgagaaagctgcagaagactcttatgcgaagattgacgaaaagaccgcagaattgaagagaaagatgtttaaaatgtcgacctag

SEQ ID NO: 233427 - DNA, 609 bp, Artificial Sequence
  Description of Artificial Sequence: Synthetic coding sequence
atggagacactctcctttcccagatacaatgtggcggaaattgtaattcatattcggaacaaaatcttgacaggggctgacggaaaaaatctcacaaagaacgatctgtatcccaatcccaagcccgaagtgcttcacatgatctacatgcgggctctgcagatcgtatacggcattaggctagaacacttttacatgatgccggtaaacagtgaggtgatgtacccccacctcatggaaggattcctacctttcagcaatcttgtgacgcacctggattcatttcttcccatatgccgagtgaacgactttgagaccgccgacattttgtgcccaaaggcaaagcgaacctctaggtttttgtccggcatcatcaattttatccatttcagggaggcctgtcgtgaaacatacatggagttcctctggcagtataaaagcagtgcagataaaatgcagcaactgaacgccgcacaccaggaagctttaatgaagctggagagacttgactcggtacctgtggaagagcaagaggaatttaaacagctgagtgacggaattcaggaactgcagcaaagcctgaatcaggactttcatcagaagacatag

SEQ ID NO: 233428 - DNA, 438 bp, Artificial Sequence
  Description of Artificial Sequence: Synthetic coding sequence
atggaaaccctgagtttcccgagatacaatgtggccgagattgtgatccacatccgtaataagatcctcacaggagctgatggaaaaaatctaacaaagaacgacctgtaccctaatcctaagcccgaagttcttcatatgatctacatgcgtgccctacagatcgtgtatggaattcgtctggaacacttttacatgatgcctgtgaattcagaagtaatgtacccccacctgatggaggggtttctgccctttagcaacctggtgactcatcttgacagttttcttcccatctgtcgtgttaatgatttcgaaacagccgatatactgtgtccaaaggcaaagcgcacgagtcggttcctgagtggaatcataaacttcatccattttcgagaggcttgtagggaaacatacatggagttcttgtggcagtactag

SEQ ID NO: 233429 - DNA, 666 bp, Artificial Sequence
  Description of Artificial Sequence: Synthetic coding sequence
atggagactctatcatttccaaggtataacgtcgcagagatcgtgattcacattcgcaataaaatccttacaggcgcagacggtaagaatctcacaaaaaatgatctctaccccaacccgaaaccagaggttctccacatgatatacatgagggctttgcagatcgtgtatggtatacgcctagagcacttttatatgatgcccgtgaactcggaagtcatgtatccccacttgatggaaggcttcctccctttttctaatctggtgacccacctggactcctttttgccaatctgtagggttaatgactttgaaacggctgacatcttgtgcccaaaggcaaaaagaacgagcaggttcctgagtggtattattaacttcatccatttccgagaggcatgcagagaaacctacatggaattcttgtggcagtacaagtcctccgcggataagatgcagcaacttaacgctgctcatcaggaggcattaatgaagctggaaaggctggactccgtgcctgtcgaggagcaggaggagttcaaacagctgagcgacggcatccaggaactgcaacagagcctgaatcaggacttccatcagaaaacttgctgtaagcgggaaattcccaagcgttcacagattttccaaaggaaaccaagtgtctag

SEQ ID NO: 233430 - DNA, 1254 bp, Artificial Sequence
  Description of Artificial Sequence: Synthetic coding sequence
atggagacgctgtcctttcctcggtacaatgtggctgagatcgtcatacacattcgcaacaagatcctgacaggcgcagatgggaaaaacctgaccaagaacgacctctaccctaatcccaagcccgaagttctgcatatgatttatatgcgagcactgcaaattgtgtacggcattagactggagcacttctacatgatgcccgtcaactccgaagtgatgtacccacatttgatggaaggatttctccccttctccaacctcgtgacacacctcgattcattcctgccaatttgcagggtgaatgattttgaaaccgcagatattctctgccccaaggccaagcgaacatctcggtttctctcaggcatcatcaacttcatccatttcagagaggcatgcagagaaacgtacatggagttcctgtggcagtataaaagcagcgccgacaagatgcagcaactgaatgcggctcaccaagaggctcttatgaagctggaacgcctggatagcgtgccagtcgaggaacaggaagaattcaaacagctgtccgacgggatccaggaactacagcagtctctgaatcaggacttccatcagaagaccattgtactgcaggaaggcaattctcaaaagaagagtaatataagcgaaaagactaaacgcttaaacgagctaaagttgagcgtggtgagtcttaaagagatccaagagtctctaaagaccaaaattgtggactctccggaaaaactgaagaactataaagaaaagatgaaagatacagtgcagaagcttaagaacgccagatcactgaatctagaggaccagattgagtccgacgaatcagaactgaagaagctcaaaactgaagaaaattcttttaaacgcctgatgatcgtgaagaaggagaaacttgcaacggcgcagttcaaaatcaataagaagcacgaggacgtgaaacagtataagcgaacagttatcgaagattgtaataaagtgcaagaaaaacggggagccgtgtacgagagagtgacaaccatcaaccaggagattcagaagatcaagttgggcatccagcagttgaaagatgctgccgagcgggagaaattgaaatctcaggaaatcttccttaatctcaagactgctctggagaagtaccacgatggcatcgagaaagccgctgaagactcttatgcaaagatcgatgaaaagacagctgaactcaagcggaaaatgtttaaaatgtcgacctag

SEQ ID NO: 233431 - DNA, 375 bp, Artificial Sequence
  Description of Artificial Sequence: Synthetic coding sequence
atggagaccctctccttccccaggtataacgtcgccgaaatcgttatccatattcgtaacaagattctcacaggggcagacgggaagaacctgaccaagaacgacctttaccccaacccaaaacctgaagtgttacatatgatctatatgcgtgccctgcagatcgtgtacgggatcagactcgagcacttctacatgatgcccgttaacagcgaggtcatgtacccccacctgatggagggcttcctgcctttctcaaacttagttactcacctagatagttttctcccaatttgtcgggtgaacgattttgagactgctgatatcctgtgtcccaaggccaaacgaacctctaggttcttgagtggaatctag

SEQ ID NO: 233432 - DNA, 702 bp, Artificial Sequence
  Description of Artificial Sequence: Synthetic coding sequence
atgaacaaactccgccagtcgtttcgccgaaaaaaagacgtgtatgttccagaggcctctaggcctcatcagtggcagactgacgaagagggcgttagaactggaaagtgctctttcccggtaaaaactggaaagaaggcggttaaagccgttctttgggtgagtgccgacggcctccgggtggtggacgaaaaaactaaagacctgattgtcgaccagaccattgagaaggtatcattctgtgcccctgatcggaatttcgacagagcattttcttacatttgtagggacggcactacgaggcggtggatatgccactgcttcatggccgtcaaagacacgggagaacgtcttagccacgccgtgggttgcgccttcgcggcttgcctggagcggaaacagaagcgggaaaaggagtgcggggtgactgcgacttttgacgcgtccagaactacattcacaagagaaggaagtttccgggtgacaacagccactgagcaagccgaacgcgaggagatcatgaagcagatgcaggatgccaaaaaagccgagaccgataagattgtggttgggtccagcgtggcacccggtaatactgcacctagcccttcgagtcccaccagtccgacgtccgatgctacgacatccctcgagatgaacaatccacatgccattcccagacggcatgctcctattgaatag

SEQ ID NO: 233433 - DNA, 1956 bp, Artificial Sequence
  Description of Artificial Sequence: Synthetic coding sequence
atgaataagctgcgacaaagctttcgacgcaagaaagatgtttatgtgccggaagccagccgaccgcatcaatggcagacagatgaagaaggggtgagaacgggaaagtgcagctttccagtgaagtacttaggacatgttgaagtggacgagtcaagaggtatgcacatttgcgaggacgccgtgaagcgccttaaagctgaaaggaaattttttaagggcttcttcggcaaaacgggcaagaaggccgtgaaggcggttctgtgggtatctgcggatggactgcgtgtcgttgacgagaaaacaaaagatctaattgtcgatcagaccatcgagaaagtgtccttttgtgccccagatagaaacttcgatagagcattcagctacatatgtagagacgggactacacgcaggtggatctgccactgctttatggctgtcaaggacacgggagagcgcctgtctcacgccgtgggatgcgcattcgccgcatgtctggagagaaaacagaagcgagagaaagaatgtggcgtcaccgccacatttgatgcaagcaggaccacatttaccagagagggttcgtttagagtgaccactgctactgagcaagcagagcgcgaagaaattatgaagcagatgcaggatgcaaagaaggccgagaccgacaagattgtcgtagggtcctcagtcgctccaggcaacactgcaccttcccctagttctcccactagccctaccagcgatgccacaacttccctcgaaatgaataatccacatgccatccctcgacgccatgctcccatcgaacaattggcaagacagggctcgttccgagggttccctgccctgtctcagaaaatgagtcccttcaaacggcaattgagcttacgcatcaacgagttgccttccactatgcaaaggaagactgattttccaatcaaaaacgccgtgcctgaggttgaaggagaagctgaatcaatcagctcactgtgcagccagatcaccaacgccttctctacgcccgaagacccattctcctccgcgcctatgacaaagccagtgaccgtagtggcgcctcagtcgcctacctttcaagcaaacggaactgatagcgcatttcacgtgttggccaagccagcccacactgcactggcccctgtcgccatgccagtgcgagaaacaaatccatgggctcatgcccctgatgccgcaaataaggaaattgctgctacatgctcaggcaccgaatgggggcagtcttcaggagcagctagcccaggcctctttcaggcgggtcatcgaaggactccctccgaggctgaccgctggctggaagaggtgagtaaatctgtgagagcccagcagccccaggcaagtgcagcccctctccagcccgtgttacagccccctccaccgaccgctatctcccaacccgcatcgccatttcagggcaacgcgttcctgacctcacaaccagtgcccgtgggcgtggtgcccgctctgcagcctgctttcgtccctgcccagtcctaccccgtagctaacggcatgccctatcctgcccctaacgtcccagtcgtagggattacacctagccaaatggtggctaatgtttttggcacagccggtcacccgcaagcagcacacccacatcagagcccatccctggtgcggcagcagacctttccccactacgaggcttcatcagccactacttcaccattcttcaagccaccagcccaacatctaaatggaagcgccgcattcaatggtgttgacgatggtcgtcttgcaagcgctgacaggcatactgaagttcctacaggaacatgtcccgtagatcctttcgaggcccaatgggcggctctggagaacaaaagcaagcagagaactaatccatctccaacgaatccattttcttctgatttgcagaagactttcgagatagagctctag

SEQ ID NO: 233434 - DNA, 1812 bp, Artificial Sequence
  Description of Artificial Sequence: Synthetic coding sequence
atgaacaagctgaggcaaagttttcgaagaaagaaggacgtttacgtgcctgaggcctctagaccacatcagtggcagactgacgaggagggcgtgcggaccggaaagtgctcattcccagtgaagtacctcggacatgtggaagtcgacgagtctcgcggtatgcatatctgcgaggatgccgtgaagcgccttaaggctgaacggaagttcttcaaagggttttttggaaagaccggcaaaaaggcggtcaaggccgtcttatgggtaagcgctgatggtttgcgcgtggtcgatgaaaaaactaaagacctgatagtggatcagacaatcgaaaaagtctccttctgtgcccctgatcggaatttcgaccgagccttctcctatatctgtagggacgggacaacaaggaggtggatctgccactgctttatggccgttaaagacaccggagagcgtctttctcatgccgtggggtgtgcttttgccgcttgtctggaacgcaagcagaagagagaaaaagagtgtggggtgacagctacttttgacgcctcaaggactacattcacgcgtgaagggtcattcagagtcaccactgcaaccgagcaggccgagcgggaggagatcatgaagcagatgcaagatgcgaaaaaagccgagacagataagattgtggttggaagctctgtggcacccggtaatacggccccatctccttccagcccaacttcccctacatcagacgccacaacctcccttgagatgaacaatccacatgccattcctcggagacacgctcccattgaacagctcgccagacaaggcagctttagagggttcccggcactgagtcagaagatgagtcctttcaaacgccagctctctctcagaattaatgagcttccttcgaccatgcaacgaaaaactgacttccctatcaaaaatgcggtgccggaggtcgagggcgaggccgaaagtatctcatctctgtgtagccagattacaaacgcatttagcacgccagaagacccattctcatctgcccctatgacaaagccagtgaccgtggtggctccacagagcccaactttccagggaactgagtgggggcagtctagcggcgctgcttcccccggactgttccaggcagggcatcgtaggacacctagcgaggctgaccgctggctggaggaagtcagtaaatccgtgcgagcacaacaacctcaggccagcgccgcaccactgcagcctgtgttgcaaccccctcccccaacagctatttcccagcccgcttctcctttccaggggaacgcttttctgacttcccagccagtgcctgtcggggtggtacctgctttacagccagctttcgttccagcccagtcttatcctgtggccaatggcatgccgtacccggctcccaacgtgcctgtagtgggaataaccccatctcagatggtggccaacgttttcggaaccgcagggcacccccaagccgctcatccccatcaaagtccaagtctggtgagacagcagaccttcccacactatgaggcaagtagcgcgacaacctcacctttttttaaacctcccgctcaacatttaaacggatcagccgcatttaatggtgttgacgatggaagactggcctccgctgatagacacaccgaggtgcctacggggacatgtcccgtcgacccattcgaagctcaatgggccgctctcgaaaacaaaagcaaacaacgtactaatccctcaccaaccaacccgttctcctcagacctccagaagacctttgagatcgaactgtag

SEQ ID NO: 233435 - DNA, 1923 bp, Artificial Sequence
  Description of Artificial Sequence: Synthetic coding sequence
atgaacaaactcaggcagtcatttaggcggaaaaaagatgtatatgtgccggaagcctcgcggccacaccagtggcagacagacgaggaaggagtgaggaccggcaagtgcagcttccctgtgaaatacctgggacatgtcgaggtcgatgagtcgcgcggaatgcacatctgtgaagacgctgtcaaaaggctgaaagcaactggcaaaaaagccgtcaaggcagtcctgtgggtcagcgcagacggcctcagagtcgtggacgagaagacaaaggacttaatagtggaccagaccatcgaaaaagtgagcttctgtgctcctgatcgcaattttgaccgagcattctcatatatctgccgggatggtaccaccagacggtggatatgccactgtttcatggccgtcaaggatactggcgagaggctgtctcatgctgtcgggtgcgcgtttgcggcttgcttggaacgtaaacagaaacgtgagaaggagtgcggcgtaaccgcaacttttgacgcttcccgcacgactttcacacgcgagggctcatttagggtaacaactgccacagagcaggctgagagggaagaaatcatgaaacagatgcaggacgccaagaaagcggaaactgataagatcgttgttggcagttccgtcgccccagggaatacagcacctagccccagttctcctacaagtcctacttcagacgcgacaacctccctcgaaatgaacaacccacatgcgatccccagacggcatgctcccatcgaacagctggcgaggcaagggagtttcaggggctttcctgccttaagtcaaaagatgagcccattcaaaaggcagctaagtctcaggattaatgagttaccgtccacaatgcagcggaaaacagactttcccattaaaaacgccgtgccagaggtggagggtgaagctgagtcgatcagcagcctctgctctcagatcactaacgccttctccacaccggaggatcccttttcgagcgctccaatgactaagccagtgactgttgtagctccccagagtcctacatttcaagctaacgggaccgattctgcctttcatgtgctcgccaaaccggctcacacggccctggcccctgttgctatgcctgtacgcgagaccaacccatgggcgcacgctcccgacgcagctaacaaggagatcgccgcaacctgcagcggaaccgagtggggccaatcgtcaggggcagctagtcccggactctttcaggccggtcacagacgcactccatcagaggcggacaggtggctcgaggaggtctctaaatccgttcgagctcagcaacctcaagctagcgctgcccctctgcagcctgtgctccagcctcctccgccaaccgccatctcacagccagccagccccttccaagggaacgcatttctcactagtcagcccgtgcccgtgggagttgtcccagccctccagcccgcattcgtccctgctcaatcctaccccgtggcaaacggaatgccatacccggcaccaaatgttccagtggtcggaattacgccttctcaaatggtggccaacgtgttcggcacagcgggacaccctcaagcagcccatccacaccagtccccctccttagtgcgtcagcagacattcccacattacgaagcgagctcagccacaaccagccctttcttcaagcctcccgcacagcacctcaacgggtctgccgcatttaatggcgtcgacgatggaagacttgctagtgcagacagacacacagaggtgcccaccggcacctgccctgtcgatccattcgaagcgcagtgggctgctttggagaacaaatctaaacaacgcacaaatcctagtccaaccaatccattctctagcgacctgcagaagactttcgaaattgagctctag

SEQ ID NO: 233436 - DNA, 1518 bp, Artificial Sequence
  Description of Artificial Sequence: Synthetic coding sequence
atgaacaagctgcgccagtcatttaggaggaaaaaggacgtgtatgtgccagaggcatcccgccctcatcagtggcagacggacgaagagggcgttagaaccggaaagtgttcatttcctgtcaaatacttgggacacgtcgaggtggatgaaagcagaggcatgcacatttgtgaggacgccgtgaagcgactaaaagcagagcgaaagttctttaaggggtttttcgggaaaactggaaaaaaggctgttaaagccgtgctgtgggtctcggcagatggtttacgggttgtggacgaaaaaacaaaagatctgatagtcgaccagacaattgagaaagtttccttttgcgccccagaccggaatttcgatagggctttcagctatatttgcagagatggaaccacaaggagatggatctgccactgcttcatggcagtgaaggataccggagagagactaagtcacgcggtgggttgcgcctttgccgcttgcctcgagagaaaacaaaagcgggagaaagaatgcggagtgacggccacattcgacgcttctcggactacattcacaagagaaggatcctttcgggttactactgccaccgagcaggccgaacgcgaagagatcatgaagcagatgcaagacgctaaaaaagtcccagaagtggaaggcgaggcagagtctatttccagcctctgttcccagatcaccaatgccttcagcacaccggaggatcccttttcatcagctcctatgactaagccagtgaccgtcgttgccccacagtccccgaccttccaggggaccgagtggggacaaagcagtggtgctgccagtcccggtctttttcaggccggtcaccgacggacaccgagcgaagccgatagatggttagaagaagtaagcaaaagcgtgagagcacagcagcctcaagcaagcgcagcccctctgcaacccgtgttacagccgcctcccccaacagcaatttcacagcccgcatccccttttcagggcaatgctttcctcaccagccagcctgtgcccgtcggcgttgtgccggcactccagcccgcattcgttcccgctcagtcttaccctgtcgccaatggaatgccttaccccgcacctaatgtgccggtggtcggaatcacaccatcccagatggtcgcgaacgtgtttggtacagccggacatccccaggctgctcatccccatcagtccccttcattagtaagacagcaaacattcccacactacgaggcctcctccgcaaccactagtcccttttttaagccaccagctcagcacctcaacggaagtgcggcattcaacggcgtcgatgatgggaggctggcatcagccgacaggcacaccgaggtgccaacgggaacttgccccgtcgaccccttcgaggcgcaatgggctgcattggagaacaagtccaaacagcgaaccaacccatctcctacgaacccgttctcttccgacctgcagaagacttttgagatcgaactgtag

SEQ ID NO: 233437 - DNA, 1923 bp, Artificial Sequence
  Description of Artificial Sequence: Synthetic coding sequence
atgaacaaactgaggcagtcctttcggaggaaaaaagatgtttatgttcccgaggctagccgaccccaccaatggcagactgacgaagaaggcgtccgcaccggcaaatgttcttttccagtgaagtatctcggacacgtcgaagttgatgagagccgcggaatgcatatttgcgaggacgccgtgaagagacttaaagcaacagggaagaaagcagttaaagccgtcttatgggtttctgcagacggattacgcgtagttgatgagaagacgaaagaccttatagtcgaccaaaccatcgaaaaggtgtcattttgcgctccagatcgcaatttcgaccgcgctttcagctacatttgcagagacggtaccactcggaggtggatatgccattgcttcatggccgtgaaggacaccggagagagactgagtcacgccgtcggatgcgcatttgctgcctgtctcgaacggaagcagaaaagggaaaaggagtgtggtgttactgccaccttcgatgcctccaggactacattcacgcgggagggatcattcagggtgaccaccgccaccgaacaggctgagagggaggaaattatgaaacagatgcaggatgcaaaaaaagccgagacagataaaatcgtggtaggctcatctgtggcgcctgggaacacagccccttcaccaagttctccaacttcaccgacttcggatgcgaccacttctttagagatgaacaacccacacgcaatcccacgtagacacgcccctatcgaacaattggccaggcaggggagctttcgtggattccccgctctgagccagaaaatgagtccatttaagagacagctgtctctgaggatcaatgagctaccgagcaccatgcagcggaaaaccgactttcccataaagaatgccgttccagaggtggaaggcgaagccgaatctatctcaagcctatgtagccagattaccaacgctttctctacacctgaggatcctttttctagcgcacctatgaccaaacctgtgacagtggtggccccacagagcccaaccttccaagctaatggaactgactctgctttccacgttctggcgaaacccgctcatacagctttggctccagtggccatgccagtacgggagaccaacccatgggcccacgcaccggatgcagctaataaagagattgctgccacatgcagtggcacagagtggggacagtcatccggcgcagcttcccccggactgttccaagctggtcatcgacgcactccttcagaggcagaccgatggttagaagaagtttctaagagcgttcgggctcagcaaccccaggcctctgcggcacctctgcagccagtgcttcaacctccgccacctactgccatctctcagccagcaagcccattccaaggtaatgcatttttgacttctcagcccgtgcctgttggggtagtgccagccctgcagcctgcattcgtccctgcgcagagctatccagtggctaacggtatgccttatcccgctccaaatgtgccagttgttggaataacgccctcccagatggtcgcaaacgtctttggcacagcaggtcacccccaggcagcccacccacatcagagcccatccttggttcgacagcagacttttccacattacgaagcttccagcgctacaaccagtcccttcttcaaaccacccgcacaacacctcaacggttccgctgctttcaatggagtggacgatggtcgattggcatcagcggatcgccacacggaggtgccaacgggaacatgtcctgtggatccctttgaggctcagtgggcggcactcgaaaacaagtctaagcaacgaactaatcctagccctaccaacccgttttcttctgacctacagaagacattcgagatagaactctag

SEQ ID NO: 233438 - DNA, 1371 bp, Artificial Sequence
  Description of Artificial Sequence: Synthetic coding sequence
atgaataagctgcgacagagcttcagacggaagaaggacgtctacgtgcccgaggcctcccgtcctcatcagtggcagacagacgaagagggcgtccgtacggggaagtgttcgttccctgtgaaatacctgggccacgtcgaggtggacgagtccagaggcatgcacatctgtgaggatgccgtgaagcgcctgaaagcggagcgtaagttctttaaaggcttcttcggaaagacgggaaagaaagcagtgaaggctgtgctctgggtaagtgctgacggactccgcgtggttgatgagaagaccaaggatcttattgtggatcaaacaatcgagaaagtctcattctgcgcacccgacagaaatttcgatagggccttctcatatatatgccgcgacgggactaccagaagatggatctgccactgttttatggcagtgaaagataccggcgaacgcctgtcccatgctgtgggctgcgccttcgccgcatgcctcgaaagaaaacaaaagagagagaaggagtgcggcgtcaccgcaaccttcgatgcatcaaggacgacatttacgagggaaggctccttcagagtgactacagctacagaacaggctgaacgggaggaaattatgaaacagatgcaagacgcaaaaaaggggacggaatggggacaaagcagcggagcagcctccccaggattatttcaggccggacaccgtcgcaccccttctgaggccgaccgttggctggaggaagtttctaagtccgtgcgcgcacagcagccacaggcctccgctgctcctcttcagccagtccttcagccacctcccccaaccgctattagccagccagcctccccattccagggcaacgcttttctgacttcgcaacccgttccagtgggcgtggtgccggctctgcagccggctttcgtccccgctcagtcgtacccagtggccaatggcatgccctatcccgcaccgaatgtgccagtggtcggcatcaccccttcccaaatggtcgctaacgtgttcgggacggcgggtcaccctcaggccgctcaccctcatcagtcacctagcttggtgcgccagcagacttttccgcactacgaagcctcttctgctacgacgtctccttttttcaaaccccctgcccaacacttaaacgggagcgccgcttttaatggcgtcgatgatggaagactggcttccgccgacaggcataccgaggtcccaacaggtacatgccccgttgatcctttcgaggcgcaatgggccgcactcgaaaataagtctaaacaacgcactaatccatctccaacaaatcctttctcttctgatttgcagaaaacattcgagattgaactgtag

SEQ ID NO: 233439 - DNA, 777 bp, Artificial Sequence
  Description of Artificial Sequence: Synthetic coding sequence
atgaacaagcttcgtcaaagcttccgcagaaagaaggatgtatacgtccctgaggcttcaaggcctcatcagtggcaaaccgacgaggagggtgtgcgaactgggaagtgctcttttcctgttaagtacctaggccacgtggaagtcgacgagtcgcgcggaatgcacatatgtgaagacgccgtgaagcggctgaaagccgaaagaaaattcttcaaagggttcttcggcaaaacaggtaaaaaagccgtgaaggccgttctctgggtttctgccgacggcttgagggtggtcgatgaaaagaccaaggacctgatcgtggaccagaccatcgagaaagtgtccttttgtgccccagaccgaaactttgacagagccttcagctatatttgcagagatggcacaacccgacggtggatctgtcattgttttatggcggtgaaggataccggtgaacgattatcccatgccgttggttgcgccttcgctgcttgcctggaacgcaaacaaaagcgggagaaggaatgtggggttacagccacttttgatgcttcacgcactacatttacacgcgagggctctttcagagtgacaaccgcaactgaacaagcagagagagaagaaatcatgaaacaaatgcaggacgccaagaaggcagagacagataaaatcgtcgtggggtctagcgtggctccagggaatactgcccctagcccatcctcgccaacgagccctactagcgacgccacaacaagcctggagatgaacaatccatag

SEQ ID NO: 233440 - DNA, 1779 bp, Artificial Sequence
  Description of Artificial Sequence: Synthetic coding sequence
atgaataaactgaggcaaagcttcagaagaaagaaggacgtgtacgtccccgaagcatcccgtcctcaccagtggcagaccgacgaggaaggggtgcgcaccggaaagtgcagcttccctgtgaagtatctggggcatgtcgaggtcgacgagtccagaggcatgcatatatgtgaggacgccgttaagagactgaaggccaccggcaagaaggccgtaaaggcagtcctgtgggtaagtgcagacggccttcgagtggtggacgagaagaccaaagacctcatcgtagaccaaacgattgaaaaagtctcgttttgtgcccctgataggaattttgaccgcgctttctcctacatctgtcgcgatggcaccacacggaggtggatatgccattgtttcatggctgtcaaggatacaggggagcgactgtctcacgctgtgggatgtgcgttcgccgcatgccttgagagaaagcaaaaacgtgaaaaggaatgtggcgttaccgctacattcgacgcctcgcgaaccacttttacccgagaggggtcttttagagtgaccactgccaccgaacaagctgaaagagaggagataatgaagcaaatgcaagacgcaaagaaagccgaaacagataaaattgtagtcggaagctccgtggctcccggaaacaccgcaccctcaccaagtagtcccacttccccaaccagtgatgccaccacatccctcgaaatgaacaacccccatgccattcccaggcgccatgccccaattgagcagcttgcgagacaggggtctttccggggttttcctgccctaagccaaaaaatgagccccttcaaacgtcagctgagtctgcgtattaatgaactgccttcgacaatgcagagaaaaaccgatttccccatcaaaaacgccgttcctgaagtagagggcgaggcggagagcatatcttctttgtgcagtcagatcactaatgccttttccacacccgaggacccattcagtagcgccccaatgacgaaaccggtgacagttgtggcaccccagtcccccacgtttcagggcacagaatggggccagtcgtctggagccgcttctccaggcttatttcaggctggacatagacggacccccagcgaggccgacagatggttagaggaggtgtccaagtcagtgagagcccaacagccccaggcctcagccgcacccctgcagccagtgttacaaccccctccccctacagccatctctcagcctgcaagtcctttccagggcaatgcatttctgacttcccaacccgtgccggtcggtgtggtgccagccctccagccggcattcgtcccagctcagtcctatcctgttgccaatggaatgccgtatcctgctccaaacgtaccagtcgttggaattaccccctctcagatggttgctaacgtgttcggcacggccggacaccctcaggccgctcatccacaccagtccccgtcccttgtgagacagcagactttcccgcactatgaggcaagctcagccacaacaagtccctttttcaagcctccagcccagcacctcaacggctccgctgccttcaacggggtggacgacggtaggctcgccagcgccgaccggcatactgaggtcccaacaggcacttgtcccgtggatccttttgaggcccaatgggccgcactcgagaataagtccaagcagcggaccaacccgagtccaacaaatccattcagtagtgacctccagaaaactttcgagatcgaactttag

SEQ ID NO: 233441 - DNA, 204 bp, Artificial Sequence
  Description of Artificial Sequence: Synthetic coding sequence
atgaacaagcttcgccagtcctttaggcgaaaaaaggacgtatacgtgcctgaagcatccaggccccatcaatggcagaccgacgaagaaggagtcagaacaggaaaatgctcattcccagtgaagtacctggggcacgtggaggtggatgagagcagaggcatgcacatttgcgaagatgctgtgaaaaggctcaaggcctag

SEQ ID NO: 233442 - DNA, 1956 bp, Artificial Sequence
  Description of Artificial Sequence: Synthetic coding sequence
atgaataagctgcgacaatcctttcgaaggaagaaggacgtctacgtgcctgaggcaagtagaccacatcagtggcagactgacgaggaaggagtgcgcacaggcaaatgcagtttccctgtgaagtatcttgggcacgtggaggtcgacgagtcccgagggatgcacatttgcgaagacgccgtgaagcggcttaaggcagagaggaagttctttaaaggcttttttggcaaaacaggaaaaaaagcagtgaaggcggtgttgtgggtctcagccgatggccttagggtggttgatgagaagaccaaggacctgatcgtagaccaaactatcgagaaggtgagtttttgtgcacccgatagaaactttgacagagcattttcctatatttgtagagacgggactaccaggaggtggatttgccactgcttcatggctgtgaaggacaccggcgagaggctatcacacgccgtaggatgcgcttttgcagcctgtcttgagagaaagcagaagagggagaaagagtgcggcgtcacagctacgtttgacgctagtcggacaactttcaccagagaaggctcgttccgagtgacaactgcaactgaacaagctgagcgggaggagatcatgaaacagatgcaggatgctaaaaaggctgaaactgataaaattgtggtcggctcatcagtggctcccggaaacacggctcccagccccagctcgccaacctcacccacaagcgatgccactaccagccttgaaatgaacaatccacacgctatccctcgacggcacgctcctattgagcagcttgcacgacaggggtcgttcagaggttttccagccttgtcccaaaagatgagtccgttcaagcggcagctgtctcttagaatcaacgaactcccgagcactatgcagcgaaagaccgattttcctattaaaaatgcggttccagaggtggaaggcgaggctgaatcaatttcttccttgtgctcccagattaccaatgccttttctactccagaagaccccttcagtagcgcccctatgaccaagccagtgactgtggtagctccgcagtcaccaacatttcaagcaaacggcacagattccgctttccacgtgctggcaaagccagctcataccgccttggctccagtggctatgcccgttcgagaaacaaacccttgggcacatgcacctgatgcagctaacaaggagatagctgccacttgctccggaaccgagtggggccagagttcaggcgcagcttctcctgggttgtttcaagccggacacagaagaaccccatccgaagcagaccgctggttagaggaagtgtcaaaaagcgtgagagcacagcagccacaggcgtctgctgcccctctgcaacctgttctgcagcctccccctccgaccgctatctcgcagccagcgagtccgtttcagggcaacgccttccttacctcccagccagttccagtgggagtggttcctgccctgcaacccgcttttgtacccgcacagagctatccggtagcaaatggcatgccataccccgcaccaaatgtcccggtcgtcggaatcacgccatcccagatggtggccaacgtgttcggcaccgcagggcaccctcaggctgctcatcctcaccagtccccctctctcgtgcggcagcagacctttccgcactacgaggcctccagcgcaaccacatctccgttcttcaagcctcctgcacaacacctaaacggaagtgcggcatttaatggcgtggacgatggtcgtctggccagcgccgatcggcatacagaggtacccaccgggacgtgcccagtcgatccatttgaagcccaatgggctgcactcgaaaataaatcgaagcagagaaccaatcctagcccgaccaacccgttcagtagcgatttgcagaaaacttttgagatcgaactgtag

SEQ ID NO: 233443 - DNA, 777 bp, Artificial Sequence
  Description of Artificial Sequence: Synthetic coding sequence
atgaataaactacgacagagcttccgccgtaagaaggacgtgtatgtacccgaagcctccaggccacaccaatggcaaaccgacgaagaaggagtacggacgggtaaatgctcttttccagtcaagtatttgggccacgtggaggtggatgagtcccgcggaatgcacatctgtgaagatgcagtaaagagactgaaggctgagcggaaattttttaagggattttttggtaaaaccggcaagaaagctgtcaaggcagtcctatgggtaagcgcggatggattacgggtggtcgatgaaaaaacaaaggacctgattgtggaccaaacaatagagaaagtgtccttctgcgcccctgatcgcaacttcgatagggcttttagctacatttgccgcgacggcaccactcggcgatggatctgccactgcttcatggccgtcaaggacactggggagagactgtctcacgccgttggctgtgcctttgccgcttgcctagagcggaaacaaaagagagagaaagagtgcggagtcacagccactttcgatgccagcagaactacttttacgagggaggggagcttccgggtgacaacggctacagagcaggccgagagagaagagatcatgaaacagatgcaagatgctaaaaaggcggaaactgataaaatcgtcgtcggttcttctgtggcccctggcaacactgctccatctcctagttccccgacttctccgacaagcgacgcaacgacaagcctagaaatgaacaacccctag

SEQ ID NO: 233444 - DNA, 1812 bp, Artificial Sequence
  Description of Artificial Sequence: Synthetic coding sequence
atgaataagctgagacagtctttcagaaggaaaaaggacgtatatgtgcccgaagcctctcgaccacatcaatggcagacagacgaagaaggagtgaggacaggcaagtgctcatttcctgttaaatatcttggtcacgtagaggtcgacgagtcccgcggaatgcatatatgcgaggacgcagtgaagaggctcaaggctgagcggaaattcttcaaaggcttctttggcaaaactggcaagaaagctgtgaaggccgtcctttgggtgtctgctgacgggctccgtgtggtggacgagaagactaaggatctgatcgttgaccagaccatcgaaaaagtcagcttttgtgctcccgataggaacttcgaccgcgctttttcttatatatgcagggatggtacgactcgtagatggatatgtcattgctttatggccgtcaaagacacgggagagagactctcacatgccgtcggttgcgcatttgcggcttgtttagaacggaaacagaagcgcgagaaagagtgcggggtgaccgccacttttgacgcatcaagaacaacctttaccagagaagggagtttcagagtgacgaccgcaacagagcaggctgagcgggaggaaattatgaaacagatgcaagacgccaaaaaagcagagacagataagattgttgtgggatcatccgtggcgcctgggaacacggcacctagtccgagtagccccacatcccccacaagcgacgctactacttcactcgagatgaataatccacacgctattccccgtcgtcatgctccgattgaacaactagcaaggcaggggagcttccgaggatttcctgccctaagtcagaagatgagcccttttaagcggcagctgtcactgcgcatcaacgaattaccgtccaccatgcagcggaagaccgattttccaatcaagaacgctgtgcctgaggttgaaggagaggccgagtccatttcctccctttgtagtcagatcacaaacgcgttttcgacccctgaagacccgttctcatccgcgcctatgactaaacctgtaaccgtggtggccccacaatctcccacattccaaggcacagaatgggggcaatcttctggagctgcgagcccgggtctgttccaagcgggacaccgaagaaccccatccgaagcagaccgttggttagaagaagtcagtaagtcagtaagggcccagcagcctcaagccagcgccgctcccttgcagccagtactgcagccgccacctccaactgccatatctcagcctgcgtctccttttcaggggaacgcctttctaacgtcgcaaccagtgcccgttggtgtggtgcccgcactgcagcctgcttttgttccagctcagagctaccccgtggctaatggaatgccttaccctgctcccaacgtgccagtagtggggattactcccagtcagatggtggcaaatgtgttcggaacagctggccatccacaggcggcacacccccaccagtcaccttctctggtgaggcagcaaaccttcccccactacgaagcatcctccgcaaccacatccccattcttcaagccgcctgcccagcacctgaacgggagtgccgctttcaacggcgtggacgacggcagattggccagcgcagataggcacacggaggtacccactgggacctgccctgtagaccctttcgaagcccagtgggctgcattggaaaacaagtcaaagcaacgcacaaatccatcacctacaaaccccttttcttccgaccttcagaagactttcgagatcgagctctag

SEQ ID NO: 233445 - DNA, 1923 bp, Artificial Sequence
  Description of Artificial Sequence: Synthetic coding sequence
atgaataagctgcgtcaaagtttcagaagaaagaaagacgtttacgtacccgaggcatcccgaccacatcagtggcagacagacgaggaaggagtgcgcacaggaaaatgctcctttcccgtaaaatacttggggcacgtcgaggtggacgagtctcgtggtatgcacatttgcgaggacgctgttaagcgattaaaagcgacagggaaaaaggcagttaaggctgttctgtgggttagcgcggacgggttgcgggtggtagacgagaaaacgaaagatctgattgttgatcaaaccatagaaaaagtgtctttttgtgcaccggacaggaattttgatcgggcattctcctatatatgcagggacggcaccactcgcagatggatatgtcattgcttcatggctgttaaagacaccggggagaggctttcccatgccgtgggttgcgctttcgccgcttgcttagaaagaaagcaaaagagggaaaaagaatgtggggtcactgccactttcgacgcttcccgcacaacatttaccagggagggttcattccgtgtcacaaccgcgaccgaacaagctgagcgggaagagataatgaaacaaatgcaggatgctaagaaggcagagacagataagatcgtagttggatcctccgtggcccctgggaatacagcgcctagccctagctcccccacatccccaacttcagacgcaactacaagtctcgagatgaataatcctcacgctattcctcgcagacacgcaccaatcgaacagttagctcgtcaggggtcgtttagaggattccctgcactgagtcagaagatgtctccgtttaaacgacagctgtcgctaagaatcaatgagttaccatccaccatgcaaagaaagaccgacttcccgatcaaaaatgccgtgcctgaagtggaaggggaggcagaatctatcagtagcctgtgtagccagattaccaatgccttctctacccccgaagatcccttctcctccgctcccatgaccaagcccgtcactgtggtagcaccacaatcccctacttttcaggctaacggaaccgactctgcgttccatgtcttggccaagcccgctcacactgcgctagcgcctgtggctatgccagttcgggagacaaacccctgggctcatgcaccagacgccgctaacaaagagattgccgctacttgcagtggaactgagtggggacagtcatccggagctgcctcacctgggctgttccaggcgggacaccggcgtactccatctgaagccgaccggtggctggaggaggtctctaagagcgttcgggcacagcagcctcaggcatccgcagcaccgctccagccagtacttcagccccctccacccacggccatttcccaacctgcttcccctttccagggcaatgcttttctcacaagccaacccgtgcctgtaggtgttgttcccgctctacagcccgcattcgtgcccgctcagagctaccctgtcgccaacggaatgccgtacccagcccctaacgtacctgtggtcggaatcaccccaagccaaatggtggctaacgtgtttgggaccgccggtcatcctcaggcagcacatccccaccagagcccctcactcgtgaggcagcagactttccctcactatgaggcctctagcgccaccactagcccttttttcaagccgccagcccagcatctcaacggcagcgcagcgttcaatggggttgacgacggcaggcttgcctctgccgatcgccatacggaggttccaacaggtacttgccccgtggaccccttcgaggctcagtgggcagcattggaaaacaaaagcaaacagaggacaaaccccagtccaactaacccattctctagtgatctgcagaagacatttgagatcgaattatag

SEQ ID NO: 233446 - DNA, 1830 bp, Artificial Sequence
  Description of Artificial Sequence: Synthetic coding sequence
atgtcgagatctgccgcagcttccggaggccctaggagaccggaacgtcacttgccaccggctccctgcggcgctccaggtccacctgagacttgccgcacggagccagatggagccggaactatgaataagctgagacagtcattaagacgcagaaaacccgcatatgtgcctgaagcgagtcggccacatcaatggcaggctgacgaagatgctgttcgcaaaggcacttgtagtttcccagttaggtacctgggacatgtcgaggttgaggaaagtcgcggtatgcacgtctgcgaagatgccgtgaaaaagttgaaggccatgggccgaaagagcgtgaagtctgttttatgggtcagtgctgacggactcagggtggtcgacgataagactaaagatctgttggtggaccaaacaatcgagaaggtcagcttttgtgcccctgataggaacctcgacaaagcattctcatacatttgcagagacggtacaacacggcgatggatttgccattgttttctggccttaaaggactccggcgaacgtctctcacatgctgtggggtgcgcgttcgccgcatgcctggaacgaaaacagaggcgagagaaggagtgtggggttacagcggcttttgacgccagtcgaacgtctttcgccagggaaggcagctttagattaagtgggggtggccgacccgctgagagggaagcccctgataagaagaaggccgaggcagctgcagctccaacagtcgctcccggacctgcccaaccaggtcacgtgtcccccacccctgctacaacgtcacctggagagaagggtgaggctgggacgcctgtggctgctggaacgactgcggcagctatcccccgacgccacgccccactggagcagctggttagacaaggaagcttcaggggcttccccgctctttcgcaaaagaactctccttttaaacggcaattatcactgcggctcaatgagttgcccagcactctgcagcgccgaactgattttcaggttaaagggacagttcctgagatggagcctcctggcgctggagactccgactctattaacgccctgtgtactcagatctccagcagcttcgcttccgcaggagcacctgcaccaggtccacctccggctaccactgggaccagtgcctggggcgagcccagtgttcctcctgccgcagccttccagcccggtcacaagaggacgcctagcgaggccgaaaggtggctggaggaagtatcgcaggtggctaaggcccagcagcaacagcagcaacagcagcagcagcagcagcagcaacaacaacaacagcagcaagcagcttcagtcgccccagtgcctactatgccacctgccctgcagccttttcctgccccagtagggcctttcgatgccgcacccgctcaggtggctgtcttcttgccccctccccatatgcaacctccctttgttccagcataccctggacttggctacccccctatgccaagagtgccagtggtagggattacaccctcccagatggttgccaatgcattttgttcagcagcgcagctgcagccccagcctgccaccttgctggggaaagcaggcgcattccccccacccgcaatccccagcgccccaggcagtcaggcccgacctaggcccaatggagctccttggcccccagagccggctcccgctccagccccagagctggatcctttcgaggcacagtgggccgctcttgaaggtaaggccaccgtcgagaaacccagtaatcccttctctggcgatctgcagaagacttttgaaatagaactttag

SEQ ID NO: 233447 - DNA, 1707 bp, Artificial Sequence
  Description of Artificial Sequence: Synthetic coding sequence
atgaataagctgaggcagtccttgagacggaggaagcccgcttatgtcccagaggcctctcgccctcaccagtggcaggccgatgaggatgccgtgcgaaaaggcacatgtagcttccctgtccgatacttggggcatgtggaggtggaggagtcaaggggcatgcacgtatgtgaagacgcagtcaagaagctcaaggcgatgggcagaaagtcagtgaaatccgtgctctgggtcagcgctgacggcttacgagtagttgacgacaagaccaaagaccttctcgtcgaccaaacaatcgaaaaggtgagcttctgcgctccggaccgcaacctcgataaggctttctcttatatttgtcgagacggcactacacggagatggatctgtcactgctttcttgccttgaaagactccggcgaacgcttatcccacgccgtgggatgtgcatttgccgcatgtcttgaacggaaacagcgaagggagaaggaatgtggtgtgactgccgcttttgacgcatcccggaccagctttgcaagggaaggtagtttccggctgagtgggggtggtcggccagcagaacgtgaggcccctgacaagaaaaaggctgaagcggcagccgctcccacagtagctccgggtccagcccagcctgggcatgtctctcctacccccgctacaacttctccaggcgagaagggagaagccggtactccagtagcagctggaaccacagcagctgcaatcccgaggcgccacgctccattggagcagctggttaggcaagggtcttttcgaggctttcccgctctatctcagaagaactcaccattcaagcgacagttatcacttcgcctcaacgaacttcccagtaccctgcaaagaagaacagacttccaagtgaaagggactgtgcccgagatggaaccaccaggggctggggacagcgactcaatcaacgctctctgtacacagatctcgagttcctttgcctctgcaggagctccggctccaggcccacctcctgccaccacaggaacgtcagcatggggagagccatccgtgcctcccgctgccgctttccagcctggccataagcgtacgccttctgaagctgagagatggctggaggaagtgagtcaggtggcgaaggcacagcaacagcaacaacaacaacagcagcagcaacagcagcagcagcagcagcaacagcaggctgcctcagtcgcccctgtgcccaccatgcctccggctctgcaaccttttccagcacctgtagggccattcgatgccgcacccgcacaggtggccgtgttcctacccccaccacatatgcaaccaccctttgttcccgcatatcccggtctgggttatccacctatgccccgtgttcccgtggtgggaataacccccagccagatggtggccaacgccttctgctcagccgctcagctccaaccccaacccgctactctgctcgggaaggcgggtgcttttccaccccctgctattccatctgcccctggctctcaggcccgtccgagacccaacggcgcaccctggccccctgaacctgcacccgcacctgccccagagttggatcccttcgaagcccagtgggctgccctcgagggcaaggctactgtggagaaacccagtaatcccttttctggagatctgcagaaaaccttcgagattgagctttag

SEQ ID NO: 233448 - DNA, 1446 bp, Artificial Sequence
  Description of Artificial Sequence: Synthetic coding sequence
atgaaggggcgaggtatgcttgtcctgctgttacacgcagtggtcttaggacttccgagcgcttgggcagtcggagcatgcgcacgagcttgccctgccgcttgcgcttgtagcacagtcgaaagaggctgtagcgtccgctgcgatagagcaggcctgctaagagtgccagcggaacttccttgcgaggcggtcagtatcgacctggacaggaatggcctccgctttctcggcgaaagggcattcggcacgcttccctccctgagacggctgtcactcagacacaataacctgtcgtttataactcccggagccttcaaggggctacctcgcctcgccgaattgcggttagcccataacggcgatctcaggtatctgcatgcacggacctttgctgctctatcacgcctgcgtaggttggacctcgcagcctgtcggctcttttcagtgcccgaacggttactggccgaattgccagccctcagggaacttgctgccttcgacaatttgtttcgtcgcgtgcccggagctctgagaggtctcgctaacctgacacacgctcatttagagaggggaaggattgaggcagtcgcttcttccagcctccagggtttgcgcagactccgtagtctgagcctgcaggcgaatcgagtgcgcgctgtccacgctggcgctttcggtgattgtggagttctcgagcaccttctgctaaacgacaatttgctcgctgaacttcccgcagacgcctttcgtggcctgcggcgtctgcggaccctcaatctagggggaaacgccttagatagagtggcaagagcttggtttgcagacttggcagaactggaactgctctacctggacagaaactctatcgcatttgtagaggagggagcatttcagaacctgtctgggctcctagccctgcacctcaacggaaatcggctgactgtgcttgcttgggtagcgttccagcccggattcttcctgggtagactgtttctgtttcgcaatccctggtgttgcgattgtcgccttgagtggcttagagactggatggaaggctcagggagggtaactgatgtgccttgcgccagccctgggtcagtagctgggctggacctgtctcaagtgacctttggcaggtccagtgatggcctctgcgttgaccccgaggagttgaatctgaccacatcttcacccggaccgagcccagaacctgcagccaccacagtgagcagatttagctcactactcagcaaattgctggctcccagagtgcccgtggaggaggctgctaacaccactgggggactggccaacgccagtctgtctgatagtctgagcagccgcggagtgggaggcgcagggagacagccttggtttcttctggcgagttgtctccttcctagtgtggcgcagcacgtggtgttcgggctccagatggattag

SEQ ID NO: 233449 - DNA, 1446 bp, Artificial Sequence
  Description of Artificial Sequence: Synthetic coding sequence
atgaaagggcgtggtatgctagtcttattgcttcacgctgttgttctcgggctgccctctgcatgggcggtgggcgcttgtgctagagcttgcccagccgcttgcgcttgttcaactgtagagagggggtgctccgtgcgatgtgaccgggcaggcctcctgagggtccccgctgagctcccctgtgaggccgttagcatcgatctggatagaaatggactgcgatttttaggtgaacgcgcatttggaacgctccccagtcttaggagattgagtctaagacacaataatctgtccttcataacccccggtgcatttaagggtttgcctcggctggcggaactgcgactcgctcacaacggtgatctgagatacctccacgcgcgtacctttgctgcgctgtcgaggttgcgcagactcgatctggccgcatgccgcctcttctccgtaccagagaggctgcttgctgagcttcccgcactacgggaactggctgctttcgataacttgtttcggagagtgccgggagcactgcgaggcctagccaacctgacgcacgcgcacctcgaacggggaaggatcgaggcggtggcaagctcctccctgcagggactgcgcagactccgctcactttccctccaggctaaccgcgttcgcgcagtacatgcaggcgcattcggtgattgcggcgtcctggagcacttgttgttgaacgacaatctgttagcagagctgcccgctgacgccttcagaggtttgcgaagactcaggactctcaacctggggggtaatgccttggaccgcgtcgctcgcgcttggtttgcagaccttgctgagctggaactgttgtatctggaccggaacagcatcgcttttgtggaggagggagcatttcagaatctcagcggactgctggccctgcatcttaatggtaatcgcctgactgttcttgcgtgggtcgccttccagccagggttctttcttggtagactctttctcttccgaaatccttggtgttgtgactgccgcttggagtggcttagagactggatggagggcagcggccgtgttactgatgtcccttgcgcgtcgccaggttcagtcgccggtctggatctctcacaggtcacattcggcagatcttctgacggtctttgtgtagacccagaggagcttaatttaaccaccagtagcccgggaccgagtccagaaccagctgcgaccacggtgtctaggttttcttctctgctgtccaaactgttagcgccaagagtcccagtggaagaagccgctaacacaacaggcggtctcgccaatgcaagtctcagtgacagtctctcatcccgaggggtgggtggagcaggaagacaaccctggttcctactggctagctgtctgctcccatcagtggcccagcacgtggtttttgggttacagatggactag

SEQ ID NO: 233450 - DNA, 1191 bp, Artificial Sequence
  Description of Artificial Sequence: Synthetic coding sequence
atgcctccgaaaaaggggggtgacggtataaaaccacctccaatcattggacggttcggcacctccctgaagataggcattgttggcctgccaaacgtgggcaagtccaccttcttcaatgtcttgaccaacagccaggccagtgctgagaactttccattttgtaccatcgatcctaatgagagccgcgtacctgttccagatgaacggtttgatttcctatgccagtatcacaaacccgcatccaaaattccagccttcctgaatgtggtggatatcgctggattagttaaaggggctcataacggccagggacttggtaacgcttttctgagccatatctcggcatgtgacggtattttccacctgacccgtgccttcgaagatgatgatatcacccacgtggaggggtcagtagatcctatccgcgatatcgaaattatacatgaggagctgcagctaaaagatgaagagatgatcggaccaatcatagataaattggaaaaagtggcagtgcgtggcggagacaagaaactgaaaccggagtacgacatcatgtgcaaagtaaagagctgggtgatagaccagaaaaagcccgtaagattctaccacgactggaatgacaaggaaatagaagttctaaacaagcatctgttcctcaccagcaagccgatggtgtatctcgtgaatctcagtgaaaaggactatatcaggaagaagaataaatggttgattaaaattaaggagtgggtcgacaaatatgatcctggcgctcttgtgatccccttcagcggtgctctggagctgaaattacaggagctttccgcagaggagcgtcaaaagtacctggaggccaatatgacccagtctgcgctgcccaagattatcaaggctggcttcgccgctctacaactcgagtatttctttacagctggacccgacgaagtgcgtgcgtggactatccgtaaaggaaccaaagcccctcaagccgcaggaaagatccacaccgattttgagaaagggtttattatggccgaagtgatgaagtacgaggacttcaaagaggaggggtcggagaacgccgttaaggccgcagggaagtaccggcagcagggtagaaactacatcgtggaggatggcgatattatcttctttaagtttaataccccacagcaaccgaagaagaagtag

SEQ ID NO: 233451 - DNA, 717 bp, Artificial Sequence
  Description of Artificial Sequence: Synthetic coding sequence
atgatcggtcccattattgacaagctggaaaaggtagccgtgcggggaggtgataaaaagcttaagcctgagtacgatataatgtgtaaggtgaagagctgggtgatagaccagaagaaaccagtgcgcttctatcacgattggaatgataaagagattgaagtgcttaataagcacttgttcctcacttctaagccgatggtataccttgtgaatctcagtgaaaaggactatatccgaaaaaaaaacaaatggctgatcaaaatcaaggagtgggtggataagtatgaccccggagccctggtcatacctttctcgggcgctctggaacttaagctccaagagctgtccgcagaggaaaggcagaagtatctggaagcaaatatgacacaatccgccctgcccaaaatcattaaagccggatttgctgcactgcaactggaatacttcttcaccgctgggccagatgaagtgagagcatggacaatccggaaaggtaccaaggcaccgcaggcggctggaaaaatccataccgattttgagaagggttttatcatggcagaggttatgaagtacgaagacttcaaggaggagggctctgagaacgctgtgaaggcggctggaaagtacagacagcaaggccgaaactacatcgtggaggatggcgacattatttttttcaagttcaatacgccacaacagcccaagaagaagtag

SEQ ID NO: 233452 - DNA, 1251 bp, Artificial Sequence
  Description of Artificial Sequence: Synthetic coding sequence
atgtctagaacctttagcgccaaggggggaagggaccttgtggagggcccacagtacctcatgcctcccaagaagggaggcgatggtatcaagcccccacccatcatcggaagattcggcacttccctgaaaatcggcatcgtcggtctgccgaacgtgggtaagtctaccttcttcaatgtgctgactaattcccaggccagtgcagagaacttccctttctgcactattgaccccaatgaaagccgagtgcctgtgcctgacgagcgctttgactttctgtgccagtaccataagcctgcctctaaaatacccgcattcttaaatgtcgtggatatcgccggtctagtaaaaggcgctcacaacggccagggcctggggaatgccttcctgtcacacatctcagcttgcgatgggatcttccatctcaccagagcctttgaagacgacgacatcactcacgtggaagggtcagtggaccctataagggacatagagatcatccacgaggaacttcagctcaaagatgaggaaatgatcggccctatcattgacaagctcgaaaaagtggcagtcagaggcggtgacaaaaagctgaaacccgagtacgacatcatgtgcaaggtcaagtcatgggtgatcgaccagaagaagccagtcaggttttaccacgattggaacgacaaggagatagaggtcttaaacaagcacctgttcctgacttctaaaccgatggtatatctggttaatctctccgagaaagattacatcaggaaaaagaataaatggctcattaaaatcaaggagtgggtcgataagtatgacccaggcgcactcgttattcccttctcaggggctctcgagttgaagctccaggagctttctgcggaagagaggcagaagtatcttgaagccaatatgacacagtcggcacttccaaaaatcatcaaagccggtttcgcggctctacagctggagtatttttttacagctggccctgacgaagtcagagcctggacaattagaaaggggacaaaggcccctcaagctgctggaaagattcatactgattttgagaagggctttataatggcggaagtaatgaaatacgaagactttaaagaagaaggttctgagaatgcagttaaggccgcagggaagtatcgtcagcagggaaggaattacattgtagaagacggcgatatcattttttttaaatttaacacacctcaacagcctaagaagaagtag

SEQ ID NO: 233453 - DNA, 351 bp, Artificial Sequence
  Description of Artificial Sequence: Synthetic coding sequence
atgccccctaagaagggtggcgacgggatcaaacccccaccaattatcggacgcttcggcactagcctgaagattggcatcgtgggcttgcccaatgtggggaagtccaccttctttaacgtgctcaccaactcccaagccagtgccgagaacttcccgttctgtaccattgaccccaatgaatcaagggttcctgtgcccgatgagcgttttgacttcctgtgtcagtatcataaacctgctagtaagatccctgccttcctgaacgtggtggacattgcaggtttggtgaagggagctcacaatgggcagggactggggaacgcgttcctgagccacatcagcgcctag

SEQ ID NO: 233454 - DNA, 837 bp, Artificial Sequence
  Description of Artificial Sequence: Synthetic coding sequence
atgccccctaaaaaagggggtgatggaataaaacctccacccataatcgggaggttcggaacctctctcaagatcggcatcgtgggccttcccaatgtggggaaatccacattcttcaatgttctgaccaatagccaggcctctgcggaaaactttccgttttgcacgatagatcccaacgagagtagagtgccggtgcctgacgagcggttcgacttcttgtgccagtaccataagcctgcaagcaaaattcccgctttcctgaatgtagtcgacatcgctggcctcgtaaagggcgcacacaatggacagggcttaggaaacgcatttctgtcccacatcagtgcctgtgatgggatcttccacctgaccagggccttcgaggacgacgatataacccacgtggagggatctgtggatccaatcagagacatagagatcatccatgaagagttgcaactgaaggatgaagaaatgatcggccctatcatagataaattagaaaaggtggccgtgcgcggaggagataagaaactgaagcctgaatacgatattatgtgtaaggtgaagtcttgggtgatagaccagaaaaagcccgttcgcttttaccacgattggaacgacaaagagatcgaagtcctcaataaacacctgtttcttacatctaagcccatggtgtaccttgtgaacctttctgagaaggactatattaggaaaaaaaacaagtggctactcgagtccaccgataataaggccgagattatcctcttgaaaatggagatcctctcttcttcgaatctaactcacctgaataataggagacggaacaagatttag

SEQ ID NO: 233455 - DNA, 312 bp, Artificial Sequence
  Description of Artificial Sequence: Synthetic coding sequence
atgatcgggccaatcattgacaagctggaaaaagtcgccgtgcgcggtggggacaaaaagttgaaacctgagtacgacatcatgtgcaaagtgaagtcctgggtaatcgaccaaaagaaacctgtcagattttatcatgactggaatgacaaagagatcgaagtcttgaataaacacttatttttaacaagcaagccaatggtgtacctcgtgaatcttagcgagaaagattacatccggaaaaagaataagtggttgattaagatcaaagaatgggttgacaagtacgaccccggtgctctcgtgatctag

SEQ ID NO: 233456 - DNA, 1329 bp, Artificial Sequence
  Description of Artificial Sequence: Synthetic coding sequence
atgtgtgagctttctcgcgaagacgctccagtcagatggtacaaagatggcctggaggtagaggaaagcgaggccctggtgctggagcgggacggccctcggtgtcggctcgtgttgccggcagctcaaccagaggatggcggtgagttcgtctgtgacgctggagatgacagcgcattctttactgtcaccgtgacagctccgcctgaacgcatagtccacccagcggcacggagtctcgatctgcatttcggcgctcccggaagagttgaattgcgatgcgaagtggcccctgcgggatcacaagtgcgttggtataaggacggactcgaggttgaagctagcgacgcactccagttgggggcagaaggcccaaccagaacattgacgcttcctcacgcccagcccgaagacgctggcgagtacgtgtgcgagaccagacatgaagccattacttttaacgtgatcctggccgaaccgcctgtgcagttcttggcgctagagacaaccccttcgcccctttgtgtggctcccggagaacccgtcgttttaagctgtgaacttagtcgagctggagctccagtcgtgtggtcacataatggacgccctgtgcaagagggcgaaggcttagagctgcacgcagaaggccctagaagagtgctgtgcatccaggctgccggaccggctcacgccggtctctacacatgtcagagcggcgcagctcccggagcacccagcctgagcttcactgtgcaggttgccgaacccctactggtgaagctggtaagtgaactgacgccactgacagttcacgagggtgacgatgccacattcagatgcgaagtctcccccccagatgcagacgtgacatggctcaggaacggcgcagtggttactccaggaccacaggtggagatggcccagaacggtagcagtcggattctcacacttcgaggctgccagctgggtgacgcgggaaccgttaccctccgcgctgggagtacagccacttctgcccgactccatgtgagggagaccgaactactcttcctgcgcagacttcaggacgtgagagccgaagagggtcaagatgtatgtctcgaggttgagactggccgagtgggagccgctggcgctgtaagatgggtgagaggtgggcagcccctgccccacgacagccgcctgtctatggcccaagacgggcacatccacagactgttcattcatggggtaatccttgctgaccaagggacatacgggtgcgaaagccaccacgaccgcaccctggcaagactctccgttcgacgtgagtgccccgttctgtcatag

SEQ ID NO: 233457 - DNA, 4206 bp, Artificial Sequence
  Description of Artificial Sequence: Synthetic coding sequence
atgaaagccagtagcggagaccagggatcgccaccatgctttctgaggttccccagaccagtgagggttgttagcggagcagaggccgagttgaaatgtgtggtcttgggcgagccacctcctgttgttgtctgggaaaagggaggccagcaattggctgcaagcgagcgactgagctttcccgctgacggggctgaacatggcctgcttctgactgcagcattaccgacggacgccggagtttatgtctgcagagcaagaaatgcagccggtgaggcatatgccgctgcagcagttaccgtcctggagcctccagcctcagaccccgaactgcaacctgcagagaggccacttcctagcccaggctccggcgagggagccccagtattcctgaccggacctagaagccagtgggtgctccgcggagctgaggtggttctcacatgccgtgcagggggattgccagaaccgaccctatactgggaaaaagacggcatggccctggatgaggtgtgggactcctcacatttcgcactacaaccgggtcgagcggaggatgggccaggagcctcactagctctgaggatcctcgctgcgagacttcccgattccggcgtgtacgtctgtcatgctagaaacgcgcacgggcacgcccaggccggagcactgttgcaggtgcatcagcccccagagtcgccccctgctgaccccgacgaggcccctgcacccgtagtcgagcctctcaaatgtgctccgaaaaccttctgggtgaacgagggaaagcatgcaaagtttaggtgctacgttatgggcaagcctgaacctgaaattgagtggcactgggaagggaggcccctcctgcctgaccgaaggagactgatgtacagagatcgcgatgggggatttgtgcttaaagttctatattgccaggctaaagatcgaggtctgtacgtgtgtgccgcaaggaatagcgctggccaaacattatccgctgtgcaattgcacgtcaaggaaccaagattacgattcacacgacccctgcaggatgtggaagggagagagcatggtattgctgtcttggaatgcaaagtccccaactctagaatcccgacggcatggtttcgggaagatcaaaggcttcttccgtgccggaaatacgaacagatcgaggaggggaccgtcaggagattgatcattcataggctcaaagccgacgacgatggtatttatctctgcgaaatgcgcggacgggtgcgtaccgtcgccaacgtgacagtgaagggaccaattcttaaacggctgccccgaaagttagatgtgcttgagggggagaacgctgtactgttggtcgagactctcgaagctggcgtagaaggcaggtggagccgcgatggcgaggaactgccggtgatctgtcaatccagctcaggccacatgcatgccctggtcctcccaggcgtaacacgcgaggacgccggtgaagttaccttcagcttgggcaattcaagaacaaccactctccttagggtgaagtgcgtcaaacactctccccctgggccacctattctcgctgaaatgtttaaaggtcacaaaaacacggtcttactgacctggaaaccccctgagcccgcacctgaaacccctttcatctatagactggagaggcaggaagtcggtagtgaggattggatccagtgcttttctatcgaaaaggccggagctgtggaagtgccaggagattgcgtgcccagcgagggggattaccgtttccggatctgtacagtctccggtcacggccgatccccgcatgttgttttccatggctccgctcaccttgttccaacagcacgcctggtggccggtcttgaggacgttcaggtatacgacggtgaggatgccgtcttctctttggacctctctacaattattcaaggcacatggtttttgaacggagaggaattgaaaagcaacgaaccagagggccaggtcgagcccggtgccctcaggtaccgtatagagcagaagggactgcagcataggctgattcttcacgcggtaaagcaccaggactcaggcgctcttgtaggatttagctgtcctggcgttcaagactcagccgcactcactattcaggagtcccccgttcacattctgagtccccaggaccgggtgagccttacttttaccactagcgagcgtgtggtgctgacatgtgagctgtcaagagtggattttcctgctacctggtataaagacggccagaaggtggaggagagtgagttgctggttgtcaagatggacggcagaaaacaccgtttaatcctccctgaggcgaaggtccaggacagtggcgagtttgagtgtcgaaccgaaggcgtatcggctttcttcggggttacagtccaggatccccctgtccacatagtggacccaagagagcacgtctttgtgcacgctattacatccgaatgtgtgatgctcgcctgtgaggtagacagggaggatgccccagtcaggtggtataaagatggacaggaagtagaggagtctgacttcgtagtactggaaaatgaaggtccccaccgacgactggtgctgcccgctacccagccatctgacggaggagagtttcagtgcgtcgcaggcgatgaatgcgcatacttcacagtgacaattactgacgtctcaagctggatcgtgtatcccagcggaaaagtgtacgttgccgctgttcgcctggagcgcgttgtcctgacttgcgaattatgtaggccatgggccgaagtccgttggacaaaagacggtgaggaggttgtcgagagccccgctctgctcttacagaaggaggatacagtgcgaaggttagttctccctgccgtacaattagaggactccggtgagtacttatgcgaaattgacgacgaaagcgcctccttcaccgtaaccgtgaccgaaccacccgtccgcattatttatccgcgtgacgaggtaactcttatagcagtgacactcgagtgtgtcgttcttatgtgcgagctgagccgcgaagatgcccctgtccgctggtacaaggatggcctcgaggtcgaggaatcagaagctctcgttctggagcgggacgggccaaggtgtcgcctcgttctgcccgctgcacagcccgaagacggtggcgagttcgtgtgcgatgcgggtgacgattccgccttcttcactgtgaccgtcactgaaccccctgtgcagtttctcgcactcgaaacaactcccagtcctctgtgtgtggctcctggggaacccgtcgtgctgagctgtgagttgagtcgggctggagcccctgtggtgtggtcacacaatgggagacccgtgcaggagggcgaggggttggagctgcatgccgaaggccctagaagagttctttgtatccaggctgccggaccagcacatgccggtctgtacacgtgtcaaagcggcgctgctcccggagctccgagcctcagcttcaccgtacaggtagccgagcctccggtgagagtggtcgcgcctgaagctgctcagacgagggttcgaagcactcctgggggagacctagaactggtggtccacctgagcgggccaggcggaccagtgaggtggtataaggatggcgagcggttagctagtcagggaagggtccagttggagcaagcgggagcacgccaggtacttagggtacaaggtgcaaggagcggagacgcaggggaatacctgtgtgatgcccctcaggacagcagaatattcctcgttagtgttgaggagccccttttggtgaagctcgtcagcgagttgacccctctgaccgtgcacgagggagacgatgctactttccggtgcgaggttagcccacctgatgctgatgtgacatggctgaggaacggcgcagtggtgacccctggaccacaaaggcagtcctgttgttcttacggcggttgtagaatgtgtggccagaggaaggcccgaatgtgtgtgtcgaagtggcgtcaagccgagtgggtccagagagggccttgtgccggatgtgaggtgggatccccttgtcctaccactctggcctgcccttggcctcgtatgggaactagcacagcatcctcctcaatggtctcttactggcccacgcgcgcacccaccgctgccagggctactactattgctccttggccaggctctgcatag

SEQ ID NO: 233458 - DNA, 3078 bp, Artificial Sequence
  Description of Artificial Sequence: Synthetic coding sequence
atgaaagcctcgtccggagatcaaggctctcccccatgtttcctccgatttccccgaccagtgagagttgtgagcggggcagaagccgaactgaaatgcgtggtgctcggtgagcccccacccgtcgtcgtgtgggaaaaaggcggtcaacaactcgccgcttcagaacgcctcagtttcccagccgacggtgccgagcatgggctcctgctaaccgcagccttacctaccgacgctggcgtatacgtgtgccgggctcgaaacgccgctggagaggcgtatgctgcggcagccgtgaccgtccttgagccaccagcctctgatcctgagctgcagcccgcagagcggcctttgccttctccaggcagcggagagggcgctcccgtgtttcttacaggtcccaggtcccagtgggtccttcggggtgccgaagtggtgctgacttgtagagcaggcggtctgccagagcctactctctactgggagaaagacgggatggccctagatgaagtctgggactcctcccactttgcactccagccaggacgcgctgaggacggtcccggagccagcctcgccttaagaatattggccgcaaggttgcccgattccggagtatatgtttgtcacgccaggaatgcccatggccatgctcaggccggagccctccttcaggtccatcagcctcctgagtcccctccagccgaccccgacgaagcccctgccccagttgtggaacctctgaagtgcgccccaaaaaccttctgggtcaacgagggcaaacacgctaagttcagatgttacgtgatgggcaagccagaaccggagattgaatggcactgggaaggcaggcctctgttaccagaccgacgccgtctgatgtaccgtgatagagacggaggtttcgtgctcaaggtactgtattgtcaggccaaggatagaggcctctacgtctgcgctgcccgtaattccgctgggcaaactctgtccgctgtacagctccacgttaaggaacctcggcttcgctttacccggcctttacaggatgtagaaggacgtgaacatggcattgccgtacttgaatgtaaggtcccaaattcccgaatccccacggcctggtttcgcgaggaccagcgtctgcttccctgtaggaagtacgagcaaatcgaagaggggacagttaggcgcctcattattcacaggctcaaggcagatgatgacggaatatacctttgcgagatgagaggaagggtacgcacagtggctaacgttactgtgaaaggtcctatactgaagcgattgccacgaaagctcgacgtgctagagggcgagaatgctgtactgctcgttgaaacgctggaggcaggtgtagaaggccgatggagcagagatggcgaggagctccccgtcatatgccaatcatcatcaggacacatgcatgccctggtgttacccggtgtgacaagggaggacgcgggagaagtaacttttagtctagggaactccaggactactaccttgctgcgcgtcaagtgtgtcaagcactcacccccaggaccaccaatactggccgaaatgttcaagggccacaagaacaccgtccttctgacctggaagccgccagagcccgctccagagacaccctttatctaccgcctggaacggcaggaggtgggatccgaggattggatacagtgtttctcaattgagaaggctggcgctgttgaagtcccaggagactgtgtcccttctgagggtgattatagatttcggatctgcacagtgagcgggcacgggagatctcctcatgtggtctttcacggttctgcccacctcgttcctacggccaggctagtggcaggcctggaagacgttcaggtgtatgatggggaagacgccgtgttctcacttgacctttcaacaattattcagggtacctggtttctcaacggagaggagttaaaatccaatgaacccgagggacaagtggagcccggtgccctacgctaccgcattgaacaaaagggactgcaacataggctgatacttcacgccgtgaagcaccaggactctggcgctctggtaggattctcctgccctggagttcaggactctgcggcacttaccatccaggaaagccccgtgcacattctgtccccacaggacagggtatccctcacttttaccacctctgaaagggtggtactaacctgcgaactatcaagagtggactttcctgcaacatggtacaaagatggccagaaagtggaagagagcgaactgctagtggttaagatggatggtcggaagcatagactcattctccccgaagctaaggtgcaggacagcggggagtttgagtgtcgcaccgaaggggtgagtgcatttttcggagtgaccgttcaggacccccctgtccacatagtggaccccagggagcacgtgttcgtgcatgccatcacatcagaatgcgttatgctcgcgtgtgaagtagatagagaagacgcccctgtgcgatggtacaaggacggacaggaagtagaagaaagcgacttcgtcgttcttgaaaacgaaggccctcaccgcagactcgtcctgcctgccacacagcctagtgatggaggggagttccagtgtgtggccggagatgagtgcgcatattttacagtgacaatcaccgatgtgagctcttggattgtgtacccctctggaaaggtctatgttgccgcagttcggttagagagggtggtattgacatgtgaactatgccggccatgggctgaggtgcgttggactaaggacggagaggaggttgtggagtcccccgcactgctactgcagaaggaggatactgtgcgtcgacttgtgctgcctgctgtgcagttggaggattccggagaatatctgtgcgagatcgatgacgaatccgctagcttcaccgtcacggtcacagaatcttaccagtcccaggacagtagcaacaacaatccagaactatgtgttctgttgaagaagccaaagactcgcagactgtggagtcggttcccaccctggcgaagaacggcaggtaccgagtag

SEQ ID NO: 233459 - DNA, 5690 bp, Artificial Sequence
  Description of Artificial Sequence: Synthetic coding sequence
atgaaagcttcttcaggggaccagggatcccccccatgtttcttgaggtttcctcggccagtaagggtcgtctctggagccgaggcggagttgaagtgcgtagttctcggggagcctcctcccgttgttgtgtgggagaaggggggacagcagctggccgcttcagagagactgtcctttcccgcagatggagccgagcacgggctgctgctgactgctgctctgcccactgacgcaggtgtctatgtgtgtcgcgctaggaacgctgcgggtgaagcgtatgcagccgctgctgtgacagtccttgaacctcccgctagcgacccagagttgcagcctgcggaaagaccactgccgtccccaggcagcggagagggggctccagtcttcctgaccgggcctcgttcccagtgggtcctccggggagctgaggtggtactgacatgccgggcagggggactccccgagcctaccctgtactgggaaaaagatggaatggcactcgatgaagtgtgggactcatcgcacttcgccctccagccgggacgggctgaggatggacccggtgcgagtctggccctacgtatcttagcggcaaggttgcctgattcaggagtttatgtgtgtcacgcccgtaacgcgcacgggcatgcccaggccggagcacttctgcaagtccaccagcctcccgaatccccacccgctgacccagacgaggctcccgctccagtggtcgaaccccttaaatgcgcacccaaaactttctgggtgaacgaggggaagcacgccaaattccgttgctatgtgatgggaaaacccgaacctgagatcgaatggcactgggagggcaggcctctgcttcccgacaggcgtcgcttaatgtaccgcgacagagacgggggatttgtgctcaaggttctgtactgccaggccaaagatagaggcttgtacgtctgtgcggcaaggaacagcgctggacaaactctatccgccgttcagttgcatgtgaaagaacctcggctgcggtttacccgcccactccaggacgtggagggtcgtgaacatggcattgctgtcctggaatgtaaggttcccaacagccgcatcccaacagcttggttccgggaagaccaaaggctgcttccatgccggaaatatgaacagatcgaggagggcacagtccgccgtctgattatccatcgcctcaaagccgatgatgacggtatctatctctgcgagatgagaggaagggtgaggacagttgctaacgtgacagttaaagggcctatacttaaacgtctgccgaggaaattagacgtgttggaaggtgagaatgccgttctgttagtagaaactctcgaagcaggtgtagaaggacgctggagcagggacggtgaagagctgcctgtaatctgccagtcgtcttcaggccacatgcacgctctcgttctgccaggcgtgacaagggaagacgctggcgaagtgaccttcagccttggcaattccaggaccaccacccttctgagggtgaaatgtgtgaagcatagtccacctggcccaccgatcctcgcagagatgtttaaagggcataagaatacggtgctgctgacatggaagcccccagagccggcacctgagacccccttcatctatcgcctggagcgacaagaggtcgggagcgaggactggatccagtgcttttcaatagagaaggccggtgcagtggaggtacctggggattgcgttcccagtgagggagattatagattcagaatctgcaccgtcagtgggcatgggaggagccctcacgtggtgtttcacggcagcgcacatctggtgcctacggcaagactggtagccggtctcgaggatgtccaggtgtacgatggggaggatgctgtgttttccctcgatctgtccacaataattcagggcacgtggttcctaaatggagaggaattgaaatcaaatgaaccagaaggccaggttgaacctggagctctgaggtacaggattgaacagaaggggctgcagcatcgcctgattctccacgccgttaagcaccaggactctggcgcactggttggtttctcatgtcctggggtgcaggattccgctgcactgacgattcaggaatctcccgtgcatatcctgtcaccccaggatcgggtgtcactcaccttcactacatccgagcgcgttgtgctgacatgtgagctgtccagggtcgatttcccagccacatggtacaaagatggccagaaggtagaggagagcgagctgctggttgtgaagatggacgggaggaaacaccgtctgattctaccagaggccaaagtgcaggatagcggagaatttgagtgtagaactgaaggggtgagcgctttcttcggagtcacggtgcaagatccacctgtacacatagtcgatccaagggaacatgtgttcgttcatgccataacatccgagtgcgtcatgctagcatgcgaagtcgacagagaggacgctcccgtccgctggtataaagatggacaggaagtggaagaatccgacttcgtggtactagagaacgagggaccccatcgcagactggtgctgcccgctacccaaccttctgacggcggtgaattccagtgcgtggccggtgacgagtgcgcctacttcacagtgactatcactgacgtgtctagctggattgtgtatccttctggcaaggtgtacgtcgccgctgtgcgactggaacgggttgtgctaacatgcgagctgtgccggccttgggcagaggtcagatggacgaaagacggagaggaagttgtcgagagtcctgccctgctgctgcagaaggaggacactgtccgcagactggtattgccagccgtccagctcgaggattccggggaatatctctgtgaaatagacgacgaatctgcctcctttaccgtgacggtcaccgagcctcctgttcgcatcatataccctcgcgacgaggtcaccctcatagccgttaccctcgagtgcgtggtcctgatgtgcgagttgtctcgagaggacgccccagtgcgatggtacaaagatggacttgaggtcgaagagtccgaggccctcgtcctggagagagatggccctcgctgtagactggtacttcccgcagctcagcctgaggatggcggagagttcgtctgcgatgcgggagatgactccgccttcttcacggttacagtgactgcacccccagagcggattgtgcaccctgccgctcggtccctggatttgcacttcggcgcacctgggagagttgaactcaggtgcgaagtcgccccagctggtagtcaggtgagatggtataaagacggactggaagtcgaagccagcgatgccttgcagctgggcgctgaaggtccaacacgaactctcaccttgcctcacgcacagccagaagacgctggcgagtacgtgtgcgagaccaggcacgaggccatcacattcaatgtcattctagccgaaccgccagtccaattcctggccttagaaaccactccttccccattatgcgttgcgccaggagaaccagtggtgctgtcttgcgaactgtctagggctggcgcacctgtggtctggagtcacaacggacgccctgtgcaggaaggggagggcttagagcttcatgcagagggcccaaggcgcgtactatgcatccaggcagccggaccagcacacgccggtctttacacatgccagagcggcgctgccccaggtgccccatcactctcgttcaccgttcaggtcgcagagcccccagtccgcgtggtggccccagaggccgcacaaacccgggtacgctccaccccaggtggagacctggaacttgtggttcacttgagcggccctggcggtccagtgaggtggtataaggacggcgagagactcgctagccaaggccgtgtacaactcgagcaggccggagctaggcaggtcctcagggttcaaggggctcggtcaggtgacgccggagagtacttatgcgacgctccacaggatagcaggatattcctggtgagtgtcgaagaaccgctgctggtgaagctcgtctctgaactgacacccctgactgtgcacgagggagatgacgctacctttaggtgcgaagtgagccctccagacgcagacgtgacttggctgcgcaacggagcagtggtgactcccggaccgcaagtggaaatggctcagaacgggagctctaggattctgacactgagagggtgccagttaggggacgccggaaccgtcacgctgcgagccggttcaaccgccaccagtgcccgattacacgtccgcgaaactgagctcctatttttacgcagattgcaggatgtcagagctgaagagggccaggacgtatgcctggaagttgaaaccggcagggtaggtgccgctggggctgttagatgggtgaggggcggtcagccactccctcatgactctcgcttgtcaatggcacaggatgggcacatccaccgcttgtttatccatggagtcattctggcggaccagggtacctatggatgcgagtcacatcatgaccgcaccctcgcccgtttgagcgtgcgccctcgtcagttacgcgtccttcgccctctggaagatgtgaccatctctgaaggtggaagtgctacattccagctggagctaagccaggagggggtgacaggagagtgggctaggggcggagttcagctgtacccagggcctaagtgccacatccactccgatggccaccgtcatcggctagtattaaacggactcggactggctgactcagggtgtgttagctttacagcagactcattgcggtgcgcagcgaggctcatagtaagggaggtcccggtaacgatagtgcgaggcccacatgatctggaagttaccgagggggatacagctacttttgagtgtgaacttagccaagccctcgccgacgtgacctgggagaaagatgggaatgctctgacgccgtcccctcggctgcggctccaggcactcgggacacgaaggctgctgcagctgagacgctgcgggccttctgatgctggaacctattcctgcgcggtgggtaccgccagggccggacctgtccgcttgaccgttcgcgagagaaccgtagcagtcttgtcagaactgcggagtgtttccgcccgagaaggtgatggggcaacatttgagtgtaccgtctcagaggtcgagactactggcaggtgggagttgggaggcagacccttacgccctggagcccgtgtacgaataaggcaggaggggaagaagcatattctagtgctttctgagctgagggccgaggatgcaggagaagtgcgattccaggcgggacctgcccagtcactggctctgttggaagtggaagccctaccgctccagatgtgccgccatcctcccagggagaaaacagttctggttgggagacgagctgtgttagaagtcacagtctcccggtccggtgggcacgtgtgttggctacgagaaggggctgagctgtgtccgggtgataaatacgagatgagatcccacgggccaactcacagtctggtaatacacgacgtccgaccggaagaccagggcacttattgctgccaagccggacaggacagtacccatacgagactgctagtcgaggggaacta

SEQ ID NO: 233460 - DNA, 2682 bp, Artificial Sequence
  Description of Artificial Sequence: Synthetic coding sequence
atggaaccaccactgcccgtgggtgcccaacctctcgctactgtggaaggtatggagatgaagggaccattaagggaaccgtgcgccctgacgcttgcgcagcgtaatggtcagtatgaactgatcattcaacttcacgagaaggagcagcacgtccaggacattatacctatcaactctcatttccggtgtgtgcaggaggcagaggagacactattaatcgacatcgcaagtaattcaggatgcaagatccgtgttcagggggattggattcgcgaaagacgcttcgaaatccctgacgaagagcactgcctcaaattcttatccgccgtcctcgctgcacagaaggcacagtctcagctgcttgttcctgaacagaaggacagcagtagttggtatcagaaactcgatactaaagacaagccaagcgtcttttctgggctactaggatttgaggacaactttagcagcatgaatttagataagaagattaattctcagaaccagcccaccggaattcatagagagccaccccctccacccttttccgtaaataaaatgctgcccagagaaaaggaagcctccaataaagagcaaccaaaggttaccaacaccatgaggaagctctttgtccctaacactcagtcggggcagcgcgaaggactgattaagcacattctggcaaaaagagaaaaagagtacgtgaacatccagacctttcggttctttgtgggaacctggaatgttaacggacaatcacccgattcaggtctggagccatggctgaactgcgacccaaatcctcccgacatctactgcatcggctttcaggagctggacctgtccactgaagcttttttttatttcgaaagtgtgaaggaacaggagtggtccatggcggtcgagaggggtctgcacagcaaagccaagtacaaaaaagtacagctggtgcggctggttgggatgatgctgctcatcttcgcacgcaaagaccaatgtagatacattagggatatcgccactgagacagtgggtactggcatcatggggaagatgggtaacaagggcggtgtcgcagtccggttcgtcttccataatacgaccttttgtattgtcaactctcatctagcggctcatgtggaggactttgagcggagaaatcaggactacaaggacatctgtgctaggatgtctttcgtggtcccaaatcaaacactgccacagctgaacatcatgaagcacgaagtggtgatctggttgggcgacctgaattatcgactctgtatgccggatgcgaatgaggtcaaatcactcatcaacaagaaagatctgcagaggctattaaagtttgaccagctcaatattcagagaacacagaaaaaggcttttgtggatttcaatgaaggggaaatcaaatttattcccacttacaaatacgacagcaaaactgatcggtgggactcttcgggcaagtgtagagtgccagcatggtgtgataggatcctgtggcgcggaacaaatgtgaatcagctgaactataggtctcacatggagctgaaaacaagcgatcacaagccagtgtcagcattgtttcacatcggggtcaaggtcgttgatgagagaagataccgcaaggtgtttgaggattctgtgcggataatggacagaatggaaaacgatttcctgcctagcctagaattgagccgaagggaattcgtgtttgaaaacgtgaagttccgtcagttacaaaaggagaaatttcaaatttcaaacaatggacaggtgccctgccactttagctttattcctaagttaaatgattctcagtattgtaaaccttggctgcgggctgagccttttgagggctatctggaaccaaatgagacagtggacatcagtcttgatgtctatgtgtcaaaggactccgtgacaattcttaactccggtgaagataagatagaggatatactcgttctccatctcgataggggtaaggactacttccttactatatccggaaattacctgccatcgtgttttggtaccagtctggaagccctttgtcgtatgaagcgcccaataagagaggtgcccgtcactaaactgattgacctggaaaaaagtctcctgcaaatggttccgttggacgagggggcatccgagaggcccttacaggtgcctaaggaaatctggcttctagtcgaccacctgtttaagtatgcctgtcaccaagaagatctgtttcaaactccgggaatgcaggaggaactgcagcaaattatcgactgccttgacacctctatccccgaaaccatcccgggtagcaaccactctgtagctgaagcgctcctgatcttcctggaggccctccctgaaccggttatctgttacgagctgtaccaaagatgtttggactctgcttacgacccgcgaatttgtcgccaggtgatcagtcaactgcctaggtgtcatcgtaacgtctttcgctatctgatggcattcttgagagagctgctgaagtttagtgagtacaactcagtgaacgcaaacatgattgcaacactgtttacgtctctgctactgagaccccctcccaatctgatggcgaggcagacaccaagtgatcgtcagcgggctatacagttcctactgggttttcttctaggttcggaggaagactag

SEQ ID NO: 233461 - DNA, 2706 bp, Artificial Sequence
  Description of Artificial Sequence: Synthetic coding sequence
atggaaccaccattgcccgtgggagcacagcccctggccaccgtggaagggatggagatgaagggtcctctgcgcgaaccctgcgcacttactctggcgcagagaaatgggcagtacgagctgatcattcagttgcacgagaaagaacagcacgttcaagatatcatacctatcaactctcactttaggtgcgtgcaggaagccgaagagaccctgttgatcgacattgcttccaattccgggtgcaaaatccgagtgcagggtgactggatccgtgagaggagatttgagatcccagacgaagagcactgtctgaagttcttgagtgccgtcctcgccgctcagaaagcccaatcgcaactgctcgtcccagagcagaaagattctagcagttggtaccagaagttagacaccaaggataaaccaagcgtttttagtggcttgctggggtttgaagacaacttcagctccatgaatcttgataagaaaattaatagccaaaaccagcccactggcatacaccgtgaaccgccaccaccacctttctctgtgaacaagatgttacctcgagaaaaggaagcatccaacaaggagcagccaaaggtgactaataccatgaggaagctgtttgtccctaacacccagagcgggcaacgagagggcctgatcaagcacatcctggcgaaaagggagaaagagtacgtgaacatccaaacctttcggttcttcgtgggtacatggaacgttaacggccagtctccggactccggcttggagccctggcttaattgtgacccaaaccctcctgatatctattgcatcggatttcaggaattggacctctctaccgaagcgtttttctattttgagtcagtgaaggagcaggaatggagcatggctgtagagagaggtttgcactcgaaggccaaatataaaaaggtccagttggttcggctggtgggaatgatgctgttgattttcgcccgaaaagatcaatgtcgatacattcgggacattgccaccgagaccgtggggactgggattatgggaaaaatggggaataaaggtggagtggccgtgcggtttgttttccacaatacaactttctgtatcgtcaattcccatctggccgcacacgttgaagacttcgagagaaggaaccaggactataaagacatttgtgcacggatgagtttcgtggtccctaatcaaaccttaccccagctcaacattatgaagcacgaggtcgtgatctggctgggtgatttgaactaccgcctgtgcatgccagatgctaacgaagtgaagagcctgatcaacaagaaagatctgcagcgtctgctgaagtttgaccagctcaacatccaaagaactcagaaaaaagcattcgtggacttcaatgaaggcgagatcaagtttattcctacgtacaaatacgattctaagactgatagatgggactcatctggtaagtgtagagtgcctgcctggtgcgaccgcatcctgtggaggggaaccaatgtcaatcagctcaactacaggagtcacatggaactgaagaccagtgaccataagccggtctcagccttgtttcacattggcgtcaaagtggtggacgagagacgctatcggaaagtgtttgaagactctgtaagaattatggacaggatggaaaacgacttccttccatcactggaactgagccgtcgggaatttgtgttcgagaatgtgaaattccgccagcttcagaaggagaagttccagatatcgaacaatggccaggtaccatgccacttcagcttcatcccaaagctcaacgacagccagtactgtaagccttggctccgggcagagccttttgagggctacctggagccaaacgagaccgtggatatcagcctagatgtttacgtgtctaaagattcagttaccattctgaactccggagaggacaagatagaggatatcctagtcttgcatctggataggggcaaggactattttctcactatctctggtaattacctgccttcatgttttggtaccagtctggaggccctctgtcgaatgaaacggcctatccgcgaagtccctgttaccaaactgatcgacctcgaggaagacagctttctggaaaaggaaaaatcgcttctgcagatggtaccccttgatgaaggtgcatccgagaggccactgcaggtcccaaaagagatttggctgctcgtcgatcatcttttcaagtacgcatgccatcaggaggacctgttccagacacccggtatgcaagaggagctgcagcagatcattgattgcctggatacaagcattcccgaaaccatcccaggctctaatcatagtgtggcggaggccctgctcattttcctggaagcactaccggaacctgtgatttgttacgagttgtatcagcgatgcctggacagcgcatacgatcctagaatttgtcggcaggtgatcagccagctgccaaggtgtcatcgtaatgtttttcgttaccttatggccttcctccgggagctgttaaagttttcagagtacaacagcgtgaacgcaaatatgatcgccacgttgtttacgagcctgctcctgaggccaccacctaatctgatggccagacaaactccttcagatcggcaacgagcgattcaatttttgctagggtttctgctcggctccgaggaggattag

SEQ ID NO: 233462 - DNA, 2445 bp, Artificial Sequence
  Description of Artificial Sequence: Synthetic coding sequence
atgcacctcgaaggccgagacggaagacgctaccctggggcacctgccgtcgagctgctccagacctcagtgcccagcgggttagccgaactggtggctggcaaacggcgtctccccaggggagccggaggagcagaccctagccatagttgtccccgaggcgctgcaggtcagtcctcatgggcccctgccggacaagaattcgcctctttcctgactaaaggccgtagccactcttccttgccacagatgtctagctcccgcagcaaggattcttgctttactgaaaacacgcctctgctgcggaattctctgcaggagaaaggatcccgctgtatccctgtgtatcatcctgagtttataaccgcagaagagtcatgggaggatagctctgctgactgggagcgcagatatctgctgtctcgcgaagtttcaggtctgtctgccagcgcctcaagcgaaaagggggatctcctagacagtcctcacataaggttgcgcctgtccaagctaagaaggtgtgtgcagtggttgaaggtcatgggactgttcgctttcgtggtcctttgttctatcctgttctcactgtatccagaccagggcaaactgtggcaactgctggcattaagtccactggaaaattatagcgtaaacctgtcatcacacgtcgactccacattattgcaggtggacctggcaggtgctctggtcgcaagcgggcctagccggcctggtcgagaggagcacatcgttgtggagcttacacaggctgacgccctgggaagtcgctggcggaggccccaacaagtgacacacaactggactgtgtatctgaacccccgtagaagtgagcattcagttatgagtaggacctttgaggtgctgacaagggagaccgtctcaatcagtattagagccagcctgcaacagacccaggccgtgcccttgctcatggcccaccagtatcttagaggttcagttgagacccaggtaaccatcgctacagcaatccttgctggagtgtatgccctgatcatcttcgagaggccatccctgactcacgttgtcgagtggattgattttgagacactggccctgctctttgggatgatgattctcgtcgctatcttttcggagaccgggttctttgactactgtgccgtgaaagcctatcggctgtctcgtggaagggtgtgggcgatgattatcatgctatgtctcatcgcagcggtcctgagcgcatttttggataacgtcacaaccatgttattatttactcccgtcacgatccggctgtgtgaggtgctcaacttagatccgagacaggtacttattgcggaggtgatatttacaaatataggcggagccgcaacagcgatcggagatccacccaacgtgataatagtttctaatcaggagctacgtaagatgggcctggactttgcaggctttacagcccacatgttcataggaatttgcctggtgctgctcgtgtgttttcccttactccgcctactttattggaatcggaagctgtataacaaagagccatccgaaatagtggagttgaagcatgagatccatgtttggaggttaacggcacaaagaattagccccgcaagtagggaagagacagcggtcagacggcttctcctcggaaaagtgctggcccttgaacatttgttggcccgaagattgcataccttccatcgacagatttcccaggaagataagaactgggaaactaacatccaagaactgcagaaaaagcatagaatctccgacggaatcctactagccaagtgcctaaccgtcctcgggtttgtaatattcatgttcttcctgaacagtttcgtacccggaattcacttagatctgggatggatcgccatcctcggggcaatttggcttctgattcttgctgacattcatgactttgaaattatattacatcgggtcgagtgggccacattgctgttctttgctgcgcttttcgttctaatggaggctttagcccacctgcaccttattgagtatgtgggggaacagacagctctgctaatcaaaatggtgcccgaagaacagcgattgatcgcagccattgtgctcgtggtctgggtgtctgctttagctagttcactaattgataatatcccctttactgcaactatgattcccgttctgcttaacttgtcacacgaccccgaggtcggcctccccgcacccccactgatgtatgccctcgcgtttggcgcttgtttgggtggcaacggaaccctgattggcgctagcgctaatgtcgtgtgtgccggaattgctgagcagcatggttacggcttttcctttatggaattttttcggctgggtttccctatgatggtggtatcctgcacagtgggtatgtgttacctgttggtagcacacgtggtcgtaggttggaattag

SEQ ID NO: 233463 - DNA, 2517 bp, Artificial Sequence
  Description of Artificial Sequence: Synthetic coding sequence
atgcatctcgagggcagagacgggagaaggtatcctggcgcacccgcagtcgaactgctgcagacctcagttccttctggcctggccgagctggtagccggtaaaaggaggttaccacggggagcaggcggtgccgatccttcccattcttgtccaagaggagccgctggacagagcagctgggcccctgctgggcaagagttcgcttcctttctgaccaaaggcagatcacatagctccctgcctcagatgtcgagttctaggtcaaaagatagttgtttcaccgaaaacacccccctgcttaggaactcactgcaagaaaagggatcccgctgcatacctgtgtaccaccctgagttcattacagctgaggaatcgtgggaagattcatctgccgattgggagagaaggtatcttctgagccgggaggtgtccggactgtccgcctctgcttcttccgagaaaggggatctccttgacagtcctcacattagactgcgcctgtccaagttgaggaggtgtgtgcagtggctgaaagtcatgggcttgttcgccttcgtggtcctctgcagtatcttgtttagcttatatcccgaccaggggaaattgtggcaattgctagcgctttctcctttggaaaattactccgtgaacctctcatcacatgtcgatagcaccctgctgcaggtcgacctggctggtgctctggtggcatccgggccttcccggcctggcagggaagaacacatcgtcgttgaactgacacaagccgacgcgctgggctcccgctggagacgaccgcagcaggtgacccacaactggaccgtatatctcaatcctaggcggagtgagcactcggtgatgagccggacgttcgaggtgctgacacgcgaaactgtaagcatcagtatacgggcaagcctgcaacagactcaggcagtgcctctgctaatggcccaccagtacctccgcggaagtgttgagacccaggtgacaattgccactgctatcctggccggagtgtacgccctgattatcttcgaaatcgttcaccgcacactcgccgctatgctgggttctcttgcagccttggcggcattggctgtaatcggggatagaccctccctgacacacgtggtagagtggatagatttcgagacactggcactgctttttggtatgatgattctggtggctattttcagcgaaactggcttcttcgattactgcgcagttaaagcttatcggctttcccggggaagagtgtgggctatgataatcatgctgtgcctgattgccgctgttctctcagctttcctggacaacgtaacgacaatgctgcttttcacaccagtgaccattcgcctctgcgaggttctgaacctagatcctcggcaggtcctgatagccgaggtaatttttacaaatatcggaggagcagctactgccattggcgatcctccaaacgtcatcatcgtgtccaaccaggaacttagaaaaatgggcttggacttcgccggatttaccgcccatatgtttataggcatttgtcttgtgctattggtgtgcttccccctactgcgcctgctttactggaaccggaagctttataacaaggagccatcagaaatcgtcgagctgaagcacgagatccacgtgtggcgcctgacagcccagcggattagcccagcgagtcgcgaagaaaccgcagtgcgtagattgttgctgggaaaagtgctggcactcgagcatttgctcgccagaaggcttcacacttttcatagacaaatcagtcaggaggataagaattgggagaccaacatacaggaactgcagaagaagcaccgaatcagtgatggtattctgctagcaaaatgtctaacggtacttggtttcgtgatcttcatgttctttctcaattcatttgtgcctggcattcacttagatcttggctggattgcaatcttgggagctatatggctgctgattctggccgacattcacgatttcgaaatcattttacaccgggtcgaatgggccactttgcttttttttgccgctttatttgtactcatggaagccctggcccacctccaccttattgagtacgtgggagagcagactgcattgttaatcaaaatggttccggaggagcaaaggctgatcgccgcaatagtgctggtggtctgggtgtccgcactggccagcagtctaatagacaacatccctttcacagccactatgatcccggttctactgaacctgagtcatgatcccgaagtcggtctacctgctccccctcttatgtacgcacttgcatttggcgcatgtctcggtggcaacggaaccctgataggggcatctgctaacgtcgtgtgcgccggaatcgccgaacagcacggttatgggttctcattcatggaattctttagactgggattccccatgatggtggtatcttgtaccgttggcatgtgctatctgttagtggcccatgtagtagtcggctggaactag

SEQ ID NO: 233464 - DNA, 2007 bp, Artificial Sequence
  Description of Artificial Sequence: Synthetic coding sequence
atgcatttagaaggtcgggatggccgacggtacccgggagctccagcagtggaactgctgcagacctcagttccatcaggcctcgctgaactagttgctggaaaacgtcgtctgcctcggggtgctgggggagcggacccaagccatagctgccccagaggcgctgctggacagagttcctgggcccctgccggacaggagtttgcttcattcctgacaaaaggccgatctcactctagtttaccccagatgagtagttctaggtccaaggattcatgttttacagaaaatacacccctgctgcggaactcactgcaggaaaaagggtctcggtgtatcccagtgtaccacccagaattcataacagcggaagagtcttgggaggacagttcagctgactgggaaagacggtacctgctcagtcgcgaagtgtcaggtctgagcgcgtccgctagcagcgaaaagggagacctgctcgactcacctcacatcagattgcggctcagtaagctgcgaagatgcgtgcaatggctgaaagtaatgggcctgtttgccttcgtggtcctctgctccattctgtttagcctatatcctgaccagggcaagttgtggcagttactggcattgagccccttagaaaactattcagtgaatctctcgtctcatgtagacagcacactgctgcaggttgatctggccggtgccttagtggccagcggaccatcccgcccagggcgtgaagagcatatcgtggttgagttaacccaggcagatgcccttggatctagatggcgccgtcctcaacaggtgacacacaactggacagtctacctgaaccctcgtcgatcagagcacagcgtcatgtccaggacctttgaggtgctcacccgtgaaactgtttctatcagtattagggctagtcttcagcagacacaggccgtgcctctgttgatggcacaccagtacctccgcggatcagttgaaactcaagttaccatcgccacagctattcttgcgggtgtatatgctctcatcatttttgagatagtccaccggaccctggccgctatgttggggagtctcgctgcacttgctgctttggctgtcataggagatcgtccgtcactcacccatgtcgtcgagtggatcgatttcgagacccttgccctgctgttcggaatgatgattctggtagcaatattctccgagaccggattttttgattactgtgcggtcaaggcgtacagactctccaggggccgagtgtgggccatgatcatcatgctctgtctcattgccgcagtcctatcagcctttctagacaacgtgacgacaatgctgctctttacccccgtcaccatcagactgtgcgaggtacttaatctcgatccacgccaggttcttatagccgaggtgattttcaccaatatcggaggtgcagccacggccatcggtgatcccccaaacgtgattatagtcagcaaccaagaattgagaaaaatgggcttagattttgccggattcacggctcacatgttcatcggaatctgtttagtgctccttgtgtgcttcccattgcttaggctcctttactggaatagaaagctatacaacaaggagccttccgaaatcgttgagctgaagcacgagatacatgtctggaggttgacggcccagagaatttcacccgcttcaagggaagaaacagccgtccgtagactgcttttgggtaaagtactggcgctcgagcacctgctcgcaagaaggctccacacttttcatagacagatatcacaggaggataagaactgggagacaaacatccaggagcttcaaaagaagcacaggatatcggatggtattctactcgcaaagtgtctgacagtgctcggatttgtcattttcatgttcttcctgaatagtttcgtgccgggaatccacctggacttaggcggactaggtttggtgcaggccggacggtattatttgagcacccctgagagttag

SEQ ID NO: 233465 - DNA, 795 bp, Artificial Sequence
  Description of Artificial Sequence: Synthetic coding sequence
atgcacctagagggtcgagacggtaggcggtacccaggtgcccctgccgtggagctgctgcaaacctcagtaccaagcggccttgccgaactcgtcgcaggaaaacgccgactgcccagaggagctgggggtgccgacccatcccactcttgtcccagaggggctgccggtcagtcctcttgggccccagccggtcaggagttcgcatccttcctcactaaaggaagaagtcactccagcttgccccaaatgagcagctctcggtccaaagacagctgttttaccgaaaacacccccttactgcgcaattccttgcaggagaagggcagccggtgtattccagtgtaccaccctgagtttatcacagccgaagaatcctgggaagactcttcggccgactgggagcggaggtatctcttgagcagggaggtctcaggcctttccgcttctgcatccagcgagaaaggcgacctcttagattctccccacatccggttgcggctgtctaagctgaggagatgtgtacagtggctgaaagtgatggggctattcgcatttgtagtgctttgtagcatcttgttctctctgtaccccgaccagggcaagctgtggcagttactggctttgtcccctttggagaattattctgtgaacctgtcttctcatgtggactctactctcctgcaggttgatcttgcaggggctctggtggcttcaggtccttccagacccggtcgggaagaacatatcgtggtcgaactcacacaggcagatgccctggggagtaggtggtag

SEQ ID NO: 233466 - DNA, 657 bp, Artificial Sequence
  Description of Artificial Sequence: Synthetic coding sequence
atgcacctggaaggcagggacgggagacgatatcccggagcacctgcagtggaactgctccagacaagcgtgccaagtggattggccgagttagtggctgggaaacgcagactccctcgcggtgcaggcggagcagatcccagtcattcttgtccccgtggggctgctggacagagctcatgggcacccgctggccaggagttcgcgtcattcctgactaagggccgttctcacagctctctcccccagatgagcagcagtaggtcaaaagactcctgttttactgaaaatacccccttactgcggaacagcctgcaggaaaaaggaagccgttgcatcccagtgtatcatcccgagttcattacagccgaagaaagctgggaggatagtagcgccgattgggaacggagatacttgctgtctagggaggtatccgggctcagtgcatcagcctctagcgagaagggcgatcttctggacagcccgcatatccggctccgactttccaaactgagacggtgcgtacagtggttgaaggtcatgggtctgtttgcatttgtggtgctttgttcagttactcataactggaccgtctatttaaacccacggaggtcagaacactcggtgatgtccagaaccttcgaagtgctgacttag

SEQ ID NO: 233467 - DNA, 801 bp, Artificial Sequence
  Description of Artificial Sequence: Synthetic coding sequence
atggggtcaaaaaccctgcccgcaccagtcccaatccacccttcattgcagttaactaactactcctttcttcaggccgtaaacggcctgccgacggtgccaagcgatcatttgccaaatctttacggtttcagcgctcttcacgccgtccacctgcatcagtggacactagggtatcccgcaatgcacttacccaggtcctccttttctaaagtccccggaacagtgagtagcctggtggatgccaggtttcagctcccggcattcccctggttcccccacgtcattcaaccaaagcctgagattacagccggagggtccgtgcctgctcttaagactaaaccacgcttcgactttgctaatcttgccttagcagccacccaagaagatcccgctaaactgggaagaggagagggaccaggcagtcccgcagggggactgggagcacttctcgacgtcaccaagctctccccagagaaaaagcctactcggggtagactcccctctaaaacaaaaaaggaatttgtttgcaaattttgtggacggcattttacaaagtcctataacttactgattcatgagcggacacatacggacgaacgaccgtatacttgcgacatttgtcataaggccttccgaaggcaggatcacctgagggaccaccgttatattcattcaaaggaaaaacctttcaagtgtcaagagtgtggtaagggcttttgccagtccaggacactagcagttcacaagacattacactcccaggttaaggagctcaagacttcaaaaataaagtgttag

SEQ ID NO: 233468 - DNA, 801 bp, Artificial Sequence
  Description of Artificial Sequence: Synthetic coding sequence
atgggcagcaaaacacttcctgcccctgttcctatacacccatctctgcagctgactaattacagctttctccaggccgtgaatggcctgcctacggttcccagcgatcaccttccgaacttatacggtttctccgcgctccatgcggttcatttgcaccaatggacactcggctatcctgccatgcacttgccgagatcttcctttagcaaagtgccgggtacggtgagtagtctcgtggacgcaagatttcagctgcccgcatttccttggtttccacacgtcatacagcccaagcctgaaatcactgctggcggatccgtgcctgcactgaaaactaagccgagattcgattttgccaaccttgccctggccgctacccaggaggacccggcaaaactgggacgcggagagggcccaggttcacccgcaggtggactgggagccttgttagacgtgactaagctgagtcctgaaaagaagccgactcgagggagactcccttcaaaaaccaaaaaagaattcgtttgtaaattctgcggcagacactttactaagtcgtacaatctcctgattcacgaacgaactcataccgacgaaaggccatatacgtgcgatatttgccataaggcatttcgaagacaagatcatttgagggaccaccgctatattcattcaaaggagaagcctttcaagtgccaagagtgtggcaagggcttctgtcagtccaggaccctggctgtccataagacgctgcactcacaggtaaaagagctgaagaccagtaaaattaaatgctag

SEQ ID NO: 233469 - DNA, 939 bp, Artificial Sequence
  Description of Artificial Sequence: Synthetic coding sequence
atgggctcaaaggctttaccggctcccatcccccttcacccttccctgcagttgacaaattactctttcctccaggcagtaaacacttttccagctacagtcgaccatcttcaggggctctatggactatctgcggtccagacgatgcacatgaaccactggacccttggctaccccaatgtccatgagatcacacgctcaaccataacagagatggcagctgcccagggtctggtggacgcaaggttcccgttccccgcactccctttcacaacacacctctttcatcccaaacagggtgcaattgcccacgtccttcctgcgctgcacaaggatcgtcccagattcgacttcgccaatctagcggtggccgctacacaggaggacccgcctaagatgggagacctgagtaagctgtcgccagggctggggtcacctatcagcgggctgagtaagttaacaccagatcgaaaaccatcacgcggacgcctgccttcaaagacgaagaaggaatttatttgcaaattttgtggtagacacttcacaaagtcatacaaccttctgattcatgaaaggactcacaccgacgagcgtccgtatacttgtgatatttgccacaaagcttttcggagacaggaccaccttcgagaccaccgctatatacacagcaaggagaagccattcaagtgccaagagtgcggaaagggattctgtcagtctaggactctcgccgtgcacaaaaccctacacatgcaggaatccccccacaagtgtccaacgtgcggtaggaccttcaaccaacggagtaatctgaaaactcatctcttaacccataccgacatcaagccctattcctgcgagcaatgcggcaaagtgtttcgtaggaactgcgacttgaggaggcattcactgactcacaccccgcgtcaagacttctag

SEQ ID NO: 233470 - DNA, 831 bp, Artificial Sequence
  Description of Artificial Sequence: Synthetic coding sequence
atgggttctaaagccctgccagccccaatccctctccatccatctctgcagctgactaactattcatttctgcaggccgtcaatacttttccggcaaccgtggaccacctccaagggctttatgggttaagtgccgtccaaacgatgcacatgaaccattggaccctgggctatcccaatgtacatgagattactcgaagtactattactgaaatggctgcggcacaaggcctcgtcgatgcacgctttcctttccccgctcttccctttaccacacacttgttccatcccaagcagggtgcaattgcacatgtgctcccagcacttcacaaggatcgtcctaggtttgactttgccaatcttgctgtagccgctactcaggaggacccccctaaaatgggcgatctatccaagctttcccccggacttgggtcaccaataagcggtttgagcaagttgactccagacaggaaaccgagtcgcggtcgcctgcccagcaaaacaaaaaaagagtttatctgcaaattttgtgggagacacttcactaagagctacaatctattgattcacgagagaacccacaccgatgagaggccatatacatgcgacatatgccacaaagccttccgaaggcaagaccacctgagagaccatcgttacattcattccaaggagaaaccatttaagtgtcaagagtgcggcaagggcttctgccagagccgtactttggccgtgcataaaacactccatatgcaaaccagctcccccaccgccgctagtagcgcagcaaagtgctctggggaaacggttatttgtggcggtactgcctag

SEQ ID NO: 233471 - DNA, 1302 bp, Artificial Sequence
  Description of Artificial Sequence: Synthetic coding sequence
atggggttgagagcagaagagggaaaaaggaaaccgccacgctccgttaggggggaggtgtctccgagccagggtccacttgcgcaagaagacgaggccaggcgcctacgatcgtgcaccccggcatgccatccgggaaaacgtggcaaaggcggacatcgcgctcggaggcagcggtccgcttgggacctgaccactcaccccctaactcatcgcagccaggagctccgaggcgctgccgcaaccgaggggttcttgtacgtcctgcttagccactgggttttcgtcggagcacccagaccaccagcatccgattcatggaagaaggggctcgttcccagtgcaccccctgcctcaagaaagatgggctctaaggccctccctgcacccattcccttgcacccttcactgcaactgaccaattatagctttctgcaggccgtgaacacatttcccgcaacggtggaccatttgcagggattgtatggcctctccgcagtgcagactatgcatatgaaccactggaccttaggctatccgaacgtgcacgaaatcactaggagcactattaccgagatggccgctgcacagggcctggtagacgcacgcttccccttcccagcgttgccttttacaacacacctgtttcaccccaaacagggggcaatcgcccatgttctaccggctctccacaaagatcgacccaggtttgacttcgctaatcttgccgtggccgcaacccaggaggatccacctaaaatgggcgacctttctaaactgtcacctggtttggggtcgcccatctccggtttgtccaagctgaccccagaccgaaaaccctcacgcggtcggctgcctagcaaaactaaaaaggaattcatctgcaagttctgcgggaggcatttcaccaagtcttacaatcttctgatacatgaaagaacacatactgatgagcgaccatatacgtgtgacatttgccacaaggcatttagacgacaggaccacctgcgcgatcacaggtatattcacagcaaagagaagccctttaagtgtcaggaatgtgggaaggggttctgccagagtcgcactctggcagtgcacaagacgttgcacatgcaagagtcaccacataagtgtccgacatgtgggaggacattcaaccagcggtctaacttgaagactcacctactgacgcacaccgatattaagccttactcttgcgaacagtgtgggaaggtctttcgtcggaattgtgatctaaggcgccattccctgacacatactcctcgacaagacttctag

SEQ ID NO: 233472 - DNA, 642 bp, Artificial Sequence
  Description of Artificial Sequence: Synthetic coding sequence
atgggctccaaagctctgccagccccaataccgctccacccctctctacagctaactaactactcgtttctgcaagctgttaacacattccctgcgacagtggaccatcttcagggtctgtatgggctttccgccgtgcagacaatgcatatgaaccattggaccctgggttaccctaatgtgcacgaaatcacgcggagcaccatcacagagatggctgccgctcagggcctcgtcgatgccagattcccattccctgccctgccatttactacgcatctcttccatcctaagcagggtgctattgctcacgtattgccggctctacataaggaccggcctcgattcgatttcgccaacctggctgtggccgctacacaggaagaccctcctaaaatgggagacctgagcaagttgagtcctggattgggaagccccatctctgggctatctaagttaacaccggatcgcaagcccagtcggggacggctgcctagcaaaacaaagaaagaatttatttgcaaattttgcggcagacacttcacaaaatcctacaacctactgatccacgagagaacccacacagatgagcggccatatacttgtgatatttgccataaggcttttcgcagacaggactag

SEQ ID NO: 233473 - DNA, 939 bp, Artificial Sequence
  Description of Artificial Sequence: Synthetic coding sequence
atgggctccaaagcgctgcccgcacccatcccattacacccttcattgcaattaaccaactacagctttctccaggccgtaaacacattccctgcgactgtggatcaccttcaggggctctatggactatcagccgtccagaccatgcacatgaatcactggaccctaggataccccaacgtccacgaaattacacggagtaccatcactgagatggcagctgcacaaggacttgtcgatgctcggtttccgttccccgcactgccgttcacgacccatctctttcaccctaaacagggggcaattgctcacgtcctccccgcattacacaaagatcgtccccgttttgatttcgccaatttggcagtcgctgctacccaggaggaccctccaaaaatgggcgatctatccaaactatcgccagggctcggctccccgatctccgggctcagcaagttgacccctgaccgaaaaccttctaggggcaggctgccctctaagactaagaaggaattcatctgtaaattctgcgggagacattttaccaaatcctataatcttctgattcacgagcgtacccataccgacgaacggccatacacttgtgatatatgccataaggcttttaggaggcaggatcatctgagggatcaccgctacatccactctaaagagaaaccctttaaatgccaagaatgtggcaaagggttttgtcaatctaggaccctggcagtacataaaaccctgcatatgcaggagtcaccgcataagtgccctacctgcgggcgaacatttaatcagcgttcgaatctgaagacacatctgttaacacataccgatataaagccatatagctgcgaacaatgtggcaaagtgttccggagaaattgcgatttaagaagacactcccttacccatacccctcgtcaggatttttag

SEQ ID NO: 233474 - DNA, 687 bp, Artificial Sequence
  Description of Artificial Sequence: Synthetic coding sequence
atgaagaccctgttccttggggttacgctgggcctcgcggcagccctgtcctttacacttgaggaggaagatatcacgggcacgtggtatgtgaaagcgatggtggtagacaaagactttccagaggacagaaggccgagaaaagtgtcccctgtgaaggtaaccgcactgggtggcggaaatctggaagcaacctttactttcatgcgagaagacaggtgtattcagaaaaaaatactgatgaggaaaactgaagagcccggaaagttctcagcgtacggtggacggaagttgatctatctgcaggagcttcctggaaccgacgattatgtcttttattgtaaagaccagagacggggaggattgcggtacatgggtaaactcgtggcaagtgccccatgcagagcagtaccgctctctccgccatggttaacgtggccacctcatctgcaggtaggtatcctgattcccacatggagaccttggaagaatctccgtaattggtgttcaactcgagacagccgcaggcgcacattcagttgtccttgtaggcgcgaagcagcattctccaacacacggcagcccccaggtctgcatctccagtcccctccttaccaccagactcagtcgccagatcatttggatctccctagttcgcacgatccgagcctgctgcctccgacctag

SEQ ID NO: 233475 - DNA, 444 bp, Artificial Sequence
  Description of Artificial Sequence: Synthetic coding sequence
atgaagaccctgttcctcggagtgactctgggacttgcagccgctctctcctttaccttagaggaggaggatgagggaggaagcgttcatccggaggagaaccctgatgctgaagatggaggggcttggcagatacagaggctgtggggacaggaagcccacatcccagctggagccgctagagatggaaggttaaggctgctccttcaacgccctgcaccttggggccctgccctccacggtaaggcatgcggcatctgcagtttacagggaagagccgctgtgcctaccttagctcatttggccacttcccctgccggtagaaaccctaataccaatctcgaggctcttgaggagtttaagaagttggttcagcacaagggcctaagtgaagaagacatattcatgccgctgcagactggatcatgcgtcctagaacactag

SEQ ID NO: 233476 - DNA, 513 bp, Artificial Sequence
  Description of Artificial Sequence: Synthetic coding sequence
atgaaaacactcttcttaggggtgacattgggcctagcagccgctctctcatttaccttagaagaagaagacattacaggtacatggtacgtcaaagcaatggttgtcgataaagactttccagaagaccgtcgtcctaggaaggtgtcgcccgtaaaggtaactgcactgggcggaggcaatcttgaagcgacatttacgtttatgcgggaggacagatgtatacagaagaagatcctgatgaggaagacagaagagcccggaaaattttctgcttacggaggcaggaagctgatttacctgcaggagctgcccggaacagacgattacgttttttactgtaaagatcagagacgaggcggtctgcggtacatgggaaaactggttgggagaaatccaaatactaatctggaggcgctcgaggaattcaagaagctagttcagcataagggtctgagcgaagaggatattttcatgccattgcagaccgggagttgtgtcctggagcactag

SEQ ID NO: 233477 - DNA, 513 bp, Artificial Sequence
  Description of Artificial Sequence: Synthetic coding sequence
atgaagacactctttctgggcgttacccttggactcgccgcagccttgagctttactttggaggaagaagacattactgggacttggtacgtgaaggccatggtcgtggacaaagatttcccagaagatcgccgtcccaggaaagtctccccagtcaaggtgacagcccttggcggaggcaacttggaagcaaccttcacgtttatgagagaggaccgatgtatccagaagaagatcttaatgcgaaaaacagaggagcccggaaaattctccgcctatgggggaaggaagctcatatatctgcaggagctccctggaacggacgattacgtcttttattgcaaagaccagcggcgtgggggtcttcgctatatgggtaaactggtgggcaggaaccccaatacaaaccttgaggctttggaagaatttaagaaactggtgcagcataaggggctctccgaagaggacatcttcatgcccctgcagacaggatcttgcgtgctcgaacactag

SEQ ID NO: 233478 - DNA, 258 bp, Artificial Sequence
  Description of Artificial Sequence: Synthetic coding sequence
atgaagactctatttcttggcgtgaccctgggacttgccgcagcgctgagctttacattagaagaagaggacgacggcccatgggtacatcccgaggaaaaccccgatgcggaggatggaggcgcatggcagattcagcggctctggggccaggaggcccatgtgcctgctggcgctgctcaggagggacccttacacctcttgcttcagcgcccagcgccttggggacccgctccccacgggaaggcatgtggctag

SEQ ID NO: 233479 - DNA, 513 bp, Artificial Sequence
  Description of Artificial Sequence: Synthetic coding sequence
atgaagacgcttttcctgggggtgacccttggccttgcggcagccctcagcttcacactggaggaagaggacattaccgggacatggtacgtgaaggctatggtggtcgacaaggattttcctgaggacaggagacctcggaaagtgagcccagtgaaggtgacagcgcttggcggaggtaaacttgaagctactttcaccttcatgagggaagataggtgtatccagaagaagatccttatgaggaagaccgaggagccgggaaaatactcagcctatgggggtcggaagctgatgtacctgcaggaactgcctagaagggatcactacatattctactgcaaagatcagcaccacggcggactgttacatatgggtaagctcgtgggcaggaattcagatacgaatagggaggccttggaagaatttaagaaactggtacaaagaaagggactgtctgaagaggacatattcacccccctgcagactggatcctgcgtgccagaacattag

SEQ ID NO: 233480 - DNA, 8310 bp, Artificial Sequence
  Description of Artificial Sequence: Synthetic coding sequence
atggatgtcaaagaaaggaagccttaccggtcactgactaggcgtcgagatgccgagagacgctacacttcttctagcgccgattctgaggaaggcaaagctccgcagaagtcttatagcagcagcgaaacactgaaagcctatgatcaggatgccaggctagcctacgggtctagggtgaaggacatcgtgcctcaggaggcagaagagttttgtaggactggagccaatttcactcttcgggagctggggctcgaagaggtgacacctccacacggcacactctacaggactgacattggcctccctcactgtggatactccatgggcgctgggtcagatgctgacatggaggccgataccgtgctgtctcctgaacaccccgtgaggttatggggccgtagcacacgtagtgggcgatcttcttgcctgtcaagccgcgctaattccaacctgacattaaccgataccgagcacgagaacacggaaactgaccaccccggaggcctgcagaaccacgcacgcctgcgcactccaccaccccctttgtcacacgcacacacaccaaaccagcaccatgctgccagtattaactctctcaatagagggaattttacaccccgaagcaatccctcacctgcccctacggaccacagccttagtggcgagccaccggctggcggtgcccaggagcccgctcatgcacaggagaactggctcctaaattcgaatattccgcttgaaacccgaaacttagggaagcagcctttccttggcacactgcaagacaacctcatcgagatggatattttgggagcaagccggcacgatggggcatatagcgacggtcatttcctcttcaagcctggcggaacctccccacttttctgcacaaccagccccggttaccccctgaccagttcaacggtgtactcacctcctccccgacctcttccgagaagtacattcgccagacctgcctttaacctgaagaaaccttccaaatattgcaactggaagtgcgccgctctgagcgcaattgtcatcagcgcgaccctcgttattttgctggcctattttgtagctatgcacctgttcggactcaactggcatcttcagcctatggaaggccaaatgtacgagatcaccgaggacaccgccagcagttggcccgtgccaaccgatgtgagtctttacccttctggtggaacaggtttggagacgcctgacaggaaaggaaaaggaactacagaggggaaaccatcgtcctttttcccagaggacagcttcatcgactccggcgagatcgatgtggggaggcgtgcatcgcagaagatccctcccggtacgttttggcgctctcaagtgttcatcgaccatcctgtccatctgaaatttaatgtgagtctcggaaaggcggcactggtgggcatatatggacggaagggcctgcccccttcacatacacagttcgacttcgtggagctcttggacggcagaaggctacttacccaggaggcacgctccttggaggggacgcctcgtcagagtcgaggcacggtgccaccctcaagtcacgagaccgggttcattcagtacctggactccgggatctggcacctcgccttctacaatgatggtaaagaatctgaagtggtgagctttctgaccacagcgatcgaatcggtcgataattgccctagtaactgctatggtaatggcgattgcatctctggaacatgccactgttttttaggctttctgggccctgactgtggacgcgcttcctgcccggtgctttgcagcggaaacggccagtacatgaaggggaggtgcctgtgtcactcagggtggaagggagcagaatgtgatgtgcctaccaaccagtgcatcgatgtggcttgcagcaatcacggcacctgtatcacagggacgtgtatatgcaaccccggttacaaaggggagagttgcgaagaggtggattgtatggatccaacgtgcagtggcaggggggtgtgcgtcagaggtgagtgccactgcagcgtaggctggggcggaactaactgtgaaacgcctagggccacctgccttgatcaatgcagtggccatggcacatttctcccagatacaggcctttgttcctgtgatccatcttggacaggccacgattgctcaatcgaaatctgcgctgctgattgcggcggacatggcgtctgcgtgggtggtacctgcagatgcgaagacgggtggatgggggctgcatgcgatcagagggcttgccacccgaggtgcgccgagcacggtacatgtagggacggcaaatgcgagtgctcacccggatggaacggcgagcactgcaccattgcacattacctggatcgggtggtgaaggagggctgtccaggcctatgcaacggaaatggacgctgcacactcgacctgaatggctggcactgcgtgtgccagctcggatggcgaggcgctggctgtgacacatcaatggaaaccgcctgcggggactcaaaggataatgacggagacggcctcgtcgactgcatggaccccgattgttgtctccaacctttgtgccacatcaacccactgtgtctggggtccccaaacccactagatatcatccaggagacgcaggtgcctgtgagtcagcaaaaccttcattcattttacgataggattaaattcctcgtggggagggattcgacccacattatccctggtgagaaccccttcgacggaggccatgcttgtgtcattcggggtcaggtgatgacaagtgacggtacccctctcgtgggggtcaatatatcttttgtcaacaatccactgttcgggtacacgatctcaagacaggacggctctttcgacctcgtgactaacgggggaatttcaataatcctgcggtttgaaagggctccctttatcactcaagaacacaccctttggctaccctgggatcggtttttcgtcatggaaacaatcattatgagacatgaagagaacgaaattccttcctgtgatctgtcaaatttcgcccgacctaaccctgtcgtctcacccagcccactgacatcatttgcatcatcctgcgctgaaaaagggcctatcgtacccgaaatccaggcattacaggaggagatcagtatatcaggctgcaagatgagactaagttacctgagctcccggactccaggatacaagtctgttttaaggatcagtctgacacaccccactattcctttcaatcttatgaaggtgcacctgatggtggcagtggaggggaggctctttaggaagtggtttgcggcagcccctgaccttagctactatttcatctgggacaaaactgatgtctacaatcagaaggtatttggcctctccgaggcgttcgttagcgtgggttacgaatacgagagctgtcctgacttgattttatgggagaagagaaccacagttttacaaggatacgagatcgacgcctctaaactgggtgggtggagccttgataagcaccatgccctcaatatacaatccggcatactacacaaaggcaacggcgaaaatcagttcgtctcacagcaaccgcctgtgatcggatccatcatgggcaacggtcggcgacggtccattagttgtccttcatgcaatggactcgcagatggcaataagttacttgctcctgtcgcattaacttgtgggagtgatgggtccttatatgtgggtgattttaactatatccgcaggatcttcccttcaggtaacgtaactaacatcttggaactgcgcaataaggattttcggcattcgcattcccctgcccacaagtactaccttgccaccgatccgatgagtggtgcagtgttcctgtcagactctaacagtagacgagtgttcaaaatcaaatccaccgtggtggtgaaggatctcgtgaaaaactccgaggtggtggcgggtaccggcgaccagtgtctcccgtttgacgatacacgatgcggcgacggcggaaaggcaacggaggcgacattgacaaatcctcgagggatcacagtggataagtttgggctgatctactttgtagatggcacaatgatcagacggatcgaccaaaatgggatcatctccaccttgctcgggtccaacgaccttacttccgctaggccattgagctgcgatagcgtgatggatatcagtcaggtccacctcgagtggcctaccgatttagctattaatccaatggacaattcactgtacgtgctggacaacaacgtggtcctgcagatttccgaaaaccaccaggtccgcatcgtggccggtcgacccatgcactgccaagttccaggaatcgatcacttcctcttgtctaaggtcgctatacacgctacactggagtctgctacagcactggctgtgagccacaacggcgtactttacatagcagagactgatgaaaaaaagattaaccgaattcgccaggtgaccacatctggagagatttccctggttgccggagccccaagtgggtgcgattgcaaaaatgacgccaactgcgactgcttcagcggagatgacgggtatgccaaggacgccaagctgaacacaccctctagcctggccgtctgtgctgacggcgagttgtacgtggccgatctcggaaacattcgaatccgattcataagaaaaaacaagccattccttaacactcagaacatgtacgagcttagctctccaattgaccaggaattatacctttttgacacaaccggaaaacacctatatactcaatcactgcctacaggggactatctgtacaactttacctacaccggcgacggcgacattacgttgataactgataataacggcaacatggtgaacgtgagacgagactcaactgggatgccactgtggctggtggtgcccgacggccaggtttactgggtcacgatgggcaccaattccgcactgaagtctgtgaccacacagggacatgagctcgcgatgatgacctaccatggaaattccggattgttggccactaaaagtaacgagaatggttggactacattttacgagtatgacagcttcgggagactgacaaacgtgacatttccaacaggtcaagtgtctagcttcagatccgatacggacagttccgttcatgtgcaggtggagacctccagtaaagacgacgtgacgattactactaatctaagtgccagtggagctttctataccctcctgcaagatcaggtcaggaactcctattatataggcgcagatggatcattgcgattgttgctggctaacggaatggaagtggccttgcagacggaaccccatttgcttgccggtaccgtgaatcccactgtcggtaaacgtaatgtcaccctcccgatcgacaacggcctgaatctggtcgaatggaggcagagaaaggaacaggcccgtggccaggtgaccgtctttgggaggcgactgcgggtgcataatcgaaatctgttgtcattggatttcgatagggtgacgcggacagaaaagatctatgacgaccacagaaagttcacactaaggatcctgtatgaccaagctgggaggcccagtctgtggtctccctctagcagacttaacggcgtaaatgtgacatactccccagggggttatatagcaggcatccagcggggaatcatgtctgagaggatggagtacgaccaggcagggaggatcacttcgagaattttcgcagacggcaagacctggtcctatacgtatctggagaagagcatggtgttactgctccatagccagcgtcagtatatctttgaattcgacaagaacgatagactgtcctcggtcacaatgcctaatgtagcccgacagacgctggaaacaatcaggagtgtgggatattatcgaaatatttaccaacctcccgagggtaatgcctctgtaatacaagatttcaccgaggatggccaccttttacacaccttttacctgggcacaggccgacgcgtgatttacaagtatgggaaattgagcaaattagcagaaacactgtacgatacaaccaaggtctcatttacctacgatgaaacagcaggaatgttaaagacgatcaacttgcagaatgagggctttacctgcactatccggtaccgccaaattgggccactaatcgatcgacagattttccggtttacagaggagggcatggtcaatgcacgtttcgactataattacgacaattcctttagagttaccagtatgcaggcagtgattaatgagacacccttgccaatagacctgtatcggtacgacgacgtgtccggcaagactgaacagttcggcaagtttggcgtcatctactacgatatcaaccagatcatcacaactgcggtcatgacccacactaagcacttcgacgcatacggaaggatgaaggaagtgcagtacgaaatttttaggtcccttatgtattggatgacagtccagtacgacaatatgggcagagtagtcaaaaaggaactcaaagttggaccctacgcgaacaccactcggtatagctacgaatacgatgccgacggccagcttcagacagtgtcgattaatgacaagccactctggaggtatagttacgatcttaacggtaacctgcacctcctctctcccggtaattcagcccgactgaccccactgaggtacgatatcagggataggatcacacgcctcggagatgtccaatacaaaatggacgaagatggcttcctgcgccagcggggaggtgatatatttgagtataactctgccggtcttttgattaaagcttataacagagccggtagctggtcagtcagatatagatacgatgggttgggacgtcgagtatcatccaaatcctcccattcccaccacctgcagtttttctatgccgacctcaccaatccgacaaaggtgacccacttatataatcattcttcgtccgaaattaccagcctctattacgacttgcaaggtcacctgttcgccatggaactgtcgtccggggatgagttctatatagcctgcgacaatatcggaacaccccttgctgtcttttccgggactggattgatgattaaacagatcctgtataccgcctatggagagatatatatggatacaaatccaaactttcagattatcatcgggtatcacgggggactctatgaccctctaactaagctggtgcatatgggaagaagggactatgatgtgctggcgggaagatggacttccccagatcacgagctgtggaagcacctctcgagttctaacgtgatgccattcaatctctacatgtttaaaaacaacaaccctattagtaattcgcaggacatcaaatgctttatgactgacgtcaattcctggctcctgacttttggcttccagctccataatgtgatacctgggtacccaaagccagatatggacgcaatggaaccctcatacgaactgatccatacccagatgaaaacacaagagtgggacaactctaagtccatcctgggagtgcaatgtgaggtacagaagcagctgaaggcctttgttaccctggaacgcttcgatcagctgtacgggagcacgatcacttcttgccagcaagcgcctaagacaaaaaaatttgcctctagcggatctgtattcgggaagggtgtgaaatttgccttgaaagacggtagagtgactaccgatatcatctcagttgccaacgaggacggacgaagagtggcagctattctcaaccacgcccactatctggagaatcttcactttacaatagacggtgtcgacacccactacttcgtaaaacccggtcctagtgagggtgacctggccattctcggcttatcaggtggtaggcgaaccctcgagaatggggtgaacgtcaccgttagccaaattaatactgtgcttaatgggagaactagacgctacacagacattcaactgcaatacggcgctctgtgccttaacacccgctatggaacaacactggacgaggagaaagctagggtgcttgagctggctaggcagagggccgtgcgccaggcatgggcaagggagcagcaaagacttcgagaaggagaggaaggtctgagagcatggaccgagggtgagaagcagcaggttctgagcaccggcagagttcagggctacgatggttttttcgtcatctccgtcgagcagtacccagaacttagtgactccgccaataacatccacttcatgcgccagagtgaaatggggagacgctat

SEQ ID NO: 233481 - DNA, 6 bp, Artificial Sequence
  Description of Artificial Sequence: Synthetic coding sequence
atgtag

SEQ ID NO: 233482 - DNA, 1404 bp, Artificial Sequence
  Description of Artificial Sequence: Synthetic coding sequence
atgcctgggcgttggcgatggcagcgggatatgcatcctgcacgcaaattgctgagtttgctattcctcattctcatgggcactgaattaacccaggtattgcccacaaaccctgaagagtcctggcaagtatatagctccgctcaagacagtgaaggcagatgtatctgtacagttgttgcaccgcagcagactatgtgttcccgggacgccaggacaaagcagctgcgccaactcctggagaaggtgcagaatatgtcccagagtatagaagttctggaccgacgcacccagcgcgatcttcaatacgtggaaaagatggagaatcagatgaaggggcttgagtcaaaatttaagcaggtcgaagagtcgcacaagcagcacctcgctagacagtttaaagccatcaaagccaaaatggatgaactccgacccctaattcctgtgctggaagagtacaaagccgatgcgaaactggtcctgcagtttaaagaagaggttcagaatctgacctcggtactcaatgagcttcaggaagaaatcggcgcttacgactacgatgaactccagtcccgagtatctaaccttgaagaaagactccgggcttgtatgcagaagctggcctgcggaaagctgacgggtatttccgaccccgtcaccgtgaaaaccagcgggtctcggttcggaagttggatgacagatcccctggccccagagggtgacaacagggtatggtatatggatggataccataacaaccggtttgtgcgggagtacaagtccatggtcgactttatgaacaccgataatttcacatcccatcggttgccccatccatggtcaggcacaggacaggtagtgtacaatggtagcatctattttaataagtttcagtctcacataatcatccgatttgatttgaagactgagaccatcctcaaaacaaggagcctcgactatgccggatacaataacatgtaccactatgcctgggggggacattctgatattgatctgatggtggatgagtcagggctgtgggcagtttacgctacaaatcagaatgctggcaacatcgtagtatcccggttagatcctgtgtcccttcaaactctgcaaacctggaatactagttatccaaaacgatcagctggcgaagcattcatcatctgcgggactctgtacgttacgaatggttattctggcggtacaaaggtccactacgcataccaaactaacgcttcaacctacgagtacattgatatccccttccagaataagtattctcatatctctatgttggactacaaccccaaagacagggctctctatgcctggaataacggacatcagatcctgtacaatgtgacactgtttcacgtcatacgatctgacgaactgtag

SEQ ID NO: 233483 - DNA, 408 bp, Artificial Sequence
  Description of Artificial Sequence: Synthetic coding sequence
atgcctgggagatggaggtggcaacgggacatgcatcccgctcggaagctcttatccctgctgtttctgattctcatgggcacggagctaacccaggttttgcccactaacccagaagaaagctggcaggtgtactcctccgcccaggacagcgagggacgctgcatctgtacagtggtcgctccgcaacagacaatgtgctcaagagatgccaggacaaagcaactgaggcagcttctagagaaggtccagaatatgtctcaatcaattgaggtacttgacaggcggacccagagggacctgcagtacgttgaaaaaatggagaaccagatgaaaggactcgagagtaaatttaagcaggtggaagaatctcataagcagcacctggctcgccagttcaaggggtag

SEQ ID NO: 233484 - DNA, 1458 bp, Artificial Sequence
  Description of Artificial Sequence: Synthetic coding sequence
atgtcagtacccctcctcaagatcggtgttgtgttatcgaccatggcaatgattacgaattggatgtcccagactctgccttcccttgtgggtttgaataccaccaaattgtccgccgctggaggtggcacactggataggagcaccggcgtccttcctacgaacccagaagagtcctggcaggtgtatagctccgcacaggacagcgaagggagatgtatttgcaccgttgtggctcctcagcagacgatgtgtagtagagatgcacgcactaagcaactacgccagctcctcgaaaaagtacagaacatgtcgcaaagcatcgaggtcctagaccgacgcacccaacgagacctccagtacgtggaaaagatggaaaaccagatgaagggactcgagtctaagtttaagcaagtggaggagtcgcataaacaacatctcgccagacagttcaaggctatcaaagcaaaaatggatgagctgcggccactgatacctgtgcttgaagagtataaggctgatgccaagctagtcttgcagtttaaggaggaagttcagaacctcactagcgtcctaaatgagctccaggaggaaatcggcgcatatgactatgacgagttgcaatcgagagtttctaatctcgaggagcggctgcgcgcttgtatgcaaaaactggcctgtgggaagctgacgggcatttccgaccccgtgaccgtaaagacctcagggtctaggtttggtagctggatgactgacccccttgccccagagggtgacaatcgggtgtggtatatggacggttatcacaataatcgatttgtccgtgagtataagtccatggtggattttatgaatacggacaattttacttcacatagactcccccacccctggagcgggaccggccaggtagtgtacaatggtagtatttactttaacaaatttcagagtcacattatcattcgcttcgacctgaagaccgagaccattctgaaaaccagatccctagattatgcaggctataacaacatgtaccattatgcctggggtggccattctgatattgatctgatggtcgatgagtccggattgtgggccgtgtacgcaaccaaccagaacgccggaaatatcgtggtcagtcggctggaccccgtttcactgcagacgctccagacatggaatacatcctacccaaaacgcagtgccggagaggctttcataatctgtgggacactctacgtcacaaatggctattcgggcggtaccaaggtccactacgcttaccagacaaacgccagcacatatgaatatatcgacatcccctttcaaaataagtattcccacatctctatgctggactataacccaaaagacagagccctctacgcctggaataacggccatcaaattctatataatgttacactcttccatgtgattcgctctgacgagctgtag

SEQ ID NO: 233485 - DNA, 1377 bp, Artificial Sequence
  Description of Artificial Sequence: Synthetic coding sequence
atgggcgaagctccaggcagggagggaagaggcccttgcccacagctagaaagtccgcgacgtaggagagtcctgcctacaaacccagaggagtcctggcaagtttactcatcagcgcaggattccgagggcaggtgtatttgtaccgtcgtggctccacagcagacaatgtgctctcgggatgcccgaaccaagcagctgaggcaactgctagagaaggttcagaacatgagtcagagtatagaagttcttgaccgacggactcagcgcgacctgcagtatgtggagaagatggagaaccagatgaaagggctcgaatcaaaatttaagcaggtagaagagtctcacaagcagcacctggcacgccagtttaaggctatcaaggccaaaatggacgaactgcggccattgatccctgttttggaggaatacaaggctgacgctaagctcgtactgcagttcaaagaggaagtgcagaacctgacaagtgtgctgaacgagctgcaggaggaaatcggggcatatgattatgacgagctgcagtcaagggtgagcaatctcgaggagcgccttagggcatgtatgcagaagctagcatgcggtaagctgactgggatctctgaccctgtcacagtcaaaacctccgggtccaggttcggatcctggatgactgacccactggccccagagggcgataaccgtgtgtggtacatggatggctaccacaataataggtttgttcgggaatacaagtcgatggttgatttcatgaacactgacaatttcacttcccaccggctccctcatccatggtctggtaccggccaggttgtctataatgggagtatatacttcaacaagtttcaatcccacataataattcgtttcgacttaaaaaccgagaccatcctgaagacaagatctctggattacgcaggatataacaatatgtatcattacgcctgggggggtcactccgatattgacctcatggtagacgaaagcggcctctgggccgtgtatgctacaaaccaaaacgccggtaatatagtcgtctctcggcttgaccccgtgagcctacaaactctgcaaacctggaacacgagttatccaaaaagatctgctggagaagctttcatcatctgcgggacactgtatgtgacaaacgggtattccggcggtactaaggttcattacgcttaccagacgaacgcaagcacttacgagtatatcgatattccatttcaaaataaatatagccacatcagcatgctggattacaatcctaaagatcgcgcactgtacgcatggaacaatgggcatcagatcctctacaacgtcaccctgttccacgtgatccgaagcgatgaactgtag

SEQ ID NO: 233486 - DNA, 462 bp, Artificial Sequence
  Description of Artificial Sequence: Synthetic coding sequence
atgtcagtacctctgctgaaaatcggcgtggtgctgtctactatggccatgatcactaattggatgagtcagacgctgccgagtctggttggcttaaataccaccaaactctccgcagctggcggtggtactctggacaggtctaccggcgtgcttcccactaaccccgaagagtcctggcaggtttattccagtgcccaggactccgaaggccgttgtatctgcacggtcgtcgcccctcagcagaccatgtgctctagggacgcaaggaccaaacagcttcgtcaattattggaaaaagtgcagaacatgagtcaaagcattgaggtccttgaccgaaggactcaacgagacctgcagtatgtcgagaagatggaaaatcaaatgaagggcctggagagcaagttcaaacaggtggaagaatcccataagcaacatctggcacggcagtttaagggttag

SEQ ID NO: 233487 - DNA, 729 bp, Artificial Sequence
  Description of Artificial Sequence: Synthetic coding sequence
atgaaccttcacgttaaaactttaagcttgatgacttggcggtcacgattcttggaggagagtttctggtcattggaggagacggccgctcttgctaaacagttgcccctcaagtctccctcagagaatatcttcctgcatattgtggatctatctgaccccaaacaaatctggaagttcgtagagaacttcaaacaagagcacaagctccacgtcctgatcaacaatgctgggtgcatggtcaacaagcgtgagctgaccgaggatggcctggagaagaacttcgccgctaatacccttggcgtttacattcttactaccgggttaattcctgtgttggagaaggagcacgatccccgtgtgatcaccgtgtctagtggagggatgcttgtgcagaagttgaataccaacgacttgcagagcgaacgtaccccctttgacggcaccatggtgtacgcccaaaacaagaggcaacaagttgttttaacagagagatgggcacagggacacccagccatccatttttcgtccatgcaccctggctgggcagataccccaggggtcagacaagccatgcccggttttcacgcccgttttggggaccgactgcgctctgaggcccaaggtgccgatacgatgctgtggttagcactaagcagtgcagctgccgcacagcccagtggccgattcttccagggtgacttcctccctggctgcgaaggttcatag

SEQ ID NO: 233488 - DNA, 492 bp, Artificial Sequence
  Description of Artificial Sequence: Synthetic coding sequence
atggcggaggatcggccacagcaaccccagctggacatgccgttggtgttggaccagggcctcacacgtcagatgaggttgcgggtggagagccttaagcagcgcggagagaagaggcaggacggcgaaaagcttttacagcctgctgagagcgtataccgactgaatttcacacaacaacagagactacagtttgaaaggtggaacgtggtccttgataagccagggaaagtgaccatcactggtacatcacagaattggactccggatctgaccaacttgatgacacgacagctgctggaccctactgcaatattctggcgaaaagaggatagcgacgccattgattggaatgaagcggacgcgctcgagttcggggaaaggctgagtgacctggcaaaaatcaggaaagttatgtactttctggtgacattcggagagggcgtggagcctgccaatcttaaggcatccgtggtgttcaaccagctctag

SEQ ID NO: 233489 - DNA, 939 bp, Artificial Sequence
  Description of Artificial Sequence: Synthetic coding sequence
atggacggagggaaccagagtgaggggtcggagttcctcctactgggaatgagtgaaagccccgaacagcagagaatcctgttctggatgttcctctctatgtacttggtaaccgtagtgggaaatgtcctcattattcttgccataagctctgattctaggttacatactcctgtatatttttttctagcaaatctctccttcaccgacctcttcttcgtgacaaatactatcccaaagatgctggtgaatttacaatctcacaacaaagctatttcctacgctgggtgtttaacacaactctatttcctcgtcagcctggtagcccttgacaatctgatactcgccgtaatggcctatgacaggtatgtcgccatttgctgcccactacactatactactgcgatgtcaccaaagctttgtatcttgctattgagtctgtgctgggtcctatcagtactctatggtcttatccacaccctgctgatgactcgcgttaccttctgtggatcaaggaagattcattacatcttctgtgagatgtacgtgctgctcaggatggcatgctccaacatacagattaatcacacagtgctgatcgccactggctgctttatatttcttatcccttttggcttcgtgattattagttatgtactaataattcgggctattctacggatccccagcgtttcaaaaaaatataaagcattttctacatgtgcctcccacctgggggcagtgtccctcttttacggcacgttgtgcatggtctacctgaaacccctccatacctactccgtcaaagacagcgtcgccaccgttatgtatgcagtggtgacaccaatgatgaatccttttatttattcacttcgtaacaaggatatgcatggtgctctggggcgtctgctggacaagcatttcaaacggcttacttag

SEQ ID NO: 233490 - DNA, 939 bp, Artificial Sequence
  Description of Artificial Sequence: Synthetic coding sequence
atgtcaggaacaaatcagtctagtgtctcagaatttttgctcctcggactctcccggcagccacaacagcagcatctgctgttcgtattctttctgagcatgtatcttgcaacggttttaggcaacctgctgattatactgagtgtgtctattgacagctgcctacacacccccatgtatttcttcctgagcaatctctcattcgtcgatatctgcttcagtttcacgaccgtgccaaagatgctggccaaccatatccttgagactcagaccattagtttttgtggctgtctcacccagatgtactttgtcttcatgtttgtagatatggacaactttctcctggctgtgatggcctacgatcattttgtcgcagtgtgtcatccattacactatacagcaaaaatgacacaccagctgtgcgccctactggtggccggactttgggtcgtggcgaatttgaatgttctgctacacacgctgctcatggcgcctttgtctttttgtgcggacaatgcaattactcacttcttctgtgatgttacccctttgctgaagctcagttgttctgatacgcatctgaacgaggtcataatcctgtcggagggagccctggtcatgatcacgccattcttgtgcatcttggcctcctatatgcacatcacctgcaccgtgctgaaggtgccaagtaccaaagggagatggaaagccttctctacgtgcggatcccatttggcagtcgtcctgctgttttacagcactattattgccgtgtactttaatcctctgtcatcccattccgcggagaaggacactatggccaccgtgctgtacacagtagtgacccctatgcttaatccgttcatatactccttacgaaatcggtacctcaaaggagccctcaaaaaggtagtagggagggtcgtgttttccgtctag

SEQ ID NO: 233491 - DNA, 924 bp, Artificial Sequence
  Description of Artificial Sequence: Synthetic coding sequence
atgaatcactcagtcgtcacagaattcatcattcttggtctcactaaaaaacccgaattgcaaggcatcatttttttgtttttcctgatagtgtatctagtcgccttcctgggaaatatgttgataattatcgcaaaaatatataacaatactctgcacacccctatgtatgtgttcctgttgacactcgccgtggtggatattatttgcacgacgagtattattcctaagatgttaggcaccatgctgacatctgagaatacaatcagttacgccggatgtatgtctcagctttttctgtttacatggagcctgggagcagaaatggttctgttcacaactatggcatacgatagatatgtagccatttgcttccctcttcactacagcaccatcatgaaccaccacatgtgcgtggctttactgtccatggttatggctatagcggtcacaaactcctgggtgcacacagcattgatcatgcgactcaccttttgcggaccaaacaccatcgaccattttttctgcgagatacccccactgctggccctgtcatgctctccagtgcggattaatgaagtgatggtttatgtagctgacataacacttgctataggcgattttatacttacatgcatcagttatgggttcattatagtggccattctccggatcaggacagtggaaggcaaaaggaaggcgttttcgacttgctctagtcaccttacggtggtaaccctttactactcacctgtgatctacacttacatccggccagccagctcctacacgtttgagcgggataaagtcgtcgccgctctctacacgctagtcacccctacgctcaacccgatggtttacagtttccagaaccgcgagatgcaggccggtataagaaaggtgttcgcgttcctgaagcactag

SEQ ID NO: 233492 - DNA, 930 bp, Artificial Sequence
  Description of Artificial Sequence: Synthetic coding sequence
atggagaatcggaacaacatgaccgagtttgttctgttgggactgactgagaacccaaagatgcaaaaaatcatcttcgtggtcttctttgtaatctatattatcactgtagtgggctacgtgttgatagtagtgacaataaccgcctccccctcacttggctctcctatgtacttaagcctggcctacctcagctttatcgacgcatgttattcttcggttaatacacccaacctgattacccacagtctgtacgggaagaaagcgatcctttttaacggttgtatgacacaggttttcggagaacattttttcgggggagctgagggcatcctgctcacggtgatggcctatgaccattatgtggcaatctgtaagccactacattacatgactatcatgaaccagtgtgtttgtgctctgctgatgggtgtggtctggatgggaggatttcttcatgcgacaattcagatcctgttcatttttcagctccccttctgtggtcccaatgtcatcgaccattttatgtgcgatctaaaccctttactgaatctggcatgtacagacacccacatgcttgagctcttcatcgcagcaaattcgggatttatctgtctcctgaattttgccctgctactggtctcctatgtggttattttgtgtagcctgagaacacattcgctcgaggccaggcacaaagccctcagcacgtgcgttagtcacatcaccgtggttattctcttcttcgtgccctgcatttttgtatacatgcgcccagctgctactcttccgatcgataaagctgtcgcaattttctacactatgataacacctatgctgaatccattgatctatacactcaaaaacgcacaaatgaagaatgctattcgtaaactgtgctcaaggaaagacatttcgggggacaagtag

SEQ ID NO: 233493 - DNA, 978 bp, Artificial Sequence
  Description of Artificial Sequence: Synthetic coding sequence
atgttcctctacttgtgttttatattccagcggacgtgctctgaagagatggaagaggagaatgcaacccttttaaccgaatttgtcctcaccggcttcttacaccagccggactgtaaaataccgctgtttctggccttcctggtaatatacctcatcaccataatgggcaacttaggccttatcgttctgatctggaaagaccctcatctacacatacctatgtatttattcctgggctcactcgcttttgtggacgcctcactcagctctaccgtgactcctaagatgctgatcaacttcttggccaaatccaaaatgatcagcttgtctgaatgcatggtgcaattttttagcctggtcaccaccgtcactacggagtgcttcctgctcgctacgatggcatatgaccgttatgtggccatttgcaaagcactcctgtacccggttattatgactaacgagttatgtattcagctgctggtcctgtcgtttattggaggcctgctgcatgctttgatccatgaggccttcagttttagactcacattttgtaactcaaacatcattcaacatttctactgtgacattattccacttctcaaaatctcctgtacggactcgtctatcaacttcctgatggtctttatcttcgctggatcggtgcaggtgtttaccatcggtaccatcctcattagttatacaattattttgtttaccatattagagaagaagtccatcaaggggatccggaaggctgtatcaacctgtggggcacaccttctgtcagtgtccctttactatggaccattgacattcaagtatctcggatctgcctcgccccaggccgacgaccaggatatgatggagagtctgttttatacagtgattgtgccgttgttgaaccctatgatttacagcctgaggaataagcaggtcatcgcttcattcacaaaaatgtttaagtccaacgtgtag

SEQ ID NO: 233494 - DNA, 963 bp, Artificial Sequence
  Description of Artificial Sequence: Synthetic coding sequence
atggagaccgggaaccaaactcatgcccaggagtttctgctgctcggttttagcgccacatctgaaattcagtttatcctattcgggctgtttctctctatgtatctagtgacttttactgggaacctgttaatcatactggcaatttgttcagactctcatctgcatactccgatgtacttttttctgtctaacttatcttttgcagatctctgtttcacttccaccaccgtgcctaagatgttgctgaacatcctcactcagaacaaatttatcacttatgccggatgcttaagtcagatttttttcttcacgtcttttgggtgccttgacaacctgctccttacagtgatggcttacgaccgattcgtcgccgtgtgccatcctctgcattacacagtcattatgaatccccagttgtgtggcctgttagtcctgggcagctggtgtatttctgtcatgggttccctactcgaaacacttacagtcttacggcttagtttctgtaccgagatggaaattcctcactttttctgcgatctgctggaagtactgaagctggcgtgcagcgacaccttcattaacaacgttgtgatctatttcgctacaggcgtgctgggcgtgatcagcttcaccggaatctttttctcctactacaagattgtgttctctatactcagaatcagctctgcgggtagaaaacacaaggctttttccacctgtggctctcatctatctgtagtcaccctcttttatggtaccggatttggagtgtatctcagttccgctgctaccccgtcaagccgcacatctcttgtcgcaagcgtgatgtatacgatggtgacacccatgctcaatcccttcatttacagccttcgcaacactgatatgaaacgggctctggggaggctcctgtcaagggcaacatttttcaacggcgacataaccgctggcctcagctag

SEQ ID NO: 233495 - DNA, 960 bp, Artificial Sequence
  Description of Artificial Sequence: Synthetic coding sequence
atggagcggggaaaccagaccgaagtggggaactttttacttctgggtttcgcagaagattccgatatgcagttgcttctccacggtctgtttctctccatgtacctagtcacaatcatcggaaatctgttaatcatactaaccatcagcagcgactctcatctccatacacccatgtacttcttcctgagtaacctaagctttgcagacatatgttttacttctacaacagtgccgaaaatgctggtgaatatccagacacagtcaaagatgatcacgttcgcaggctgtcttacccagatatttttttttatcgcttttgggtgtctggataatctgctgctgactatgaccgcttacgatcggtttgtggccatctgctacccgctgcactataccgttatcatgaacccacgtctgtgcggcctcctggttctcggaagttggtgtatctccgtgatgggctcccttctcgagaccctcacaattctcagattaagtttctgcaccaatatggagatccctcactttttctgtgacccttctgaagtgttaaagctggcttgttcagacacattcatcaataatatcgtgatgtacttcgtgacaatagttcttggcgtgtttcccctatgcggcattcttttttcatactcccagatcttcagttcggtgctgcgcgtatccgctcggggacagcacaaagccttctcaacttgcggttcacatttgtccgtggtgagcctcttctacggaaccggactgggtgtgtatctctcgtctgccgtgacccctccaagtagaacttctttagcagcttcggtgatgtacactatggtgacaccaatgttgaatcccttcatatactccctccgaaacaaagatatgaaagggtcactcggccgtctgctactacgagccacctccctcaaggagggtacaattgccaaacttagttag

SEQ ID NO: 233496 - DNA, 939 bp, Artificial Sequence
  Description of Artificial Sequence: Synthetic coding sequence
atggaagcagaaaatctgacagaactgagcaagtttctcctgttaggactcagtgatgatccagaactacagcctgtcctcttcgggctctttctctctatgtatctggtcactgttctgggcaacctgctcatcattctcgctgtgtcgtcagatagtcatctccacacaccgatgtacttttttctctccaacctatcctttgttgatatttgcttcattagtactactgtgccaaaaatgctcgtgtcgattcaggcgcgttccaaggatatctcctatatgggttgtttaactcaagtttacttcttgatgatgttcgccggaatggacaccttcctgttggccgtcatggcttatgatcggtttgtagctatttgtcaccctctgcactacaccgtgataatgaatccatgtctgtgcggtctgttggtcctggccagctggtttatcatcttttggttcagtctcgttcacattctcttgatgaagagactgactttttcaacaggcacagagattccacacttcttctgcgagcccgcacaggtgctaaaggtggcttgcagcaacacgctattaaacaacattgtgctgtacgtcgcgaccgccctgcttggtgtgttccctgttgcagggatcctgtttagttactcgcagatcgtgagttccctgatgggcatgtcatccactaaaggaaagtacaaagcatttagtacatgtggttcacacctctgtgtggtgtcactgttttacggtaccgggctgggggtgtatctgagtagcgccgtgactcactcatcacagagcagctcaactgcctctgtgatgtatgcaatggtgacacctatgctgaatccttttatctatagtctcagaaataaggatgtgaagggcgcactggagcggcttctcagtcgggctgattcctgtccatag

SEQ ID NO: 233497 - DNA, 972 bp, Artificial Sequence
  Description of Artificial Sequence: Synthetic coding sequence
atggatagcgacgcttccctcgtgagctctcgccctagctctcccgaacccgacgatttgtttcttccagcccgttccaagggcagctctggaagtgcgtttacggggggaaccgtgagttcttcaaccccctccgactgcccccctgaactatccgcagagctgcggggagctatggggagtgccggagctcatcctggggataaactgggcggatctggattcaagtcgtcttcaagttcgaccagcagctcaacctcaagcgccgcagcctcatcaaccaagaaagacaagaaacaaatgacagagccagagctacagcagttacgtctaaagataaatagccgcgagcgcaaacgcatgcacgacttaaacatcgccatggatgggctccgggaagttatgccatacgctcacggaccgtcagtccggaaactgtcaaaaattgcaactctactgttagccaggaactatattctgatgctcaccaattcattagaggagatgaagagactcgtaagtgaaatctacgggggacaccatgccggattccacccttcagcttgtggcggactcgcccacagcgcgccacttcccgcagccactgcacacccggctgccgcagcccacgccgcacaccatcctgccgtgcaccacccaatcctcccacctgcggctgcagcggcagcagccgcagccgctgccgcagcggtttcatctgccagcctgccaggaagtgggctgccctcagtggggtctatcaggccccctcacggtctacttaagtcgcctagtgctgccgctgccgctccgctgggagggggtggcggaggctctggcgcatcaggcggatttcagcattggggcggaatgccgtgcccctgtagtatgtgtcaggtaccgcctccacaccaccacgtctccgctatgggggcaggaagtctgcctagattgacgagtgatgcaaagtag

SEQ ID NO: 233498 - DNA, 972 bp, Artificial Sequence
  Description of Artificial Sequence: Synthetic coding sequence
atggactcagatgcttccctggtgagctctagaccaagctcccccgagcctgacgatctgttcttgcctgccagatccaaggggtcgtcaggttccgcctttacaggagggaccgtaagctcgagtacaccgtcggattgtccgccagagctgtccgctgaattgcggggtgctatgggctccgctggtgcccaccctggcgataagttaggaggaagcggatttaaatcatcatccagttctacatcatcatcaactagttcagccgcagcgagttcgaccaagaaagacaagaaacagatgactgagcccgaactgcagcagcttcggctcaaaataaacagtcgtgagagaaaaaggatgcacgacctcaacatcgccatggacggcttgcgggaagtgatgccctacgcccacgggccttccgtaagaaagttgtctaagatagccactttgctcctggcccgaaattatatcttgatgttgactaattctctcgaggaaatgaaacgacttgtaagcgaaatctatggcggacaccatgccggattccatccaagtgcttgcgggggtctggcacactccgctcctctgcccgcagcaacggcccaccctgccgctgccgctcatgcagctcatcaccccgctgtacatcatcccatcttgccccctgctgctgccgcagccgctgccgcagctgccgctgccgctgtcagctcagcatcgctgcctggttccgggttgcctagcgttggttccatccgccctccacatggcctattgaaatccccaagcgccgcagctgccgctccattaggagggggaggcggtgggtctggcgcttccggcggttttcaacactggggaggcatgccttgtccgtgcagcatgtgccaagtaccaccgccacatcaccatgtaagcgccatgggggctggctcacttcctagactaacgtctgatgctaagtag

SEQ ID NO: 233499 - DNA, 189 bp, Artificial Sequence
  Description of Artificial Sequence: Synthetic coding sequence
atggactctgacgccagcctggtttcatctagaccaagctcccccgagcctgacgatttatttctgcctgcaagatccaagggttctagcgggtccgccttcacaggtgggaccgtgagctctagtacaccttcagactgcccccctgagctgtctgccgaattgcgaggcgcaatgggctccgcctag

SEQ ID NO: 233500 - DNA, 1323 bp, Artificial Sequence
  Description of Artificial Sequence: Synthetic coding sequence
atggaataccagatactcaagatgtcgttatgcctattcatcctgctctttctcactcccggaatactctgcatctgccctctccaatgcatatgcactgagagacataggcatgtggattgtagtggtcgcaatctgtcgaccctccccagcgggttgcaagagaatattatccatctaaacttgagctacaatcacttcactgatctgcacaaccagctgacccagtacactaatttgcggaccttggacatctctaataaccggctggaaagtttgcctgcccacctcccacggtccctgtggaacatgagtgcagccaacaacaacattaaactgttggataagtccgataccgcatatcaatggaacctcaagtatctggacgtctcgaaaaacatgcttgagaaagtcgtactcattaagaacacacttcgatccctggaggttctgaacctgagctccaataaactgtggaccgtgccaaccaatatgccctcaaaactacacatcgtggatctgagtaacaatagccttacgcagatactgccaggaacattaattaacttaaccaacctaacccatttgtaccttcacaataataagttcacctttattcccgaccaaagtttcgaccagctgtttcagctccaggaaatcaccctctacaacaacaggtggagctgcgatcataaacagaacattacttatcttctcaagtggatgatggaaactaaagcccatgttattggtactccttgcagtacccagatctcatctttgaaggagcataacatgtacccaactccaagcggatttacaagcagcctgtttactgtgagtggaatgcagactgtcgatactattaattcactgagcgtcgtcacccagcctaaggttacaaagatccctaagcagtatagaaccaaagagacaacattcggcgcaactttgtcaaaggacacgacatttaccagcacagacaaagcattcgtcccttaccctgaggacacttccaccgaaaccataaattcccacgaggcggcagccgctacacttaccatccacctgcaggacgggatggtaacgaatacatccttaacctcctccaccaaatcatccccaacccctatgaccttgtcgatcacttccggtatgcccaataattttagcgaaatgccccagcagtccactacactgaatttgtggagagaggagacaacaaccaatgtgaaaacgcctctgcccagtgtggccaatgcctggaaggtgaacgcctcgttcctactgcttctgaacgtggtggttatgctggccgtctag

SEQ ID NO: 233501 - DNA, 819 bp, Artificial Sequence
  Description of Artificial Sequence: Synthetic coding sequence
atgaatagcgattcatcctctgtaagtagcagagcgtctagtcctgatatggacgagatgtatcttagagaccatcatcataggcaccaccatcatcaggagagtcgcttgaatagcgtgagttctacccaaggcgatatgatgcagaagatgcctggagaatcgctctctcgagctggggcaaaggcggctggcgagtccagcaaatacaagattaaaaaacagttgagcgagcaagatctccagcagctcaggttaaaaatcaatggacgggagcgaaagcgcatgcatgatctcaacctagccatggatgggttgcgggaggtgatgccctacgctcatggcccatctgtccgcaagctgtccaaaattgccactctcttgctggcgcgtaactacatcctgatgctcaccagtagcttagaagaaatgaaacgtctggtgggagagatatacggtggccaccacagtgccttccactgtgggaccgtaggacactctgccggacaccccgcacacgcggctaatagtgttcacccagtccaccccatcctgggaggcgctttatccagtggtaacgcaagttctcctttaagtgccgctagcttgcccgcaatcggtacgatcagaccaccacacagtcttctcaaggctccttctacccctcccgctctccagctcggttcaggtttccagcattgggcaggactgccttgcccctgcacaatttgtcagatgccaccccctccccatctctccgctttgtcgaccgccaatatggccagattatccgccgaaagtaaggatctcctaaaatag

SEQ ID NO: 233502 - DNA, 375 bp, Artificial Sequence
  Description of Artificial Sequence: Synthetic coding sequence
atgtggaaaggatgtctgaccctctatactgggcgaggtggcgaactgcagaagattggcgagttctgcatggtgtatagcgaggtgcctaacttttctgaaccaaacccagactaccgcggtcaacagaacaagggcgctcagtctgagcagaagaataacagcatgaactccaatatggggactggaactttcgggccagttggcaatggggttcacaccggccctgagtcaagggaacatcaattcagtcacgccggtagaagcaatgggcgaggcttgataaacccacagcttcagggcaccgccagcaatcagaccgtgatgacgaccatctctaatggaagagacccccgacgcgcttttaagagatag

SEQ ID NO: 233503 - DNA, 375 bp, Artificial Sequence
  Description of Artificial Sequence: Synthetic coding sequence
atgtggaagggctgcctgactttatatactgggagaggtggggaactgcagaaaattggtgagttctgcatggtgtatagtgaggttccaaacttctctgaacccaaccccgattacagaggacagcagaataagggggcacagagtgaacagaaaaacaatagcatgaactccaacatgggaacaggaacatttggccctgtgggcaacggggttcatactggcccagagtctcgtgagcatcagtttagtcacgccggaaggtctaatgggagaggcttaattaacccccaactgcaaggtacggcctcgaatcagaccgtgatgaccactatcagcaacggaagagatcctcgaagggcatttaagagatag

SEQ ID NO: 233504 - DNA, 615 bp, Artificial Sequence
  Description of Artificial Sequence: Synthetic coding sequence
atgaaccgagtgaatgaccctcttatttttatccgcgacatcaagcctgggttgaagaacctcaacgtggtgttcatcgtgctggagattggaagagtgacaaagacaaaggacggacatgaagttcggtcatgcaaggtggccgacaagactggctcaattactatttctgtctgggacgaaattggtggtttaatccaacccggtgacattattagactgacgaggggctacgcgagcatgtggaagggctgcctaactttgtacactggtcgcggtggggaattacagaagatcggagaattctgtatggtgtacagtgaggttcctaactttagtgagcccaaccccgattatcgtgggcagcagaataaaggagcgcagagcgagcagaagaataacagtatgaactccaatatgggcactgggacttttggaccagttgggaatggggtacatacagggcctgagagccgggagcatcaattttcccacgcaggccgtagcaatggacgcggtttgatcaaccctcagctgcagggtactgcgtcgaatcagaccgtaatgactacaatctccaacggaagggaccccaggagagccttcaagagatag

SEQ ID NO: 233505 - DNA, 636 bp, Artificial Sequence
  Description of Artificial Sequence: Synthetic coding sequence
atgactactgagactttcgtgaaggatatcaagccaggattaaaaaacctcaaccttattttcattgtgcttgagacggggagggttaccaaaaccaaggacggtcacgaggtgaggacgtgtaaagtggcagataagacaggctcgatcaatatcagcgtgtgggacgacgtggggaatcttatccaacccggagacatcattaggcttacaaaggggtatgcttcagtgttcaagggatgcctgaccctgtacactgggaggggtggcgatctacaaaagataggcgaattttgtatggtgtactccgaagtgcctaattttagtgagccaaaccctgagtacagtacacagcaggctcctaacaaggcggtgcagaatgattctaatcctagcgctagccagcccactaccggaccctccgcggctagtcccgcttccgagaatcagaatgggaacggcctatccgctccgcctggccctggaggcggaccccaccctccccacaccccctctcatccacccagcaccaggattactagaagtcagcctaatcataccccagccggaccaccgggtcctagttccaatcctgtgtccaatggaaaggagacgcgacgctcctccaaaaggtag

SEQ ID NO: 233506 - DNA, 636 bp, Artificial Sequence
  Description of Artificial Sequence: Synthetic coding sequence
atgaccacggaaacgtttgtaaaagacatcaagcctggcctgaagaaccttaatcttatctttatcgtgttggagacaggacgcgtcactaagactaaggatggacatgaggtgcggacttgcaaggtagccgacaaaactggttccatcaatattagcgtgtgggatgacgtgggcaacctaatccagcccggtgacatcatacggctgacgaaggggtacgcgagtgtctttaaaggatgcctcacgttatacacaggtcggggtggtgatttacagaagataggggagttttgcatggtatactcagaggtgccaaatttcagtgaacccaatcctgagtacagcacacagcaggctcctaacaaggccgtgcaaaacgactccaaccctagcgccagccaacccaccaccggtccgagcgcagccagtccagcgtcggaaaatcaaaacggaaatgggctaagcgcccctccaggtcccggaggtggacctcacccaccccatacgcctagtcaccctcctagtactagaattacccggagtcaacctaaccacacgccagccggacccccaggcccaagttctaatcccgtctctaatggcaaggaaactaggcggagcagcaaaaggtag

SEQ ID NO: 233507 - DNA, 636 bp, Artificial Sequence
  Description of Artificial Sequence: Synthetic coding sequence
atgactacggagacttttgtaaaggacatcaagccgggattgaaaaacctcaaccttattttcatcgtcctggaaacaggtcgagttaccaaaacgaaggacgggcatgaagtgcgaacatgcaaggtagccgacaagacgggctcaatcaacatttctgtgtgggatgatgtgggtaacttgatacagcccggagacataatacgactgacaaaggggtacgcctccgtgttcaagggctgtttgacattgtatacggggagaggaggagacctgcagaaaatcggagagttttgcatggtctacagcgaggtgcccaacttttctgagcccaaccccgagtatagtacacagcaagctcctaacaaggcagtgcaaaatgactctaacccttccgcatctcaacctactaccggaccttcagccgcatcccccgctagcgagaaccagaacggcaacgggctgagtgcccctccgggacctggagggggtcctcatcccccacacaccccctcgcatcctccgagcaccaggataactcgctcccagccaaaccacactccagccggaccacctggaccctctagtaaccccgttagtaatgggaaggagactcggcgttcttcaaagagatag

SEQ ID NO: 233508 - DNA, 459 bp, Artificial Sequence
  Description of Artificial Sequence: Synthetic coding sequence
atgacgactgaaacctttgtgaaagatattaagcctggactaaagaatttaaatttgatcttcatcgttcttgaaacaggcagggtgacgaagacgaaggacggacatgaggtcagaacctgcaaagtggccgataagactgggtccataaacatatctgtttgggacgacgtcggcaatctgatacagcccggtgatatcatcagattgacgaaaggctacgcctctgtgttcaaaggctgtctcactctatacacgggtcggggtggcgacctgcagaagattggggagttctgtatggtgtactcggaggtcccgaatttctccgagcccaacccagaatacagtacccaacaggctcctaataaggccgtccaaaacgattcaaacccgtctgcaagtcaaccaaccacaggaccttccgctgcgagcccagcctccgagaatcagaacgggtag

SEQ ID NO: 233509 - DNA, 435 bp, Artificial Sequence
  Description of Artificial Sequence: Synthetic coding sequence
atgacgactgagactttcgtgaaggatatcaaacccggtcttaaaaacttaaacctaatttttatcgtacttgaaactggcagagtgacaaagactaaggacggccatgaggttcgaacatgtaaggtagccgataaaacgggatctatcaacattagcgtgtgggacgacgttgggaacttgattcagccgggagacattataaggctgaccaaaggttatgcctctgtgttcaaggggtgtttgaccctctacaccggcagaggtggtgacttgcagaagatcggcgagttttgtatggtgtattccgaagtacctaacttttctgaaccaaaccccgaatactctacacagcaggctcccaataaggcagtgcagaatgactctaatccgtctgccagtcagcccacgactggtcccagcgcagcttcttag

SEQ ID NO: 233510 - DNA, 2409 bp, Artificial Sequence
  Description of Artificial Sequence: Synthetic coding sequence
atggggcacccccctttggaattctctgactgctatctagacagtcccgatttcagggaaaggctgaagtgctacgaacaggaactggaacgcactaataaatttatcaaggatgtgataaaagacggcaatgcccttatcagtgctatgcgcaattattcgtccgcggtacagaagttctcccagaccctgcagtcttttcagttcgattttataggggacacgctgacagacgatgagatcaatatcgccgagtccttcaaagagtttgctgaattgttaaatgaggtcgaaaacgagcgaatgatgatggtgcataacgcaagcgacttacttatcaagcccctggaaaacttccgcaaggaacagatagggttcacaaaggagagaaagaagaagttcgaaaaggatggggaaaggttctacagcctgctggatcggcacctgcatctctcttccaagaagaaggagtcgcagctgcaggaagctgatttgcaggttgataaggagcgccacaattttttcgaatcctcgctggactacgtgtaccaaatccaggaggtgcaggagagcaaaaagtttaacattgttgagccggtcttagcctttctgcatagtctttttataagcaatagcctgacagtggaactcacccaggatttccttccctacaagcaacagcttcagctaagtctccagaacacacgaaaccacttctcatccactcgggaagagatggaggagctcaagaaacggatgaaggaggcaccacagacttgcaagctcccagggcagcccaccatcgaagggtacctgtacacgcaggaaaagtgggctctggggatcagttgggtgaaatactactgtcagtacgaaaaagagacgaaaaccctgacgatgactcccatggagcaaaaacctggagctaagcaaggtccactggacctgaccttaaagtactgcgtgcgccgtaaaaccgagtccatcgacaaacgtttctgttttgatatcgagacaaatgaaaggccaggcaccattactctgcaggccctgagcgaggctaaccgcagactgtggatggaggctatggatggaaaggagcctatctatcacagtcctattacaaagcagcaagagatggagctcaacgaagttggattcaagttcgtccggaaatgcattaacattatagagaccaagggcatcaaaaccgagggcctgtaccgtaccgtcggctccaacatccaggtacaaaaacttctgaacgcgttcttcgatcccaagtgcccaggcgacgtggacttccacaatagcgactgggacatcaaaacaatcacttctagcctgaagttttacctgaggaacctctccgagccagttatgacctatcggttgcacaaagaattggtgtcagccgctaagtctgacaatctcgactataggctgggcgctattcacagcctggtctataagctccccgaaaaaaatagagaaatgttggagctactcattagacacctggtgaatgtgtgcgagcatagcaaggagaacctgatgaccccttccaatatgggtgtgatctttggacctaccctgatgagagctcaggaagacacagtggcagcgatgatgaacataaagtttcagaatattgtcgttgaaatccttattgagcatttcggaaagatctacctggggccacccgaggaaagtgccgcaccccctgttcccccacctcgggttactgccagacgccacaaacccattactatcagtaaacggctgttgagagaaaggaccgttttctacacttcttctctggacgaaagcgaggatgaaattcagcatcaaacgccaaacgggactattacctcatccattgaacctccaaagcctcctcagcaccctaagcttcccatccagcggtctggagaaacagacccaggaaggaaatctcctagcaggcccatcctcgacggaaagctggagccctgtcccgaggtcgacgtcggaaagttagtttctcgtctgcaggacggcggaactaagatcacacccaaggccacaaacgggccaatgcctgggagtggtcccaccaagaccccaagcttccatataaagagacctgcccctcggcctctggcccaccacaaagaaggggatgctgacagcttttcgaaggttcggccacccggtgagaagcctaccattattcgacccccagtaaggccccctgacccgccatgccgcgctgccaccccccagaaacctgagcccaagcctgatatagtggctgggaacgccggtgagatcacgtcctccgtggtcgcctcccgtacgaggttttttgagacagctagcaggaagactggctcctcacaagggagactaccgggtgatgaatcctag

SEQ ID NO: 233511 - DNA, 2085 bp, Artificial Sequence
  Description of Artificial Sequence: Synthetic coding sequence
atgggccacccacccctggagttctcagactgttaccttgactcccctgacttccgggagcgcctgaaatgttatgagcaggagctagaaaggacaaacaagtttataaaggacgttatcaaggatggcaacgccctgatctccgccatgagaaactactcctcagccgtccaaaagttttctcagactctgcaaagctttcagtttgatttcataggggataccctgaccgatgacgagattaatattgcagagagcttcaaggaattcgccgagttgctgaacgaggttgagaatgaaaggatgatgatggtccacaacgcttccgaccttttgatcaaaccactcgagaacttccgaaaggaacagattggatttacgaaagaaaggaagaaaaagtttgaaaaggatggagagcgcttttattctctcctggatcgccacttgcacctaagtagcaagaaaaaggagagccagttacaagaagccgacttacaggtcgacaaggaaaggcacaacttttttgaatctagcctggactacgtatatcagatccaagaggtgcaagaatcgaaaaagtttaatatcgttgaacctgtgctagccttcctccacagcctgttcattagtaattccctcacagtcgagctcacccaggacttcctaccctataaacagcagctccagctttctctccagaacacaagaaatcacttctccagcacgcgggaggagatggaggagcttaaaaagcgcatgaaggaggctccccagacctgcaagctgccaggccaacccacgattgagggctacctttacacgcaagaaaaatgggccctaggtatatcatgggtgaagtactactgtcagtacgagaaggagaccaagactctcaccatgacccccatggaacaaaaacccggagccaagcaagggccactggatctgaccctgaagtactgcgtcagacggaaaacagaaagcattgataagagattttgcttcgatatcgaaactaacgaacggcctggtaccatcactctgcaagcactgtccgaggctaatcggaggctctggatggaggccatggacggcaaggagcccatctaccacagcccaatcacaaagcagcaggaaatggaactgaatgaggtgggcttcaaattcgtgagaaagtgcatcaatataatcgagaccaagggcattaagacagaaggcctctatcgaacagtcggttccaatatccaagtgcagaagctgcttaacgcattttttgatcccaaatgtccaggtgatgttgacttccacaactctgattgggatattaagactattacctcctctttgaaattttatctgcgcaatctgagtgaacccgtgatgacctaccgcctgcacaaagagctggtgtccgcagccaagtccgataatttagactaccgcttgggcgctatccacagtctggtgtacaaactgccagagaaaaaccgtgagatgttggagcttttaatccgccatttggtaaacgtgtgtgaacactccaaggaaaatctaatgaccccatctaatatgggtgtcatatttggcccaactctcatgcgggcacaggaggacacagtagccgctatgatgaatattaagttccaaaacatcgttgtcgaaatcttaattgaacatttcggcaagatttacttgggaccacccgaggaatcagctgccccaccagtaccccctcccagagttacagccaggaggcacaagccaatcaccatctccaaacgcttgctgagggaacggactgtgttttataccagctcacttgatgaaagcgagggtgacgccgactcattctctaaagtcaggccacctggggaaaaaccaaccataattcgtccacccgtcaggccccctgatcccccatgccgcgcagccactcctcagaagcctgagcccaagccggatatcgtcgctgggaacgctggggagataacgtcctcagtggtggcttcaaggacaagattctttgaaacagcatctcgcaagacaggatcaagccagggaagattacctggtgacgaatcatag

SEQ ID NO: 233512 - DNA, 225 bp, Artificial Sequence
  Description of Artificial Sequence: Synthetic coding sequence
atgttagaactactgatcaggcaccttgtgaacgtgtgcgagcactccaaggagaacctgatgacaccctcaaacatgggcgtaatttttggcccaacactcatgcgagcgcaggaagatactgtcgcggcaatgatgaacatcaagttccaaaacattgtggttgagattttaatagaacactttggaaaaataagctcgtttttcttgcaccgctctatttag

SEQ ID NO: 233513 - DNA, 3111 bp, Artificial Sequence
  Description of Artificial Sequence: Synthetic coding sequence
atggcctcatcagtgggcaacgttgctgacagtacagggcttgccgaactggcacaccgcgaatatcaagctggcgatttcgaggccgctgaacggcactgtatgcaactctggcgacaggagcctgataacaccggcgtgctgttgttactgtcctccatccattttcagtgccgcagactggatcggtctgcacacttctcaacgctggccataaagcaaaacccactgttagcagaagcgtatagcaaccttggcaacgtgtacaaggaaagaggacaattgcaggaggccatagagcactatcggcatgcacttcggctcaaaccagactttatcgacggctacattaaccttgctgccgcactggttgctgcgggagacatggagggcgctgtacaggcatatgtgtcggcattgcagtataaccctgacttatactgcgttcgaagcgatctaggcaacttactcaaggccctcgggaggttagaggaggcaaaggcatgctacctgaaggccatcgagactcagcccaattttgccgtagcatggtccaacctgggatgtgtgtttaacgcccagggagaaatttggctggctatccatcacttcgagaaggcggtgactctcgaccctaatttcctggatgcttatattaatctggggaacgtgcttaaggaagcacggattttcgatcgcgctgtggcagcctatttgagggctctcagtctgagccccaaccacgccgtcgtgcacggcaatctggcttgcgtatactacgaacagggcctcatcgacctggccattgacacatatagacgggctatcgagctccagcctcactttcctgatgcttattgcaatctggccaacgccctgaaggagaaaggaagtgttgctgaagctgaggattgctacaacacggccttgcggctgtgccccactcatgcagattctctgaataatctcgctaacatcaagagggaacaggggaacatagaggaagcagtcaggctatacaggaaagcactggaggtgtttccagaatttgccgcagcccactctaacttagcctcagtgctgcagcagcagggaaagctgcaggaggcactaatgcactacaaggaagcaatacgaatctccccgaccttcgccgacgcttattcaaacatgggcaatacgttgaaggaaatgcaggatgtccaaggcgcactgcagtgctacacaagggccattcagatcaatcccgcatttgccgacgcccactccaacctcgcctctatacacaaggattccgggaacatcccagaagccatcgccagctacaggactgctctgaaactgaaaccggatttccctgatgcatactgtaaccttgctcactgtctgcaaatcgtatgcgattggacagactacgacgagcgaatgaagaagttagtcagcattgtggccgatcaactcgagaaaaatagactaccctctgttcatccacaccatagcatgctgtaccccctcagccacggtttccgtaaagcaatcgccgaacgccatggtaacctatgcctggacaagatcaacgttctacataagccaccttatgagcaccccaaagacctgaagctctccgacggcagacttcgcgtaggttatgtatccagtgacttcgggaatcatccgactagtcacctgatgcagtctatccccggtatgcataatccagataagtttgaggtcttctgctacgccctcagtcctgacgacggtacaaattttagagtcaaggttatggccgaagcaaatcattttatcgatctcagtcagatcccgtgcaacggaaaggctgccgaccgcatccaccaggatggcatccatatccttgtcaatatgaacggttacacaaaaggggcacggaatgaactgttcgctttacggccagcccctatacaggcaatgtggttggggtatcccggaacaagcggcgcactttttatggactatattattaccgaccaggagacttcgcccgctgaggttgccgaacaatattccgagaaactggcctacatgccacacacgttctttatcggagaccatgccaatatgttcccccacctaaaaaagaaagctgtgattgattttaaatctaatggtcacatctatgataacagaattgttcttaatggcattgatcttaaagctttcctggatagtttgcccgacgtgaaaatagttaaaatgaaatgcccggacggcggagacaacgccgatagtagtaacactgccctcaatatgcccgtgatccccatgaatactatcgccgaggctgtgatagagatgatcaacagaggccagattcaaattactattaatggcttttccatcagtaacggtctcgctaccacacagatcaataataaagccgctaccggcgaggaggtgccaaggactatcattgtgacaactagatcgcagtatgggctgcccgaagatgctattgtatactgcaatttcaaccaactgtacaaaatagacccttctaccctccagatgtgggcaaacatcctcaagcgggtacccaattcggtgctatggcttttgaggttcccagcagttggcgaacccaatatccagcagtatgcccagaatatgggtttgccgcaaaatcgcatcatcttttcacctgtggctcctaaggaggaacacgttagacgtggacagttagccgatgtgtgtttggacacgccattgtgcaacggccacacaaccggcatggacgtactttgggcagggacacctatggtaactatgcccggagaaacactggctagccgtgttgcggctagccagctcacatgcttgggatgcctggaactcatcgccaaaaataggcaagaatacgaagacatcgccgtgaaactaggcaccgatctcgagtatcttaagaaggtgaggggcaaagtctggaagcagcgtatctccagccccctgtttaacacaaaacagtatacaatggagctagagaggctttaccttcaaatgtgggagcattacgcagctgggaacaagcccgaccacatgatcaagcctgtggaggtcacggagagtgcctag

SEQ ID NO: 233514 - DNA, 3141 bp, Artificial Sequence
  Description of Artificial Sequence: Synthetic coding sequence
atggccagcagcgttggtaatgtagccgattctacagagcctactaagagaatgttgagcttccagggattagccgaactggcgcaccgcgaatatcaagctggcgacttcgaggccgctgagcgccactgcatgcaactgtggaggcaggaacccgataatactggcgtcttactgctgctgtctagtattcatttccaatgccggcgacttgatagatcggcccacttttcaactcttgccattaaacagaatcctctgctggccgaggcttactcgaatttgggtaatgtttataaggagagaggacagctgcaagaggccatagaacattataggcacgccttaaggctgaagccagatttcatcgatgggtatattaatctggctgctgccctggtggcagcaggcgacatggagggcgctgttcaggcctatgtgagcgccctgcagtacaatcccgacctctattgtgtgcggtcagatctagggaatctcctgaaggccctgggcagattagaagaagccaaggcgtgctacttgaaagcaattgaaactcaacctaactttgccgtcgcttggtcaaacctggggtgtgtcttcaatgcacagggggagatctggctggcgatccaccattttgaaaaagcagtgactctagatcccaactttctggacgcttacatcaatctggggaacgtgctgaaagaggctaggatttttgatcgggctgtggctgcttatttgagagcgctgtctctgtcccctaatcatgctgttgttcatggtaacctcgcctgtgtttattatgaacaggggctaatagacctggccatcgatacgtatcgcagggctatcgagttgcaaccgcattttcccgatgcctactgcaacctggccaatgcactgaaggaaaagggctctgtcgcagaagcggaggattgctacaacacagcccttcggctttgcccaacccacgccgacagcttgaacaacttagctaatattaagagagaacagggaaatatagaggaggcagtacgcctgtacaggaaggccctggaagtgtttcctgagttcgctgcggctcattctaatctcgcgtccgtgctccagcagcagggaaagttacaggaggcccttatgcactataaagaggcgataagaatttcaccaacatttgcagatgcctactccaacatggggaatacccttaaggaaatgcaggacgttcagggggctctgcagtgctatactcgggctatacagattaatcctgcgttcgccgacgcacattctaaccttgcatctatacacaaagattcaggtaatattccagaggcgatcgcatcataccgaaccgctctcaagctcaagcctgactttcctgacgcttactgcaatctcgcacactgtctacagatcgtgtgtgattggacggactatgatgaacgtatgaagaagctggtgagcatcgtggccgatcaattagaaaaaaatcgactgcccagcgtgcatccacaccattccatgctgtatcccttgtcccacgggttccgtaaagcaatcgcagagcgtcacggcaatttgtgtctggataaaatcaatgtcctgcataaacccccatatgaacatccaaaggatctgaagctctctgatggcagacttagagtcggatacgtttcgagcgactttggcaaccatcccacttctcatctgatgcagtccatccccggtatgcataatcctgataagttcgaggttttttgctacgcgctgagtcctgatgacgggaccaacttccgtgtcaaggttatggcagaggccaatcacttcatcgatctgagtcaaatcccgtgcaacggtaaggctgctgaccggatccaccaggatggcatccacatcctcgtgaacatgaacggatacaccaagggagcacgaaacgaactctttgccctcagacctgcaccaatacaagctatgtggcttgggtacccagggacttcaggggctctgtttatggactatatcattactgatcaggaaacctctcccgcagaggtggctgagcaatactccgagaaactggcgtacatgcctcatactttttttattggcgaccatgcaaatatgtttccacatctcaagaagaaagccgtgatagacttcaagtccaatgggcacatctacgataatcgcattgttctcaacggaattgatctgaaggcattcttggactccctgcccgacgtcaaaattgtgaagatgaaatgccctgatggtggagacaacgccgattcgtctaacacggcgctgaatatgcctgtcatacccatgaacaccattgcagaggctgtcattgagatgatcaatcggggacagattcaaatcactatcaacggatttagcatctcaaacggcttagccacaacccagataaacaataaggccgctactggagaggaggttccacggacaatcatcgtgacaacgagatcacaatacggcctgccggaggacgccatcgtctattgtaactttaaccaactgtataagatcgaccccagcactctccagatgtgggccaatatcctgaagagggtgcctaattctgtcctgtggttactgcggtttcccgcagtgggcgagcccaatatccagcagtatgcgcagaacatgggattacctcaaaatcggattatttttagtcctgtcgccccaaaagaagaacacgttcgtcggggacagctggctgacgtgtgcttggacacgcctttgtgtaacggccacacgacaggcatggatgtgctgtgggccggaacacctatggtgacaatgcccggtgaaacgctcgccagcagggtagcggcatctcaactcacctgtctcgggtgtctggaactgatcgccaaaaacagacaggagtatgaagacatcgcagtaaaactgggtaccgacctcgaatacctcaagaaggtgcggggtaaggtgtggaagcaaaggattagtagccctctgttcaacactaagcagtatacaatggagctcgagcgattgtacctgcagatgtgggagcattacgccgcagggaataagcctgaccatatgataaaacccgtagaagtgacggagtctgcttag

SEQ ID NO: 233515 - DNA, 330 bp, Artificial Sequence
  Description of Artificial Sequence: Synthetic coding sequence
atgtcaatcactgacgttcttagtgccgacgacatcgctgctgctctgcaggaatgcagagatccagatacatttgaaccacagaagtttttccagacttccggccttagcaaaatgtccgcaaatcaggtaaaggatgtatttagatttatcgacaatgaccagagcggatatctcgacgaagaggagcttaaattcttcctccagaagttcgagagtggggcacgtgaactgactgagtcagaaacaaaatcacttatggctgccgcagataacgatggggacgggaagatcggggcagaggaattccaagagatggtccacagttag

SEQ ID NO: 233516 - DNA, 330 bp, Artificial Sequence
  Description of Artificial Sequence: Synthetic coding sequence
atgtccattaccgacgtgcttagcgctgacgacatagccgctgcgctccaggaatgcagagatcctgacaccttcgagccccagaaatttttccagacctccgggctgtccaagatgagcgccaaccaggtcaaagatgtgtttcgctttatagacaatgatcagtcaggatacctcgacgaggaggaactcaagttctttctccagaaattcgaatccggcgcacgcgagctgactgagtccgaaacgaaatccctgatggccgctgcagacaatgatggcgacggaaagataggggctgaggaattccaggaaatggtccattcctag

SEQ ID NO: 233517 - DNA, 1638 bp, Artificial Sequence
  Description of Artificial Sequence: Synthetic coding sequence
atgcctcctttcctcttgcttacctgcctatttatcaccggcacatcagtgagtcctgttgcactagacccttgttccgcttacatcagccttaacgagccctggcgcaataccgatcaccaattagacgaatcccaagggccaccattgtgcgacaatcacgtgaacggtgagtggtaccactttactggcatggccggagatgccatgcccacattttgcattccagagaatcactgtggaacacacgcaccagtgtggcttaacggatcgcaccccctggagggagacggtatagtacagagacaggcgtgcgcttccttcaatgggaattgttgcctgtggaataccactgtggaagttaaggcttgtcccggaggatactatgtttatcggctgactaaacctagtgtttgcttccacgtgtactgtgggcacttttatgatatctgtgatgaagactgtcacggttcctgttctgatacgagcgaatgcacctgtgcccctgggactgtacttggcccagatagacagacctgtttcgacgaaaatgagtgcgagcaaaacaatggaggttgttcagaaatttgcgtaaatttgaaaaactcttacagatgcgaatgtggagtagggagggttctccgctcagacggcaagacttgtgaagatgtggaggggtgccacaacaacaacggcggttgctcccactcttgcctcggctccgagaaaggataccagtgcgagtgcccacgcggactggtactcagcgaagacaaccatacctgccaggtcccggtgctgtgcaaatccaatgccatagaggtcaacattcctagggagttagtgggaggattggagttgttcctgacaaatacctcctgtagaggggtgtcaaacggaacacacgtcaacatccttttctcgttgaaaacgtgtggaacggttgtcgacgtggtcaacgataaaattgtggccagcaacctggtgactggccttcccaagcaaacccccggttcaagcggggacttcatcatccgaaccagtaagctgttgatccccgtcacttgcgagtttccccgtttgtataccatatctgaggggtatgttcccaacctaaggaattcccccttggagatcatgtctcggaaccatggtatatttccgttcactctcgagatcttcaaagacaatgagtttgaggaaccttaccgggaagcccttcccactcttaaactccgcgatagcctttatttcggcatcgaacctgtcgttcacgtgtccggccttgagtcccttgtcgaatcttgcttcgccaccccgacgtctaaaattgatgaggtcctgaagtactacttaatcagagacggatgtgtttccgacgatagtgtcaagcagtacacctcaagggatcaccttgcaaaacatttccaggtgcctgtatttaaatttgtggggaaggatcacaaagaggtgttcctgcactgtagagtcctggtgtgcggcgtcctggatgagagatccagatgtgctcaaggatgtcatcgccgtatgcgcagaggcgctggcggagaagactctgctggacttcagggacagacgcttacggggggaccaatccgcatcgactgggaggactag

SEQ ID NO: 233518 - DNA, 966 bp, Artificial Sequence
  Description of Artificial Sequence: Synthetic coding sequence
atgccacctttcctacttctcacttgtctgttcatcacaggtacttcagtgagtcctgtggccctggatccttgctccgcctacatttccttaaatgaaccctggcgtaacacagatcaccagctagatgaaagccagggtccacccctatgtgataatcacgtgaatggcgaatggtaccatttcaccggcatggctggggatgcaatgcctacgttctgtatcccagagaaccattgtggtacccatgcccctgtctggttgaatggttctcatcccctggaaggcgacggaatagtccagcgccaggcgtgtgcttcatttaacgggaactgttgcctttggaacaccacggtggaggtcaaagcctgccctggtgggtactacgtataccgacttaccaagccgtccgtgtgcttccatgtctattgcggacatttttacgatatctgcgatgaagactgccacggatcctgctcagacactagcgaatgcacctgtgcgcctggaaccgtgcttgggccagacaggcaaacatgcttcgatgaaaatgaatgcgaacagaacaatggtggttgctcagaaatttgcgtcaatctcaagaactcttataggtgtgagtgtggtgtaggtagagttctccggagcgatggcaagacttgtgaagacgtggagggatgtcataataacaacgggggttgcagtcactcttgcctggggtccgaaaaggggtaccagtgcgagtgtcctagggggctggtgctgagcgaggacaatcatacttgccaggtacctgtgctgtgcaagagcaatgcaatagaggtgaatatccccagggagttggtcggagggcttgagctgtttttgaccaacaccagctgccgtggagtttccaatggcacccacgttaatatactgtttagtcttaaaacctgtggaacagtcgtggattcctgttttcagtag

SEQ ID NO: 233519 - DNA, 735 bp, Artificial Sequence
  Description of Artificial Sequence: Synthetic coding sequence
atgggactggaactgttcctggatcttgtgtcccagccctcccgggcagtttatatatttgctaaaaagaacggaattccactggagcttagaacggttgatctggtgaagggtcagcataagagcaaagaattcctccaaataaattcccttggcaagttacctaccctcaaagacggagatttcatccttaccgaatcatccgccattctcatctatctgtcgtgcaagtatcaaacacctgatcactggtacccaagtgacctgcaagctagggctcgagtacacgagtaccttggatggcatgccgactgcattagagggactttcggtatcccgctgtgggtccaggtactgggacccctgatcggtgtccaagtaccgaaggaaaaggttgagcggaatcgtaccgcgatggaccaagcccttcagtggctcgaagacaagttcctcggtgaccgacctttcttggcagggcagcaggtcaccttggccgacctaatggcactggaggaattgatgcaacctgttgcccttggctatgagctgtttgaaggacgccctcggttggccgcatggcggggtagagttgaagcctttctgggagcagaactctgccaggaggcccattctatcattctctccattctggagcaagccgcaaaaaagacattgcccaccccttcccccgaggcctatcaggcgatgttgctgcgcattgctaggatcccctag

SEQ ID NO: 233520 - DNA, 696 bp, Artificial Sequence
  Description of Artificial Sequence: Synthetic coding sequence
atggctagcatggcagcaatcggtagctgctccaaagagtaccgtgttctgttaggccaactacagaaacagaccgatttgatgcaggatacttccagacttctagacccatacattcggattcaggggcttgacgtgccgaagttaagagagcactgccgggaacgtcccggtgccttcccttccgaggagaccctccggggactgggtagaaggggctttctgcaaaccctgaatgcaaccctgggttgtgttctgcaccggctggctgatctggagcaacggctaccaaaggcgcaggacctcgaacgctcaggtttgaacatagaggacctggaaaaacttcaaatggctagacctaacatcctggggcttaggaacaatatctattgcatggcacagctgctggacaacagtgacacagctgagccaaccaaggccggacggggagcgagtcagccaccaaccccaacccccgcttctgatgcattccaaaggaagctggagggatgtcggttcctgcacggatatcataggtttatgcactcagtgggcagagtcttctcaaaatggggggagagcccgaatagatctaggcgtcacagcccccaccaggctttacggaaaggcgttcgaaggacccggccatcacgcaaaggtaaacgtctgatgacaagaggtcagcttcctaggtag

SEQ ID NO: 233521 - DNA, 2940 bp, Artificial Sequence
  Description of Artificial Sequence: Synthetic coding sequence
atggctctgttcgctgtgttccagaccacttttttccttacactgttgtccctgcggacctatcagtccgaggttctcgccgagcgcttgcctctaacccctgtgtctctgaaggtaagcaccaactccacgcgccagtccctccacctgcaatggacggtccataatcttccgtaccaccaggagcttaagatggtgtttcagatccaaatctcccgcatagagactagcaacgtaatttgggtgggcaactatagtaccactgtaaagtggaaccaggttctccattggtcctgggaatccgagcttcccctcgagtgtgccacccatttcgtgaggattaagagtctggtggatgacgcgaagttccccgagcccaacttctggtcaaactggtcttcttgggaggaggtgtcagtgcaggactccaccgggcaggatatcctgttcgtattcccaaaggataagctggtcgaggaggggaccaatgtgaccatttgttacgtctcaaggaacatacagaataatgtgtcttgttacctggagggtaaacaaattcacggtgagcagctggacccccacgtgactgcatttaacttgaacagcgtcccatttattaggaataagggaaccaacatatattgcgaggctagccaggggaatgtttcggaaggcatgaagggcatcgtgcttttcgtttctaaagtcttggaagaacctaaggatttttcctgtgaaacggaggacttcaaaacgctgcattgtacatgggaccctggtaccgacactgcccttggctggagcaagcagccaagccagtcatatactttgttcgagtcttttagcggggagaaaaagctgtgtacacacaagaattggtgtaactggcaaataactcaggattctcaggaaacctacaatttcacactgattgctgagaattatttacggaagcgatctgtgaatattttattcaacctgacccaccgggtctatctgatgaatccattcagcgtgaacttcgagaacgtgaacgctactaatgccatcatgacatggaaagttcatagcatcagaaataattttacatatctgtgccagatagaactgcatggggaggggaaaatgatgcagtataacgtttccattaaagtgaatggcgagtacttcctgagtgagctggaacctgccacagaatacatggccagggtccgatgtgcggacgcctcccatttttggaaatggagtgagtggtccggccagaactttacaaccctcgaggcggcaccatccgaggcgccagatgtttggcgaatcgtgtctctcgagcccggaaaccacaccgtgacgttgttttggaagccgttgagcaagttacatgccaacggcaaaatcctgttttataacgtagtagtcgaaaaccttgacaagccctcgagcagtgagctgcactctattcctgccccagccaactcaaccaagttgatcctggatcgttgcagctatcagatctgcgtgatcgctaacaattctgtgggggctagcccagcttccgtaatcgtgatttctgcagatccagagaacaaagaagtggaggaggaacgcattgctgggactgaaggaggattctctttaagttggaaaccccagcctggcgacgtaattggatacgttgtggactggtgtgatcacacacaggatgtcttgggcgattttcagtggaagaatgtgggtcctaataccacctctactgtcatatcgaccgatgccttccgccctggtgtccgctacgattttaggatttacgggctgtccacaaagcggattgcttgtctcctcgagaaaaaaactgggtattcgcaggagctggctcccagtgacaacccccacgtgttggtcgatactttaacatctcactcattcacgctgagctggaaggactattccactgagagccaacctggtttcattcagggttatcacgtttacttaaagtcaaaagcaagacagtgtcacccccgtttcgaaaaggcggtcttaagtgacggaagcgaatgctgtaagtataaaattgacaacccggaagagaaggcgctaattgtggacaatttgaagcctgaatctttttatgagttctttattacgccattcacatcggcaggcgaagggccaagcgccacatttaccaaggtcactacacccgacgaacatagctccatgttgattcatatactgctgcccatggtgttctgtgtgctactgatcatggtgatgtgttatctcaagagccaatggatcaaagagacgtgttaccccgacattcccgatccttacaagtctagcattctctccctgataaagtttaaagaaaatcctcatcttataatcatgaacgtgtccgactgtataccagacgcgatcgaagtggtgtctaaacccgaagggacaaaaattcagttcctaggcacccggaagagtctcactgaaacagagctcactaaaccaaactatctctatctattacctaccgagaaaaaccacagcggtcctgggccttgtatctgcttcgagaacctcacctacaatcaagccgcttctgactccggcagttgcggacatgtccctgtgagccctaaagcaccaagtatgctgggattgatgaccagcccagagaacgtcctaaaggctcttgagaaaaactacatgaacagtctaggtgagatcccagccggagagacaagcttgaattacgtgagccagttagcaagccctatgttcggagacaaggattcgttgcccaccaatcccgttgaggctccccattgctccgagtataagatgcagatggctgtgtcattacgactggctctacctcctccgaccgagaatagtagccttagctctatcactttgctggatccgggtgagcattactgctag

SEQ ID NO: 233522 - DNA, 1029 bp, Artificial Sequence
  Description of Artificial Sequence: Synthetic coding sequence
atggctctcttcgcagttttccagaccacattctttttgactctgctcagcctcaggacatatcagagcgaggtgctggctgaacgccttcctctcacacctgtgtcactgaaagtcagcacaaatagtaccagacagtctctacatctgcagtggacagtccataacttgccctatcatcaggaactgaaaatggtgtttcaaatccagataagtagaatagagacatccaatgtgatatgggtgggaaattatagcacaacagtcaaatggaatcaggtcttgcattggtcttgggagagcgagcttccacttgaatgtgcaacacattttgtgaggataaagtctcttgtggacgacgccaaatttcccgagccaaatttctggtctaactggagttcatgggaggaggtttcggttcaggactctacaggacaggacatcttgttcgtcttccctaaggacaaattggtggaagagggcaccaacgtgactatttgttacgtgtccaggaatatccaaaataacgtgtcttgttatttggagggcaagcaaatccatggggagcagctggaccctcacgtgacggccttcaatctgaatagcgtgcccttcattcggaacaaaggcactaatatttattgcgaggcaagccagggtaacgtgtccgagggcatgaaggggatcgtgctcttcgtaagcaaggtactggaggagccaaaagacttcagttgtgaaaccgaagactttaagactctccattgcacttgggatcccggaaccgacaccgccctcggctggtcaaaacaaccgtctcagagctacactctcttcgaatcgttttctggagagaaaaagctgtgcacccacaaaaattggtgcaattggcaaataacacaggacagccaagagacgtacaatttcactctgatcgcagaaaactatttacgtaaaagatcagtgaacatcttatttaacttaacacatagaggcgaaacaagagtggtcacagctcatagaggacactag

SEQ ID NO: 233523 - DNA, 1398 bp, Artificial Sequence
  Description of Artificial Sequence: Synthetic coding sequence
atgaacgcccagttgaccatggaggccataggtgagctgcatggggtgtctcacgagcctgtcccagccccagcagacctgctgggtggcagtcctcatgcaaggagttccgtggcccaccggggtagccacctgccaccagctcatccacgatcaatgggaatggcatcgctgctggatggcggaagtggtgggggagattaccaccaccaccacagggcgccagaacattcactggcgggacccctgcatcctacaatgacaatggcctgcgaaacgccgcctggaatgagcatgcctacaacctacaccacacttacaccattgcaaccccttcccccaataagtaccgtcagcgataaatttccgcaccatcaccatcaccaccaccaccatcatcatcctcaccatcaccagcggctcgcgggaaacgtgagcggtagcttcacactcatgcgcgacgaacgcggtctggcctccatgaacaatctgtatactccctatcacaaggacgttgctggcatgggtcagagcctctcacctctgtcctcttcaggtctgggctcaatccacaacagtcaacagggtctcccacattatgcacaccctggcgctgctatgcctactgataagatgctgacccccaacggcttcgaagcccatcatccagctatgctgggacgacacggtgaacaacatctgacaccaacttccgcgggaatggtgccgattaacggactccctccacatcatccacacgctcacctgaacgcgcagggccacggccaactgctaggcacggcacgggaacccaacccctccgtaactggagcgcaggttagcaatggttccaattccggacagatggaagagatcaacaccaaagaagtcgcccaacggattacaacagaacttaagcgatacagcatcccacaggccattttcgcccagagggtgctctgtcggtcacagggcacactgagtgacttgttgcgaaaccctaagccatggtcgaaactgaagagcggcagggaaacattccggagaatgtggaagtggctgcaagaacctgaatttcagagaatgtcggctctgcggctggctgcctgcaagcggaaagagcaagagcatgggaaggacagaggaaatacccccaaaaagcccagattggtcttcactgatgtccagaggcggaccctgcatgcaatcttcaaggaaaacaaacgaccgagtaaagagctgcagattacgatttcacagcagctggggttagaactctcaactgtctcaaacttttttatgaatgccagacgcaggagtctcgacaagtggcaggatgaaggctcaagcaattccggcaattctagctccagctcaagcacgtgcacaaaggcctag

SEQ ID NO: 233524 - DNA, 1515 bp, Artificial Sequence
  Description of Artificial Sequence: Synthetic coding sequence
atgaaagcagcgtacacagcataccggtgtctgacaaaggacctagagggttgtgccatgaatcccgaactcaccatggagtcactcggtacattgcatggaccagctgggggaggatcgggtggcggtggaggcggaggcggaggaggcggaggagggggtccgggacacgaacaggagctgttggcgtccccgagtcctcatcacgcaggcagaggagctgccggtagcttacggggtcctcctccgcctcctacagcacatcaggaactcgggacggccgcagccgcagcagctgccgctagtcgttcagcaatggtcacgtcaatggcttctatcctggacggcggtgattaccggcctgagctgagtattcccctgcaccacgccatgtctatgtcgtgcgactccagtccacccggtatggggatgtcaaacacatataccactcttactcccttgcagcccctgccaccaatttctacagtctcagacaagttccatcatccccacccacaccatcacccacatcatcatcatcaccaccatcaccagagactcagcgggaatgtatctggatcctttacattgatgagagatgaacgcggattacccgcaatgaataacttgtacagtccatacaaggaaatgcccggaatgtctcaatctttgtcacctctcgccgcaacccccctaggcaatggcttgggaggcttgcacaacgcgcagcagtctctacccaactacgggccaccaggacatgacaaaatgctctcccctaattttgacgcccaccacacagcaatgctaaccaggggggagcagcatttgtctcgtggtctgggcacaccgcctgctgcaatgatgagtcatctcaacgggttgcatcacccgggacacacccagtcccatggaccagtgctagcacccagtagggaaaggccgccaagctcaagtagtggttcacaagtagccacctccggtcaattggaggaaatcaatacaaaggaagtcgctcaacgcattactgctgaactcaagagatactccattccacaagctatattcgctcaacgggtgctctgtaggagtcaaggaacgctgtcagatttactgcggaacccgaagccctggagtaaattgaagagcggcagagaaacatttcgtaggatgtggaaatggctccaagagcctgagttccagcgaatgtccgctctgagactcgcagcttgcaaacgaaaggagcaggagccaaacaaggaccggaacaatagtcagaagaagtcccggcttgtgtttacagacctgcagaggcgcaccctgttcgcgatcttcaaggagaataaaaggccatctaaagagatgcagatcaccatctcacagcagctcggactggagctgacgacagtctctaatttttttatgaacgccaggaggcggagtctggaaaaatggcaggacgatctgtctaccgggggtagtagcagtacgtcttccacgtgcacgaaagcctag

SEQ ID NO: 233525 - DNA, 1458 bp, Artificial Sequence
  Description of Artificial Sequence: Synthetic coding sequence
atgaaccccgaactgactatggaaagcttaggtaccctccatggcccagccggaggagggtccggagggggtggcggaggtggtgggggtggcggaggtggtgggcctggacatgaacaggaattactggccagtccctccccccaccacgctggcaggggagctgctgggagcctgcggggaccaccgcctccaccaactgcgcatcaggaacttggcacagccgctgccgcagctgcagccgcatcacgatcagccatggttaccagcatggcaagcatcctggacggcggtgattatcggccagaactcagcattcctctacaccatgccatgagtatgtcatgcgactccagtcccccagggatgggaatgtcaaatacatataccacccttacccccctccagcctctgccgccaatctccaccgtgagcgacaaatttcaccacccccacccccaccatcatccccaccaccaccaccatcaccaccaccagcggctctccggcaatgtctccggatcctttactcttatgagggacgagcggggactacccgcaatgaataacctgtattcaccctacaaagagatgcccggaatgtctcagtcattgtcccccctcgctgcaaccccactgggaaacggtctgggtggtctgcacaacgcccaacagtcactgccgaattacggacccccagggcatgataagatgctctcgccaaatttcgatgcccatcatacggcaatgttgacgagaggagagcagcaccttagtaggggtttgggaactcccccagctgccatgatgtcccatttgaatggtttacaccatcccggtcacacgcagagccatggaccagtcttggctcccagcagagaaagacccccaagctcctcttctgggtctcaggtcgccaccagcggccagctggaagagatcaacacaaaggaggttgcacagagaatcaccgctgagctgaaacgatattcgatcccacaggccatcttcgcccagagggtcctctgccgatcccaaggcacactgagcgatttgctgcgaaatccgaaaccgtggtccaagttaaagtcaggcagagaaacctttaggcggatgtggaagtggctccaagaacccgaattccagagaatgtctgcgcttcggctggcagcatgcaaacgcaaagagcaagaaccaaataaagaccggaataattctcagaagaaaagcaggctcgtctttaccgatctccagaggagaactttgttcgcaatcttcaaggaaaataagcgcccttctaaggagatgcagatcaccatcagtcagcaactagggcttgaattaacgaccgtgagtaatttctttatgaacgcgcgaagaaggtcactggagaagtggcaggacgacttgtccacgggagggtcgagcagcacgtccagcacctgtaccaaggcatag

SEQ ID NO: 233526 - DNA, 450 bp, Artificial Sequence
  Description of Artificial Sequence: Synthetic coding sequence
atggtggatgatgccggtgccgcagagtcccagcgtggcaaacaaacacccgctcattccctcgagcagctgcgcaggttacccctgccccctccccagatacggatccgcccttggtggttcccagtccaagagcttcgcgatccactcgtgttctatctcgaggcctggctggctgacgagttgttcggacccgatagagcaatcatccccgaaatggagtggaccagtcaggctctgttaactgtagatatcgtggatagcggcaacctcgtggaaattacagtcttcggtagaccacgggtgcagaatagggtcaaatctatgctcctttgtctggcctggtttcacagggaacaccgggctagggctgaaaagatgaagcacctagagaaaaacctgaaagcccatgccagcgacccccactccccacaggatcccgtcgcctag

SEQ ID NO: 233527 - DNA, 387 bp, Artificial Sequence
  Description of Artificial Sequence: Synthetic coding sequence
atggcgccagtgaaaaaattagtggtaaaggggggtaagaaaaagaagcaggtcctgaaattcaccctcgactgtacacaccctgtagaagatggaatcatggatgcggctaatttcgagcaatttctacaggagcggatcaaggtgaacggcaaagcagggaatttgggcggaggtgtggtgacgatcgaacggtccaagtcaaagatcacagttaccagcgaggtgcccttcagcaagagatatctgaagtatctgaccaaaaaatatttgaagaagaataacctccgtgattggctacgggtggtcgcaaactctaaggagtcttatgaactccgatacttccagataaaccaggacgaggaggaggaagaggacgaggactag

SEQ ID NO: 233528 - DNA, 975 bp, Artificial Sequence
  Description of Artificial Sequence: Synthetic coding sequence
atggagccggcacctagcgcaggcgctgaattacagcccccactgttcgcaaatgcctccgacgcttacccctcagcatgtcccagcgcaggtgccaacgcctcaggtccaccgggtgcccgaagcgcatcatctctggctctggcaatcgcaattactgccctttacagcgctgtgtgtgccgtaggattactagggaacgtcctggtgatgttcggaatagttcgctataccaaaatgaagaccgcgacaaacatttatatttttaatctggctttagcagatgctctagctacctccacacttccatttcagagtgccaaatatctgatggagacatggccatttggagaactgctctgtaaggcagtgctgtctattgattattacaacatgttcacatccatcttcacgctaaccatgatgagcgtcgatcgctacattgcagtctgccaccccgtcaaggcgttggacttccgcacacctgccaaggcaaagttgattaatatctgcatctgggttctggcttctggggtgggcgtcccaatcatggtaatggcagtgaccagaccccgtgacggtgcagttgtgtgcatgctacaattcccttcaccttcttggtattgggacaccgtgacgaagatttgcgtgttcctgtttgcatttgttgtgtgctgggctcccatccatatttttgtgatcgtctggaccttggtcgacatcgatagaagagacccactggttgtggccgctcttcacctttgtattgccttaggttacgcaaactcgagcctgaacccagtgctctacgcatttctcgatgagaatttcaagcggtgctttaggcagctctgcagaaagccctgtgggaggcccgacccaagcagtttctcaagggccagggaggccactgcacgtgagcgcgtgacagcatgcacaccgagtgacggccctgggggaggtgcagcggcatag

SEQ ID NO: 233529 - DNA, 1143 bp, Artificial Sequence
  Description of Artificial Sequence: Synthetic coding sequence
atggactcccccatccagatcttccgcggagagccaggacccacatgcgcgccaagcgcttgcctgccgcctaattcctctgcctggttccctgggtgggcagagcctgactctaatgggagcgctggatcagaagacgctcagctggaaccggctcatatctctcccgcaattcctgtgatcataacagcagtgtatagcgtcgttttcgttgtgggcctcgtcggcaacagcctcgtaatgttcgtgattatacgatatacaaaaatgaagactgccaccaacatttacatttttaaccttgcactcgccgacgctctggtgactactactatgccctttcaatctacagtgtatctgatgaactcttggcccttcggcgacgtgctttgtaaaattgtaattagtatcgactattacaatatgtttacaagtatcttcacactgacaatgatgtcagtagaccggtacatagccgtgtgccaccccgtaaaagccttggatttccggacaccattaaaagccaaaatcatcaatatttgcatctggctgttatctagctcggttggaatcagcgccatcgtgctcggcggtacgaaggtgagggaggatgtcgacgtcatagaatgttccttgcagttccctgacgacgattattcttggtgggacctcttcatgaaaatatgtgtgttcatctttgcattcgtgatacccgtactcatcatcattgtgtgctacacgctgatgattctgagactgaagagtgtgaggttgctgagtgggtcgcgagaaaaagacagaaatctgcggagaattacccgactggtgctagtcgtagtagccgtgtttgtggtgtgctggacacccattcacattttcattctggtggaggcgttgggtagtacatctcattcaaccgccgctctgtcgagctattacttctgcattgcactggggtacactaactcaagtctgaacccaattttatatgcattcctcgatgagaactttaaaaggtgtttcagagacttttgttttccacttaaaatgcgcatggagaggcagtccaccagcagggtccggaataccgtccaggatcccgcataccttcgagatattgatggtatgaataagcccgtgtag

SEQ ID NO: 233530 - DNA, 1101 bp, Artificial Sequence
  Description of Artificial Sequence: Synthetic coding sequence
atggactctcctattcagatttttagaggcgagccagggccaacatgtgcaccttccgcctgcctaccacctaattcatccgctggatccgaggacgcccagctggagccagcccacataagccctgccatacctgtgataattacagcagtgtatagcgtagttttcgtcgtgggattagtgggcaattccttggtcatgtttgtcattattaggtacaccaagatgaaaacggccaccaacatttatatctttaacttggcccttgccgatgcacttgtgacaacaactatgccatttcagtcgacagtttacctgatgaattcctggcccttcggtgacgtgctgtgcaagatcgtgatcagcatagattattataatatgtttacctccatatttacgctcaccatgatgtccgttgaccggtatattgccgtctgtcaccccgtcaaggctttggacttccgaactccgctgaaggccaagataatcaatatctgcatctggctgctgtcttcctcagtgggaatttctgccattgttctggggggaactaaggttagggaagatgtggacgtcatcgaatgctcactccagtttcctgacgacgactacagttggtgggacctgttcatgaaaatttgcgtgtttatctttgcattcgtaatccccgtgctgatcatcattgtctgttatacactcatgattcttcggctcaaatctgttaggctgctcagtggctcccgcgaaaaagatagaaacctacgtcgcattactcgcctcgtactagtcgttgtagccgtgtttgtggtctgttggacccccatccacatattcatactggtggaagcgcttgggagtacatcgcattcaacagccgctctgagctcctattacttctgtattgcgctcggatatacaaatagctctctaaatcctatcttatatgcatttttagatgaaaactttaaacgatgcttccgtgacttttgctttccgctgaagatgcgtatggagaggcagtctacgtcccgggtacggaacaccgtgcaggatccagcctatctccgtgacatcgatggcatgaacaagccagtgtag

SEQ ID NO: 233531 - DNA, 1143 bp, Artificial Sequence
  Description of Artificial Sequence: Synthetic coding sequence
atggatagccccatccagatttttcggggtgagcccggtcccacctgcgcgccttcggcctgcctgcctcctaattcttctgcctggttcccaggatgggctgaaccagacagcaacggaagtgcaggttcagaagacgcccaactagagccggctcacatctcaccagccatacccgttattatcacagcagtgtactctgtggtgtttgtcgtgggcttggttggaaacagcctagtcatgtttgtgatcatacgctatactaaaatgaagactgccaccaatatctatatcttcaatctggctctagcagatgcgctggtgacgacaaccatgccatttcagagcacagtctacttgatgaatagttggccttttggagacgtgctgtgcaagatcgtgatcagcattgactactacaacatgttcaccagcatctttacattgaccatgatgagcgtggataggtatattgcagtctgccatcctgtgaaggcgctggacttccggacccccttgaaagccaagatcatcaacatctgtatctggctgttaagctcctccgtgggcatatccgcaattgttctcggtggcaccaaagtgcgcgaggacgtagatgtgattgagtgttcgctacagttcccagacgatgattactcctggtgggatctcttcatgaagatttgtgtctttatttttgccttcgtaatccctgtccttattattattgtatgctataccttgatgattctcagacttaaatcagtccggcttctaagtggtagcagagagaaggatagaaacctgcgcaggatcacccggttggtgcttgttgtggttgccgtgtttgtagtatgctggacacccatacatatctttattctcgttgaggcacttggaagcacctcacattctacagccgctctctccagttactacttttgtatcgccctgggatacactaactcctctctgaatcccattctgtacgcattccttgatgaaaacttcaagcggtgcttccgtgatttttgttttccactgaagatgaggatggagaggcaatctacatccagggtccggaacacagtccaggatccagcctatttgagagacatcgacggtatgaataagcctgtttag

SEQ ID NO: 233532 - DNA, 1344 bp, Artificial Sequence
  Description of Artificial Sequence: Synthetic coding sequence
atgtctcggcgaccttgttcctgtgctctgaggcctccaagatgttcctgcagcgccagtccatcggctgttacagcagcaggcaggcccagaccaagcgactcttgcaaagaggaatcttccacactgagcgtgaagatgaaatgtgacttcaattgcaatcatgtccacagcggtttgaagcttgtcaaacccgatgatatcggacgcctggtatcttacacccctgcctatctagaagggagttgtaaagattgcattaaagattatgagcgtctgagttgtatcgggagtcccatcgtgtctcctcggatagtgcagctggagacagagtcaaagcgactgcacaacaaggagaaccagcacgtccagcaaacgctaaatagcactaatgaaattgaggcactcgaaacgtcaagactgtatgaagatagtgggtacagcagcttttctctccagagcgggttgtccgaacatgaggagggaagtctcctagaggaaaatttcggagactctctgcagtcatgcctgctccagatccagtccccagatcagtatccaaacaaaaacctcctccctgtccttcacttcgaaaaggttgtgtgcagcactctgaaaaaaaatgctaaacgcaacccaaaggtagaccgggagatgctcaaagaaataatcgctcgcggaaattttagacttcaaaacattatcggccgaaaaatgggccttgaatgcgtcgacatcctgagtgaactgttccggcgaggcctcaggcacgtactggccactattctggcccagctcagcgatatggatctgatcaatgtgtccaaggtcagcactacctggaaaaagatcctagaggatgataagggcgcattccagctgtattccaaagctatccagcgggtgaccgagaataataacaaattctccccccatgcatccacgcgcgagtatgtcatgttcaggacccccctggcctctgtgcagaaatctgccgcacagacttccttgaagaaggacgcacagaccaaactctctaatcaaggtgaccaaaaggggagcacttattctagacacaacgagttttctgaagtggccaaaaccttaaaaaagaacgagtcactcaaggcctgtatccggtgtaactctccagccaaatacgattgctatctccaacgtgccacctgcaagcgagagggatgcgggtttgattattgtaccaaatgcttatgtaactatcacaccactaaggactgcagtgacgggaaacttttgaaagcaagctgtaagattggccctctacccggaacgaagaaatccaagaagaacctacgcagactgtag

SEQ ID NO: 233533 - DNA, 1203 bp, Artificial Sequence
  Description of Artificial Sequence: Synthetic coding sequence
atggactcctctgctgctcctactaatgccagtaattgcaccgacgcactggcatactcctcttgtagtcccgctcccagcccagggtcctgggtcaacctctctcatttagatggtaatctgtctgacccgtgcggccctaatagaaccgacctgggcggaagggattcgttatgtccaccaacaggttcgcccagcatgatcaccgcgatcacaataatggccctgtattcgattgtgtgtgtggtgggactattcggaaactttctcgtgatgtatgtcatcgtacggtataccaaaatgaagacagcgaccaatatctacatttttaatctggcgctcgctgatgcattagccacatctaccctcccattccagtctgtaaattatttaatgggtacatggccattcggaactattttatgtaagatagtcatttctattgactactacaacatgtttacctcaatcttcactctgtgcacaatgagtgtcgataggtacatcgccgtgtgtcatcctgttaaagcgctcgattttcgcaccccacggaacgccaaaattataaatgtgtgtaattggattctgtcttcggcaatagggctgcctgtcatgtttatggctactactaaatacaggcagggtagtatcgattgcacgctgacttttagccaccccacatggtattgggagaacctgctgaagatctgtgtgtttatctttgcattcattatgcctgtcctgatcatcaccgtctgctacgggctgatgatcctccgcctgaagagcgttaggatgctcagcggctcaaaggagaaggatcgcaacctcagaagaatcaccaggatggtactggtcgtggttgctgtattcattgtgtgctggaccccgattcacatttacgttattattaaagccctggttaccatcccggagacgactttccagacagtgagttggcacttttgtatagcgctaggatacaccaactcctgtctgaatcctgtactgtatgcatttctggatgagaattttaaacgatgcttcagggaattctgtattccaacatcaagcaatatcgagcagcagaatagcacccgcattaggcagaacacccgcgatcacccttccacagctaatacggtggatcgtactaaccatcagctggagaacctggaagcagaaaccgccccattaccgtag

SEQ ID NO: 233534 - DNA, 1257 bp, Artificial Sequence
  Description of Artificial Sequence: Synthetic coding sequence
atggattcctcagccgcacccacaaatgccagcaactgtactgacgcgctagcctattctagctgcagcccagcaccgtcacctggctcgtgggttaatcttagtcatctggacggcaacctgagtgatccttgtggcccaaaccgcactgacctgggtggacgcgatagcctgtgcccacccactggcagcccctccatgattactgctatcaccattatggccctgtactctattgtgtgtgtagtcggactgttcggcaatttcctggtaatgtatgttattgtcagatacaccaagatgaagaccgcaactaacatatatatctttaaccttgccctggccgacgctcttgctacgtccacactgccctttcagtcagtcaattacctgatgggaacttggccctttggtacaattctgtgtaagatagtcatctctatcgactactacaacatgttcacttctattttcaccttgtgcaccatgtctgttgatagatacatcgccgtgtgtcatcctgtaaaggctttggatttccgaaccccccgtaatgcaaaaattattaacgtttgcaattggatactgagttctgctatcggcctgccggtaatgttcatggctaccacaaagtacagacaggggagtattgattgtacgctgacctttagccatccgacgtggtattgggaaaatctgctcaagatctgtgtctttatctttgcgttcatcatgcctgtacttattatcaccgtgtgctatggacttatgatcttacgtttgaagtccgtgaggatgctgtcaggttccaaggagaaggaccgaaaccttagacgcataacaagaatggtgttggtcgtggtggctgttttcattgtgtgttggaccccaatccacatttacgttattatcaaagcacttgttaccatccctgaaacaacattccagactgtgagctggcatttttgtattgccctggggtacacaaacagctgcctgaaccctgtcttatatgcatttctcgacgaaaacttcaagcgctgtttcagagaattctgcatcccgacttcatcgaacattgagcaacaaaactctaccagaatccggcaaaacacgagagaccacccctccactgcgaataccgtcgatagaactaatcatcagcctcctctggctgtatctatggcccaaatcttcactcggtatcccccacctacacacagggaaaaaacctgcaatgattacatgaagagatag

SEQ ID NO: 233535 - DNA, 1209 bp, Artificial Sequence
  Description of Artificial Sequence: Synthetic coding sequence
atggactcctccgccgctcctaccaacgcgtcaaattgcaccgatgcgctggcatactcatcatgcagtcctgccccttcccccggaagctgggttaatttgtcacacctggacggcaacctgagcgacccatgtggacctaaccgcacagaccttgggggtcgcgatagcctgtgtcctcctactggcagtccttccatgatcaccgctattaccataatggccctgtattccatcgtctgtgtggttggtcttttcggtaacttcttagtgatgtacgtcattgttaggtacacaaagatgaaaacagccacaaatatttatatcttcaatctagctctagccgacgctcttgcgacgtctaccctcccttttcaatccgtcaattatttaatggggacctggccattcggcaccattttgtgtaagattgtcatctctattgactactacaatatgtttacatccattttcaccctgtgcacaatgagcgtggatagatacatcgcggtttgccatcccgttaaagcactggattttcgcacgcccaggaacgcaaaaatcataaatgtgtgcaactggatactttcctcagcaatcgggctccccgtgatgttcatggctacaacaaagtatcggcagggcagtattgactgtacactgactttctcccaccccacttggtactgggagaacctgctcaaaatttgcgtttttatctttgcctttattatgccagtcctgattataaccgtgtgttacggtcttatgatccttcgtctgaaaagcgtccgcatgctgagtggtagcaaagagaaggaccggaacttacgtcggatcacgcgcatggtgctggtggtggtcgctgtgttcatcgtttgttggacaccaatacatatctatgtgataatcaaagctctcgtgacgattcccgagacaacgtttcagactgtgtcctggcacttttgtatcgccttggggtatacaaatagttgcctgaaccccgtcctgtatgcattcctagacgagaatttcaagagatgcttcagagagttctgcatcccaacctcatccaatattgagcaacagaatagtactcggattagacagaacaccagggaccatccgagtaccgccaataccgtcgacaggactaaccaccagataagggatccaatctccaacctgcctagggtgagtgtcttttag

SEQ ID NO: 233536 - DNA, 1212 bp, Artificial Sequence
  Description of Artificial Sequence: Synthetic coding sequence
atggattcttcagctgcacctactaatgcctcgaactgtactgatgcactggcttatagctcctgctcaccagcacctagtcctggcagctgggtaaacttgtctcacctcgacggcaacctttccgacccttgcggccctaaccgtactgacctaggcggtcgggatagtctctgcccccctaccggatcacctagtatgatcaccgcaatcactattatggctctctatagcatagtgtgcgtcgtgggactgtttggtaattttctggtgatgtacgtcatcgtgcgctatactaaaatgaagacagctacaaatatttacattttcaacttggctctcgccgatgccttggccacatcaactctgccgtttcagagcgtcaactatttaatgggaacttggccattcggaaccatcctgtgcaagattgtcatcagtattgactattataatatgttcactagcatctttactctttgcacaatgagcgtggacaggtacattgctgtttgccaccccgtgaaggccctggattttcggacaccgaggaacgcaaagatcattaatgtatgtaactggatcctgagcagtgcaatcggcctgccagttatgttcatggcaaccacaaagtaccgtcagggttctatcgactgcaccttaacctttagtcaccccacatggtactgggagaacttgctcaagatatgtgtgttcatcttcgctttcattatgcctgtcctcattatcaccgtgtgttacggactgatgattctgaggctgaaaagcgttcgcatgctgagcggatccaaggaaaaggatagaaatctgagacgcattactcgtatggtgctcgtagtcgtcgctgtattcattgtgtgctggactcccatccatatctacgttattattaaagcgttggtgacaattccggaaaccaccttccagactgtgtcttggcacttctgcatcgctttgggttatacaaactcatgcttaaatcccgtcctgtacgcttttcttgacgagaacttcaaacggtgcttccgggagttctgtattcccacttcctcaaacattgaacagcagaatagcacacgcatcaggcagaataccagagaccatcctagcaccgcgaatacggtggatcggaccaatcatcagggccctcccgctaagttcgtggccgatcagctggctgggtcaagctag

SEQ ID NO: 233537 - DNA, 1263 bp, Artificial Sequence
  Description of Artificial Sequence: Synthetic coding sequence
atggatagcagcgcagcgcctacaaatgcctctaactgtaccgatgctttggcatattcatcctgttcacctgccccaagtccaggtagctgggtcaacctatcacatctggacgggaatctctcagatccttgcggacccaatagaacggacctgggaggacgggacagcctgtgcccacccaccggctctccctccatgataactgcaattacaattatggcactctattctatagtgtgcgtggtaggtctgttcggcaatttcctcgtcatgtatgtgatcgtgcgatacacaaagatgaagaccgccaccaacatctacatattcaatctggctttggctgacgctctcgctacatccactctgccgtttcaaagcgtcaattacctcatgggtacatggcctttcgggactatactttgtaagatcgtgatttctatcgattactacaacatgtttaccagtatctttaccctatgtaccatgagcgtggaccgatacatagctgtatgtcaccccgtgaaagctcttgacttccgaacccctagaaacgcaaaaatcatcaacgtctgtaactggatccttagcagcgcaatcggattacccgtcatgtttatggctacgactaagtatagacagggctctatcgactgtactcttacattcagccaccccacctggtactgggaaaatctgctgaaaatctgcgtgttcatcttcgcattcataatgcctgtcctcattatcacggtgtgctatggtctgatgatcctgcgcttgaagtcggtgaggatgctgagcggctctaaagaaaaagaccgtaatcttaggcgcatcacgagaatggtcttagtggttgtggccgtgtttattgtctgttggacaccgattcatatatacgttattataaaggcactggtcaccataccagaaactacgtttcagacagtcagctggcacttctgcatcgcactgggttatacgaacagctgtctgaatccagtgctttatgctttcctcgacgagaatttcaagagatgtttccgagaattctgtatccctacatcttctaacattgagcaacaaaacagcactcgaatcagacagaatacaagggatcacccgtctactgctaacacggtggatcggacaaaccaccaggtcgagttaaatctggactgtcactgtgagaatgcaaaaccatggccattatcatacaacgctggacaatcacccttcccttttcccggtcgggtgtag

SEQ ID NO: 233538 - DNA, 1179 bp, Artificial Sequence
  Description of Artificial Sequence: Synthetic coding sequence
atggattcgagtgcggctcctactaacgcttccaactgtaccgatgcccttgcgtactcttcctgttcacccgctcctagccctgggagttgggttaatctgagtcacctagacgggaatctgtcagatccgtgtgggcctaatcgaacggacctcggcggtagagactctttatgccccccaactggctcaccctcaatgatcaccgctatcacaattatggccctgtacagtatagtttgtgtggtcggcctgtttggcaattttcttgtgatgtatgtgatcgtgcgctacactaaaatgaagaccgccaccaacatttatatcttcaatctggccctggcggacgccctggccacatcaactctcccctttcagtcagtgaattacctgatgggcacatggcccttcggcactattctctgcaagatcgttattagcatcgactactataatatgttcacgagtatatttactctgtgcaccatgtccgtggaccgttacattgctgtatgccacccagtgaaggccttggacttccgcaccccccgtaacgcaaagattattaatgtgtgtaattggatcctgagttcagccataggactcccagtgatgtttatggctactaccaagtataggcagggctctatagactgcacgctgaccttctctcatccaacttggtactgggaaaacctgttgaagatctgcgttttcatttttgcctttatcatgccagtactgattataacggtttgctatgggctgatgatcctgcgccttaaatctgtgaggatgctctcgggctccaaggagaaagacagaaacttaagaaggattacaaggatggttcttgtcgttgtggcggtctttatcgtgtgctggacccccatccacatttacgtcatcattaaggcactggtaaccattcccgaaactacattccagaccgtcagttggcatttctgtatagcactaggatataccaattcctgcctgaaccctgttctgtacgctttccttgacgaaaatttcaagaggtgttttcgcgagttttgtatccccacctccagtaacattgagcagcagaatagcactagaatacgccagaatacgcgggaccatccgagcacagccaacactgtggacaggaccaaccaccaagttaggagtctttag

SEQ ID NO: 233539 - DNA, 1482 bp, Artificial Sequence
  Description of Artificial Sequence: Synthetic coding sequence
atgtgcctgcaccgcagagtaccttctgaagaaacatactccctagacagatttgcccagaatcctcccctattccctccaccctctctcccagctagcgagtccagaatggctcacgccccattgctccaacgatgtggcgctgccagaacaggcttctgtaagaagcagcaggagctgtggcagcgtaggaaggaagccgcagaagcgttgggtactagaaaggtgagcgtcctcctggcaacttcccattcaggcgctcgtccagctgtgtcgacaatggactcctcagccgcaccaaccaatgctagcaattgtactgatgctcttgcatactcgagctgctcccccgcaccttcccctggctcatgggtcaaccttagtcaccttgacggcaacctctctgatccatgtggaccaaatcgcacagacctagggggaagggactccctgtgtcccccaacaggctctccttctatgatcactgcgattacaattatggcgctttatagcattgtgtgtgtggtgggattattcggaaatttcctagtcatgtatgtcattgtgcgctatacgaaaatgaagacggccaccaacatttacatttttaatctggcccttgctgatgcactcgccacctctaccttgccttttcagtctgtgaactatctgatgggaacctggccctttggcacgatcttgtgcaaaattgtaatctcaattgactactacaatatgtttacttctatcttcaccctctgcactatgtctgtggatcggtatatagccgtgtgtcaccccgtcaaggccttggatttcaggacacctaggaatgctaagattataaacgtgtgtaattggatactgtccagtgccatagggctccctgtaatgtttatggccaccaccaagtatcgccagggcagtatcgattgcacccttacttttagtcatcccacctggtactgggaaaacttactcaagatctgcgtgttcatttttgctttcatcatgcccgtgctcattatcactgtgtgttatggactcatgatactgaggttaaagagtgtgaggatgctgtctgggagtaaggaaaaggatcgaaacctcaggcggataacaagaatggttcttgtggtagttgctgttttcatcgtgtgctggaccccaattcacatctacgtgattattaaggcccttgtgactatcccagaaacgacattccagactgtgtcctggcacttttgcatagcgctgggctataccaactcttgcctgaatccggtattgtacgcatttttagacgagaacttcaaaagatgttttagagagttctgcattccgaccagcagcaacatcgaacagcaaaattcaacccgcatcagacagaacacaagagaccaccccagtaccgccaataccgtggaccgtaccaaccaccaactggaaaacctcgaagctgagaccgctcctctgccttag

SEQ ID NO: 233540 - DNA, 1194 bp, Artificial Sequence
  Description of Artificial Sequence: Synthetic coding sequence
atggattcatccgcggctccaaccaatgcatcaaactgcacggacgcactcgcatattcttcgtgttccccagccccttcccccggaagttgggtaaacctctcacatttggacggtaatctcagcgacccttgtggacctaaccggacagatttaggcggacgtgattctctgtgcccccctaccggctctccatctatgatcactgctattactataatggcactgtacagcattgtctgcgtggtcggcttgttcggaaactttctggtgatgtacgtgatcgtacgatacactaagatgaagactgcaacaaatatctacatcttcaatctcgccttagctgacgctttggctacgtctactcttccctttcagagtgttaactacttaatggggacgtggccgtttggaaccatactctgcaaaatcgtgatcagcattgattattacaacatgttcacgagtatcttcacactatgtacgatgagcgttgatcgttatattgccgtatgtcatcctgtgaaggctttagattttcggactccacgaaacgccaaaatcatcaacgtgtgcaactggatcctcagcagtgctatagggctccctgttatgttcatggctacaacaaaatacagacaagggtcaatcgactgtacactcacttttagccaccccacctggtactgggaaaatctgctgaagatctgcgtcttcattttcgcctttatcatgcccgtcctgataatcaccgtttgttacggactaatgatcctgaggctaaaaagcgtcagaatgctgtctgggtctaaggagaaggacagaaacctgagaaggatcactaggatggttctggtggtggttgcggtgttcatcgtgtgctggacccccatccatatctatgtgatcataaaggcactggtcactattcccgaaactacttttcagaccgtgtcttggcacttctgcatcgccctgggctatacgaattcatgcctgaacccagttctttacgccttcctggatgagaattttaagcgctgcttccgagagttctgtataccaacctcctcgaatattgaacagcagaacagtacacggattcggcagaacacgagggatcatccatccaccgccaacacagttgatcggactaaccaccaaagggagcggcgacagaaatcagattggtag

SEQ ID NO: 233541 - DNA, 1221 bp, Artificial Sequence
  Description of Artificial Sequence: Synthetic coding sequence
atggattcctccgccgcacccactaacgcctctaattgtacggacgctttggcttattcctcttgctctccagcaccctcccccggtagttgggtcaatctcagccaccttgatggtaacctgtcagatccctgcggtcccaataggacagacctcggcggtcgggattccttgtgcccccctaccggtagtcctagtatgatcactgccatcacaataatggctctgtactcaatcgtctgtgtggtggggctgttcgggaattttctcgttatgtacgtaattgttcgctatacaaagatgaagacagccaccaatatatatatattcaatctggccctcgccgacgcactggctacatcaacgctgccatttcaatcagtgaattacctgatgggaacttggcccttcggcacaatactgtgcaagatcgtaatctcaattgattattacaacatgtttacctcaatatttacgctgtgcactatgtctgttgatcggtatatagcagtttgccatccagtaaaagcccttgactttcggacccccagaaatgccaaaatcataaacgtttgcaattggattctgagttcggcaattggtcttccagttatgttcatggccaccaccaagtatcgccaggggtccatagattgcaccctcactttttcccaccccacctggtactgggagaatctgctgaagatttgcgtattcatctttgcattcatcatgcctgtgctgatcattaccgtttgttacggtctgatgatccttagattgaaatcagtgcgaatgctgtcgggcagcaaagagaaagatcggaacttgagaagaattacccgaatggtcctggtggtggtggccgtgtttattgtctgctggacccctatccatatatatgttatcattaaggctctggtgactattccagagacaacgtttcaaactgtgagctggcacttctgcatagcgctggggtacacaaatagctgtctcaatcctgtgctgtacgcatttttagacgagaatttcaaacgttgtttccgcgagttctgcattccaacgagttcaaatattgagcagcaaaattcaacaagaattagacagaacaccagagatcacccctccaccgcaaatacagtagatcgtacaaaccatcaaaaaatagatctctttcagaaaagcagcttattgaactgcgaacacacaaaaggttag

SEQ ID NO: 233542 - DNA, 960 bp, Artificial Sequence
  Description of Artificial Sequence: Synthetic coding sequence
atgatgcgggctaaaagcatttccaccaaggccggaaaacccagcaggtacacgaagatgaagacggctacaaatatttacatttttaatttagcgctggctgatgcgctggctacttccacactgccattccagagcgtcaactatctgatgggaacctggccgtttgggactatactctgcaagatagtgataagcatcgactattataacatgttcacctccatcttcactctgtgcactatgtctgtcgaccggtacatagccgtgtgccacccagtaaaggctcttgacttccgcacccctaggaacgctaaaataatcaacgtgtgtaactggattctgtcaagtgcgatcggtctccctgtcatgtttatggcaaccacgaaatatagacagggatctattgattgtaccctgacatttagtcatcctacatggtactgggaaaatcttctgaagatatgcgtgttcattttcgccttcatcatgcccgttcttatcatcactgtgtgctatggtttgatgattctgcgcctgaaaagtgtacggatgttatccggcagcaaagaaaaggacagaaacttacgacggatcacacgcatggtgctcgtggtagtggccgtttttattgtgtgttggacaccaatacacatctatgtcattattaaggctcttgtgacaattcctgaaactaccttccagacagttagttggcacttttgtattgccctcggttataccaactcctgcctgaaccctgtactttatgcattcctcgatgagaacttcaagaggtgtttccgtgaattttgtatcccaacctcgtctaatatcgagcaacagaactccacacgtattcgccagaacactagagatcatccgtcaacagccaatactgtggatcgcacaaaccaccagttagagaacctggaggccgagacagctcctctaccttag

SEQ ID NO: 233543 - DNA, 1209 bp, Artificial Sequence
  Description of Artificial Sequence: Synthetic coding sequence
atggattcctctgccgctcccactaatgcgtccaattgtaccgatgccttagcatacagttcctgtagtcctgccccatcacccggttcgtgggtgaacctcagccacttggatggaaacctgagcgacccctgcggacccaatcgaactgatctgggaggcagggatagcctctgtccacctaccggttctccatctatgattacggccatcacaattatggcactgtattccatcgtatgcgtggttggtttatttggcaacttcttagtcatgtacgtcatcgtgagatacacaaaaatgaagacagccacaaacatttatatcttcaatctcgccctcgcagatgccttggccacctcaacgctgccgttccaaagcgtgaactacctgatgggaacatggccctttggaaccattctatgtaaaattgtgatctcaattgactactataacatgttcacatcaattttcacattgtgtacaatgagcgtggaccggtatatcgccgtctgtcatccagtgaaggcactggattttcgaacacctcgcaacgctaagataataaacgtgtgtaattggatcttgtcgagcgctatagggctcccagtgatgtttatggcaaccacaaaatacagacaagggtctatcgactgcaccctgaccttttctcacccaacctggtattgggagaatctgctcaagatctgcgttttcatcttcgccttcattatgccggttctgatcatcacagtgtgttatggcctgatgatactgaggctcaagtccgtccggatgttgtcaggctctaaggagaaggaccgtaatctgcggcgaatcacgcgcatggtattagtggtagtggcagtgttcattgtctgctggactcccatccacatctacgtgattataaaggctttggtgacaatccctgaaacaactttccaaacagtctcctggcacttctgcatagccttagggtatactaactcatgcctgaatccagttctctatgcttttctggacgagaatttcaaaaggtgtttccgagagttctgcatcccaacaagttctaatatcgagcagcaaaactctacccggatccggcagaacacgcgcgatcacccctccactgcaaacaccgtggatagaacaaaccaccagattagagatcctatctccaacctcccccgagtcagcgtgttctag

SEQ ID NO: 233544 - DNA, 492 bp, Artificial Sequence
  Description of Artificial Sequence: Synthetic coding sequence
atggtccaggccaggacaggattctgcaaaaaacaacaggagctgtggcagagaaggaaagaggcggcagaggctttaggaacccgaaaagtgtctgtactcctggcaacatcgcactccggagctcgtcctgctgtttccactatggattcatccgcagctcctacgaacgcttctaattgcaccgacgccctcgcttatagcagctgctccccggctccatcccccggatcgtgggtaaatttatctcacctggacggcaacctgtctgacccctgcggacctaacagaaccgaccttggcggaagagacagtctgtgtcccccaacgggttcaccttccatgattaccgccatcactattatggccctgtactcaattgtgtgtgtcgttggcctctttggaaattttctggtgatgtatgtaatcgtgcgatacaccaaaatgaagaccgctacaaatatctacatttttaacttggcgctggcatag

SEQ ID NO: 233545 - DNA, 903 bp, Artificial Sequence
  Description of Artificial Sequence: Synthetic coding sequence
atgaaaaccgcaacgaacatctacatcttcaatctggcccttgcagacgccctagccacgtcaactctgcctttccagtccgtgaattatctgatgggaacctggccattcggcacgatcctgtgcaagatagtgatttctatcgattattacaacatgtttacctcaatttttacactttgcacaatgagcgtggaccggtacattgctgtgtgccatcctgtgaaggccttggactttcgaacacccaggaacgctaagatcataaacgtgtgcaactggattttgtcctccgccattggtctcccagtcatgtttatggccacaaccaagtataggcaggggtcgattgattgtacactgaccttctctcacccaacctggtactgggaaaatctgctgaagatctgtgtgttcattttcgcctttatcatgcccgtactcattatcaccgtgtgttatggactcatgattctcaggctcaaatctgtgcgtatgcttagcggctctaaggagaaagatcgaaatctgaggaggataacacgcatggtgctagttgtcgtcgccgtgtttatagtgtgctggacccctatacacatctatgtgattataaaggcattggttacgattccggagactaccttccaaaccgtgagctggcacttctgcattgccctgggctatactaactcctgtcttaaccccgtgttatatgctttcctggatgaaaactttaagcggtgttttcgcgaattctgcatccctacttcaagcaacatcgagcaacaaaattctacacggatacgccagaacacccgagaccacccttcaaccgctaacaccgttgaccgcaccaatcaccagttagaaaatcttgaggccgagacagcacctctgccatag

SEQ ID NO: 233546 - DNA, 903 bp, Artificial Sequence
  Description of Artificial Sequence: Synthetic coding sequence
atgaagactgcgacaaacatatatatctttaaccttgcactggctgatgctttagcaaccagtactttaccattccagagcgtaaactacctgatgggtacatggccattcggcactatcctgtgcaagatcgtcatctccatcgattattataacatgtttacttcgatttttacactgtgtactatgtccgtggaccgatacattgctgtgtgccatcccgtcaaggccctcgacttccggactcccaggaacgcaaagataataaacgtgtgcaactggatcttgtccagcgccataggactgccggtcatgtttatggctaccacgaagtaccgccagggcagcatcgactgcacgctgacttttagccatcccacctggtattgggaaaatctcctgaaaatctgcgtgttcatctttgcctttatcatgcccgtcctcattattaccgtgtgctatggcttgatgatactgaggctcaaaagcgtccgcatgctgtccggcagtaaggaaaaagaccgaaatctgcgtagaatcacacggatggtgctcgtggttgtggccgtcttcatcgtctgctggacaccaattcacatctacgtcatcattaaggccctggttacgatccccgaaactacgttccagacagtgtcctggcacttctgcattgccctcggttatacaaactcttgtctcaaccccgtcctttatgcatttctggatgaaaattttaagcggtgcttcagagagttctgcatacctacctcctctaatatagaacagcagaattctacccggattcggcagaatacaagggaccaccctagtactgctaataccgtggaccggaccaatcatcaattggaaaatcttgaggcagagaccgcaccccttccctag

SEQ ID NO: 233547 - DNA, 903 bp, Artificial Sequence
  Description of Artificial Sequence: Synthetic coding sequence
atgaagacggccacgaacatttacatcttcaacctggctctcgctgacgcactggcaacttcgacactgcccttccagagtgtgaactatcttatggggacatggccctttgggactatactgtgtaaaattgtcatctctatagactactataatatgtttacaagtattttcaccctgtgcaccatgagtgttgacaggtatatcgctgtttgtcaccctgtaaaagccctggactttagaacgccaaggaatgccaagatcatcaacgtatgcaactggattctcagcagcgctattggactaccggtgatgtttatggcaacgacaaagtaccgacagggctccatcgactgtactctgacctttagccatcctacatggtattgggaaaatctactcaagatctgcgtttttatctttgcttttatcatgccagtcctgataattacggtgtgttacgggctgatgatcttacgtctgaagtctgttaggatgctatccggttccaaagagaaagatcggaacttaaggagaatcacacgtatggtgctggtggtggttgcagtcttcattgtgtgttggaccccaatccacatttacgtgatcatcaaagcgctggtgacaattcctgagacaacattccagaccgtgtcttggcacttctgtattgcgcttggctacactaattcatgtttgaaccccgttctctacgcctttctcgacgagaatttcaagaggtgtttcagagaattctgcattcctacctctagcaacatcgagcagcaaaattccacccgcattagacagaatacaagagatcacccgtccacagccaatactgttgaccgcacgaaccatcagctggagaatctggaggccgagaccgctcctttgccatag

SEQ ID NO: 233548 - DNA, 1209 bp, Artificial Sequence
  Description of Artificial Sequence: Synthetic coding sequence
atggattcttcagcagctccaaccaacgcttccaactgtactgacgcgctcgcgtatagctcttgcagccctgcgccttctccgggaagctgggtcaacctgagtcacctcgacgggaatctgtccgatccttgcgggcctaatcgaaccgacttgggagggagggatagtctatgtccccctacaggtagcccttccatgatcaccgccataacaatcatggccctgtactcaatagtatgtgtagtcgggctgtttggcaacttccttgtgatgtacgtgatagtccgctataccaaaatgaagacagctacaaacatctacatcttcaaccttgctttagctgacgctttagcgactagcacgctgcccttccagtccgtgaattacttgatggggacgtggcctttcgggacaatactctgtaagatagttatcagcatcgactattataacatgtttacttcaatctttactctgtgcactatgtccgtcgatcggtatatagcggtctgtcatcctgttaaggccttggactttagaacaccaaggaacgcgaaaatcatcaatgtttgcaactggatcctctcctccgccatagggctgcccgtgatgtttatggcaactaccaaataccgccaggggagcatcgattgcacattgaccttcagccatcccacctggtactgggaaaacctgttgaaaatctgcgttttcattttcgctttcatcatgcctgtcctaattataaccgtgtgttacggcctcatgattcttcgcctcaagtccgtccgcatgctgtcaggcagtaaagaaaaggataggaaccttcggagaattaccaggatggttctagtagtggtggctgtcttcatcgtttgctggacaccgattcatatctatgttatcattaaggctcttgtgactatccctgagacgacatttcagacagtctcctggcacttttgcatcgcccttggatatacgaacagttgcctcaatccagtcctgtacgccttcctggacgagaactttaagcggtgcttccgcgaattttgtattcctacatcttcaaatattgaacagcagaactcaacccggatccgacagaacactagagaccatcctagcaccgctaacaccgtggacagaactaatcaccaaataagagatccaatcagtaacctccctagagttagcgtgttttag

SEQ ID NO: 233549 - DNA, 561 bp, Artificial Sequence
  Description of Artificial Sequence: Synthetic coding sequence
atggactccagcgctgcgccaaccaatgcatccaactgtactgacgcccttgcctattcgtcctgctccccagctccgagccctggaagctgggtgaacctgtcccacctggatggtaatttgagtgatccatgcgggccaaatagaactgatttgggaggacgagactcattgtgccccccaacagggtcaccaagcatgatcaccgccattaccatcatggcactttattctatcgtgtgtgtagttggcctgttcggcaatttcttagtgatgtatgtgattgtgaggttccacaggctctatacgaatatattgagctccaatcttgtgctgggcaaacccgctgaggatctgtgctttcacttgcgcctccattacgcatctgctcatcattacagggtgctctggactgacgatctggctccccaagaatgcccgcacgctctgtggctgcagcgtaaagggcaggagtctagtaaagatcaccaggacggtgctggtggagggggatgtgtacatcgccttctggactctcactctcatttacgtcaccattag

SEQ ID NO: 233550 - DNA, 1170 bp, Artificial Sequence
  Description of Artificial Sequence: Synthetic coding sequence
atggactcatccgcagccccaacgaatgcatcaaattgcactgacgcgctggcatatagcagctgctccccggcaccctcccctgggtcatgggtgaatctctcccacttagacggaaacctcagtgatccatgcgggcctaaccgcactgatctgggcggaagggattccctctgtccacctacaggctctccatcgatgataacagccatcaccatcatggccctgtatagcatcgtatgcgtggtgggactcttcggcaactttctggtgatgtatgttatcgtgcgatacacaaaaatgaaaaccgccacaaatatctatatctttaatctcgctctggctgacgccctggccacttccactctgccattccaaagtgtcaactacctgatgggcacctggccattcggcaccatcctctgtaaaatcgtcatttccatagactactataatatgtttacttcaatctttactctatgtacaatgtctgtggatcggtatatcgccgtctgccaccctgtcaaagccctggactttcggactccgaggaatgcgaagatcatcaacgtctgtaactggattctctcatccgctatagggctccccgtgatgtttatggccacaaccaagtaccggcaaggtagtatcgactgcaccttgacttttagccaccctacctggtattgggaaaacctgttgaagatctgcgtgtttatctttgcgtttattatgcctgttctgatcataactgtgtgctacggcctgatgattcttcggctcaaaagtgttcggatgctgagtggatctaaagaaaaagaccgcaacctcaggcggattacacggatggtgctcgtggtcgtggcagtcttcatagtgtgttggacacctattcatatttacgtcatcattaaagcacttgttacgatcccagagacaacctttcagactgtgagctggcatttttgcatcgcgttaggctatactaactcatgcctcaaccccgtgttgtatgcattcctggatgaaaactttaaacggtgctttagggagttctgtatccccacctcctccaatatcgagcagcagaatagcactcgaatccgtcagaatactcgggatcacccgtcgaccgccaatacagtcgatcgcactaaccatcaaagctag

SEQ ID NO: 233551 - DNA, 1095 bp, Artificial Sequence
  Description of Artificial Sequence: Synthetic coding sequence
atggcacaacaatggtcattgcagagactcgcaggtcgccatcctcaagactcgtacgaggacagcacacagtcctctatcttcacttacacaaactccaacagcacaagaggcccattcgagggccctaattatcacattgcacctcgctgggtctaccacctgaccagtgtgtggatgatctttgtggtcaccgccagtgtgtttaccaacgggctcgtccttgcagccactatgaaatttaaaaaactgcgacatcctctcaattggatcctggtgaatttggcagtggctgacttggcggagaccgttattgcctctactataagcatcgtcaatcaggtgagtggctacttcgtactggggcacccgatgtgcgtactggaagggtacacagtcagtctttgcggcattacaggactttggagtcttgcaattatttcatgggagaggtggttagtagtgtgtaaaccgttcgggaacgtgagattcgacgccaaattagccatcgtgggaattgcgttcagctggatctggtccgcagtgtggaccgcacccccaatttttggctggagtcgatattggcctcacgggctgaagacctcctgcggccctgatgtgttcagtgggtcctcttaccctggcgtgcagtcttatatgattgtcttgatggtgacatgttgcatcatacccctggccatcatcatgttgtgttacctgcaagtctggctggctattagagccgtggcgaaacaacaaaaggagtctgaaagcactcagaaggctgaaaaggaggtgactcgtatggtggtagttatgattttcgcgtactgcgtctgctggggcccatataccttctttgcttgctttgctgccgctaatcctggctatgctttccatcctctgatggccgctctgccagcctattttgctaaaagcgcaacaatttacaatcccgtcatctacgtatttatgaatagacagtttcgcaattgtatcctgcagttgtttggaaaaaaagtcgacgatggatctgaactgtcctccgcttcgaagactgaagtttccagcgtctcctcagtatcaccagcctag

SEQ ID NO: 233552 - DNA, 1095 bp, Artificial Sequence
  Description of Artificial Sequence: Synthetic coding sequence
atggcccagcagtggtcactgcagcggcttgccggacggcaccctcaggactcctacgaagactccactcagtcttctattttcacatacactaactctaattcaactcggggtcctttcgaaggccctaactaccacatagcaccgcgatgggtgtatcacttgaccagtgtgtggatgatttttgtggtgattgctagcgttttcacgaatggtctagtgctggcggctaccatgaaatttaagaaactgaggcacccgctaaactggatcctcgtgaacctagccgttgctgatttggcagaaaccgtcatcgctagcacaatctctgtcgtgaatcaagtctacggctattttgtcctgggtcacccaatgtgcgtcttagaaggatatacagtgagtctgtgtgggataacagggctgtggtcccttgctataatctcttgggagaggtggatggtggtgtgtaaacctttcggcaacgtacgctttgacgcaaaactggctatagtgggtatcgcattttcctggatttgggcagccgtctggactgcgcctcccatcttcggctggtcacggtattggccgcacggccttaagacatcctgtggccctgatgtgttttccggaagcagttaccctggtgttcagtcatatatgattgtactgatggtaacttgctgtattactcctctgtcgatcattgttctttgctacctacaagtgtggctcgctatcagagcagtagcgaaacagcaaaaagagtcggaaagcactcagaaagccgagaaagaggtgacccggatggtagtcgtgatggttttggctttttgtttttgttggggaccttatgctttttttgcttgtttcgcagccgcaaaccccggttacccgttccaccctttaatggccgctctgccagccttttttgccaagtcagccaccatctataacccggtgatttacgtgttcatgaatcggcagttccgcaattgtatcctgcagcttttcggaaaaaaggtagatgacgggagtgagttgagctctgcctccaagactgaggtgtcaagtgtgtcatccgtttctcctgcctag

SEQ ID NO: 233553 - DNA, 1047 bp, Artificial Sequence
  Description of Artificial Sequence: Synthetic coding sequence
atgcggaagatgagtgaagaggaattttatttgttcaaaaacatcagttccgtgggcccttgggatgggccacagtaccacatagcacccgtctgggcgttttacctacaggctgcatttatgggaacagtgtttctgatcggcttccctctgaatgctatggttctggttgcaacacttaggtacaaaaagctgcgccagccccttaactatatactggttaacgtgtccttcgggggttttttgctctgtattttttccgtttttcctgtctttgtggcatcctgcaatggctacttcgtgttcggacgccacgtgtgcgccctggaaggtttcctggggaccgtagccggactagtgacgggctggagtttagccttcctggctttcgagcggtacattgtgatctgtaagccatttggcaactttaggttctccagtaagcacgccctgaccgtggtgttggcaacgtggacaatcggcatcggcgtcagcatccctcccttcttcggttggagtcggtttattcctgaggggcttcaatgcagttgcggtcccgactggtataccgtgggtaccaagtatcgatctgagagttacacttggttcctcttcatcttctgcttcattgtcccactgagcctgatttgttttagctacactcagctgttgcgggctctcaaggctgtcgccgcacagcagcaggaatcagccaccacacagaaggcagagcgtgaggtgagtcgcatggtagtggtgatggtcggtagcttctgtgtgtgttatgtgccttacgccgctttcgccatgtacatggtcaataaccgcaatcacggtttggacctgaggctggtgactattccatccttcttcagtaaatctgcctgcatctacaaccctattatctactgttttatgaataaacaattccaggcctgcatcatgaagatggtttgtgggaaggcaatgaccgatgagagcgacacctgttcgtctcagaaaaccgaagtctctactgtatctagtactcaagtggggccaaactag

SEQ ID NO: 233554 - DNA, 972 bp, Artificial Sequence
  Description of Artificial Sequence: Synthetic coding sequence
atgtattccgggaatcgctctgggggacacggctactgggatggtggaggggcagccggtgcagaaggcccagcacctgccggaaccctgtccccagccccattgttctcccccggaacatacgaacgccttgctctcctgctgggaagcatcggcctgcttggcgtagggaacaacctcctcgtcctggttctatactataagtttcagagactgcgaactccaacacaccttctgcttgtgaatatctccctcagtgatttgctggtttctctttttggagttaccttcacttttgtgtcatgtcttcggaatgggtgggtctgggacacagtgggctgtgtttgggatggatttagcggttctctgtttggctggatatcccaactgcaggcagcaacacgcgaagctcgcgcttctatgggccctgttcagcaggggaccatctgcatgcagcttcggtgcgtcgaggatttgcagaccatccaagtaattaagattctgaagtatgaaaaaaagctggccaaaatgtgctttctgatgattttcacctttctcgtgtgttggatgccctacatcgtcatatgttttcttgtggtgaacggtcacgggcaccttgtaacacccactatcagcatagtttcttacctgttcgccaagagcaacaccgtgtacaacccggtgatttatgtctttatgatacgtaagtttcgcaggagtttgctacagctgctctgtctgaggttactgcggtgccagagaccagccaaagatctcccggctgccggaagcgagatgcagatccggccaatcgtgatgtcacagaaggacggagaccgacccaagaaaaaggtgacttttaattcctcttccattatctttattattacttctgatgagtccctgtctgtcgacgacagcgacaagactaacggatctaaagttgacgtcatacaagtcagaccgctttag

SEQ ID NO: 233555 - DNA, 1209 bp, Artificial Sequence
  Description of Artificial Sequence: Synthetic coding sequence
atgtattcaggtaatcgaagcgggggtcatgggtattgggacggaggcggtgccgcaggtgctgaggggcctgctcccgctggcactctctcccccgctccactgttttctcccggtacttacgagcggctggctctcttgctcggtagtatcggcctcttgggcgtgggcaacaatctcctggtgctggtattatattataagttccagcgcctccgcacacccacacacttgttacttgtaaacatttccctaagtgacctgctggtttctttatttggcgtgaccttcaccttcgtctcttgtcttagaaacggatgggtctgggatacggtagggtgcgtgtgggatgggttctcaggatctctcttcgggatcgtatcaattgccactctgactgtgctcgcatatgaacgttacatccgggtggttcatgcacgggtcatcaacttctcatgggcctggagagcgatcacctacatctggttgtatagcctcgcatgggccggagctccactgctggggtggaaccgctatattctcgacgtgcacgggctcggatgcaccgtggactggaagtccaaggatgctaacgactctagctttgtactgtttctgtttctgggatgtcttgtagtgccactgggagtgattgcacactgttatgggcacatcctttatagcattcggatgttgcgctgcgtggaagacctgcagactatacaggtcataaagatcctgaagtacgagaagaagctagccaagatgtgcttcctcatgatttttacatttctggtctgttggatgccatacatcgttatctgtttcttggtggtcaatggacacggacatctggtgacacccacaataagcatcgtgagctatctattcgccaagtcaaacactgtctacaaccctgtgatttatgtgtttatgatccggaaatttcggaggagcttactgcagctgctgtgtctgaggcttctccgatgccagaggcccgcaaaggatcttcccgcagcaggttcagagatgcagatccggcctatcgtgatgtcccagaaggatggagaccggccaaaaaagaaggtgacttttaactctagctctatcatattcattattacatccgacgagtcccttagtgtcgacgattctgataagactaatggatccaaagtcgacgttatccaggtacgacccctgtag

SEQ ID NO: 233556 - DNA, 2886 bp, Artificial Sequence
  Description of Artificial Sequence: Synthetic coding sequence
atgtggcgcctgagaagagctgccgtggcatgtgaagtttgccagagcctggttaagcatagcagtgggatcaaaggaagcctgcctttacagaaactgcacctcgtttcccggtcaatctatcatagccatcaccctacactgaagttacagcgccctcagctgagaacctcctttcagcagttctccagcctgacaaacctgccattacgtaaactgaagtttagcccgatcaagtatgggtatcagccccgacgaaacttttggccagccaggctggccacacgcctcctaaaacttagatacttaattctgggctcagccgtgggtggaggctacactgcaaagaagacgtttgatcagtggaaagatatgatccccgacttaagcgaatacaagtggattgtgcctgacatcgtgtgggagatagatgaatacatagactttggctcgcccgaagagacagctttccgcgcaacggacagaggcagtgaatctgacaagcacttcaggaaaggactgttaggcgaattgatcctcctgcagcagcagattcaggagcacgaagaggaagccaggcgtgccgctggacagtactctacttcctacgcgcagcagaagagaaaggtttccgataaagagaagatagatcaactgcaggaggagttgctgcatactcaattgaagtaccaaaggatcctcgagcgtctagagaaggaaaacaaagagttacgtaagctcgtgctgcagaaagacgataagggaatccaccatcgcaagctgaagaaatcgctgatagacatgtattctgaagtgttggatgttctgagcgactacgacgcctcttataacacacaggaccatttaccccgtgtggtagtggtcggggatcaaagcgccggtaaaacgagtgtgctggagatgatcgcccaagcccgtattttcccgagaggtagcggtgagatgatgacccgctcccccgtgaaagtgacgctatcggaaggtcctcatcacgtcgcactgtttaaggactcttctcgagagttcgatcttactaaggaggaagatctcgccgctcttcgccacgaaatcgagcttaggatgcgcaagaacgtgaaagagggctgtaccgtctctccagaaacaatttccctgaacgtcaagggtcccggtttgcaacggatggttctggtggatctgcctggagtaattaatacagtgacgtctgggatggcacctgacactaaggagaccatatttagtatttctaaggcctatatgcagaacccaaacgcgataatcctctgtatccaggacggcagtgtcgatgcggagaggagcatcgttacagatctcgtgagtcagatggacccccatggtagacggaccattttcgtactcaccaaagtcgacctggctgaaaagaatgtggcctcaccatctcgcatccagcagatcatcgaaggaaaactgtttcctatgaaagcgctgggatatttcgcagtggttaccggcaagggaaactccagtgagtctattgaggctattcgtgaatatgaggaagaattttttcagaactcgaagcttctgaagacgagtatgcttaaagctcatcaggttacaactcgtaacctcagtctagccgtgtcagactgtttctggaagatggttagagagtctgttgagcagcaggcagactctttcaaggccacaagattcaacctggagacggagtggaaaaataattatcccagactgagagaattggatagaaatgaactgtttgagaaagctaaaaatgaaattttagacgaggtgatcagcctgtcacaggtaacacctaaacactgggaagagatcctacagcaatcactgtgggaaagagtgtccacccatgtgattgagaatatctacctgcccgctgcacagactatgaatagcggtaccttcaatacaacggtggatatcaagttgaagcagtggactgataagcagctccccaacaaagccgttgaggtggcctgggagactctacaggaggaattttctcgttttatgaccgaacctaaaggtaaggaacacgacgatatttttgataaactgaaggaagccgtgaaggaggagagcattaagagacacaagtggaacgatttcgcggaagacagtctgcgtgtgattcagcataatgctctggaggaccgaagcatctccgataagcagcagtgggacgcagctatttactttatggaagaggcgttgcaggcccgactgaaagacaccgaaaatgccatcgaaaacatggtgggcccagattggaaaaagcgttggctatactggaagaatcgcacacaagaacagtgtgttcacaacgaaactaagaatgagctggagaaaatgctgaaatgtaacgaagagcatcccgcttacctagcatccgatgaaattacgacagtgcgaaagaaccttgagagtagaggcgtggaggtcgacccatcgttaattaaggacacttggcatcaggtgtatagaagacactttttgaaaaccgctttgaaccattgtaatctctgccgcaggggtttctattactaccagagacacttcgtggattctgaactggagtgtaatgacgtggtgttgttttggagaatacagcgaatgttggctatcaccgccaatactctgaggcagcagctgactaacaccgaggtgcgcaggctcgaaaagaatgtgaaagaagtgcttgaagattttgcagaggacggagaaaagaagatcaagctgttgacaggtaagcgcgtgcagctggctgaagacctcaaaaaggtccgagaaatccaggagaaactcgatgcttttatcgaagcactacaccaggaaaaatag

SEQ ID NO: 233557 - DNA, 3048 bp, Artificial Sequence
  Description of Artificial Sequence: Synthetic coding sequence
atgtggaggctgcgcagggccgcagtggcctgcgaagtgtgccagtcattagtcaaacacagctcgggaatcaaaggctcactgccacttcagaagttgcaccttgtgtctaggtctatctaccattcacatcacccgacactgaaattgcagagacctcagcttagaacctctttccagcagttctcttctttgacgaacttaccactgaggaagctgaagttctcacctatcaaatacggataccagccacggagaaacttctggcccgcacgtctggctacacggctcttgaaactgcggtacctgatccttggcagtgcagtgggtggtgggtacacggcaaaaaagaccttcgaccaatggaaggacatgatcccggatttgtctgagtacaaatggatcgttccagacatcgtctgggaaatcgatgaatacattgatttcgaaaagatccgaaaagcactgccatcctccgaagatcttgtgaaacttgccccagacttcgataaaatcgtggaaagcctctctctactgaaggacttcttcacgagcggccacaagctcgtttctgaggttataggtgcttccgatttactgctgcttctggggtctcccgaagaaacagccttcagagcaactgacaggggttcagagtctgataaacatttccgaaaggggctgctgggcgaattgattctccttcagcagcagattcaggagcacgaagaagaggcgaggcgcgcagcgggacaatactccacttcttacgcccaacagaaaagaaaggtgtccgacaaagagaaaattgaccagcttcaggaagagcttctccacacccagttaaagtatcaaagaatcctggagaggctggaaaaagagaataaggaactgcgcaaattggtcttacagaaggatgataaagggattcaccaccgtaaacttaagaaaagcttgatcgatatgtactcagaggtcctggatgtgctgagtgattacgacgcctcttacaacacccaagatcaccttcccagggtcgtggtggttggcgatcaaagtgcagggaaaacatcggtgttagagatgattgctcaagccaggatcttccctcggggaagtggtgagatgatgacccgaagtccggtcaaggttaccctctctgaaggtccgcaccacgtcgccttgtttaaggattccagccgggaatttgacctgaccaaggaggaggatctggctgccctgcggcatgagatagagctacgcatgaggaagaatgtgaaagaaggctgcacagtttctccagagactatctccctgaatgtgaagggccctgggcttcagaggatggtgttggtggatctgccgggtgtaataaacactgtgaccagtggcatggcccctgataccaaggagacaatcttctctatatccaaggcgtatatgcagaaccccaacgctataatcctgtgcatccaagatggctctgtcgacgcggaaagatccattgtcaccgatctggtgagtcagatggatcctcacgggcgaaggactattttcgtcttgactaaggtggatttagcggagaagaacgtggcgagccctagccggattcagcagatcatcgaaggtaaattattcccaatgaaagcactcgggtattttgcagtagttaccgggaaaggcaattcttccgaatccatcgaagccattcgagagtacgaggaggagttttttcagaacagcaagctgctgaagacaagcatgttgaaagctcatcaggtaaccacgcggaatttgtctctcgccgtgtccgattgcttctggaagatggtacgagaaagtgtcgaacagcaggcagattcatttaaggctacacgtttcaacttggagactgagtggaagaacaactacccccgattaagggagttggaccgcaacgagctgtttgaaaaagcaaaaaatgagatccttgacgaggtaatttcactctcccaggtcacaccaaagcattgggaggagatcctgcaacaatccctgtgggagagggtcagcacacatgtaattgaaaatatttacctgcccgcagcacagactatgaactcgggaaccttcaacactaccgtggatatcaagctgaagcagtggacggacaaacaactgccgaataaggcagttgaagtcgcctgggagacattgcaggaagaattctctaggtttatgaccgagcctaagggcaaagagcacgacgatatttttgataagttgaaagaggcggttaaagaggagagcattaagagacacaaatggaatgattttgccgaggactccttacgcgtgatccagcacaatgccctcgaggatcgaagtatctctgataaacaacagtgggatgcagcaatatattttatggaggaggcattgcaagcacgcctgaaggacacggagaacgccattgagaatatggtgggtcctgactggaaaaagcggtggctgtactggaaaaatcgtactcaagaacagtgcgttcacaacgaaaccaagaatgaactggaaaagatgctgaagtgtaacgaagaacatccagcgtacctcgcgagcgacgagatcactacagtgcgcaagaacctggagtctcgtggggtggaggttgatccttccctgataaaagatacctggcatcaggtgtatagaagacacttcctcaaaactgctctcaatcattgcaacctttgtcgtcggggattttactattaccaacggcactttgttgattccgaactggagtgcaacgatgtagtgctgttttggcgaatacagcgcatgctggctatcactgctaatactctgcgccaacagctgaccaacaccgaggtgcggaggttggaaaagaacgtgaaggaagtcctggaagattttgccgaggacggagagaaaaaaattaaactgcttactggcaagagggtgcaactcgcggaggacctgaagaaggtccgggaaattcaggaaaaactcgacgcgttcatcgaggctctacaccaggagaagtag

SEQ ID NO: 233558 - DNA, 2940 bp, Artificial Sequence
  Description of Artificial Sequence: Synthetic coding sequence
atgtggaggctgcgtcgggcagctgtggcttgcgaggtgtgtcagtccctggtcaaacatagcagtggaatcaaaggtagcctccctctccaaaagctgcacctggtctcccgaagtatttatcacagccatcaccccaccctcaagttacagcggcctcagttgcgcactagctttcaacaattttcttcgctgacaaacctgccactcaggaaattgaaattctctccaataaaatacggttatcagccccgacgcaacttttggccagcacgcctcgctacccggctactcaaattgagatatctcattctggggagtgccgttgggggtggttatacggccaaaaaaaccttcgatcagtggaaggatatgataccggacctctcggagtataagtggatcgtgccagacattgtgtgggagatcgacgagtacattgattttggtcacaaacttgtgtccgaagttataggagcttcagacctgcttctgctgttaggttcacctgaagaaactgcattccgcgcaactgaccgcggaagcgagagtgacaagcactttagaaagggcctgctgggcgagctaatcttgttacagcaacagatccaggaacacgaagaagaagcacgccgagccgcaggccaatacagcaccagctacgcgcagcagaaacgtaaggtttctgacaaggagaagattgaccagctgcaggaggaacttctacatactcagctgaagtaccagcgaatcctggaacggttggaaaaagagaataaggaacttaggaagctcgtattgcagaaagatgacaaaggaatacatcaccggaagctcaagaaatcattgatagacatgtattccgaggtcttggacgtcctgtcagactatgatgcaagctacaacacccaggaccacctccctcgcgtggtggtcgtgggggaccagtccgcaggcaagacatctgtgctggagatgattgcccaggcaaggatcttccccaggggctcaggcgagatgatgacacgcagcccggttaaggtgactcttagcgaaggccctcatcatgtggccctgtttaaggactcctccagagaatttgacctgacgaaggaagaagacttggcggcactgcggcacgagatcgagcttagaatgcggaagaatgtgaaggagggctgtacggtctcccctgaaactatatctcttaatgtcaaagggcctggtctccagcgaatggtcttagtcgatctgcccggtgtcataaacactgtgacaagcggcatggcgccagacactaaagaaaccatcttcagcataagcaaagcttacatgcagaaccccaacgcaattatactttgtattcaagatggttccgtcgacgctgaacgttctatcgtgacagacctcgtgagccaaatggatccacacggtaggagaacgatatttgttttgaccaaagtagacctggcagagaaaaatgtcgcaagcccctcacggatccagcagatcatagaaggaaagctgttccccatgaaagcattgggctacttcgctgtcgttacaggaaagggcaatagcagtgagtcaatagaggctattcgcgagtatgaagaagaattcttccagaattcaaagttactgaagactagcatgctgaaggcacatcaggttaccactcggaatctctccctggctgtctccgactgtttctggaagatggtacgagagtctgtggagcagcaggcagattccttcaaagccactcgattcaatttggaaactgaatggaaaaacaattatcctcgactcagggagctcgaccgcaacgagctctttgagaaggccaagaatgagatactggatgaggtaatatcactgtctcaagtgacacctaagcattgggaggagatcctacaacaatctttgtgggaacgggtgagtacccatgttatcgaaaacatttacctgcccgctgctcagactatgaattcgggtacttttaatactaccgtagatattaagttgaaacagtggaccgataaacagttgccaaacaaggccgtggaggttgcttgggagactctacaggaagagtttagccggttcatgaccgagcctaagggtaaggagcacgacgatatctttgataagctgaaggaagccgtgaaggaggagtccattaaaagacacaagtggaatgacttcgctgaggacagcttaagagtgatccaacacaatgcgctggaagatcgctccatcagtgataagcagcaatgggacgctgctatctattttatggaagaggcgttgcaggcgagactgaaagacactgaaaacgccatcgaaaatatggtagggcctgactggaagaagcggtggctctactggaagaacagaactcaggagcaatgcgtccataatgaaactaaaaacgagctggagaagatgttgaagtgtaacgaggaacatcctgcctatttagcttccgacgaaatcactaccgtgcggaagaatctggaatctcgtggggtagaggtagatccatccctgatcaaggacacgtggcaccaggtttaccgccgacatttccttaagaccgccctgaaccattgcaatctgtgccgcagagggttctattactatcagaggcacttcgttgattccgagctcgagtgcaatgacgtagtactcttctggaggattcagcggatgctagccattacagccaacacattgagacagcaacttacgaataccgaagtgcgcaggcttgagaagaacgtcaaggaggtactcgaggacttcgcagaggatggagagaagaagatcaaactcctaaccggaaaacgcgtgcagctagccgaggatcttaagaaggtccgagagatccaggagaagcttgacgcattcatcgaggcccttcaccaggaaaaatag

SEQ ID NO: 233559 - DNA, 2937 bp, Artificial Sequence
  Description of Artificial Sequence: Synthetic coding sequence
atgtggcggctgcggagagccgctgtcgcctgcgaggtctgccagtccctcgttaaacatagttccggaatcaagggcagtttgcccttacagaaactgcatctggtgagcaggtcaatatatcactctcatcatccaacccttaagctccagcgtccgcagctgcggactagcttccaacagttctccagcctgactaatttgccactccgcaaattgaagttctctccaattaagtatggctaccaacctagacgcaacttctggcccgctaggcttgcgacacgcctgttgaagctgcgctacctgatcctgggttcagctgtgggaggaggctacaccgccaagaaaacatttgatcaatggaaagatatgatccccgacctcagcgagtacaaatggattgtccccgatatcgtgtgggaaatcgacgagtatattgattttgagaaaattcggaaagccttgccatctagcgaggacctggtgaaattagcacccgactttgacaaaatcgtggagagcctgagcctgttgaaggacttcttcactagtggccacaagttagtatcggaagtcataggagcttcggaccttctcttattgctggggagcccagaagaaacggcgttccgtgctaccgatcggggttctgaaagtgataagcacttcagaaaagtgagtgataaggagaagatagaccagttgcaggaggagctgctgcacacccagctgaaatatcagaggattctggagcgccttgagaaagagaacaaagaactcagaaagcttgtactccagaaagacgataagggcattcaccacagaaaactgaagaagagcctgatcgacatgtattcggaggttctcgacgtcctgtccgactacgatgcgagctataacacccaggaccatctccccagagtcgttgttgttggagatcaatcagcaggaaagacttcagtcctcgagatgattgcccaggccagaatttttccacgcggttcaggcgagatgatgacacgatcccctgtaaaagttacgctctccgagggaccccaccacgtcgccctgtttaaggacagcagccgcgagtttgacctgacaaaagaggaggacctggccgcactgagacacgaaattgagttgaggatgcgaaagaatgtgaaggaggggtgtacggtttctccggaaacaatttctctgaatgttaaaggccctggcctccagcgaatggtcctggtggatttgccgggagtgatcaacaccgtgacgagcggcatggctccagacaccaaagaaactattttcagcatctctaaggcatatatgcagaaccccaacgcgattatcctctgtattcaggatggttcagtcgacgccgaacggagcatcgtgacggatctcgtcagtcagatggatccccatggacgtaggacaatcttcgttctgacaaaagtggatctagcggaaaaaaatgtggcgtcccccagtcgtatccagcagattatcgagggaaagctgtttcccatgaaggccctgggttatttcgccgttgtaaccggcaagggaaattcttcggagtctattgaggctatacgcgaatacgaggaagagttcttccagaacagcaaactcctcaaaacaagcatgctgaaagctcaccaagtcactacccggaatctgtcgctcgcggtgagtgattgtttttggaagatggtgcgggagtccgtagagcaacaggcagactcctttaaggcaacaagattcaatctggagactgagtggaagaataattacccacggttgagagaacttgataggaatgagctgttcgaaaaggcgaagaatgaaatccttgacgaagtaattagcttgtctcaggtgaccccaaagcactgggaagagatcttacagcagtctctgtgggagagggtttccacgcatgtgatcgaaaatatttatctcccagcggcacagacaatgaattctggtacgttcaacacaactgtggacatcaagttgaagcaatggacagataagcagctgcccaataaggccgtggaagtcgcgtgggagactcttcaggaagaattttcgaggttcatgaccgagcctaaggggaaagaacatgatgacatcttcgataagttgaaggaggccgtcaaggaggagtctatcaaaaggcacaagtggaatgacttcgccgaggactcactgagagtaatccaacacaacgctctggaggatcggagcattagcgataaacaacagtgggacgctgctatctattttatggaggaagccctgcaggccagactgaaagatacggaaaacgcgatagaaaacatggtgggacctgattggaaaaagaggtggctgtactggaagaatcggacccaagagcagtgcgtccataacgagacgaagaacgagttggagaagatgctgaagtgtaatgaggaacaccccgcttacttggcatccgacgagataacaaccgtcaggaaaaatctggagagtaggggcgtggaggtggaccccagcttgattaaggatacctggcatcaggtttatcggagacactttcttaagaccgctttgaatcactgcaatctgtgccgacggggattttactactatcagcgacattttgtggatagcgagctggagtgcaatgatgttgtcctgttctggaggattcagcggatgctggccattaccgctaacactcttaggcagcagctgacaaacacggaggtgaggagattagaaaaaaacgttaaagaggtactagaggattttgccgaagacggggagaagaagataaagctcctgacagggaagcgggtccagctggccgaagatctcaaaaaagtcagggagatacaggaaaagctggatgcttttatcgaggccctgcaccaggaaaaatag

SEQ ID NO: 233560 - DNA, 2994 bp, Artificial Sequence
  Description of Artificial Sequence: Synthetic coding sequence
atgtggaggctgcgacgcgcagctgtcgcatgtgaagtctgtcagtctctggtgaagcacagttctggaattaaagggagcttacccctccagaagctacacctcgtaagtagatcaatttaccatagtcaccatccaaccctgaaacttcagcggcctcagctgagaacctcatttcagcagttcagttcattgacaaacttgccactacgcaaattgaagttcagcccaattaaatacggctaccagcctcggaggaatttctggcctgccagactggccactcggcttcttaagttacgctatctaatcttaggaagcgccgttggagggggttataccgcaaaaaagaccttcgaccagtggaaagatatgattccggatcttagcgaatataagtggatcgtccctgacatcgtgtgggagatcgacgaatacattgactttgaaaagatcagaaaggcactaccgagcagtgaagacttggtgaagctggcgcctgactttgataagatcgtggagtctctgagtcttctgaaggacttcttcacaagtgggtctccagaggaaaccgcctttagagctacagatcggggaagcgagagcgacaagcacttcagaaaaggactcttgggcgagcttattctactgcagcagcagatccaggagcatgaggaggaggctagaagagccgcaggtcagtattcaacaagctatgcccagcagaagagaaaggtctctgataaagaaaaaatcgatcagctgcaagaggagctcttgcatacgcagctaaaatatcagagaatcctagaacggcttgagaaagagaataaggagctccgcaaattggtgctgcagaaggacgacaaaggtatacaccaccggaagctaaagaaatcccttattgatatgtatagtgaggttctggacgtcctcagtgattacgacgcttcttataacacccaggaccacttgcctcgtgtggtggtggtgggagaccaaagcgccggaaaaacttctgtgctggaaatgattgcacaggcacgtatttttcctaggggaagcggcgaaatgatgactaggagcccggtgaaggtaaccctgagcgaggggccacaccatgttgcactcttcaaagatagctctagagaattcgatttgactaaagaagaagacctcgcagcactaagacacgaaatagaacttaggatgagaaagaacgtgaaagaagggtgtaccgtcagccccgagactatttctctaaacgttaaaggtcctggcttgcaacgtatggtgctagtggatctgcccggagtgattaacaccgtgactagcggcatggcccctgacaccaaggaaaccattttcagcattagcaaagcatatatgcagaatcccaacgcgatcattctgtgtattcaagatggaagcgtcgacgctgagcgaagcatcgtgaccgatctggtgtcgcagatggaccctcacgggcgtagaactatatttgtacttacaaaggttgacctcgccgagaaaaatgtcgcaagccctagtcgcatccaacagatcatcgaaggaaaactgtttcccatgaaagccctcggctattttgctgtggtgactgggaaaggtaacagctcagagagcattgaagcgatccgagagtacgaggaagagttttttcaaaacagcaaacttctcaagacttccatgcttaaggcccatcaagtcaccacacgcaatctttccttggctgtgagcgactgcttctggaaaatggtacgagaatccgtggagcagcaagctgacagtttcaaggctaccaggttcaatctcgagacggagtggaaaaacaattatcctcgattacgggagcttgacaggaacgagctcttcgaaaaagcaaaaaacgagatcctggacgaggttattagtctgtcgcaggtgaccccaaagcactgggaagagatactccagcagagtctgtgggagagggtcagtacccatgtgatcgagaatatatacttgcccgcagcccaaacgatgaactcagggacctttaacaccaccgttgacatcaaactcaagcaatggaccgacaaacagctgcctaacaaggcggtggaggtcgcgtgggagaccttgcaggaagagttctcccggttcatgacggagccaaaaggcaaggagcacgacgatatcttcgataagctgaaggaagcagtcaaagaggagtccatcaagagacacaaatggaacgattttgccgaggatagcctgcgcgtgatccaacataacgccctcgaagatcgatccatcagtgataagcaacagtgggatgctgcaatttatttcatggaagaagctttgcaggctagacttaaggacactgaaaatgccattgaaaacatggttggccctgattggaagaagcgatggttgtattggaaaaataggactcaggaacagtgtgtacataacgagaccaaaaatgagctggagaaaatgttaaagtgtaatgaggaacacccagcatatcttgcctccgatgagatcaccacagtgagaaagaacttagagtcacggggagttgaagtcgacccctcactgattaaagatacctggcaccaagtctaccgcagacactttcttaaaaccgctcttaaccactgtaacctctgcagacgcggattttactattaccagcgtcattttgtcgactccgaactggagtgtaatgacgttgtgctattttggcggattcagcgcatgctggctatcaccgcaaacacactcagacagcaactcaccaatacagaggttaggagactggagaaaaacgtgaaagaagtattggaggacttcgctgaagatggggagaagaagatcaagctgttgactgggaaaagggttcagctagctgaggacctcaaaaaggtgagagagattcaggaaaaattagacgcttttattgaagccctacaccaggagaaatag

SEQ ID NO: 233561 - DNA, 501 bp, Artificial Sequence
  Description of Artificial Sequence: Synthetic coding sequence
atgtggcgtctgcggagagccgctgtggcatgcgaagtgtgccaatctctcgtcaagcattcctccggaataaaagggtctctgcctttgcagaagctccacctcgtgagcaggtctatctaccacagccatcatccaaccctgaagctccagagaccacagctaagaacttccttccagcagttctctagccttacaaatcttccccttagaaaacttaagttctcaccaatcaagtatggctaccaacctagaaggaatttttggcctgctaggctcgctaccagattgcttaagttaaggtacttgatcctgggtagcgcagtgggcggagggtataccgctaagaagactttcgaccagtggaaggatatgatccccgacctgtcagagtataagtggattgtgcccgatattgtgtgggagattgacgaatatatagacttcggctcacctgaggaaactgctttcagagccacagatcgtggctccgagtcctag

SEQ ID NO: 233562 - DNA, 2883 bp, Artificial Sequence
  Description of Artificial Sequence: Synthetic coding sequence
atgtggcgactgaggcgggctgcggttgcgtgcgaggtctgccagtccctcgtcaaacactccagtggcatcaagggtagtctgccgctacagaagctgcacctggtctcaaggtctatctaccattctcaccatcctacactcaaattacagagaccccaacttcggacatctttccagcagttctcgtcactcactaacctcccactgaggaaattaaaattctcaccgattaaatatggctatcagccgagacggaacttttggcctgcccgactggccacacgactcctgaagttgcgatacctaatcctggggtctgccgtaggaggcggatacactgctaagaagactttcgatcagtggaaggatatgatccccgatttgtcagaatataagtggatagtgccagatatagtttgggagatagacgagtatattgactttgaaaagattaggaaagccctgccctcttccgaggatctcgttaagctggctcccgatttcgataagattgtcgaaagcctctcattgttaaaagatttcttcaccagcggctctcctgaggaaacagcctttcgggcaaccgacagaggatccgagagcgataagcactttaggaaggtgagcgacaaagaaaaaatcgatcagttacaggaagagctgctgcacacccagctgaagtaccaacggattctggagaggctggaaaaggaaaacaaggagctgagaaaacttgttcttcagaaggacgataaggggattcaccaccggaagctgaagaagagcttaatcgacatgtattctgaggtcttagacgtgcttagtgactatgacgcttcttacaatacgcaagatcatcttccaagagtagtggtagtgggagatcagagtgccggaaagactagtgtcttagagatgattgcccaggctaggatcttccccagaggaagcggcgagatgatgactcgttcccccgtgaaagttactctatccgagggcccacatcacgtcgctctgtttaaggacagctctagggaatttgacctgactaaagaggaggatctcgccgctctgcgccatgaaattgagcttagaatgcggaagaacgtgaaggaaggttgcacagtcagtccagagacaatctcattgaatgtcaaggggcctggcttacaaagaatggtgcttgtcgatctgccaggggtcattaacaccgtcacttcgggtatggcacccgacacaaaggagactatttttagcataagcaaagcttatatgcagaaccccaacgccattatcctttgtatccaggacggcagtgtggatgctgaacgcagtatagtgaccgacctggttagtcaaatggacccccacggcagaaggactatcttcgtcctgactaaagtagatctcgcggagaagaatgtggcatccccctccaggattcaacagattatcgaaggcaaactatttccaatgaaagctctgggctatttcgccgttgtcactggcaaggggaatagctctgagtctatagaggcaatacgagaatatgaagaggagttcttccagaatagtaagctgcttaagactagcatgctgaaagcccaccaagtgacaactaggaatctgtctttggcggtttcggattgtttctggaagatggtgagagagtccgtggaacagcaggctgatagcttcaaggcaactaggttcaacctcgagacagagtggaaaaataactacccacgtttgagggagcttgatagaaatgaacttttcgagaaggccaagaatgaaatcctggatgaagttatttctctctcccaagtcacacctaagcactgggaagagatattgcagcagagcctgtgggaaagagtctctactcacgttatcgagaacatttacctccccgctgcccagacgatgaattccggcactttcaacaccactgtggatatcaaactgaagcagtggaccgataaacagttacccaataaggccgtcgaggtggcatgggagaccctacaagaggaattttccagatttatgacggaaccaaagggtaaggagcatgatgatatttttgataaactgaaggaggctgtcaaagaggagagtattaagcgtcataaatggaacgacttcgccgaggatagcctgcgtgtgatccagcacaacgccctggaagaccggtctatctctgacaagcagcagtgggacgcagctatctattttatggaggaggctcttcaggcgaggcttaaggataccgagaacgcgatagagaacatggtgggacccgattggaagaaacggtggctttactggaagaaccgcacacaagagcagtgcgtacataacgagacaaagaatgagctggaaaagatgctgaagtgtaacgaggaacatcccgcttacctggcgtcggacgaaataaccactgtgcggaagaaccttgaaagcagaggtgttgaggtggatccatcattgatcaaggacacatggcatcaggtctaccgtcggcacttccttaaaaccgcacttaaccattgcaacctttgcaggcggggtttttattactatcagaggcattttgtggattccgagctggagtgtaacgacgtggtgctcttctggcgcatccagcgaatgctcgctataaccgccaacaccctgagacaacagctaactaatacagaggtccgtaggctggagaaaaacgtgaaagaggtcctggaagacttcgccgaggacggggaaaaaaaaattaagttgttgactggcaagagggtgcagctggccgaggacctcaagaaggtcagggagattcaggaaaagctcgacgcatttattgaggcactacaccaggaaaagtag

SEQ ID NO: 233563 - DNA, 558 bp, Artificial Sequence
  Description of Artificial Sequence: Synthetic coding sequence
tgatacctgatcctgggctctgccgtagggggtggttatacagccaaaaaaacctttgaccaatggaaggacatgatacctgatttgagtgaatacaagtggatcgtgccggacattgtctgggagatagacgagtatatcgattttgagaagatccgtaaggccctgccctcatccgaggaccttgtcaagttagcgcctgattttgataagatcgtcgaatccctgtctttattgaaggacttctttacaagtggtcacaagctcgtgagtgaagtaattggcgctagcgacctgctgctccttcttgggagccccgaagaaacagccttcagggccacagaccggggatctgagtcagataagcactttcggaaagtgagcgataaggagaaaatagaccaattgcaggaagagctcctgcacacacagttaaaataccagcgaatcctggagaggctcgagaaggagaataaggaattacgtaagcttgttctgcaaaaggacgataagggaattcaccatagaaagttaaagaagtccctgatcgatatgtag

SEQ ID NO: 233564 - DNA, 540 bp, Artificial Sequence
  Description of Artificial Sequence: Synthetic coding sequence
atggttgtgggagcattcccgatggctaaacttctctacctggggatcagacaggtctctaagccgctagctaaccggatcaaggaggcagcccgacgatctgaattcttcaaaacttatatttgtctgcctcccgctcagttgtaccattgggtggagatgcggactaagatgaggattatgggcttcagggggaccgttataaaaccattgaacgaagaggctgccgcagaattgggggcagagttgctgggagaggccactatattcatcgttggtggcggatgcctggtgttagaatactggcggcaccaggcccagcagagacacaaggaagaggagcaacgtgccgcatggaacgccctgcgagatgaggtgggacacctggccttggccctcgaagcactgcaggcacaagtgcaggccgcacctcctcagggcgcattggaggaacttcgaactgagctgcaagaggttcgcgctcagctctgtaatcctggcagaagtgcaagccacgcagtcccggcttcaaaaaagtag

SEQ ID NO: 233565 - DNA, 543 bp, Artificial Sequence
  Description of Artificial Sequence: Synthetic coding sequence
atggtggtgggggctttcccaatggctaaattgctctatctggggatcaggcaggttagcaaacccctggcaaaccgaataaaagaggcagccaggagatccgagttcttcaagacgtacatatgtctgccccctgctcagctgtatcattggctcgagatgcgcaccaaaatgaggatcatgggttttaacgcagccgcaatcaagccactgaacgaaggagcggcagccgagctaggagcggaactcctgggcgaaggaatcatattcatcacggcttgttcttgtttaatgctggaatattggaggcatcaactccaacagcggcgaaaagagaaagagcgaagagtcgcgagagaagctctgcgcggtgaggtcggtcacctcggactggctctcgaggagttgcaggcccaggtacaggcaacttccacacagttggccctcgaggagctgagggcccaattacaggaagtgagagcccacctgtgtctgagagatccccctcctgcaccacccgtggccccagcttcagaaaaatag

SEQ ID NO: 233566 - DNA, 381 bp, Artificial Sequence
  Description of Artificial Sequence: Synthetic coding sequence
atgaggactaaaatgaggatcatggggttccgagggaccgtcatcaagccgttgaatgaagaggccgctgcagagctcggcgctgaacttctgggagaggcgacgatttttattgttggcggtgggtgcctcgttcttgaatattggagacatcaggctcagcagcggcataaagaggaggagcagcgtgccgcttggaatgctctacgagacgaagtagggcatctggcgctggccctggaagcgcttcaagctcaggtccaggcagcaccccctcagggagccctggaagaactgaggacagagcttcaggaggttcgcgcacaactatgtaatccgggtcgctcagcctcccacgcagtgcccgcttccaagaaatag

SEQ ID NO: 233567 - DNA, 1734 bp, Artificial Sequence
  Description of Artificial Sequence: Synthetic coding sequence
atgtcacaccagcccttgagctgcctcaccgagaaggaggattccccttccgagagcactggaaatggaccaccacacttagcgcaccctaacttagacacgttcacgccagaagagctgctgcagcaaatgaaggaattgctgaccgaaaatcatcagctcaaggaggcgatgaagctgaacaaccaagccatgaaagggaggttcgaagagctgtcagcctggactgaaaaacagaaagaagaaagacaatttttcgagattcaaagcaaggaagcgaaagagagactgatggccttgtctcacgaaaatgagaaattgaaggaagaactgggaaagctgaagggcaagtccgaaagaagtagtgaagaccccacagatgatagcagactgcctagagctgaagccgagcaggagaaagaccagcttcgcacccaggtggtgagactgcaggccgaaaaggccgatcttttaggcatagttagcgaacttcaactgaagctgaactctagcgggagttctgaagactccttcgtcgaaatccggatggccgagggagaggcagagggctccgtcaaggaaattaaacactcgcctggcccaacccgcaccgtgtccacgggaacagcactgagcaagtacaggagtcgttctgctgatggagctaaaaactatttcgaacatgaggaactgactgtgtcccagctactcttgtgtcttagagaaggcaatcagaaagtggaacgcctagaggttgctctgaaggaggccaaagagagagtaagtgacttcgagaaaaagacaagcaacagatccgaaattgaaacccagactgagggtagcactgaaaaggagaacgatgaggaaaagggtccagagactgtgggttccgaggtcgaagcacttaatctacaggtgacaagtctctttaaagaactgcaggaagcgcacactaaactctccaaggctgagctcatgaaaaagcgcctgcaagaaaaatgtcaagcactggaacgtaaaaactctgccatcccttctgagcttaatgagaaacaagagttggtttacaccaataaaaaactggagcttcaggtggagagcatgctgtcagaaattaagatggagcaggctaagacagaagatgaaaagagcaaactgaccgtattacagatgacccataacaagctactacaggaacataataacgccttgaagacaattgaggagctcaccaggaaggagagcgagaaggttgatagggctgtgctgaaggagctctctgagaaactcgaactggctgaaaaagccttggccagcaaacagttgcagatggatgagatgaagcagactatagccaaacaggaagaagacctcgaaacaatgacgatcctgagggctcagatggaagtgtattgcagcgatttccacgctgaacgagcagcccgagaaaaaatccatgaagaaaaggagcagctggctctgcaactcgcagtactacttaaggagaatgacgctttcgaggacggaggcagacagtccctgatggagatgcagtccagacatggcgcacggacctccgactcagaccagcaggcttatcttgtccaaaggggcgcagaggacagggactggagacagcagagaaacattccgattcacagctgtcccaagtgcggggaggtgctaccagacattgatacgctacagatacatgtaatggactgcatcatttag

SEQ ID NO: 233568 - DNA, 1734 bp, Artificial Sequence
  Description of Artificial Sequence: Synthetic coding sequence
atgagccaccaacctcttagttgcctcacagaaaaagaggactcaccatccgaatccacggggaatgggccaccacacctggcccatcctaacctcgacacattcactccagaagagctcctgcagcagatgaaggagctgctgacagagaatcatcagttaaaggaagccatgaagctgaacaaccaggctatgaaaggcaggttcgaagagctgtcagcttggaccgaaaaacagaaggaagagcgacagttttttgagatccagtctaaggaggctaaagaaagactgatggcgctatcccacgagaacgagaaactgaaggaagaacttggaaaactgaagggcaagtcagaaagatcatcagaggatcccaccgatgattcacggctccccagggctgaggcggaacaggaaaaggatcagctgcgaacacaggtggtccgcttacaggctgagaaagccgacctactaggcatcgtatctgagttgcaactgaagctcaactctagcgggtcgagtgaggactccttcgttgaaattaggatggccgagggagaagccgaaggctcagtaaaagagatcaagcactcccccggtcctacaagaacagtgtctacaggaacagcgctcagcaaatatcgatcaagatcagctgatggggcaaagaattattttgagcatgaagaactcactgtatcccagctcctcctgtgtctgagggaaggcaaccagaaagtcgaaaggctggaggtagctctgaaagaagcgaaggagcgcgtgtccgactttgagaaaaagacttccaaccggagcgagattgagactcagacagaaggcagcaccgagaaagagaatgacgaggagaagggccctgagacagtcggatcagaggtggaagctcttaatctccaggttacatctttgtttaaagagctccaggaggcccacacaaagctcagcaaggctgaactgatgaaaaagcgcctgcaggaaaagtgccaggccctggagcgaaagaacagtgctatcccatccgaactcaatgaaaagcaggagctggtctataccaacaaaaagttagaattacaagtggaatctatgctgtctgaaattaagatggaacaggccaaaacggaggacgagaaaagtaaactgacggtgttacagatgacccataacaaactcttgcaagagcacaataacgcgctgaaaacgatcgaagagttgacaaggaaggagtctgagaaagtagatagggccgtgctgaaggaactttccgaaaaattggagctggctgagaaggccctggcaagcaaacagttgcagatggatgagatgaagcagacgatagcaaagcaagaagaggatttggaaactatgaccattctgcgcgcacagatggaagtttactgcagcgacttccatgcagagcgagccgcacgcgagaaaatacacgaggagaaggaacagcttgcgctccagctagcggtgctcctaaaggagaacgacgctttcgaagatggaggaagacaatccctgatggagatgcagtcccgacacggcgcaaggacgtccgatagcgatcagcaagcatatctggtgcagcgaggtgcagaagaccgcgattggcgacagcagcgaaatataccgatccattcatgccctaagtgcggggaggtcttgccagatatcgacactctgcagatacacgtgatggactgcatcatctag

SEQ ID NO: 233569 - DNA, 1734 bp, Artificial Sequence
  Description of Artificial Sequence: Synthetic coding sequence
atgtcacaccagccattgagttgtcttactgaaaaagaggattcaccaagtgagtcaacaggcaatgggcctccccacctggctcaccccaaccttgacacctttacaccggaggaactgctgcagcagatgaaggagctgctcacagaaaaccaccaattaaaagaggccatgaaactgaataaccaggctatgaaaggacgcttcgaagaattaagcgcatggactgaaaagcagaaggaagagagacaattctttgaaatccaatctaaggaagccaaggagagactgatggcactgagtcatgagaatgaaaaattgaaagaggagctcggcaaactgaaaggaaagtcggagagatcttctgaggaccctactgacgattcccgcctcccgagggccgaggcagaacaggagaaggaccaactacggactcaagttgttcgtttgcaggcagaaaaggccgacttgctgggcatagtgagtgagctccagctcaaactgaactcttccgggtccagtgaagacagctttgtggagataagaatggcagagggagaggcagaaggctcagtcaaggagattaagcactcccccggtccaacccgcaccgtttcaaccggaaccgcgctgtccaaatatcgtagccggtctgctgatggcgcaaagaactacttcgagcacgaggagctgaccgtgtcacagcttctgttatgtctgagagaggggaaccagaaggtggaaaggttggaagtggcgctgaaggaggccaaagaaagggtgagcgatttcgagaaaaagactagcaatagaagtgaaatcgagacgcagaccgagggcagcacagaaaaagaaaatgatgaggagaagggacccgagactgtggggtcagaagttgaggcattaaatctccaagtcactagcctatttaaagagctccaggaggcccacaccaagctgtctaaagctgaactgatgaaaaagcgcttgcaggagaagtgccaggcacttgagagaaaaaatagtgctatcccctccgagctcaatgaaaagcaggaactggtctacaccaacaaaaagttggagctgcaggtggaaagcatgttgagcgaaattaagatggagcaggcaaagaccgaggatgaaaaatccaagctgacagttcttcagatgacacacaataaattgcttcaggagcacaacaatgcgctcaagaccatcgaggagttgactagaaaggaaagcgaaaaagttgatagagctgtactgaaagagctcagcgaaaaattggagcttgcagagaaggccctggctagtaaacaattgcaaatggacgaaatgaaacagactatcgctaaacaggaggaggatctcgagacaatgacaattctgcgagcgcagatggaggtatactgttcggactttcacgccgaacgggcagctcgagagaagatacacgaagagaaggaacagctcgcccttcaactggctgtcctgttgaaagaaaacgatgcctttgaagacggcggaagacagtcactgatggagatgcagtcacgtcacggggcaaggacttctgatagtgaccagcaggcatatctggtacagcgaggcgcagaggacagagattggaggcagcaaaggaatattccgattcactcatgtccgaagtgcggggaggtgctcccagatatcgataccctgcagatccatgtgatggattgtatcatctag

SEQ ID NO: 233570 - DNA, 1716 bp, Artificial Sequence
  Description of Artificial Sequence: Synthetic coding sequence
atgtcccaccaacctctctcttgcctcactgagaaggaggacagccctagtgagtctacagggaacggccctccccacttggcccatccgaacctcgacaccttcactcccgaggaattgcttcagcagatgaaagaactgctgaccgagaaccatcagcttaaggaagcaatgaagctaaacaaccaggcgatgaagggcagatttgaagagctgtcagcctggactgaaaaacagaaggaggaaagacagttctttgagattcagtctaaggaagcaaaggaaaggctaatggctttaagccacgaaaatgaaaagttgaaggaggagttggggaagctaaagggtaaatccgagaggtcttctgaggatccaacggacgacagcagactcccaagggccgaggctgagcaagagaaggatcaactcaggacacaggtggtgcgtttgcaggccgagaaggctgatctacttggcatcgtatcggagctgcaactaaaactaaatagcagcggcagcagtgaagacagctttgtcgagattcgcatggcggagggtgaagccgaaggttcggttaaggaaattaagcactcacccggaccaacacggaccgtttcgacaggtacgtcgcgcagcgcagacggcgcaaagaattacttcgagcacgaagaacttactgtgagccagctgctgctgtgtttgagagagggcaaccagaaggtggaacgattggaggtagctctgaaggaggctaaagaacgtgtgtcagatttcgaaaagaagacaagtaatagaagcgaaatcgaaacacagaccgagggctccaccgagaaggaaaacgatgaagagaagggccctgagactgttgggagcgaagtggaagctcttaatctccaggtcacaagcctttttaaggagctccaggaagcacatacaaagctaagcaaggcggagctgatgaaaaagcgtctgcaggagaaatgccaagccttggaaagaaaaaacagcgcgatccccagcgagctcaatgagaaacaggaactggtgtacaccaacaagaagctagagctgcaggtggagagcatgctgagtgaaattaaaatggagcaggccaagacagaggacgaaaaaagtaagcttacggtgctacagatgacacacaataagctccttcaggaacacaataacgcattgaagaccatcgaagaactcacgagaaaagaaagcgagaaagttgatagagctgtcctgaaagaactgtcggaaaagctagaactggctgaaaaagccttggcctctaagcagttgcagatggatgaaatgaagcagacaattgcgaagcaggaggaggacctggaaacaatgaccattctaagggcccagatggaagtgtactgttccgacttccatgcagaacgtgcagccagggagaaaattcacgaagagaaagaacagctggcacttcagttggccgtcttactgaaagaaaatgacgcgtttgaagatggcggaaggcaaagcttaatggagatgcagagcaggcatggcgcacgtacctctgactcggaccaacaggcctacctggttcaaaggggtgctgaggatcgggactggagacaacaaaggaacattccaattcattcctgtcccaagtgcggagaggtcctacccgacatagacactttacagatacacgtgatggactgtattatttag

SEQ ID NO: 233571 - DNA, 1734 bp, Artificial Sequence
  Description of Artificial Sequence: Synthetic coding sequence
atgtcccaccagccattgtcatgcctgaccgagaaggaggactccccctcagaatcaactggcaatgggccaccacaccttgctcaccctaaccttgatacttttacaccggaagaactgctgcagcaaatgaaggaactcctgaccgagaaccaccagctgaaggaggctatgaaactgaacaatcaggctatgaagggcagatttgaagaactgtcagcctggacagagaagcaaaaggaagaacgccagttctttgaaatacagagcaaggaggctaaagagagactcatggccctctcccacgagaacgagaagcttaaagaggagttgggcaaacttaaggggaagtccgagcggtccagtgaagatccaacggacgattcccggctaccaagggccgaggccgagcaagaaaaagatcaattacggacccaggtggtccggctgcaagccgagaaggctgatctcttgggaattgtgagcgaactccaacttaagctgaactcaagtggatcttccgaagacagcttcgtggaaatccgcatggccgaaggcgaggcagagggcagcgtcaaggagatcaaacacagtccgggacctacgcgcactgtatccacaggaactgccctgagtaagtatcgctcccgatctgctgacggtgcaaaaaactatttcgagcatgaggagctcactgttagccagctgttactgtgtttgcgggagggcaatcaaaaggtcgagcgtcttgaggtggcactgaaggaagctaaagaaagggtcagcgatttcgaaaagaaaacatctaacaggtccgagattgaaactcagaccgaaggcagcactgagaaggagaatgacgaggagaaaggccctgagactgtgggctcggaggttgaggctctaaacctgcaggttactagtttattcaaagagctccaggaagcacacaccaagttgagcaaggccgagttaatgaaaaaaaggctccaggaaaaatgccaagccctcgagcggaagaattccgctataccaagtgagctgaatgagaaacaggagctggtatataccaataaaaagctcgaactacaggtggaaagcatgttgagtgaaatcaaaatggaacaggctaagactgaagatgagaagtctaaactcacagtgttgcaaatgacccataacaaacttctgcaggagcacaataatgcattgaagacgattgaggagctaacacgtaaagagagtgagaaggttgatcgggctgtcttgaaagaactgagtgaaaaactggaacttgcggaaaaggcactcgcttctaagcagctgcagatggacgagatgaagcaaactattgctaagcaggaggaggacctcgagaccatgacaatcctgagagctcaaatggaagtgtattgttcagattttcatgccgagagagctgctagagaaaagattcacgaggagaaggaacaactggccctgcaattagccgtgttactaaaagagaacgatgcttttgaggatgggggacgtcagtccctcatggaaatgcaatcgcgccatggcgcaagaacgtctgattctgatcaacaggcgtacttagtgcaacgcggagccgaggaccgagactggcgacaacaacggaacatacctatccacagctgccctaagtgcggagaggtactgccagatatcgatacactgcaaatccacgtgatggactgtattatttag

SEQ ID NO: 233572 - DNA, 1716 bp, Artificial Sequence
  Description of Artificial Sequence: Synthetic coding sequence
atgtcccaccaacccctctcgtgcctaaccgagaaggaggattccccctcggaatcaacgggtaacggacctcctcatctagcccatcctaatttagatacttttacaccagaagaactcctgcagcagatgaaagagctgctgactgaaaatcaccagctgaaggaggcaatgaagcttaacaatcaagctatgaaaggaagattcgaggagctttcagcctggacagagaaacagaaagaagagaggcagttttttgagattcagagcaaggaggctaaggaacgcttaatggctctcagccacgaaaatgagaagttaaaggaagagctgggtaaactaaagggaaaaagtgagaggagcagcgaggatcctaccgatgacagcagattgcccagggccgaggcagaacaggaaaaggatcagctccgaacacaggtggtacgtctgcaggccgaaaaggccgatctgctcggcattgtttcagaactgcagctaaagttaaattcttctggatccagtgaggacagttttgtggagattcggatggcggagggggaggccgaaggatctgtgaaagagattaagcatagtccaggcccaacccgcaccgtgtccaccggtacaagccgaagtgccgacggcgctaaaaactacttcgagcatgaagagctaaccgtgtcccaactgttactttgtctgcgagaaggcaatcagaaggtggagcgtctcgaagtggctctaaaggaggccaaggagcgagtcagcgatttcgagaaaaaaaccagcaaccggagcgagatagagacacagactgaaggttccactgagaaggagaacgatgaggagaaaggcccagagacagtgggcagtgaggtcgaagcgttgaacctgcaggttacgtcactgtttaaggagttgcaggaagctcatacaaagctgtccaaagctgagctcatgaaaaagaggttgcaggaaaagtgccaggctctcgagcgaaagaacagcgctatcccatccgaactgaacgaaaaacaagaattggtctacacaaataagaagctcgaactgcaggttgaaagtatgctctccgaaatcaaaatggagcaggccaaaaccgaggacgaaaagtctaagctgaccgtactccagatgacccataataaactgcttcaggaacataacaacgcccttaaaaccattgaggagctgactcgcaaagaatcagaaaaggtagaccgggctgtgttgaaagagctgtcagagaagctcgaactggccgaaaaagctcttgcctccaagcagttgcagatggatgagatgaagcaaacaatcgcaaaacaggaggaagacttggagactatgactatcctgcgggcacagatggaggtctattgcagtgattttcacgcagagagagctgcaagggagaaaatccatgaagagaaagaacagctggcactgcaactagcagtcctgctaaaggagaacgacgcttttgaagacggcggacgtcagagtctcatggaaatgcaatctagacacggggcacgtacatccgattctgatcagcaggcctacctcgtccagagaggcgctgaggacagagattggagacagcagcgaaacattccaatccatagttgcccgaagtgtggcgaggtacttcctgatatcgatacactccagatccacgtgatggactgtatcatctag

SEQ ID NO: 233573 - DNA, 381 bp, Artificial Sequence
  Description of Artificial Sequence: Synthetic coding sequence
tagggggaggcagagggaagcgttaaggagataaaacactcccccggacccaccagaactgtgtctactgggactgccctctctaagtaccgaagccgcagtgccgatggcgctaagaattacttcgaacatgaggaactgaccgtttctcagctgctgctatgtctccgcgaaggcaaccaaaaggtggagcgtttggaggtagcacttaaagaggctaaagaacgggtatccgatttcgaaaagaagacgtcgaacagaagcgagattgaaacccagaccgaggggtctactgagaaggagaatgatgaagaaaagggtcctgaaacgactggattccatcatgtggggcaagatggcctggacttgctaacttcgtag

SEQ ID NO: 233574 - DNA, 444 bp, Artificial Sequence
  Description of Artificial Sequence: Synthetic coding sequence
atgaaattgaacaaccaggcaatgaagggaaggttcgaggagctctcagcttggactgaaaagcaaaaagaggagagacagttctttgagatccaatctaaagaggcgaaggaacgtcttatggcgctcagccatgaaaacgagaagctgaaggaggagttaggaaagctgaaaggtaagtctgagcgaagcagcgaggaccctaccgatgatagcaggctgccaagggcggaagcagaacaggagaaggatcagctcaggacacaggtggtccgcttgcaggccgaaaaagccgatcttctgggtatcgtgtccgagctgcagctaaagctgaactcttcagggtcctccgaggacagtttcgtggaaatcagaatggccgaaggggaagcggagggcagcgtcaaggagattaaacactcacctggccctaccaggacatag

SEQ ID NO: 233575 - DNA, 912 bp, Artificial Sequence
  Description of Artificial Sequence: Synthetic coding sequence
atgcatccagagcctgccccacccccaagccgtagctctccagagctcccaccttccggcggttccaccacctcaggaagtaggagaagccgtagacgttccggagatggagagccaccaggcgcacccccaccaccacctccgcctagcgccgtgacctatccggattggattggccagagctatagcgaagttatgagtctgaatgagcatagcatgcaggcactttcatggcgtaaattgtacttatcaagggccaaactgaaggccagcagtaggacgtccgccctcctgtccgggttcgcaatggtagccatggtggaagtacagctggacgcagatcatgattaccccccagggttgctgatcgctttttctgcctgtaccactgtcctcgtggctgtgcatctatttgctctgatgatttccacctgtatcctcccaaatattgaagccgtgtcgaacgtgcacaatctgaacagtgtcaaagagagtcctcacgaaaggatgcatagacacatcgagctggcctgggcattctccacagtcattggaacccttcttttcctggccgaggtagtcttactctgttgggtgaaatttcttcccctcaaaaagcaacctggacagccacgccctacatcaaagcctcccgcatctggagccgctgcgaacgtgagcacgtcaggtatcaccccaggtcaggcagcagcaatagccagcaccacaatcatggtccccttcggtttgatatttattgtctttgccgtgcacttctatcgtagcttggtcagccacaagacggaccgtcagttccaggagctgaatgaactggccgaattcgcacggctgcaggatcagctggaccacagaggggatcacccactcacacccggttcccattatgcttag

SEQ ID NO: 233576 - DNA, 765 bp, Artificial Sequence
  Description of Artificial Sequence: Synthetic coding sequence
atgagcgcagaactgaacgtgcccatagacccctcggccccagcttgccccgagccgggacacaaggggatggattatagggattgggtgcgccgaagctacttggagctcgtgacaagcaatcaccacagtgttcaagcactgtcctggcggaaactctacctgagtcgtgcgaagctcaaagcctcaagtagaacgagtgcactcctctccggctttgctatggtcgctatggtcgaggttcagcttgaaacccagtatcagtaccctcgtccgttgttgattgccttttccgcatgcacgacagtgctggtggcggtgcacctttttgctctgctgatctcaacatgcatcctgccgaacgtggaagctgttagcaacatacataacctgaactctattagcgagagtccccacgaaaggatgcacccatacatcgagttggcttggggctttagcactgttctgggaatactcctattcctcgcagaagtggttctgctttgctggataaagtttctcccagtggacgcccgtagacagccaggaccccctccaggacccggaagtcacaccggctggcaggcagctttggtatccaccattatcatggtaccagtgggtttgatttttgtcgtgtttaccatccatttttatagatccttagttagacacaagaccgaacgccataacagagagattgaggaactccataagttgaaagtgcagttagatggacatgagcgctcgctgcaggtcctttag

SEQ ID NO: 233577 - DNA, 765 bp, Artificial Sequence
  Description of Artificial Sequence: Synthetic coding sequence
atgtccgcggaactcaacgttccaattgacccgagtgcaccggcatgtccggaacctggacacaaagggatggactaccgtgattgggttaggagatcatatcttgaattggtcacaagcaatcatcattctgtccaggctctgagttggcggaaactgtacctatcccgggctaaactgaaggcatcctctcggacttccgccctgctctcaggattcgcaatggtagccatggtcgaagtccagctcgaaacccaatatcagtatccccgtcccctgctcattgccttttcagcgtgcactacagttctggtggccgtgcatctctttgcactgctaatctccacgtgtatcctgcctaatgtggaggccgtgtctaacatacacaacctgaactccataagcgagagcccccacgaacggatgcacccatacatcgaactcgcttgggggttctctacggtgctggggattctccttttccttgccgaagtggtgttgctctgctggatcaaatttcttccagtggatgccagaagacagcccggtccccctcctggtccaggatctcatactggctggcaggcagccctggtttctactattattatggttcccgttggcctgatctttgtcgtgttcaccattcacttctatcggagtttagttagacacaagactgaacgacacaaccgcgagatcgaggaactccacaagctcaaggtgcaattggacggccatgaacgatcactccaggtgctgtag

SEQ ID NO: 233578 - DNA, 639 bp, Artificial Sequence
  Description of Artificial Sequence: Synthetic coding sequence
atgtccgcggagctgaatgtacccatcgacccgtccgcacccgcatgtcccgaaccaggccataaaggaatggactaccgcgattgggtccgaagatcttatctcgagcttgtcaccagcaaccaccactctgttcaggctttaagttggcgaaagctgtacctctctcgagctaaacttaaagccagttccagaacgagcgctcttctgagtggtttcgccatggtggccatggtagaggtccagctggagacgcagtaccagtatccccgacccctgctgatcgccttttcggcctgcactacagtgctagtagccgttcacctgttcgccctgctgatctctacgtgcatcctccctaacgttgaggccgtatcaaacattcataatctgaatagcataagcgaaagcccccacgagcggatgcacccttatatcgagttagcctggggcttctcgaccgttttggggattctcttgttcctggccgaggtcgtactgctctgttggatcaaattcctgcccgtagacgctcgaagacagcctggccctccccctgggcctggctcccacactgggtggcaggcggctctggtctctacgatcatcatggtgccagtgggccttatcttcgtttag

SEQ ID NO: 233579 - DNA, 765 bp, Artificial Sequence
  Description of Artificial Sequence: Synthetic coding sequence
atgtcagcagaactcaacgttcccattgatccctcagcacccgcatgccccgagcccggacacaaggggatggactacagagactgggtgcgcaggagctacctggaattggtgacatcaaaccatcacagtgtgcaagctctgagctggagaaagctctatcttagcagggctaaattgaaggccagctcccgcacctctgccctgctatctgggtttgctatggtcgccatggtcgaggtgcaactggaaactcagtaccaatatcccagaccactcctgatcgctttctctgcgtgcaccacggttttggttgcggtgcatctgtttgcactgttgatctcaacctgcatcctgccgaacgtggaggctgtaagcaatatacataatctgaacagcatctcagagtcaccacatgaacggatgcacccatatattgagttggcctggggtttctctaccgtcctcgggatactactgtttttggcagaggtggtcctcctgtgttggatcaaattccttcccgtcgacgcgaggcgacagccgggacctcctcctgggcctggctcccacactggttggcaagcggcattagtatccaccataataatggtgcccgttggactgattttcgttgttttcactatccacttctatcggtctctcgtccggcataagacagagcggcacaatcgggagattgaggaactgcacaagttgaaggtacaattagacgggcatgagcgcagtcttcaagtgctgtag

SEQ ID NO: 233580 - DNA, 765 bp, Artificial Sequence
  Description of Artificial Sequence: Synthetic coding sequence
atgtccgcggagctaaatgtccccattgaccccagcgctccggcatgtcctgagcctggacacaagggcatggattacagggactgggtgagaaggagctatctggaattggtgacctccaatcaccacagcgtacaggccctctcatggaggaaactatatctgtccagagccaagttaaaggcttcctcacggaccagtgcactgctgtcaggattcgcaatggtggccatggtggaagtccaactagaaactcaataccaataccccaggccattactaattgccttctcagcatgtacaactgtgctagtggccgtgcacctgtttgccctgctcatatctacttgtatactgcctaacgtagaggcagtgtctaacatccataacctcaattctataagcgaatcgcctcacgagaggatgcacccttacattgagctggcttggggcttttccacagtcctgggaatcctgctgtttttggcagaggtggtactgctctgctggatcaagttcctacctgtggatgctagacggcagcctggccctccacccggtccaggttcccacacaggttggcaggcagcactggtctctacgatcataatggtgcccgtcggactgatctttgtcgtctttactatacacttctacagatcattagtgaggcataagactgagagacacaatcgcgaaatcgaggagttgcacaagctcaaggtccagctcgacggacatgaaaggagtctacaggtcctgtag

SEQ ID NO: 233581 - DNA, 93 bp, Artificial Sequence
  Description of Artificial Sequence: Synthetic coding sequence
atgtccgcagagcttaacgtgccaattgatcctagtgccccagcctgcccagaacccggacacaaaggcatggattatcgggactgggtgtag

SEQ ID NO: 233582 - DNA, 690 bp, Artificial Sequence
  Description of Artificial Sequence: Synthetic coding sequence
atgtcagccgaacttaacgtgcccatcgacccctctgccccagcctgtcctgagcccggtcacaaagggatggattatcgagactgggtccgtcgctcctatctcgaactggtcaccagtaatcatcatagtgtacaggccctgagttggagaaaactgtacttgtctagggcaaagcttaaagcttcctcacggacctcagcgctcctaagcgggtttgctatggtggcaatggtggaagtccaactcgagacccagtaccaatacccacgccctttgctcatcgcctttagtgcttgtacaactgtgttagtggcagttcacttgtttgctctcctaatcagtacttgtattctgccaaacgtcgaggccgtctctaatattcataacctgaacagtatcagcgaatcaccccatgagaggatgcatccatatattgaactggcttggggtttttctacagttctcggaatattgctattcttggccgaggtcgtcctgttatgctggattaaatttctgccagtggatgccaggcggcaacctggcccaccgcctggtccaggtagccatactggatggcaggccgctttagtctccacaattatcatggtgccagtgggtctcatttttgtagtcttcaccatccacttttacagatcactggtacgccataaaactgaaaggtag

SEQ ID NO: 233583 - DNA, 294 bp, Artificial Sequence
  Description of Artificial Sequence: Synthetic coding sequence
atgagtgccgaactcaatgtgcctattgaccctagcgcaccagcctgccccgagcccggtcacaagggtatggactaccgcgactgggtacgtaggtcttatctggaactggtgacgagcaatcaccacagtgtccaggccctaagttggcgaaaactgtacttgtcccgtgccaagctcaaagcctcgtccagaacatcagctcttttgagcgggttcgctatggtcgcaatggtagaagttcagctggagacgcagtaccagtatccccgtcctttgctgatcgccttctag

SEQ ID NO: 233584 - DNA, 888 bp, Artificial Sequence
  Description of Artificial Sequence: Synthetic coding sequence
atgaaaggcggagaaggggatgctggggaacaagctccattgaaccccgaaggcgaatcaccagcaggttccgctacttaccgggagttcgtgcataggggatacttggatcttatgggcgcatctcaacatagtctgagggcactctcttggcgaagactctacctgagcagagcgaagctgaaggcttcatctagaacttccgccctgttgagcggctttgccatggtcgccatggtcgaggttcagctcgaatccgatcatgagtatccgcctggccttctcgtggcattctccgcctgcactacagtgctcgtagccgtacacttgtttgcactaatggtaagtacatgcctgctgcctcatattgaagcggtgtcaaatatacataacctgaattccgttcaccagtcacctcatcagcgcctgcaccgatacgtcgaactagcttggggtttctcaactgccttagggacttttctgttcttggcagaggtagtcctagtcggatgggtgaaatttgtgcccatcggggcaccgctagacaccccgacccctatggtgcccaccagccgcgtgcctggcaccctggccccagtggctacatccctctcccctgcgagcaatttgcctaggtcgtcggcctccgcagccccatcacaggcagaaccggcttgcccccctaggcaggcgtgcggtgggggaggagcccacggtcccggttggcaggctgccatggcctccaccgccattatggtcccggtcgggctggtcttcgtggcttttgccctgcacttttataggagtttggtggcgcacaagactgacaggtacaagcaggaactggaggagctgaatcgcctgcaaggtgaactgcaggcggtttag

SEQ ID NO: 233585 - DNA, 822 bp, Artificial Sequence
  Description of Artificial Sequence: Synthetic coding sequence
atgaaaggtggcgagggtgatgcgggagagcaggcccctttgaatcccgagggagaatcgcccgcaggttccgcgacctaccgcgagttcgtgcaccgcggatatttagacttgatgggagcaagtcagcactcactgcgtgccttgagttggcgtagattgtacctgagccgggcaaaactcaaggccagtagtcggactagcgcactcctgtccggcttcgcaatggtggctatggtcgaggtgcagctcgaaagcgaccatgagtatcctcctggtttactggtggcgttctccgcttgcacaacagttcttgttgccgtgcacctgttcgccctgatggtcagtacttgtctgcttccacatatcgaggccgtgagcaacatacacaacttaaattctgtccaccagtcaccgcatcagagactccaccgctatgttgagctggcctggggcttctcaactgcactcgggacattcctgtttctggccgaagtggtcttggttggttgggtaaaattcgttcccatcggcgcaccacttgatacccccacacctatggttcctacttcaagggtgcccggaactctggccccagtggccacctctctgagtccggcttccaatctcccaaggtcgtcggcgtccgctgctccttcgcaggcagaacccgcatgcccccctaggcaggcttgtggcggagggggtgcacatggacccggttggcaggctgccatggccagcacatttccaggaattttccccattagccttagtctgggcttctgcaaattattgtgcacctgggcaggcttgtcgtag

SEQ ID NO: 233586 - DNA, 414 bp, Artificial Sequence
  Description of Artificial Sequence: Synthetic coding sequence
atggccggatcacaagatatattcgacgcaattgtgatggccgacgaaagatttcacggtgagggctatagagaggggtatgaggaaggaagttcccttggcgtaatggagggcaggcagcacggaaccctgcacggagcgaagatcggaagcgagatagggtgttatcagggatttgcgttcgcctggaagtgtctcctgcatagctgtacaacggagaaggactcccgcaaaatgaaagtcctggaaagtctgatcggcatgatccagaaattcccttatgatgaccccacatacgataaactccatgaagatttagacaagataaggggcaagtttaagcagttttgctcactactgaatgttcagcccgatttcaaaatctctgctgaaggatctgggctgagcttttag

SEQ ID NO: 233587 - DNA, 666 bp, Artificial Sequence
  Description of Artificial Sequence: Synthetic coding sequence
atggccggtagccaggatatattcgacgccattgttatggccgacgagaggtttcacggcgagggttatcgcgagggatacgaagagggcagctcgctaggcgtgatggagggtcgccagcacgggacactccatggtgccaaaatcggaagcgagatcgggtgttaccagggcttcgcgttcgcttggaagtgtctgctgcattcttgcacaactgaaaaagactctaggaagatgaaggtccttgagtcactcattgggatgatccagaagttcccctacgatgaccctacttatgacaagctccacgaggacctggacaaaataagaggcaagtttaagcagaccggcctgtcccctagtgcagtgatggtcagacctccaagctacgtggaactcccggtgacctgctggtgctgggaggccccaagatgcaatcagaaatgtacagatcctgcagctcgccgacccgatccacaaacgtgcgccagccaggacagactccgttgcgctccctgcacctgtcatcaaccacttgccagtcggtatacccagcacccgggactcgtgccccttccgcatcacgatagacaatccgtcccccaggggccacgagtcgtccagacagacgcggcagcacgcatggtcgaacaacagacgatgtag

SEQ ID NO: 233588 - DNA, 414 bp, Artificial Sequence
  Description of Artificial Sequence: Synthetic coding sequence
atggcgggatcacaggacatctttgatgccatagtgatggcagacgagcgttttcacggggagggttacagagaaggctacgaagagggctcgagcctcggcgtgatggaagggagacagcacgggacacttcacggagcaaagatcgggtcggaaattggctgttatcagggctttgcctttgcctggaaatgcttactccattcttgcactaccgaaaaggatagccggaagatgaaggttctggagtctcttattggaatgatccaaaaatttccttatgatgaccctacctatgataagctccatgaggatttagataagattcggggaaagtttaaacagttttgttcactcttgaacgtgcagccagattttaaaatctcggcggaagggagtggtctgagcttctag

SEQ ID NO: 233589 - DNA, 237 bp, Artificial Sequence
  Description of Artificial Sequence: Synthetic coding sequence
atggctggctcccaggatatcttcgatgctatagtcatggcagatgagagtcggaaaatgaaagtgctagaatccctcattgggatgatccagaaatttccatatgatgatcctacttatgacaagctccacgaggatctcgataaaatccggggaaagttcaagcagttttgtagccttctgaatgtccagcctgactttaaaatctccgccgaaggatctggcctcagcttctag

SEQ ID NO: 233590 - DNA, 3039 bp, Artificial Sequence
  Description of Artificial Sequence: Synthetic coding sequence
atgatggcacagtctaatatgttcactgtcgccgatgtcttgagccaagatgagctcagaaagaagctctaccagaccttcaaggaccgcggaatcctggacaccttgaagactcaacttcgcaatcaactgatccacgagctgatgcaccctgtattgtctggtgaactgcagccgaggagcatttcggtggagggatctagtctgctgatcggagcttctaattctttggttgccgatcacctccaacggtgtggctatgagtacagcttaagcgtgtttttcccggagagtggtctggcgaaggaaaaagtgtttactatgcaggatctgctgcaattgattaaaataaatcccacttcatctctgtacaagagcttagtgagcggttcggataaggagaaccagaaggggttcctgatgcactttctgaaagagttagcagagtatcatcaggccaaggaaagttgtaatatggagactcagacttcgagcacgtttaatcgcgactcactggctgagaagttgcagctgatagatgaccagtttgcggacgcctatcctcagagaattaagttcgaaagcctcgagatcaagctcaatgaatataaaagggagatcgaggaacagttacgcgcagaaatgtgtcaaaaactgaagtttttcaaggacaccgaaattgcaaaaatcaagatggaagccaagaagaaatacgaaaaggaattaacgatgtttcaaaacgatttcgaaaaagcttgccaagcaaaatctgaagctctggttctgcgggagaagtccacgctggagagaatacacaaacaccaggaaattgaaactaaagagatctatgcccagcggcagctcctgttaaaagatatggacctgcttaggggaagagaggcagaactgaagcagagagtggaggcttttgaactaaatcagaaactccaggaagagaaacacaagtcaattactgaagctctccggagacaggaacagaatataaaatcctttgaagagacctacgaccggaagctgaagaacgagttgttgaaatatcagctcgagctgaaagatgattacattatccgaaccaatcgcttgatagaggacgagcgaaaaaacaaggaaaaagctgtgcaccttcaagaagaacttattgccatcaattccaagaaggaagagctcaatcagtcagtcaatagagtcaaagaacttgagctggaattggagagtgtgaaggcccagagtttggccatcactaagcaaaaccatatgttaaatgagaaggtgaaggagatgtcagattattcattgcttaaagaagagaagctcgagctcctagctcagaataagctcctcaagcagcagctcgaggagtctaggaatgagaatcttcgcctgctgaataggcttgcccagcctgccccagagctagccgtgttccagaaagaacttcggaaggccgagaaagctatagtggttgaacacgaagaattcgagtcatgcagacaggctcttcacaaacaactccaagacgaaattgaacattctgcccagctaaaagcccagatccttggttacaaagctagcgtcaaatcacttacgactcaggtggcagacttgaaactgcagttaaagcagacccagaccgccctggagaacgaagtgtactgtaacccgaaacagagcgtaattgatagatcagttaacggcttgattaacggcaacgtggttccttgcaacggcgagatttccggagattttctcaacaaccccttcaagcaggagaacgtgctcgcccgtatggtggcctccaggattacaaactacccaaccgcctgggtggagggatcttcacctgactccgacttggaattcgtggcaaataccaaggcaagagtaaaagaactgcagcaggaagctgagaggctagaaaaagccttccgatcttaccacagacgagtgattaaaaactccgcgaagagccctttggccgcaaagtccccaccatccctccacctcctcgaggcctttaaaaatataacctcttctagcccagaacggcacatctttggcgaagacagggtggtgagcgaacagccgcaagtcggcaccttggaagaaaggaatgatgtcgtcgaagctttgacaggatccgccgcatccaggctgagaggaggtacaagctcccggagattgagttcaactcccttacccaaagctaaacgatctctggaatccgagatgtacctggaggggttaggcaggagtcatattgcctccccatccccttgcccagatcgtatgcccctgccgtctcccaccgagtctcgtcactccctgtccatcccgccagtttcgagtccccctgagcaaaaggttgggctgtaccgtcgacaaaccgaattacaggacaagagcgagttctctgacgttgacaagttggccttcaaagacaatgaggagtttgaaagcagtttcgagtccgcgggtaatatgccccgacaactcgagatgggaggtttatcacctgccggtgacatgtcccatgtagacgcagcagccgcagccgtgcctcttagctaccagcacccaagcgtcgaccaaaaacagattgaggagcagaaggaggaggagaagatccgagagcaacaggtgaaggagcggcgacaacgcgaagaaagacggcagagcaatcttcaggaagtgctggaacgtgaacggagagaacttgaaaaactgtatcaggagcgtaagatgattgaagagagtctgaaaattaaaattaagaaagagttggagatggaaaatgagctggagatgagtaatcaagaaattaaagacaagtccgcccatagtgaaaaccccttggagaagtatatgaaaatcattcagcaagaacaggaccaggaatcagccgataaatctagcaagaaaatggtccaggaaggtagtttggtggatacactacagagttccgataaggtagaatctctcactggattctcccatgaggaactggacgactcctggtag

SEQ ID NO: 233591 - DNA, 2919 bp, Artificial Sequence
  Description of Artificial Sequence: Synthetic coding sequence
atgatggcacagtcgaatatgttcacagttgccgatgtcctgtcgcaagatgagctgcggaaaaaactttaccaaacgtttaaggatcgagggattctggatactttaaaaacccaactgcgtaatcagctgattcacgaactcatgcatcctgtgctctccggagagctgcaacctagaagcatttcggtggaaggatcatcgctgctcattggagcttccaatagtcttgttgctgaccatcttcagaggtgcgggtacgaatactccctgagtgtgttttttcccgaatctggattggccaaggaaaaggtgtttacaatgcaggatctcctccagttgattaaaattaaccctacgagttctttgtacaagtctctcgtgagtgggtcagataaggaaaaccagaagggattccttatgcatttcctgaaggagctggctgagtaccaccaggcaaaggaatcatgcaatatggagacccagacatcttctacatttaatagagatagcctcgccgagaagttgcaactgatagatgatcaatttgccgacgcctacccccagcggataaagtttgagagcctcgaaataaaactgaacgagtataagagggagatagaggaacaactgagagctgaaatgtgtcagaagctcaagttcttcaaggatacagaaattgccaagatcaagatggaggcgaagaagaagtacgagaaggaacttaccatgttccaaaacgactttgagaaagcatgtcaggcaaaaagtgaggccctcgtgctgcgggagaagtcgacgttagaaagaattcacaagcaccaggaaattgaaaccaaagaaatctatgcccaacgtcagcttcttttgaaggatatggatctgctaagaggtcgggaagcggagttgaaacagagggttgaagcttttgagctgtaccagctcgaacttaaggacgattacataatccgaacaaatagactgatcgaggatgagcgcaaaaacaaggaaaaagccgtccacctccaggaagagctgatcgccattaacagcaaaaaagaagagctcaaccagagcgtcaatagggtgaaagagctggaactcgaactcgagtccgttaaggctcaatccctggcaatcaccaagcagaaccacatgcttaacgagaaggtcaaagaaatgtcagattactcactgcttaaggaagagaagttggaactgctcgcgcagaataagctgctcaagcagcagctcgaggagtccaggaacgagaatctgcgactactgaatcgccttgctcagccagcccctgagcttgctgtgttccaaaaagaactgaggaaagctgagaaggctatcgtggtggaacatgaggaatttgagagctgccggcaagccctacacaaacagctacaggacgaaattgagcatagcgcccagcttaaggctcagatcttggggtacaaggccagcgtgaaatcactcaccacccaggtggccgatctcaagctgcagttgaaacaaacccaaacggccctcgaaaacgaagtttattgcaacccgaagcagtctgtcattgatcggagtgttaacggactgatcaatggcaatgtcgttccctgcaacggcgaaatctccggcgatttcctaaataatccttttaaacaagaaaacgtcctcgcacggatggtcgcttctcgcattacaaattatcccactgcttgggttgaaggatcctcccctgactccgatctggagtttgtggcaaataccaaggcgagagtgaaggaactacagcaggaagctgagagactggagaaagcctttcgttcataccaccgcagagtcattaagaacagtgccaagagtccccttgcggctaagagtccgccatcactgcacctgctcgaggcctttaaaaacattacatcatcttctccagagcgacatattttcggcgaggaccgggtggtatctgagcaaccacaggtgggcaccctggaggaacggaatgacgttgtggaagcactcaccggctccgcagctagccgcctgcgaggcggtacatcctcaagacggctgtcttccacccctctacccaaagcaaaacggagcctggagtcggagatgtacctcgagggcctgggcagatcccacattgctagcccaagcccctgcccggatcgcatgcccttaccttcacccacagagtctcggcacagcctgtccatccctccggtgagttctcctcccgaacagaaagtcgggctctaccgaaggcagactgagttacaggataaatcagagttttcagacgtcgataaactggcatttaaagataacgaggaatttgagagttcttttgagagcgccggaaatatgccgaggcagcttgagatgggtgggttatcacctgcaggggacatgagccacgttgatgcagcagccgcagccgtcccgctatcatatcagcacccatcagtagatcagaaacaaatagaggagcagaaagaggaggagaaaatcagggagcagcaagttaaggagaggcgtcagcgagaggagagaaggcagtccaaccttcaggaggtcctggaaagagaaagaagagagttggaaaagctctatcaggagagaaaaatgatcgaggagtcgctgaagatcaagattaagaaagagctcgaaatggagaatgaactggagatgagcaaccaggagattaaggataaaagcgctcactctgaaaacccactcgagaaatacatgaagataatacagcaggagcaggaccaggaatccgctgacaaaagtagtaagaagatggtgcaggaaggatctctggttgatactctgcaaagcagcgataaagttgagtcgttgactggcttcagccacgaagaactagatgactcttggtag

SEQ ID NO: 233592 - DNA, 2619 bp, Artificial Sequence
  Description of Artificial Sequence: Synthetic coding sequence
atgcattttctgaaggaactcgcagagtaccaccaggcaaaagagagttgcaacatggagacgcaaacctccagcaccttcaaccgggactcattagcagagaaattgcaactcatagatgaccagtttgcagatgcctaccctcagcgcattaaatttgagtctttggagattaagctgaacgaatataagagagaaatcgaggaacaactgcgtgccgagatgtgccaaaagctgaagttcttcaaggataccgaaatagccaagattaagatggaggctaagaaaaaatatgagaaggaattgaccatgtttcagaacgatttcgaaaaagcttgccaggctaaatcagaagccctcgtgctccgtgagaagtctactctcgagcgcattcataagcaccaagagatcgagactaaagagatctatgctcagagacagctactactaaaagatatggatctcctccggggacgagaagctgaactcaagcagcgcgtcgaggcctttgaacttaaccagaagctgcaggaggaaaagcataagtctattacggaagcactccgcaggcaagagcagaacattaagtcgttcgaggagacatacgatagaaagctgaagaacgagctgctgaaatatcaactggagttgaaagatgattatatcattagaacaaatcgtctcatcgaggatgagcgtaagaataaggaaaaggcagtgcatcttcaggaggagctaatcgcaattaatagtaagaaggaagaactgaaccagtctgtgaacagggtgaaagaattagaactggaactggagtctgtgaaagcccagagcttggctattacaaagcagaatcacatgcttaacgaaaaggtcaaggagatgtctgattattcactccttaaagaggagaaactggagctgctcgcccagaataagttattaaagcagcaacttgaagagagcagaaatgagaatctcaggctgttgaatagactagcccagccggcacctgagctggctgtgttccagaaggagctacgcaaagcggagaaagcgattgtggtcgagcacgaggagtttgagtcatgtagacaggcactccataaacagctccaagacgaaattgaacacagcgcacagttgaaagcgcaaatcctgggatacaaggcaagtgttaaaagcctcaccacacaagtggcagatctcaaactccaacttaaacagacgcagacagccctggaaaatgaggtgtactgtaatcccaagcaaagtgtgattgacaggtcagtgaacggattgatcaacggaaatgtagtgccctgcaacggcgagatctcgggtgatttcctgaataacccttttaaacaagagaacgtcctggcacggatggtggccagcagaatcaccaactaccccaccgcctgggtggagggcagtagtccagattcggatcttgagttcgtcgcgaacactaaggcacgggtgaaggaactgcagcaagaagcagagagactggaaaaggctttcaggagctaccatagaagggtgataaaaaatagcgcaaaaagtcctttggcggcaaagagcccgccttccctgcacctgctggaagcctttaagaatatcacttcatccagccccgaacgccacatttttggtgaagatcgggtggtgtccgaacaaccacaggtgggaactttagaagaacgaaacgatgtcgtggaagccttgacaggctccgccgcttcccggctcaggggtggaaccagttcccgacgattgtctagcaccccccttcctaaggccaaacggtcgttagaatctgaaatgtacctggagggcctcggaaggtctcacatcgcatcaccgtccccttgtccggataggatgccccttccttcccccacagagtcaagacactctttgtcgattccgcctgtctcatccccacctgagcagaaagtggggctgtaccggagacagactgaactgcaagacaagagcgaatttagcgacgtggataagctggccttcaaagataatgaggagtttgagtcgagtttcgaatcagctgggaacatgccgaggcagctggaaatgggaggcctgtcccctgccggtgacatgtctcacgtggacgcagctgccgctgcagtgcctttgtcttaccagcatccctccgtggatcagaaacagatcgaagaacaaaaggaggaggaaaaaatccgggaacagcaagtcaaggagaggcgacagcgggaggaacgtaggcagagcaacctgcaggaggttctggagcgggagagaagggagcttgaaaagttgtatcaggaacgtaagatgattgaagagtccttgaaaataaaaatcaagaaagaacttgagatggagaatgagctggagatgagtaaccaagagataaaggacaaatccgcacactccgagaatccgctggagaaatacatgaagattatccagcaggagcaagaccaggagagcgcagacaaaagtagtaagaaaatggtgcaagaagggtcactggtggacaccttgcagtcttctgataaagtcgaatctttgacagggtttagccatgaggagctggatgactcttggtag

SEQ ID NO: 233593 - DNA, 1104 bp, Artificial Sequence
  Description of Artificial Sequence: Synthetic coding sequence
atgatggctcagagtaacatgtttaccgtggccgatgtgctgtcccaggatgaactccggaagaaattataccagacttttaaagatcgaggcatcttagacaccttgaaaactcaactacgcaatcagctgatccatgaactgatgcatcccgtgctttctggcgaactgcagcctaggagtatttctgtggagggatcctcactgcttataggtgcaagcaattccctggttgccgatcacttgcagcgatgcgggtacgaatactcactgtccgttttttttcctgaatcaggccttgccaaggaaaaagtgtttacaatgcaggatctattacagttgatcaagatcaaccctacatcttccctctataaaagcctcgtttcgggcagtgataaagaaaatcagaaaggtttcctcatgcactttctcaaagaattagcggagtatcatcaggcaaaggaaagctgcaacatggaaacacagacaagctcaacgttcaatcgcgatagcctggccgaaaagctgcagcttatcgatgaccaattcgcagacgcctaccctcagcgaatcaagtttgagtccctagaaatcaagttgaatgaatacaagcgcgagattgaagaacagctccgggctgaaatgtgtcagaaactgaaattcttcaaggacaccgaaatcgctaaaatcaagatggaagcaaaaaagaagtacgagaaggaactcacaatgtttcagaatgattttgaaaaggcctgccaggctaaatcagaggccttggtgctcagggagaagtctacactggagagaatacacaagcatcaagagattgaaactaaggagatctacgctcagagacagctgctacttaaggacatggatctcctgagaggtcgcgaggctgaattaaaacagcgtgtagaggcatttgaattgaaccaaaaactgcaggaggagaaacataaaagcataaccgaagcactgagacgccaagagcagaacattaaatcctttgaggaaacctacgatagaaaactgaaaaatgagctgttaaacttccataggctccacggtgtctgcttggctctggggatattaatctag

SEQ ID NO: 233594 - DNA, 1017 bp, Artificial Sequence
  Description of Artificial Sequence: Synthetic coding sequence
atggtgttcctctgcattttcaaagagctcgctgaataccaccaggccaaggagagctgtaatatggaaacccagacttcatcaacattcaaccgcgattctttggcagagaaactacaactgatcgacgaccaatttgctgacgcatacccacaaagaatcaaatttgagtcactcgagattaagctgaacgagtacaagcgtgagatcgaggagcagctgagagccgagatgtgccagaagctgaaattttttaaggatacagagattgccaaaattaagatggaagccaagaagaagtatgagaaagaactgacgatgtttcagaatgatttcgagaaggcctgccaggccaagagtgaagccctggtgttgcgagagaagtccaccctggagcgcatccataaacatcaggagatcgagacaaaagagatatacgctcagcgccagctgctgttgaaggacatggacctgcttcggggaagggaagccgagctcaagcaacgagtggaagcattcgagctctaccagctcgagttgaaggatgattatatcatcaggaccaatcggctaatcgaagacgagcgcaagaataaggagaaggcagtgcatcttcaagaggagttgatagccattaatagtaagaaggaggagttgaaccagtccgtgaaccgagttaaggagctggaactggaattagaatccgtgaaggcccagtccctggcgattacaaagcagaatcatatgctcaacgagaaagtgaaagaaatgagcgattatagtttactcaaggaggaaaagctggaactattagcacagaacaagctgcttaaacagcaattagaggaatctagaaacgaaaatctgcgactgttgaataggctcgcccagccggcacccgagctggccgtgtttcagaaggagcttcgcaaagctgagaaagccatcgttgtagagcacgaagagtttgaatcatgtcggcaagctctgcataaacagctgcaggatgagccctag

SEQ ID NO: 233595 - DNA, 2586 bp, Artificial Sequence
  Description of Artificial Sequence: Synthetic coding sequence
atggcccattacccgactcgcctgaaaacacgcaagacctacagttgggtcggtaggcctctcctagatcgaaagctccattaccagacctaccgcgagatgtgtgtaaagactgagggatgctcaacagagattcatattcaaattggacagtttgtgctgattgagggggacgacgatgagaatccatacgtggccaagttgttggaactgttcgaagacgattctgatcccccaccaaagaaaagagccagggtccagtggtttgtcagattttgcgaagtcccagcttgtaaaagacatctgctcgggcgtaaaccaggcgcacaggagattttttggtacgattaccctgcatgcgacagcaacataaatgccgaaaccatcatcgggctcgtgcgcgttatccccctggccccaaaggacgttgtgccaactaatcttaaaaatgagaaaacgctgttcgtgaaactctcatggaacgagaagaagtttcgtccattgtcctccgagctgttcgccgaactcaacaaaccccaggagagcgcagccaagtgccagaaacccgttcgcgctaagtcaaagagcgctgagtcacccagctggaccccagctgagcatgtggccaaacgaatcgagagccggcatagcgcttcaaaaagtcgtcagactcctacacacccccttacacctcgggctcgaaagaggctggaactggggaacttggggaatccacaaatgagccaacagacctcctgtgcaagtctggatagtcccggaagaatcaaacggaaagtcgcattctcagagattaccagtccgagcaagaggagtcagcccgacaagttacaaaccctcagcccagccctgaaagctcccgagaagacgagggaaactggcctaagttatacagaagacgacaagaaggcaagccccgagcaccgaataattctgcggacacgcatcgcggcaagtaagacaattgatatcagggaagagagaaccctgacccctatctctgggggtcaaagatcctcggttgtgccgtctgtgatactcaaacccgaaaatatcaaaaagcgggatgcaaaggaggcaaaggcccaaaatgaagcgacctctacaccccatagaattcggaggaaaagctctgtcctgacaatgaatagaattaggcagcaactgcggttcctgggcaactccaaatctgaccaggaggagaaggagatactgcccgcagccgagattagcgattcaagtagcgacgaggaagaggcatctactccgcctttaccgagaagggcccctagaaccgtgagcagaaacctaagatcctccctgaaatcgagcttgcatactcttaccaaagtccctaaaaaaagcctaaagccaagaaccccccgttgtgccgcacctcagattagaagcaggagccttgcagcacaggagccagcttcagtgctggaagaggctaggctgcggctgcacgttagtgcggtcccagagtctctgccctgcagagagcaggagttccaggacatttacaacttcgtggaaagtaagcttcttgaccacacaggcggatgcatgtatatctcaggtgtgcctggcaccggcaaaacagctaccgtccacgaggtcattcggtgccttcagcaggctgcacaggcgaatgatgtgcctccattccagtacattgaggtaaatggcatgaaattaacggagccccaccaggtttacgtacaaattctccagaagctgaccgggcagaaggccaccgctaatcacgccgctgagctgctggctaagcaattctgcacgcgcggttcaccccaagagacgactgtcctgctggtcgatgagttggatctgttatggacccacaagcaggatatcatgtacaacctgttcgactggccaactcataaggaagcacgcttagtagtcctggccattgctaatactatggacctccctgaaaggattatgatgaacagagtctcttctaggctggggctaactcggatgtgcttccaaccttatacatatagccagctgcaacagatattgagaagtaggctgaagcacctgaaagcgtttgaagatgatgccatacaactggttgcgcgtaaagtggccgcactctctggcgacgcgaggcgctgcctggatatttgccggagagccacagaaatctgtgagtttagccagcagaagcctgattctccaggactggtgaccatcgcccactctatggaagccgtcgatgagatgttcagctctagctatatcactgcaattaagaattcaagcgttttagagcagtcatttctgcgagctatcctagcagagttcaggcgatctggcctcgaggaggcaaccttccagcaaatttactcgcaacatgtcgctttgtgtcgtatggaagggctgccataccccactatgtcagagactatggccgtttgtagtcacttgggcagttgtcgcctcctccttgtcgaaccatcaaggaacgacttgctattgcgggtccgtcttaacgtttcacaagacgacgtgctgtatgcactgaaggatgaatag

SEQ ID NO: 233596 - DNA, 2586 bp, Artificial Sequence
  Description of Artificial Sequence: Synthetic coding sequence
atggctcattacccaacccggttgaagactcgcaaaacttacagctgggtcggtagacctctccttgaccgcaaactgcactaccagacgtaccgcgaaatgtgcgttaagacagagggatgttctacagagatacatatacagatcgggcagttcgtgcttattgagggagatgacgacgaaaacccatacgtggccaagctgcttgagctgtttgaggacgattctgacccgccaccaaagaaaagagccagggtccagtggtttgttagattttgtgaggtaccagcttgtaagagacatctgctgggaagaaaacccggagcacaggaaatcttttggtatgattaccccgcttgcgattctaacattaacgccgaaactatcattggtcttgtgcgggtcatccctctcgcacctaaggacgtggtccctaccaatctgaagaatgagaagaccctgtttgtcaaactgtcgtggaacgagaaaaaattcaggcccctgtccagcgagctgttcgccgagctgaataaacctcaggaaagcgctgctaaatgtcagaaacctgtgcgtgccaagtccaagtcagccgaatccccgtcatggacgcccgcagagcacgtggcaaaacggattgagtcgagacactcagccagtaaaagccgccagaccccaactcacccgttgacaccacgggctagaaaacgattggaactgggcaacttaggaaacccacagatgtcccaacagacctcgtgcgcatcactcgattctcctggacggattaagcgcaaagtcgcattttcagaaatcacaagtccttctaagaggtcgcagcccgataagttgcagaccttatctcctgcacttaaggctcctgagaagactagggagacaggtcttagctacacagaggacgacaagaaagctagccccgaacacaggataattctgcgcaccaggatagcagctagcaaaactattgacatcagagaagagcgaacgctgacccctatttccggcggacagcgttcctccgtggtccctagtgtcattctgaaaccagaaaacatcaagaagcgagacgccaaagaggctaaagcgcaaaacgaggctacatccaccccacaccggatacggaggaagtctagcgtgctgacgatgaatagaatcagacagcagctgaggtttctggggaacagtaagtctgaccaggaggagaaagagatcctgccagcagctgaaatttccgactcgtcctcagacgaggaagaggcgtccacgcccccactacccaggagggctccacggaccgtgtccaggaacttgagatcatctctgaagagctctctgcacactctaactaaagtgcccaagaagtcccttaagcctaggacccctagatgtgccgctccccaaatcagaagtcgatcactggcagctcaggaaccggcatctgtcttagaggaggcgagactgaggctgcatgtgagtgctgtgccagagtcactgccgtgtagagagcaggaattccaagacatttataatttcgtcgaatcaaagctgctggaccacacaggcggttgcatgtacatctccggggtacctggtacaggtaaaacagctaccgtccatgaagtcatcaggtgtctacagcaggctgctcaggctaatgacgtgcctcccttccaatatatagaagtgaatggaatgaaactgacagagccacatcaggtttacgtgcaaattctccaaaagctgaccggccaaaaggccactgccaaccacgcagccgagctgctggcgaaacaattctgcactaggggctcgccacaggaaacaacggtactactagtcgacgagctagacctcctgtggactcataaacaagacattatgtataacctgtttgactggccgacccataaagaggccagactcgttgtgcttgccatcgcgaacactatggatctgccagagagaatcatgatgaaccgagtgtcctcacgcctcgggctgacgaggatgtgctttcaaccatacacatattcccaactgcaacagatcttacgtagtcgacttaaacacctgaaagcattcgaggacgacgctatccagttggtcgcacggaaggtcgccgctctatctggcgacgcacgaagatgccttgacatctgcaggcgcgcaaccgaaatatgtgaattctcacaacagaaacccgactcacctgggcttgtcaccatcgctcacagcatggaggccgtggacgaaatgtttagctcaagctacattactgcaatcaagaacagctcagtgcttgaacaatccttcctccgggctattctggctgaatttcgaagaagtgggcttgaggaggccacatttcaacaaatttattctcagcatgtagctctttgtagaatggagggacttccttaccctaccatgtccgagactatggctgtgtgcagccatctgggatcctgtcggttgctgctagttgaacccagcaggaacgatttattgctacgcgtccgcctgaatgtgtctcaggatgacgttctttatgcactcaaagatgagtag

SEQ ID NO: 233597 - DNA, 1599 bp, Artificial Sequence
  Description of Artificial Sequence: Synthetic coding sequence
atggagaagagcaacgagaccaatggctatctggactctgcgcaggccggacccgctgcaggacccggagcccctggtacagctgcagggcgagctagaagatgcgcaggttttctgaggaggcaggctctggtgttattaactgtttcaggcgtgctagcgggtgctgggttaggcgctgctctgcgagggctctcactcagcaggacccaggtcacatatttggccttccccggtgagatgctgctgcgcatgctgagaatgattatccttccactcgtggtctgttccttagtcagcggagcagcaagtttagacgcctcgtgcctgggtcgcctgggtggcatcgctgtcgcctattttggactcacgacactttctgcttctgctctcgcagttgctctggcctttataatcaagcccggaagcggcgcacagacacttcaatccagtgaccttggcctggaggatagtggccctcctcctgtcccaaaggagactgtagattcctttcttgatctcgccaggaacttatttccctcaaacttggttgtcgcggcttttcggacgtatgcaacagattacaaagtggtgacgcagaactcaagttcgggaaacgtcacacacgagaaaattccgattgggactgagatcgagggcatgaacatcctgggtcttgttctctttgcgctggtgctcggcgtcgccctcaaaaagttgggttcggagggggaggatctgatcagattcttcaactcgcttaacgaggctaccatggtgttggtgtcctggattatgtggtacgtgcctgtcggcatcatgtttttggtcggttcgaagatcgtggaaatgaaagacattattgtattagtgactagcctgggaaagtacatctttgcctctattctaggacacgtgatccatggagggatcgtcctgccactgatctacttcgtcttcaccaggaagaacccctttcgttttctgctcgggctgctggccccatttgcgaccgccttcgcgacctgttctagctcagctactcttccttctatgatgaagtgcattgaggagaacaatggtgttgacaagagaatatcccgtttcatcctccctatcggggcaacggtgaacatggacggggctgccatctttcagtgtgtggctgcagtctttattgcccagcttaataacgttgagctaaacgcgggacagatttttacaatcctcgtgaccgccactgctagttccgtgggagctgcaggagtccccgctgggggagtgctcacgatcgctatcatactggaggcaattgggctgcccacccacgacttgcccttaattctcgctgtcgactggattgtggataggacaaccacagtggtgaacgtcgaaggggatgctctgggggcaggtattctccatcaccttaatcagaaagcgaccaagaaaggggaacaggaactcgctgaggtgaaagtggaagccataccgaattgtaagagcgaagaagagacgagtccactcgtgactcatcagaaccccgcagggcctgttgcctcagcgcctgagttggagagtaaagaaagcgtcctctag

SEQ ID NO: 233598 - DNA, 330 bp, Artificial Sequence
  Description of Artificial Sequence: Synthetic coding sequence
atgtctaaaccagagctgaaagaggacaaaatgttagaggtgcacttcgtcggcgatgacgacgtccttaatcatattttagacagggaaggcggagccaaactgaaaaaggaacgtgcccagctattggtgaaccccaaaaagatcatcaagaagccagaatacgacttggaagaggacgaccaggaagttctgaaagatcaaaactacgtggagatcatggggagagacgtgcaggagtctctgaaaaacgggtctgctacagggggaggcaacaaagtttattctttccaaaacagaaagcattctgagaagatggccaagctctag

SEQ ID NO: 233599 - DNA, 219 bp, Artificial Sequence
  Description of Artificial Sequence: Synthetic coding sequence
atgtccaagcctgagttgaaggaggataaaatgctggaggtgcattttgtgggcgacgacgacgtcctgaatcatattctcgaccgagaaggtggtgccaaattgaagaaagagagagcacagttgctcgtaaatccaaaaaaaattataaagaaacctgagtacgatctggaagaagacgatcaggaggttttaaaagatcagaattatgtcgaatag

SEQ ID NO: 233600 - DNA, 2139 bp, Artificial Sequence
  Description of Artificial Sequence: Synthetic coding sequence
atggctacctctagtatgtctaaaggctgcttcgtgtttaagccaaacagtaaaaagcgcaagatcagcctgcctattgaggactattttaacaagggcaagaacgagcccgaggattcgaagctacggttcgaaacataccagttaatttggcagcaaatgaaatctgaaaacgaacgcttacaggaggagctgaacaagaatctgtttgataatctgatagagtttctccagaagagtcattccggctttcaaaaaaatagccgcgacctgggaggacagattaagcttcgagagattcctaccgcagctctagtgctaggcgtcaatgtaaccgatcacgatctaactttcggaagcctgacagaagcgctgcagaacaacgtgaccccttacgttgtgagccttcaggccaaggattgccctgatatgaaacatttcctacaaaaattgatctcacaattgatggactgctgcgttgacataaagtctaaggaagaggaatcagtgcacgtaacccagagaaagactcattattcgatggattcactgtcctcttggtatatgacagtcacccagaagaccgacccaaagatgctgtcaaaaaagaggaccacctcttcgcagtggcagagcccacccgtcgtggtgattctgaaggatatggagagttttgctaccaaagttctgcaggacttcatcataatctcatctcaacacctgcacgaattccctctgatcctgatcttcggaatagccacctcccccataatcatacaccgcctccttccccatgccgtcagctcacttctgtgcatcgaactgttccagagcctgtcatgcaaagagcacctgacaaccgtgctagataaactgttgctgaccacccagtttccctttaaaatcaatgaaaaggtgcttcaggtgttgacaaatatcttcctgtaccacgatttttcagtccagaacttcataaaagggttacagctgagtttacttgaacacttctactcacaaccattaagcgtgctgtgctgtaatttaccagaggccaaaaggaggattaactttctgagtaacaaccagtgtgagaacatacgcagactgccgtctttccgaagatacgtcgaaaagcaagcctctgaaaaacaggtcgccctcctgacgaatgaacggtacttgaaagaggaaacacagctgctcctggagaacttacacgtttatcacatgaactatttcctggtgctgagatgcctccacaagtttacctcatccctccctaaatacccattgggacgccagatcagggagttatactgcacctgtctggagaaaaatatatgggattctgaggagtacgcctccgtcctgcagctgttgcgtatgctggcaaaggacgagcttatgactattctggagaaatgcttcaaggtgttcaaatcatattgcgagaaccacttggggagcaccgccaaacgcatcgaagaatttctggcccaattccagtcacttgatgccgagactaaggaagaagaagatgcctcaggttctcaacccaagggcctacagaagactgacctgtaccacctgcaaaagagcctgttagagatgaaagagctgcgcaggagtaagaagcaaaccaagttcgaagtgttgagggaaaacgtggtaaacttcattgattgcctagtccgcgagtatcttctcccacctgagactcaaccgctgcatgaggtcgtgtacttttcggccgctcacgctttgcgcgagcacctgaatgccgctcccagaatcgcgctgcacaccgccctcaacaatccatattattatttgaagaatgaagccctcaaatccgaagaaggatgcatccccaatatcgctcctgatatctgtattgcttataagctgcatttggagtgtagtcgtttgatcaatttggtggactggagcgaagcgtttgccaccgtggtgaccgcggctgagaagatggatgccaacagcgcaacatcagaagaaatgaatgagatcatacacgctagattcattagagccgttagcgaactggagttattggggtttattaaacccaccaagcagaaaaccgatcacgttgcaaggctgacatggggagggtgctag

SEQ ID NO: 233601 - DNA, 2136 bp, Artificial Sequence
  Description of Artificial Sequence: Synthetic coding sequence
atggcgacgtccagtatgtctaaaggatgttttgtatttaaacccaatagcaagaagagaaaaatctcactgccaatcgaggactacttcaacaagggaaaaaatgagcccgaagatagcaagttaagattcgagacctaccagctcatatggcaacaaatgaagagcgaaaacgagcgcctgcaggaagagttgaataagaacctattcgataatctgatcgaattccttcagaaatcccattccggcttccaaaagaatagccgcgatctgggtggacagatcaaactaagagagatccctactgctgcgcttgtcttgggtgtaaacgtgactgaccatgacctcacgttcggcagcctgacagaggccctgcaaaacaacgtgacgccatatgtggtgagccttcaggccaaagactgccccgatatgaagcactttctgcagaaacttataagccaactgatggattgctgcgtagatatcaagtcaaaggaggaggaaagcgtccatgtgacccagcgcaagacacattacagcatggactccctctcttcatggtatatgaccgtgacacaaaaaacagaccccaagatgctgtccaagaagcgcactaccagcagccagtggcaaagtccacccgtggttgtcatcctcaaagacatggagtcgttcgcgaccaaggtcctgcaagattttatcatcatatcatcccaacacctccacgagtttccactcattctgattttcggaattgcaactagccctataataattcacaggctgctgcctcacgccgtgagctcgctgctgtgcatagaactctttcagtccctgtcctgtaaagagcacctcactacagttctggataagctactgcttaccactcagtttccatttaagatcaacgagaaagtcttacaggtcctgacgaatattttcttatatcacgatttctctgttcagaatttcattaaggggcttcaattatcactgctcgagcacttttattctcaaccgctctccgtactgtgttgtaatctgccagaggccaaacgtcgtatcaacttcctttcgaacaatcaatgtgagaacattcgccgtctgccaagctttaggagatacgtagaaaaacaagcatctgagaaacaggtagccctgctcacaaatgagagatacctgaaagaagaaacccagctcctgcttgaaaacctgcatgtgtaccacatgaattatttcctcgttttgcgttgcttacacaagtttacttccagtctgccaaagtaccctctaggcaggcagatacgcgagctttattgtacctgcctggagaagaatatctgggatagcgaggagtatgcctcagtgcttcagctgctccgcatgctcgcaaaggatgagctgatgacgatccttgagaaatgctttaaagtgtttaagtcttattgcgagaatcaccttggatccacggccaaacgcatagaagaattcctggctcagttccagtctcttgatgaaactaaagaggaagaagacgcttctggatcccagcccaagggactccaaaaaacagatctctaccatctccaaaaaagcctgcttgagatgaaggaattgagaagatccaaaaagcaaacaaaattcgaggtccttcgagagaatgtcgtcaactttatcgattgtctggtgcgcgaatatttattgcctcctgagacgcagcctttgcacgaggtggtgtacttcagcgcagcccatgccctccgggagcacctgaacgccgctcctagaattgcacttcacacagctctcaataatccctactactatttgaaaaatgaagcccttaaatcagaggaggggtgcataccaaacatcgccccagatatttgtatcgcgtataaactacacttggagtgtagtagactgatcaatcttgtcgattggtctgaggcttttgccactgtggtgaccgcagccgagaagatggatgcgaactcagccacttctgaagaaatgaatgaaataatccatgctcgctttatccgggcagtctcagaactcgaactgttggggtttatcaagcctacaaaacagaaaacggatcatgtcgcacgactcacatgggggggatgttag

SEQ ID NO: 233602 - DNA, 1335 bp, Artificial Sequence
  Description of Artificial Sequence: Synthetic coding sequence
atgaagtcggagaacgagcgcctgcaggaggaactcaacaaaaacctgttcgacaaccttattgagtttcttcagaaatctcactcaggtttccagaagaacagtcgcgatctgggaggacagatcaaacttagagagatccctactgccgctctagtgctgggagtcaatgtcactgaccacgatcttacctttggcagcctgactgaggctctgcagaataatgtaactccctacgtagtgagcctgcaggcgaaagattgtcccgacatgaaacacttcttgcagaaattgattagccagttaatggactgctgcgtcgacatcaaatcaaaagaagaagaatccgtgcatgtgacccagcggaaaacccactattcaatggatagcttatcatcctggtacatgactgttactcagaaaaccgacccaaagatgctcagcaaaaaaaggaccacttcctctcagtggcagagtcctccagtggtggtcatcctgaaggatatggaatcgtttgcgacaaaggtcctgcaggacttcattattatcagcagccaacacttgcacgaatttcctctcatcctcatcttcggaatagcaaccagccctataatcattcaccgactgcttccgcacgcagtgtcgtcactgctgtgcatcgaactgttccaaagcctgagttgtaaggaacatttgactactgtgctcgacaagctgctcctcacgacacagtttccttttaagattaacgaaaaagtgcttcaggtgttaacgaacatcttcctgtaccacgacttttctgtccagaacttcatcaaaggactgcagctgtccttgcttgaacatttttattcccaaccactttctgtactgtgctgtaatctgccagaagccaaacggcgaatcaacttcctcagcaacaatcagtgcgagaatatccgtaggttaccctccttccggaggtatgtggagaagcaggcatcagagaagcaagtcgccctgctgacgaacgagcgttacctgaaggaggagactcagctcttattggaaaacttgcatgtatatcatatgaattactttctggtattgaggtgcttgcataagtttaccagttcactgccaaagtacccactgggaagacagattagggagctgtactgcacctgtctcgaaaaaaacatctgggatagcgaagagtatgctagtgtcttgcagttgctgcgtttagggctggcttttctggatatccagctgttcggcgctcagtctggacaggagttattgctgccgctgtcttgggaggctaatccatcccatgccgctaacttgggctag

SEQ ID NO: 233603 - DNA, 1707 bp, Artificial Sequence
  Description of Artificial Sequence: Synthetic coding sequence
atgaagcattttctccagaaactgatttctcagctgatggactgctgcgtggacatcaagagtaaagaagaggaaagtgttcatgtgacacagcgcaaaacacactattctatggattctctgtcttcctggtacatgactgtcacacaaaagacagacccaaagatgctaagtaagaagcgcaccacgagctctcaatggcagagccccccagtggtggtcatcctaaaggacatggaaagctttgctaccaaggtcctgcaggactttatcatcatcagtagtcagcatctgcatgagtttcctttgatcctcatattcggtattgctacttcacctataatcatacaccgattgctgccacatgcggtctcctccctgctgtgcatagagctcttccaatccctcagttgtaaggagcatttgacgacggtcctggataagctacttctgactacacagtttccttttaaaatcaatgaaaaagtgttgcaggtcctgacaaatatctttctgtaccacgatttcagtgtacagaactttattaaaggtctccagctgtctctgctggaacacttctactcccagcccctgagtgtgttgtgttgtaacctgcccgaggctaagcgtagaatcaattttctttcaaataaccagtgcgagaacattcggagactcccaagcttcagaaggtacgtggaaaagcaggcgagtgaaaaacaagtcgctttgctgactaacgagcgctacctgaaagaggaaacccagcttctgttggaaaacttacacgtgtatcacatgaattactttttggtcctacggtgtctgcataaattcactagttccctgccaaagtacccgttgggtcgtcagattagggagttgtactgcacctgcctggaaaagaacatctgggatagcgaagaatacgccagtgtgctgcagttgctgcgcatgcttgctaaagacgaactgatgactatactggagaaatgcttcaaagtgttcaaaagctactgtgaaaatcaccttggctcgactgccaaaagaatcgaggaattcctggcccagttccaatccctagatgagacgaaagaggaagaggacgcatcagggtcgcagccaaaagggctgcagaaaacagacctgtaccatctgcaaaaaagcctgctggaaatgaaggagctgcgaagaagcaagaaacagaccaaattcgaggtcttgcgagagaacgtagtcaatttcattgattgtctggtgcgggagtacctgttacctcccgaaacccagcctctgcatgaagtcgtatactttagtgccgctcacgcattgcgggagcacctcaatgctgctcctaggatcgctcttcatacggccttaaataacccatactattatctcaagaacgaagccctcaaaagcgaggaagggtgcataccaaacatcgctcctgacatatgtatcgcctataagctgcacctggaatgcagccggttaataaacttggtggactggtccgaggccttcgccacagtggtgactgccgctgaaaagatggacgcaaatagcgctacctcagaggaaatgaacgaaatcattcacgcacggtttatccgtgctgtcagcgaacttgagcttctcgggttcattaagcccaccaaacagaaaacagaccacgtggccaggctgacctggggaggctgttag

SEQ ID NO: 233604 - DNA, 1311 bp, Artificial Sequence
  Description of Artificial Sequence: Synthetic coding sequence
atgtccagccgaaagtctaagtccaactctctcattcataccgaatgcttgtcgcaggtccagagaattttaagagagcggttttgccggcagagtccacatagcaatttgttcggcgtgcaggtgcagtacaaacacctatctgaactcctcaaacgtactgcgctccatggggagagtaactccgttctgattatcggccctcgcggatctgggaagactatgttgatcaatcatgcactcaaggagctaatggagatcgaggaggtgtcggagaatgtgctccaggttcatcttaatggcctactgcagatcaacgacaaaatagccctcaaagagattactcggcagctaaatctggagaacgtggtgggagacaaagttttcggaagctttgcagagaacctgtcctttcttctagaggccctgaaaaaaggggaccgaacctcctcttgtcctgtcatttttattctcgacgagtttgatctcttcgcacaccacaagaatcagactctgttgtacaatctcttcgacattagtcagtcggcccagacacctatcgcagtgatcgggctcacttgtagactggatatcctggagctgctggagaagcgagttaagagcaggttcagccatagacagatccatctgatgaacagtttcggcttccctcaatacgtcaagatctttaaagagcaactcagcttgcccgcagagttcccagacaaggtgttcgccgaaaaatggaatgagaacgtgcagtacttgtccgaggataggtctgtccaggaagtcctgcagaagcacttcaatatttctaagaacctacggtctctgcacatgctcttaatgcttgctttaaacagggtgaccgcctcacaccctttcatgacagcagtggacctgatggaagcctctcaactctgcagtatggactcgaaagccaatattgttcacgggcttagcgtcctggagatttgtttaataatcgccatgaagcatctgaacgacatctacgaggaagaaccttttaactttcagatggtttataacgagtttcagaagttcgtacagagaaaagcgcactcagtgtacaatttcgagaagcctgtcgtaatgaaggccttcgaacacttgcagcagctggagctgattaagccaatggagcgaacctctggaaactcccagcgcgagtatcagttgatgaaactactcctggataacacccagataatgaacgctctccagaaatatccaaactgccccactgacgtgcggcagtgggcaacctccagcctctcatggctgtag

SEQ ID NO: 233605 - DNA, 1311 bp, Artificial Sequence
  Description of Artificial Sequence: Synthetic coding sequence
atgtcttctagaaaaagtaaatccaactcactgatccatacagagtgtctgagtcaagtgcagcggattctccgggagaggttttgcagacaaagtccgcattctaacctttttggtgtccaggtccagtataagcacctatcagaactgctgaagcgcaccgcattacacggcgagtcaaactccgtactaattatagggccacgaggatcgggtaagaccatgctgatcaaccacgctctcaaggagttaatggaaatcgaagaggtctccgagaacgtcctccaggtgcacttgaatggattgctgcaaattaacgataagatcgcccttaaggaaattactcggcagttgaacttagaaaacgtcgttggggacaaggtttttggctctttcgcggaaaacctttctttcctcctagaggcgctaaaaaaaggcgaccggacatcaagttgccctgttatctttattctggatgagtttgatctttttgcacaccataagaatcaaacccttttatacaacctgttcgatatatctcaatctgcccagactcccattgcggtcataggactaacctgccgcttggacattctggaactgcttgaaaaacgagtgaaatcgaggttttcacaccggcagattcaccttatgaactcgtttggattcccccaatatgtgaagattttcaaagaacagttatccctacccgctgagtttccagacaaggtttttgctgagaagtggaacgaaaacgttcaatacctctctgaagaccggagtgtgcaggaagtccttcagaaacacttcaatatctctaaaaatttacgcagcctccatatgctgttgatgctggcacttaatcgcgtgaccgccagtcatcccttcatgacggctgtggatctcatggaggcatcgcagctgtgcagcatggatagtaaagccaacatcgtccatggattgtccgttctggagatttgtttaataattgccatgaaacacctgaacgatatatatgaggaggaacctttcaactttcagatggtttataatgaattccagaaatttgttcagaggaaggcccactctgtatataatttcgagaaacctgtggtaatgaaagctttcgagcatttgcagcaacttgagttgattaagcctatggaacgcacttcagggaactcccagagggaataccagttgatgaagctcctgctggataatacccaaattatgaatgctttgcaaaaatatcccaattgcccaactgacgttcggcagtgggccacttcctcattgtcttggctttag

SEQ ID NO: 233606 - DNA, 1311 bp, Artificial Sequence
  Description of Artificial Sequence: Synthetic coding sequence
atgtcttctcgtaaatcaaaatcaaacagcttgatccacactgagtgcctttctcaggtccaaaggatcctgcgcgagcgtttctgtaggcagagtcctcacagcaatctctttggcgtacaggttcaatacaaacatctgtccgagctgctgaagcgtacagcgcttcacggcgagagcaacagcgtcttgataataggacccagaggctcggggaaaaccatgttgatcaaccatgccttgaaggaattaatggagatcgaggaggtctctgaaaacgtcctacaggtccatcttaacggccttctccagattaacgataagattgcactcaaagaaatcacccgccaactgaacctggaaaacgtagtcggcgataaggttttcggttcgtttgctgagaacttgtcatttttattagaagcactcaagaagggcgaccggacatcttcatgccctgtgatcttcattctcgatgagtttgacctgttcgcacaccataagaatcagacactactgtataatctgttcgatatttcccaatcggcccagacccctattgcagttatcggtctgacttgccggttggacattctggaacttctcgaaaagagggttaaatcgaggtttagccacaggcagatccatcttatgaatagcttcggttttccccagtacgtgaagatcttcaaggagcagctgtccttgccagctgagttccctgataaagtgtttgcagaaaagtggaacgagaacgtacagtatctgagtgaggacagaagtgttcaagaagtgcttcagaagcattttaacatttccaaaaaccttaggtcgctgcacatgctgctcatgcttgcgttgaaccgggtgaccgccagtcacccctttatgaccgccgttgacctgatggaagcgtctcagctatgtagtatggatagcaaggcgaacatcgtgcacggcttatcagtgctcgagatctgccttataatcgccatgaagcatctgaacgacatctacgaagaagagccctttaacttccagatggtctataacgaatttcagaaatttgtccaaaggaaggcccacagtgtgtataactttgagaaacctgtcgttatgaaagctttcgaacacctgcagcagctcgagctgatcaagcccatggaacgaactagcggtaatagccagagggagtaccaacttatgaagttgctgctcgataacacccaaatcatgaacgcactgcagaaataccctaattgtcccactgatgttaggcagtgggctacatcaagcctaagctggttgtag

SEQ ID NO: 233607 - DNA, 438 bp, Artificial Sequence
  Description of Artificial Sequence: Synthetic coding sequence
atgtctagtcggaagtccaagagcaacagtctgattcacacggagtgcttgagtcaggtgcagcgcatcctgcgggaaaggttctgcagacagagtccccattctaatctttttggagtgcaagtgcagtacaagcacctcagcgagttacttaagagaacggcactgcatggagaaagcaacagtgtgctgatcatcgggcctaggggctcaggcaaaacaatgttaattaaccatgccctgaaggagctcatggagatcgaggaagtgagtgagaacgtcctgcaggttcacttgaatggtttactgcagattaatgataagattgccctgaaggagattacgcgccagttgaatctcgagaacgtcgtcggagataaggtgttcggctcgttcgcggagaatctgtcttttctcctggaggccctcaaaaagtag

SEQ ID NO: 233608 - DNA, 384 bp, Artificial Sequence
  Description of Artificial Sequence: Synthetic coding sequence
atgtcttctcgcaagagtaagtcaaattcactcattcacacagagtgccttagtcaagtccagagaatcctgcgagagcgcttctgcagacagagccctcactcaaacttatttggggtgcaggtgcagtacaaacatttgtcagaactactgaagagaacagccttgcacggagaatcaaatagtgtcctcatcatcggcccacggggatctggtaagactatgctcattaaccacgctctcaaagagctgatggaaattgaggaagtatctgaaaatgtcctacaggtccatctgaacggcctcctgcagatcaatgataagattgctttaaaagagattacccgccagcttaatctcgaaaatgtcgtaggagataagtag

SEQ ID NO: 233609 - DNA, 387 bp, Artificial Sequence
  Description of Artificial Sequence: Synthetic coding sequence
atgagtagcaggaaaagcaagagcaactctctcattcataccgagtgcctctcgcaggtacagcggattcttagagagcgattttgcaggcagtcaccacactccaacctcttcggtgttcaggtgcagtataagcatttatctgaactccttaagcgcacagcccttcatggcgagtccaattctgtgctcatcatcggaccgagaggctcgggcaagacaatgctgattaaccacgcactcaaagaactcatggaaattgaggaggtgagtgagaacgtgctgcaggtccacctaaacggccttctccagatcaatgacaaaattgcccttaaagaaattaccagacaactgaacctggaaaacgtggtcggtgataaggtctag

SEQ ID NO: 233610 - DNA, 1311 bp, Artificial Sequence
  Description of Artificial Sequence: Synthetic coding sequence
atgtctagcaggaaatccaaatccaacagccttattcacactgagtgtttgtcacaagttcagcgcatcctaagagagcgattctgtagacagtctccacacagtaacctgtttggcgtgcaggtgcagtataaacatttgagcgaacttttaaagcgaacagctttgcatggcgaatcaaatagcgtgctgatcattggccctagaggatcaggaaaaaccatgctgataaaccacgcattgaaagaactaatggagattgaggaggtctccgaaaacgtccttcaggtgcacctgaacgggcttttacaaatcaacgataaaattgccctgaaggaaattactaggcagctgaatctggagaatgtcgtaggagacaaggtgtttggaagctttgctgagaacctcagctttctgctcgaagccttgaagaagggcgaccggaccagttcttgtcctgtgatatttatcttggatgagttcgacctgtttgctcatcataagaaccagacactgctgtataacttgtttgatatctcacagtcagcacagacccctattgctgtgattggcctgacatgtcgactcgatattctcgagctgctcgaaaaaagagtgaagtcccggttcagccacagacagattcatctcatgaactcttttgggtttccccagtacgtcaagatcttcaaggaacagttgtccttgcctgcagagttccccgataaggtttttgctgaaaaatggaatgaaaatgtgcaatacctctctgaggataggtcagtccaagaagtcctgcagaagcactttaacataagcaaaaatttgagatcgctgcacatgctcctgatgctcgctctgaaccgggtgaccgcctcccacccctttatgaccgctgtggatttgatggaagcttcacagctttgctcaatggattccaaagccaacatcgttcatggactcagcgtgctggagatatgtctgattatcgcaatgaagcacctgaacgacatttacgaggaagaaccgttcaacttccagatggtatataacgagttccagaaatttgtgcagcggaaggcacacagcgtgtacaacttcgaaaagccagtcgtcatgaaggcattcgagcacctccagcaattagagctgattaagcctatggaacggaccagcggcaattctcagcgggaataccagctcatgaagctgcttctggacaacacccagattatgaacgccctccaaaagtatccgaactgccccactgacgtacgacaatgggcaacaagcagtctctcatggctctag

SEQ ID NO: 233611 - DNA, 1059 bp, Artificial Sequence
  Description of Artificial Sequence: Synthetic coding sequence
atggagattgaagaggttagcgaaaatgtgttacaggtacacctgaatggacttttgcagatcaacgataagatcgccctgaaggagataacccgccagcttaacctggaaaatgtagtcggggacaaagtgtttgggagtttcgcagagaatctgtccttcctacttgaagctctgaaaaagggggaccgcacctcctcttgccctgtgatatttattctggatgagtttgacctgtttgcgcatcacaagaatcagacccttctctacaacttattcgacataagtcaatcagcgcagacccccatcgccgtgataggcctgacatgcagactggatattctggaactcttggaaaagagggtaaagtcccgtttctcgcaccgacagatccacctcatgaactcttttggatttccacagtacgtgaagatctttaaggaacagctcagcctgcccgcagaatttcctgacaaggtgttcgctgaaaaatggaacgagaacgtgcaatacttgagcgaggacagatctgtccaggaggtgctgcagaagcactttaacattagcaagaatttgagatcattacacatgcttctgatgctggctctgaatagagtcacagcctcccacccatttatgacggccgtggacctgatggaagcctcacaactgtgcagcatggactcaaaggccaacatcgtacacggactgagcgtgttggaaatctgtctgatcatcgctatgaagcaccttaatgacatctacgaggaagagccatttaacttccagatggtctataacgagtttcagaagttcgtgcaaaggaaagcccactcagtatacaattttgaaaaacctgtagtcatgaaggccttcgagcacttacagcagctggagctaattaaacctatggagcgcaccagtgggaacagtcagcgcgaataccagctgatgaaactgctgctggacaatactcagatcatgaatgctttacagaaataccccaattgtcctaccgacgtaaggcaatgggccacctcatctctatcttggctgtag

SEQ ID NO: 233612 - DNA, 1089 bp, Artificial Sequence
  Description of Artificial Sequence: Synthetic coding sequence
atgctgataaatcacgccctcaaagaactgatggagatcgaagaagtgtcggaaaacgtcctccaagtccacttgaatggacttctccagatcaacgacaaaatcgcccttaaagaaatcactcgccagctgaatctggaaaacgtggtgggtgataaagttttcggaagtttcgctgagaacctttccttcctattagaggcactgaagaagggcgatcgaacttcttcatgccccgtgatatttattctcgatgagttcgatttgtttgctcaccacaagaatcagaccttgctgtataatctttttgacatctcacagtcagctcagacccccatcgccgtaattggactgacttgcaggttggatatactggagctgctggaaaaacgcgttaagagcaggttttcacacaggcagattcatctgatgaactctttcggatttccacaatacgttaaaattttcaaagagcagctttcactgcccgcagagtttcccgataaagtgttcgccgagaagtggaatgaaaatgtgcagtacctgtcagaggatcggagcgtgcaggaagtgttacagaaacattttaacatttctaaaaatctcagaagtctgcatatgctgctgatgctggctttaaatcgtgtcacagcctcacatccctttatgactgccgtcgatttgatggaagcttcccagttatgctccatggactccaaagccaacatcgtgcatggtctgtccgtactcgaaatctgcttgattatcgccatgaaacacctgaacgatatttacgaagaggagcccttcaacttccagatggtgtacaatgagttccagaaatttgtgcaacgaaaggctcactcagtctacaactttgagaagcctgtggtgatgaaggcgttcgaacacctgcagcagttagagcttataaagccgatggagcgaaccagtgggaacagccagagggagtaccagctaatgaagctgctgctggataatacccagatcatgaatgccctgcagaagtatccgaactgtcctaccgatgtgagacagtgggcaacttcgagtctcagttggctgtag

SEQ ID NO: 233613 - DNA, 660 bp, Artificial Sequence
  Description of Artificial Sequence: Synthetic coding sequence
atgaattctttcggtttcccgcagtatgtcaagattttcaaagagcagctcagcttaccagccgagttcccggataaggtgttcgctgagaagtggaacgagaacgtgcagtatttatccgaagatagaagtgtccaggaagtgctgcagaaacatttcaacatctctaagaacctgcgttccttgcacatgctcctaatgctggcgttaaatagagtgacagcgagtcatccctttatgaccgccgttgacctcatggaggcgagtcagctgtgtagcatggactctaaagctaatattgtccatgggctgagcgtgctcgagatttgtcttatcattgccatgaagcacctgaatgacatctacgaggaggagccctttaacttccaaatggtatataacgagttccagaagttcgtgcaaagaaaggcacatagtgtgtataacttcgagaagccagtggtcatgaaggcatttgagcacctgcagcagctcgaattaatcaagccaatggaaaggactagcggtaatagtcagcgggagtatcagttgatgaaactgctgctggacaatacccagatcatgaacgctcttcagaagtatccaaactgtcccaccgacgttcggcaatgggcgacaagtagcctgtcttggctctag

SEQ ID NO: 233614 - DNA, 1308 bp, Artificial Sequence
  Description of Artificial Sequence: Synthetic coding sequence
atgccccacctggagaatgtggtgctttgtcgggagtcccaagtcagcatccttcagtcacttttcggcgagcgtcaccattttagctttccttctatctttatctatggccacacagcatctggcaagacttatgtaacccagacactcctcaagaccctggaacttccccatgtttttgtgaactgcgtagaatgctttacgttgcggctgctcctagaacagatactgaataaactcaatcacttgagtagctctgaggatggttgcagcacggagatcacctgcgagaccttcaatgatttcgtgaggctgttcaaacaagttactactgccgaaaatctgaaagatcagaccgtgtacattgtcctcgataaagctgagtatctacgcgacatggaagccaaccttctgccagggttcttgcgactccaggagctcgctgaccgcaacgttactgttctattcctatccgaaatcgtgtgggagaaatttaggcctaacaccggatgcttcgagcctttcgtcctgtactttccggactacagtatcggcaatctgcagaagattctgtctcacgatcatccaccggagtactccgctgacttctacgctgcctacattaacatcctgctaggagtgttctacaccgtgtgtagagatctcaaagagctcaggcacctggccgttctgaactttcccaaatattgcgagcctgtcgttaagggcgaggcaagtgagagggatacaagaaaactttggcgcaatattgagccccaccttaaaaaagctatgcagaccgtctacctgagggagatctccagctcccagtgggagaaactccaaaaagacgatacggacccagggcagctcaaagggctctctgcgcatacacacgttgagctgccctattacagcaaatttatcctgatcgcggcatacctcgcctcatataacccagctcggactgacaagagatttttcttgaagcaccatggaaaaatcaagaagacgaattttttgaagaagcatgaaaaaacttccaatcatctactgggaccaaagccatttcccctggacaggttgctcgctatcctgtacagcattgtggactcccgggtggctccaaccgctaacatcttctctcagatcacaagtctggtcacattgcagctcctgacgttggtgggacacgacgaccagttggatggaccaaagtacaaatgtactgtgtccctagatttcatccgagccatcgcgcgaactgtgaacttcgatattatcaagtacctgtacgacttcctgtag

SEQ ID NO: 233615 - DNA, 975 bp, Artificial Sequence
  Description of Artificial Sequence: Synthetic coding sequence
atgccacacctggagaacgtcgttctgtgccgggaatcacaggtgtcgattctgcaatcccttttcggcgagcgacaccacttcagctttccctccatatttatatatggtcacaccgcctcgggcaaaacctacgtaacacagactttgctcaaaacccttgagctgccccatgtattcgttaactgtgtcgagtgctttactctacgtcttctgctggaacaaattctgaacaagctcaatcaccttagtagctcagaggatggctgcagcacggagataacttgcgagactttcaacgattttgtaagactgttcaaacaggtgacaaccgcagaaaacttgaaggaccaaaccgtgtatattgttctggacaaggctgagtatctgcgggacatggaggccaatctgctcccaggctttttgcggttgcaagaacttgccgatcgaaatgttactgtgcttttcctgagtgaaatcgtgtgggagaagttccggcctaataccggatgctttgaacccttcgttttgtacttcccggattatagcatcggtaacctgcagaagatactgagccatgaccaccctcccgagtactcagctgatttctacgcagcctatataaatatactactcggcgtattttacaccgtgtgccgcgatctcaaggaactgaggcacctcgctgtgctgaattttcccaagtattgcgagccagtagttaagggcgaggctagcgaacgagacactaggaagctgtggaggaacatcgaacctcaccttaagaaagccatgcagactgtttatctgcgggagatttcttcatctcagtgggagaagctccagaaagacgatacagacccaggacagctcaagggtattcggggatcaatcgaaactgtcaccggcgatacatccagtgctaattatcaagatactaaagtgaacaccaaggagcactcggttcggaagtag

SEQ ID NO: 233616 - DNA, 912 bp, Artificial Sequence
  Description of Artificial Sequence: Synthetic coding sequence
atggaggcaaacctgctgcctggcttcctccggctgcaggagcttgccgataggaatgtgactgtgctgttcctgtctgagatcgtttgggagaaatttcgacctaatactgggtgcttcgagccatttgttttatacttcccagattattctatcggaaacctccagaaaatattgagtcatgaccaccctccagaatattccgcagacttctacgccgcatacataaatatccttttgggtgtgttctatactgtatgccgggacctgaaagaactccgacacttggcggtcctcaacttccctaagtactgcgagcccgtggtcaaaggagaggcctctgaacgggacactcgcaagctgtggcgaaatattgagcctcatctgaagaaagcaatgcagaccgtctacctcagagagatttcctcctctcagtgggagaaactccagaaagatgacactgaccctggccagcttaaaggcctgtccgcccacacacatgtcgaactgccttactattcgaagttcatccttatcgccgcatatttggccagctacaacccagcacgcaccgataagagattctttctgaaacatcacgggaagataaaaaagaccaatttcctcaaaaaacacgaaaaaacctccaaccaccttcttggacctaagccttttcctttagaccgcctactcgccatcctgtattccattgtggactcccgagtcgccccaacggcaaacatattttcacagatcactagcttggttacgctgcagttactgacattggtgggccacgatgaccagctggacggtccaaagtacaaatgcacggtgtccctcgatttcatccgcgctatcgccagaacggttaactttgatatcatcaagtacttgtatgattttctgtag

SEQ ID NO: 233617 - DNA, 1665 bp, Artificial Sequence
  Description of Artificial Sequence: Synthetic coding sequence
atgagcgctgacggcggtggcatccaggatacacaggataaggagaccccgcctgaagtgccggatagaggccatcctcaccaagaaatgccctccaaactgggggaggccgtgccctccggggatactcaggagtccctgcatattaagatggaaccagaagagccacacagcgagggcgcatcacaagaagatggggctcaaggagcctggggctgggcacccctaagccatggctctaaagaaaaggcgttgttccttcccggtggtgctctccctagtcctcgcatcccagtgctctcgcgggaaggcagaactagagataggcaaatggccgcagccctcctcacagcatggagccagatgccagttacctttgaggacgtcgcactgtatctttctcgggaggaatggggcagattagaccacacacagcagaacttttacagggacgtgctgcagaaaaaaaacgggttatcattggggtttccgtttagccggccattctgggcgcctcaggcccatggcaagggcgaggctagcgggtcttctaggcaggctggcgatgagaaggaatggcggggagcctgcacaggggctgtggaggtgggacagcgggttcaaacctcctctgtcgctgccttgggcaatgtcaaacccttccgaacccgagcagggagggtacagtggggcgtgcctcagtgtgcccaggaggccgcttgtggtcgctcttctgggcctgctaaggacagtggccaacctgctgagcccgacagaactcccgatgcggctcctcccgatccgtcgccaaccgagccacaggaataccgtgtgccagagaagcctaacgaggaggaaaaaggggcacctgaaagcggggaagagggattggccccagatagtgaagttggaagaaagtcctacagatgcgagcagtgcggcaaaggcttctcctggcactcacacctggtcacacatagacgcacacacaccggggagaaaccttatgcctgtactgattgcgggaaaaggttcggaaggtcctcccatcttatacagcatcagataatacacaccggcgaaaaaccctatacctgtccggcatgccggaaaagcttctcgcaccactccacgttgatccagcaccaacgcatccacaccggcgagaagccttatgtctgcgacaggtgtgccaagaggtttacccggcgaagcgacctagtaacacaccagggcacccataccggagctaagccacacaaatgtccgatttgcgctaagtgcttcacccagtcaagtgcgcttgtcacacatcaaaggacccatacgggggtgaaaccgtatccctgtcctgagtgcgggaagtgcttttcgcagaggagcaatctgatcgctcacaacagaacccataccggagaaaagccctatcactgtctggattgtggcaaatccttctcccattcttcacacctgaccgcgcaccaacgcacgcatcgcggtgtgcggccatatgcctgcccgttatgcggcaagtctttctccaggcggtcgaaccttcatcgtcatgaaaagattcacaccacgggtcccaaggccctggccatgttgatgcttggagcagccgcagccggagccctagccacacccccacctgcaccaacttag

SEQ ID NO: 233618 - DNA, 462 bp, Artificial Sequence
  Description of Artificial Sequence: Synthetic coding sequence
atgaatgttggtgttgcacattctgaagtgaatcccaacactcgcgtgatgaattctaggggaatgtggctgacatacgctctcggcgttggcctactccatatcgttctattatccatcccatttttttccgtccctgtagcctggaccctgactaacattattcacaacctgggtatgtacgtgtttctgcacgccgtgaagggtactccctttgagacgccagaccaaggcaaagctcgcctgctgacacattgggagcagctggattacggggtgcagtttacctcctctagaaagttttttacaatttctcccatcattctgtactttctcgcatccttctataccaagtacgatcccacccacttcatactcaacaccgcatccttgctgagtgtcctgatacctaaaatgcctcagctacacggcgtcaggatttttgggatcaataagtattag

SEQ ID NO: 233619 - DNA, 462 bp, Artificial Sequence
  Description of Artificial Sequence: Synthetic coding sequence
atgaacgtaggggtggcgcatagtgaagttaaccctaacacacgtgtaatgaatagtcgtggaatgtggttaacctacgctcttggggtgggcctcttgcatatagtgctgctgagtatacctttcttttccgtcccagtcgcatggacactgacaaatatcatacacaatctcggaatgtatgttttcctccacgctgtcaagggaaccccatttgagaccccagatcaaggaaaggcgagactactgacgcattgggagcagttggactacggtgtccaattcaccagcagtcgcaagtttttcaccatctcgccgattatcttgtactttttggcaagtttttatactaagtatgatccaacgcattttatcctaaacacagcatctctgctgagtgtgcttatccctaaaatgcctcagctgcatggtgtgcgtatcttcgggataaacaaatattag

SEQ ID NO: 233620 - DNA, 462 bp, Artificial Sequence
  Description of Artificial Sequence: Synthetic coding sequence
atgaacgtgggcgttgcccatagcgaggttaatccaaacacccgcgtgatgaattccaggggaatgtggttgacctacgctctgggtgtgggcctgctgcacatcgtgctcctttcaatcccgtttttttcagtaccggtggcttggactctgactaatatcatccacaatctgggcatgtatgtattcctgcacgccgtcaagggcactccattcgaaacccccgaccaaggtaaggcgcgactcctcacacattgggagcaattagactacggtgtgcaattcacaagcagtagaaaattttttactattagccctattattctatacttccttgcgagcttctacactaagtacgatccaacacacttcatccttaacaccgcctccctgctctccgtgcttatcccaaagatgccacagctgcatggcgtgcgaatctttggaattaacaaatactag

SEQ ID NO: 233621 - DNA, 330 bp, Artificial Sequence
  Description of Artificial Sequence: Synthetic coding sequence
atgaacgttggagtggcccattcggaagtaaaccccaatacccgcgttatgaattcccgaggtatgtggttgacatatgctctcggtgtaggcctgctgcatatagtgctcctgtccatcccattcttttccgttcccgttgcttggacacttaccaacatcatccacaacctaggaatgtacgtttttctgcatgccgtgaagggaactccttttgagactcctgaccagggtaaggcgaggctgttgactcattgggaacaactcgactatggagtgcaatttactagctcccgtaaattttttacaatctcccctatcatcctctag

SEQ ID NO: 233622 - DNA, 330 bp, Artificial Sequence
  Description of Artificial Sequence: Synthetic coding sequence
atgaatgtaggtgttgcgcactccgaggtgaaccccaacactagagtaatgaactcgcgcggtatgtggctaacttacgccctgggagtgggcctgctgcacatcgtcctgcttagtatcccattcttttcggtccccgtggcttggacacttacaaatattattcacaatttaggaatgtatgtgtttctccacgctgttaaaggaactccttttgaaactccagatcaaggcaaagctcgtctactgacacattgggaacagcttgattacggagtgcagtttacaagttcccgcaagttcttcactatcagtcccattatcctctag

SEQ ID NO: 233623 - DNA, 462 bp, Artificial Sequence
  Description of Artificial Sequence: Synthetic coding sequence
atgaatgtgggcgttgctcacagcgaggttaatccaaacacccgggttatgaatagtaggggaatctggttggcctacatcatactggtgggattgttacacatggttcttttgtccatccctttcttctcgattcctgtcgtttggaccctgaccaacgttattcacaacctcgccacatatgtattcttgcacacagtgaaggggactccgtttgaaacaccggaccagggcaaagccaggcttctcacccactgggaacagatggattacggactccaatttacgtccagccgcaagtttcttagcatatcgcccattgtgttgtatttgttagccagcttttatactaaatatgatgctgctcattttctaattaacactgccagccttttatctgtacttctgccgaagctgccgcaatttcatggggtacgcgtcttcggaattaacaagtattag

SEQ ID NO: 233624 - DNA, 462 bp, Artificial Sequence
  Description of Artificial Sequence: Synthetic coding sequence
atgaatgtgggcgtcgctcattcagaagttaatcctaacacaagagtgatgaattcgcgcggaatttggctggcctacatcatccttgttggcttgctgcatatggtgttactgagcatcccgttcttctccatacctgtggtatggacgttaacaaacgtcatccataacttagcaacttacgtctttctgcacacagtcaagggaacgccttttgaaacccctgatcagggaaaagccaggctcctgacgcattgggagcaaatggactacggtctgcagttcaccagcagccgaaaatttctgagcattagcccaatcgtcttgtatctgttggcctccttttataccaagtatgacgctgcccactttttgatcaacacagccagcctactcagcgtgttacttccgaagctccctcaattccacggagttcgcgtgtttggcatcaacaagtattag

SEQ ID NO: 233625 - DNA, 462 bp, Artificial Sequence
  Description of Artificial Sequence: Synthetic coding sequence
atgaacgttggcactgcccacagcgaggtgaacccgaataccagagtcatgaatagccggggtatttggctttcatatgtgttggctattggtctccttcacatcgttctgctgtcaataccatttgtgtccgtacctgtcgtctggaccttaaccaacctcattcacaacatgggcatgtacatattcctccacaccgtgaaggggactccctttgagactcccgaccagggaaaagcaaggctgctcacccactgggagcaaatggactatggggtgcaatttaccgcttcaagaaagttccttacgatcacgccaattgtgttatactttctcactagtttttatacaaaatacgaccaaatacactttgttttgaacaccgtttctcttatgagtgttctgatccctaaactgccacagctgcacggggtaaggatattcgggatcaacaaatattag

SEQ ID NO: 233626 - DNA, 462 bp, Artificial Sequence
  Description of Artificial Sequence: Synthetic coding sequence
atgaacgtgggcaccgcccactccgaggtcaatcccaacactagggtaatgaactctcgcggaatctggttgtcgtacgtgttagcaattggcttgctgcatatcgtccttctgtcaattccatttgtgtctgtgcctgtcgtgtggaccctgacaaacctgatacacaacatgggcatgtatattttcttgcatacagtcaagggcactcctttcgaaacaccagaccaggggaaagcacgcttactcacccattgggaacagatggactatggcgttcagtttactgcctcccggaaattcctcacaatcacacccatcgttctctatttcctgacatcattctacactaagtacgatcagatccacttcgtacttaacactgtatccctcatgagtgttcttatccccaagctaccacaactgcacggcgtgagaatctttggaatcaacaagtactag

SEQ ID NO: 233627 - DNA, 1320 bp, Artificial Sequence
  Description of Artificial Sequence: Synthetic coding sequence
atgttttcaaagctggcccatctgcagcgcttcgcagtgctaagccgcggagtccattcctcggtggctagcgcaacttctgtggctacgaagaagaccgttcaggggccaccaacttctgacgatatctttgagagagagtacaaatatggagctcataattaccaccctctgcctgtcgcactagaacgcggaaagggaatttatctttgggacgtggagggaagaaagtacttcgatttcctttcttcgtatagtgcagtgaatcagggacattgccacccaaagatagtgaatgctctgaaatcccaggttgataagctcacattaacctcccgtgcattctacaacaacgttcttggcgagtatgaggagtacatcacaaagctttttaactatcataaggtgctgccgatgaatactggcgtcgaggctggtgagacggcttgcaagctggccagaaaatggggctacaccgtgaagggaattcaaaaatataaagccaagatagtctttgctgctggcaatttctggggtaggactttgtctgccatatctagtagcacagacccaacatcttatgacggattcggcccttttatgccagggtttgacatcatcccgtataacgaccttccagcacttgagagagccctgcaagaccccaacgttgccgcattcatggtcgaaccaattcagggagaagcgggtgtagtcgtgccagacccaggttacctaatgggcgtgagagagctctgcacacggcaccaggtgttgttcatcgcagatgagatccagactggactggccagaacaggccgttggctggccgtagattacgagaacgtgcgacccgacatcgtgctgctcggcaaggcactaagtggagggctgtatcccgtctctgccgtcctgtgtgatgatgacatcatgctcactattaaacctggtgaacacgggtctacctacggcggaaaccctcttggatgccgggttgctatcgctgcccttgaggtgcttgaagaggaaaacctggctgagaatgctgataagcttggaatcatccttcggaatgagttgatgaagctgcctagcgatgtggtcacagccgtccggggaaagggactcctgaatgccattgtgatcaaagagacaaaggactgggacgcctggaaagtgtgtctccgtctcagagataacggactcctggccaaaccgactcatggtgacatcatccgctttgcccctccgctggttatcaaggaggacgagcttcgcgaaagcatcgaaatcatcaataagacgattctgagcttctag

SEQ ID NO: 233628 - DNA, 906 bp, Artificial Sequence
  Description of Artificial Sequence: Synthetic coding sequence
atgaacaccggagttgaagctggcgagactgcttgcaagcttgctagaaagtgggggtatactgtgaaaggtattcagaagtataaagcaaagatcgtgtttgccgcaggaaacttttggggtcggaccttgagcgctatttcatccagcaccgatcctactagctacgatgggttcggaccgtttatgcccggattcgacatcatcccctacaatgatctacccgcactcgagcgtgcactgcaagatcccaacgtagctgcctttatggtggagccaatacagggcgaggctggagtggtcgtgcccgatccaggttatctcatgggggtccgtgagctttgtacgcgccaccaggtgcttttcattgccgacgagatacagacaggcctggcacgcaccggcaggtggctcgcggtggattacgagaatgtccggccagacatcgtcctgctgggtaaagcactgtccggaggcctctaccccgtctctgccgtgctgtgtgatgatgacatcatgcttactatcaaaccaggcgaacacggatccacttacggcggaaacccattaggctgtagggtggcaatcgccgcacttgaagtgttggaagaggagaatcttgcagaaaacgctgataagttgggcatcatattgcggaatgaactcatgaaattgccttctgatgtggttacagctgtgaggggcaaagggctgctgaacgccatagtgattaaagaaactaaggactgggacgcgtggaaggtctgcctacgcctgagagacaacggcttgcttgctaagcctacccacggggacatcattaggtttgcaccaccactggtgattaaggaagacgagctgcgggagagtattgaaatcattaacaaaaccatcttgagtttctag

SEQ ID NO: 233629 - DNA, 405 bp, Artificial Sequence
  Description of Artificial Sequence: Synthetic coding sequence
atgaaggcttttagcccagttcgaagcgtccggaaaaactccctgtcagatcactctctcggaatcagtaggtctaagacccccgtcgacgatccgatgtcactgctgtataacatgaacgattgttattccaagctgaaggagttggtcccatccatcccacagaacaagaaggtgtccaagatggaaatcctgcagcacgttatcgattatatcttagatcttcaaatcgctctggattcccaccctaccatcgtaagccttcatcatcagagacccggacaaaaccaggcctcccgtacacccttgaccaccctgaacaccgatatcagcattctttcgctccaggcgtctgaattcccttctgagctgatgtcgaatgattcaaaagctctgtgcgggtag

SEQ ID NO: 233630 - DNA, 1386 bp, Artificial Sequence
  Description of Artificial Sequence: Synthetic coding sequence
atgaataattttgggaatgaggaatttgactgtcacttcttagatgagggattcacggcgaaagatatcctggatcaaaagataaatgaggtgtccagtagtgacgataaggacgcgttttatgtcgctgatctaggagacatcctgaagaaacacctgcgctggctgaaggctctgcctagggtcacaccattctatgcggttaagtgtaatgacagcaaggccattgtgaagactttggccgctaccgggactgggtttgattgcgcttccaaaacagaaatccagctggtccagagcttgggagttcccccagaaaggattatctatgcgaacccttgcaagcaagtatctcagattaagtatgctgccaacaacggagtgcagatgatgacctttgacagcgaggtggagctgatgaaagtggcacgggctcatccaaaggctaagctggtccttagaatcgccactgatgactcgaaggctgtatgcaggctctcagttaaatttggcgcaacattgcggacttcacggctgttgctggaaagagctaaagaattgaacattgatgtcgtcggcgtatcatttcacgtgggctctggatgcactgatcccgaaacctttgtccaagccatatccgacgcgcgatgcgttttcgatatgggagctgaggtgggattttcgatgtaccttcttgatatcggtggaggcttcccgggttccgaagatgtgaagctaaagtttgaggagattaccggtgtgattaatccagccctggacaaatactttcctagcgacagcggtgtcagaattatagccgagcccggacgctattacgtggccagcgctttcacactcgcggtgaacatcatcgcaaaaaagatcgtactgaaagagcaaacaggaagtgatgatgaagatgagtccagcgagcagacattcatgtattacgtgaatgacggggtgtacggtagcttcaattgcatcctgtatgaccatgctcacgtaaagcccctgctgcagaaacggccaaagcctgatgagaagtactatagctcaagcatatggggccctacttgcgacgggctcgatcggattgtggagcgctgcgaccttcccgagatgcacgtgggggactggatgctctttgagaacatgggcgcttacactgtggcagcagctagcacctttaatggctttcagcgtcctacaatctattacgtcatgtccggcccagcctggcagttaatgcagcagttccaaaatcccgactttccaccggaagtggaggaacaggacgcaagcactctgcctgtctcatgtgcttgggagtctggcatgaagcgacacagggcagcttgcgcaagtgcaagtataaacgtatag

SEQ ID NO: 233631 - DNA, 207 bp, Artificial Sequence
  Description of Artificial Sequence: Synthetic coding sequence
atgaacaatttcggtaacgaggagttcgactgccattttcttgatgaagggttcacggccaaggacattctggaccaaaagatcaatgaggtttcctcgtccgacgacaaggatgccttctacgtggctgacttgggtgatatcctcaaaaagcacttaagatggcttaaagctttgccacgggtcaccccattctatgccgtctag

SEQ ID NO: 233632 - DNA, 927 bp, Artificial Sequence
  Description of Artificial Sequence: Synthetic coding sequence
atgatgacttttgattctgaagtggagctgatgaaagtcgccagagctcaccctaaggccaagctcgtcctcagaattgccacggatgactccaaggctgtgtgtagattgagcgtcaagtttggtgccacactgcggacatccaggctgcttctcgagagagccaaagagttaaacattgacgtagtgggcgttagcttccacgtcggctctggttgtaccgacccagagacattcgtgcaggccatttccgacgcacgctgtgtgttcgacatgggtgccgaggttggctttagtatgtatctactcgatataggtggtgggttccccggtagtgaggacgtcaaactgaaattcgaggaaatcacaggagtgataaacccagccctggacaaatactttccttcagatagtggcgtgagaataattgctgaaccagggagatactacgtggcctccgccttcacgcttgcagttaacataatcgccaaaaagatcgttctgaaggagcaaaccggcagcgacgacgaggatgagtcaagcgagcagacctttatgtactatgttaacgacggtgtgtacggatcattcaattgcatcttgtacgaccatgcacacgtgaaacccttactgcagaaaaggccaaaacctgacgagaagtactattccagctccatatggggaccaacatgcgacgggctggatcgcatagtggaacgttgtgaccttcctgagatgcacgtaggcgactggatgctgtttgagaacatgggcgcttatactgtggcagccgcatctacctttaatggttttcaacggccaacaatctattacgtcatgagcgggccagcctggcagttaatgcagcagttccagaacccagattttccaccctgcttgtgtctcgtccctggcagagtcggctag

SEQ ID NO: 233633 - DNA, 684 bp, Artificial Sequence
  Description of Artificial Sequence: Synthetic coding sequence
atggtcaagagcagtttgcagcgcattctgaacagtcattgtttcgccagagagaaggagggagataaaccaagcgccactatccacgcgagtcgaaccatgccgctgctctccctgcacagccgcggaggatctagcagtgagtcttctagagtctcgctccattgttgttcaaatcctgggccaggcccacggtggtgcgacgctccccatccccctttgaagattcccggtgggcgagggaatagtcagcgggatcacaatctctcggccaatctgttctattccgatgacagactcaacgtaacagaagagctgacttcaaacgacaagaccagaattttgaatgtgcagagtaggcttaccgatgccaagcgaatcaactggagaaccgtactgtcagggggatccctatatatcgaaataccaggcggtgcgctccctgaaggtagcaaagattcattcgccgtgctgctggagttcgctgaagaacagctacgtgcagatcacgtgtttatctgctttcacaaaaatagagaggaccgggcagcactgctgcggacattctcttttttggggttcgagatagtgcgaccaggccaccccttagtcccaaagagacctgatgcctgcttcatggcctatacttttgaaagagagtcaagtggggaagaagaggagtag

SEQ ID NO: 233634 - DNA, 831 bp, Artificial Sequence
  Description of Artificial Sequence: Synthetic coding sequence
atgtggatcacatccctgatcaccatgaaagacgaggacatttttgatctggctggagatccacaagactcccttattcctggacctagtccaacacctaagcagaacccagtgtgtaatgaagccttttttgggcatcagacgtttagcctgagagaaaccgggctcaagtccgtccattgccagggccaagaggctgaaaacatggagagggaaaagttccagcagaaggctcttaaacagacgaaacagaaaaagtctaagagtgccgagtttttgatggtgaaagaggatagggaagcaaccgagggtaccggcaaccccgcttttaacatgtcatctcctgatctaagtgcatgccagaccgcagaaaaaaaagttattcggcatgatatgccggacagaacccttgctgcacaccagcaaaagtttcggcttcccgctagcgcagagccaaaggggaatgagtatgggcgtaattattttgacccactgatggatgaggagattaatccacgccaatgtgcgactgaagtgagcagggaagacgaaagcggaagggaagagacgctgaattcggaagcacccggatcgtctaacaaaagccacgaaattcataaggaagccagtgaggcgaccacagcccacttagaggaattccagcggtcccagaagacaattatactgctgggtagcagtcccctggagcaggaaataaggagcacgtcactgcattgtatggaggatgaaatgtcccatccctggattcttctgctgaaggtgactgctgtgattagatctaggcgatattacagggagcagcgattctag

SEQ ID NO: 233635 - DNA, 1443 bp, Artificial Sequence
  Description of Artificial Sequence: Synthetic coding sequence
atggaacgagagaagtttcagcaaaaggccctaaaacagacaaagcagaaaaaatccaaatccgcagagtttctgatggtgaaggaggaccgcgaagccacagaaggaacaggtaacccagccttcaacatgagtagccccgacttgagcgcctgtcaaaccgccgaaaagaaagtgattcgccatgatatgcccgaccggacactggctgcacaccagcagaagtttcggctcccagcaagcgccgaaccaaaaggcaatgaatatggtagaaactacttcgacccgctgatggacgaagagattaaccccagacagtgcgccacagaggtgagtcgggaggtgtgtttaatggcaaagggggagaaagcagagagcggagtagacaacacggcagggttgagcgagaaagagacacaaaaaaatcccagggcgccaatggatgaagccgatgtgaaatctgctgcgcattcttcgcaaggttctatccctaagaaaattggcccttgcagtatggactatgacccgaatttattggaggaagacgatgagctccactctcaaggcgatagtctaaccgatcatagtgtgaagggtaagagcacagtgtggaggataggtgaggctgaagattatagccaggatattagttatctagaggagctcgaagaacaccgattcagcgtctgctgttccagcgtagccgatagccggtatggcgacttcttcaagcacctgcacttcgtcctggtgtccgcaagctctgagctccagctaagccagtggcagtcccaggggttttggtacattatccttttaatgttcttcttatggtttcttcgattgtatctgcactatctgggacaatggctgtttctgcaggcaattagcaccccggtgaccaagtttcatttctcactgcacatcgtggaactctgctaccccaccagtagtctccacattggggaggagctgccagtcgttgtgatggggcctctgatgctcaatgcaatactgttgctgctggtgctgatcaggtggggatgtcagctgctgtttgcgagctgtccagacgtcttaagcaagctcatcataacaatgggattgtggacaattttagatccactcgcagtgtttattctggacactttgctggggaggctaaccgataacgaagaaactcctgtagccgatgccgctaagttatattggatgtttgtacgcacagtccagccagggatactaggagtcgtgattacggtactgctatacatcctcctattcgtgatcagcagcctgatactttacttgtactgccttcgccttcacaatgactcttggatcttggatgcttttcagcgcatccattcagaggaaaccaagttttttatcccttatgacttggaaatctcaaaccaggagctaagttacatagtgaagtag

SEQ ID NO: 233636 - DNA, 606 bp, Artificial Sequence
  Description of Artificial Sequence: Synthetic coding sequence
atggccctgtcctgggtactgacggtcttgtccttgctgccgctgctcgaggcacagatacctctgtgcgccaacctcgtaccagtgccaattacgaacgcaactctggataggattacgggtaagtggttttatatcgccagcgcattcagaaacgaagaatacaacaaatctgttcaggaaattcaggctacgtttttctacttcacacctaacaagaccgaggatacaatcttcctcagagagtatcagacaagacaggatcagtgcatatataataccacatacctgaacgtgcagagagaaaatggcacaatttcaaggtacgttggcggacaggaacactttgcccacttactcatcttaagagataccaagacatacatgctggcttttgacgtgaacgatgagaaaaactgggggctttccgtctacgctgacaagccagaaacaaccaaagaacaactgggcgaattctacgaagccctcgactgtcttaggattcccaagtccgatgtagtttacactgattggaagaaggataagtgtgagcctctggagaaacagcacgaaaaggagaggaaacaggaagaaggggagagttag

SEQ ID NO: 233637 - DNA, 585 bp, Artificial Sequence
  Description of Artificial Sequence: Synthetic coding sequence
atggcactatcgtgggtgctgaccgttctgagtctgctgcccctcctggaggcccagatcccgctgtgtgctaatctggtgcccgtgccaattaccaacgctaccctcgatcgggtgtcagcatgggcatcccctgtcctctcaacatgggccgctgcctctctgctgtgggcgagtctttctctgctggcagtcgtcggaccccctctgccggctctaccattttccttgctggggcctcaaggcgagatcctgacttctcctggagattcagggggaacaccgtgtttacagactcagaaaccacattgcagagtactgcacgggggacggttctgcgctggacctgggggagctgcctggggggctatgacagacccccagggcgaattattacacgcccattgtcctcctggcgctagttcccctcaccttcagaaccagggcgagatctgcctttcactcctgcccgcagactcacagcggttctcaattaaaccaccttcgcccgctcccacatttagtcccgatcactggcaggttgtgctgtatagaattggacttagcaagagaggggtacaatag

SEQ ID NO: 233638 - DNA, 585 bp, Artificial Sequence
  Description of Artificial Sequence: Synthetic coding sequence
atggccttgagctgggtactgacggtgctttccctgctgcctctccttgaggctcaaattcctctctgcgccaacctggtaccagtgccaataaccaacgcgacactcgacagagtgagtgcctgggccagccctgttctctccacatgggccgctgctagtctgttgtgggcttctctgtacctactggctgtggtggctcccccacttccagcactgccattcagcctgttgggcccacaaggggaaatcctgacatccccgggagattctggaggaactccttgtctgcaaacgcagaagccccattgtcgagtcctgcatggtggaagattttgtgctggtcccggaggagctgcttggggtgccatgacagaccctcaaggtgaactcctacatgcccactgccctccaggcgctagctcccctcatttgcagaatcagggggaaatatgcttgtctctgttaccagcagattctcagcgctttagcattaagccacccagcccagctcctccgtttagcccagaccattggcaggtggtcctgtaccggatcggactatctaagcggggagtgcagtag

SEQ ID NO: 233639 - DNA, 606 bp, Artificial Sequence
  Description of Artificial Sequence: Synthetic coding sequence
atggcactctcgtgggtccttactgtgctgtctttgttaccactcctagaggcacagatcccgttgtgtgcgaatcttgttccagtgcccataaccaatgccaccttggacaggatcacggggaaatggttctacatagcgtccgcattccggaatgaggagtacaacaaaagcgtgcaggaaatccaggctacattcttctatttcacgccaaacaagactgaagataccattttcctgcgcgagtaccagacacggcagaatcagtgcttttacaacagctcttacctgaatgtgcagagagagaatgggaccgtgagccgctacgagggaggaagagaacacgttgcccacttgctgtttctacgagataccaagactctaatgttcgggtcctacctcgacgacgaaaagaattgggggctgtccttctacgccgataagcccgaaacgaccaaggagcagctaggtgaattctacgaggctctggactgtctgtgtattccaagaagcgatgtgatgtatacagattggaagaaagataagtgcgaaccgttggagaagcagcacgaaaaggagcggaagcaggaggaaggcgaatcatag

SEQ ID NO: 233640 - DNA, 1065 bp, Artificial Sequence
  Description of Artificial Sequence: Synthetic coding sequence
atgatgtcttacttgaagcaaccgccttacggtatgaatgggctggggctggcaggacccgctatggatctcttgcatccttcggtgggataccccgcaactccccgaaagcagcggagagaaaggaccaccttcacacgaagccagctggacgtactagaggccctgtttgccaagacgcggtaccccgatatttttatgcgagaggaagtggctctcaaaatcaatttgccagaatccagagtgcaagtctggttcaagaatagacgcgctaaatgtagacagcaacagcagagcggctctggaacaaagagtagaccggcaaagaaaaagtcatcccctgttagagaatcttccgggtcagagtcttccggacagttcacaccacccgctgtctccagctccgctagtagttcatcttccgcatcctcatcgtccgccaatcccgctgccgctgccgcagctggcctgggcggaaacccagtcgccgcagcaagctccctgtccacacccgcagccagctcaatctggagtcccgcttccatttcccccggaagcgcaccagcgtctgtctcggtgcctgagccactggcggcaccatccaacacatcatgcatgcaacgttctgtcgcggctggggctgcaacagccgctgcatcatacccaatgagttacgggcaggggggttcctacgggcaaggctatccaacaccatcatccagctattttggtggagtcgattgcagtagctacctggctccgatgcattcccatcatcatccccatcagctgagtcctatggccccatccagtatggctgggcaccaccaccaccatcctcacgctcatcaccccctgtcgcagagtagcggacaccatcaccatcaccatcatcatcaccaccagggatacggcggatcaggactggcattcaattctgccgattgcttggattataaagagcctggggctgctgctgcctcaagcgcatggaaactgaacttcaactctccagattgcttggattataaggatcaagcatcctggcgttttcaggtactctag

SEQ ID NO: 233641 - DNA, 1065 bp, Artificial Sequence
  Description of Artificial Sequence: Synthetic coding sequence
atgatgtcctaccttaaacagcccccatatggaatgaacggcttgggactcgccggtccagcaatggatttgttacacccatcagttggataccctgccaccccacggaagcagagaagagagagaactacctttacacggtcccagctggacgtgctggaagcgctgtttgccaaaacccgatatcctgacatctttatgagagaggaagtcgccctaaaaattaatctgcctgagagtagggtacaggtctggtttaagaaccgcagagccaaatgccgacaacagcaacagagcggctctggaactaaatctaggcccgcaaagaagaaaagttctccagtcagggagagttcaggttctgagtcctcaggacagtttacaccacctgctgtgtcttcctcagctagcagttcctcctccgcgtcttcgtcatcagcaaatcctgcagccgctgccgctgccggactaggaggcaatcctgtagccgctgccagcagtttatccacgcctgccgcaagctccatatggagcccagccagcatatcccctggctctgcaccagctagtgttagcgttcccgaacccttggccgcaccatccaacacctcctgcatgcagcgaagcgtggccgcaggcgcagctaccgcagcagcaagctatccgatgagctacggccagggaggatcctacggccaagggtatccaactccttcctcatcctacttcggcggtgtcgattgttccagctatctggcaccaatgcattcccatcaccacccccatcagctcagccctatggcaccaagcagcatggcaggccaccatcatcatcacccccatgcgcaccaccccctctctcagagcagcggacaccaccatcaccatcaccaccaccaccatcagggatatggtggttccggtctcgcctttaattcggctgattgcctagactacaaagaacctggagccgcagctgcgagcagcgcttggaagcttaacttcaattctcctgactgtctggattataaagaccaggctagttggcgattccaggttctctag

SEQ ID NO: 233642 - DNA, 894 bp, Artificial Sequence
  Description of Artificial Sequence: Synthetic coding sequence
atgatgtcataccttaaacagccgccttatgcagtcaacgggctgagcctgacaacaagcggtatggacctgctgcacccgtcagtgggttacccaggcccttgggcatcttgccccgcagcaaccccccgtaagcagcgtagagaaagaactactttcactagagcacagctagatgtcttagaggcactatttgcaaaaactcggtatccagacatctttatgcgcgaagaagttgccctgaagataaacttacccgaatcccgcgtccaagtgtggttcaaaaatcgccgagctaagtgccgccagcagcaacagcagcaacagaatggcggtcagaacaaggtacgcccagccaaaaagaaaaccagtcccgctagagaggtgagctcagagtctggcacaagcgggcagttcactcctccttcctccaccagtgtcccaactatcgcatcgtcctctgccccagtgtcaatttggagcccagcctcaatttctccacttagcgatccattaagcacttcatccagctgcatgcagcggagttatcctatgacatacacccaggcatctggctatagccagggctacgctggaagtacatcttacttcggcggaatggattgcggatcttatctgactcccatgcaccaccaactgccaggcccaggagcaaccctttcgcctatgggcaccaacgccgttacatctcacctgaatcagagccccgctagtctgagtacacagggttacggggctagcagcctgggctttaattccacaactgattgcctcgattacaaggatcagacagccagttggaagcttaacttcaacgctgactgtcttgattataaagatcagaccagcagttggaagtttcaggtcctctag

SEQ ID NO: 233643 - DNA, 870 bp, Artificial Sequence
  Description of Artificial Sequence: Synthetic coding sequence
atgatgtcctatcttaagcagcctccgtatgcagtgaacggtctctccctaaccactagcgggatggacctgcttcacccaagtgtgggttaccccgctactccacggaagcagcggagagaacggactacttttacgcgggcacagctcgatgtgctagaggcactattcgccaaaactaggtacccagatatctttatgcgggaggaggtggccctcaagatcaacctgcctgaatccagggtccaggtgtggtttaagaacagacgtgcaaaatgccggcagcagcaacagcagcagcagaacggagggcagaacaaggtgcgcccagcaaaaaaaaagacaagccctgctcgagaggtttcatctgaaagcggaacatccggccagttcacacctccatcttcaacgtctgttcctaccattgcaagctcaagtgcacccgtatcaatttggagcccggcatccatctcccctctgtctgaccccttatcaacaagcagcagttgcatgcagaggagttatccaatgacgtacacacaagcgtcaggatattcccaaggatatgccggatctactagctactttgggggtatggactgcggctcatatctcacacctatgcaccatcagttgcctggtcccggagcaaccctgagcccaatgggtacgaatgcagtcacatcacaccttaatcaaagtccggcaagtctaagcacccagggttatggcgctagtagcctcggttttaatagtaccacagattgccttgattataaagaccagacggcatcatggaaactaaatttcaacgcagactgccttgattataaggatcagacatcctcttggaagttccaggttctgtag

SEQ ID NO: 233644 - DNA, 720 bp, Artificial Sequence
  Description of Artificial Sequence: Synthetic coding sequence
atgatgagctacctcaaacaaccaccatacgctgttaatggcctcagcctcactactagtgggatggacctgctgcaccctagtgtggggtacccaggcccatgggccagctgcccagccgcaactcctagaaaacagaggagggagcgcactacattcactagggcccagctggatgtgctggaagcactatttgcaaagactcgctatcctgatatcttcatgcgcgaagaagtcgctctcaagattaacctcccagagagccgcgtccaggtctggtttaagaaccggagagccaagtgcagacagcagcagcagcagcaacagaatggtggtcagaataaagtccgacccgctaaaaaaaagacctcaccagccagagaggtgtcctcagagagcggaacaagcgggcagtttacacccccttcctccacttctgtgccaaccatcgcatcttcctctgcgcctgtgtccatatggtcccctgcttctatcagccccctttcagatcctctctcaacgtctagctcctgtatgcagcgatcgtaccctatgacctacacccaagcatctggatatagccagggttatgccggatcaacctcatattttggaggtatggactgcgggtcttacctcaccccgatgcatcaccagctgccgggacccggagccaccctgagccccatgggtacaaacgccgtgacttctcatctttag

SEQ ID NO: 233645 - DNA, 870 bp, Artificial Sequence
  Description of Artificial Sequence: Synthetic coding sequence
atgatgagctacctgaaacagccaccatacgccgtgaacggcctctccttgaccacttccggaatggatctgctgcatccatcggtgggatacccagctacccctcgcaaacagagaagagaaagaacaacattcaccagggctcagctggacgtccttgaggccctgttcgccaaaaccagataccccgacatctttatgcgtgaagaggttgcattgaaaatcaacctccccgaatccagggtgcaagtttggttcaaaaataggcgagctaagtgtcgccagcagcagcagcagcagcagaacggcggacagaacaaggttcggccagcaaaaaagaagaccagccctgcaagggaagtttcctccgagagtggcacttcaggacaattcacccctccaagctcaactagtgtgccaaccatagcaagctcaagcgctcctgtgagcatctggagccccgcaagcatctctcctctttcagatccgctgtccacctcgagcagctgcatgcagagaagctacccaatgacctacacccaggcaagtggctacagccagggctacgcagggagcacctcctattttgggggaatggattgtggcagctacctgacaccgatgcatcaccagctgccaggtcctggggcaacactaagccccatgggaacaaatgccgtgacgtcccatctcaatcagtcccctgcaagcttgtcaacccaaggttatggtgctagcagtctgggtttcaactcgacgactgactgtctcgactacaaggaccagactgctagttggaaactgaattttaatgccgactgtctcgattacaaggaccaaacaagtagctggaagtttcaggtgctttag

SEQ ID NO: 233646 - DNA, 492 bp, Artificial Sequence
  Description of Artificial Sequence: Synthetic coding sequence
atgatgagctacctcaagcagcctccatacgctgtcaatggactgtctctgacgaccagcggaatggatctcctccatccaagcgtcggataccccgctaccccacgaaaacaacggagagaaagaactactttcaccagggcccagctagatgtgcttgaggccctcttcgctaagacaaggtatcctgatatctttatgagggaagaggtggcattaaaaatcaatctgccggagagccgggtccaggtatggtttaaaaaccgccgtgcaaaatgcagacagcagcaacaacagcagcaaaatggcggacagaataaggtcaggccggcaaaaaagaagactagtccagcaagggaggtaagttctgagtccggcacctcggggcagtttacccccccttcctctacttccgtccccactatcgcaagtagcagtgcaccagtgagcatttggagtccggcaagcatcagccctctcagtgatccttag

SEQ ID NO: 233647 - DNA, 978 bp, Artificial Sequence
  Description of Artificial Sequence: Synthetic coding sequence
atgctgtctcacgcagatttactcgatgcccgtttaggcatgaaggacgccgctgagctgttaggccatcgggaagcggttaaatgccggctcggcgttggcggatctgatcctgggggacatccgggagatctggcacctaacagcgaccctgtggaaggggctacattgctgccgggagaagacattactaccgtgggatcaacacctgcctctcttgcggtttctgccaaagatccagacaaacagcctggccctcaagggggacctaacccttctcaggcaggccagcagcaggggcagcagaaacagaaaagacatcgcactcgatttacgcccgctcagcttaacgagctcgagaggagctttgcgaagacccattaccccgacatctttatgcgcgaggaactcgccctgcgtatcgggttgacagaaagtagagttcaggtttggtttcaaaatcggagggctaagtggaaaaagcggaaaaaaaccacgaacgtgtttcgcgctcctggcactctgctgcccacacctggactcccccagtttccaagcgcagcggctgcagccgcagccgcaatgggcgactccctctgcagcttccacgccaatgacactcgctgggccgcagcggcaatgcctggtgtgtctcagctcccgttgccgcctgcgctaggacgtcagcaggctatggctcagagcctgtcccaatgttcccttgccgcaggaccccctcccaactccatggggctctctaacagtctggccggtagtaatggtgccggactgcagagccacctgtatcaaccagccttccctggaatggtgccagccagccttcccggaccttccaatgtctctgggtccccccagctgtgcagctcacctgattccagcgacgtctggcggggaacctcaatcgcttctcttagaagaaaggcgctggaacacactgtctccatgagcttcacgtag

SEQ ID NO: 233648 - DNA, 912 bp, Artificial Sequence
  Description of Artificial Sequence: Synthetic coding sequence
atgggtatagtgcagatctgtaagggggagtatttctggttagagcccaaaaacgcgttcgaaaatttccaggagcctgatattgggctggtggcactggccttccttcagggaagttttgcctatgggggttggaactttttgaactatgtgacagaggagctggtggatccctacaaaaacttaccgagggctatttttatttccatacctcttgtcacattcgtctacgtatttgcgaacgttgcctacgtaactgcaatgtctccacaggagcttctggctagcaacgccgttgcagtcacatttggggaaaaactgctcggagtgatggcctggattatgcctatatctgtggctctgtcaaccttcggtggggttaacggaagtttattcaccagcagcagactgtttttcgctggggctcgtgagggccacctgccttccgtgctcgctatgattcatgtcaaaagatgcacacccatacccgctctgttgtttacttgcatttctactctcttgatgctcgtgacatccgatatgtatacccttattaactacgtggggtttatcaactatttgttctatggcgtgactgtggccggacagatcgtactgagatggaaaaaacccgacatccccagacccattaaaataaatctcctcttcccaataatatacctcttgttctgggcattcttactcgtgtttagtctttggtctgagcctgtggtctgcgggatcgggctggcaattatgctgacaggcgtgcctgtgtatttccttggcgtctactggcagcacaaaccaaagtgctttagcgactttattgagttactgaccttggttagccagaagatgtgcgtcgtggtgtacccggaagtggagggcctccgtgaccgcggtggttag

SEQ ID NO: 233649 - DNA, 861 bp, Artificial Sequence
  Description of Artificial Sequence: Synthetic coding sequence
atggccctggtactgattctgcagctgctgaccctctggcctctatgccatactgacattactccatccgttgccatcatcgtcccccctgcaagttatcaccctaaaccttggctcggcgctcagccagctacagtggtgacaccaggagtcaacgttactctaaggtgcagggcaccacagccggcatggcgattcggtctgtttaaaccgggagagatcgcgccactcttatttagggatgtgagctcagaactcgctgagttcttcctggaagaggtcaccccagcacagggtggcatctatcgttgctgctatcggcgtccagactggggaccaggggtgtggagccagccctcagatgtcttagaattactcgtgactgaggagctcccacggccttctctagtggccctgcctgggcctgttgttggaccaggagctaatgttagcctgaggtgcgctggtcgcctgcgtaacatgagcttcgtcttatatagggaaggcgtcgccgctcccttacagtatagacatagtgcacagccttgggccgattttaccctgctgggggctagggctccagggacttattcatgctactatcacacccctagtgccccttacgtgctgtctcagagatcagaggttctggttatcagttgggaaggcgagggcccagaagcccgacccgcttccagcgctcccggtatgcaggcgccaggccctcccccaagcgaccccggagcccaggctccgtcccttagctcattccgtccaagaggactggtccttcagcctctcttaccccagactcaagattcttgggatcccgcaccccctccatccgaccccggtgtgtag

SEQ ID NO: 233650 - DNA, 849 bp, Artificial Sequence
  Description of Artificial Sequence: Synthetic coding sequence
atggcgctcgtcctcatcttgcaactgctgactctttggccactttgccacacagacataactccttctgttccaccggctagctatcatcccaagccttggctgggcgcacaacctgccacggtggtaacgccaggtgttaatgtcacgctgcgctgcagagccccacagccagcatggcgctttgggctatttaagcctggggagatcgctcctctactgttccgggatgtgtcttcagagctggccgagttcttcctggaggaagtgacacccgcacaggggggaatatacagatgctgctacagacgccctgactggggcccaggggtttggtcccagcccagtgacgtgttagaactgctggtgactgaggagctgcccaggccatctctcgttgcacttcctggccctgtggtaggcccaggcgctaacgtctcccttcgttgtgccggtcgactacggaacatgtctttcgtattatatcgtgaaggcgtggcagccccactccagtatcgccatagcgcacagccgtgggctgatttcactctcctgggcgctagggccccagggacatattcctgctactaccatacgcccagtgctccatatgtgttaagccaaagaagcgaagttctcgtgatatcatgggaaggcgagggcccagaggcccgacctgccagttccgcgccaggaatgcaagctccgggtccccctccaagcgatcctggcgctcaggctccttccctgtcaagttttcgccctcgtggacttgtcttgcaacccttacttccccagactcaagacagctgggaccctgcacctccaccctctgatcctggcgtctag

SEQ ID NO: 233651 - DNA, 759 bp, Artificial Sequence
  Description of Artificial Sequence: Synthetic coding sequence
atggcattggtgcttatcctgcagttattgaccctcttcccaccagcctcatatcaccctaaaccatggttaggagcacaaccagccacagtagttacacccggagtgaatgtgacactccgctgtcgcgctccacagcccgcatggcggtttggtctgttcaaacccggtgaaatcgctcctttactgtttagagatgtaagttctgaattagccgagtttttcttagaagaggttaccccggctcaaggcggaatctaccggtgctgctacagacggccagattggggtcccggtgtctggtcacagccaagtgacgtgctggagctgcttgttaccgaagagctcccaagaccttctctggtggcactgccaggcccagtggtgggcccaggtgccaacgtctcactcaggtgtgcagggagactccggaacatgtcatttgttctctatcgagagggcgtagcggctccactgcaatacagacactccgcccagccttgggccgattttaccctgctgggagcacgcgctcctggtacctactcttgctactaccacactccatccgcgccatacgtcctgtcccagcggagcgaagtccttgtgatctcctgggaggattccgggtcttccgattatacgcggggtaacctggtgagactgggtctggctggcctggtccttattagcctcggagccctggtgactttcgactggaggagccagaatcgggcacctgccggtatccgcccttag

SEQ ID NO: 233652 - DNA, 804 bp, Artificial Sequence
  Description of Artificial Sequence: Synthetic coding sequence
atggctctcgtcctaattttgcagctcctgactctgtggccactatgccatacagacattaccccttccgtcgccattattgtgcccccagccagttatcaccccaagccctggttaggtgcccaacctgctactgtagtcacacctggggtcaatgtcacgctgagatgccgcgctcctcagcctgcctggaggtttgggttgtttaagcctggggaaattgctcccttactgtttagagatgtgtctagtgagctggccgagttttttctggaagaagttacacctgcccagggcggtatttatcgatgttgttaccggagacccgattggggtccaggcgtgtggtcgcagccctcagacgtgctcgagttgttagtgactgaggaactgccaaggccctctttagtggctctgcctgggccagtcgtgggtcccggagccaacgtttccctacggtgcgctggtcgtctccggaacatgagtttcgtgctgtacagggagggggtggccgctcccctgcagtatcggcatagcgcccagccttgggcagacttcaccctactgggagccagggccccaggcacttactcatgctactatcacaccccctcagccccatatgttctgtcccagcggtctgaagttctggttatttcttgggaggactccggctccagcgattacacccggggaaacctggttcgcttaggactggctggcctcgtactgatctcgctcggtgcccttgttaccttcgactggcgaagccaaaatagagcgccagctggaattagaccatag

SEQ ID NO: 233653 - DNA, 792 bp, Artificial Sequence
  Description of Artificial Sequence: Synthetic coding sequence
atggcccttgtcctgatcttgcaactgctcacgctctggccactatgccacacagacatcacaccctcagtgcctccagcttcgtaccaccccaagccttggctaggggcacaacctgccacagtggtgaccccaggggtgaatgtgacactcaggtgtagagctccgcagccagcttggagattcggactgtttaaacccggagagatcgctcctttactgtttcgcgacgtctcatccgagctggccgaatttttcctggaggaagtgactcctgctcagggaggaatctatcgttgctgctaccggagaccagactggggacccggagtgtggtctcagccaagtgacgtgttagaactgttagtcacggaggagcttcctcggccatcacttgtggcccttccaggtcctgtggtgggacctggcgcaaacgtaagtcttagatgcgcagggagactgcgaaacatgagtttcgtgctataccgggagggcgtggctgctccacttcagtatcgccacagcgcgcagccatgggccgactttaccctgctgggagcccgagccccaggaacctattcttgctactatcacacacctagtgctccgtatgttctttctcagcggagtgaggtgctggttattagctgggaggattccggaagctctgactatacacgaggtaacctagtccgcctcggactcgcaggactggtgttgattagcctcggcgcattggttaccttcgactggagatcacagaaccgcgctcctgcaggtatccgtccgtag

SEQ ID NO: 233654 - DNA, 645 bp, Artificial Sequence
  Description of Artificial Sequence: Synthetic coding sequence
atgagtaagcctcctcccaagccagtaaagccaggccaagttaaggtgtttcgggctttgtataccttcgagccgcgaactcccgacgagctgtacttcgaagaaggcgacattatatacatcacagacatgagcgacactaactggtggaaaggcaccagcaaaggtagaaccgggctaatcccttctaactacgtagctgaacaagctgaaagtatcgacaatcctctccatgaagccgcaaagcgaggtaacctgtcatggttacgagagtgccttgacaatagagtaggggttaatgggttagataaggccggtagcaccgccctgtattgggcttgtcacggaggtcataaagatatagtggaaatgctgttcactcagccaaacattgaacttaatcagcaaaacaaactcggagacaccgccttacatgctgccgcatggaagggatacgctgatatcgtccagctcttgctcgctaagggggcaaggacggaccttcgtaatattgagaagaaacttgctttcgatatggctactaatgctgcatgtgcaagcttactcaagaagaagcagggcaccgatgctgtcagaacgctgagtaacgctgaggactacctggacgacgaggactccgactag

SEQ ID NO: 233655 - DNA, 897 bp, Artificial Sequence
  Description of Artificial Sequence: Synthetic coding sequence
atgaaaacccttcagtcaacacttctgttgttactgctggttcctttaatcaagcccgctccaccaacgcagcaggactctcgcattatttatgactatggaactgacaatttcgaagaatcaattttttcccaggactatgaggataaatatctggacggtaaaaatataaaagaaaaagagactgtaatcataccaaacgaaaagagcctgcagctgcagaaggacgaggcaatcacacctctgccaccaaaaaaggagaatgacgaaatgccaacctgtctcctctgcgtatgtctcagtggcagtgtatattgcgaggaggtggatatagacgcggtccctcccctgccaaaagaatccgcttacctgtatgcacgatttaataagattaaaaagctgacggctaaggactttgcagacatcccgaatcttcggaggctggacttcaccggtaatctgatagaggacattgaagacggaaccttttcgaagctgagcctcctcgaggaactgtcactagcagagaatcaactcctgaaattgcctgtgctgcccccaaagctcaccctttttaatgcaaaatataataaaatcaagagccgaggtatcaaagctaatgctttcaaaaaactaaacaatctgacattcctgtatctcgaccacaatgccctggaatctgtgcctctgaatcttccggagagcttgcgggtcatccaccttcagtttaataatatcgcaagcattacagatgatacattctgcaaggcaaacgacactagttacatccgggatcgcattgaggaaatccgactcgaaggcaaccccatcgttctgggcaaacatcctaactcatttatttgcctgaaacggctgcctatcgggtcatacttttag

SEQ ID NO: 233656 - DNA, 897 bp, Artificial Sequence
  Description of Artificial Sequence: Synthetic coding sequence
atgaaaactcttcagtccaccttgttactgcttttactggtgcccttgatcaaacccgcacctcctactcagcaggactccagaattatttatgattacggcacagataacttcgaagaatcaatctttagtcaagactatgaggacaagtacttggacggcaagaatataaaggagaaagagactgtcataatcccaaatgaaaaaagtctgcaactccaaaaggacgaggccatcacccctctgcctccaaaaaaggaaaacgacgagatgccaacttgtttgctttgcgtgtgtctgtctgggtcagtgtactgtgaggaagtggacatcgacgcagtcccgccacttccgaaagaaagtgcttatttatatgcgaggttcaataagattaaaaagcttactgctaaggattttgccgacatacccaacctccggaggcttgatttcacgggcaacctgattgaagatatagaggacgggacatttagtaagctgagtctgctggaggaattaagtctcgccgagaatcagctcctgaagctgcccgtgctgccaccaaagttgacgcttttcaacgctaagtataacaagatcaagagtcgcggaatcaaggcaaacgcttttaagaagttaaataatctcacgtttctatatctggaccacaacgctctggaatctgttcccttgaatcttcccgaatctctgcgagttatacacctacagttcaataacatcgcaagtatcacagatgatacattttgtaaggctaatgatacctcctacatccgtgataggatcgaggaaattcgcctggagggcaaccctattgtcctaggaaaacatcccaattctttcatctgcttgaagaggctgccaattggttcatatttttag

SEQ ID NO: 233657 - DNA, 807 bp, Artificial Sequence
  Description of Artificial Sequence: Synthetic coding sequence
atgcttgctaaaatctccacaacatggaaactctttctgaagctgttgggcccagaaatcctgctttcatcattgaagtccagacatagttttagccatagtcccagtcacctggggttaatgcaccggcatgaacatctcctgcggaaaaccactaaaaacttcaagactgccactaccaccctccaatctaccctgctcctgctgcttttagtgcccctgatcaaaccagccccaccgactcagcaggactcccgcataatttacgactatggcactgacaacttcgaggagtcgatcttctcccaggactacgaggataagtacctcgatggcaagaacataaaggagaaggaaacggtgatcattcctaatgagaagtccctccagctgcagaaagacgaggccattacccccctccccccaaagaaggagaatgatgagatgcccacgtgtttgctgtgcgtgtgcttgagcgggtcggtgtattgtgaagaagtagatatagacgcggtgccacccttacccaaggagagcgcatacctgtacgctcgatttaacaagatcaagaaattgactgcgaaggacttcgctgatatccctaacttgcgcagactggatttcacagggaaccttatagaggacatcgaggacgggacgttctctaagctcagtctgctggaggagctcagtcttgcagagaaccagctgctgaaattgcctgtgctcccgccaaaactgacattattcaacgctaagtacaataagatcaagtctaggggcattaaggctaacgcctttaaatag

SEQ ID NO: 233658 - DNA, 1842 bp, Artificial Sequence
  Description of Artificial Sequence: Synthetic coding sequence
atggctgccgagacccttctcagcagtctgctgggtttgctgctgctaggcctgttactgccagcatccctaaccggaggagtgggcagtctgaacctggaagaactgagtgaaatgaggtacgggattgagatcctacccttgccggttatggggggacagtcacagagctcagatgtcgtcatcgtgtctagcaagtacaaacagcgttatgagtgccgtctgcccgctggcgcaatacactttcaaagagagcgggaggaagagacacccgcataccaggggccaggcatcccggaactcctctctccgatgcgcgacgccccatgtctcctgaagacaaaagattggtggacttatgagttctgttacggccgtcacatccaacagtaccacatggaggacagcgaaattaagggcgaagttctctacttggggtattaccagtccgccttcgattgggacgatgaaacagctaaggcatcgaagcagcacagacttaaaaggtaccattcccagacctacggaaatggtagcaagtgcgacctgaatggcaggcccagagaagcagaggttcgcttcctctgtgatgagggggctggtatctctggagattatatcgatcgggttgacgagcccctgtcctgcagttatgtgctgaccatccgcaccccaaggctctgcccgcacccgttactgagacctccaccatccgccgcaccccaagccatcttgtgccaccctagcctccagccggaggagtatatggcatatgtccagcggcaggccgtcgactccaaacagtatggtgacaagattatcgaggagctccaggacttaggaccccaggtgtggagtgaaacgaaaagcggagtggctccccagaaaatggccggagcgagccctaccaaagatgattcaaaggacagtgacttttggaaaatgttaaacgaacctgaggaccaagccccaggcggtgaggaagtgcccgctgaggagcaggacccttcgccggaggccgcagactccgcatctggagcccctaacgacttccaaaacaacgtgcaggttaaagttatccgatcccctgccgacttgatccggtttatcgaagaactcaaaggcggtacgaagaagggcaagcctaatataggccaggagcaaccagttgatgacgccgctgaggtgccccaaagagaacccgagaaggaaaggggtgaccccgaacgccagagggagatggaggaggaagaggacgaggatgaggatgaggatgaggacgaggacgagcggcagctgctcggcgaatttgaaaaagaattggaagggattctgcttccatctgatagagatagacttcgcagcgaagtgaaggctggcatggagagagagttggagaatattattcaggagacagagaaggagctggatcctgatggtcttaagaaggaatctgagcgagaccgggcaatgctggcgctgacatcaaccctgaataagctgataaagaggctggaagaaaagcagtctcccgaactggtgaaaaagcacaagaagaagcgggtggtccccaagaaaccccctccctctcctcagccgaccggcaagatcgaaatcaagattgtccgcccatgggccgagggcaccgaggagggggcacgctggctgaccgacgaagataccagaaatttgaaagagatcttcttcaacattctggtacctggcgctgaagaggcacagaaagaacgacagcggcagaaggagctcgagagcaactaccgcagagtgtggggatcccccggaggagaagggactggggacttggacgagtttgatttctag

SEQ ID NO: 233659 - DNA, 1959 bp, Artificial Sequence
  Description of Artificial Sequence: Synthetic coding sequence
atggcagctgagaccctattgagttccctactgggcttgctgctgctcggcctgctgctgccggcttctcttaccggcggtgtcggatccctgaacctagaagagctgtctgagatgaggtacggtatcgagattctgccgctgcctgtgatgggagggcaaagccagtccagtgacgttgtaattgtttccagtaagtacaaacagcgttacgaatgtcgcctccctgccggagctattcattttcagagagagcgcgaggaggaaacccccgcttaccaagggcctggcatccctgagctgctgtcacctatgagagacgctccctgccttttgaagactaaagattggtggacctacgagttttgctacggtagacacatccagcagtatcacatggaggactccgagatcaaaggtgaagtgctttatcttggctactaccaaagtgcttttgactgggatgacgaaacggctaaagcctccaagcaacataggctgaagcggtaccactcccagacctacgggaacggttccaagtgtgatctcaacggaaggcctagggaggctgaggttcggtttctttgtgatgaaggtgcgggaatctccggagactacattgatcgtgtcgatgaaccactgagttgtagttacgtgctgaccattagaacccccagactgtgccctcacccactcctgcggccacctccgagtgccgctcctcaggccatcttgtgtcatccctctttacagcccgaggagtacatggcatatgtgcagaggcaggccgatagcaagcagtatggcgacaagataattgaggagctgcaggacttaggccctcaggtgtggtccgaaaccaagtctggcgtcgctccccagaagatggccggtgcgtcccccaccaaggatgatagcaaggacagcgacttttggaaaatgctcaatgaaccagaagatcaagcccctgggggtgaggaggtgcctgctgaagagcaagacccatcccctgaggccgctgactccgcaagtggtgctccgaatgattttcagaacaatgtgcaggttaaggttataaggtctcccgcagatctgatccggttcatagaggagctgaaaggcggaaccaaaaaaggaaaaccaaacattggacaggaacagccagtcgacgacgccgcagaggtgccccaaagagagcccgagaaagagaggggagaccccgaaaggcagagggagatggaagaggaggaggacgaggacgaggacgaagatgaagatgaggatgaaagacagctcctcggcgaatttgaaaaagaattggaagggatcctcctcccatccgatagagaccgtcttagaagtgagaccgaaaaggagctggatcccgatgggctgaaaaaagagtccgaacgtgacagagccatgctggccctgacctcaacactgaataaattaatcaagcgcctggaggagaagcagtctcccgaattggtcaaaaagcacaagaagaaacgagtggtccccaaaaaaccccctccatcgcctcagccaaccgaggaagacccagaacacagggtgagggttagagttaccaaacttaggctgggaggtccaaaccaggacctgacagtcctcgaaatgaagagagagaacccacagctcaagcagatcgagggcctcgtgaaagagctcctcgaacgggaaggtctgaccgcggcaggcaaaattgagatcaaaatagttcgcccttgggccgaagggaccgaggagggggctcggtggctcactgatgaagacacgagaaacctgaaggagatattttttaatattctggtccctggggcagaggaggctcagaaagaaagacagagacagaaagagctcgagagcaattaccggagggtgtggggctcgcccggaggagagggcacaggcgacctcgacgagtttgatttttag

SEQ ID NO: 233660 - DNA, 1683 bp, Artificial Sequence
  Description of Artificial Sequence: Synthetic coding sequence
atggctgccgaaaccctgctgtcgtcactactcggcctgctcctgctcggactcctgctcccagcctctttgaccgggggagtagggagcctaaaccttgaagagttgagcgagatgagatacggcattgagattctccctctgccagtaatggggggacaatctcagtctagtgatgtggtcattgtttccagtaagtataaacagaggtacgagtgtcgcctgccagcgggagctatccactttcagcgcgagcgagaggaggaaacccccgcataccaagggcctggaatccctgaacttctgtctcccatgcgggacgccccttgtctgctgaagactaaggattggtggacctatgagttttgctacggacgtcacatccagcagtatcatatggaggactccgaaatcaaaggcgaatttctgtgtgacgaaggcgctggcatctctggagattacatcgacagggttgacgaacccttgtcttgctcttacgtgttaactatccggacccccaggttgtgtcctcacccgttgcttcgtccacctcccagtgccgctccccaagccattctttgtcacccctcactgcaacctgaggaatacatggcttatgtccagcgtcaggcggactctaaacagtatggcgacaagattatcgaagaactccaggacttaggcccacaggtgtggtcagagaccaaaagtggggttgccccacagaaaatggcaggggcttcgccaaccaaggatgattccaaggattcggacttttggaagatgcttaatgagcccgaagatcaggcacccggtggggaggaggtgcctgccgaagaacaggacccttctcccgaagctgccgactctgcctctggcgctcccaacgacttccagaacaacgtgcaggtaaaggttattcggtcaccagcagatcttatacgttttattgaggaattgaaggggggaactaagaagggtaagcccaacatcggccaagagcagcctgtggatgacgctgcggaggtgccccagagggagccagagaaggagaggggagatcctgaaaggcagcgtgagatggaggaggaggaggacgaggacgaggacgaggacgaagatgaagatgagaggcaactcctcggggagttcgagaaggagctcgaaggaattctcctcccatctgatagagatcgcctgagatctgaagtcaaggcgggaatggaacgggagctcgaaaatattatccaagaaacggagaaagaactggatcctgatgggctgaagaaggaatctgagcgggatagggccatgctggccctcacatcaaccctgaacaaactgatcaagcggttggaagaaaaacagtcccctgagttggtaaaaaaacacaagaagaagagggttgtgccgaagaagcctcccccatcccctcagccaactggaaagatagagatcaagattgttcggccttgggcagagggcaccgaggaaggcgctaggtggctcaccgacgaagataccaggaatcttaaggagatattctttaacatcctggtgccaggcgctgaggaggcccagaaagagaggcagagacaaaaagaactagaatccaactacaggcgggtgtggggctctccaggtggcgaagggacaggagatctcgacgagtttgacttctag

SEQ ID NO: 233661 - DNA, 1743 bp, Artificial Sequence
  Description of Artificial Sequence: Synthetic coding sequence
atggctgctgagactttgctgtcttccctgctgggtttattgctgctggggctgcttttacctgcgtccttgaccggaggagtgggttcgttgaatctggaggagctgagtgagatgagatatggcatagaaatcttgccactgcccgttatggggggtcagtctcagtccagcgacgtcgtgatagtttcttccaaatacaagcaacgttacgagtgcagactgccagctggggctatccactttcagagggagcgtgaggaagaaacccccgcttatcaggggccaggcatcccagagcttctgagtcccatgagggatgccccatgcctgctgaagaccaaagactggtggacatatgagttctgctatgggcgtcacattcagcagtaccatatggaggatagtgagatcaaaggagaagtgctgtatctgggttactatcagagcgcctttgattgggacgacgagactgccaagttcctgtgcgatgagggtgcaggcatctcaggtgattatatcgacagagtcgatgaacctctgtcctgcagctatgtactgacaatcaggacccccagattatgtccccacccactgctaagacccccaccttcagccgcacctcaagcaatcctgtgccacccctcccttcagccagaggagtacatggcatacgtgcagagacaggctgttgatagtaagcagtacggcgacaaaataatcgaagagctccaggatctcggacctcaggtctggagtgagactaaatccggtgtggcgccacagaaaatggctggcgcatccccaacgaaagacgattcgaaggattccgacttttggaagatgttgaatgagcccgaggatcaggcacccggtggggaagaagtacccgcagaggaacaggatcccagtcctgaggccgctgattctgccagtggagcaccgaacgactttcaaaataacgttcaggtgaaagtgatacggagcccagccgatttgatccgcttcatagaggagctaaaaggagggaccaaaaaaggtaaacctaacattggacaggagcagcccgtggacgatgcggctgaggtgccacagagggagcctgaaaaggaaagaggagaccctgaacggcaacgcgaaatggaggaagaggaggacgaagatgaggatgaggatgaggacgaggatgaacgacagctgttgggggagttcgagaaagagctggaggggatcttacttccctcggacagggatcgcctgcgctcagaggttaaggccggtatggagcgcgagttggagaacattatacaggagaccgaaaaggagctggatcccgacggtctgaagaaggagtctgaacgagacagagccatgctggccctgacttccactttaaataagctgataaagaggttggaggaaaagcaatctccagaactggtgaaaaagcacaagaagaagcgcgtcgtgcccaaaaagccaccaccttccccccagccaaccggtaagatcgagattaaaattgtgcgtccgtgggctgaaggaacggaagagggcgcacgctggcttacagacgaggatacccggaatttgaaggaaatcttctttaatatcttggtgcctggggcagaagaagcccagaaggagaggcagcggcagaaagagttggaaagtaattaccgcagagtgtggggcagtcctggcggagaaggaactggcgacctcgatgagttcgacttctag

SEQ ID NO: 233662 - DNA, 2004 bp, Artificial Sequence
  Description of Artificial Sequence: Synthetic coding sequence
atggcagccgagactctgctttcaagtctcttaggtctattactgttaggcctgctgctgcctgcatccctgaccgggggagtggggagcctgaaccttgaagagctctccgagatgaggtacggaatcgaaattttgccgctgcctgtcatgggcggacagtctcagagttcagacgtagtgatcgtgagcagcaagtacaagcaacgttatgaatgtaggctccccgctggggcaatccactttcagagagagcgagaggaggaaacacctgcttaccagggccctggcattccagagctgctgtcgccgatgcgggatgcgccatgtttgctcaagacgaaagactggtggacctacgagttctgctatgggaggcacattcagcagtatcacatggaggatagcgaaatcaaaggagaggtactttatctcggttactaccagtcagcgttcgattgggacgacgagacggccaaagcatctaaacagcacagacttaaacgttaccattctcaaacatacggcaatggttctaaatgtgacctcaatggcagaccgagagaagctgaagtgcgctttctctgcgacgagggtgcgggtatctcaggggattatattgacagagtggatgagccattaagttgttcctacgttctgactatccggacccccaggctttgtccacatccgttacttcggcctcctccaagcgccgcaccccaagctattttgtgccacccaagcctccagccagaagagtatatggcttatgttcagcgccaggcagattcaaagcagtacggtgacaaaattatcgaggagttgcaggatctgggcccacaagtgtggtctgagactaaatcaggcgttgcaccacagaagatggccggagcgtctcctaccaaagacgactccaaagatagcgacttttggaagatgctgaacgaaccagaggaccaggcacccggtggtgaagaggtgcccgctgaagagcaggacccttccccggaagcggcagatagcgcctccggcgcaccgaacgattttcaaaataacgttcaggttaaggttatcaggtcgcctgccgacctcatccggtttatcgaagaattgaagggcggaaccaagaagggcaagccaaacatcgggcaggaacaacctgttgacgacgcagccgaagtgccacaacgcgagcctgagaaggagcggggtgaccctgaacggcagcgggaaatggaggaagaagaggatgaggatgaggacgaagatgaggacgaagacgagcgccagctgttaggcgagttcgaaaaggagctggagggcattttgctgcccagtgatagggatcgtctccgttccgaagtgaaagccggtatggaaagggagctggagaacatcattcaagaaacagagaaggaacttgatccggatggactgaagaaggagtccgagcgcgaccgggctatgctcgcactcacgtccactctcaacaaactgatcaaaagacttgaggagaaacagtctccggaactggtaaaaaagcataagaagaagcgggtggttccaaagaagcctcccccaagtccgcaaccgaccgaagaggatcctgagcatagagtgcgggtgcgagtgacaaagctgcggctgggtgggcctaatcaggatctgaccgttctggagatgaagcgtgagaacccccaactgaaacaaattgaaggcctggttaaagaattgctggagagggaaggcctcaccgccgctggaaaaattgaaattaaaatcgtacggccatgggccgagggaactgaggaaggcgcacggtggctcacagatgaggatactcgcaatctgaaagagatatttttcaacattcttgtccccggtgcagaagaggcccaaaaagagcggcaaagacaaaaggaactcgaaagcaactaccgccgagtttggggcagtccaggaggagagggcactggagacctagacgagttcgacttttag

SEQ ID NO: 233663 - DNA, 1794 bp, Artificial Sequence
  Description of Artificial Sequence: Synthetic coding sequence
atggccgcagagactctactgtccagcctgctggggttactactcttggggttgctattgcccgcaagccttaccgggggagtgggttcactcaatctcgaggaacttagcgagatgaggtatgggatagagattctgcccctgccggtcatgggtgggcaatcacaaagtagcgacgtagtgatagtctccagcaagtataagcagcgttatgaatgccgcctgccggctggggcaattcacttccaaagagaaagagaggaagagaccccggcatatcaaggaccaggaatccctgaacttctctcccccatgcgcgatgccccttgtctcttgaagaccaaggattggtggacatacgagttctgttatggacgccatatccagcagtaccatatggaagattccgagataaaaggcgaggtcctctatcttggctactaccaatccgcctttgactgggacgacgagactgcaaaggcttcaaaacagcaccgccttaagcgctatcactctcaaacatacggtaacggatctaaatgcgatcttaacggcaggccaagggaagccgaggtgcgattcctttgtgatgaaggcgctgggatcagcggggactacattgaccgagtggacgaacccctgtcctgctcttatgtcttgactatccggacccctaggctgtgtccacaccccctgcttagaccacccccttctgctgccccacaagccatcctgtgccatccatctctccaaccggaagaatatatggcctacgttcagcgccaggccgactcgaagcaatatggggacaaaataatcgaggaactgcaggatctcggcccacaggtgtggtcagagactaagagtggtgtcgcccctcagaagatggcaggcgcatctccaactaaagatgattccaaagattcagatttctggaaaatgctcaatgaacctgaagaccaggccccagggggagaggaagtcccagctgaagagcaggaccctagccctgaagcagccgactccgcatctggcgctcctaacgacttccagaacaatgtgcaggtcaaagtcattagatcccctgcagatctgatccggttcattgaagagctgaagggaggcaccaaaaagggcaaacccaacatcggccaggagcagcctgtggatgacgctgcggaggtgccacagagggagccagagaaggaaagaggagaccctgagcgtcaacgtgagatggaggaagaggaggacgaagacgaggatgaagacgaagacgaagatgagcgacagctgctgggagagtttgagaaagaattagaggggatcctgctgccttcagaccgcgatcggttgcgtagcgaaactgaaaaagagttggatcccgatgggctgaagaaggagagtgaaagagaccgagcgatgttggctctgaccagtacattgaacaagctgataaaacgcctggaagaaaaacaatctccggaattggtgaagaagcacaagaagaagagggtggttcctaaaaaacccccaccttctccacagcctaccggcaagatcgagatcaagattgtccgcccatgggctgaggggacagaggaaggcgctcggtggcttaccgacgaggatacccgcaatctaaaggagatttttttcaacattttggtccctggagctgaggaggctcagaaggagcggcagagacagaaggaactcgagtcaaactatcggagagtgtgggggtcccctggcggagaaggaaccggcgatctggatgaattcgatttttag

SEQ ID NO: 233664 - DNA, 1839 bp, Artificial Sequence
  Description of Artificial Sequence: Synthetic coding sequence
atggctgcggagactttgcttagctccttactaggcctgctgctgctggggctgctgctccccgcatctcttactgggggtgtggggagcctgaatctggaggagctttccgagatgcggtacggcattgaaattctaccgcttcctgtcatgggtggccaaagccaatcatccgacgtagtgatcgtgagtagtaaatataagcaacggtacgagtgtcggctccctgcgggagccatccacttccagcgggagcgtgaggaagaaactcccgcttaccaggggccagggattccagagttgctgtcacccatgcgcgatgccccttgtttgctaaaaacaaaagactggtggacttacgagttttgctatggacgacatatccaacaatatcatatggaagatagtgaaatcaagggggaggtgctatacctcggatactaccagagtgctttcgactgggacgatgaaaccgccaaggcttcgaagcaacatagattaaaaagatatcattcacagacctacgggaatggatccaaatgtgacctgaacggccgaccaagggaagcggaggtcagatttctgtgcgacgaaggggctggtatcagcggcgactacattgatcgggtcgacgagcctctgtcatgctcctatgtgttaacgatccgaacccccaggctgtgcccgcaccctctgctcaggccacctccgagcgctgcccctcaagccatcctctgtcacccctccctgcagcccgaagagtacatggcatatgtccaaagacaggctgacagcaaacagtacggggacaagattatcgaggaactgcaagacctggggcctcaagtgtggtctgagactaaaagtggtgtcgcccctcagaaaatggccggagcgtcaccgacgaaggacgatagcaaggacagtgacttctggaagatgctgaacgaacccgaagatcaggcgccaggaggagaggaagtccccgctgaagaacaagatccttccccagaagccgctgattccgctagtggcgctcctaacgatttccaaaacaatgtccaggttaaagtgatccggtcccctgccgaccttatccgcttcatcgaggagctcaaagggggaaccaagaagggcaaacctaacatcggacaggagcagcctgtcgacgacgccgcagaggtccctcagagagaaccagagaaagaacgaggtgatccagagaggcagcgggaaatggaagaggaagaagacgaagatgaagatgaggacgaagacgaggacgagcggcagctgctaggagagttcgagaaggaactggagggcatcctgctaccatccgatcgggaccgactgcgcagtgaggtgaaagccggaatggaacgtgagctggaaaacatcatacaggagaccgagaaggaactggacccagacggccttaaaaaggagtccgagcgtgacagggcgatgctggccctgacctccaccctcaacaagctgattaagcggcttgaggaaaagcagagccccgaactggtgaagaagcacaagaaaaagagagtggtgcctaagaagccccctccctccccgcagccaacaggcaaaatcgaaatcaagattgtgaggccctgggccgagggtactgaagaaggggctagatggctcacagatgaagacacaaggaacctgaaagaaatttttttcaacatcctggtaccaggagcggaggaagcgcaaaaggagcgccagagacagaaggagctcgagagtaactaccgcagagtctggggatctcctggaggtgaaggcactggggatttggacgagtttgacttctag

SEQ ID NO: 233665 - DNA, 3462 bp, Artificial Sequence
  Description of Artificial Sequence: Synthetic coding sequence
atgtctcaagaacctacaacatattcactgtttctgtttttgttcctatcccatggagtgtcgtcctatacggtgccgaactcaagacaagatcttcatcctctattgcagaatatggccgaggagattatcgatggttcataccttaatgcccttctcgacctgatccaattccagtcctcacacgtgtggacagatgacctaagtcatcgcgtgctggcgtatttgaacagcaggaatgtggctttcacaattccgagtcttcaagcggctgtggaaaatcaccttgaacagagactgcatcagccccaaaaactgctggaagacctgaggaaaacggacgcccagcagttccggaccgccatgaaatgtttgctggaggataagaaggacgggctggatcttaaggatatcatcattgacctcggcgaaattagggaacgggcactgcaaagccccggagtgaaccgctccctcttcttaattaccttggaacggtgctttcaaatgttgaactccctggaatgtgtggagatcttgggtaaagtccttagaggctcttctggctcatttcttcagcctgacattacagagcgtctgccgagggatctgcgtgaagatgccttcaaaaacctctctgccgtgttcaaagatctttatgacaagacctctgcccattcacagagggccctttacagctggatgactgggatccttcaaacgagcagtaacgccaccgacgattctgctagctgggtaagtgctgaacatctgtgggtgttgggtaggtacatggtccacctgtcttttgaagagatcacgaagatctctccaattgaaatcggcctcttcatctcttacgataacgccacaaagcagctcgatatggtctacgacataacaccggaactcgctcaagcctttcttgaacgaatttcttcctcaaattttaacatgcgaaatacatctactatccaccggcaagctcatgaactttgggcacttgagccttttcctaagatgcttggactgctggtgtgcttttataacgacctagagttactggatgctaccgttgcccaagtgttactctaccagatgataaagtgtagccatctgagagggtttcaagccggagtccaaaagctgaaggccgaacttcttgacatcgccatggagaatcagactctgaacgagacgctcggatccctttccgacgccgtggtgggcctcacttattcccagctagaaagccttagccctgaagccgtgcatggcgcaatcagcacactgaatcaggtgagcggatgggccaaatcccaagtgataattctctccgcaaaataccttgctcatgagaaggtcctcagcttctacaatgtatctcagatgggcgctttactggctggcgtttcaacacaggctttctgcagcatgaaacggaaagatatatcacaagtcctgcggagtgcagtgtcccagtacgtgtccgatctgtcccccgcacagcaacagggaatactgagcaagatggtgcaggcagaagataccgcccctggcatcgtggagatccagggtgcttttttcaaagaagtctcgctgtttgacctaaggcggcagcccggttttaactccacggtgctgaaggacaaggaattaggacggtcacaggccttgttcttgtatgagctcctgttgaaaaccacgaggcgcccagaggagctgctatcagcgggacagctggtgaagggggttacctgttcgcatatcgatgctatgagtaccgacttctttctggcccactttcaggatttccaaaacaattttgctcttcttagcccctatcaggtcaattgcctcgcctggaagtattgggaagttagccgcctgtcaatgccgccttttctgctagccgctctcccagccaggtatcttgcgagtgttcccgcatcacagtgcgtgcctttcctcatctcactggggaagagttggctggattctctggtcctggattcacacaagaaaacctccgtgttaagaaaggtacaacagtgtttagacgactccattgccgacgagtataccgtcgacataatgggaaatctgctctgtcacctgcctgctgcaattattgacagaggcatctcaccaagggcatgggctaccgccttacacggattacgggattgtcccgatttgaatccggaacagaaggcggcagtgaggctaaaacttctcggccagtacggactcccccaacattggaccgctgagacgaccaaagacctaggcccatttctggtgctattttccggagatgaattgtcaagcatcgcaacgaaattcccagagattctgctgcaagccgctagcaaaatggcgcgtacactgccaaccaaggagtttctgtgggctgtgttccaatccgtacgcaacagcagcgataaaatccccagctacgacccaatgccaggctgtcacggtgtggtggcaccatcctccgacgacatatttaagctcgctgaggcaaacgcttgttgggccctggaggatctacgctgtatggaagaggacacttttattcggaccgtggaacttttaggtgcagtccagggcttctccagaccccaacttatgaccttaaaggaaaaagcgatccaagtctgggatatgccttcctactggagagaacatcacatcgtgagtctcggcagaatagccctggcattgaatgagtcagaacttgagcaactggacttgagctcaattgacacagtcgcctcgctctcttggcaaacagagtggacacctggtcaggcagagtctatcctgcagggatacctcgatgactccggctattccatccaggatctgaagagcttccatctggtgggtttaggggcaaccctgtgcgctatcaacatcacggagattcctctcatcaaaatcagtgaattccgggtggtggtcgcgcgaatcggtaccctcctgtgcagcactcacgttcttgcagagtttaagcggaaggccgaggtggtcttcggcgatccaaccgagtggacttcctcagtactgcaagaactcggaactatcgccgctggcctcacaaaagcggagttgcgcatgctggataaggacctcatgccttattttcagccgagcgccataaaatgcctgcctgacgaaatcttcaaggaactctccgctgaacagatcgcttctctggggcctgaaaatgcagccgctgtgacacatgcccagagaagacggctcagtccactccagctccaatcgctacagcaggctttggatggtgcgaagacgcatagctggcaggatgccccagcctccgcgggtcccactcggacttcgtcttcccgctcccctgccggagcgttgcaatcttggggcctgtggctcggttgccccctgctcgtcctaatggcaaagctactctggtag

SEQ ID NO: 233666 - DNA, 1647 bp, Artificial Sequence
  Description of Artificial Sequence: Synthetic coding sequence
cctcgggctgtgtgggtggaggcacggggtggagcccagcaccccacgatgcgccgaacagctccactgcaccggggtacatggtcaaaaatgtcgatcattttgagggctcggtacctcgcaagcgtgccagcctcccaatgcgtaccattcctgatatccctggggaagagttggttggattctctggttctggactctcataagaagacgtcagtcttacggaaggtgcagcagtgtctcgatgactcaatcgccgacgagtacacagtcgacatcatggggaatctgctgtgccacctgccagctgccatcatcgatcgcggtattagccccagggcgtgggctacggccctgcacggcttgcgggactgtccggatctgaatccagaacagaaggccgctgtgaggctgaagctgctcggacaatacggtctgccacagcactggaccgccgaaaccactaaggatctaggcccattccttgtgctctttagcggagatgaactgagtagcatcgccaccaagtttcccgagattctactgcaggccgcatccaagatggccagaacccttccaacaaaagaatttctttgggcagtgtttcagagtgttcgcaattcaagtgataagatcccatcctacgaccccatgccaggttgtcatggggtcgtggctccaagctcagacgatatcttcaaactcgctgaggccaatgcgtgctgggctctggaagacctacgctgtatggaagaagatacttttatccgaactgttgaacttctcggtgctgtccagggattctctcgtcctcagttgatgacactcaaagagaaagcaatccaagtgtgggatatgccaagctactggcgtgaacaccacatcgtgagtctgggacggattgcactcgccctgaatgaaagcgaattagaacagctggacctctcgagcattgacaccgttgccagcttaagttggcagaccgagtggacaccgggacaggcagagagcatccttcagggatatctcgacgactctggatactcaatccaggatttaaaatccttccacctggtggggctgggtgctactctctgcgcaattaacatcaccgaaattccacttatcaaaatttcagagtttagggtcgtggttgccagaatcgggacccttctatgctcgacgcatgttctcgccgagttcaaaagaaaggctgaagtggtctttggcgaccctaccgagtggaccagcagtgtgctgcaagagctcggaacaattgccgctgggttgaccaaagccgagttacgaatgttggataaagacttgatgccgtattttcagccctccgcaataaaatgtctgccagatgaaatctttaaagagctgagcgcagagcagatcgccagtctcggcccagagaacgcagctgccgtgacccacgctcagcggaggcggctttccccgctccaacttcagagtctccagcaggcactcgatggagctaaaacgcattcttggcaagatgctcctgcctctgcaggaccaacccggacctccagctctcgaagtccagccggagcccttcagagctggggactctggctgggttgccccctcttggtgctgatggcaaagctgctgtggtag

SEQ ID NO: 233667 - DNA, 3183 bp, Artificial Sequence
  Description of Artificial Sequence: Synthetic coding sequence
atgggaaattctatcacataccgtgatcaggcagccgtggagaatcacctggaacagcggctgcaccaacctcagaagcttctggaggatctgcgaaagacagatgcccagcagttccgaactgccatgaaatgcctactggaggacaaaaaagatggcctcgacctgaaggatatcataattgatctgggtgagatacgcgagcgcgcactgcagagtccaggagtcaaccgatccctctttctcatcaccttggagcgctgcttccagatgctgaactctcttgagtgcgtcgaaattctaggcaaggtcttaaggggcagttctggttctttccttcaaccagacatcaccgaaagactccccagggacctgagagaagacgcgtttaaaaacctgtccgcagtgttcaaagatctgtacgacaagacctctgcccattcccagagagctctctatagctggatgactggaatcttgcaaacatcttctaacgcaacagatgatagcgcatcgtgggtcagtgcggagcatctgtgggtgttgggcagatacatggtccacctgtcgtttgaggaaattacaaagattagccctatagagattggtcttttcatcagctacgacaacgctacaaagcaacttgacatggtatatgacattacgccagagcttgcccaggcctttctggagagaatctcttcatccaattttaatatgcgcaatacgtcaacgatccacagacttggactgctcgtgtgtttttacaatgacctggaactgttagacgctacagtggctcaagtgttactataccagatgattaaatgctctcatttgagagggttccaggcaggcgtccagaaactgaaggcggaactcttggacatcgcaatggaaaatcagaccttgaatgagaccctggggtcactctcagatgcagtggtgggactcacctactctcagttagagtctctttcgcccgaggcggtgcacggagccattagtacattgaatcaggtctcaggttgggccaagtcccaggtcatcatactcagtgctaagtacctcgcacacgaaaaagtgttatctttctataatgtgtctcagatgggcgctctgttggctggcgtgtctactcaggctttttgctcaatgaagcggaaggacatcagtcaggtgttacgcagcgccgtttcccagtacgtgagcgacctcagcccagcgcagcaacaaggaattttatctaagatggtgcaggctgaagatacagctcccggtattgtggagatccagggcgcatttttcaaggaggtgagcctgttcgatctgcggagacagccgggatttaattccacagtgctcaaggataaggaactcggcaggagccaggcattattcctgtacgagctccttctcaaaaccactaggaggcctgaagagctcctgtcagccggacagctggtgaagggagtgacctgttctcacattgatgcaatgagcactgacttcttcttagcccacttccaggattttcaaaataatttcgctctgctgagcccataccaggtaaactgtctggcttggaagtattgggaagttagtaggttgtctatgccaccatttctgttagctgctctgcctgcaaggtacctggccagcgtcccagctagccagtgcgttcccttcctgatttctctcggaaaatcctggctcgatagtctagtgctcgacagccataagaagaccagtgtgctccgcaaagtgcagcaatgcttggatgactctatcgcggacgagtacacagtggatatcatgggcaatctgctctgccaccttcctgcagcaatcattgaccggggaataagcccgcgtgcgtgggccaccgctctccacggcctccgcgactgccccgacctgaatcccgagcaaaaagccgctgtcaggctgaagcttttggggcagtacggattgcctcagcactggaccgctgagactactaaggacctggggccttttctggtcttgttttcaggagatgaattgtccagcatcgctaccaagtttccagaaattctcctccaagcagcgtctaaaatggcccgaaccctgcctaccaaagagttcctctgggccgtattccaaagcgtgaggaactctagcgacaagatcccgagttacgaccctatgcccggttgccatggagtggttgcccctagcagcgatgatattttcaagcttgccgaagccaacgcatgttgggccctggaagatttacgatgtatggaagaggatacctttatccggacagtggaattgttaggggctgtgcagggcttctccagacctcagcttatgaccttgaaagagaaggctattcaggtctgggacatgccctcttactggcgcgagcaccacattgtctccctcggaaggatcgcactggcactgaatgaaagcgagctggagcagttggacctgtcctccattgacaccgtggcttcactgtcctggcagaccgaatggacccccggtcaggccgagagtatacttcagggatacctggatgactctggctacagcattcaagacctgaaatctttccatctggtggggctcggagcaacactttgtgccattaatattactgagatacctttaatcaagatatcagaatttagagtggtagtggccagaattggcacccttctgtgcagcactcacgttctggccgaatttaagcgcaaggccgaagttgtgtttggagatccaacagagtggacctccagcgttcttcaggagctcgggaccattgcagctggactaaccaaggcagagcttcgaatgctagacaaggacctcatgccctacttccagccttctgcgattaaatgcctaccggacgagatctttaaggagctgtctgccgagcaaatagcctctctgggaccagagaacgctgctgccgtgacacatgcccagaggaggcgcctgagccccctacagctgcagtcgctacagcaggccctcgatggtgcaaagacacactcttggcaagatgcccctgcctcagctggcccaacccgtacgagcagctcacggtctccggctggcgcactgcagtcatgggggctgtggcttggctgtccactgctggttctgatggcgaagctcctctggtag

SEQ ID NO: 233668 - DNA, 2448 bp, Artificial Sequence
  Description of Artificial Sequence: Synthetic coding sequence
atgttccgcctgggcctgttggtctgcttttataacgacctcgaactgcttgatgcaactgtcgcccaagtgcttctctatcagatgatcaagtgctcacaccttcgcggatttcaagcaggagtgcagaaactgaaggccgaactcctagacatagcaatggaaaaccagacccttaacgagaccttaggatctctgtctgatgcagtggtaggactcacctactcacaattggagagtctgtcccccgaggccgttcacggagcgatcagtacactgaatcaggtgtcagggtgggctaagagccaggtcatcattctcagtgcaaagtatctggcccatgaaaaagtactgtcattctataacgtttcccagatgggtgctctgttggccggagtctccacacaagctttttgctctatgaagcggaaggacatctcccaggttctcaggtccgccgtgtcgcagtacgttagtgacctaagtcctgcccagcaacaaggcatcctcagtaaaatggtccaggcggaggacaccgccccaggcattgtggaaattcagggcgctttctttaaggaagtctccttgtttgatcttcgccgtcaaccaggatttaattccacagtccttaaggacaaggagctgggccgatcacaggcgttatttctgtacgaactgctattgaaaacaaccaggagaccagaagaactgttaagtgcaggtcagttagttaagggcgttacctgttcccacatagacgctatgtcgacggatttctttctcgcccatttccaagatttccaaaataacttcgccctacttagcccttaccaggtgaattgcctggcttggaaatattgggaggtgtccaggctgagcatgcctcctttcctcctggccgcactgcccgcaagatatctggcttctgtacctgcttctcaatgtgtacccttcctaatttcactgggaaagagctggcttgattctctagtcctcgactcccacaaaaagacgtccgtgttaaggaaagtgcagcaatgtctagatgactccatagcggacgagtacacagtcgacatcatgggaaacctactttgtcatcttcccgcagctatcatcgacagaggtatctccccaagagcatgggccacagcattacacgggctacgggattgtcccgaccttaaccccgagcagaaggctgcagtgaggctgaagctgctcggccagtatggccttccacaacattggacagccgaaactaccaaggatctgggcccttttcttgtgctgttttcaggcgatgaactctcaagcatcgcgactaagtttccagaaattctcctccaggcggcatctaagatggcacgtacacttccaacaaaggaatttttatgggccgttttccagtctgttcgaaattcctctgataagattcctagttacgatcccatgccgggttgccacggtgtcgtggcaccaagctcagacgacatctttaagctggcagaggctaatgcttgttgggccttggaggatctgaggtgtatggaggaggacactttcatcaggactgtcgagctattaggcgctgtacaggggttttccagaccccagctgatgacgttgaaagagaaggcaatacaggtttgggacatgccatcctattggagggagcaccacatagtcagtctgggccgtattgctttggctctgaacgagtccgagctcgaacagttagacttgagctctatagacacagtggccagtctatcgtggcagacggaatggaccccaggacaggccgagtcgatcttacagggctacctggacgacagcggctacagcatccaagaccttaaatcattccatctggtggggctcggggctactctgtgcgccatcaatattactgagatccccctgataaaaattagcgagttccgagttgttgtggcacgtatcgggaccctcctgtgtagcacacacgtgctcgcagagtttaaaagaaaggcggaggttgtgttcggtgaccctaccgagtggactagctcagtcttgcaagaactcgggaccatcgctgcaggcctgaccaaagctgagctgcgtatgctcgacaaggatctgatgccttactttcagccttccgccattaagtgccttccagacgagatctttaaggagctttcagcagaacagattgcaagtttaggtccagagaatgcagcagctgtcacccacgcccagagacgtagactgagcccactccagctgcagtcacttcaacaagctctggacggcgcaaagacccactcttggcaagatgcgccagcttcagccggaccaacccggacatccagcagccgatccccggcaggcgctctacagtcatggggtctatggctagggtgccccttgctcgtactgatggccaaactgttgtggtag

SEQ ID NO: 233669 - DNA, 3420 bp, Artificial Sequence
  Description of Artificial Sequence: Synthetic coding sequence
atgtcccaggagcccacgacttatagtctgtttctattcctcttcttgtcccatggagtctcctcctatacagtgccaaacagcaggcaggatctgcaccccctgctccagaatatggccgaggaaatcatcgatggctcctatctcaatgcactgcttgatttgatccagtttcaaagctcccacgtttggaccgatgacctatcccacagagtgttggcctacttgaacagtcgtaatgtggcattcactattccttccctgcaggctgctgtagaaaatcacctcgagcaacggcttcatcagccccagaagctgctcgaggacttgaggaagacggacgcccagcagttccgaaccgcgatgaagtgcttactggaagataagaaggacggccttgatctgaaggatataattatcgacctgggggaaattagagagcgcgctttacagagccccggagtcaaccggtccttgtttctcattaccttggagcgctgtttccagatgttgaattcattggaatgtgtggagattctagggaaggtgctgagaggaagctctgggagctttctccagcctgacatcaccgagcgattgcccagagaccttagagaagatgcattcaagaacctctccgcagttttcaaggacctgtacgacaaaacctctgcccacagccaaagagcattatacagttggatgacagggatcttgcaaacgagctcaaatgcaacagatgactcagctagctgggtgagtgctgaacacttgtgggtcttaggtcgctatatggtgcacctttcatttgaggagattacaaagataagtcccatcgaaataggccttttcatatcctacgacaacgctacaaagcagctggacatggtgtatgacatcaccccagaattagcccaggccttcctggagaggatctcatcctccaacttcaatatgcggaatacaagtactattcataggttagggttgctagtttgtttctataatgacctagagctgctcgacgctactgtggctcaggtgctattataccagatgatcaaatgctcgcacctgcggggatttcaggcaggcgtgcagaagctcaaagctgaactgctagatattgctatggagaaccagacactgaatgagactctgggaagtttgtctgatgccgtggtgggcctaacatacagtcaactggagagccttagtcccgaggctgtgcatggcgctattagtaccctgaatcaggtgtccggatgggccaagagccaggtgatcattttgagtgccaagtacctggcacatgagaaagtcctctcattttacaacgtgagccagatgggggcattgctggctggggtgagcacacaggccttctgctccatgaagaggaaggacatctcccaggtcctgaggtccgcagtaagccaatacgtgtcagatctgagtcccgctcagcagcaaggaatcctgagtaaaatggttcaggcggaagacaccgcgcctgggatagtggaaattcagggagcgttttttaaagaggtctctctgttcgatctgagacggcagcctggatttaattccaccgtcctaaaagacaaagaattggggcgatctcaggcgctgttcctctatgagctcttgctgaaaacgacccgacgcccagaagagttgctttcggcgggtcagctagttaaaggtgttacttgctcccacatagacgccatgagtacagacttcttccttgcccacttccaggatttccaaaacaatttcgccctgctgagcccttatcaggtgaactgcctggcgtggaagtactgggaggtctcccggcttagtatgccacctttcctgctcgccgctcttcccgctagatacttggcctccgtgcctgctagccagtgcgttccgtttctgatctcattgggtaaatcatggctagatagtctcgttcttgatagccacaaaaagacttccgtgttaaggaaggtgcaacagtgcctggatgactcaatcgccgacgaatacacagtagatatcatgggaaatctactgtgtcatctccccgctgctatcatcgatcggggtatatctcctcgggcatgggctactgcattgcacggcctgcgggactgcccagatctgaacccagagcagaaggcagcagtgcgcttaaagctcctgggacaatacggattgccacagcattggacagccgagacgactaaggaccttggcccattcctcgtactgttctccggcgatgaacttagctccatcgccaccaagttccctgagatccttcttcaagcagcgtcaaaaatggctagaactctcccaacaaaggagttcctgtgggccgtttttcagagtgtgaggaattctagcgataagatcccctcttatgatcccatgcccggatgccacggggtggtggcgccttcatccgacgacatctttaaactggcagaagctaatgcttgctgggcactcgaggatcttcggtgcatggaggaggacaccttcatccggaccgtggagctcttgggagcagtccaggggttctcccgaccgcagctaatgactctcaaggagaaagctatccaggtctgggatatgccgagctactggcgcgaacatcacatcgtctcattagggaggatagccctagccctaaacgaatcagagctagagcagctggacctcagttcaattgataccgtggcaagtctgtcctggcagacagaatggacacccggtcaggccgagagtatcctacagggctacctggatgatagcggctacagtatccaggacctgaagtcctttcatctggttggcctgggcgcaactctgtgtgccatcaacataacagagattcccctcatcaaaattagcgagttccgggtggtagtggcgagaatcgggacgcttctgtgcagtacgcacgtccttgcagagttcaaacgtaaggcggaggtcgtgttcggggaccccactgagtggacttcttccgtactccaggaattgggaactatagctgccggactaacaaaggccgaactcaggatgctcgacaaggatctgatgccatacttccagccttccgctattaagtgtttgcctgatgaaatctttaaggagctttctgccgaacagatcgcctctctcggcccagagaacgccgcagccgtaactcacgcccagcgcagaaggctgtcccctttgcagctccagtctttgcaacaggccctcgatggagctaagactcattcttggcaagatgccccagcctcagcagggcctacaagaacgtcctctagcaggagccctgcaggcgctctgcagtcttggggcctttggcttgggtgccctctgctggtgttgatggccaagctactgtggtag

SEQ ID NO: 233670 - DNA, 1434 bp, Artificial Sequence
  Description of Artificial Sequence: Synthetic coding sequence
atgatcgctttcctcctgactagcgtacttatgatcccccatgcaggagggcacccgctggacacgccacatttaccccaggaattgcccccaggtctgcctaataatatcaacatcacatttttttccggaatgttcaagaacgtagagagtgtagcagaaattttcgattgccttggccctcacttcacttggctgcaggctgtgttcacgaacttccccgtcctgattcagtttgtgaacggaatgaagtgcgttgcgggactttgtcccagggactttgaggactatgggtgtacgtgtcgttttgagatggagggcctccccgtagatgaatcagatagttgttgtttccagcatcgcagatgttacgaggaggccgctgagatggattgcctgcaggaccccgcaaagctcagcaccgaagtgaactgtgtaagcaaaaaaattatctgcgaatctaaggacaactgtgaacacctgttatgcacttgtgataaggcggctatcgagtgcctggccagaagttctctgaattctagcctgaatttgttagatacgagtttttgcctcgcgcagacccccgaaactacaatcaaagaggacctgaccacccttctgccacgcgtggttcccgtggaacccaccgacacctccctgacagccttgtcgggcgaagaggctggccatgatcaggagggcgttggcgcagccagggctacatccccccctggttctgctgaaatcgtggcaaccagggtgacagctaaaatcgtgacactggtgcctgctgggataaaatctctcggactggctgtgtcttctgtggagaacgacccagaagagaccaccgaaaaggcctgcgaccgttttactttcttgcatctgggctccggagacaatatgcaagtcatgccccagttgggcgagatgctgttttgccttacttctcgctgcccagaagaattcgagagctacggatgctactgtgggcaagaaggcagaggagagcccagagacgacttagaccgctgctgcctctctcaccactgttgccttgagcaggtgcggcgtctgggatgtcttctggagagactgccgtggtctcctgtagtgtgcgtcgaccataccccaaaatgtggcggacaaagcctttgcgagaagctgctctgcgcttgtgatcagacagcagccgagtgcatgacaagcgctagtttcaaccaatctctgaaaagtccttcgcgtctgggttgcccagggcagccggctgcttgcgaggatagcctccacccagtccccgcagcccctacactagggtcttcgagtgaggaagattctgaagaagacccccctcaggaggatttggggcgtgcaaagcgctttctcaggaaatctttgggcccattgggtatcggtccattgcatgggaggtag

SEQ ID NO: 233671 - DNA, 1482 bp, Artificial Sequence
  Description of Artificial Sequence: Synthetic coding sequence
atgatcgcattcctcctgacctccgtgctaatgatcccacacgccggaggtcaccccctcgacactcctcacttgcctcaggaattgccccctgggctccctaacaacatcaacatcacatttttttcagggatgttcaaaaacgtagaaagtgttgccgaaatcttcgactgcctgggcccacatttcacatggctacaggccgtgtttacaaattttccagttctcatccagttcgtcaatgggatgaaatgcgttgccggactctgccctcgcgacttcgaggattacgggtgcacctgtcgcttcgagatggagggcctgcccgtggacgagagtgactcatgctgcttccagcacagacgatgttacgaggaggccgcagagatggattgcctgcaagatcctgcgaagctttccacggaagtgaattgtgtctcaaagaaaattatatgtgaaagcaaggacaattgtgaacacctgctgtgcacctgtgataaagctgctattgaatgtttggcccgatctagccttaactctagtctgaaccttctcgatacatcattctgcctcgcacagactcctgagaccacaattaaggaggacttgaccacgctgctgccacgtgtggtccctgtcgaacctactgacacctcactcaccgcactctctggggaggtcgctgccgagaccgaagcagaccgcctgatcaccctgtctaaaaagaaagctgggcacgatcaagagggtgtgggcgcagctcgagccactagccctcctgggtctgcagagatcgttgcaacaagggtgacagccaagattgtgaccttagtcccagcgggaatcaagagtctcggcctcgctgtgtcatctgtggagaacgaccctgaggagacaacagagaaagcatgtgaccggtttactttcctccacctaggctccggagacaatatgcaggtgatgcctcagttgggggaaatgctgttttgcctcacatctaggtgcccagaggaatttgaaagctatggctgctactgcggacaagaggggaggggcgagcccagagatgatttggacagatgctgcctgtcacaccactgctgtcttgagcaggtgaggaggctcggctgcctgctcgaaagactcccatggagccccgtggtgtgcgttgatcacactccaaagtgcggtgggcagtctctctgcgaaaagctcctgtgtgcctgcgaccaaacggcagcggagtgtatgacatcggcctcctttaaccagtctctcaaatcgccatcacgtctgggctgcccagggcagcctgctgcctgtgaagactctctgcatcctgtgcccgctgctccaaccctcggatcatcctccgaggaggactctgaagaagacccaccacaggaagacctgggccgagccaaaagattccttcgcaagagcctgggccctctcggtattggtcctctacatggaagatag

SEQ ID NO: 233672 - DNA, 5994 bp, Artificial Sequence
  Description of Artificial Sequence: Synthetic coding sequence
atggctttactaatacacctgaaaaccgtttctgagctgcgcggtcggggagaccgcatagcaaaggtgacgttccgtggccagagcttctattcacgggtgttggaaaattgcgaagacgtcgccgattttgatgagaccttccgttggcctgtggcaagctcaatcgaccgaaacgaaatgctcgagattcaagtttttaactacagtaaagtcttctctaacaagcttattggaaccttcaggatggtgttgcaaaaagtggtggaggaatcccacgtcgaggtgacagacacattaatcgacgacaacaatgccattattaagaccagtctatgcgtggaggtgcgctatcaggctacggacggcacagttggaagttgggatgatggcgattttctcggcgacgaatctctgcaagaagaagagaaagattctcaggagactgacgggctgctacccggttcaaggccaagctcccggccacccggtgagaagtccttcaggcgcgcagggagaagcgtgtttagtgctatgaaattgggtaaaaacagatctcacaaagaggagccccagcgccctgatgagcctgctgtgctggagatggaggaccttgaccatctagcgattcgcttgggagacggactggacccagacagcgtgtccctggcatccgtcactgcccttacgaccaatgtaagcaataagcggtccaagcccgacatcaaaatggagcctagcgccggaaggcctatggattaccaggtgtcaattactgtcatcgaggctaggcagttagtgggcctgaacatggaccctgtcgtctgcgtagaggtgggggacgacaaaaagtatacctctatgaaagaaagcacaaattgcccgtactacaatgagtacttcgtcttcgattttcacgtctcccccgacgtgatgttcgacaaaatcatcaagattagcgttatacacagcaagaatctcttgcggtccgggacattggtggggtctttcaaaatggacgtgggaactgtctactcgcaacccgagcaccagttccatcacaagtgggccatcctgtccgatccggatgatatcagtagtggcctgaaggggtacgtcaagtgcgatgtcgcggtggttggcaagggggacaatatcaaaacaccccacaaggcaaacgagacggatgaggacgacatcgaggggaatctgctcctccctgaaggggttccacccgaacgtcagtgggcaaggttctatgtcaagatttaccgggcagagggcttacccaggatgaataccagtttgatggccaacgtcaagaaagcctttattggcgaaaacaaagatctcgtcgacccatacgtccaggttttctttgctggccagaaaggaaagacctccgtccaaaagagctcgtacgagcccctgtggaatgaacaagtggtcttcacagacctgtttcctccattatgcaaaaggatgaaagttcagattagagactctgacaaggtgaacgatgtggcgatcggtacacatttcatcgacctgcgaaagatctctaacgatggagataaaggcttcttacctacactggggccagcctgggtcaatatgtacggatctacccggaattacactcttctggatgagcatcaggatctaaacgaaggcctgggggaaggagtgtcattcagagcacggctcctcctgggcctcgctgtcgaaatcgttgacacctctaaccccgaactcacatcatctacagaagttcaggtcgagcaggccacacctatcagcgagagttgcgccggaaagatggaagagttttttctgtttggcgctttcttggaagctagcatgattgaccgacgcaatggcgataagcccatcaccttcgaggtcaccatcggcaactacgggaatgaagtggacggactaagcagaccgcagcgtccaaggccacgcaaggagcctggcgatgaggaggaggtggacctcatccagaacgccagtgacgacgaggcgggagacgctggtgaccttgcgagcgtgtcgagtactccgccaatgaggcctcaggtgaccgatagaaactatttccaccttccctacctggagcgtaaaccatgtatctacatcaaaagctggtggcctgatcaacgaagacgcctctataatgctaacataatggaccacatcgccgacaagttagaggaaggccttaacgacattcaggaaatgataaagacggagaagtcatatccggaacgtcggctgaggggagtgctggaagaactaagctgcggttgctgccgctttctgagtctagcagataaggaccaggggcactcatcaaggactcgcctggatcgtgaacggctgaagagttgcatgcgggaactggagaatatgggtcagcaggctcggatgttgagggcccaggtgaaaaggcatacagtcagagataaattacggctgtgtcagaatttccttcagaaactgcgcttcctggccgacgagccacagcatagcatacccgatattttcatctggatgatgtctaacaacaagcgggtagcctatgccagggtaccgtcgaaggatctgttattttccatcgtggaggaagagactgggaaagactgtgccaaagtgaagacgttgttcttaaagctacctgggaaaagaggattcggctccgccggatggacagtgcaggcgaaggttgagctctacctttggctcggactctctaaacaacgcaaggagtttctctgtggcctgccttgcggattccaggaggtcaaagctgcccaaggactggggctacacgcttttccacctgtctccctggtttacaccaaaaaacaggcgttccagctgcgcgctcatatgtatcaggctcgttcacttttcgctgccgactcctcgggcttgtctgatcctttcgccagagtgttcttcatcaatcagtctcagtgtactgaagtgctgaacgaaaccctttgcccaacctgggaccagatgctcgtattcgataacctcgaactgtacggcgaagcccacgaactcagagacgaccccccaatcattgtcatagagatatacgaccaggacagcatgggcaaggcggactttatggggagaacatttgcgaagccactggtcaaaatggctgatgaagcctactgtcctcccaggttccctcctcaactggagtactaccagatataccgcggtaacgcaacagccggtgaccttctcgccgctttcgagctcttgcagattggaccagccggaaaggcagacctcccaccgatcaatggtccagtcgacgtggataggggaccaatcatgcccgtgcccatgggaatccgacccgtgctgtccaaatacagagtggaagttctgttttgggggctcagagacctgaagagagtcaacctagcccaggtcgatcgtccacgcgtagatattgaatgcgccggaaaaggagtccagagctccttaatccacaactacaagaaaaaccccaactttaatactttggtcaaatggttcgaagtggatctgcctgagaatgagctgctgcatcctccactgaatatcagagtcgtagactgcagagctttcgggagatatactctggtaggaagccacgcagtttccagcctgcggagatttatctatagacccccagataggtcagctccctcttggaatacgaccgtccgattactgcgacggtgtagagtcctctgcaatggaggaagtagctcccactcaactggtgaggtcgtggtgactatggagcccgaagtccccattaagaagttggagactatggtgaagctcgacgctacctcagaagctgttgttaaggttgatgtagcagaggaagagaaagagaaaaaaaagaaaaaaaagggcacagctgaagagcctgaggaagaagaacccgatgagtctatgctggattggtggtctaagtatttcgcctctatcgataccatgaaagagcagcttcgacagcaagagccaagtggaattgacctcgaggaaaaggaggaagttgacaacactgagggtctgaaggggagcatgaaggggaaagagaaagcccgagcggctaaagaagaaaaaaagaaaaagactcaaagtagtggtagcggccaagggtccgaggccccagaaaagaagaagccgaaaatagacgagctgaaggtctatccaaaagaactggaatccgagttcgacaactttgaggattggctgcacacctttaatttgttacgcggtaagactggggatgatgaggacggcagcacagaggaggaaaggattgtcggacgctttaagggctcactgtgtgtatataaggtccctctaccagaagacgtgtccagggaagccggttacgattccacttacggaatgttccaggggatcccaagcaacgaccctataaacgtgctggtaagagtctacgtggtcagggccaccgatctccatccggctgacataaatgggaaagcagatccctatatcgctatcaggctggggaaaaccgacattagggataaagaaaattacatcagcaaacaattgaatccggtgtttggcaagagctttgatattgaggcaagtttcccgatggagtcaatgttgacggttgccgtatatgactgggacctcgtgggtaccgacgatcttatcggagagaccaagatcgacctggagaaccgtttctacagcaagcatcgcgctacatgcgggattgctcagacgtatagtacccacggctataacatttggcgcgacccgatgaaaccgtcacagattctcacacgtctgtgcaaagatggcaaggtggacggaccacactttggccctcccggtcgggtaaaggtggcaaatcgggtgttcactggaccttcagagatcgaagacgaaaatggacagcggaaaccaacagatgaacacgtggctttgctcgctctgcggcactgggaagacatcccacgggctggctgccgtttggtgcctgagcacgtcgaaacccggccactgctgaacccagataaacccggtatagagcaagggcgactggagctctgggttgacatgttccctatggacatgccagcccctggtacgcccctggacatttcaccaagaaagccaaagaaatatgaattgagagtcataatctggaacacagatgaagtggtgctggaagacgatgatttcttcacgggggagaagtcatcagacatattcgtgcggggatggctgaagggccaacaggaggataagcaggacactgatgtgcattaccacagtcttacgggtgaggggaattttaattggcgttacttgttcccctttgactatctcgctgctgaggaaaagatcgtaatttccaaaaaagagagtatgtttagctgggatgagacagagtataagatacccgctcggctgactcttcagatctgggatgcggatcatttctccgccgatgattttttgggtgccatagaactggacctgaacagattccccaggggagctaaaaccgctaagcagtgcacaatggaaatggccactggggaggtggacgttccattggtgagtattttcaagcagaagcgggttaaaggctggtggcccctgctggcccgaaacgaaaacgatgaattcgaactcactggtaaggtggaagcagaactgcaccttctcaccgctgaagaggctgagaagaaccctgtcggcctcgcccgaaacgagcccgacccattagaaaagcccaatcgccctgacacttcttttatctggttcttaaatccgctgaaaagtgcgagatacttcctctggcatacctatcggtggctacttctgaagctcctgctccttttgctgctcctgctgttgctggccttatttctatacagtgtgccaggttacctggtcaagaaaatcctcggcgcatag

SEQ ID NO: 233673 - DNA, 3693 bp, Artificial Sequence
  Description of Artificial Sequence: Synthetic coding sequence
atgattaagacagagaagagttaccccgaaaggagactcaggggcgttttggaggagctcagttgtggatgctgcaggtttctcagcctcgccgacaaggatcagggccacagtagtcggacccggctggatagggaacgcctcaaatcctgtatgagagaactggaaaacatgggccagcaggcacgcatgcttagagcccaggtaaaaagacacaccgtgcgggataagctgagactctgtcagaactttctccaaaagctgaggtttctagcagacgagccgcaacatagcattccagatatctttatttggatgatgtcaaataataaaagagtggcatatgcacgagtacccagtaaagatctgctgttcagtatcgttgaagaggaaacagggaaggattgtgcaaaggttaagaccctcttcctaaagctgccaggtaagcgaggcttcggctcagccggatggaccgtgcaagcaaaagtggagctgtatctgtggctgggcctatctaagcagaggaaggaattcctgtgcgggttgccctgtggattccaggaggtcaaggcagctcaagggcttgggttacacgcctttcctcctgttagcctcgtgtacaccaaaaagcaggcttttcagctgcgggcacacatgtatcaggctaggtccttgttcgctgcggatagttccggcctctctgacccctttgctcgcgtgttttttattaatcagagtcagtgtactgaagtactgaatgagaccttgtgtcctacatgggatcaaatgctcgtatttgacaacttggaactttacggcgaagctcacgaacttagagacgacccacccatcattgtgatcgagatatacgatcaagactccatggggaaggctgattttatgggccgtaccttcgccaaacccctagtgaagatggccgacgaagcttactgcccgcctcggtttcccccacagctggagtattatcaaatttaccggggtaatgctacagctggagacctgctagccgcatttgagctgcttcagatagggccagccggtaaggcagatctgccccctatcaatggtcccgtcgatgtcgacaggggccctattatgccagtccccatgggcatccgacctgtcttatccaagtaccgggtggaggtcctgttttggggcctgagagacctaaaacgggtaaatctcgcacaggtggaccgtcccagggtggacatcgaatgtgcagggaagggggtacagagctccctgatacacaattacaagaagaaccctaactttaacactttggttaaatggtttgaggttgacttgcccgagaatgagctgcttcatcccccacttaatatcagagttgtcgactgcagagcgtttgggaggtatacactggtgggatcacatgccgtttcatcgctacgtcgcttcatttatagaccgcctgaccgtagcgcccctagctggaacaccaccggggaggtcgtcgtgaccatggaacccgaagtgcccataaaaaaactggagacaatggtgaagctggatgccacgtctgaagcagtggttaaggtcgacgtggcggaggaggagaaggaaaaaaaaaaaaagaaaaaaggcacggcagaagagcccgaggaggaagagccagacgagtcaatgctggattggtggagcaaatattttgctagtattgacaccatgaaagagcagctgagacagcaggaaccttccggaattgacctggaggagaaagaggaggttgacaacaccgagggacttaagggatccatgaaaggcaaggagaaggcaagagcagctaaggaagagaagaagaagaagacacagtcaagtggctcaggccaggggtctgaagctccagagaaaaagaagccaaaaatagatgagctcaaggtttatccaaaggaactggagtctgaattcgataattttgaggattggctccatactttcaacctccttcgaggcaaaaccggagatgacgaagatggcagcacagaagaggaacggattgtgggcagatttaaaggatctctttgcgtgtataaggtcccccttcctgaggacgtgagtcgcgaggcagggtatgattccacttacgggatgttccagggaataccgagcaatgatccgattaatgtgctggttcgggtttatgtcgtgagagccactgacctgcaccctgctgatattaatgggaaagccgacccctatatcgcaattcgcttaggaaagactgacatcagagataaggagaactatatttctaagcagctgaaccctgtgttcgggaagtctttcgatatcgaggccagctttccaatggaatcaatgcttacagtggctgtgtacgattgggatctggtaggcaccgacgacctcatcggtgagaccaagatcgacctggagaataggttctacagtaagcaccgcgctacatgtggcattgcccagacctactctactcatggatacaacatctggagagatccaatgaaaccatcacagatcctcaccagactctgcaaggatggaaaggtggacggccctcactttggccctcccggacgcgtaaaagtcgcgaatcgggtcttcacaggacccagcgagattgaggacgaaaacggacagaggaaaccaacagatgaacatgtggcactgcttgccctcagacactgggaagatattccaagggcagggtgccggctcgttcccgagcacgtggaaaccagacccttgctcaaccctgataagccagggatcgagcagggcagactggagctctgggtagacatgttcccgatggacatgcccgcacctggcacacccctggacattagtccgcgaaaacccaaaaaatacgagctgcgtgtgataatatggaacaccgacgaggtggtccttgaggatgatgacttcttcaccggagaaaaaagctctgatatcttcgtaagagggtggctgaagggccagcaggaagacaagcaggatactgacgtacactaccattcgcttacaggagagggcaacttcaattggaggtatctgtttccatttgattacttagcggctgaagaaaagattgttatttccaaaaaagaatccatgttttcttgggacgagacggagtataagatcccagccagattgacattgcagatctgggatgctgatcacttctcagccgacgattttcttggtgctatcgaattggacctgaacaggttccctcggggagctaagaccgccaaacagtgtaccatggagatggctaccggggaagttgatgtgcccctggtgtctatcttcaagcaaaagagagtgaagggctggtggcctctgcttgcgaggaatgaaaatgatgagttcgaactgactggtaaagtggaagccgagctccatctgttgacggccgaggaagccgagaaaaatcccgttgggctcgctcgcaatgaaccagatccattagagaagccaaatcggccagacactagctttatctggtttctaaaccccttaaagtcagcgagatatttcctgtggcacacctacaggtggcttctgctcaagctactccttctgctcctattgctgctgctgctggccctgttcttgtactcagtccccggttacttagtaaagaagatcttgggggcttag

SEQ ID NO: 233674 - DNA, 3693 bp, Artificial Sequence
  Description of Artificial Sequence: Synthetic coding sequence
atgataaaaacagaaaagtcctatcccgaacgtagactgcggggagtgctcgaggagctgtcatgcggctgttgtcggtttctcagcctggctgacaaagatcaaggccacagttctcgaacaaggcttgaccgagaaaggctcaagtcctgcatgcgcgaacttgagaacatgggacaacaagccaggatgttgcgggctcaggtcaaacggcatacggtccgcgataagctgagactgtgccagaatttcctgcagaagcttcggttccttgccgatgagcctcagcactccatacctgatatattcatctggatgatgagcaacaacaagcgagtggcttacgcacgggtccctagtaaagacctgctgttctcaattgtggaggaggagacagggaaggattgtgctaaggtgaaaacgttgtttctgaaactcccagggaagcgcggattcggaagtgcaggttggacggtccaagctaaagttgaactttacttgtggttgggactgtcaaagcagagaaaagagttcctctgcggtctgccctgtgggttccaagaggttaaggcagcccagggtctcgggctgcatgcatttcctcccgtaagcctggtgtacactaaaaagcaggcctttcagctgcgagcccacatgtaccaggccaggtctctttttgccgctgattctagtggcctttcagacccattcgcgagggttttttttatcaaccagagtcagtgtaccgaagtgcttaacgaaacactgtgccctacttgggaccaaatgctggtgtttgataacctggaactgtacggggaagctcacgagcttagagatgaccctcccattatcgtgattgagatttatgaccaggattccatgggtaaagccgatttcatgggcaggactttcgccaagccgctggtgaaaatggcagacgaggcttactgccctccacgctttccccctcaactggagtattatcagatttatcgcggaaacgctaccgctggagatctacttgccgcatttgaacttttgcagatcggacctgccggtaaggcagacctccctcctataaacggacccgtggatgtcgatcggggacccatcatgcctgtgcccatgggcatcagacctgtgttgagcaaatacagagtggaggtactcttctgggggctgagggatctgaaaagggtgaatctggcccaagtcgaccgtcccagggttgacattgagtgcgcgggaaaaggcgttcagagcagcctgatccacaactacaaaaagaatcccaatttcaataccctggtaaaatggtttgaggtcgatttaccggagaatgagctccttcaccctcccctgaacataagagtggtagactgccgggcatttggtagatatactctggtcggcagccacgcagtctctagcctgagacggttcatttacagaccccctgaccggtccgccccaagctggaatactacaggtgaagtggtggtaactatggagccggaggtgccaattaagaaactggaaaccatggtcaaacttgatgctacatccgaggcggtagtgaaggtggacgtcgctgaggaggaaaaggagaaaaaaaaaaaaaaaaagggaacagctgaggagcccgaagaagaggagcctgacgagagcatgctcgactggtggtctaagtatttcgcatctattgacacaatgaaagagcaactgcgccagcaagaaccctccggcatagatctcgaggagaaagaggaggtcgataataccgaaggcctgaagggctccatgaaaggaaaggagaaagcccgtgctgcgaaggaggagaaaaagaaaaagacacagtcgtccggttccggacaaggcagtgaggccccagaaaaaaagaaacccaagatcgatgagctgaaagtctatcccaaagagctcgagtcggaatttgacaactttgaagattggctccacacattcaatctgctgcgcggtaaaacaggagacgatgaggatggaagcactgaggaagaaagaatcgtgggcagattcaaggggagcctctgcgtttacaaggttccactcccagaggatgtgagtagggaggcgggttatgattcaacctatggaatgtttcagggaatcccatctaacgacccaattaacgtcctggtgagagtctacgtggtgcgagcgaccgacctgcaccccgcagacatcaacggtaaggcagatccctatattgcaattcggttgggcaaaacagatatccgagacaaggaaaattacatcagcaagcagctgaatcccgtattcgggaagtcattcgacatcgaggcaagctttcccatggaatctatgttaaccgtggcagtatacgactgggaccttgtcgggaccgacgatttgattggcgagactaagatagatctcgagaatcgcttctactccaaacacagggctacgtgcggaatcgctcagacctattccacccacgggtataatatttggcgcgaccccatgaagcccagtcagattttgactcgtctgtgtaaagacggaaaggtggatgggccacatttcggtcctccgggtcgagttaaagttgcaaatcgtgtatttacgggaccatccgagattgaggacgagaatggccaacgtaaacccactgatgagcacgtggccttgttagcgctgagacactgggaagatatacccagagctggatgccgactcgtacccgagcacgtggagactcgcccactccttaacccagacaagcccggaatcgaacagggtcggctcgaactatgggtggatatgttccctatggacatgcccgctcctggaactccactggatatatctcctcgaaagccaaagaagtacgagctgcgcgtgataatttggaataccgacgaggtagttctggaggatgacgatttctttaccggagaaaagagcagcgacatcttcgtgaggggttggctgaaagggcagcaggaggacaaacaggacaccgatgttcactaccactccctgacaggagaaggtaatttcaattggaggtaccttttcccgtttgattatctcgcagccgaagagaagattgtcatctctaagaaggaatcaatgttttcttgggacgaaacagaatataaaatccccgcaagactaaccctgcagatctgggatgctgaccacttctcagccgatgactttctaggcgctattgagctggacttgaataggtttcctcgcggagctaaaacagctaagcaatgtacaatggagatggcaactggcgaggtggacgtgccccttgtatccattttcaagcaaaagagagtcaagggctggtggcccctactcgccaggaacgagaatgacgagtttgagctgactggaaaggttgaagccgagttacacttgctgactgccgaggaggctgaaaaaaatccggtcgggctcgctagaaacgagccagatccacttgaaaaaccaaaccgtccagacactgcgttcgtatggtttttaaatccgttgaaatccatcaagtacttgatctgcacccggtataagtggctcatcatcaaaatcgtgctagccctgttgggtctgttaatgcttggactcttcttgtatagcttgccagggtatatggttaaaaaactcttgggggcttag

SEQ ID NO: 233675 - DNA, 234 bp, Artificial Sequence
  Description of Artificial Sequence: Synthetic coding sequence
gaggccgagaagaacccagttggcctcgccagaaacgagccagacccattggagaagccaaatcgaccggacactgctttcgtgtggttcctaaatccgcttaagtcaattaaatatctgatctgtaccaggtataagtggcttatcattaagatagtactagctctcggctgctcttgttggggtcctctccagcccccttggctgcacggtcaaaaggctccctgggggtag

SEQ ID NO: 233676 - DNA, 342 bp, Artificial Sequence
  Description of Artificial Sequence: Synthetic coding sequence
gattttctgggcgatgagtccttacaggaggaggaaaaagactcccaagaaacagatgggctcttgccaggatcccgcccatcctctcgccctccaggcgaaaagtccttcaggtccaaaggtcgcgagaagacgaagggaggtcgggacgacgaacacaaggccggaaggtccgtcttctccgcgatgaagctcgggaaaaacaggagccacaaagaggaaccacagaggcctgatgagcccgctgtactggaaatggaagacctggaccatttagccattcggttaggcgacgggctggatcctgattcagtctctctggctagtgtgacagcattgtag

SEQ ID NO: 233677 - DNA, 3924 bp, Artificial Sequence
  Description of Artificial Sequence: Synthetic coding sequence
atgatgacagacacacaggacggaccttccgaaagttcacagatcatgcgctcactcacccctctgataaatagagaagaagctttcggtgaagccggagaggcaggactgtggccgtccatcacccacacgcccgacagccaggaggaaggactgaacgatatccaggaaatgattaagaccgagaagtcctacccagagcgccgtctgcggggagtgctggaggagcttagttgcggctgctgtcggttcctttctttggctgataaagaccagggccacagttctcggaccaggctggatagagagaggctgaaatcttgcatgcgggaactcgagaacatgggtcagcaagccaggatgctgagggcacaggtgaaacgccataccgttagagacaaactgcgtctgtgccagaatttcttacaaaagttgagattcctagccgatgaaccccaacacagtattccagacatcttcatctggatgatgtctaacaataagcgggttgcgtatgcgagagtgccatctaaggaccttctgttttcaatcgttgaggaagaaaccggcaaggactgtgcaaaggtgaagactctattcctgaagctgcctggaaagagaggctttgggtccgctggctggacggtccaggcgaaagttgaactttatctgtggctgggcctgagcaagcagaggaaagagttcctgtgcggacttccatgtggcttccaagaggtaaaagctgcccaaggacttggccttcacgcttttcctcccgtttctttggtttatacaaaaaaacaagcctttcagctgcgcgcacatatgtatcaggctagatctttgttcgctgccgactcctctggtctctctgatccattcgcacgggtgttcttcatcaaccagtcccagtgtaccgaggttttgaacgagactctctgccctacatgggatcagatgctcgtctttgataatcttgagctctatggcgaagctcacgagttaagggatgacccccctattatcgtgattgaaatctatgaccaggattcaatgggaaaagctgattttatgggtcgcacctttgctaagcccttggtcaagatggccgacgaagcctattgccctcctaggtttcctcctcaactggagtactaccaaatctacagaggaaacgccaccgctggtgacctactcgcagcctttgagctcctccagattggaccagcaggaaaggccgacctgcccccaataaatggcccagtggatgttgacagaggtcctattatgcccgtccccatgggaatccggccagtgttgagcaagtatagagtggaagtactattttggggactccgcgatctgaagagggttaatttagctcaggtcgatagacctcgtgtggacattgaatgtgccggtaaaggagtgcagtcaagtctgatccacaattacaaaaagaatcccaatttcaatacactagtaaagtggtttgaagtagatctgcctgagaatgagctgctgcatccaccactcaacattcgggtggttgattgccgcgcattcggaaggtatactctcgtgggctcccatgcagtgagcagtctgcggaggttcatttaccggcctcccgataggtccgctccctcatggaacaccacagtgcgtttgttgaggaggtgtagagtcctctgtaatgggggatcctcttctcacagcacgggggaagttgtcgttaccatggaacctgaggtgcctattaagaagttggaaactatggtcaagctggatgcaactagcgaagccgtggtgaaagtggacgttgcggaagaggaaaaagaaaagaagaaaaagaaaaaaggtaccgctgaggagccagaggaggaggaacccgacgagtcaatgcttgactggtggtctaaatactttgcttcaatcgacacaatgaaagagcagttgagacagcaggagccgtctgggattgacctggaagaaaaggaggaagtagacaataccgaaggtctgaagggctccatgaaagggaaggagaaggcaagagcagctaaagaggagaagaagaaaaagactcaatccagcggtagcggccaggggtctgaggcacctgagaagaaaaagccgaaaatcgacgaactgaaggtctatcccaaggagctggagagcgagtttgacaattttgaagactggctgcacacgttcaatcttctgcggggaaagaccggcgatgatgaagacggctccaccgaggaagaacggatcgtcggaagattcaaggggagcctgtgcgtgtataaggttccccttccagaggacgtgtctagagaagcaggttacgacagcacgtacggaatgttccaaggcataccttctaacgatcccatcaacgtgctcgtgagagtctacgttgttagagccactgacctacaccctgccgacatcaacggcaaggcagacccctacatcgccatcagacttggaaagacagacataagggacaaagagaattatatttcgaaacagctgaaccccgtctttggtaagtcctttgacatcgaagcctcatttcccatggagtcaatgctgacagtagcagtgtacgattgggaccttgtgggcaccgacgacctgattggagagaccaagatcgatcttgaaaaccgtttttattcaaagcatcgggctacctgcggcattgcccagacctattcaactcacggatataatatctggcgcgaccccatgaagccaagccaaatcttgacacgactgtgcaaagatggaaaggtggacggaccccatttcggacccccaggacgagtgaaggttgctaatagagtcttcacaggacccagtgaaatcgaggatgagaatggacaacggaaacccaccgacgagcacgtggccctgctggccctgcgtcactgggaggatatcccaagagccggttgtcgcctggtgccagaacacgtagagacgaggcccctgcttaaccctgacaaacccggaatcgagcagggtcgtctggagctgtgggtggacatgtttcctatggacatgccagcccctgggaccccccttgacatcagccctcggaaaccgaaaaagtatgaactccgggtaatcatctggaatactgatgaggtggtcctggaggatgatgacttctttaccggcgagaaatctagcgacattttcgtgaggggctggttaaaagggcagcaggaagataaacaggatacagatgtgcattaccatagccttaccggagagggtaacttcaactggcggtacctgttccctttcgattacctggccgctgaagagaagattgtcatcagtaaaaaggagagcatgttctcatgggatgagacagaatacaagattccggcacgcctgaccctccagatctgggacgcagatcatttctccgcggacgactttctcggcgcaatcgagctcgacttaaacagatttccgagaggtgctaaaactgcaaagcagtgcacaatggagatggctacaggagaagtcgatgtaccactcgtctctatatttaaacagaaacgcgtgaagggttggtggccactactcgcgaggaacgaaaatgacgaattcgagctgaccggcaaagtggaggcagagttgcatctcctgactgccgaagaagctgaaaagaatccagtgggtctcgcaaggaatgagccagaccccctagagaagcctaacagaccagataccagttttatctggttcctgaatcccctgaaaagcgcgagatactttctatggcatacctacaggtggctcttgctgaagttactccttctcctgctgctgctcctactgctcgccctgttcctgtactctgtgccgggatacctggtaaagaaaattcttggggcatag

SEQ ID NO: 233678 - DNA, 4527 bp, Artificial Sequence
  Description of Artificial Sequence: Synthetic coding sequence
atgttccccgctagaggggttcctctgcacttggaaggcgaaggggtgttcccctggggacccggagatgtctccctaccttatttgtccacgagcgatgtctccttttccgtcatcgtggagaatgtcaactgctatagcagcggcatgatttgccggaagttcatcagcattaatgtaggcaactcgctcatagtctttgacgacgattccggcaacccctctccagaatcattcctcgacgataagcaggaggtgcacacctggagggtaggtttttttactctagttcactttccgcaagagcacatcactttgctctgggaccagcgcacaacggtgcacgtccaggcaggtccccaatggcagggacagctcgcaggactatgcggcaatttcgatctaaaaacaatcaacgagatgagaacccctgagaacctggagctgacaaatcctcaggagttcggctcgagttgggcagctgtcgaatgtcccgatacattggatccaagggacatgtgcgttctcaaccccctaagagagcccttcgcaaaaaaggagtgctccatcttgctctccgaggtcttcgaaatctgtcatcctgtggtggatgtgacctggttctacagcaactgcttaactgatacttgcggatgcagccagggcggagactgcgagtgtttctgtgccagcgtctcagcgtacgcacaccagtgctgccaacacggcgtggcagtcgattggcgtactcccaggttgtgcctgttaggcaaggggccataccagctgagctcgctcgctgctgggggagcccttgttgggatgaaggctgtgggagacgacatcgttctcgtgcggaccgaagatgtcgccccagcagacatcgtcagtttcctgcttaccgccgcactttataaggctaaagctcatgacccagatgttgtaagcctagaggctgcggatcggccaaacttcttcctgcacgtgactgccaatggctctctagagctggcaaagtggcagggaagggacacgttccaacagcacgcgagcttcctcctgcataggggtaccagacaggccggactcgtggctctcgagtcacttgctaaaccaagttcttttctgtatgtttctggagctgtgctggcgctgcggctgtatgaacacactgaggttttccgcagggggacactgttccgtctgttggacgccaagccatcaggggctgcctaccccatctgtgagtggagatacgacgcctgtgctagcccatgttttcagacatgtcgcgaccccagggccgctagctgcagggacgtccccagggtcgaaggctgcgtgccagtgtgccccacaccacaagtactcgacgaggtgacacagcgctgcgtgtatctggaggactgtgtggaaccggcagtttgggtgcccacagaggcactaggtaatgagactctaccaccaagccaggggttgcccacaccctctgacgaggagcctcagctgtctcaggagagcccacgcactccaacccatcgtcctgccctgactcccgcagcgccactgaccacagccttgaatccaccagttactgcgacggaagaacccgtggtgtctccaggaccaactcagacaaccctgcagcagccattggaactgaccgccagtcagctcccagctgggcctaccgaaagtcccgcttcaaaaggggtcactgccagtctcctcgccattcctcatacccctgagagcagctcactgcccgttgccctgcagacaccaacacctgggatggtgtctggagccatggagaccacacgcgtcacggtgatattcgctggctctccaaatataaccgtctccagccgttcccccccagccccaagattcccgcttatgaccaaggccgtcaccgtacgtggccatggcagcttgcctgtgcgaaccacgccaccacagccgagtcttactgccagcccttcttcgcgtccggtggcttcacccggagctattagccggtcgcccaccagcagcggaagccacaaggctgtgctgaccccggctgtgacgaaagttatttcaagaactggagtcccgcagccgacacaggcacagagcgccagctcaccctcgacccctctaaccgtggccggtaccgctgccgaacaggtgccagtttctcccctagcaaccagatcgttggagatcgtgctgagtacagaaaagggggaggccggtcatagtcagcccatggggagccctgctagtccacagccacatcctctccccagcgcacctccgagacccgctcagcataccacaatggcgactcgctcacctgctctccccccagaaacgcctgccgcagcctcactgtccacagccaccgacggcctggccgctacacccttcatgagtctagaatcgactcgcccatcacagcttttgtctggcttaccacccgacaccagccttcccctggcgaaggtaggcacttccgcacccgttgccacacctggacctaaggcttccgttataactaccccactgcagccacaggccacaaccctcccagcccagaccctttcaccagttctgccattcactccggctgctatgacacaggcccaccccccaacacacattgccccacccgcagccggtacagcgcctgggctcctgttgggggcaaccttacctacgtcaggagtcttgcccgtcgcagaaggcaccgccagtatggtcagcgtggttccacgtaaatcaactaccggcaaggtggccattctgagtaagcaggtcagcctcccaacctcaatgtacggttccgctgagggcggtccaaccgaactgacgcccgctacaagtcaccccttaactccactggttgcggagccagaaggagctcaggcgggtacagctctaccggtacccaccagctatgcactatctcgggtgagtgccagaactgctcctcaagacagtatgttagttctgttgcctcagctcgccgaggcccatgggacctccgcagggccacacctggccgctgaacctgtggatgaagcaaccacagagccatctggccgaagcgctccggcattaagtatcgtggaggggttggccgaggccctggcaacaaccactgaggccaacacctcaacgacctgcgtccctattgccgaacaggactgcgtgcgccatatttgtttggaaggtcaactcataagggtcaaccaaagtcagcattgccctcagggcgctgccccacctcgctgcggcattcttggcttggcagttcgcgtaggtggagaccggtgttgcccgctctgggagtgtgcctgcagatgttcaatctttccagacctgtcatttgtcacgttcgatggtagccatgtcgccctctttaaggaggccatttatattcttagtcagtcccccgatgagatgttaactgttcacgtcctcgattgtaagtctgcgaacctagggcatctgaattggcccccattctgcttagttatgttgaacatgacccacttggctcaccaggtgaccatcgacagatttaatagaaaggtcacagtggatctacagcctgtttggccaccagtctctaggtatggatttagaattgaagataccgggcacatgtatatgatcctgaccccctccgacattcagatccagtggctgcactcctctggcctcatgattgtggaggcctcaaaaaccagtaaggcacaggggcatggcctgtgtgggatctgcgacggggacgccgcaaacgatttgactttgaaggacggttccgtggtaggtggcgctgaagatcccgcaccttttctggacagctggcaagtgccctcttccctcacatctgtgggccagacacgctttcgcccagattcctgtgcgacaactgattgctctccctgtttaaggatggtatctaatcgcactttttctgcgtgtcaccggtttgtccctcccgagagcttttgcgagctttggataagggataccaaatacgtccagcagccatgcgtggccctgaccgtctatgtggccatgtgtcataagttccatgtctgtatcgagtggcgtaggtctgactactgtccatttctgtgctcaagcgactccacctaccaagcatgcgtgactgcctgtgaacccccaaagacttgtcaggacggcatcctggggccactggatccagaacactgccaggtcctaggggaaggctgcgtctgctcagaaggcactatcctccaccgacggcacagcgctctttgtatacccgaagcgaagtgcgcttgtggcgactgtccggatagcattcctgagtgtcaagagggagaggccttaaccgtgcatcgaaatacgactgagttatgttgccctctgtaccagtgtgtgtgcgaaaactttcgctgtcctcaggtccagtgtggcctcgggacagctcttgtggaagtatggtctcctgaccgatgctgcccgtataagagttgcggctag

SEQ ID NO: 233679 - DNA, 8777 bp, Artificial Sequence
  Description of Artificial Sequence: Synthetic coding sequence
atgggggtcttagcatctgccctctgttggttgctgtgtgtttggcttccttggggcgagcaggcagcagagagtctgcgtgtgcagcggctgggcgagagggtggtcgatagtggtaggtcaggcgctcgcggaatgcgtaatgtcaagggaatgcgcaacggccctgcccagacgcgagtcagctcttcttcctcacaccaggaggcaaccctcgctatgggcgataaagccacagtggtgggtggacagcaagcagaagctcctgactccgtggctatgtcgtcctgggagcggcgtctgcacagagcaaaatgcgcaccttcctatctgttttcctgctttaatggaggcgagtgcgtgcacccagctttctgcgattgcagaagatttaacgcgactggtccccgttgccagatggtctacaacgctggacctgaacgcgatagtatatgtcgggcatggggacagcatcacgtggagacctttgatggattgtactactacttgagcgggaaaggaagctacacgcttgtcggccgtcacgagcccgaagggcaatcattctcgattcaggtgcacaacgatccccagtgcggtagcagcccctatacgtgctctagggctgtctcacttttcttcgtaggcgaacaggagattcacttagcaaaggaggtgacacacggtggaatgagagtgcagctaccgcacgtgatgggctctgctcgccttcaacagctggccggatacgtgatcgtacgtcatcaatccgcgttcactctagcatgggacggagcatcggcagtgtatatcaagatgagccccgagctgcttggatggacccacggcctgtgcggaaacaacaatgcggacccaaaggacgacctagttacctcttcagggaagctgactgatgatgtggtcgagtttgttcatagctggcaggaacaggcgccaaatcagccgcctggcccaaccacctcatctttacccagaccaccttgcctccagcagaatcccggaactatgcagggggtgtatgaacagtgcgaagccctgttgaggccgccattcgacgcatgtcatgcgtacgtctctccattaccgttcacagctagttgtacaagtgatctctgccagtctatgggagatgtggcaacttggtgtagggccttggcagagtatgcccgtgcctgtgcccaagcgggtcggcctctgcaaggatggcgcacgcagcttcgacagtgtactgttcactgcaaagagaaagccttcacctataacgagtgcattgcctgttgtccagcctcatgccaccctagggcatcctgcgttgactctgagattgcctgcgtcgatggatgttactgtcctaatggactgatattcgaggatggcggatgcgtcgcaccagctgagtgtccatgcgagtttcacggcaccctttacccgccaggatccgtggtgaaagaagattgcaacacatgcacatgtaccagcgggaagtgggaatgcagcaccgctgtctgcccggctgagtgctctgtcactggcgatattcacttcaccaccttcgatggacgacggtacacttttccagccacctgccagtatattcttgctaaatcaagatctagtggaacctttactgtgacgcttcagaatgcaccctgtggtctcaaccaagatggagcatgtgtgcagagtgtctcggtcatcctccatcaggatccaagaaggcaggtaacgcttacacaagccggagacgttctcttgttcgaccagtataagattattccgccttacactgatgatgcattcgagatacggaggttaagttcagttttcctgcgggtgaggacaaacgtcggcgtgagagtcctctacgacagggagggtctcagactgtacctgcaggtggatcaacggtgggtggaggacacagtgggcctctgtgggacatttaatggcaatacacaggacgacttcctgtcaccggttggcgtgcccgaatccactccgcagttatttggtaacagctggaaaactctttccgcatgttctccattggtgagcggatctcctctggatccgtgcgatgtgcacctccaggccgcatcctactctgtgcaggcctgttcagtgctgacaggggagatgttcgccccttgtagcgcgttcctgtctccggtaccatactttgagcaatgtaggagagatgcttgtcggtgcggacaaccctgcttgtgtgctaccctggcgcactatgctcacctgtgtcgtagacacgggttgcctgtggatttcagggcacgcctcccagcatgcgctttatcttgtgaggctagcaaggaatatagcccgtgcgtggcgccttgtggtcgaacatgtcaggacttggcaagtccagaagcatgtggagtggatggaggggatgacctgtcaagggatgagtgtgtggagggatgcgcatgcccccctgatacttatttggatacccaggccgacctttgtgtccccagaaaccaatgctcttgtcacttccaaggagttgactacccgcctggagatagtgatatacccagtctggggcactgccactgcaaagacggcgttatgtcatgcgactctagggccccagcggctgcctgtcctgctggccaggtgtttgtaaactgcagtgacctgcatacggatctcgaactgtcgcgggaacgcacctgcgagcaacaattactgaatttgtctgtgtccgctagagggccttgtctgagcggatgtgcgtgtcctcagggcctcctgcgtcatggcgacgcctgttttctcccggaggaatgtccgtgcacctggaaaggaaaagagtacttcccaggcgaccaggtgatgagcccatgtcacacatgtgtctgccagcgcggatcctttcagtgtactctgcatccttgcgcctccacttgcacagcttatggggacagacactataggacattcgatggcttaccattcgactttgtgggggcttgtaaggtgcatctcgtcaagtcaacctccgatgtatcgtttagcgtaatcgtggagaacgtgaactgctattcgagcgggatgatctgcagaaaattcatctctataaacgtgggcaattccctcattgtgttcgacgacgacagtggaaatcccagcccagagtcctttctggacgataagcaagaagtacacacatggcgagtgggttttttcacgctggtgcacttcccccaggagcatatcaccttgctgtgggaccagaggacaacggtgcatgtgcaagccggacctcagtggcagggacagctagcaggtctctgcggaaattttgatctgaaaactatcaatgaaatgcgaaccccagagaatctggagctcacaaatccccaggagttcgggtcatcttgggccgctgtggagtgtccggatacacttgaccccagagatatgtgcgtactcaaccctctccgggaaccttttgcgaagaaggaatgctctattctcctgtcagaggtatttgagatctgtcatcccgtggtggacgttacttggttttactcgaattgcctcacggatacctgtggctgctcgcaaggaggggattgtgagtgtttttgcgccagcgtgtcagcctacgcccatcagtgctgccaacacggagtcgccgtcgattggagaactccacgactgtgtccttacgactgcgacttcttcaataaagtgttaggaaaaggcccttatcagctctccagcctggccgctggcggagcacttgttggcatgaaagctgtaggcgacgacatcgttttggtgagaaccgaggacgtggcgcctgcagatattgtgagcttcctactgacagccgctctctataaggctaaggcccatgatcctgacgtagtcagcctcgaggctgctgaccgacccaattttttcctgcacgtaaccgctaatggctccctcgagttagcaaaatggcagggccgtgacacattccagcagcacgccagctttctgctacacaggggaaccagacaggcaggtctcgtggcattagagagtcttgccaagccgagttccttcctgtacgtttcaggagccgtgttggcgttgcgcctctatgagcacacggaagtcttccgtcgcggtaccctgttcagattgctcgacgcaaaaccgtcgggagccgcttatcctatttgtgagtggcggtacgacgcgtgcgcttcgccatgttttcagacctgtcgcgatcccagggcggctagctgccgagatgtgcctcgcgtcgaagggtgcgtccccgtctgccctacgccgcaagtcttagatgaggttacccagcgctgtgtgtacctagaggactgcgtcgaacctgccgtttgggttccaactgaagcgctgggaaacgagaccctcccaccgtctcagggactgcctacacccagcgacgaggaaccacagctgagtcaagagtcccctcggacgcccacccataggcccgcactgactccggctgcgcctctcacgaccgcactgaacccaccggtgactgcgaccgaagagccggtggttagcccagggccaacgcagaccaccctccagcagcccctcgaactgacggccagccagttgccagctgggcctactgagtctccagcctcaaagggggtgacagctagcctgctcgccatcccccatacaccagaatcttccagcctgcctgtggccttacagacacccaccccaggcatggtgagcggtgcgatggaaactaccagggttaccgttatcttcgctggatcccccaacatcactgtttctagcagatctccccctgctccaaggttccccctgatgactaaggcggtgactgtcagagggcatggctcacttcctgtaaggactacccctcctcagccttcgttgactgcctccccatcttcaaggcctgtcgcatcgcctggcgcaatttcccggtcacctacctccagcggcagccacaaagccgtgctaactcccgcagttaccaaggttattagcagaactggagtgcctcagcctacccaagcacagagtgcttccagcccttctaccccgctgactgtagccggaaccgctgccgaacaggtgcctgttagccccctcgccacccgctctctcgagatcgtgctcagcactgaaaagggcgaagccggtcacagccagccaatgggctccccagccagcccccagccacaccctctcccgtccgcccctccacggcctgctcagcacacgaccatggccactagatctccggcactccctccagagacccctgctgctgcctccttatctaccgccacagatgggctggcggctactccattcatgtccctggaatcaaccaggccctcacagctgctctcgggattgcccccagacacttccctccccttggctaaagttggcacgtccgcacctgtagccacccccggacccaaggcgtccgtgatcactacgccgctgcagccccaggccacgacccttccagcccagaccctctcacctgtgctgccattcacccctgctgctatgacgcaggcacaccctcctacacatatcgcaccgcctgcagccggaactgcccctggcctgctcctgggcgcaactttacctaccagcggtgtcttgcctgttgccgaggggacagcttccatggtgtcagtcgtccccagaaagtcaacaactggaaaagtagccatcttgagcaagcaggtaagtctaccaacctccatgtacggatccgccgagggcggacctaccgaactgactcccgcaacatcacatcctctaacacctctggtggccgaacccgaaggggctcaggcaggcaccgccttaccagtgccaacttcctatgcattaagcagagtgagcgcacgcaccgcccctcaggactccatgctagtgctgctccctcagctcgccgaagcacacggaacgtccgcagggcctcacctggccgcagagccggttgatgaggccacgaccgagccaagtggccgatccgcaccggcactctccattgttgaaggtctggcggaggcgcttgctaccacaaccgaggctaacaccagcacaacttgtgtgcccatcgctgaacaggattgtgtccgacatatttgtcttgaaggacagctaatcagagtgaaccagtcccagcattgtcctcagggggctgcccctcccagatgtgggatcctgggcctggctgtccgggtcgggggagaccggtgttgtcccctgtgggagtgcgcttgcagatgcagtattttccccgatctgtccttcgttaccttcgacggcagtcacgtggcgttgtttaaggaggcgatctacattctgagccagtctccagatgaaatgttaacagttcacgtcctggattgcaaatcagcgaatcttgggcatctgaattggcctccgttttgcctcgtgatgctgaatatgacccatttggcccaccaggtcaccatcgaccgcttcaaccgaaaggtaacagtcgatctccaacctgtgtggccacctgtgagtagatacggtttccgcatcgaagacactggtcatatgtatatgattctaacgcctagtgacattcagattcaatggctgcactctagcggattaatgattgtggaagccagcaaaacctccaaggctcagggtcacggcctgtgcggaatttgcgacggcgacgccgcaaacgacctcacgctcaaggatggcagcgtcgtgggcggtgcagaagatcctgctcccttcctggacagctggcaggtgccatcttcacttacctcagttggacagaccaggtttcgtcctgattcttgcgcaaccacagattgcagtccctgccttcgtatggtgagtaaccgtacctttagtgcctgccaccgctttgttccccctgaaagcttttgcgagctgtggattagggacactaagtacgtgcagcagccctgtgtggctttgacagtctatgtcgccatgtgccataagtttcacgtgtgtattgagtggcgcaggagtgactactgcccatttctgtgttccagtgatagtacttatcaggcgtgtgtgactgcatgtgaaccccctaagacctgtcaggatggcattctgggccctctggacccagagcactgccaggtcttaggggaggggtgcgtgtgtagcgaaggcactattcttcacagaagacattctgcactgtgcattcctgaagccaagtgcgcgtgtacagactccatgggagtccctagggccctcggggagacttggaacagctctttgtcaggctgttgtcagcaccaatgtcaggcaccagacacgatcgtgcccgtcgatctgggctgcccctcgccgaggcctgaatcttgcctccgcttcggcgaggtggcactgctgctcccaactaaagacccttgctgtctcggcactgtctgcgtttgtaaccaaacgctctgcgaaggcttggcccctacatgccggcctggtcaccggctgctgactcacttccaagaggattcctgctgtcctagctacagttgtgaatgtgatccggacctctgcgaggccgaattggttccatcgtgtcgccaggaccagatacttatcacaggacggctgggagactcttgctgtacgtcctacttctgcgcctgtggggactgtccagacagcatcccggagtgtcaggaaggcgaggcactgactgtccaccgaaataccacagagctctgctgccccctctatcagtgcgtctgcgaaaactttcgctgcccacaggtgcagtgcggactagggaccgcactggtggaagtttggtcaccagatcggtgttgtccctataaaagttgcgagtgcgactgcgacacgatccccgtgcccagatgtcacctttgggaaaagtcacagctcgatgaagagttcatgcactctgtggagaacgtgtgcggatgcgctaaatatgaatgcgtcaaggctcccgtctgtctgtcccgggaactcggtgttatgcagcccggtcagacagtcgttgagctgtcagcagatggggtgtgtcacacctctagatgtaccactgtcttagacccgctgaccaatttctaccaaattaacaccacatctgtactgtgtgatatccactgcgaggcgaatcaggagtatgaacacccacgcgatttagcggcatgttgcgggagttgcaggaatgtcagctgcttgttcacgtttcccaacggaactactagtctcttcttgccaggtgcttcgtggattgcggattgtgccagacaccactgcagtagcacgcctctaggagcagtgctcgtgcgttcacccatcagctgtcccccattgaacgagactgagtgtgccaaggttgggggttctgtcgttcccagcctggaaggctgttgcagaacttgcaaagaggatggtcgatcttgtaagaaggtaacaatacgaatgacaatccgcaagaatgagtgcaggagctctacaccagtcaatctcgtctcctgtgacggaagatgcccctccgcatctatctataattacaacatcaacacctacgcccgtttctgcaaatgttgtcgggaggttgggctgcagagacggtctgttcagctgttctgcgccacgaatgccacatgggtaccctacacggtgcaggaacccacagattgtgcctgccagtggagcta

SEQ ID NO: 233680 - DNA, 387 bp, Artificial Sequence
  Description of Artificial Sequence: Synthetic coding sequence
atggccaggatactgctgttatttttgccgggtctggtggccgtgtgtgctgtgcatggtatttttatggaccgattagcctcaaagaagctttgtgcagatgacgagtgtgtatataccattagcctggcttcggcgcaggaggattacaacgcccctgattgcagattcatcaatgtgaaaaaaggtcagcagatctacgtttattcaaaactggtcaaagaaaacggcgcaggggagttctgggccggtagcgtctacggcgatggacaggatgagatgggagtagtgggctatttcccgagaaatctggtgaaagaacagagggtctatcaggaggccacaaaggaagtgccaacgactgatatcgattttttctgtgagtag

SEQ ID NO: 233681 - DNA, 1446 bp, Artificial Sequence
  Description of Artificial Sequence: Synthetic coding sequence
atgcagctgtatagcagcgtttgcacgcactaccctgcaggagctccagggccaaccgccgcagcacccgcacctccggctgccgctactccgtttaaagtttcattgcagcctccaggcgctgccggagcggctcccgagcccgagaccggagaatgccagcccgcagccgcagccgaacatcgtgaagccgctgctgtgcctgctgctaaaatgcccgcattttctagctgtttcgaagtcgtctcaggagccgcagcaccggcaagtgctgctgctgggcctcctggggcatcgtgtaaaccaccgcttcccccacactacacctctaccgctcagattacagttcgagccctcggagcggaccggcttctgctccacggtcccgatcctgtgcctggagctgctggctctgcagcggcaccaagaggcaggtgcctgctcctggcccctgctcccgcagctccagtgccccctcgtagaggctctagcgcctggctgctggaggaacttcttcgacctgattgtcccgaacccgcaggcttggacgccacacgcgaaggaccggatagaaacttccgcttgagcgaacaccggcaggcccttgcagccgcaaaacaccgaggcccagccgcaaccccaggatcccctgaccccggacctggtccatggggcgaggaacatttggcagagcgcggacctcggggatgggaaagggggggagaccgatgcgatgctcccggtggggacgcagcaagacgaccagacccagaggcagaggccccacccgcaggatcaattgaagccgctccatcgtctgctgccgagccagtcattgtgtcccgaagcgatccacgcgatgaaaagctggcactttacctcgccgaagtggagaaacaggacaaatacctgaggcagaggaataaatacagattccacatcatacccgacggcaactgtctttatagagccgtctcaaagaccgtgtacggcgaccagagcctccatcgggagctgcgagaacaaaccgtccattatatcgccgaccatctggaccacttcagtcccctcatagagggtgatgtcggggaatttattatcgccgctgcccaagatggagcctgggcaggataccccgaactgctggctatgggtcaaatgctgaatgtaaacattcatctcaccactggaggcaggctggaatctccaactgtcagtaccatgatccattatttggggcctgaagactcccttcgccctagcatctggctcagttggctgagcaacggacactatgacgccgtgtttgatcacagctatcccaaccccgaatacgataattggtgtaagcagacacaggtccaacgcaaaagagatgaggagctcgctaaatcgatggctatctcattgagtaaaatgtacattgaacagaacgcctgttcctag

SEQ ID NO: 233682 - DNA, 1197 bp, Artificial Sequence
  Description of Artificial Sequence: Synthetic coding sequence
atgtctagaaagcaggccgcaaagagtagaccaggcagcgggagccgcaaggctgaggcggagagaaaaagagatgagcgtgccgcaaggcgagccctggcaaaggagaggaggaatcgcccagaatctggcggagggggaggatgcgaagaggaatttgtttcattcgccaatcagctgcaggcccttgggctgaaactgcgagaagtcccaggggatggcaactgtctgttcagggcgctaggtgaccaactggaggggcattcccgaaaccatttgaagcacaggcaggagaccgtagattacatgatcaaacagcgcgaggatttcgagccctttgttgaagacgacattccctttgaaaagcacgtcgcctccctcgcaaaaccaggtacattcgctggtaacgatgccatcgtggcatttgcccgaaatcaccagttgaatgtggtgattcaccagttaaacgcgcctctttggcaaatacggggaaccgagaaatccagcgtccgagaactccatattgcttatcggtatggagaacactatgatagcgtgcggcgaattaacgataattctgaggcacctgcccacctgcaaaccgatttccagatgcttcatcaggacgaatccaacaagagggaaaagattaaaaccaagggaatggactccgaagatgacctccgggatgaagtggaagatgccgtgcagaaggtgtgcaacgctactggctgcagcgatttcaacctgatagtacagaacctcgaagccgagaattacaatattgaaagtgctataatcgctgtgctcaggatgaatcagggtaagaggaataacgctgaggaaaacctggaaccttctggcagagtgttgaaacaatgcgggcctctgtgggaggaagggggaagtggcgctaggattttcggcaaccaagggctaaatgaaggccgaactgagaacaataaggctcaggcaagcccctccgaagagaataaggctaacaagaatcagcttgccaaggttaccaataaacagcggagggaacagcagtggatggaaaaaaagaagaggcaagaagagaggcaccgccacaaagctctggaaagccggggttcacacagagacaacaacagatcagaagctgaagccaatactcaggtgacgctagttaagaccttcgcggctctgaacatctag

SEQ ID NO: 233683 - DNA, 438 bp, Artificial Sequence
  Description of Artificial Sequence: Synthetic coding sequence
atggcctgtattcactacttaagggaaaaccgtgagaagttcgaggccttcatcgaaggatccttcgaagagtacctgaagaggctggagaatcctcaagaatgggtgggacaggtagaaatctctgctctctctctgatgtatcggaaagactttattatctaccgagagccgaacgtgagtccatcccaggtgaccgagaataatttcccggagaaggtgcttctgtgcttcagcaacggaaaccattatgatattgtctacccgatcaaatataaggagtcatccgccatgtgccagtccctcctatacgaattgttgtacgaaaaggtgttcaaaacagacgtctccaagatcgtaatggaactggacaccttggaggtggcagatgaggacaactccgagatttcagactctgaagatgattcttgcaaatag

SEQ ID NO: 233684 - DNA, 3345 bp, Artificial Sequence
  Description of Artificial Sequence: Synthetic coding sequence
atggaagctgccgtcggggttcccgatgggggagatcagggaggggcagggccacgggaggatgccactcctatggacgcctacttaaggaaactggggctttatcggaaactcgtcgccaaagatggcagttgcctgtttagggccgtggccgaacaggtcctgcattcacagagcagacacgtcgaagtgcgcatggcctgcatacattacttgcgggaaaatcgggagaagtttgaagcatttatcgaaggaagttttgaggagtatttaaaacggttagagaacccccaggagtgggtaggtcaagtggagatcagcgctttgtcgctgatgtatcgcaaagactttattatatatagagaaccgaacgtttcaccatctcaggtaacagagaacaatttccccgagaaggtcttgctctgtttcagcaatggtaatcactatgatatcgtgtaccctatcaagtacaaggagtcctctgccatgtgccaatctttgctgtacgaactgctgtacgaaaaagtgttcaaaaccgacgtctccaaaatcgtcatggagttagacactctcgaggtggcagacgaggataattccgagatttcagactctgaggacgactcctgtaaatctaagaccgctgctgctgccgcagatgtaaatggcttcaaacctcttagtgggaacgaacagcttaagaacaatggcaattccaccagtctcccccttagcaggaaagtgctgaaatcgctgaacccggcagtctaccggaatgtggagtatgagatctggctgaagagcaagcaggcccagcagaagagagattattcaatcgccgcaggactgcagtacgaggttggagataaatgtcaagtgcgcttggaccacaatgggaagttcctgaacgctgatgtacaggggatccattccgagaacggacctgtcctggtagaagagctgggcaaaaagcatacctctaagaatcttaaggcaccgcctcctgaatcgtggaataccgtatccggaaagaaaatgaaaaagccaagcacctccggccagaacttccacagtgacgtggactaccgtggtccaaagaacccctcaaaaccaatcaaggccccttcagcactgccaccaaggctccaacatccaagcggggtcaggcagcacgccttttcatcccacagcagtggcagtcagtcccagaaattcagctcggagcacaaaaacctgagcagaacccccagccagattatccgcaagcctgaccgggagcgggttgaggactttgatcatacctcccgagagtctaattatttcggtctgagcccggaagaaagacgcgagaaacaggcaattgaggaatcgagattattatacgaaatccaaaatcgcgatgagcaggcatttcctgccctgagtagtagcagcgtgaatcagagcgcttcccagtccagcaacccttgcgtgcaacgaaaatcatcccacgttggggaccgcaagggctctagaaggcgcatggataccgaagaacggaaggacaaagactctatccacggacattcgcagctggataaacgacccgagccttctaccctcgaaaatataaccgacgacaagtatgcaacagtttccagtcctagcaagtccaaaaaattagagtgcccaagccctgcagagcaaaagcctgctgaacacgtgtctcttagtaatccggctcctctactggttagcccggaggtccacctcacccctgcagtccccagcctccccgctaccgtgcccgcatggccaagcgagcccaccacatttggccctaccggagtgcccgctcccatccccgtgctctccgtgacccagacacttaccaccggccctgactctgcggtgtcgcaagcgcacctgacaccgtcaccggtgccagtgagcatccaagcagtaaaccaacccttaatgcctctcccccagaccctgtcattataccaggaccccctgtaccctggattcccctgtaacgagaagggtgaccgcgctattgtcccaccttatagcttatgccagactggagaggatctcccgaaagataaaaacatcctgcgctttttctttaatctgggagttaaggcctattcttgccccatgtgggcccctcatagttacctgtatcccttgcaccaagcatatttggccgcttgccgtatgtacccaaaggtccccgtaccagtgtatccccataacccatggtttcaggaagcccctgcagcccagaatgagtcagactgcacttgtacggacgctcacttccctatgcagactgaagcctcagtaaatggacaaatgccacagcctgagatcggaccaccgactttctcctctccactggtgatccctccatctcaagtgtctgagtcccacggtcaactcagctatcaggctgatctagagtccgaaacgcctggtcagctactgcatgccgactatgaagaatcactgtcaggaaaaaatatgttcccacagccatctttcgggccaaacccattcttgggcccagtccccatcgctcctccatttttccctcacgtgtggtatggctacccgtttcagggattcatcgagaaccccgttatgcgccaaaatattgtgttgccgtctgacgagaagggggagttagacctgagcctggagaatttggacctttccaaggattgcggatcagtgagtactgttgatgagtttcccgaggcacgcggagaacacgtgcactctctgcctgaagcttccgtatccagtaagccggacgaaggtaggaccgaacaatcaagccaaactcgcaaggcagataccgctctcgcgtcaatccctcctgtagcggaaggcaaggctcacccacctacgcagatcttgaaccgcgaacgcgagactgtacccgtggagctggaacccaaaagaacgatccaatctctcaaggagaagacggaaaaagtaaaggatccgaagaccgcagcagacgtcgtgtcgcctggggctaatagtgtcgattctcgggtccagaggccaaaggaggaatcctcggaagatgaaaatgaagtctccaacatactgcggagcggcaggagcaagcagttctacaatcaaacctatggctctcgaaaatataaaagcgattgggggtactccggcagaggcggatatcaacacgtgaggtcggaggagtcttggaaagggcagccctctagaagcagagatgagggctatcagtaccacagaaatgtcaggggtcgtccatttcgcggagacagaaggcgttcggggatgggggacggtcaccgtggacaacacacctag

SEQ ID NO: 233685 - DNA, 3150 bp, Artificial Sequence
  Description of Artificial Sequence: Synthetic coding sequence
atggcttgcatccattatcttcgtgagaaccgcgagaagtttgaggcctttattgagggatcctttgaggaatatttgaaacggctggagaacccccaggaatgggtaggacaggtcgagattagtgccttgtccttgatgtacagaaaggatttcattatataccgagagcctaacgtaagtccctctcaggtcaccgaaaacaactttcccgaaaaggtgctgctctgcttcagcaatggcaatcactacgatatcgtctacccaataaaatacaaagaatcttctgcaatgtgccagtctcttttgtacgagcttctatacgaaaaagttttcaagaccgatgtttcaaagatagtgatggagttggataccctcgaggtggctgatgaagacaattctgagatctccgactctgaagacgacagttgcaagagtaagactgctgcagctgcagctgacgtgaacggattcaaaccgttgtcagggaatgagcagctcaagaacaacggcaatagcacttctctgccgctgtcgcggaaagtcctcaagtcactaaacccagccgtctaccgaaatgtggaatacgagatatggctcaaaagcaagcaggctcagcaaaagcgagactattctattgccgctgggctccagtacgaagtcggtgataagtgccaggttcgtctggatcacaacggaaagttcctgaacgccgacgttcagggtatccatagtgagaacgggccagttctcgtagaggaactggggaagaagcatacctctaaaaatctgaaggcccctccccctgaatcttggaacacagtgtccgggaagaagatgaaaaagccttctacgtcgggacagaattttcattccgatgtcgactatcgaggcccaaagaacccaagtaagcctatcaaagcacctagcgcactccccccacgactccagcatcctagcggggtcagacaacacgcatttagcagccacagcagtgggagccaaagccagaagttctcatctgaacacaagaatctgagtcgaacgcccagccagatcattaggaaaccagacagggagcgcgttgaagattttgatcatacctctcgggagagtaactactttggcctgagtcccgaagaacgcagggagaaacaagcaatcgaggaatctcgcttactgtacgagattcagaaccgggatgagcaagcctttcctgcattgagctcctctagcgtgaaccagagtgccagtcaaagtagtaacccctgcgtccagcggaaatcatctcacgtgggtgaccggaagggaagcaggcgtcggatggatactgaggagcgaaaggacaaggatagcattcacggtcattctcagctggataaaagaccagagccatcgactttggaaaatattacagacgacaagtacgccacagttagcagcccgagtaaatcaaagaaactggagtgcccttcgcccgcagagcagaaacccgctgaacatgtttccctgagcaaccccgctcctctgctcgtgagcccagaagtgcacctgactcccgctgtcccttcactgccagcaacagtgcccgcatggcccagcgagccgaccacattcggcccaactggggtgccagctccgatccccgtgctgtcggtcactcagactctgacgacgggccctgattccgctgtgtcccaggcacatttgacccccagcccagttcctgtgagtatccaggccgtgaatcagccgcttatgccccttccacagacactttctctgtatcaggatccgctttatcctggtttcccatgcaacgagaagggcgaccgcgctatcgtcccaccatatagcttatgtcagacaggtgaagacctgccaaaggacaagaatatcctgagattcttcttcaatctcggcgtcaaggcttatagttgcccgatgtgggcccctcactcatatctgtaccctctgcaccaggcctatctggctgcttgtagaatgtatccaaaagtgccagtgccagtgtacccacacaacccatggtttcaggaggctcctgccgctcagaatgagtctgactgtacctgtaccgatgcgcatttccccatgcaaacagaagcatccgtaaatgggcaaatgccgcaacccgaaataggaccaccaacatttagtagcccattggtgatccccccttcccaggtcagcgaatcacacggtcaactgagttatcaggctgatctggagtctgagacccccggacaactgctccacgccgattatgaagagtccctctctgggaagaatatgttccctcagccctcattcggacctaaccctttcttagggccagtgcctatagcaccccctttcttccctcatgtctggtacgggtacccttttcagggctttattgagaatcccgtgatgcgacagaatatagtcctgccctccgatgagaagggggaattggacctatctctcgagaacctggatctgtcaaaggactgtggcagtgtgtcaactgtagacgagttccccgaggccagaggcgagcacgtccatagcctgccagaggcttccgtgtccagtaagcccgacgagggcaggacagagcagagtagtcagacccggaaagccgacacagcacttgcttcaataccacccgtggccgaaggaaaggcccacccgccaacacagatcttaaacagggagcgcgagaccgtgccagtcgagctcgagcccaaaaggacaatccagtccctgaaagagaaaaccgagaaggtcaaggaccccaagactgcagccgatgtggttagtcctggggcaaacagtgtcgactctagggttcagagaccaaaggaggagtcatctgaagatgaaaacgaagtgtctaatattcttaggtccggccgtagcaagcagttttataaccagacttatggctctaggaagtataaaagtgattgggggtacagtggccgtgggggataccagcacgttaggtcagaggagagctggaaggggcagccttcccgcagccgcgatgagggctatcagtaccaccgtaacgttcgcggtcgacctttcaggggtgaccggcgacggtctggcatgggggacggccaccggggtcaacatacatag

SEQ ID NO: 233686 - DNA, 420 bp, Artificial Sequence
  Description of Artificial Sequence: Synthetic coding sequence
atggcgtgtatccattatctgagggaaaatcgagagaagtttgaggcctttattgagggctcatttgaagaataccttaagaggctcgagaacccccaggaatgggttggccaggtggagatcagcgccctatcattgatgtatcgtaaggatttcattatctatcgagaacctaacgtttccccatcgcaggtcaccgagaataacttccctgagaaagtcctgttgtgtttcagcaatgggaaccactatgatattgtgtacccaattaaatataaagaatcctctgctatgtgccagtctctgctctacgagcttctctatgagaaggtgtttaaaacggatgtctcaaaaattgtgatggagctcgacactctggaggtggcagacgaagataattcagagatcagcgattcttag

SEQ ID NO: 233687 - DNA, 438 bp, Artificial Sequence
  Description of Artificial Sequence: Synthetic coding sequence
atggcgtgcatacattacctgagagaaaaccgcgagaagttcgaggcatttatagaaggaagcttcgaagaataccttaagcgccttgagaatccccaggagtgggttggtcaggtggagatctccgccctttccctcatgtatcgcaaggactttattatttaccgagagcctaacgtgagccccagtcaggtgaccgagaacaactttccagagaaagtgctgctttgtttctcgaatggaaatcactacgacattgtttacccaatcaagtataaggaaagcagcgcaatgtgccagtccctcctttacgaactgctgtatgaaaaggtgtttaagacggacgtgtctaaaatcgtgatggagctggacaccctggaagtcgccgacgaggataacagtgagatttctgactcagaggacgacagctgcaaatag

SEQ ID NO: 233688 - DNA, 1716 bp, Artificial Sequence
  Description of Artificial Sequence: Synthetic coding sequence
atgacaattttgccaaaaaagaaaccaccacctccggatgcagatccagctaatgaaccacccccacccggacccatgccgcctgcccctagacgaggaggaggggtcggggtgggcggtggtggcaccggagtgggtggtggcgatcgggaccgggattcaggcgtggtaggagccaggccccgtgccagccccccaccacaagggccactgccgggtcccccaggcgcactgcaccggtgggccttggccgttcctcccggagccgttgctggtcccagacctcagcaggcctcgccacctccttgtggcggacccggagggccaggcggtggcccaggagacgctcttggtgccgcagccgcaggcgtgggcgcagccggagtggtggtcggcgtggggggagccgtcggcgtcggagggtgctgttcagggccaggacatagtaagaggaggaggcaggcgcctggcgtgggcgcagtgggcggaggttcgcctgaaagggaagaggtcggggctggatataatagcgaggacgagtacgaggccgctgctgctcgcatcgaagccatggatccagctacagtcgaacaacaagaacattggttcgaaaaagcactgcgcgacaaaaaagggtttatcatcaaacagatgaaagaggacggagcctgtctgtttcgcgctgttgcagatcaagtgtatggcgaccaggatatgcacgaggtggtccgcaaacactgtatggactacctcatgaaaaatgcagactattttagcaactacgtgactgaggatttcactacttatatcaatcgtaagcggaaaaataattgccatgggaaccatatcgagatgcaagctatggcagagatgtacaaccggccagtggaggtctatcagtatagcaccggtacgagtgccgtcgagcctattaacactttccatgggattcaccagaatgaggatgaaccaatcagagtctcctatcacagaaatatccactacaacagcgtcgtgaaccccaacaaagcgacaattggagttggattgggtttgccatccttcaagcctgggtttgctgagcaaagtttgatgaagaacgccattaagacctccgaggaaagttggattgagcagcagatgcttgaggataagaaaagagctaccgattgggaggcaacaaacgaagcaatcgaggagcaggtggcacgcgagtcttatttgcagtggctcagagatcaggagaagcaggccagacaggtaagaggaccctcacagcctcgcaaagcctctgccacttgttccagcgcaacagccgcagcgtccagcggactagaggaatggacctctagaagccccagacaacgctcctccgcatcttcccccgagcatcccgagctgcacgccgagcttggcatgaaaccccctagtcccggaactgtgctggctctggctaaaccacccagcccttgcgctccagggacaagcagccagttcagcgcgggagcagacagagccacatcgcccctggtctctctgtacccagccctggagtgccgtgccctgatacagcagatgagtccatcagcatttggactcaacgactgggatgatgacgagattttagcgtccgtgttggctgtgtcccagcaggaatacctagacagtatgaaaaagaacaaagtccacagagaccctcccccagataagagttag

SEQ ID NO: 233689 - DNA, 1701 bp, Artificial Sequence
  Description of Artificial Sequence: Synthetic coding sequence
atgactattctgccgaaaaaaaaaccacctccacctgacgcagatcccgctaacgagcccccaccccctggaccaatgcccccagctccacggagagggggtggtgtgggggtaggcggaggcggtaccggagtgggcggaggagatcgggacagggattcaggtgtagtaggcgctcgccctagggcctcacccccaccacagggcccactaccaggccctcctggggctcttcatcggtgggccctggccgtaccccctggcgctgttgccggaccaaggccgcagcaggcatctccccctccctgcggcggaccagggggtccgggtggtgggcctggtgacgcactcggagcagcagctgccggtgtaggcgcagctggagtcgtcgtgggcgttgggggagcagtgggggtgggaggatgctgtagcggccctggtcattcaaaaaggaggcgccaggctcccggagtcggtgcggtcggcggagggagtccagagcgcgaggaggtgggcgcaggctacaacagtgaggacgaatacgaggcagcagccgctcgcattgaggccatggatccagcgacagtagagcagcaggagcactggttcgagaaagccctcagagacaaaaagggtttcattattaagcagatgaaggaagacggggcttgcttatttcgcgctgtggcagatcaggtttatggcgatcaggatatgcatgaggtagtgcgaaaacattgcatggactacttgatgaagaacgcggactactttagtaattatgtgactgaagatttcacaacctacattaacagaaagaggaagaacaattgccatggaaatcatattgagatgcaggccatggcggagatgtacaatagacccgtggaagtctaccagtattcaactgagccaatcaacaccttccatggaattcatcagaatgaagacgagcccatccgcgtgtcctaccaccgaaacatccactataattcagtcgtaaaccctaataaggctaccatcggcgtgggcttggggctgccttcctttaaacccggatttgcagagcagtctctgatgaagaacgcaataaaaacctctgaggagagctggatagagcagcagatgcttgaggacaagaaacgtgcgactgactgggaggcgaccaacgaggccattgaggagcaagtggcccgagaaagctatctgcagtggctgcgggaccaagagaaacaggcccgacaggtgaggggaccttcgcagccacgcaaggcctccgccacttgctcatcagccacagcggctgcctcttccggcttagaggagtggactagccggtcgccgaggcagcggtcctctgcaagttctcccgaacatcccgaattacatgccgagctaggcatgaagccaccctcacccggaactgtgcttgcactagctaaaccccctagtccctgtgcacctggcacctcctcacagtttagcgctggcgcagatagggctacgagtccgctggtgagcctgtatcctgccctcgaatgccgcgcactcatccagcaaatgagcccaagcgcgttcggattaaacgactgggatgacgatgagatcctcgccagcgtgctcgctgtatctcagcaggaatatctcgatagcatgaagaagaataaggtccatcgagaccctccgccagataaatcctag

SEQ ID NO: 233690 - DNA, 1701 bp, Artificial Sequence
  Description of Artificial Sequence: Synthetic coding sequence
atgactattctcccaaaaaagaagccacccccaccggacgccgatcctgcaaatgaacctcccccaccaggacctatgccccctgcacccagaagaggagggggagtgggggtcggcggaggagggaccggagtcggcggaggagaccgtgatagggacagcggtgtggtgggggctaggcccagggcctcacccccaccccaagggccactgcccggacctccaggagcgctacaccggtgggctcttgcggtgccacccggtgcagtggcagggcctagacctcagcaagcctccccgccaccttgtggagggcctggaggtccaggcggtggcccaggggatgcgctcggcgctgcagcagctggggtgggcgcagccggtgtcgtagttggggttggaggcgctgtcggcgtggggggatgctgttctggccctggtcactccaagaggaggagacaggcacccggagtgggggctgtgggcggtggatcccctgagcgcgaggaagtaggagccggatacaattctgaggacgaatacgaggctgctgcagccagaatcgaggcaatggaccctgctaccgtggagcagcaggaacactggtttgaaaaggctttgcgagataaaaagggctttattatcaagcagatgaaggaggacggcgcttgtttgttcagagctgtggcggaccaggtgtatggggatcaggatatgcatgaggtggtccgaaagcattgtatggattatctgatgaagaacgcagactacttctctaactatgtgacagaggattttactacctacatcaatcggaagcggaagaacaactgtcacggaaatcacatcgaaatgcaggccatggctgagatgtacaaccgccctgtggaggtctatcaatatagcactgagcccattaacactttccacggcatccatcagaatgaggatgagcctatcagggtgagctaccaccgaaacattcactataattctgtggtgaatcccaacaaggctaccattggggtgggcttagggcttccttcattcaaacccggtttcgctgagcagagcctgatgaagaacgcaatcaagacctctgaggaatcatggatagaacagcagatgctagaggacaaaaagagggccaccgactgggaagccacaaacgaagccatcgaggagcaggtcgctagggaaagctacctgcaatggcttcgggaccaggagaagcaagcccgacaagtacgcggtccttcccagccaagaaaggcctctgcaacctgttcttccgccacggcagccgctagctcgggtcttgaagaatggacaagtaggtctccccgtcaaaggtcctctgctagctcacctgagcaccctgaattgcacgcagaattgggcatgaaaccaccgtcccccggaacagtcctggccctcgccaagcccccatcgccctgcgctcctggtacttcttctcagttctcagcaggcgcagatcgcgcaaccagtccgttggtgtcactatacccagcactggaatgcagagctctgatccagcagatgtccccttccgcgttcggtcttaatgactgggacgacgatgagattttggcaagtgtattggccgtgtcccagcaggaatacttagacagcatgaagaagaacaaagtacacagagatcccccaccagacaagagctag

SEQ ID NO: 233691 - DNA, 1050 bp, Artificial Sequence
  Description of Artificial Sequence: Synthetic coding sequence
atgaaggaggacggagcctgcctgttccgggcagttgccgaccaggtgtatggggaccaggacatgcatgaagttgtaagaaaacattgcatggactacctcatgaagaatgccgactatttcagtaactatgtgacggaggatttcaccacatacatcaacaggaaacggaagaacaattgtcacggaaaccacattgagatgcaggctatggctgagatgtacaacaggccagtggaagtataccagtacagtacggagcctatcaacactttccacggcattcaccagaacgaagacgagccgataagggtatcgtaccatcgtaacatacattataactctgtggtcaacccaaataaagctactatcggcgtgggtctgggtttgccttctttcaagcctggattcgccgagcagtctcttatgaagaatgccattaagacttcagaagaaagctggatcgagcagcaaatgctggaggacaaaaagcgcgctacagattgggaggccacgaatgaggctattgaggagcaagttgctagagagagttacctgcagtggctgagagatcaggagaagcaggccaggcaggttcgcggaccctcccagccaagaaaagcaagcgccacatgttcctccgccactgccgctgcctcttcaggcctggaagaatggaccagcaggtctcccaggcagagaagctcagcctcttccccagagcaccccgagctccacgcagagctggggatgaagccccctagccctgggactgtcctggcccttgccaaacccccttccccctgcgcacctggcactagcagtcagtttagtgctggcgcagacagagctactagtcccttggttagcctgtatccagctcttgagtgccgcgctctgatccagcagatgtctcccagcgccttcggcctcaacgactgggatgacgacgaaatccttgcaagcgtgctggctgtgagccagcaggagtatttggacagcatgaaaaagaataaagtgcaccgggatccgcctccagataagtcctag

SEQ ID NO: 233692 - DNA, 1629 bp, Artificial Sequence
  Description of Artificial Sequence: Synthetic coding sequence
atgaccattctgcctaagaagaagcccccacccccagacgccgacccaggaggaaccggcgtcggaggaggggaccgtgatcgcgatagtggggtcgtgggagcccgacctcgcgctagccccccaccccaagggcctctccccggtccaccaggcgctcttcaccggtgggctctggcagtgccacccggtgctgtggctggccctcggccacagcaggccagcccacctccttgcgggggtcctggcggaccaggagggggaccaggtgacgcccttggagcagctgctgccggagttggtgctgccggagttgttgtcggcgttggaggcgctgtgggggtggggggttgctgttccgggcctggtcatagcaaaagaagacgccaggccccaggggttggagctgtgggcggtgggtcccctgaacgcgaggaggttggtgccggatataattcagaggatgaatacgaggccgcagccgctaggattgaggctatggatcccgcaactgtggagcaacaggagcactggtttgagaaggccctgcgggacaagaagggttttattattaagcaaatgaaggaggatggagcctgtcttttcagggccgtggctgaccaggtatacggtgaccaggacatgcacgaagtggtgaggaaacactgtatggattacctgatgaaaaatgccgactatttcagtaattacgtgaccgaagatttcacaacgtatatcaaccgtaaaaggaaaaataattgccatgggaatcacatagaaatgcaggctatggcggaaatgtacaatcgaccagtcgaagtgtaccagtattccacagagccaatcaataccttccacgggatccatcaaaatgaagacgaacccataagagtgtcttatcacagaaacatccattataactccgtggtaaaccccaacaaagcaacgattggagtggggttggggctgccctcctttaaaccaggatttgctgaacagtcccttatgaagaatgctatcaaaaccagtgaagaaagttggatcgaacagcaaatgctcgaggataagaagagggccactgattgggaagcaaccaatgaagctatcgaagaacaagtggctcgcgagtcttacttgcagtggcttagggaccaggaaaagcaggccaggcaggttcgcggaccgtctcaaccccgtaaggcctcagccacctgttcttcggcaacggcggcagctagtagcggcttggaagagtggacctctaggagtccaagacaacgttcttcagccagcagccccgaacatccagaactccacgctgagctgggaatgaaacctccgagtccgggaacagtactcgccctggccaagcctccttccccctgcgctccagggacatcctcccagttcagcgccggagcagacagagccacctcaccactggtgagcttgtaccccgctcttgagtgccgggctcttattcagcagatgtctccctcagctttcgggcttaacgattgggacgacgatgagatcctggcgagcgtgctagcagtgagccaacaggagtacctagattccatgaagaaaaataaggtccatcgagaccccccacctgataagagctag

SEQ ID NO: 233693 - DNA, 1335 bp, Artificial Sequence
  Description of Artificial Sequence: Synthetic coding sequence
ggggtggtggttggagttggcggagcggtcggcgtggggggatgctgttctgggccaggtcattcaaagcggcgaaggcaggccccaggagttggcgctgtcggaggcggtagcccagagagggaagaagttggagctggctataacagcgaggacgaatacgaggctgccgcagctagaatcgaagctatggatcccgctacagtagagcagcaggagcactggttcgagaaggctctgagggacaaaaaaggcttcatcatcaagcaaatgaaggaggacggcgcttgtcttttccgcgctgtggccgaccaggtgtatggggaccaggatatgcacgaagtggtgagaaagcactgcatggactacctaatgaaaaacgctgattatttctctaattacgtaacagaagattttaccacttatatcaatcgtaagcgaaaaaacaactgccatggcaaccacatcgagatgcaagccatggcagagatgtacaacaggcccgtggaggtgtaccagtattctacaggaactagcgccgtagaacctataaacacttttcatgggattcatcagaatgaggatgagcccatccgggtgagctatcataggaacattcactacaatagcgttgtgaaccccaataaagctactattggggtggggctaggactgccctctttcaagccaggcttcgcggagcagagcctgatgaaaaatgccatcaaaacatctgaagaatcctggatagagcagcaaatgctggaggacaagaagagggccaccgactgggaagccacaaacgaagctatcgaggaacaggtcgccagggaatcctacctgcagtggcttcgtgatcaagagaaacaggctcggcaggtaagagggccttcccagcctcggaaagcgagcgcaacctgctcctccgctaccgctgcggctagcagcggtctggaagagtggacgtctcgctctccaaggcagaggtcctccgcttctagccccgagcatcccgaattacacgctgaattaggcatgaagcctccttcccctggcactgtcctggcacttgccaaacctccctcgccatgtgccccaggaactagctcccagttttccgcaggggcagaccgggcaacttcacccctggtgtccctgtatccagcgctcgagtgccgtgccctgattcaacagatgtcaccttccgcatttgggcttaacgactgggatgatgacgaaatactggcctccgtactcgcagtgagccagcaagaatacctcgacagtatgaagaaaaacaaagtacaccgagacccccctccggataagtcttag

SEQ ID NO: 233694 - DNA, 867 bp, Artificial Sequence
  Description of Artificial Sequence: Synthetic coding sequence
atggatgatcctaagtcagagcagcagagaatacttcggaggcatcagagggaacgccaggaattgcaggcccaaatacgatctctgaaaaactcggtccccaaaaccgataaaacaaaacgaaagcagttactgcaggatgttgcaaggatggaggccgaaatggctcagaagcacagacaggaactagaaaaattccaagacgattcatctattgaatctgttgttgaagacctggctaaaatgaacctcgaaaaccgacctccacggtctagcaaggcccatcggaaaagggaaagaatggaatcagaggaacgtgagcggcaggagagtattttccaggcggaaatgagtgaacatctggcgggatttaagagggaggaagaggagaaactggctgcaattcttggagcgcgtggtcttgaaatgaaggccattcccgcagatggccactgtatgtatcgcgctatccaggatcagctggtgttctccgtaagcgtcgagatgctacgctgtagaactgcctcctacatgaagaaacacgtggatgagttcctccccttttttagtaatcccgagacttctgactcattcggttacgatgacttcatgatatattgtgacaatatcgttcgaactaccgcctgggggggacagctcgagctgcgcgcactttcccacgttctgaaaacacccattgaagtgatccaggccgactccccgactctgattattggtgaagaatatgtcaaaaagccgattatcctggtgtatctgaggtacgcatacagtctgggcgaacactacaactctgtaactcctcttgaagcaggagctgcaggcggagtactgcccagactgctgtag

SEQ ID NO: 233695 - DNA, 972 bp, Artificial Sequence
  Description of Artificial Sequence: Synthetic coding sequence
atggaaccccgtgtgagagtagaaggttggaaggtccccacaagccgctgccggttcctgctcgccagagtgctgggatacctcgtggtgatggaagccgttctgacagaggagctggatgaagaggagcaacttcttcgccgtcaccggaaggaaaaaaaggaattacaggctaagatacaaggtatgaaaaacgctgtgccaaagaatgataaaaagaggcgcaagcagctgacagaggatgtcgcaaaactggaaaaagagatggaacagaaacaccgcgaagagctggaacagcttaaactgaccacaaaagaaaacaagattgactctgtggcagtaaatatatccaatctggtgctggagaaccagcccccacgcatttcgaaagcacagaagcgtagagagaaaaaagccgcactcgagaaggagcgggaggagcgtattgcagaagctgaaattgaaaatctgaccggagcacgacacatggaatccgagaaacttgcacagattttggccgctaggcagctggagattaagcagattccttccgacggtcattgcatgtataaggccattgaggatcagcttaaggaaaaggattgtgcgctgactgtagtggccctgaggtctcagactgccgagtacatgcagtcacatgtcgaggatttcctccccttccttacaaatccgaacacgggagacatgtacactcctgaggagtttcaaaaatattgcgaggatatcgtcaacaccgctgcatgggggggacaattagaacttcgcgcactcagtcacattcttcagacccctatcgaaattatccaggcagactcccctcctattatcgtcggagaggagtattctaagaagcccttaatcttagtttacatgcgccatgcttatggactgggcgaacattataatagcgtcactagactcgttaacatcgttactgaaaactgctcttag

SEQ ID NO: 233696 - DNA, 579 bp, Artificial Sequence
  Description of Artificial Sequence: Synthetic coding sequence
atgatctccaaagagaaaaaggctgcactggagaaggagcgagaggagcggatcgctgaggccgaaatcgagaatctcacaggcgctcgccacatggaaagcgagaagctcgcgcagatcctggccgctcgacagctggagattaagcagataccctcagacggtcattgtatgtacaaggctatcgaggatcagctgaaggaaaaggactgcgccttgactgtcgttgcgctgcggtcacagacggcggagtatatgcagagccacgtggaggattttcttccctttttgactaaccctaacacaggcgacatgtatacacccgaagagttccagaagtattgtgaggacattgttaacacagctgcctggggcggtcagctcgaactccgcgcattgagccatatcctgcaaacaccaatcgaaataattcaggcagattcaccaccaattatagtaggtgaagaatacagcaaaaagccattaatccttgtgtacatgaggcatgcctatggcttgggagaacactacaacagcgttacccgtctcgtgaatattgtgactgagaattgcagctag

SEQ ID NO: 233697 - DNA, 2781 bp, Artificial Sequence
  Description of Artificial Sequence: Synthetic coding sequence
atggtctcaagcgtccttccgaatccaaccagtgcagagtgctgggccgctctgctgcacgatccaatgaccttggatatggacgctgtgcttagcgatttcgtgagatcaacaggtgctgagccagggcttgcacgggacctcctagaagggaagaattgggacttaacggccgctctgtcagattacgaacagttgcggcaggtgcacacagctaatcttccgcacgtgtttaatgagggacggggacctaagcagcccgagagggagccccagccgggacataaggtggagcggccatgcctacagcgacaagacgacattgcccaggagaaacgcctatcacgcggaatttctcatgcctcttctgccatcgtgtctttagcaagaagtcacgtcgcatccgagtgcaataacgaacagttccctcttgaaatgccaatttacacgttccagctgccagatctcagtgtatattcagaagacttcagatcgttcatcgaacgggatttaattgaacaggcaacaatggtcgccctggaacaagccggaagacttaactggtggagcacagtctgcacatcctgcaaaagactgttacctctcgctactaccggggatggcaactgcctgctccatgctgcttctcttggcatgtggggctttcatgatagagatctggtgctccgcaaggccctctacacaatgatgagaacaggcgcagagcgagaggccctaaaaagaaggtggcggtggcaacagacgcaacagaataaagaggaagaatgggagcgtgaatggactgagttgctcaaactggcctcgtctgagcctcgtacccactttagtaagaatggagggacgggaggaggagtggataatagcgaggatccagtttatgagtcactcgaggaattccacgttttcgtccttgctcatatcctgcggagacccatcgtcgtcgtggctgatacaatgctcagggatagcggaggagaggccttcgcacccataccgttcgggggaatctatctgccccttgaagtgcctcctaatcgatgtcactgttcccctctggtgcttgcttacgatcaggctcattttagcgcgctggtgtctatggaacagcgggaccaacagagggagcaggctgtgattccactgacagactctgaacataaactgctgccactccactttgcagtcgaccctgggaaggattgggagtgggggaaagacgataatgacaatgcaagactggcccatctcatcctgagtctggaggctaaactgaacctgcttcatagctacatgaacgtgacctggatcagaattccctcagagacgcgcgctccactcgctcagcccgaatccccaacggcttctgcgggagaggacgtacagtctctggccgattcactggacagcgatagagactcagtgtgctctaacagcaactctaacaacgggaaaaacggcaaagataaagagaaggaaaaacagagaaaggagaaagacaaaacacgcgcagattccgtcgcgaacaaactcgggtccttctccaaaactttaggcattaaactcaaaaagaacatgggtggtctcgggggtctagtccatggcaaaatggggcgagctaatagcgccaatggaaagaacggcgatagcgctgagagaggcaaggagaagaaagcgaagtcaaggaaggggtctaaggaagagtccggtgcctctgccagcacctccccgagcgagaagaccacccccagccctacggataaagccgcaggagcctcaccagctgaaaagggaggcggtcctcggggtgacgcctggaaatattccacagacgtcaaactgtccctcaacattctgagggccgctatgcagggcgagagaaaattcatatttgctggattgctcctaacgtcacatcggcaccagttccacgaggagatgataggctattatctgacatcagctcaggagagatttagcgcagaacaggaacagcgacgaagggatgcggcaaccgcagcagccgctgcagcagccgcagccgcagccacagctaagcgaccaccacggagacccgagaccgaaggcgtacctgtgcccgagagagcctcccccggacctcctacacagctggtcctgaagctcaaagagcggccttcacccggacccgctgcaggacgcgcagctagagcggcagcaggaggcacagcatctcccggtggaggggctcgaagggcaagcgcatcaggaccggtgcctggccgatccccacctgcacccgctcggcagtccgtgatccacgtgcaggcctccggcgcaagggatgaagcctgcgccccagctgtcggggcactgcggccatgcgcaacctacccccaacaaaatcgcagcctttcttctcagtcatactctccagctcgcgctgctgccctccggaccgtgaacaccgtggaaagcctggcacgggctgtccctggggcactgccaggtgcagccggaactgctggtgccgcagagcataaatcccagacttacaccaacggatttggagccttgcgggatggtctggagtttgctgatgctgatgccccaaccgctagatccaacggagagtgcggcaggggcggaccgggtcccgtacaacggagatgccaaagggagaactgtgccttctacggcagggcagagaccgaacactattgttcctactgctaccgggaagaactgcggaggcggagagaggcccgtggggcacgcccttag

SEQ ID NO: 233698 - DNA, 2802 bp, Artificial Sequence
  Description of Artificial Sequence: Synthetic coding sequence
atggtgtcttcagttctgcccaacccgacatctgcggagtgttgggcagccctcctccatgacccgatgacactcgatatggacgctgtactatccgactttgtcagaagtaccggagccgaaccgggtttagcccgagatctgctagagggtaaaaattgggacctgacagccgcactttccgactacgagcagctgcgccaggtgcacaccgcgaacttgcctcacgtcttcaacgaagggagaggccctaagcaaccggaacgtgaacctcagccaggacacaaggtggaacggccttgtttacagagacaagacgatattgcacaggaaaaaaggctgtctcgaggaattagtcatgccagctccgctatcgtcagtcttgcccgttcccacgtggccagtgaatgcaacaatgaacagtttcccctggaaatgcctatctacacattccaactgccggatttgagcgtgtactcagaggacttcaggtcttttatcgaaagagacttgattgagcaagccacaatggtagccttagagcaggccggaaggctgaactggtggtctacagtgtgcaccagctgcaaacggctgctgccgctggctaccaccggggacgggaattgcctactccatgcagcgtcactggggatgtggggttttcacgacagagatttagtgctgaggaaagccctgtataccatgatgcgaaccggtgcagagcgcgaggctctgaaaaggcgctggcggtggcagcaaacccaacagaacaaagagagcggtctggtatatactgaagaggagtgggaacgcgagtggaccgagttactaaaactggcatcttccgagcccaggacgcacttcagcaagaacgggggaaccggagggggagttgacaactccgaggatccagtttatgagtcactggaggagtttcatgtattcgtgctggctcacatcctgcgcaggccaattgtcgtggtggccgacaccatgctgagagactcaggcggtgaggctttcgcgccaatcccctttgggggtatctatctgcctttggaagtgccccctaatcggtgccactgctctcctctggtgttggcctatgatcaggctcatttctccgcactcgtctcaatggagcagagagatcagcaacgggaacaggccgtcattcccctgaccgactccgagcataagctgttgcccctccattttgcggttgatcccggaaaagactgggagtggggcaaggatgataatgacaatgcacggttggcacatctgatcctttccctcgaagccaaattaaacctcctgcacagctacatgaatgtaacctggatcagaatcccttctgaaacccgagcaccgcttgcccagccagaatcccccaccgcatctgcgggtgaagatgttcagtcactggccgactccctggactcagaccgggactctgtgtgttcaaacagtaattccaataatggcaaaaatgggaaggataaggaaaaagagaagcagagaaaagagaaggacaagactcgcgcagattctgtggcaaacaagctgggatcctttagcaagaccctgggcataaagctgaaaaaaaacatgggcggtctgggcggacttgtgcacggcaaaatgggaagagccaactcggcaaacggaaaaaacggcgattccgcggagagaggcaaggagaaaaaagctaagtcaaggaagggatcgaaggaagagtcaggagcaagcgcatcgaccagcccaagtgagaaaactaccccttcacctaccgataaggctgccggtgcctcaccagcggaaaaagggggaggcccacgcggagacgcttggaagtattccacagacgttaaactgtccctgaacatccttcgcgcagccatgcaaggcgagagaaagtttatctttgctggcttactcctcacctcacaccgacatcaatttcacgaagagatgatcgggtattacttaaccagcgcacaggagcgcttcagtgcggagcaagaacagcgcagacgggatgctgccactgcggctgcggctgccgcagctgcagcggctgcaacagctaaacgccctcctcgtcggccagagacggagggcgttccagtaccagagcgggctagcccgggacctcctacgcagctcgttctgaagctgaaggaacgccctagtcccggaccagcagcaggcagagccgcacgagccgcagctggcggaaccgcatcaccaggcggaggtgcgcgacgtgcctcagcaagtggacccgttccaggccgttctcctccagcccctgctcggcagagtgtgatccatgtccaagcaagcggagccagggacgaggcctgtgcaccagccgtcggggcattgcggccttgcgcaacatatccccagcagaatcggagcctctcttcccagagctacagccctgccagagcagcagccttgagaacggtcaacacagttgagagccttgctcgcgctgtgcctggggctctgcctggcgctgccggaacagccggagctgcggaacacaagtcacagacgtacactaatgggttcggtgctctgcgggatggtctggaatttgcagacgccgacgcgccaacggcacgctctaacggagagtgcggcaggggcggacccggtcctgtgcaaagacgctgccaaagagagaactgcgctttttatggtagggcagagaccgagcactattgtagttactgctacagagaggagctccggcgtagaagggaagccagaggtgctcggccatag

SEQ ID NO: 233699 - DNA, 333 bp, Artificial Sequence
  Description of Artificial Sequence: Synthetic coding sequence
atggtgagttccgttttgccgaacccaacctcagctgagtgttgggctgccctgctacatgatccgatgacattagacatggacgctgttctgagtgattttgtccggagcacaggtgccgaacccggactggccagggacctgctggaagggaaaaattgggacttaactgcagcactatccgattatgaacagcttcggcaggtgcatactgcaaaccttcctcacgttttcaacgaagggagaggccctaagcagcccgaacgggaaccacagcccggtcacaaggttgaacggccttgtctccagcggcaagacgatatcgcacagtag

SEQ ID NO: 233700 - DNA, 2532 bp, Artificial Sequence
  Description of Artificial Sequence: Synthetic coding sequence
atgacccttgacatggatgctgtcctctcagattttgtgcgaagcacaggagctgaacctgggttggccagagatcttctcgaggggaaaaactgggacgtcaacgccgcacttagcgattttgagcagttgcgtcaggtccatgccggtaatttgcccccaagcttttccgaaggcagtggcggtagtcggaccccagaaaaaggattcagcgaccgagaaccaacccggccacctagacctatcctacagagacaggacgatatcgttcaggagaaacggttgagcagagggatatcgcatgcttcttcgtctattgtgtccctagctaggagccatgtttcatcaaacgggggtggaggaggaagcaatgaacaccctttggaaatgccaatatgcgccttccaactgccagacctgacagtgtataatgaggactttagatcgttcatcgaaagagacctgattgagcaatctatgctcgtggctctggagcaagcgggacgcctcaactggtgggtgtccgtggatcctacgtctcagagattgctgcctctggccacgactggggatggaaattgccttttgcacgcagcaagcctcggcatgtggggattccatgatcgagacctaatgttgagaaaggccctctacgccttgatggaaaagggcgtcgagaaggaggctttaaagagacgatggaggtggcaacagacacagcaaaataaggagtctggccttgtgtacactgaagacgaatggcagaaagaatggaatgaactcattaagctcgcctcaagtgagccaagaatgcaccttggaacgaatggagcgaattgtggaggagtggagtcttctgaggagcccgtatatgagtctctagaagaattccatgtgtttgttctagcccatgtgctgagaagacctatagtggtcgtggccgacacaatgctgagagatagcggtggtgaggccttcgctcccatcccatttgggggaatttacctgcctcttgaggtgccagccagccagtgtcacagatcaccactggtcctggcgtatgatcaggcccatttctcggcactggtgagcatggaacagaaagagaacaccaaggagcaggcagtcatccccctgaccgactctgaatataaactgctcccactgcattttgccgtggacccaggcaaagggtgggaatggggaaaggacgactcagataatgtgagactcgcctctgttattctttctctcgaggtcaaactccatttgttgcactcctatatgaacgtcaagtggattccgctctcaagcgacgcacaggctcccttggctcaacccgagtcgcccacagcatccgccggagacgagcctaggtccacccccgagagtggcgactctgataaggagtcagtcgggtcttcatctacaagcaacgaaggaggacggaggaaggaaaaatcgaagcgggacagagagaaagataaaaaacgggctgattccgtggctaataaactcggtagcttcggtaagaccttaggctccaaactgaagaaaaacatggggggactgatgcattccaaaggctcaaaacctggtggcgtaggcacagggttgggtgggagctcgggcaccgagacattggaaaaaaaaaagaaaaacagtctcaagagctggaaaggaggcaaggaggaggccgctggcgatggacccgtatcagaaaagccccctgcagagagcgtgggaaacggtggatcgaagtacagccaagaagtgatgcagagtttgtccattctgcgaacagccatgcagggcgaagggaaattcatctttgtagggactctcaagatgggccatcggcatcagtaccaagaggagatgatccagagatacctgtctgacgccgaagaacgctttttagctgaacaaaaacagaaggaggcagagaggaagattatgaacggcggtataggcggtggacctcccccagcaaaaaaacccgaaccggatgccagagaagaacagccaacgggtccccctgccgagtcccgggcaatggcttttagcacgggctatcccggagactttacaattccccgtccatctgggggaggagtgcattgtcaggagccgaggaggcaactcgctgggggaccctgcgtcggcggtctacccccttatgccacctttcccagacaatgtcccccaggccgtccctacccgcatcaggattccatcccgtccctggaaccaggcagccacagcaaggacggcctgcataggggggcactcctcccacccccatacagggtggccgacagttactccaatgggtatcgtgagcctcccgaacccgacggctgggccggtggcctgaggggactgcctcctacacagaccaagtgcaaacagccaaattgctcattctacgggcaccccgaaacgaataatttttgcagttgctgttacagagaagaactgagacgacgcgagcgagagccggacggggaattactcgtgcaccgcttttag

SEQ ID NO: 233701 - DNA, 1284 bp, Artificial Sequence
  Description of Artificial Sequence: Synthetic coding sequence
atgacccttgacatggatgccgtgttaagcgactttgtgagatcgacaggagctgaaccaggcttggcccgtgatctgctggagggcaaaaactgggacgttaatgccgctctgtcggatttcgagcagctgaggcaggttcacgcaggcaatctccccccttcttttagtgagggcagcgggggaagtcgcacacctgagaagggcttcagcgatcgggaaccaacccgacctccacggcctatcctccaaagacaggatgatattgtgcaagagaagcggctgtctagaggaattagccatgcctcttcgtccatcgttagcctggccaggtcccacgtgtcctcaaacggcggtggaggcggatccaatgaacatccactggaaatgcctatttgtgcattccagctgccagatttaactgtgtacaacgaggattttagaagttttatcgagcgtgacttgatcgagcagagtatgctggtggccctggagcaagccggaagactaaattggtgggtgtccgtcgaccctacgtcgcagcgcttgctgcccctagctacaacgggcgatggcaattgcttgcttcatgcagcgtcactcgggatgtggggctttcatgatcgcgacctgatgctgcgcaaggctctttatgctctcatggaaaagggagtggaaaaggaggcgctcaagcggaggtggagatggcagcagacacagcagaacaaagagtctggtctggtttatacagaagatgaatggcaaaaggagtggaatgagctgattaagctcgctagcagcgaaccaaggatgcatctggggactaatggggcaaactgtggaggtgtggagagctctgaggaaccagtgtatgaatctctggaagaattccatgtcttcgtacttgcccacgtgctgcgtaggccaatcgtcgtggtggctgatacaatgctcagggatagtgggggagaggccttcgccccaatacccttcggcggaatctaccttccactcgaagtacctgcctctcagtgccatcggagccctttggttttggcctatgatcaggctcatttctccgccctggtctcgatggagcaaaaggaaaatacaaaggagcaggctgtgatccctctgaccgacagcgaatacaagctcctcccactgcacttcgccgttgaccccggtaagggctgggaatggggaaaagatgattctgacaatgtgcggctggcaagtgtcattttatcccttgaggttaagttgcatcttctccatagttag

SEQ ID NO: 233702 - DNA, 2445 bp, Artificial Sequence
  Description of Artificial Sequence: Synthetic coding sequence
atgactctggacatggacgcagtactttccgactttgtcaggagtacgggagcagaacctggactagcccgtgacttgctggaggggaaaaactgggacgttaatgccgcactctcagactttgagcagctccggcaagtgcatgccggaaatctgcccccatcttttagcgaaggttctggaggttctagaacacctgaaaagggcttttccgatagagagcccacccgaccaccacgccctattctgcagaggcaggacgatatcgtgcaggagaagcggttgtctaggggaatatcacacgcttcctcttctattgtaagtctcgctagatctcatgtctcttctaacggaggcggtgggggatctaacgagcatcccctggagatgcccatttgtgctttccaacttccggatctgaccgtatataatgaagatttccgtagctttatcgaaagagatcttattgagcaaagcatgcttgtcgccctggaacaggctgggcgactgaattggtgggttagcgtggacccaacctcacaaaggcttctcccactggccaccacgggagatggtaattgtctgctgcatgctgccagcctggggatgtggggatttcatgatcgtgacttaatgttgcgaaaagccctgtatgcactgatggagaagggagtggagaaggaggcactgaagagacggtggagatggcagcaaactcaacagaacaaggagagcggcctggtatacactgaggacgaatggcagaaagagtggaatgaactgatcaagttggcttcatcagaaccccgtatgcacttagggacgaatggagcaaactgtggaggagtcgagagttccgaagaacctgtatatgagagcctggaagaattccacgtgttcgtcctggctcacgttctgaggaggcctatagtcgtcgtcgcggatactatgctgcgtgacagcggaggggaagcatttgctcctatcccttttgggggaatttaccttcctctggaggtgccagcgagccaatgtcacagatcccctctggtgctcgcctatgatcaggcccactttagcgccctggtgagcatggagcagaaggaaaatacgaaggaacaggccgttattccactgactgattcggagtacaagctcctccccctgcacttcgccgttgatcccggaaagggttgggagtgggggaaagacgattcagataatgtcaggctggccagcgttatattatcactggaggtgaagctgcatcttctgcatagctatatgaacgtcaaatggatccccctgtcatccgatgctcaggcgcctttggcacagccggaaagcccgaccgcttcagcaggagacgaacccaggtccactcccgaaagcggggacagtgacaaggagtcggtcgggagcagttctacctccaacgagggaggcaggcggaaagaaaaaagtaagagagaccgagaaaaggataagaagagagcagacagtgtggcgaacaaacttggttcttttggtaagacactcggtagcaaactcaagaagaacatgggtgggttgatgcatagcaaggggagtaagcctgggggagttgggacaggacttggtggctcatctggcactgaaacccttgaaaaaaaaaaaaagaatagtcttaaaagctggaaaggcggaaaggaagaagctgccggagacggacctgtgtcagaaaagcctcctgctgaaagtgtgggcaatggcggttcaaagtattcacaggaagtcatgcagtctctcagcattctgcggacggcaatgcagggcgaagggaagttcatctttgttggcactctcaagatgggccatcgccaccagtatcaggaggaaatgatccagcggtatctgtccgatgccgaggagaggtttctggctgaacaaaagcagaaagaagccgagcgaaagataatgaatggcggtatcgggggagggccacccccagccaagaaaccagagcccgacgcgagagaggagcaaccgaccggccctcccgctgaaagcagagccatggcatttagcacaggttaccccggtgatttcacgattcctcgtccaagcggcggaggggtccattgtcaggagccacggcgacagcttgccggaggcccatgcgttgggggactgcctccatatgctacctttccaagacaatgccctcctggccgaccttaccctcatcaggattctataccttcgctggaacctggcagtcatagtaaggatggactacatcggggagcccttctgcctccaccgtaccgcgttgctgactcctatagcaacggttatcgcgaaccgcctgagccggacgggtgggctggaggcctgcgtggtttacccccaactcaaactaagtgtaagcagcctgacggcgagctccttgtgcatcggttctag

SEQ ID NO: 233703 - DNA, 927 bp, Artificial Sequence
  Description of Artificial Sequence: Synthetic coding sequence
atgtgtggcgtggaggggtgttgccagggcggagctacccgaaggggaagcctgccagggggacggcaacttgctactcggaagcggagcgtggtgagacgctgcctcaagatggccgcagaagaaccccaacaacaaaaacaggaacctttaggatccgattctgagggcgtcaactgtctggcctatgacgaagcgattatggcacagcaggataggatccagcaggagatagccgtccagaaccccttggtgtcagagcggctggagttgtctgtgctctacaaggagtacgccgaggatgacaacatctaccagcagaaaattaaagacctccacaagaagtactcttatatccgaaagacccggcctgatggaaactgtttctaccgagcctttggtttttcacatctcgaggccctcctggacgattctaaggaactccagagattcaaggcagtcagtgcaaaatcaaaagaggatcttgtgtcccaaggattcaccgagttcactatcgaggactttcacaacactttcatggatctcattgagcaagtcgagaaacagacttctgtggccgaccttctggcatcctttaacgatcaatctacttccgactacctggttgtatacttgaggctcctcacttcagggtacctgcagagggagtcgaaattttttgagcactttatcgaaggagggagaactgtgaaggagttttgccaacaggaggttgaaccaatgtgtaaggagtccgatcatatccacattatcgccctcgctcaggccctctctgtctctattcaggtcgagtacatggaccgcggagaaggagggacaaccaacccccacatcttccccgaggggagtgagcctaaagtgtacttgttgtatcggccaggacactacgatattctgtacaaatag

SEQ ID NO: 233704 - DNA, 816 bp, Artificial Sequence
  Description of Artificial Sequence: Synthetic coding sequence
atggcagcagaagaaccgcagcagcagaagcaggaaccactcggcagcgactcggagggggtgaattgcctggcatacgatgaagccattatggcccaacaggacagaatccagcaggagattgccgtacagaatcccctggtgagcgaacgtctggagctatccgtgctgtataaggaatacgcggaagatgataatatctatcagcagaaaatcaaggatctgcacaagaaatactcctatattcgtaagaccaggcccgatgggaactgcttttaccgggctttcggatttagccacctagaagctctcctggatgattcaaaggagcttcagcgcttcaaggcggtcagtgctaaatcaaaagaagacttggtgtctcagggctttacggaatttacgatagaagatttccacaacacttttatggatctcatagaacaggtggaaaaacagactagtgtagcagatctcctcgcatcattcaacgaccagagtacctcagactatcttgtggtgtatttgcgactgttgacaagcggataccttcagagagagtcaaaatttttcgaacatttcatagaaggcggtaggaccgtcaaagagttttgtcaacaggaggtcgaacctatgtgcaaggagagcgatcatattcatatcattgctctggcccaggccctctctgtgtctattcaggtcgagtatatggatcgcggagaggggggaactactaatcctcatatcttcccggaaggctccgaacccaaagtgtatctgctctaccgccctggacactatgacattctctataaatag

SEQ ID NO: 233705 - DNA, 816 bp, Artificial Sequence
  Description of Artificial Sequence: Synthetic coding sequence
atggctgctgaggaaccgcaacagcagaaacaagagcccctgggcagcgactccgagggagtcaactgcctggcttatgacgaagccatcatggcgcaacaggaccgaattcagcaagagatagccgtgcagaatcccttggtgtccgagcggctggaattgtctgttctgtataaggagtacgccgaggacgacaacatctaccagcagaagatcaaggatctgcacaaaaaatatagttatatccggaaaactcgacctgatgggaattgtttttacagggcttttggattcagccacctcgaggcactgctggatgatagcaaggagctgcagcgttttaaggcagtctcggccaagtctaaagaagaccttgtgagccagggatttacagagttcacgatagaagatttccacaacactttcatggatctgatcgagcaagtggagaagcaaacaagcgtggccgacttgctggcctcctttaacgaccagagcacttcagactacctagtggtttatttgagattacttaccagcggatatctgcagcgggaatccaagttcttcgagcatttcatagaggggggtaggacagtaaaggagttctgtcagcaggaagtagagcctatgtgcaaggaatcagatcatattcatatcatcgcgctcgctcaggcgctgtctgttagcatacaggtagagtacatggatcgcggagagggcggtaccactaacccgcacatcttccccgagggtagtgagcccaaggtttacttgttgtatagacccggacactatgatattctctataaatag

SEQ ID NO: 233706 - DNA, 843 bp, Artificial Sequence
  Description of Artificial Sequence: Synthetic coding sequence
atggcggctgaggagccgcagcagcaaaagcaggaacctctgggctcagattctgaaggggtcaactgccttgcatacgacgaagctatcatggctcaacaggacaggattcagcaggaagacatgaccgatccctgtctgcttcagattgccgttcaaaaccccctagtgtctgaaaggctggaactctctgtgttatacaaagagtatgctgaggatgacaatatttaccaacaaaaaattaaggacttacataaaaagtattcttacataagaaaaacacggccagatggaaattgtttctatcgggcatttggttttagtcatctcgaagcactactggatgatagtaaagaactccaacgttttaaggccgtatccgctaaaagcaaagaggatctcgtctctcaaggctttactgagtttacaatcgaagacttccacaacacattcatggatctgatcgagcaggttgagaaacagacttcagtggcagacctgctggcaagctttaatgaccagtccacttccgactaccttgtggtgtacttacgcctcctcacctctggctacctccagcgggaaagtaagttcttcgaacacttcattgaggggggacgcacagtgaaggaattttgccagcaggaggtggagccgatgtgcaaggaatccgatcatatccacattattgccctggcacaggccctgtcggtaagcattcaggtcgaatacatggatagaggggagggcggtacgaccaacccacatattttccctgagggttccgaacccaaggtgtatctcttgtacaggccaggacactacgatatactgtacaaatag

SEQ ID NO: 233707 - DNA, 705 bp, Artificial Sequence
  Description of Artificial Sequence: Synthetic coding sequence
atgagcgagacttccttcaacctcatttccgagaaatgtgacattctctccatcctgcgtgaccacccagagaaccggatctatcgccgtaagattgaagagctgtccaagcggtttacagccattcgcaaaacaaaaggagatggtaattgtttctatagggccctcggctatagttatctcgaatcgctgttgggtaaatccagggagatatttaaatttaaggagcgggttctccagactccgaacgacctgcttgcagctgggtttgaagagcataaatttcggaattttttcaacgctttctacagcgtggtggagttggtcgagaaggacggctcagtgagctctttattgaaggtcttcaatgatcagtccgcttctgatcacatcgtccagttcctgcgcttgcttacatccgctttcatacgcaaccgcgcagacttcttccgccatttcatcgatgaggagatggacatcaaagatttctgtacccatgaggtcgaacccatggccacagaatgcgaccacatccagattactgccttgagccaagccctgtcaattgccctgcaggtcgaatatgttgacgagatggatactgcactgaatcaccacgtttttcccgaagccgctacacctagtgtgtacctgctttataagacatcacactataacatactgtacgctgctgataagcattag

SEQ ID NO: 233708 - DNA, 222 bp, Artificial Sequence
  Description of Artificial Sequence: Synthetic coding sequence
atgtccgagacgtcctttaacctgatttcagagaaatgcgatattctcagcatcctgcgagaccaccccgagaacagaatctacaggcgtaaaattgaggagctgtcaaaaagatttacggccatccgaaagactaagggcgatggtaactgtttctatcgagctctggggtacagctacctcgaatctctactcggaaaaagtcgagaaatcttcaagtag

SEQ ID NO: 233709 - DNA, 753 bp, Artificial Sequence
  Description of Artificial Sequence: Synthetic coding sequence
atggcagctttgtcatgtctgctcgatagtgtgcgccgagatatcaagaaggtcgaccgagagctgagacagctgcgttgcatcgatgaattttccacccggtgcctctgcgacttgtacatgcacccgtattgctgttgtgatctccatccatatccctattgcctgtgttactctaaaagatctcggtcttgcggactttgcgatctgtatccctgctgcctatgcgattacaagttgtattgcctccgtccctcattacgatcactagagcgcaaagctatccgcgctatcgaagacgagaagcgggaattagccaaactcaggcggactacgaacaggattctggccagttcatgttgcagtagtaacatcctgggatctgtaaatgtatgcggctttgagcccgatcaagtcaaagtgcgcgtgaaggacggaaaggtgtgcgtgtccgctgaacgggagaaccggtacgactgcctggggagtaaaaaatacagttatatgaatatatgcaaagagttttccctgccaccatgtgtggatgagaaggacgtcacgtacagctacggcctcggcagctgcgtgaaaatcgaatccccctgctacccatgtacttccccatgcagcccttgtagcccctgctccccgtgcaatccctgctcaccctgcaatccttgctcgccatacgacccgtgcaatccctgctatccgtgcggctcacggttcagctgcagaaaaatgatactgtag

SEQ ID NO: 233710 - DNA, 2418 bp, Artificial Sequence
  Description of Artificial Sequence: Synthetic coding sequence
atgaaggataggagtagcaccccaccattacacgtacatgtggacgagaacactcccgtacacgttcacattaaaaagctccctaaaccatctgcaacatcaagtcagaagagccataaaagggggatgaaaggcgacacggtaaatgtgcggcgaagtgtgcgtgtaaagaccaagaacccaccccactgtctggagatcacccctccctcctccgaaaaactggtgagcgtaatgaggctctcagacctatcaacagaagatgacgactctggacactgcaagatgaaccgttacgataagaagatagattccctgatgaatgccgtaggatgtttgaagagcgaggttaagatgcagaagggtgaacgccagatggctaagaggtttctggaggaaagaaaggaagagctggaagaggtggctcacgaactcgctgaaaccgagcatgagaataccgtgctccgacataacattgaaaggatgaaggaggagaaggacttcacgattctccaaaaaaagcacctgcagcaggagaaggaatgcttaatgtccaagctggtcgaagccgaaatggacggcgctgctgccgcaaagcaggtgatggccctcaaggacacgattggcaaactcaagaccgagaagcagatgacttgcacagatattaacacgttgaccagacagaaggaactcctgctacaaaaactgtctacgtttgaggagaccaatagaaccctccgcgaccttttgcgagagcaacactgcaaggaggatagcgagcggctgatggaacagcagggggcactgctgaagcggctggctgaggccgatagcgagaaagctagattgttactgctactccaagacaaggataaggaagttgaagagctcctgcaggaaattcagtgcgagaaggcacaggccaaaacagcgagcgaactgagcaagagcatggagagtatgcggggacacctacaggcccagttgcgctcaaaagaggccgagaattccagattatgcatgcagattaagaacctggaacggagcgggaaccaacataaagcagaagtcgaagccattatggagcaacttaaggaactgaagcagaaaggggatagagataaggagtcactgaaaaaggccatccgcgctcagaaggagcgggcagaaaagtctgaggaatatgccgagcagcttcacgtgcaactggctgacaaggatctctacgttgctgaagcactgtctactctggagtcctggcgatctcgatataaccaggttgtgaaagaaaaaggcgatcttgaattggaaatcattgttctaaacgacagagtaactgacctggtcaaccaacagcagaccctggaggagaagatgagagaggatcgggattccttggtggaacgtcttcaccgtcaaacagccgagtacagcgcttttaagctggagaacgaacggctgaaagccagttttgccccaatggaagacaagcttaatcaggcgcacttggaagtgcagcagttgaaggccagcgtcaaaaattatgaagggatgattgataactataagtcccaagtcatgaagacacgcctggaagcagacgaagtggccgctcagctggagaggtgcgataaggaaaataaaattctcaaagatgaaatgaataaagaaatcgaggcagcgaggaggcagtttcagtcacagctggctgatcttcagcagctccctgatatcttaaagatcaccgaagccaaactggccgaatgtcaggaccagttacaggggtatgaacgtaagaatatcgaccttactgccatcataagcgatctgaggtctaggattgaacaccagggtgataaactggaaatggccagggagaagcatcaggcctcacagaaagagaataagcaactaagtcttaaagtggacgagcttgaacgcaaactagaggctacaagcgctcaaaacatcgaattcctgcaggtgatcgccaagagggaagaagcgattcaccagtcccagcttcgcttagaagagaaaaccagggaatgcggcacattggccagacagcttgagtccgctatcgaggatgccagacggcaggttgagcagaccaaagaacacgcactgagcaaagaacgggctgcccagaacaagattctcgatctggagacacagctgtcccggacaaaaacagagctttctcagctgagacggtccagagacgacgctgaccggaggtaccagagcaggctgcaggatcttaaggatagactggaacaaagcgaaagcaccaataggtctatgcagaattacgtgcagttcctcaagtcttcctatgctaacgtttttggagacggaccttactcaacttttctaacttcttcccctattcgctcgcgttctcctcccgcttag

SEQ ID NO: 233711 - DNA, 2475 bp, Artificial Sequence
  Description of Artificial Sequence: Synthetic coding sequence
atgaaggaccggtcgtcaacccccccattacacgtgcatgtggatgagaacactcccgtccatgtccatattaaaaaactgccgaagccaagcgcaaccagctctcagaaaagtcataaacgcggaatgaaaggcgacacagtaaatgtcaggcgctctgtccgcgtgaagaccaaggtgccttggatgccaccagggaagtcaagtgccaggcccgtaggctgcaagtgggaaaacccgccacattgccttgaaatcactcccccttcctcagagaagctggtctctgtgatgcgactaagcgacctgtcaaccgaggatgacgactccggacactgtaagatgaatagatacgataagaagatcgactccctgatgaatgccgtgggctgtctcaagtctgaggtcaaaatgcaaaaaggagagcgccagatggccaagcgctttttggaggaacgtaaggaggaactcgaggaggtagcacacgagctggcggagaccgaacatgagaataccgtgcttcgtcataatatcgagagaatgaaggaggaaaaggactttaccatccttcagaaaaagcatcttcagcaagagaaagaatgccttatgtcaaaactcgtggaggcagagatggatggtgccgcagccgctaagcaggttatggccctgaaggacaccatcggtaagctgaaaacagaaaagcagatgacctgtaccgacatcaacacgctaactcggcagaaggaattgctactgcagaagctgtctacctttgaggaaacgaaccgaaccttgcgggacctgttgcgcgaacagcactgtaaggaggacagtgaacgcctgatggaacaacagggcgctctgctgaagcgtctggcagaggccgactccgagaaagccaggctgctgctcctgttacaagacaaggataaagaagtggaggagctgctgcaggaaattcaatgcgaaaaggctcaggccaaaaccgcatctgaattgagtaagtcaatggaaagcatgaggggccacctgcaggcccagctgcgtagtaaagaggccgagaactcaagactgtgtatgcaaatcaagaacttggaacgttcaggtaaccaacacaaagccgaggtggaggctattatggagcagctgaaagagttaaagcaaaaaggcgacagggataaggaaagtcttaagaaggccattagagctcagaaagagcgagctgaaaagagtgaagagtatgcagagcagctccatgtccagctggccgacaaggacctatatgtggctgaagctttatccactttggaaagctggcgatcaagatacaatcaggtggtgaaggaaaagggcgacttggagcttgagatcatcgtgctgaacgaccgagttactgatctggtcaaccaacagcaaaccctggaagagaaaatgcgtgaggacagagacagcctggtggagagacttcatagacaaacagcagaatacagcgcgttcaagctggagaatgagcggttaaaggcttccttcgcccctatggaggacaaattgaaccaggcgcatctggaagtgcaacagctcaaggccagcgtcaagaattatgaaggaatgatagacaattacaaatcacaggtaatgaagacaagacttgaagcagatgaagtcgccgcacagctggagcggtgcgacaaggaaaacaaaatcctgaaggatgaaatgaacaaggaaatcgaagccgcacggaggcagttccaaagtcaactggccgatctgcagcaactaccagacattttgaagataactgaggctaagcttgcggagtgtcaggaccaattacaggggtacgagcgcaagaatatcgatctcaccgctattataagtgatctgaggagccggatagagcatcagggcgacaagctggaaatggccagggaaaagcatcaggcttcccagaaggaaaacaaacagctctctctgaaggttgacgagctggaacgaaagctggaggccaccagtgcccagaacatcgaatttcttcaggtcattgcaaaaagggaggaggctattcaccagtctcagctcagactggaagaaaagacaagggaatgcggaacgttagcacgtcaattggagtctgctattgaagacgcacggaggcaagtcgaacagacaaaggaacatgcgttgtctaaagaacgggctgcacagaataaaattttggacctggaaacccaattgtcccggacaaagactgagttatcgcagctgcgcagatcccgtgacgacgcagacaggagatatcagagcaggcttcaggatttaaaagatagactggagcaaagtgaatccacgaatcgctccatgcagaattacgtgcagttcttaaagagcagctacgcaaatgtcttcggagacggcccatatagtacgttcctgactagttcccccattcgctctcggtccccaccggcttag

SEQ ID NO: 233712 - DNA, 1917 bp, Artificial Sequence
  Description of Artificial Sequence: Synthetic coding sequence
atgtccgccagttcttcgggagggagtcctaggttccccagttgcggaaagaatggagtgacaagcctgacccagaaaaaggtcctgcgagcgccatgcggagcaccctctgttactgtcaccaaatcacataagcgaggcatgaagggagataccgtaaatgtgcggaggtctgtgagggtcaagactaaaaacccgccacactgcctggagataacacctccttcctcagaaaaattggtcagcgtaatgcgattatccgatctaagcaccgaagatgacgattcggggcattgcaagatgaataggtacgataaaaagattgacagcctgatgaacgccgtcggttgtcttaagagcgaagtaaagatgcaaaagggggaacggcagatggcaaaacggttcttggaagagcggaaggaagagctcgaggaggttgcccacgagctcgcggagaccgagcacgagaatactgttctgcgccataatatcgagcgcatgaaggaagagaaggactttacaatcctacagaagaagcacctccagcaggagaaagagtgcttaatgtctaagttggtggaagctgaaatggacggcgctgcggctgccaagcaggtcatggccctgaaagacaccatcggaaaactgaagactgaaaagcagatgacttgcactgacatcaataccttgacgagacaaaaggaactcctcctgcagaaactgagcacattcgaagaaacaaatagaactctccgggacttactgcgagagcagcattgcaaagaggacagcgaacggcttatggaacagcagggcgcactgttgaaacggctcgcggaagctgacagtgagaaagcccgtctgctgctactgctgcaagacaaagataaggaagtggaagagctgttgcaagagatccagtgtgaaaaagcccaggcgaagactgccagcgagctctccaagagcatggaatcaatgcggggtcacctgcaagcccaactgcgatccaaggaggccgagaactctcgtctttgcatgcagatcaagaatctggaacgcagcggcaatcagcacaaggcagaagtagaggcaatcatggagcaattgaaggagcttaaacaaaagggcgatcgagacaaagaatctctgaagaaggcaattcgggctcagaaggaaagggctgagaagagcgaggagtatgcagagcagttacacgtgcagttggcggacaaagacttatacgttgcggaggctctgagtacacttgagagttggagatcccggtataatcaagtcgtgaaagaaaagggcgatctggagctggaaataatcgtgctgaacgaccgggtgaccgatctggttaaccagcagcaaacccttgaggaaaagatgagggaggatagggattcactggtcgagcggcttcacaggcagactgctgagtatagcgctttcaaactggaaaacgagcgactaaaggcctccttcgcccctatggaggataagctgaaccaagcacatttggaggtgcagcaacttaaagcttcagtgaagaattacgaagggatgatcgacaactacaagtctcaggttatgaaaacaaggcttgaggccgacgaggtcgccgcacagctggaaagatgcgacaaagagaacaagatccttaaggatgagatgaacaaagagattgaagcagccagacgacagttccagagtcagcttgccgacctccaacagttaccggatattttgaaaatcactgaagccaaactggctgagtgtcaggaccagcttcaggggtatgagcgtaagaatattgacttgacagcgataataagcgatctacggagtcgagtccgagactggcagaaagggagccacgagctcacgagggctggagcacgaattccacggtag

SEQ ID NO: 233713 - DNA, 2490 bp, Artificial Sequence
  Description of Artificial Sequence: Synthetic coding sequence
atgtccgcttcctcttctggaggcagtcctagattccctagctgtggcaaaaatggcgtgacctcactcacacaaaagaaggttctcagagctccttgtggagcccctagtgttactgtcacaaaaagccacaagcggggaatgaaaggagatacagtaaacgttcggcgaagtgtcagggtgaagaccaaggtgccctggatgccccctggtaaatcgagcgcacgaccagtcggctgtaagtgggaaaatcctcctcattgcctggagatcacccctcccagttccgaaaagctggtttccgtgatgcgactcagcgatctgtcaacggaggacgatgacagcggtcactgtaaaatgaaccggtacgacaagaagatcgactctcttatgaatgctgtggggtgtctcaagagcgaggtcaagatgcagaagggcgagaggcagatggccaaacggtttctcgaggagcgaaaggaagagctcgaagaggtcgcccatgagctggcggaaacagaacatgaaaataccgtccttcggcacaacatcgagcggatgaaggaggagaaagattttacaatcctccagaagaagcatctccaacaggagaaggagtgccttatgagtaaactggttgaggcggagatggacggcgctgccgctgcgaagcaggtcatggctctcaaggacacaatcggaaagttgaagaccgaaaagcaaatgacgtgcactgacatcaacacattaacaagacagaaggaattactactgcagaagctgtcaaccttcgaggagactaaccggacactccgcgatctgctgagggagcagcactgtaaggaagactccgaacggctcatggagcagcagggcgcactgttgaaacgactggctgaggccgatagcgagaaggcgcgtcttctgttactcctccaagacaaggacaaggaggtggaagaactgctccaggagattcaatgtgagaaagcccaagccaaaactgcaagcgagctctcgaaatcaatggagagtatgaggggacatctacaggctcagttgaggtctaaagaggctgagaattcaagactctgtatgcagatcaaaaatctcgagaggagtggaaaccagcacaaagccgaagtggaggcgatcatggagcagctgaaggaactaaagcagaagggtgacagagacaaggagagtctcaagaaagccatacgggctcaaaaagagagggccgaaaaaagcgaagaatacgccgagcagctccacgtgcagctcgctgacaaggatctttacgtcgccgaagcactgagcacgcttgagtcctggaggtcacgctataaccaggtcgtgaaagaaaaaggcgatttggagcttgaaattattgtgcttaatgacagggtgacagatttagtgaatcagcagcagacacttgaggaaaaaatgcgcgaggacagagacagcctggtagagagactccacaggcagacggcagagtattccgctttcaaactcgagaacgaacgcctgaaggctagctttgctccaatggaagataagctcaaccaagctcatttagaggtccaacaacttaaggcctcagtcaagaactatgaggggatgatagataattataaatcccaagtgatgaagactcggctggaagcggacgaggtcgctgcccagctcgaacgatgtgataaagagaataagatcctgaaggacgaaatgaataaggagattgaggctgccagacgacaattccagagccagttggcagacctacaacaactcccggacattctcaaaataacggaagccaagctcgcagaatgtcaggaccagttacagggctatgaaagaaagaacatagacctgaccgcaatcatctccgatcttcggtccagaatagaacatcagggtgacaagctggaaatggcacgagaaaagcaccaagccagtcaaaaagagaataagcaactaagcctcaaggtggacgagttggaacggaaactcgaagccacatcagctcagaacatcgaatttctgcaagttatcgcaaagcgggaggaggctattcaccaatctcagttacgtctggaggaaaagacacgagagtgcggaacattagccagacagctggagagcgccatagaggacgctaggagacaggtggaacaaacaaaagagcacgccctgtcaaaggagcgcgcagcgcagaacaaaatccttgatctcgaaacccaactttctaggaccaagacagagcttagccaattgcgtaggagcagagacgatgcagataggagataccagtccagactgcaagatcttaaagaccgtctggagcagagcgaatccaccaacagaagcatgcaaaattatgtccagtttctaaagagttcctacgccaatgtctttggcgacggcccttactctacctttcttacctcatcgcctattcgcagtagaagtccaccggcatag

SEQ ID NO: 233714 - DNA, 2106 bp, Artificial Sequence
  Description of Artificial Sequence: Synthetic coding sequence
atgggcgagcttccgaccggatgccgaaaaagaagacgcaaaagaggcggagccgctgcccgtgcccgtttgcaccctccacgcagactgcatgggacaactttagcctccgatttcaacgactttattaggagacgtttttgggcacaaccatgcaggtcttggttcccttcttgcgggaagaacggagtgaccagtctcacgcaaaagaaagttctgcgagccccttgcggagctccctctgtgactgtgaccaaatctcataagcggggaatgaaaggggacaccgttaacgtgcgaagatcagtgagggtaaagaccaaggttccgtggatgccgcctgggaagagctctgcccgtccagtgggttgcaagtgggagaatcctccccattgtctggaaatcactcccccttccagcgagaaacttgtgtccgtaatgcgcctgagtgacctgtcaactgaggacgacgactccggtcactgcaagatgaatcgttatgacaagaagatcgattcactgatgaatgctgtggggtgtttgaagtccgaagttaagatgcagaaaggagagcgccagatggcaaagcggtttctggaggagcggaaagaggaattagaagaagtggcccacgagctggcggagacggagcacgaaaataccgtgctccgtcataacattgagagaatgaaggaggagaaagacttcaccatcttgcagaagaaacacctgcagcaggagaaggagtgtctgatgagtaagctggttgaagccgaaatggacggagccgcagctgccaagcaggttatggccttgaaagacacgattggtaaactcaagaccgaaaaacagatgacgtgtaccgatattaacaccttgacgagacaaaaagagctgctcctgcagaagctatctacatttgaggaaactaatcgtaccctcagggacctgctcagggagcagcactgcaaggaagactctgaaaggctgatggagcaacagggagccctgttaaagcgcttggctgaggccgattccgaaaaggcacgccttttgctccttttacaggacaaggataaggaggtggaagagttgctgcaggagattcaatgtgaaaaggcacaagcgaaaaccgcctccgaactcagcaagtctatggagagcatgcggggtcatctgcaggcacaattgagaagcaaagaggccgaaaattcacgactttgtatgcagatcaaaaacttggagagatccgggaatcaacataaagcagaagtggaggcaatcatggagcagctcaaagagctgaaacagaagggggaccgcgacaaagagagtttgaaaaaagccatcagagctcaaaaagagcgggcagaaaaaagcgaggagtatgcggaacagctccatgtgcagctggcagataaagacctttatgtggcagaagctctttcaaccctggagtcctggcgatctagatacaatcaggttgtgaaggagaaaggagacctggagctggaaatcatcgttcttaacgacagagtgacagatttagtgaaccaacagcaaacgcttgaggagaaaatgcgggaggaccgggattccctagtcgaaagactgcaccgccagaccgcagagtattccgctttcaagctagagaatgagagactcaaagcatcatttgccccaatggaagacaagctcaatcaggcccacttggaggtacagcagcttaaagcatcagtgaagaattacgaaggcatgatcgataattacaagtctcaggtgatgaagacccggctggaggctgacgaggtcgccgcacaactggaaagatgtgacaaggaaaacaagatcctgaaagatgagatgaacaaggaaattgaggccgcacgtagacaattccagtcgcagctggctgatcttcaacagcttcccgatatcctgaaaatcaccgaggctaagctggcggagtgccaggatcagctccagggctatgaacgtaagaatattgacctcacagccatcatttccgatttgcgttctagggtgagggattggcagaaaggtagtcatgaactcacacgggcaggagctcggattccacgttag

SEQ ID NO: 233715 - DNA, 1974 bp, Artificial Sequence
  Description of Artificial Sequence: Synthetic coding sequence
atggccgaccaacagggccctcaccagaacaggtttccctcttgcggaaaaaatggtgtcaccagcctgacccagaaaaaagttttgcgggctccctgcggcgcacctagcgtgaccgttactaagtcacacaagagaggtatgaagggcgatacagtgaatgtgcgcagatccgtcagggtgaaaacaaaggtcccgtggatgccaccagggaagagctctgccagaccagtaggttgcaaatgggagaaccctcctcactgcctcgaaattacccctcctagctcagagaaactggttagcgtgatgaggctgtcagatctaagcacagaagacgatgacagtgggcactgtaagatgaaccgatatgataagaaaatcgacagtctaatgaatgccgtgggctgtctgaaatcggaggtgaagatgcagaaaggagaacgccagatggcaaagaggtttctcgaagaacgtaaggaggagctcgaggaagtggctcatgagctcgccgagacagagcacgagaataccgtcctgcgacataatatcgagcgcatgaaagaggagaaggatttcactattctgcagaagaaacatctgcaacaagagaaggagtgtttgatgtcaaagctggtggaagctgaaatggatggggctgcagccgcaaagcaagtcatggccttgaaggacaccattggcaaattaaaaaccgagaagcagatgacgtgcacagatataaacactttgacccgccaaaaagagcttttgctccagaaacttagtacatttgaggagacgaatcgaaccctacgggatctactgcgggagcagcattgtaaggaggatagtgaacgactgatggaacagcagggcgcactgttgaagagactggcagaggccgactccgaaaaagcacgcctattactgctcctgcaggacaaagacaaggaagtggaggaacttctgcaggagatccagtgtgaaaaagctcaggctaaaacagcatccgagttgagcaagtcgatggagtccatgcgtggacacctgcaagcacagctgaggtccaaggaggctgagaatagtcggctctgtatgcagattaaaaacttggagcggtctggaaaccagcacaaggcggaagtagaagccatcatggaacagcttaaagaactgaaacaaaaaggcgacagggataaagagtctctgaaaaaggctataagagctcagaaggaacgagcagaaaagtcagaagagtacgcagagcagctgcacgtccagcttgctgacaaggacctttacgtggcagaagcgttgagcactctggaaagttggcggagccggtacaaccaagtagttaaggagaaaggcgacttagaattagagattatagtcctgaacgacagagtgacagatctggtgaaccagcagcagaccctggaagaaaagatgcgggaggatagggactctctcgtcgagcggctgcatcgtcagacggccgaatattctgcatttaaactggaaaacgaacggctgaaggcatcgtttgcccctatggaggacaaactgaaccaagcacacttggaggtacaacagctaaaggcttcagtcaaaaactacgagggaatgatcgacaattacaagagccaagttatgaagacaagactggaagctgatgaggtggcagcccagctggagagatgtgacaaggagaacaagatcctgaaggacgagatgaacaaggagatcgaagccgcaaggagacagtttcagagtcagctcgctgacctccagcagctgccagatatcctcaaaatcacggaggctaagctggctgagtgccaggaccagctccagggttatgagcgcaaaaacatagatttgaccgccataatttccgatctgcggagtcgcgtgagagactggcagaagggttcccatgagttgaccagggccggagccagaattcccaggtag

SEQ ID NO: 233716 - DNA, 570 bp, Artificial Sequence
  Description of Artificial Sequence: Synthetic coding sequence
atgaaggacaggtcatccacaccacctctgcacgttcatgtggatgagaacactccagtccatgtgcacatcaaaaaactcccaaaaccgagcgctacttcttcacaaaagtcccataaaagaggcatgaaaggagataccgtcaacgtgcgtcgaagtgtgcgggtgaagacaaaggttaagatgcaaaaaggggaacggcaaatggctaagaggttccttgaagagagaaaagaggagctagaagaagtggctcacgaactagccgagacagagcacgaaaacactgtgctaaggcacaacatcgaacgaatgaaggaggagaaggacttcactatactccagaaaaaacacctgcagcaggagaaagagtgcttaatgtccaagctggtggaggcagagatggacggcgctgccgcagcaaaacaagtcatggctctcaaagatacaattggaaaactcaaaacagagaagcagatgacttgcactgatattaacactctgactagacagaaagaactccttctgcagaaactgtccacattcgaagagacaaaccggacactatag

SEQ ID NO: 233717 - DNA, 618 bp, Artificial Sequence
  Description of Artificial Sequence: Synthetic coding sequence
atgtctgcctcttccagcggaggatccccaagattcccatcctgcgggaagaacggcgttacttccctgactcagaagaaggtgcttcgcgcaccatgtggggctccatcagttactgtcaccaagtcgcacaaaaggggtatgaagggagatacagttaatgttcgacggtccgtcagggtgaaaactaaggtgaaaatgcaaaaaggagaacgtcaaatggcaaaaaggtttctcgaagaacgtaaggaagagttggaagaggtggcccacgaattagcagagaccgaacatgagaacaccgttctccgccataatatcgagcgcatgaaagaggagaaagactttactatcctgcagaagaaacacctgcagcaggagaaggaatgtctcatgtccaagctcgtcgaggccgagatggacggtgcggcagctgctaaacaggtaatggccctgaaggatacaatcggaaagctcaagaccgaaaagcaaatgacttgtaccgacataaacaccctcacaaggcagaaagaattactcctacagaagctttcaacatttgaggaaacgaaccgtactcttagagacctgctccgggagcaacattgtaaagaatag

SEQ ID NO: 233718 - DNA, 543 bp, Artificial Sequence
  Description of Artificial Sequence: Synthetic coding sequence
atgagcgcatcatcttcaggaggcagccctagatttcctagttgcggaaaaaacggcgttacaagcctgacacagaagaaggttctacgtgccccatgcggcgcacctagcgtgaccgtgacaaagtcccacaagcgcggaatgaagggagataccgtcaatgtgagacgcagtgtgcgagttaaaactaaggtcccatggatgccacctgggaaatccagcgccagaccagtgggttgcaagtgggagaacccgcctcattgtctagaaatcacccccccatcctccgagaagttggtgtctgtaatgagattgagtgatctctccactgaagatgatgattctgggcattgcaaaatgaatagatacgacaaaaagattgactctttgatgaatgccgtaggctgtctgaagtctgaagtcaaaatgcagaaaggggaacgtcaaatggctaagcgcttcttagaggaaagaaaagaagagcttgaagaggtggctcatgagcttgcggaaaccgaacacgaaaacaccgttctccgctag

SEQ ID NO: 233719 - DNA, 648 bp, Artificial Sequence
  Description of Artificial Sequence: Synthetic coding sequence
atgaaagatagatccagcaccccccctctccacgtccatgttgacgagaatactccggtccatgtgcacatcaagaaactgccgaagccctccgcgacctcatctcagaagtcgcataaacggggtatgaagggcgatacagtgaatgttcgccgatctgtgcgtgtcaagaccaagaatccccctcattgtctggagatcaccccaccttcgagcgagaagctggttagcgtgatgcgtctttctgacttatctacagaggatgatgacagcggccactgtaaaatgaataggtacgataaaaaaattgacagtctgatgaatgccgtggggtgcttgaagagcgaggtgaaaatgcagaaaggggagagacagatggccaaaagatttctcgaagagagaaaggaggaactcgaagaagttgcacacgaactagccgagacagaacacgagaataccgtgttacggcacaatatcgaaaggatgaaagaagaaaaggacttcactattctgcagaaaaaacacttgcagcaggagaaagaatgcctgatgagtaaactggtagaggccgagatggatggcgctgcggctgctaagcaggtgatggcccttaaagacacaataggcaagctgaagactgtcggctag

SEQ ID NO: 233720 - DNA, 471 bp, Artificial Sequence
  Description of Artificial Sequence: Synthetic coding sequence
atgtcagctagctcaagcgggggatctcccaggttcccatcttgtggaaaaaatggcgtgacttccttaacgcagaagaaggtgttgcgggcaccttgtggcgctccatctgtgaccgtgactaaatcacacaagcgcggaatgaagggcgatacagtaaatgtcagaagatctgttagggtgaagaccaagaacccccctcattgcctggaaattacgcccccttcatctgagaaattggtgtctgtcatgcggttgtctgatctgtcaacggaagacgatgatagcggccactgtaaaatgaaccggtatgataaaaagattgattccctgatgaatgctgttggttgcctgaaaagcgaagttaagatgcagaagggagagcgccagatggccaaacggttcttggaggagcggaaagaagagctggaagaggtggcgcacgagctcgcagagacggagcatgagtag

SEQ ID NO: 233721 - DNA, 1731 bp, Artificial Sequence
  Description of Artificial Sequence: Synthetic coding sequence
atgaaggaccgctctagcacacctcctctccatgtacacgtggacgagaacaccccagtgcacgttcatattaaaaagttgccaaagcccagcgccaccagcagccagaagtcgcacaagagaggcatgaagggcgacacagttaacgttaggcgctccgtgcgtgtaaagaccaaggtgaaaatgcaaaagggagagcgtcaaatggcaaagcgctttttggaagagcgcaaggaagaactggaggaggtggcccacgagttagcagaaaccgagcacgaaaatactgtcctgcggcataacatcgagcgcatgaaagaggaaaaagactttaccatactccagaagaagcatctgcagcaggagaaggagtgcctaatgagtaaattagtcgaagctgagatggatggagcagcagctgcaaagcaagtgatggctctgaaagacacgataggcaagttgaagactgagaagcaaatgacatgtacggacatcaatactctgacacggcagaaggaattactcctccaaaagctatccacctttgaggaaacaaatcgaaccctgagagatttgctccgtgagcagcattgcaaagaggatagcgagaggctcatggagcaacagggcgcacttctaaagcggctggccgaggccgattctgaaaaggcaaggctgttgcttctgctgcaggataaggacaaagaagtggaggaactgctgcaggaaatccagtgcgaaaaggctcaagctaagactgctagcgagctgagcaaatctatggagagtatgcggggacaccttcaagcccagctgaggtctaaagaggccgagaactcgcggctttgcatgcagatcaagaatctggagcgttcggggaaccagcataaagcagaagtcgaggccatcatggaacagcttaaagaactgaaacagaagggagaccgcgacaaggagagcctgaaaaaagctatacgcgcacagaaggagcgggctgaaaaaagcgaggagtacgccgagcaactgcacgtccagctggccgataaggacctatacgtggctgaagcgttatcgacactcgagagttggcgctctcgctataatcaggtggtcaaagaaaaaggtgacctcgaacttgaaatcatcgtcctaaacgatcgagtcaccgacttggtgaaccagcagcagactctagaggagaaaatgcgagaggatcgagatagcctagttgagcgtttacaccgccagaccgcagaatacagtgccttcaagctcgagaacgagaggttgaaggcatcttttgccccaatggaggataagcttaaccaggcacatctggaggtgcagcagctgaaggcttctgtcaagaactatgaaggaatgatcgacaattacaagagtcaagtgatgaaaacacggctagaggctgatgaggttgcggcacagctggagaggtgcgacaaggagaacaagatcctcaaggatgaaatgaacaaggaaatagaagcagcaaggagacagtttcagtcccagctcgccgatctccagcaacttcctgatattcttaaaattacggaggctaagctggcggaatgtcaggatcagctccaaggatacgagcgaaagaatattgatctgacggccattatctctgacttgaggagcagagtgcgggattggcagaagggctcacacgaattaacaagagctggggcacggatcccacgctag

SEQ ID NO: 233722 - DNA, 444 bp, Artificial Sequence
  Description of Artificial Sequence: Synthetic coding sequence
atgaaagatcgaagcagcactccccctcttcatgttcacgtggacgagaacacacctgtccacgtgcacatcaaaaagctgcccaagcctagcgcgacgtcctctcagaaatctcacaaacggggaatgaaaggagatacagtgaatgttagaaggagcgtgagggtgaagactaaagtcccttggatgcccccagggaagagttccgcacggcctgtgggctgcaagtgggaaacatctgaagagacgcccaccaccggcgaaggcgtgccgcacgtgcaggcgggagggggtgggaatggctggggctgcgggtgtcaagcaggacacggcctggagggctaccacagagaggccgagaatcgcgagactaatgacctgcatggacaccagcacccagacaaggctgagggcacgagcccggcagaggcggaacacatttag

SEQ ID NO: 233723 - DNA, 1917 bp, Artificial Sequence
  Description of Artificial Sequence: Synthetic coding sequence
atgggacgcaatagatatccccctgcctgctggtttccaagttgtggcaaaaatggagtgacctctctgacgcaaaagaaagtcctccgggctccttgtggagccccaagcgtaaccgtgactaagagtcataaacggggtatgaaaggagatacagtcaatgtacgtagaagtgtaagggttaaaactaagaacccgccacattgccttgagataactccgccaagtagtgaaaagctcgtgagcgtgatgcgcttatccgacctctctacggaggacgatgattctggacactgtaagatgaaccggtatgacaaaaaaatcgactctctaatgaacgctgtaggctgtctgaagtcagaagtaaaaatgcagaaaggggaacgccagatggctaaacgtttcctggaagagcgaaaagaagagcttgaagaagtggctcacgagctggccgaaaccgagcatgaaaacactgtgctccgccacaatatcgagcggatgaaggaagaaaaagattttactattctgcagaaaaagcacctacaacaggagaaagaatgtctgatgtcaaagctggtcgaagccgagatggatggcgctgccgcagccaagcaggtgatggcactgaaggatacgatcggaaagctgaagaccgagaagcagatgacttgtactgatataaacacgctaactagacagaaggagctcttgcttcagaagctctccacgttcgaggagacaaatcggacccttcgcgacttgctccgcgagcaacattgcaaggaagacagtgagcggttgatggaacagcagggggcactcctgaaacgtcttgctgaagcggactccgagaaagccagactgcttttgttactgcaggacaaggataaggaagtggaagaactgttacaggagatacagtgtgaaaaggcccaggccaagaccgccagcgagctgagtaaatctatggaatccatgcgaggccacttacaggcccagctcaggtccaaggaagcggagaattcccgcctctgcatgcagattaaaaatctggagcgctccggtaaccaacacaaggctgaggtggaggctatcatggagcagctgaaggagctaaaacaaaaaggagatcgagataaagaaagcctgaagaaagccatcagggctcagaaggagagagcagagaagagtgaggagtacgctgagcagttacacgtgcaactagccgataaggatctttatgtcgctgaggctctctcaaccctcgagtcctggagaagtcggtacaaccaggtagtgaaagaaaagggggacctcgagcttgaaatcatcgttctaaacgaccgcgtgactgacctggtcaaccaacagcagaccctcgaggagaaaatgcgggaggaccgcgatagcctggtcgagaggctccaccgacagaccgccgagtatagtgcgttcaagctggagaacgagcgccttaaagcttcttttgcccctatggaggataagcttaaccaggcgcatttggaagtccagcagcttaaagcctccgtgaagaactacgagggaatgatcgacaattataagtctcaggtgatgaagacccgcttggaggccgatgaggtcgcagcccagctggagagatgtgacaaggagaataagattctgaaggacgaaatgaataaggagattgaagccgctcgcaggcagttccagagccaattagctgatctgcagcagctccccgacatcttaaagatcacggaggccaagcttgctgagtgccaggatcagcttcaggggtacgaaaggaaaaacatcgatctcacggcgatcattagcgatctccgctctcgggtacgtgattggcagaaagggtctcacgaattgacacgcgcaggcgcacgcatcccacggtag

SEQ ID NO: 233724 - DNA, 765 bp, Artificial Sequence
  Description of Artificial Sequence: Synthetic coding sequence
atgacggaggaggtgtggatggggacatggaggcctcaccggccaagaggaccaattatggctctgtactcttcccctggacctaagtatctgatcccccctactactggctttatgaaacacaccccaacaaagcttcgagctcccgcttacagttttcgaggcgctcctatgttacttgccgaaaactgtagtccgggacccaggtataacgtaaaccctaagattctgagaacgggaaaagatctggggccagcatactccattctggggagatatcagaccaagacgatgctaactccaggacccggtgattattttccggagaaaagcactaagtacgtgtttgactctgctcctagccactcaatcagtgccaggacaaaggcgttcagagtcgactccactccaggcccagctgcctatatgctccctatggttatgggcccaaacacagtgggcaaggctagccaaccgtcattcagcattaaagggcgttctaaacttggcggattctccgacgatcttcataaaaccccgggaccagccgcttaccgacaaaccgacgtgagagtgactaagttcaaggcaccccagtacacaatggccgctcgagtcgagccacccggtgacaaaacgctgaagcccggacctggagcccacagtcctgagaaagtaaccctgaccaaaccttgcgctccagtcgtgacatttggaatcaaacactcagactatatgacaccacttctcgtggacgttgagtag

SEQ ID NO: 233725 - DNA, 417 bp, Artificial Sequence
  Description of Artificial Sequence: Synthetic coding sequence
atgacagaggaggtctggatgggtacatggagaccccaccgcccaaggggacctatcatggcgctgtattcttctccaggtcctaaatatctgattcctcccacaacgggcttcatgaagcacactccgacgaaattgcgtgcacctgcctatagtttcaggggggcacccatgctgcttgccgagaactgttctcccggacccaggtataatgtcaatcccaaaatactgagaaccggtaaagacctcggtccagcatacagcattctagggcgataccagaccaagacaatgctcacaccaggaccagctctgaagtcggcgtttccttcatggacacccccagatcccacttggtctcccccagtgctggagccccgtggccctacaccacgcatgctcggatctcccccatag

SEQ ID NO: 233726 - DNA, 375 bp, Artificial Sequence
  Description of Artificial Sequence: Synthetic coding sequence
atgaccgaggaagtatggatgggaacctggcgccctcacaggcctcgcggacctatcatggcgttatactcatcaccaggacctaaatacctgatcccaccaaccacggggttcatgaaacataccccaacaaaattgcgcgctcctgcttatagcttcagaggcgcacccatgctcctggcagaaaattgttcccccccaaatactgtcgggaaggctagtcagccttcttttagcattaaaggtaggagtaagctaggcggatttagcgatgacctccacaaggtcacgctgaccaagccctgcgcccctgtggtgacttttggtatcaagcatagcgactacatgacgcctcttctggtcgacgtggaatag

SEQ ID NO: 233727 - DNA, 774 bp, Artificial Sequence
  Description of Artificial Sequence: Synthetic coding sequence
atggacgccgaatacagtggcaacgagtttccaaggtctgagggagagcgagaccagcatcagcgccctggcaaggaaaggaaatccggcgaagcaggatggggaacaggggagctaggacaggacggcaggctgttgagcagtacgctgtccctgagttccaaccggtctctgggtcagaggcagaatagccccttaccctttcagtggcgcattacacacagttttaggtggatggctcaggtcctggcgtcagagctgtctttagtggcattcatcctgttactagtcgtagctttcagcaaaaaatggctggacctgagccgatccctcttttaccagaggtggcctgtggacgtgagtaataggatccacacctccgcacacgtgatgtctatgggtttgctgcatttttataaaagccgaagttgttctgacttggagaacggcaaagtgacatttatttttagcactctgatgctgtttcccatcaatatttggatctttgagcttgaaagaaacgtgagtataccgattggctggagctacttcatcggatggctcgtcttgatcctgtattttacttgcgccatcctctgttatttcaatcacaagtcgttttggagccttatcctgtctcatccttccggcgctgtaagctgctcttcatcctttgggtctgtcgaggagagtccacgagcccagacaatcaccgacacacctattacgcaggaaggtgtgctggaccccgagcagaaggacactcacgtctag

SEQ ID NO: 233728 - DNA, 1488 bp, Artificial Sequence
  Description of Artificial Sequence: Synthetic coding sequence
atggtaacctggttgtatagatttctgcctacgtctaatatggccgcaaaacttagatctctgttgcctccggacttgaggcttcagttttggctgcacgcccgactacagaaatgtttcctctctaggggatgcggtagttattgcgccggtgctaaggcgagccctctgccaggcaagatggcgatgggcctcatgtgtggcaggagagagcttctgagactgctacagagtgggcgtcgagtgcattccgtcgcgggaccctcccaatggttgggaaaacccctaacaactagactgctttttcctgctgccccatgctgttgccggccacactacctgttcctcgccgcttctggtcccaggagcctctctacctccgcaatatcttttgccgaggttcaggtacaggcccctcccgttgtggcagccacccccagtccaaccgctgttcctgaagtggcttccggagaaacggccgacgtggtccagaccgctgccgagcagtcctttgctgagctcggcctcggaagctacactcctgtaggtttgatccagaatctcctagagttcatgcatgttgatcttggcttaccgtggtggggagccatcgctgcgtgtaccgtgttcgcgaggtgcctaatcttccccctgatcgtcactggccagagggaggcggcacgcattcacaatcatctccccgagatacaaaagttcagctcacgcattcgggaagccaagctcgcaggcgatcacatcgaatactacaaggcaagctcagagatggccctgtaccagaaaaaacatggtattaaattatataagcccctgatcctgccagtcacccaggcgccaatttttatcagcttcttcattgcgcttcgagagatggccaacctccctgtgccgagcctgcagactgggggtctgtggtggtttcaggacctcacagtgtctgatccgatatatattctgccactggcagtgacagccacaatgtgggctgttttggaactcggcgcagaaactggcgtgcaatcttctgatcttcagtggatgcgaaacgttatcaggatgatgccgcttatcacattaccaatcacgatgcactttcccacggccgtgttcatgtactggctgtcatcaaatctgttcagtctggtgcaggtctcttgcctgagaattcctgccgtcaggacagtgcttaagatcccacaacgggtcgtgcacgacttagacaagttgccgccacgtgagggctttctggaaagcttcaagaagggatggaagaatgccgagatgaccagacagctcagggagagggaacagcggatgagaaatcagcttgagcttgcggctcgcggacctctgcgccagacatttacgcataatcctctgctccagccaggaaaggataatcctccaaacatacccagcagctcatcaaaaccaaaatctaagtacccatggcacgatacactcgggtag

SEQ ID NO: 233729 - DNA, 1260 bp, Artificial Sequence
  Description of Artificial Sequence: Synthetic coding sequence
atgcgcggtactcaggtgcattcggtggccggtccttcacagtggctcggcaagcccttgacgacaagactcttgtttcccgcagctccttgctgctgtcgaccacactacctgtttctggccgcttctgggcctagatcccttagtacaagcgccatctcattcgccgaagtgcaagtccaggctcctcctgttgtggcggctacccctagtcccactgctgtaccagaagtcgcgtcgggtgagaccgccgatgtggtgcagaccgcggctgaacaaagcttcgctgaactcggacttggaagctatactccagtgggcctaatacagaacctgctcgaattcatgcatgtggacctcggcctaccctggtggggggcaatagccgcatgcaccgtgtttgccagatgtttaatctttccccttatcgtgacaggacagagggaggccgcacgtatccataatcatttacctgaaatccagaagttctcttcacggatccgcgaggccaagttagccggagatcatatagagtactacaaagcttcttccgaaatggctctttaccagaagaagcacggaatcaagctgtacaaaccgctgatccttccggtaactcaggctccaatttttataagcttcttcatagcactacgagagatggctaacctgcccgtgccctctttacaaaccggcggtctgtggtggtttcaggatctgactgtaagcgacccaatttatattctgcccctcgcagtcactgccaccatgtgggccgtattagagctgggcgcagagaccggggtgcaatcttctgatctgcaatggatgaggaacgtcattcgcatgatgccccttatcacacttcccattactatgcatttccctacagcagtctttatgtattggctgtcatcaaatttgttcagccttgtgcaggtctcatgcctgcggatccctgccgtgaggaccgtgcttaaaatacctcaaagggtagtgcatgatctagacaagttgccaccacgagaaggattcctggaatccttcaagaagggatggaagaacgctgaaatgactaggcaattgcgggagagggagcagagaatgaggaatcagctggagctggcggcaagagggcctttgcgccagacgttcacacacaatcccctgctgcaacccggaaaggacaatcctcccaatattccatcctccagttcaaagcccaaatctaagtacccatggcacgacactctcggatag

SEQ ID NO: 233730 - DNA, 732 bp, Artificial Sequence
  Description of Artificial Sequence: Synthetic coding sequence
atgtcgcgactgtggtacgggaagaaaggcaggcgccaccagcctatcaatcataagtacaccctggtagtctcagtggctgagtatcaccgaagaattgatgctcttaacaccgaagagctcagaaccctgtgtcgacgtcttcagataaccacccgagaagacatcaacagcaagcaggtagcaactgtgaaggctgatcttgaatctgaatcctttaggccaaatctgtctgacccttctgagctcctactcccagaccagatcgagaagctcaccaagcatctaccaccgaggacgattgggtatccttggaccctcgtctacgggacgggcaaacacggaacgtctctcaagacgctgtataggactatgacaggcctggatacccccgtgctgatggtgatcaaggactcagacggccaggtgtttggcgcactggcttcagaacctctgaaagtctctgacggattttacggtactggtgaaacattcgtgttcaccttttgtcctgaatttgaggtgttcaaatggacaggggacaacatgtttttcatcaagggggatatggattccctcgccttcggagggggtgggggtgagtttgcgctttggctggacggagacctttatcacggtaggagccacagctgcaagactttcggtaatcgcactctgtcgaagaaggaagatttttttatccaggacatcgagatctgggctttcgagtag

SEQ ID NO: 233731 - DNA, 2520 bp, Artificial Sequence
  Description of Artificial Sequence: Synthetic coding sequence
atggattacctgaccacatttacggaaaaaagtggacggctcctcagaggcacagcgaatcggctgctggggttcgggggtggaggcgaagccaggcaggtacgcttcgaagattacctgcgggagccggcacaaggagatctgggctgtggaagtcctccccatagaccacctgcaccttctagtcccgaggggccagacacagggcagaaaaagactctggacaagaaggacgggaggaggatgtcattccaaaagcccaagggcaccatcgaatatacagtcgagagcagggactcactgaactccatcgccttaaaattcgatacaactcccaacgagctggtgcagctcaataagctgttttctcgggcagtcgtgacaggtcaggtcttatacgtgcctgaccccgagtatgtgagctctgttgaaagctccccgagcctgagtcctgtatctcccttgtccccaacgtcttcggaggccgaattcgacaagacaaccaaccctgacgtgcacccaactgaggctacgccatcctcaacgtttaccggcatacgccctgctagagttgtttctagtacgtccgaagaggaagaagcttttacagagaagttcctgaaaatcaattgcaaatacatcacgtctgggaaaggaaccgtgtccggtgtgttacttgtgacgcccaataacatcatgttcgatccacataagaacgatcctttggtgcaggaaaatggctgcgaagaatatggtatcatgtgccccatggaggaggtcatgagcgccgctatgtacaaagagattctggatagcaagattaaggaatctctacctatcgatatcgaccaactgagcggtcgagatttttgtcacagcaagaagatgactggcagtaacacggaagaaatcgactcccggatccgagatgccggtaatgactccgcatctaccgccccacgttccactgaagagtctctgagcgaggacgtgtttaccgaaagtgagttgtcccccattcgagaggagctcgtgagctccgacgaattaagacaggacaagagttcaggcgctagctccgaatccgtacaaacagtaaaccaggctgaagtcgaatccctcactgtaaagtccgagtccaccggtacacctggccacctccgctcggataccgaacacagcactaatgaagtcggaacactgtgtcacaagactgatctcaataatctggagatggccattaaagaagatcagattgctgataatttccagggcatatccggcccaaaggaagactcaacatctatcaaggggaacagtgaccaagattcttttctccacgagaactcactgcatcaagaggagagccagaaagaaaacatgccctgcggagagacagccgagttcaaacaaaaacagagcgtgaataaagggaaacaaggtaaagagcagaaccaagatagccagactgaggcagaagaactgaggaagctatggaagacacacactatgcagcagaccaagcagcaaagagagaacatacagcaagtgtctcagaaggaggcgaaacacaaaatcacatctgctgatggccacatagaatcctccgccctcttgaaagagaaacagcgtcaccgtctacataagttcctctgtctccgcgtgggcaaacccatgcgaaaaacgttcgtttcacaggcctctgccactatgcagcagtacgcacaaagagacaaaaagcacgagtactggttcgcagtgcctcaggagcgcacagaccatctgtacgcgtttttcatccagtggtcccccgagatttacgcagaggacactggggaatacactagggagcccggattcatcgtggtaaaaaagatagaagaaagcgaaacaattgaggacagctcgaaccaggccgctgcacgtgagtgggaaattacaactcgcgaagacatcaatagtaagcaggtagccacagtgaaggccgatctggagagcgagtcctttcgtcctaatctttccgaccctagcgaactgctattgcccgatcagattgaaaaactgacaaaacatctgcccccaaggacaatcggctacccgtggacactagtgtacggaacgggcaaacatgggacgagtcttaaaacgttgtacagaaccatgaccgggctggatacccctgtactgatggtaataaaggactccgacggccaggtctttggggcactggcgagtgaacctctgaaagtatcggatggtttctatggcacaggtgagacatttgtcttcacattctgtcccgagtttgaggtgttcaaatggaccggggacaacatgttcttcataaagggcgacatggatagtttggcattcgggggtgggggaggagagttcgctctttggctggatggtgatctttaccatggcagatctcacagctgtaagacgtttggcaaccggacattgagcaagaaggaggatttctttatccaagatatagagatctgggccttcgagtag

SEQ ID NO: 233732 - DNA, 2625 bp, Artificial Sequence
  Description of Artificial Sequence: Synthetic coding sequence
atgacgaaggacaagaatagcccaggactgaaaaagaagtctcagagcgttgatataaacgccccaggcttcaacccactggctggtgcaggaaagcagaccccgcaggcctctaaaccccctgccccaaagacgccaatcattgaggaggagcagaataatgctgctaacacccagaaacatcctagccgtcgcagtgaactcaaacgcttctacacaatagacactggacaaaagaagaccctcgataaaaaggatggtcggagaatgtccttccagaaacccaagggcacgattgaatatacagtggaatcccgggacagcctcaacagtatagccctgaagtttgacacaacccccaacgagcttgtgcagctaaacaagcttttttcccgggcagtggttactgggcaagtgctatatgtccctgatccagagtacgtgtcctccgtcgaaagctcaccttccctgtcacctgtgtcccctctttctcccacgagctcagaggcagagttcgataagactacaaatcctgatgtccaccctaccgaggcgaccccttcctccacattcactgggatcagaccggcacgagtggtgagttcaacctccgaagaggaagaagcttttaccgagaagttcctgaagatcaactgtaagtatattacttcaggtaaaggaactgtctctggagtgctcctggtgacccccaacaatatcatgttcgaccctcacaaaaacgacccactcgtccaagaaaacgggtgcgaggaatatggcatcatgtgcccaatggaggaagttatgagcgccgctatgtataaggagatcctcgactccaagataaaagagagccttccaattgatatcgaccagctttcaggcagagatttctgtcattcaaaaaagatgaccggctccaacaccgaggagatagattcccgaattcgagacgccggtaacgattcagcgtccactgctccccgaagcacggaggagtctctttccgaggacgttttcacagagtcagagcttagccccattagagaggaactggtgtcaagcgacgagttacggcaggataagtcttcaggagcatcctcagagagcgtccagacggttaaccaggccgaggtggagagtctaactgtgaaaagcgaatcgaccggaacaccaggtcatcttaggtctgacactgagcactcgacaaatgaggtaggcactctttgccataagaccgatctgaacaacctggagatggccattaaggaagaccaaatagcagataacttccagggcatcagtggcccaaaagaagattccactagcataaaggggaacagtgatcaggacagttttcttcacgaaaacagcctgcaccaggaggagtcccaaaaggaaaacatgccctgcggcgagacagccgagttcaagcagaagcagtccgtgaacaagggtaagcagggcaaggaacagaatcaggatagtcagactgaagcagaagagttgcggaagctttggaagacgcacactatgcaacagacaaaacagcagcgagagaatatacagcaggtgtcccagaaagaggccaaacataagattacttcggcagacggccacattgagtctagtgccctgctgaaggaaaagcagcgtcacagactacataaatttctgtgcctccgagtgggaaagcctatgaggaagaccttcgtatcacaggcgtccgctacgatgcaacagtatgcgcagcgagacaagaaacatgagtactggttcgccgtacctcaagagcgcacagatcatctctacgcttttttcattcagtggtctccagaaatttacgccgaggacaccggtgaatacacacgcgagccagggtttatcgttgtgaaaaaaatcgaagagtccgaaactatcgaagactctagcaaccaggccgctgcgagggagtgggaggtggttagtgtggctgagtatcaccggcgaatcgacgctctgaataccgaggagctcagaaccctctgtcgtcgcttgcagattacaaccagagaagatattaatagcaagcaggtagccacggtaaaagccgacctggaatctgaatctttcaggcccaacctgagtgatccaagcgaattgctgctgccagaccagatcgagaagctgaccaagcacttgcccccaaggaccatcggatatccttggacactggtttatggtacaggtaaacacggcactagcttgaagaccctgtacaggaccatgactgggttagacaccccagtcctgatggttataaaagactccgatggacaggtgttcggcgcactggcatcggaacctcttaaggtgtccgatggattctatggcacaggggagaccttcgtgttcacattctgcccagagttcgaggtgtttaaatggacaggggataatatgtttttcatcaagggtgatatggatagcttggccttcggcggtgggggtggcgaattcgctttatggttagatggggatctgtatcacggtcgttcacactcctgtaagaccttcgggaatagaaccctaagcaagaaagaagattttttcattcaggatattgagatctgggctttcgaatag

SEQ ID NO: 233733 - DNA, 2541 bp, Artificial Sequence
  Description of Artificial Sequence: Synthetic coding sequence
atgtccgtcagcaacctctcgtggctgaaaaagaagtcccagtccgttgatattaacgcccctgggttcaacccattggccggagccggtaaacagacacctcaggcttccaaaccaccagcgccaaaaacacctattattgaggaggagcaaaataacgccgctaatacacagaagcacccctcacgcagatctgagctgaagaggttctataccatcgatacgggacagaaaaagacgctcgacaaaaaggatggtcgtcgcatgagttttcagaagcccaaagggaccatagagtatacggttgaatcccgagactcacttaacagcatagctcttaagttcgatactactccaaacgagttagtccagctcaataaattgttctccagagccgtggtcactgggcaggtgctgtatgtccccgatccagagtacgtcagtagtgtggaaagcagcccttccctgagccctgtctcccctcttagccctacgagttcagaggcagagtttgataaaacaaccaatcctgatgtccatcctacagaagcaacaccatccagcacattcaccggtataagaccagccagggtggtgagttctacgagcgaggaagaagaggccttcaccgagaagtttctcaaaattaattgtaaatatatcacatctggtaaagggacagtttccggggtgctgctagtgacaccaaataacatcatgttcgatccccataaaaacgaccctctggtccaggaaaatgggtgtgaagaatacggcatcatgtgccccatggaagaggtgatgtcggccgcaatgtataaagagatcttggactcaaagatcaaggagagtctgcctatcgacatcgaccagctatcaggccgtgacttttgccactcaaagaagatgaccggatctaacacagaagagatagattccagaattagagacgccggaaacgattccgcctctacagcacctcgttcgacagaggagagtctgtccgaggacgtctttactgagagcgaattatcacctatccgcgaggaactagtcagcagtgacgagctgcggcaagacaagagttccggggctagctccgaatcagttcagacagtgaaccaggctgaggtagagagtctgaccgtgaaatccgagtctacaggcacaccaggacacttaagatcagatacagagcattccacaaacgaagtcggcaccctctgtcataagactgacctgaacaatctcgaaatggccatcaaggaagatcagattgcagataacttccaagggatcagtgggccaaaggaggacagcaccagcattaaaggtaacagtgaccaagattctttcctgcacgagaactccctccatcaggaggagtcacagaaggagaatatgccatgtggcgaaacggctgagtttaagcagaaacaatcagtcaacaaaggaaagcagggtaaagaacagaatcaggattcacaaaccgaagctgaggaactgaggaaactctggaagacacacaccatgcagcagaccaaacaacaaagggaaaacatccagcaggtctctcagaaggaagccaaacacaagataacctccgcagatggccacattgaaagctcagccctgttaaaggagaaacaacgtcacagactccacaagttcctgtgccttagagtgggaaagcccatgcgcaagacgtttgtgtcgcaggcctcggctaccatgcagcagtacgcccagcgagacaagaagcatgaatattggtttgcagttccccaggagagaacagaccacctttacgcgttttttatccagtggtccccagagatatatgccgaagacacgggcgagtacacacgtgaacctggatttatcgtggtgaagaaaattgaggaaagtgagactattgaagatagctcgaaccaggctgcagcaagggagtgggagatcacaacccgggaagatataaacagtaaacaggtagcgactgttaaggctgatttggagtcagagagttttagaccaaacctaagcgaccccagcgagctgctccttcccgaccaaatcgagaagctaaccaagcacctgcctcccagaacaataggctatccatggacacttgtgtacggtacaggcaaacacggaaccagcctgaagacgctctaccgcacgatgaccggactcgacacccccgtgctcatggtcatcaaggactcagatggccaagtattcggggcactcgcctccgagcctctcaaagtctccgatggcttctacggaacaggagagacattcgtcttcaccttttgtcccgagtttgaagtgttcaaatggactggcgacaacatgttcttcatcaagggggacatggacagcctggccttcggcggaggaggaggggagttcgcgttgtggctggacggcgacctatatcacggcagaagccattcctgcaaaacattcgggaatcgaactctaagcaagaaagaggactttttcattcaggacatcgaaatttgggcctttgagtag

SEQ ID NO: 233734 - DNA, 651 bp, Artificial Sequence
  Description of Artificial Sequence: Synthetic coding sequence
atgagcaggttgtggtatgggaagaaggggagaaggcatcagcctataaaccacaagtacacactgattacaacgagggaagacattaacagcaagcaagtagctaccgtgaaagccgatttagagtccgaatcgtttaggcccaacctaagcgacccaagcgaactcctgctcccggaccaaatagaaaagctcactaagcacttaccgccaagaacgatcggatacccctggacactggtgtatggcaccggtaaacacggtacctccctgaagaccctgtatcgcaccatgacgggtttggacactcccgttcttatggttattaaagactctgatggacaagtgtttggagctctggcgtctgagcccttgaaggtgtccgacggattttatggcaccggggaaacttttgtctttactttttgccccgagttcgaggtcttcaagtggaccggggataacatgttctttatcaagggtgacatggattctctggcattcggaggtgggggaggcgaattcgccctttggctggacggggatttgtaccatggcaggtcacactcttgcaagacattcgggaatcgaacattgtctaagaaagaagacttctttatccaggacatcgagatatgggcctttgaatag

SEQ ID NO: 233735 - DNA, 885 bp, Artificial Sequence
  Description of Artificial Sequence: Synthetic coding sequence
atgcagcagacgaagcagcagcgggagaacatccagcaggtctcccagaaggaagctaaacataagatcacgtcagcagatggacacatagaaagtagcgcccttctcaaagaaaagcaacgccaccgcctgcacaaatttctgtgtctgcgcgtcggaaaacccatgcgcaagaccttcgtctcacaggctagcgccaccatgcagcagtatgcccagagggacaagaaacatgagtactggtttgccgtgccccaggagcgcaccgatcacctctatgcctttttcatccaatggagtccggagatctacgcagaggacactggcgaatacactagggaaccagggttcatcgttgtgaagaagattgaggagagtgagaccatcgaagactcttcgaatcaagccgctgccagagaatgggagttaacaaaacacctgccccctcgcactattgggtacccatggacattagtctatgggacgggcaagcatgggaccagtctaaagactctgtacagaaccatgactgggcttgacacgcctgtgctgatggtgattaaagactctgatggccaagtgttcggcgctttggccagcgaacccctgaaagtgagcgatggtttctacggaacgggcgagacttttgtgtttacattttgccctgagtttgaggtgtttaaatggacaggagacaatatgtttttcatcaaaggagatatggactctctcgcctttggaggaggaggcggtgagttcgcattgtggttagatggagacctataccacggccgatcacacagctgtaagacctttggaaatcggaccttgtctaagaaggaggatttcttcatacaggacattgagatatgggcgttcgagtag

SEQ ID NO: 233736 - DNA, 1512 bp, Artificial Sequence
  Description of Artificial Sequence: Synthetic coding sequence
atgttctgccaaaggaaagataccggacagaaaaagaccctggataaaaaagatggccgacggatgtctttccagaaaccaaaaggcactattgagtataccgtcgagagcagagattctttgaatagcatagcgcttaagtttgatacgactcctaatgagctagtgcaactgaacaagctgttctctagggccgtggtcaccgggcaggtattatacgtgccagacccagagtacgtttctagcgtggaaagttccccttccctctcacccgtcagtccgctttctcctactagcagcgaggccgagtttgataaaacaactaatccagatgtgcaccccaccgaagctacaccttcttctacgtttacaggcatcagaccagcacgcgtggtatcatctacatccgaggaagaggaagcgtttaccgaaaaattcctgaagattaattgtaagtatataacttccggcaagggtacagtaagtggcgtgttattagtgacgccgaataatatcatgtttgatccgcataagaatgatcctttggtacaggagaatggctgtgaagaatatgggatcatgtgccccatggaggaggttatgtccgccgctatgtacaaagagatcttggactccaagatcaaagagtcgctgcccatcgatattgatcaactgtccggcagggacttctgccactccaaaaagatgaccggtagcaatacagaagagatagattcacgaattagagatgcgggtaatgatagcgccagtacggcccctaggtcaaccgaggagagcctctccgaggatgtttttacagagtcggagctaagtcctattagagaggagctggtgtcttctgatgagctgagacaagacaagagctccggcgctagcagcgagagcgtgcagactgtgaatcaggccgaggtcgagagcctgaccgtgaaaagcgaaagtacaggaacaccagggcacctgaggagtgatacggagcacagtactaacgaagttgggaccctttgtcacaagaccgacttaaacaatctggagatggctatcaaggaggatcagatcgctgataactttcaaggcatctcaggtcccaaggaagatagtactagcattaaaggcaacagcgatcaggactcattcctgcacgagaattctctgcaccaagaagaatcccaaaaggagaatatgccctgcggggaaacagcagagtttaagcaaaagcagtccgtcaataagggcaagcaaggcaaggaacagaaccaagactcgcagaccgaggcagaggagctgcgtaagctttggaaaacccatacaatgcagcaaaccaaacaacagcgggaaaacatccagcaggtatctcagaaagaagctaaacacaagattacatccgcagacggtcacatagagtcaaaatgctatagagtcaatgaagtgagcagctccaactgcatggtgagcccttcttttctgaccgacagcaaggccgcagtcccttag

SEQ ID NO: 233737 - DNA, 2622 bp, Artificial Sequence
  Description of Artificial Sequence: Synthetic coding sequence
atgagtgtgtccaacctctcctggttgaagaagaagtcccagtccgtggatatcaacgctcccggatttaacccgctggctggagctggaaagcagaccccacaagcatctaagccgcctgctcctaaaacacctatcatcgaagaagagcagaataatgccgctaacacccagaagcacccatctaggcgtagtgaactgaagcgtttttatacgatcgatacgggccagaaaaagaccctcgacaagaaagacggtcgtcgcatgagcttccagaaacctaaaggtacaatcgagtacaccgtggagtctagggacagccttaatagcatcgcgttaaagttcgacactacccccaacgagcttgtccagttaaacaagcttttctccagagctgtagtcaccgggcaagtgctgtacgttccagaccccgagtatgtgagcagcgtggagtcaagcccgtccttaagcccagtttctcctttgtcgcccactagctccgaggctgaattcgacaaaacaaccaatcccgatgttcacccaaccgaggcaactccatcctcaacctttacgggaattcgaccagccagggtagtcagcagtacctccgaagaggaagaagcatttaccgaaaaattcctgaagatcaactgcaagtatatcacctccggcaagggaaccgtcagcggtgtcctgcttgtcacaccaaacaatatcatgtttgacccacacaaaaatgatcctctcgttcaggaaaacggctgcgaggagtatggaatcatgtgccctatggaagaggtcatgtctgccgcaatgtacaaggagatcttagactctaagatcaaggagtcactccccatcgacatcgatcaactcagcgggagagacttctgccactccaaaaaaatgacaggtagcaacacagaagagatagactcaagaattagagatgcagggaacgactcagcctcgaccgcaccccgatcaacggaggagtccctctccgaagacgtgtttacagagagtgagctgagtcctatacgagaagaactggtttcatcagacgaactaaggcaggataagtcttcaggtgcatccagcgagagcgtccaaacagtcaaccaggccgaagtcgaaagcctaactgtgaaaagcgagtctaccgggacaccagggcatcttaggtctgacacagaacacagcacaaacgaggtaggtactctctgccataaaacagatctcaacaacctggaaatggccattaaggaggatcagatcgccgataactttcagggcattagcggccctaaagaagatagcacatccattaaggggaactccgaccaggattcctttctccacgagaatagtctgcaccaggaggaaagccagaaagaaaacatgccctgtggcgagaccgctgagtttaagcagaagcagagcgtgaataagggcaagcaagggaaagaacaaaaccaagatagccaaacagaagcggaggaactccggaagctttggaagacccacaccatgcaacagaccaaacagcagagagaaaacatccagcaggtgtcccagaaggaagccaaacacaagattacttctgcagatggacacattgagtcttcagcgttgctaaaggaaaagcagcgtcacagactgcacaaatttttgtgcttgagggtcggaaagcccatgaggaaaacatttgtttcccaagctagtgccacaatgcagcagtatgcgcaaagagataaaaagcacgaatattggttcgcggtgccacaggagcgcacagatcacctgtacgcattcttcattcagtggagtccggagatttatgctgaagacactggcgaatacaccagggaacccggtttcatcgtggtgaagaagatcgaggaaagcgaaaccatagaggacagctctaatcaggcagccgctagagagtgggaagtcgtatccgtggctgaataccaccggaggattgacgctcttaacacagaggagcttaggactctctgtaggcggctgcagatcacaactcgagaagacattaatagcaagcaggtcgcaaccgtcaaggctgacctggagtctgagagtttccgcccaaacctgagtgatcccagcgagctcctcctgccagatcagatagagaagctgacgaaacacctcccaccacgcactatcgggtacccctggaccctggtgtacggaacaggaaagcacggtacatcactgaaaactctctatcgaactatgacgggactggacaccccagtgcttatggtgataaaggattccgacggccaggtattcggagccttggcatccgagcctttgaaagtgagcgacgggttctatggaaccggagagacgttcgtgtttacattttgtcccgaattcgaagttttcaaatggacgggagataacatgtttttcatcaaaggggatatggattctctggccttcgggggagggggaggagagttcgctttatggctggacggagacctttatcacgggagatcccactcatgtaaaacgtttggcaatcggacgctcagtaagaaggaggacttcttcattcaagacatcgaaatctgggcgttcgaatag

SEQ ID NO: 233738 - DNA, 2541 bp, Artificial Sequence
  Description of Artificial Sequence: Synthetic coding sequence
atgtccgtctccaatctgtcgtggctcaaaaaaaaatcccagtccgttgatatcaacgctcccggatttaacccgctcgcaggagctggtaagcagactccccaggccagcaagcctcccgctcccaaaacacctattatcgaggaggagcaaaacaacgccgctaacactcaaaaacacccttctcgaagatctgaacttaagaggttttacacaatcgacacaggtcagaaaaagactctagataaaaaggacgggcgtcgcatgagctttcagaagcctaaaggaactattgagtacacagtggagagcagggatagtctgaattctatcgccctgaaattcgataccacgcccaacgaattagtccagctgaataagctcttctctcgggctgtcgtcacagggcaagtgctctacgtgcccgacccagaatacgttagctccgtggaaagcagccccagcctttctcctgtgtctccactcagccctactagctcggaagccgagttcgacaagactacaaacccggacgtacacccaaccgaggcaacgccgagtagtacttttacaggaatccgacctgcacgcgttgtttccagcacatctgaagaagaggaggcttttaccgaaaaattcctgaaaatcaactgcaagtacatcacatctggcaaaggcactgtgagcggagtgttgttagtaacacccaacaatataatgttcgacccacacaaaaatgatcccctcgtgcaggaaaacggttgtgaggagtatgggattatgtgccccatggaggaagtgatgagcgccgctatgtacaaagagatcctggacagcaagatcaaggaaagcctgccaattgatattgaccaattgtcaggaagagacttctgccatagcaagaagatgaccggttctaacaccgaagagattgatagcaggatacgggatgctggcaatgactctgcatccaccgcccctagaagcaccgaggagagtctgagcgaggacgtgtttacagagagcgaactttcccctataagagaggagttagtgagcagtgatgagcttcggcaggataaaagcagtggcgcttcctctgaaagtgtccagacagtcaaccaggctgaggtagagagccttactgtgaagagtgagagtaccgggactccgggacacctgcgcagcgacacagagcattccaccaatgaagttgggaccctgtgtcacaagactgatctcaataatttggagatggctatcaaggaggaccagatcgccgacaattttcaaggcatcagcggaccaaaagaagacagtacatcaatcaaggggaatagcgatcaagattccttcctccacgagaattctctgcaccaggaggagtcccagaaagagaacatgccatgcggcgaaacggctgagttcaaacagaagcagtccgttaataaaggaaaacagggtaaagaacagaaccaggatagccagaccgaggcagaggagctgcgaaagctgtggaaaacccacactatgcagcagaccaaacagcaaagggagaatatccagcaggttagccagaaggaggccaagcataaaataacgagtgctgacggccacatcgaatcatctgcactattaaaggaaaagcaacgtcaccgtcttcataaattcctctgcttaagagtggggaaacccatgcgaaagacattcgtgagtcaagcaagtgccaccatgcaacagtatgctcagagagacaaaaaacatgaatattggttcgcggttccccaggagaggacggaccacctgtatgcatttttcatccagtggagtcccgaaatctacgctgaggataccggagagtacacgcgcgaacctggattcatcgtcgtgaagaagatcgaagaatctgagaccatcgaggattcatccaatcaggccgcagccagggagtgggagattaccacccgagaggacataaattcaaagcaggtggcgacagtcaaggcagacctcgaatcagagagctttcgtccgaacctgagcgatcccagtgaactcctcctgcctgaccaaatcgaaaaacttacgaaacacctgccgcctaggacaataggctatccatggaccttagtctacgggaccgggaaacatggaacttcactgaaaaccctgtacagaaccatgactggcctcgatacacctgtactgatggttataaaggattcagacggccaggtctttggagccctagctagtgaacccctcaaagtatctgacggcttctatgggactggcgaaacctttgtgtttaccttttgtccagaatttgaggtgtttaagtggaccggagataatatgtttttcattaaaggagacatggactccctggccttcggtgggggtggtggggaatttgcgttgtggctggacggagacctataccacggaaggtcacactcctgtaaaacatttgggaacagaactctctctaaaaaagaggatttctttatccaggatattgagatctgggcgttcgagtag

SEQ ID NO: 233739 - DNA, 822 bp, Artificial Sequence
  Description of Artificial Sequence: Synthetic coding sequence
atgaccttcgacgatcttaagattcagactgttaaagaccagccagacgaaaagtctaatggtaaaaaggcaaaaggattacagtttttatactcaccctggtggtgcctggccgctgcaacattaggagtgctctgtcttgggttagtggttactataatggtgctgggaatgcaactctcccaggtctccgacctacttactcaggaacaagctaacctgacacatcagaaaaagaaactggaaggtcagattagtgcaaggcagcaagcggaggaggcctcccaggaaagcgaaaatgaattgaaggagatgattgagaccttagccaggaagctgaacgaaaagtctaaagaacaaatggagcttcaccaccaaaatctgaacttgcaagagactctgaagcgagtggccaactgcagcgccccatgcccccaggattggatttggcatggggagaactgctacctgtttagcagcgggtccttcaattgggaaaaatctcaggagaagtgtttatctctcgacgccaagctgctcaaaatcaattccacggccgatttggactttattcagcaggcaatttcttatagttccttccccttctggatggggctctctcgtcggaatcctagctacccgtggctctgggaggatggctccccactaatgccacacctgtttcgtgtccggggagctgtaagccagacctatccctcaggcacttgtgcctacattcagcgcggtgctgtgtacgctgagaattgcattctggcggcattctccatctgccagaagaaggcaaatcttcgagcccagtag

SEQ ID NO: 233740 - DNA, 546 bp, Artificial Sequence
  Description of Artificial Sequence: Synthetic coding sequence
atgacctttgatgacttgaaaatccagaccgtgaaggaccaacccgatgagaagtcaaacgggaaaaaagcaaagggcctgcagtttctatactcaccctggtggtgtctggctgctgccaccctgggggtgttgtgcctcggcttggtggtgaccatcatggtgctgggcatgcagctgagtcaggtgtctgacttgctgacgcaggagcaagccaacttgacccatcagaaaaaaaagctagaggggcagatctctgctcgacagcaggcggaagaggccagtcaggagagcgaaaatgagcttaaagagatgatcgaaaccctggcaagaaagctgaatgagaagtcaaaggaacaaatggaactccaccaccagaacctgaacctccaggagaccctcaagcgcgtggcgaattgttctggattgcatcccgcaagtaactttttgttccaattctccatcctcgacggcgcagtaagcgaggagccacagctgcccatggctctgggaggaaggttttcattcgacgctccgctaatatag

SEQ ID NO: 233741 - DNA, 570 bp, Artificial Sequence
  Description of Artificial Sequence: Synthetic coding sequence
atgacattcgatgatctgaaaattcagacggttaaggatcaaccagatgagaaatccaatggcaagaaggccaaaggcttgcagttcctttacagcccctggtggtgcctggcagccgctacactgggggttctgtgtctagggttagttgtgacaataatggtcctcggaatgcagctttcacaggtctctgacctgttgacgcaggagcaggccaacctcacacaccaaaagaagaaacttgagggacagatctccgcacggcagcaggccgaggaggccagtcaggaatccgaaaacgagttgaaagaaatgatcgaaacactggcccgaaaattaaatgaaaagtccaaggaacagatggaacttcaccaccagaacctaaacttgcaagagaccctaaagcgggtcgcgaactgctctgctccttgtcctcaagactggatctggcatggtgagaactgttacctcttctcttctggctccttcaactgggagaagtctcaggagaagtgcctgagcctggacgcaaagctgttgaaaataaacagcacagctgatctgatttag

SEQ ID NO: 233742 - DNA, 1623 bp, Artificial Sequence
  Description of Artificial Sequence: Synthetic coding sequence
atgcagcaggtgctcgagaacctcacagaactaccctcgagcaccggcgcagaagagattgacctcattttcctgaagggcatcatggaaaaccctatagtcaagtctctcgccaaggcccacgagcgtctagaggacagcaagttggaagctgtttcagataataacctcgagctggtgaatgagatattagaggatataacgcccctcattaacgtggatgagaacgtggccgaactggtcggtattcttaaggagcctcattttcagagcctgttggaggcgcacgatatagtagcctccaaatgttacgacagccctccgtcaagcccggagatgaacaatagctctataaataatcagttattacctgtggacgcaattagaattttaggcattcataagcgagccggtgagcccctgggcgttaccttccgtgtcgaaaacaacgacctggtgattgcacgaatccttcacggcggaatgattgaccggcaggggctactgcacgtgggggacatcatcaaagaagtgaacgggcacgaggtaggaaacaacccaaaggaactgcaagaactactgaagaatattagcggctccgttaccctgaaaattttgccttcttatcgggacactattactccacaacaggtcttcgtgaaatgccatttcgactacaacccttataatgataacttaattccctgtaaagaggccggattgaagtttagcaagggggaaattctgcagatcgtcaatcgcgaggaccccaactggtggcaagcttcacatgtgaaggaaggtgggagcgccggtctgattccaagccaatttttagaggagaagcgaaaggcatttgtgcgcagggattgggataattccggacccttctgcggtaccatctcctcaaagaaaaagaagaagatgatgtacctcacaactaggaatgctgagtttgaccgtcacgaaatccaaatctatgaggaggtcgccaaaatgcctccatttcagcgtaagaccctggttcttattggggcacagggagtgggcagaaggagtctgaaaaacaggtttatcgttctcaatccaacgcggttcggaaccactgtcccctttacctctcgaaagccacgagaagacgagaaagacgggcaggcttacaaatttgtcagtaggtcggaaatggaggccgacatcaaagcaggaaaatatctcgagcacggtgaatacgaaggaaatctgtacggcaccaagattgattctattttggaggtggttcagacagggaggacttgtatcctcgacgtaaaccctcaagcattaaaggtgctcaggacttccgaatttatgccttacgtggtgttcatagcagcgccagagttagagaccttaagagccatgcacaaggcggtggttgacgctggcataacaacaaagctgcttacagactctgatcttaagaagaccgttgacgaatctgctagaattcaaagagcctacaaccactatttcgatctcatcattattaacgacaatttggataaagcatttgagaagctccagaccgcgatagagaaactgagaatggaacctcagtgggtgcccatctcttgggtatactag

SEQ ID NO: 233743 - DNA, 636 bp, Artificial Sequence
  Description of Artificial Sequence: Synthetic coding sequence
atgtttcacctgaggacttgcgctgctaagcttcgcccactgactgctagccagacagtgaagacctttagccagaacaggcctgccgcagcacggacatttcagcagattcggtgctactcagcaccggtcgcggctgaaccgtttttgtctggtaccagttcaaactatgtggaagagatgtattgtgcctggcttgaaaacccaaagtccgttcataaatcctgggatatcttcttccgaaatacaaacgctggagcaccccctggcactgcctaccagagtcccctacccttgagtagggggagtctggccgcagtagcccatgctcaaagtttagttgaagctcagcctaacgtggataaacttgtcgaagatcacctcgctgtccagagtctcatccgcgcatatcaaattcgcggacaccacgttgcacagcttgaccccttgggaatactcgatgcagacctcgattcgtccgtcccggcagacatcatttcctcaaccgacaagttggggttttacggtctggacgaatctgacctggacaaggtctttcatctgccaaccaccactttcatcggtggccaggagtcagccctgcccctgagggagatcatccgtcgcttagagtag

SEQ ID NO: 233744 - DNA, 1284 bp, Artificial Sequence
  Description of Artificial Sequence: Synthetic coding sequence
atgttccacctgagaacgtgcgcggctaagctgcggccattgaccgcaagccagacagtcaagactttcagccaaaaccgccctgctgctgccagaactttccagcagattcggtgttacagtgctccggtcgccgcagaacccttcctgtccgggacatcctcgaactacgtcgaagagatgtactgtgcctggctggagaatcccaaaagcgtgcataaatcttgggatatcttctttcggaatactaatgccggagcgccaccagggaccgcctatcaatcgccattgcccctgagccgtggcagcttggcagccgtcgctcatgcacagtctctggtggaagctcaacccaacgtagataaactggtggaggaccatctggccgtccaatctctcatcagagcttatcagatccgcggtcaccacgtcgcacagctagatccactgggtatcctcgatgctgacctggactcctctgtgccagccgacataatttcctctaccgacaagctgggcttctacggcttagatgagtcagatctggataaggtgttccatctgcctaccacaacttttatcggcggacaagagagtgcactgcctctgcgcgagattatccggaggctcgagatggcatactgtcagcacatcggcgtggagtttatgtttatcaacgacctggagcaatgccaatggattcgacagaagtttgagacacccggaataatgcagttcacgaatgaggagaagcgaaccctgctggcaagactcgtgaggtctactcgcttcgaagaattcctgcagcgaaagtggagttcagaaaaaagatttggcctcgaagggtgcgaggttttgatccctgcgttgaaaactattatcgataaatccagcgagaacggggtcgactatgttattatgggtatgccgcacagaggcaggttgaacgtcctcgcgaatgttatccgaaaagagctagagcagatattttgtcagttcgattcaaaactggaagccgctgatgagggctcaggagacgtgaaatatcacctcgggatgtatcataggagaataaaccgggtaactgacaggaacatcacgttgtccctggtggctaacccaagccacctagaagccgcagaccctgtcgttatgggcaagaccaaagccgagcagttttactgtggagacactgagggcaagaaagtgcgccctagggaaaggagagccaggcagattgttaaggccccatgctcgagcatggaattccggtctcctacctag

SEQ ID NO: 233745 - DNA, 2925 bp, Artificial Sequence
  Description of Artificial Sequence: Synthetic coding sequence
atgtactgtgcttggctcgaaaatcctaaaagtgtgcataagagctgggatatcttttttagaaacactaacgccggtgcgccacctggcaccgcatatcaatcccccctgcctctgagcaggggttctcttgcagcagtggcacacgcccagagtttggtggaggctcagccaaatgtggacaaattagtcgaagatcacctcgccgttcagtcactgattcgcgcataccaggtacgaggccaccacattgcaaagttggaccctctgggcatctcctgcgtgaattttgacgacgcccctgtgacagtgagcagcaacgtagatctggcagtctttaaagagcggttacgtatgttgaccgtcggaggcttttatggtcttgatgagtctgacctggacaaagtgttccaccttccgacaaccacttttatcggcggacaggagtcggctttaccgctccgcgagattattagacggctggagatggcatattgccagcatatcggcgtggaattcatgtttatcaatgacctggagcagtgtcagtggatccgccagaagttcgaaactccgggtattatgcagttcacaaatgaagagaagagaactctgctggccaggctcgtgaggtcgacgcgctttgaggagtttttgcagcggaaatggtcatccgaaaagcgctttggccttgaaggatgtgaggtcctgatcccagcccttaaaacaatcatagataagtcatccgagaatggtgtggactatgtgattatgggtatgccccatcggggtcgtctcaacgtccttgccaacgtcattcggaaggagctggaacagatcttctgccaattcgactccaaactggaagcagccgacgaaggttccggggatgtcaaataccacctggggatgtaccaccgcagaatcaatagggtgacggataggaacatcactttaagtctggtggccaatccgtcccacctcgaggccgctgatccagttgtgatgggaaaaacaaaagccgagcagttttattgcggggataccgaagggaaaaaagtgatgtctatcctgttgcacggggatgccgcattcgccggtcagggcatcgtctacgagacttttcatttgtctgatttaccatcatatacaacacatggcactgtacacgtcgttgtgaataatcagattggattcaccacagacccgagaatggccaggtcctcaccctaccccactgatgtcgccagggtggtgaacgcgcctatattccacgtaaactcggacgatcctgaggccgtgatgtatgtgtgtaaagttgccgctgagtggagatcaaccttccataaggacgtcgtcgtcgacctggtgtgctacaggcggaacggccacaacgagatggacgagcccatgtttacccagcccttgatgtacaaacaaatccgtaagcagaagcctgttctacagaagtacgcagaacttctggtctcccagggggtggtgaatcagcctgagtacgaagaggaaattagcaagtatgataaaatctgtgaagaggcctttgcccgtagcaaggacgaaaaaattctccacattaaacactggctggacagcccctggccgggtttcttcacactcgacggccaacccaggtccatgagttgtccctccacagggctgacagaggacattttgacccatattgggaatgtggcttctagcgtgcctgtggagaactttaccattcatggcggactcagcagaattcttaagacacgaggcgagatggtaaagaataggacagttgactgggctctcgcggaatacatggcttttggatcgttgcttaaggagggcattcatatccggctgtctggacaggatgtggagagggggacattttcacaccgacatcacgtgctgcatgaccagaatgtagacaagcgtacatgtatacccatgaaccacctgtggccaaatcaggctccttacaccgtgtgcaatagttcactcagcgagtatggagtcctaggcttcgaactcgggttcgcaatggcaagccctaacgcactggtcctttgggaggcacagttcggtgacttccacaatacagcccaatgtataatagaccagtttatctgccccggacaagctaagtgggtaagacagaacgggatcgtgttactgttgccacacggaatggaggggatgggcccagagcatagctcagcacggcctgagcgttttctccagatgtgcaacgacgatccagacgtgttgcctgacttgaaggaggccaatttcgatatcaatcagttgtacgactgcaactgggtcgttgtcaattgcagcacccctggtaacttcttccacgttctccggcgacagatcctgctccctttcagaaaacccctgatcatctttacccctaaatctcttttaagacatccggaggctcgctcttccttcgatgaaatgctgcccggaacccatttccagcgcgtgattccagaagacggcccagccgctcagaaccccgaaaatgttaagcgcctactgttttgcaccgggaaggtgtattacgacctgactagggaacgtaaggcaagggacatggtgggacaagtggcaataacaaggatcgagcaactgagcccgttccctttcgatctgctcctgaaggaggtacagaagtatcctaacgccgagctcgcttggtgtcaggaggaacataaaaaccaagggtactacgattacgtgaagcctcgcctgagaaccactatctcacgcgctaaacctgtgtggtacgcgggtagagaccctgccgcagcccctgctaccgggaacaagaagactcacctgaccgaattgcagcgtctcctcgacactgcttttgatctggatgtattcaaaaacttttcttag

SEQ ID NO: 233746 - DNA, 3060 bp, Artificial Sequence
  Description of Artificial Sequence: Synthetic coding sequence
atgtttcacctaagaacctgtgcggcaaaactccgaccactaacagccagccagacagtcaaaacattcagtcagaaccgaccagctgctgcccgaacattccagcagatcagatgctactcagctcccgtggctgcagagccattcctctctggcacctcgtctaactatgtggaagaaatgtattgtgcctggttggaaaatccaaagagcgtccataaaagctgggatatcttttttcgtaacacaaacgccggagcccctccgggaaccgcttaccagtctccgcttccactttccagggggagccttgcagctgttgctcatgctcaaagcctggtcgaggcccagcccaacgtagataagctggtcgaagaccacttagccgtgcagagcttgattcgtgcctatcaggtacgtggtcaccacattgccaagctggatccccttgggatttcttgcgtgaactttgacgacgctcctgtgactgtgtcaagcaacgtcggtttctatgggctggacgaatctgacctggataaggttttccacctgcctaccacgacatttataggcggtcaggagtctgccctgccattgagggagatcattagacgcctggaaatggcgtattgtcagcacattggcgtggaattcatgttcatcaacgacctggagcagtgtcaatggattcgtcagaaatttgagacaccaggtattatgcagttcactaacgaggagaaacgcaccctcctcgcaaggctggttaggtccacaagatttgaggagttcctccagcgcaaatggtcatccgaaaagcgcttcggactcgaaggatgtgaagtcctaattccagctctgaaaaccatcattgataagtcttccgagaacggcgtcgattatgtcattatgggaatgccccaccgtgggaggctgaatgtactggccaacgtcatcaggaaggaactggaacagatcttctgccagttcgacagcaagttagaagccgctgacgaaggaagcggagacgtgaagtatcacctcgggatgtatcatagacgcatcaacagagtcacagaccgcaacatcaccctgtcactggttgctaatccctcccatctggaagctgcggacccagtggtgatgggaaagactaaggccgagcaattttattgcggcgataccgagggcaaaaaggtgatgtctattcttctgcacggcgatgccgcatttgctggacagggcatagtgtatgagactttccacttatccgatctcccttcctataccacacacggtaccgtgcacgtggtggttaacaaccaaattgggtttaccacagatcctcgaatggccaggagttcgccctacccaactgacgtcgcacgcgtcgtcaacgcccctatcttccacgttaactcagatgacccggaggcggttatgtacgtgtgtaaagtggccgctgagtggagaagcacctttcacaaagatgtcgtggtcgacctggtgtgctacagacgtaacgggcataacgagatggacgaaccaatgttcacacagccactcatgtataaacagatcagaaagcagaagcctgttctacagaaatatgcagagctgctggtatcccagggggttgttaatcagcccgaatacgaggaagaaatcagcaaatatgacaaaatctgtgaagaagcattcgcaaggtcaaaagatgaaaagattctgcacatcaagcactggctcgattctccatggcctggcttcttcacactcgacgggcagccacggagcatgtcctgcccaagtaccggtctgactgaggatatcctcactcatattggaaacgtggccagctccgtgcccgtagaaaatttcaccatccacggcggtctatctcggatcctgaagacacggggtgagatggtgaaaaatcgcaccgtggattgggcgttggccgaatacatggcctttggctcactactcaaggaaggaatccatataagactatctggtcaggatgtggagagaggtacgttctcccacaggcaccatgtgctgcatgaccaaaatgtggataaacggacttgtattccgatgaatcatctctggcctaaccaggctccttacaccgtttgcaatagtagcctgagtgagtatggcgttttgggtttcgaactgggatttgctatggccagtcccaacgctctcgtcctctgggaagctcagttcggtgacttccataacaccgcccagtgcatcatagaccaatttatctgtcctggacaggccaagtgggtaaggcaaaacggaatcgtgttactcttaccgcatggcatggaggggatgggcccagaacacagctccgccagaccagagcgatttttgcagatgtgcaacgacgatccagacgtgctgcctgacctgaaggaggcgaatttcgatatcaatcagctctacgactgcaactgggtggtggtaaactgcagtaccccgggaaatttcttccatgttctccggcgacagattcttctgccttttcgaaagccgttgataatctttactccaaagtctctcttgaggcaccccgaggcccgtagtagcttcgacgaaatgctgcccggaacacactttcagcgggtcataccagaagacgggccagctgcgcagaaccctgaaaatgtgaagaggttgcttttttgcactgggaaggtctattacgatttgacaagagaacgaaaggcccgagatatggtgggacaggtcgccattacgcgcatcgagcagctctccccattccctttcgatcttcttctgaaggaagttcagaaatatccaaatgcggaactcgcctggtgtcaggaggaacacaagaatcaaggctactatgattacgtgaagcctcggctgcggactacaataagccgcgctaagcccgtgtggtatgcgggtcgagaccccgcagctgctccagctaccggtaacaagaagacgcacctgaccgagttgcagcgcttgttggatacggcgttcgatttggatgtgttcaaaaactttagctag

SEQ ID NO: 233747 - DNA, 2424 bp, Artificial Sequence
  Description of Artificial Sequence: Synthetic coding sequence
atggctgcaactgaactcaggggcgtcgttggacctggcccagctgccattgcggcattaggaggcggaggggctggccctccggtggtgggtggagggggaggcaggggagatgcgggaccgggatctggcgctgcaagtggaacggttgtcgcagccgctgctggcggacccggaccaggggctggcggtgtggccgctgcagggccagcacccgctcccccaaccgggggaagtgggggaagtggtgccggaggttctgggagcgcaagggaagggtggctattcaaatggacgaactacattaagggctatcagaggagatggttcgtactcagcaatggtcttctgagctattacaggtccaaggcagagatgcgacacacatgccggggtaccatcaatctcgccacagctaacattaccgtggaagacagctgtaactttattattagcaacggcggtgctcagacatatcacctcaaggccagttccgaggtggagcgccagagatgggtcacagcgttggagcttgcgaaggccaaagccgtaaagatgctggccgagagtgatgagtctggggacgaagagtctgtctcacagactgacaaaaccgagctgcagaacaccctcagaactctcagtagcaaagtggaagatctaagcacttgtaatgatttgattgctaaacacgggaccgccttgcagcgctccctcagtgaactggagtctcttaagctcccggctgaaagcaatgagaaaattaaacaggtgaatgagcgggctaccctattcagaataacaagtaatgcaatgatcaacgcgtgccgggactttctcatgctggctcagactcatagcaaaaagtggcagaagtcactgcaatacgagagagaccagaggattcggttggaggaaactctagagcagctcgcgaagcagcacaatcatttagagagggcttttcgaggtgcaactgttctgcctgccaacactcctggaaacgttggctccggcaaggatcaatgctgtagcggtaaaggcgacatgtcagacgaagacgatgaaaacgagttttttgacgcaccggagataataacgatgccggagaacctaggtcacaaacggactggatccaatatcagtggagctagctccgatatatcgctggatgaacagtacaagcaccagctggaggaaaccaagaaggagaaacgcacacggatcccgtataaacccaattactccctgaatctgtggtctatcatgaaaaattgcatcggcaaggagctgagtaagatacctatgcccgtcaatttcaatgagccactatccatgctgcagcgactgacggaggatttggaataccacgaactcctggaccgagccgctaaatgcgaaaatagcttagagcagttatgctacgtggccgcttttacagtgagtagctactcgaccactgtgttccgcacatctaaacctttcaatccactgctgggagaaacctttgaattggatcggctggaggaaaacggttaccgaagcctgtgcgaacaggtctctcatcacccaccggctgccgcacaccacgccgaatccaagaacggctggaccctcagacaggaaatcaaaattacaagcaaatttagaggcaaatatctgagcatcatgccactgggcaccatccactgtatttttcacgccacaggacaccactacacctggaagaaagtaactaccactgtgcataatatcatcgttggcaagctgtggatagaccagagcggggaaatagatatcgtcaaccacaagacgggcgacaaatgtaacctgaagtttgtaccgtactcgtacttctctcgagacgttgctagaaaggtgactggagaggtgactgatcccagcggcaaggtgcactttgctctgcttggcacatgggatgaaaaaatggaatgcttcaaagtgcaacccgtgattggcgagaatgggggagatgcacggcagagagggcatgaagctgaagagagcagggtgatgctgtggaaaaggaatcccttacctaaaaatgcagagaacatgtattacttctctgagctcgccctgacgcttaatgcatgggaaagtggtacagcccctacggattcaaggctcagacctgaccagaggctcatggaaaatggccgatgggatgaggctaatgcagaaaagcagaggctggaggagaaacagaggctttcccgcaagaagcgggaggcggaggccatgaaggcaaccgaggatggtacaccgtacgatccctataaagcgctttggttcgagcgaaagaaggacccagtcacaaaagagcttactcacatttaccgcggagagtattgggagtgtaaggaaaaacaagattggtcctcctgtccagacatattctag

SEQ ID NO: 233748 - DNA, 1224 bp, Artificial Sequence
  Description of Artificial Sequence: Synthetic coding sequence
atggccgcaactgaattgagaggcgtcgtgggtccaggtccagctgctattgccgcactcggaggtggtggagccggacccccagtagtgggaggcggaggcggacgtggggacgcaggtccagggagcggggcagccctgcagcgactgactgaagatctcgagtaccatgagctcctggatagggccgcaaaatgtgagaattccctagaacagctctgctatgtggctgcctttactgtaagttcttattctactactgtgttccggacttcaaagccctttaatccattgcttggcgagacctttgagttggaccggttagaggagaacggatatcgctcactgtgcgaacaggtgtctcatcatccaccagcagctgcacaccatgccgaatcaaaaaatggctggacccttcgtcaggagatcaagattacctcaaagtttcgaggcaaatatctgtcaataatgcccttaggaaccatccactgcatattccatgcgactggtcatcactacacatggaagaaggtcaccacgacagtccataatatcatcgtagggaaactttggattgatcagtcaggtgaaatcgatatcgtgaatcacaaaacgggggacaagtgcaatttgaaatttgtaccttactcttacttctcccgggacgtagctcgcaaagtgaccggtgaggtgaccgatccctcaggtaaggtgcacttcgcactgttagggacttgggacgaaaagatggagtgcttcaaagttcagcccgtgattggcgaaaatggcggtgacgcaagacagcgtggccatgaagcagaggaatcaagagtgatgttatggaagcgaaatcctctgcctaaaaatgcagagaatatgtactacttctccgagctggctctcactttgaatgcctgggagtctggtaccgcaccaactgactcaaggctgcgccctgaccagcgcctgatggaaaacggacgttgggatgaggccaacgccgagaagcagcggctagaagaaaaacagcggctatcgcggaaaaagagagaggcagaggccatgaaggccacagaagacggaacgccctacgacccatacaaggcactgtggttcgagcgcaagaaagacccagtgactaaagagctgacccatatttataggggcgaatactgggaatgcaaagagaaacaggattggagttcttgcccagatattttctag

SEQ ID NO: 233749 - DNA, 2751 bp, Artificial Sequence
  Description of Artificial Sequence: Synthetic coding sequence
atgggtaaagccgctgcaccctcaagaggtgggggatgtgggggtagaagtaggggccttagcagtctctttactgtggtcccctgtctgtcatgccataccgctgccccaggtatgagcgcctcaacgagcggcagcggtccagaacctaaaccgcagccccagcccgtaccggagcctgaacgcggtcccttgtctgagcaagtatcggaggccgtgtccgaggctgtaccacggagtgagcctgtgtcagagacgacttcagaaccagaacccggagctggtcagccttcagagctcttacaagggtcacgccctggaagcgaatcctcaagcggagttggtgccggaccattcaccaaagccgcatccgagcccctcagtcgcgctgtgggcagcgctacctttctgagaccagaaagcggctccctccccgcacttaaaccactgcctctactgagaccaggccaggccaaaacacccttaggagtgccaatgagcggtaccggaaccacgtcctccgcaccactggcccttcttccactcgattctttcgaaggatggctcctgaagtggacaaactacttaaagggctatcagaggcggtggttcgtgctgggaaacggtttgctgagttattataggaaccagggcgaaatggcacacacatgtagaggaacaattaatctgtcgaccgcccatattgataccgaggatagctgcgggattctgctcacatccggagccagatcctaccatctcaaggcatcctcagaggttgacagacagcagtggattaccgctttggaacttgcgaaggccaaagcggtccgagtgatgaatacccatagtgacgattctggggacgatgacgaggccacgacaccggcagataagtccgaactccatcatacactgaagaacctctcactgaagctggacgacttgtccacctgcaacgatcttattgccaagcatggggctgcattgcagcgctcactgacagagctggacggactcaaaatcccaagcgaaagcggtgagaaattgaaggttgtgaacgagcgcgctacgctgtttcggatcacaagcaacgctatgattaatgcttgtagggatttcctcgagctggccgagatccactcccgaaaatggcaacgtgctttgcagtacgagcaggaacagagagttcacttggaggaaaccatcgaacagcttgccaagcagcataattcacttgaacgagctttccattcggccccaggacgccctgccaacccaagcaaaagcttcattgaaggttcattgttaactccaaagggagaggattccgaggaagatgaagacactgagtactttgacgccatggaagacagtacttctttcattaccgtcattacagaggctaaagaggactcccggaaggcggaagggtctacggggacatccagcgtggactggtcaagtgcagacaacgtgttggatggtgcatctctggtccctaaagggagctccaaggttaagagacgagtgcggatccctaacaaaccaaattactcactaaatctttggagcataatgaagaattgtataggaagggagctgtctagaatccctatgcccgtaaactttaatgaacctctctcaatgcttcaaaggttaacggaagatctggagtatcatcatttgctggataaagcagtgcactgcacgtctagcgtggagcaaatgtgcctagtggcagcattctccgttagttcctattctacaacggttcaccgcatcgccaaaccttttaaccccatgctaggcgaaacttttgaattagacagactggatgatatgggtctgcgaagtctatgcgaacaagttagtcaccacccaccgtcagccgcacattatgtgttcagcaagcacggatggagcttgtggcaggaaataactattagcagcaagtttagaggcaagtatatttctatcatgccattgggcgctatacacctagaatttcaggcctctggaaaccactatgtgtggcggaagtctacgagcacagtccacaatattattgtgggaaagctctggattgatcaatccggtgatatcgagattgtaaaccataagactaacgaccgatgtcagctgaaattcttaccatattcgtatttttccaaggaagcggctcgcaaagtcacaggcgtggtttctgactcacagggcaaagcccactacgtcctgtcgggctcttgggatgaacagatggaatgttctaaagtgatgcattcaagtccctctagtccttctagcgatgggaaacaaaaaaccgtttaccagacattaagcgcaaaactcctgtggaagaaatacccactgcctgaaaacgccgagaacatgtattatttttccgagctagctctgactctgaacgagcatgaggaaggagtcgcccctaccgatagcaggctacggcctgatcagagattgatggagaagggtcggtgggacgaggccaacactgagaagcagagacttgaagagaagcaacggctgagcaggagacgcaggctagaagcttgtggcccaggctctagctgttcatcagaagaagagaaagaggctgacgcgtatactcctttgtggtttgagaaacggttggaccctttaaccggcgagatggcttgtgtgtataaggggggttattgggaggcaaaagaaaagcaggactggcacatgtgcccaaatatcttctag

SEQ ID NO: 233750 - DNA, 2625 bp, Artificial Sequence
  Description of Artificial Sequence: Synthetic coding sequence
atgggaaaggccgcagctccttctcggggtggcggatgtggtgggaggtcaagaggcctgtccagcttgttcacagtggtcccatgcttatcttgtcacacagctgcacctggaatgagcgcctcaacttccggcagtggaccagagccaaagccgcaaccccagccagtgccagagccagaaaggggtccactaagcgagcaggtctcagaagctgtcagcgaggccgtcccccgatctgaacctgtatcagaaaccacctccgagccggaacctggggctggacagccttctgaattgctgcagggatctcgacctggcagcgaaagcagcagcggggtcggcgctggcccatttacaaaagctgctagcgaaccattgagcagagccgtgggctccgctaccttcctgcggccagagtcgggaagtttaccggctctgaagccgctgccactgcttaggccaggccaagcaaagacgccattaggggtgcccatgtcgggaaccgggacgacctcaagtgccccactggctctcctgccactggacagtttcgagggatggttgctcaaatggaccaactacctcaagggctatcagagacgttggtttgtgctcggtaacggtctcctaagctactatcggaaccagggggaaatggctcacacctgtcgcggaaccattaatctctctacagcccatattgacaccgaggattcctgcgggatacttctcaccagcggcgctaggtcctaccatctgaaagcaagctctgaggtcgaccgccagcagtggatcaccgctctggaattggctaaggctaaggcagtcagagtgatgaatacacatagcgatgactccggggacgatgacgaggcaactactcccgctgacaagagtgaactgcaccacacacttaagaatctatcactgaagttggacgacttgtctacctgtaatgatctaatcgctaaacatggagccgctctgcagaggtccctgaccgagctagatggtctcaaaatacccagcgaatccggagaaaaactgaaggtcgttaacgagagagctaccctctttagaataacgtcgaatgcaatgatcaacgcctgcagagacttcctggagctggctgagatccactctcggaagtggcagcgggctttgcagtacgagcaggagcaaagggtccatctggaggaaacaattgaacagctggccaaacagcataattcacttgagcgggcttttcacagtgcccctgggcgtccagctaacccctccaagtcatttattgaaggttctttactcacccccaagggagaggatagcgaggaggacgaggatactgaatacttcgatgcgatggaggattctacctctttcatcactgttattactgaggcaaaagaagattcccggaaagctgaaggctccaccggtacctccagtgtcgactggagtagcgcagacaacgtgaacttcaatgaacccctcagtatgctccagcggctcaccgaggacttagagtaccaccaccttctcgacaaagccgtccactgcacatcctctgtcgagcagatgtgcctcgtagccgctttttcggtgtcctcttattctaccactgtccatcgtatagccaagcccttcaatcctatgctaggcgagacttttgaattggaccgcctggacgacatgggactccgttctctgtgtgagcaggttagccaccacccgccaagcgcagcacactatgtgttctctaaacacggctggtccctgtggcaggaaattactattagcagcaaattccgtggcaagtatatctcaataatgccgctgggcgctatacatttggaattccaggcctctggtaaccattacgtgtggcggaagtcaacgagcaccgtgcacaatatcattgttggaaaactctggatcgaccagagcggtgacattgagatcgtgaatcacaaaacgaacgatagatgtcagcttaaattccttccatactcctacttttccaaggaagcagctcgaaaggtgaccggagtagtgtccgatagtcagggcaaggcacattatgtattgtccggtagctgggacgaacagatggagtgcagcaaagtcatgcacagtagtccaagcagtccctcttccgatggcaaacagaagaccgtgtatcagaccctctccgcgaaactcctatggaaaaagtatcccctccccgagaacgccgaaaatatgtactactttagtgagcttgctctgactcttaacgaacacgaggaaggggtagccccaaccgactccagattacggcctgatcaaaggttgatggagaagggcagatgggacgaagctaacacagaaaagcaaagactggaggagaagcagcgactgagccggaggcggaggcttgaggcctgcgggcctggtagcagctgcagctccgaagaaggagaagccggtcgggaaggtcgccctggaggagaagaacggggagctcgagtgggcgtcccacaggggagaatcccaggcgagcaggccaccagcccacctaccagcccgctgtgcctaccgagtcgtgagggtggagggtgcctccacgcaaccgtggtgtag

SEQ ID NO: 233751 - DNA, 2253 bp, Artificial Sequence
  Description of Artificial Sequence: Synthetic coding sequence
atgcatcggcagcggactcgaaccatgtcaagcctggctgcaaaacgtttaggcatgaacaggcgccctgcgggttcagggggaggaggaggcgaggctgccacgtggggacatcgattttggagacctcaggaacgcccaaccgacaggaaccagggggaaatggcacacacctgccgcggaactataaatctgtcaaccgcccacatcgatacggaagattcatgtgggatattgctgaccagtggagccagatcctaccacctaaaggccagtagcgaggtcgatagacagcaatggatcacagcactcgagctggctaaggctaaagccgtgagggtgatgaacactcacagcgatgattccggagatgatgatgaggccaccacgcccgctgacaaatccgaattgcaccataccctcaagaatctgtctctgaaactagacgacctgtccacctgcaacgatttaatcgccaagcacggagctgcgctgcagcggagcctcactgaattggacggcctcaagatcccaagcgagagcggcgagaagctcaaagtcgtaaatgagagggctactctgtttaggattacctccaatgctatgatcaatgcctgtagggattttctggaattggccgagatccactctcggaagtggcagcgggctctgcagtatgagcaagagcagcgcgtgcatcttgaggagaccatcgagcaactcgccaagcaacataactcgctggaaagggcattccattcggcccctggaagaccagccaacccttcaaaaagttttatcgaaggatcactccttaccccaaagggcgaagacagtgaagaagatgaagacacagaatactttgacgccatggaagactctaccagttttattactgtgattacggaagccaaggaagataggaaagccgaagggagcaccggcaccagctctgtggactggtcatcagctgacaacgtgctcgacggcgcttcactggtgccaaagggatccagtaaagtgaaacgtagagtgcggatcccaaataagccaaattatagcctgaatctttggtcgattatgaaaaactgcatcggacgcgaactatcgagaattccgatgcctgtcaatttcaacgaacccctgtccatgctgcaaaggttgaccgaggacctggagtaccatcatctcttagacaaggccgtgcattgtacatcaagtgtcgaacagatgtgtctggtagcagcattttccgtctcgtcctacagtacaacagtgcatcgaatcgctaagccctttaaccccatgttgggcgagactttcgagctggaccgactcgacgatatgggactgcgctcactttgtgaacaggttagccaccatccaccttccgctgctcactatgtgttcagcaagcatgggtggtctctgtggcaggagatcaccatttcgtctaaattccgcggaaaatacatctctattatgcctctcggcgcaatccacttagagtttcaggcatccggcaaccactatgtttggcgcaagtccacttcaaccgtacataacatcattgtgggcaagctgtggatagatcagtctggcgatatagagattgtaaatcacaagaccaacgatcggtgccagctcaagttcctgccttactcatacttctcaaaagaagccgcaagaaaagttactggggtggtcagcgactctcagggaaaggcacattacgtgctcagcgggtcatgggatgagcagatggagtgctcgaaagtaatgcactcgtctccctcttccccctcttcagatgggaagcagaagacagtctatcaaaccctgtccgccaagttactgtggaaaaagtacccactcccggaaaacgctgaaaacatgtattacttctcagagctggctttaactctgaatgaacacgaagagggtgtcgctcctactgactcccggctgcgccctgaccagcggctgatggagaaggggcgatgggacgaagccaacactgagaaacagcgcctggaagaaaaacaacgactctccagaaggagacgcctggaggcttgtggcccaggtagcagctgctcgtccgaggaggagaaagaggcggatgcctacacccctctctggttcgagaagcggttagatccgctgactggggagatggcatgtgtttataaagggggttactgggaggcaaaggagaagcaggattggcacatgtgtccgaatatcttctag

SEQ ID NO: 233752 - DNA, 1980 bp, Artificial Sequence
  Description of Artificial Sequence: Synthetic coding sequence
atgaaggggaggggctgttgggataccgcttccgtgcgctctttctgttcatccggttgtttgaacaagtttaagaaagatgattcaggggatgatgacgaagccactacacccgcagataaaagtgaacttcaccacaccctgaagaacttgagcttaaaattagacgacctcagcacgtgtaacgatttgatcgctaaacatggagcagccctgcagcggagcctcacagagctggatggccttaagatcccatccgagagcggggagaaactgaaggtggttaatgagagggctacgttattccgaatcacatctaacgccatgatcaatgcctgccgagatttcctcgaacttgccgaaatccacagccggaagtggcagagagccctgcagtacgaacaggagcagcgggtgcatcttgaggagacgattgaacagctcgccaagcagcataactcccttgagagggccttccattccgccccagggaggccagccaatccgtcgaagtcttttatcgagggctctcttctgactcctaaaggggaggacagtgaagaggacgaggatacagaatatttcgatgcaatggaagattcaacatcctttatcaccgtcattacagaagctaaagaggacagcaggaaagccgagggatcaacaggcactagctcagttgactggagtagcgcagataacgtccttgatggagcatcattagtacccaagggtagctcaaaagtgaaacgccgagtgcggattccgaataagcccaattacagtctcaatttatggtcaatcatgaaaaattgcattggccgtgaactctccaggatccccatgcccgttaactttaacgaacccctgagtatgctgcaaaggctcaccgaggacctggaataccaccatctcctggacaaagcggttcattgtaccagcagcgtcgagcagatgtgtctcgtcgccgcatttagtgtgtcttcttactctactacagtgcataggatagccaaaccttttaaccctatgctaggggaaacatttgagctcgatcgtctggacgacatgggcctcagaagcttgtgcgagcaagtcagtcatcatcctccgtctgccgctcactacgttttttccaagcatggttggagcctgtggcaggagatcacgatctcctccaaattcaggggaaagtatatcagcatcatgcccctaggagcaattcacctggaattccaggcgagtggtaatcactatgtctggaggaaatctactagtacagtgcacaacatcatcgtgggtaagctgtggattgaccagagcggtgatatcgagattgtgaatcacaagactaacgataggtgtcaacttaagttcctaccttactcttatttctcgaaggaggccgcacgaaaagtaaccggagtggtgagtgattctcagggcaaggctcactatgttctctccggctcttgggacgaacagatggaatgttccaaggtcatgcactctagcccatcatccccctcatctgacgggaagcagaaaacagtatatcagacgttgagcgccaagcttctgtggaaaaaatatcctctacccgagaatgcagagaacatgtactatttctctgagctcgccttgaccctaaatgagcatgaagagggagttgcaccaacagactcccggttgcggcctgatcagagactgatggaaaaaggccgatgggacgaggccaataccgaaaaacagaggttagaagaaaagcaaaggctctctaggcgcaggagattagaggcctgcggtcctgggagttcatgtagtagcgaagaagccgaaaaggaagccgacgcctatacacccctttggtttgagaagcggttagatcccttaacgggggagatggcttgtgtgtacaaaggtggctattgggaggcaaaggagaagcaggactggcatatgtgtcccaatatattctag

SEQ ID NO: 233753 - DNA, 1383 bp, Artificial Sequence
  Description of Artificial Sequence: Synthetic coding sequence
atggaagactctacctccttcatcactgtcattactgaggccaaagaagatagaaaggcggaaggtagcaccggcaccagctccgtggactggtcctcagctgacaatgtgctcgacggagcctctttggtgcctaagggatccagcaaagtaaaacggagggtcagaatccctaataaacctaattatagtctgaacctgtggtcaattatgaagaactgcataggaagggaattgagccggatcccaatgcccgtcaattttaatgaacctttgagtatgctccaacggctcactgaggatttggagtaccatcacttactggataaggccgtgcactgcacatcttcagtcgagcaaatgtgtttggtggcagcctttagtgtttcttcgtacagtaccacagttcaccgcatagctaagccctttaaccccatgttaggcgagactttcgagttagacaggctcgatgatatgggcctccgcagcttgtgcgagcaagtgagtcaccatccaccgagcgcagcgcattatgtgttctccaagcacgggtggtccctctggcaggaaatcactatctcctccaaattcaggggcaagtacataagtattatgcccctcggggctattcacctggaatttcaggcgtcgggtaaccattacgtgtggcgcaaaagcaccagtaccgtccacaacatcatagtaggtaagctgtggattgaccaatccggtgatatcgagatcgttaaccacaagacaaatgacagatgccagttaaaattcttgccttacagctacttctcaaaagaggctgctcgcaaggtgactggcgttgtgtctgacagccaggggaaggcccattacgttttgtcaggatcttgggacgaacagatggaatgctcaaaagtgatgcatagcagcccaagctcgccttccagtgacgggaagcagaagacagtatatcagactcttagcgctaaactgctttggaaaaagtatcctctaccagaaaacgcagaaaacatgtattacttttccgaactcgccctgacgttaaatgagcacgaagagggcgttgctccaaccgactctcggctgagacccgatcagaggctaatggagaagggcagatgggatgaggctaatactgaaaaacagcgcttggaagagaagcagcggttgtccaggaggcggaggctcgaagcctgcggccctggcagtagctgttccagtgaggaggaaaaagaagctgatgcgtatacccccctatggttcgagaagagactcgacccattaactggggaaatggcctgcgtctacaaaggcggttactgggaggccaaggagaaacaagactggcacatgtgccccaatatcttctag

SEQ ID NO: 233754 - DNA, 2295 bp, Artificial Sequence
  Description of Artificial Sequence: Synthetic coding sequence
atggaacgggcagttcagggcacggatggcggaggagggtcgaactcatccagccgaagcagtagtagagccacttcagcgggttccagtccatcatgttcattggccggacgcggagtgtcatctcggtccgcggctgctggcctggggggagggggaagtcgatccagcccaggctcagtcgcagcctcaccatccgggggtggaggtcgcaggcgtgaacctgcgctagagggagtgctgagcaaatacaccaacttactccaaggctggcagaaccggtacttcgtcctggactttgaagccggaattctgcaatattttgtcaacgaacaatccaagcaccagaaaccccgaggagtgttaagtttgagcggggcaattgtgtcactatcggatgaagctccgcacatgttagttgtatattctgcaaacggtgaaatgttcaagctacgagccgctgatgccaaagaaaagcagttttgggttacgcagttgagggcatgcgcgaaataccacatggaaatgaattccaagtccgcgccaagttctcggagccggagtctgacacttctgccacacggcacccccaacagcgcatccccctgcagccagagacacctctccgtaggagcccctggggtagtgactataacacatcacaagtctcccgctgctgccaggcgtgcgaaaagccagtatagtggtcagctacacgaagtcagagaaatgatgaaccaggtggaaggccagcaaaagaacctggtccatgcaattgagagcttgccaggatcagggccactgaccgctcttgaccaagacctgctcctgctgaaagcgaccagtgcagccacattgagctgtctcggcgaatgtctgaatttactgcagcagagcgtgcaccaggctggacagccatcacagaaacctggagctagtgagaatatcttaggatggcatggctcaaagtcccactccactgaacagcttaagaacgggactctggggagtttgcccagtgccagtgccaatatcacgtgggcaatactgcccaacagcgctgaagacgaacaaacatctcagcccgagcctgaaccaaattcaggcagcgagctagtgcttagcgaagacgaaaaaagcgacaacgaagataaggaggaaaccgaattgggggtgatggaggatcagcgctccattatcctgcatcttatctcacagctgaaacttggcatggatctgaccaaggttgttttgccaacattcatcctggaaaaaagatctttgctggagatgtacgctgacttcatggcccaccctgatctcctgctggctatcacagccggagccactcctgaggagagggtgatctgtttcgttgagtactatcttactgcttttcacgaagggagaaagggggctttagccaagaagccgtacaatccgatcatcggcgagacgttccactgctcatgggaggtgccaaaggatcgggttaagcccaaaagaacagccagtcgaagcccagcttcttgccatgagcatcctatggcggatgaccccagcaaaagttacaagttgagattcgtggcggagcaggtgtcccatcatcccccaattagttgtttctactgcgagtgtgaggagaagaggctttgtgtgaatactcacgtctggaccaaatcaaagttcatgggcatgagtgttggggtgagcatgattggtgagggcgtgctgaggctccttgagcacggcgaagaatacgtgtttaccctgccctcggcttacgccagaagcatacttaccatcccttgggtggagttgggaggaaaagtgtccatcaattgtgcaaaaacaggctattcagctactgtgatctttcatacgaagccattctatggcggaaaggtgcaccgagtcactgctgaggtgaagcacaatcctacgaataccatcgtgtgcaaggcccacggtgaatggaacggtacacttgaattcacctataacaatggggaaactaaggtaatcgacaccaccactctgcctgtgtatccgaaaaagattagacctctcgaaaagcaaggacccatggaatcaaggaatctttggcgggaggtgacgcggtatctgaggctgggtgatattgatgctgccacagaacagaaacggcatcttgaggaaaagcaacgcgtggaggaacgcaagcgcgagaatcttcggaccccctggaagcctaagtactttatccaggaaggagacggctgggtctatttcaatcccctgtggaaagctcattag

SEQ ID NO: 233755 - DNA, 2103 bp, Artificial Sequence
  Description of Artificial Sequence: Synthetic coding sequence
atggaacgggcagttcagggcacggatggtggcggagggtcaaactccagcagccgcagttcctcacgggcaacgagtgctggctctagccccagttgctctctggccggaagaggcgttagctcacgctccgccgcagctggattgggtgggggaggaagtcgctcatctcctggttctgtggccgcatcgcctagtggcggtgggggacggcgtcgcgagcccgctctggaaggtgtcttgagtaagtacaccaacctcttacaggggtggcagaaccgatattttgtcttggacttcgaggcaggaatcctgcagtactttgtgaacgagcaatctaaacaccagaagcctcgaggtgtgctcagcctgtccggcgctatagtgtcgctatcagacgaggcaccccatatgctcgtggtctattctgccaatggtgagatgttcaaactacgcgcagctgacgcaaaggagaaacagttttgggtcacacagctcagggcctgtgccaagtaccacatggaaatgaacagcaagatgatgaatcaggtcgagggccagcagaaaaacttggtacatgccattgaaagtttaccaggaagcggccctctgacagcgctggatcaagacttgctgctcctgaaggctacaagtgccgctactcttagctgcctgggagagtgccttaaccttctccagcaatcagtgcaccaggcaggacagcccagtcagaagccaggggcttcagagaacatccttgggtggcacggcagcaagtctcatagcactgagcagctgaaaaatggcaccctgggttccctaccatccgccagcgctaatatcacgtgggcaattctgcccaactccgctgaagatgaacaaacctcgcagcccgaaccggagcctaacagcgggagtgaactggttttgagtgaagatgagaagtccgacaacgaggataaggaagagaccgagctgggggtaatggaagaccagcggagcatcatacttcatcttatatctcagctaaagcttggaatggacctgacaaaggtggtgttaccaaccttcattctggagaagaggagcctgttagagatgtacgccgatttcatggcccacccagacctgctgctggccatcaccgcgggagccactcccgaggagagggtaatctgctttgttgagtactacctgaccgcattccacgagggcaggaagggagctctggccaagaaaccttataacccaatcatcggagagacattccactgttcttgggaggtccccaaggatcgcgttaagcctaagcgtaccgcgtccagatcaccggcatcatgccacgagcaccctatggctgacgacccctcaaagagctacaagctgcgattcgtcgccgaacaagtatcgcatcaccccccaatctcatgcttttattgtgaatgcgaggagaaacgtctgtgtgtgaatacccatgtctggacaaagagtaaatttatgggcatgtccgtgggggtctctatgatcggcgagggagttctcagactgctggaacatggcgaggagtacgtctttacactcccctctgcttacgctcggagtatccttactatcccctgggttgagcttgggggaaaggtttctatcaattgcgcgaaaactggatacagcgccaccgtcatttttcacacaaaacctttctacggtggtaaagtacaccgcgtgaccgccgaggttaagcataatccgaccaacaccattgtatgcaaggctcacggcgaatggaacggaactctggagttcacgtataataatggggaaacaaaagtaatcgacaccaccacattgcccgtataccccaagaaaatccggcctctggagaaacagggcccaatggagtcacggaatctctggcgggaagtgacgcggtacttgcgccttggggacatcgatgctgcaactgagcagaaacggcacttggaggaaaagcaacgggtggaagagcgcaaaagggaaaacttgaggactccatggaaaccgaaatactttattcaggagggggacggttgggtatactttaatcccctctggaaagcacactag

SEQ ID NO: 233756 - DNA, 2244 bp, Artificial Sequence
  Description of Artificial Sequence: Synthetic coding sequence
atgcagggaggggaaccagtgtccaccatgaaggtcagcgagtcagaggggaagctggagggccaagccaccgcggttacccctaataagaacagctcatgcggcggaggcataagctcatctagctcatctcgtgggggaagcgccaagggatggcaatactctgatcatatggagaatgtgtatggctacctgatgaagtatactaatctggttacaggttggcagtaccgcttttttgtccttaacaatgaagctggcctactcgagtatttcgttaacgagcagtcaagaaaccagaagcctcgcggtaccctacaattggccggagccgtcatatcacccagtgatgaggattctcatacgtttacggtcaacgccgcatcaggggagcagtataagctcagagctaccgacgcaaaggaacgacagcattgggtgagcagactgcagatctgtacacagcaccatactgaagctattgggaaaaataacccacccttaaagtcgaggtcattctcacttgcctctagcagcaactctcctatctcccagagaaggcctagccagaatgctattagcttcttcaacgtcgggcatagtaagctccagtcgcttagcaaaagaaccaatttgcctccagaccatctggtcgaagttcgagagatgatgtcgcatgcagaaggacagcagagggatctgattcgaagaatcgagtgcttaccaacatccggacacctttccagccttgaccaagacctgctgatgctgaaagccacatcgatggctacaatgaattgcttgaacgactgtttccacatcctgcagcttcagcacgctagtcaccagaaaggctctctcccttcaggaaccaccatcgaatggctcgagccaaagatctcgctctcaaaccattacaagaacggtgccgaccagcccttcgccactgatcagagcaaacctgttgcagtgcccgaggagcagcctgttgccgaaagcggtttattagccagggaaccagaggagatcaacgccgacgacgaaatcgaggacacctgtgaccacaaggaggatgacctgggcgctgtggaagagcagcgctccgtgatccttcacctgctgtcccagctgaagcttggaatggatcttaccagagtggtgttgcccacctttatcctcgagaaacgaagcctgctcgaaatgtatgctgactttatgagccacccagacctgtttatcgccatcaccaacggcgctactgccgaggatcgaatgattcgttttgtagagtattatctgacatctttccacgaaggtagaaagggggcaatcgccaagaaaccttataatccgatcatcggcgagaccttccattgttcctggaagatgccaaaatccgaagtggcttcttcagtgttctcttcctctagcacccagggggtgactaaccacgctccactgtcgggcgagtccctcacgcaggtgggttctgactgttacacagtgaggtttgttgccgaacaagtcagtcatcatccacccgtaagtgggttctatgctgaatgtacagagcgcaagatgtgcgtgaacgcccacgtctggaccaaatccaaattcttgggaatgtctattggagtgaccatggtaggcgaaggcatcttgagtcttcttgagcatggcgaagaatataccttctctctcccttgtgcctacgcacggtccatcctcacagtgccctgggtagaattgggcggtaaagtcagcgtgaactgcgccaagacaggatattccgctagcatcactttccacaccaagccgttttatggtggcaaactgcaccgagttacagcagaggtcaaacacaacattaccaacaccgtcgtgtgcagagtacagggtgagtggaatagtgtcctggaatttacatatagtaacggtgaaacaaagtacgtcgacctgaccaagctggccgttactaagaagagggtgagacctttagagaaacaagatcctttcgagtctcggcgactgtggaagaatgtaacagactctttgcgcgagagtgaaatcgacaaggccacagaacacaagcatactctagaggagagacagcgcacagaggagaggcacagaaccgagaccggaacaccctggaagaccaaatacttcatcaaagaaggggatggctgggtgtaccataagcctctttggaaaattattcccacaactcagccagcagagtag

SEQ ID NO: 233757 - DNA, 2853 bp, Artificial Sequence
  Description of Artificial Sequence: Synthetic coding sequence
atgaatacagaagccgagcagcagctgctgcatcacgcgaggaacgggaatgcagaagaagtccggcaactcctcgaaacaatggcgcgtaatgaagtgatcgccgatattaactgtaaagggaggtcaaaaagcaatcttgggtggactccactgcacttagcttgctatttcgggcatagacaggtggtccaggatcttctgaaggcaggcgcagaggtcaacgtgttaaacgacatgggcgatactccattacatcgcgctgctttcacaggcagaaaagagctagtcatgctgctgcttgaatacaatgctgacacaacgatcgtgaatggttcgggccagacagccaaggaggttacccacgccgaggaaatcagatcaatgctggaggctgtcgagcggacacagcagaggaagctagaggaacttctgctggccgctgctagagagggcaagaccaccgaactgactgccctcctgaacaggcccaaccccccagatgtcaactgttccgatcaactagggaatacgccgcttcactgcgccgcatatagagctcataagcagtgcgctctgaagttgctgcgatccggcgctgatccgaatctcaagaacaaaaatgatcaaaaacctctggacttggctcagggcgcagaaatgaaacacatcctagtgggcaacaaggtgatctataaggccctcaaaaggtatgagggtcctctgtggaagtcttcacgcttctttggctggagactgttttgggtggtcctggagcatggcgtgctgagctggtaccggaaacagcctgatgcggtccacaacatctataggcagggatgtaagcatctcacgcaggctgtctgcactgtgaagtcaaccgactcctgtctgttcttcataaaatgctttgacgacacaattcatgggtttagggtaccgaaaaacagtcttcagcaatcaagggaggactggctcgaggccatcgaggagcatagcgcctactccacccactactgttcccaggatcagctgaccgacgaggaagaggaggatactgtgagcgcagccgatctgaaaaagtctctggagaaggcccagtcttgccagcagcgattggaccgggagatatctaacttcctcaaaatgatcaaagagtgtgacatggccaaggaaatgctcccaagtttcctgcagaaagtcgaagtagtgtctgaggccagtagagagacgtgtgtggctttgaccgactgcctaaatcttttcacaaagcaagagggggtaagaaatttcaaattagaacaggaacaggagaaaaataagatcctcagcgaggccttagagaccctggcaactgaacatcatgagttggagcagagtctggttaaggggagcccccctgcttcaatcctgtctgaggacgagttttacgatgcccttagtgattctgagagtgagagatcactgtctcgcctggaggccgtcacagcacggagcttcgaggaagaaggggagcatttggggtctaggaagcacagaatgtcagaagagaaagactgcggcggtggggacgctttaagcaatgggatcaagaaacatcgcacttcgttaccgtctcctatgttctcccgcaatgatttcagcatctggtcaatcctcaggaagtgtatcggtatggagctgagcaaaatcacaatgcctgtgatttttaatgaacccctatctttcctccagcggctgactgaatatatggagcacacctacctcatacacaaggcctcttctctctccgatcccgttgagaggatgcagtgtgttgccgcttttgccgtgtccgccgtggctagccagtgggaacggaccggcaaaccatttaatccacttttgggagagacctacgagctggtccgagatgacctcggcttccgactcattagtgagcaagtaagccaccatccacccatctctgcctttcacgcagagggactgaataacgatttcatttttcacggcagcatctatcctaagctcaagttttggggcaaaagcgtcgaggccgaaccgaagggtactattacactggaactcctggaacacaacgaggcatacacttggaccaatcctacctgctgtgtgcataacataatagtgggtaagctctggatcgagcaatacggcaatgtggaaataatcaaccacaagaccggggacaagtgcgtgcttaatttcaagccctgcggcttatttggcaaggagctgcacaaagtcgaagggtacattcaggacaagagcaaaaagaaactttgcgcactctacgggaagtggaccgagtgtctgtactctgtcgaccctgctaccttcgacgcctacaagaagaacgataaaaaaaatacagaggagaaaaagaattctaaacagatgtcgaccagtgaggagttagacgagatgcctgttccggacagtgaaagcgtatttatcatccccggaagcgtactcctgtggcggatagcacctagacccccaaattcagcgcagatgtataattttacttccttcgcaatggtgctgaatgaggttgacaaagatatggaaagcgtcattccaaaaactgactgtcggctgaggcctgatattagggccatggaaaatggtgagatcgatcaagccagtgaggagaaaaagcgactcgaggaaaaacaacgtgccgcacggaagaataggtctaagagcgaggaggactggaaaaccaggtggttccatcaggggccaaatccatacaacggcgcacaggattggatttattccgggtcctattgggacaggaattacttcaacttacctgacatctactag

SEQ ID NO: 233758 - DNA, 1707 bp, Artificial Sequence
  Description of Artificial Sequence: Synthetic coding sequence
atgattaaagagtgcgacatggctaaggaaatgctcccctcctttttgcagaaggtcgaggtcgtctcagaagccagtagggagacgtgcgtggccctcactgattgcctgaacctcttcactaaacaggaaggggtccgtaattttaagctggagcaggaacaggaaaaaaacaaaatactgtctgaggccctggaaaccctggctacagaacaccacgagctcgagcaaagtttggtgaagggcagcccccctgccagcatactcagtgaggacgagttttacgatgccctgagcgatagcgaatccgagcggtcgctgtctagattggaggccgttaccgccaggagtttcgaggaggagggtgagcacctggggtctcgtaagcatagaatgtctgaagagaaagactgcggaggcggtgacgccctcagtaacggcattaaaaaacaccgcacatctctgcctagccccatgttctcacggaatgatttttcaatttggtccatcctccgcaagtgtatcgggatggagctctccaaaattaccatgcccgtcatctttaacgagcctctgtccttcttgcagagattaaccgagtacatggaacacacatacttaattcacaaagcttcgtccctgtccgaccccgtagagcgcatgcaatgtgtcgcagcatttgcagtgtccgccgtcgctagccagtgggagaggacaggcaagccctttaatcccctgctgggggagacttacgaacttgtacgggatgacctgggctttaggctgatctccgagcaggtttctcatcaccctcccatctccgcctttcacgcagaaggtttgaataatgattttattttccatggctccatttacccaaaacttaaattctggggcaagtccgtggaggcagagccaaagggcacaatcacactagaactcctagaacacaatgaagcctatacttggaccaatcccacatgctgtgtgcacaacataatagtggggaagctctggattgaacagtacgggaacgtggaaataatcaaccataaaacgggagacaagtgcgttctgaacttcaagccatgcggattattcggaaaagagctgcacaaagtggaggggtatatccaggacaagtctaagaagaagctatgtgccctgtacggaaaatggactgaatgcttatactccgtggatccagctactttcgacgcctacaagaaaaacgacaagaaaaacactgaagagaagaagaacagtaagcagatgtctacatcagaggagttggacgaaatgccagtgccagattctgagagcgtgttcataattccaggttctgtgctcctctggcggatcgcccctaggcctccgaactccgcgcagatgtacaacttcacaagctttgctatggtgctgaacgaggtggataaggacatggaatccgtgattccgaagaccgactgtaggctccgtccagatatcagagcaatggaaaacggtgagatagatcaggcttccgaggaaaaaaagcggcttgaggaaaagcagagggcagccaggaagaatagaagcaaaagcgaagaggattggaagacccgatggttccaccaagggccaaatccctataacggtgcccaagactggatctactctggtagttattgggaccgcaactacttcaacttacccgacatctattag

SEQ ID NO: 233759 - DNA, 303 bp, Artificial Sequence
  Description of Artificial Sequence: Synthetic coding sequence
atgaacactgaagctgagcagcaactgttacaccacgccaggaacggcaatgcagaagaagtgaggcagctcctggaaacaatggcacggaatgaggttatcgccgacatcaattgcaaaggtaggtcgaagagtaacctggggtggacacccttgcacctcgcgtgctatttcgggcaccgacaggtggtgcaagacttgcttaaagcaggagccgaagttaacgtactgaatgacatgggtgacacccccttacaccgcgcagccttcaccgggaggaaaatttgttcgcaggggtcctag

SEQ ID NO: 233760 - DNA, 1314 bp, Artificial Sequence
  Description of Artificial Sequence: Synthetic coding sequence
atgtcagaagagaaggactgtgggggtggcgatgctctgtccaacggcataaagaagcacagaactagccttcctagccctatgttttctcggaacgatttttctatctggtcaatcctgcgcaaatgcattggaatggagttatccaaaatcaccatgccagttatttttaacgagccactgtccttcttacagagattgacagagtacatggagcacacatacctgatccacaaggctagctcactgagtgatccagtggagcgcatgcagtgcgttgctgcgtttgccgtgtctgccgtggcgtcgcagtgggaaaggacagggaagccattcaaccccttgctgggggagacctacgagttagtccgggacgatctcgggtttagactgatcagtgaacaggtaagccaccaccccccaatctccgctttccatgctgaggggcttaataacgactttatctttcatggctctatctatccgaaactaaagttctgggggaagtccgtggaggcagagccaaagggcacaatcacactggaactgctggaacacaacgaggcctacacatggactaatccgacttgctgcgtgcacaatattattgtgggaaaactgtggatcgagcagtatgggaacgtggagatcattaaccataagaccggcgacaaatgtgtgctcaacttcaaaccttgcgggttatttggcaaggaactccataaggttgagggctacatccaggacaaaagtaaaaaaaaactgtgtgccttgtatggtaagtggaccgagtgtttgtactccgtcgaccctgcaactttcgacgcgtacaagaagaacgacaagaagaataccgaagagaagaagaactccaaacagatgtctacaagcgaggagcttgatgagatgcctgtgcctgactcggagagtgtcttcattatccccggttccgtgttactatggagaattgcaccccgaccacccaattccgcacagatgtataatttcacgagtttcgcgatggtgctgaatgaagtggacaaggatatggagtctgttatacctaaaactgattgtagattacgaccagatatcagagctatggaaaacggtgaaatcgaccaagcatctgaggagaagaagcgcctggaagagaagcagcgagccgcacgaaaaaaccggtcaaagtcggaagaagattggaaaaccagatggttccaccaggggccaaacccttacaacggcgcacaagattggatatacagcggaagctattgggatcgcaattactttaatctgcctgatatctactag

SEQ ID NO: 233761 - DNA, 345 bp, Artificial Sequence
  Description of Artificial Sequence: Synthetic coding sequence
atgcagagcgtcgcagcttttgcagtatctgccgtagctagccagtgggagcgaaccggaaagccgtttaacccactcctcggggagacctacgagctgattagagaggacctggggtttagattcatcagcgagcaagtatcacatcaccccccaatctcggctttccactctgagggactcaatcacgactttctgtttcacggcagtatctatcctaagttaaaattctggggcaagtctgtcgaggcagagccgagagggacaattacgctagaactgcttaacgtgaatcagaggcatctaagagcaaaacataagtctccaacaaatgccggtaggtag

SEQ ID NO: 233762 - DNA, 1443 bp, Artificial Sequence
  Description of Artificial Sequence: Synthetic coding sequence
atgaacggagaggaggaattctttgacgcggtcaccggattcgactccgataatagttctggcgagttttctgaggcaaaccagaaagttactggaatgatagatttagataccagcaaaaacaatcggattgggaaaactggagagaggccttctcaagaaaacggaatacagaaacaccggacaagtctgcctgcccctatgttctcccggtctgacttcagcgtttggacaattctgaaaaagtgtgtcggcctggaactaagtaaaatcaccatgcctatcgctttcaacgagccactcagttttctccagagaatcacagaatatatggaacacgtttacctcatacacagggcctcatgccagcctcagccactagagcggatgcagtccgttgctgcattcgcagtgagcgctgtggcctcacagtgggagaggaccgggaaacctttcaatccactgctaggcgaaacctatgaactcatccgagaggacctcggtttcaggttcatctcggaacaggtttcccatcacccaccaatctcagcctttcatagcgaaggtctcaatcacgacttcctatttcacggcagtatctaccctaagctgaagttctggggaaagtcggtcgaagcagaacctcggggaacaatcacactcgagctgcttaagcacaatgaggcatatacttggacaaacccaacctgttgtgtgcataacgtaattatcggtaagctgtggatcgaacaatatgggaccgttgagatcttaaaccatcgcaccgggcataaatgcgtgctccatttcaaaccttgcggcctgtttggaaaggaacttcacaaagtagagggtcacatacaggacaaaaacaagaaaaaattgtttatgatctatggcaagtggaccgagtgcctgtggggtatcgaccccgtctcatatgaaagcttcaaaaagcaagaaaggcggggtgaccatctgcgcaaggcgaagttggacgaagattcgggcaaggccgatagcgacgtagctgacgatgtccccgttgcccaggaaacagtacaggtgatcccaggatcaaaactgctctggcgaataaacactagacccccaaacagcgctcagatgtacaatttcacgagttttactgtctccctgaacgagctggagacaggaatggagaagaccctcccacccaccgactgtagactgaggcctgacataagaggcatggagaacgggaacatggacttggcttcccaggagaaggagcgtctggaggagaagcagagggaggctcggagggagagagcaaaggaagaggccgaatggcagactcgctggttctaccccggaaataatccgtataccggtacacctgattggctgtatgcaggagactactttgagcggaactttagtgattgccctgacatttattag

SEQ ID NO: 233763 - DNA, 1407 bp, Artificial Sequence
  Description of Artificial Sequence: Synthetic coding sequence
atgaatggggaggaggagttcttcgatgcagttacagaggctaaccagaaagtaaccggcatgattgatctggacacaagcaagaacaaccggatcggcaaaacaggtgaacggccttcccaggaaaacggcattcaaaaacatcgtacatcactgccagccccaatgttttctagatcagatttcagcgtttggactatcctgaagaaatgcgtgggcttggagctgtctaaaatcacgatgcctattgcattcaacgaaccgttaagctttttgcagcgaattactgagtacatggaacacgtgtacctcattcaccgagcttcctgccagccccaaccactggagagaatgcaaagcgttgccgcttttgcagtgtccgccgttgcgtcccagtgggaacgaacaggcaagccatttaacccactcttaggagagacttatgagttgatccgggaagatcttggctttaggttcatctctgagcaggtgtcccaccatccccctatctccgcattccactcagaagggctcaaccacgatttcctgttccacggctccatctacccaaaacttaaattctggggcaaatccgtggaggccgagcccaggggcaccataactctggaacttttaaaacacaacgaggcctacacatggactaatccaacttgttgtgtacacaacgtgatcatcggaaagctctggattgagcagtacggaaccgtagagattctgaaccataggaccggccacaaatgtgtgttacactttaagccttgcggcctctttggaaaggaattgcacaaagtcgagggacatatccaggataaaaacaaaaaaaagctgtttatgatttatggcaaatggactgagtgtctctggggcatagatccagtgagttacgagtcctttaagaaacaggagcgacggggagatcacttgagaaaggctaagctagacgaggatagcggcaaggcagattccgacgtggcggacgatgtgcccgtcgcccaggagaccgtgcaggtgatacctgggtcgaagctcctgtggcgcatcaacaccagacccccaaacagcgctcagatgtacaactttacctcatttaccgtgagcctgaatgagctggagacaggcatggagaaaaccctaccccctaccgattgtagattgcgacctgacattcggggaatggaaaatggaaatatggacctggcctctcaagagaaggaaaggctggaggaaaaacagagagaggccagacgggagcgcgcaaaagaggaagccgagtggcagacaagatggttttatcctggcaacaacccgtataccggcacacccgactggttgtatgctggcgattattttgagaggaatttctcagattgtcccgacatctactag

SEQ ID NO: 233764 - DNA, 1113 bp, Artificial Sequence
  Description of Artificial Sequence: Synthetic coding sequence
atgccaattgcatttaacgagcctttaagcttccttcagagaatcactgaatatatggaacatgtttatctcatccatagagcttcctgccagccccagccgctggaaaggatgcaaagcgtggccgctttcgctgtttcagctgtagcgtcccaatgggaaaggacaggcaagccattcaaccccctgttgggcgaaacttatgagctcattcgggaggacctgggcttcagatttatcagcgaacaggtgagccaccacccgccaatatcagccttccattcagaagggttgaaccacgacttccttttccacggaagcatatacccgaagcttaaattttgggggaagtctgtcgaggccgagccccgaggaactattaccctggaattactgaaacacaatgaagcctacacctggacaaatcccacctgctgcgtgcataatgttatcatcggaaagctgtggattgagcaatacgggaccgtcgagatcctcaatcacagaaccggccataagtgcgtactgcattttaagccctgtgggttgtttggtaaagagctccacaaagtagaaggccatatccaggataaaaacaagaaaaagctatttatgatatacggaaagtggacagagtgcctatggggaattgaccccgtatcatatgaatcgtttaaaaagcaggagaggagaggggaccacttgcgcaaggcaaagctggacgaggattctggcaaagcggattctgacgtcgccgatgacgtccctgttgcccaggagactgtccaggttatccccggtagcaagttactgtggcgcatcaatacccggcctcccaatagcgcccaaatctggcctgctaggaggcgatccggatggagacgttcacgagagaaacacggcggttctggacccaggcggagacaaagtggtcgaagagggggatctacacaggccataactccgacactgggccctcctacaggctgcatgcagggcatcaccttgtctggaatttccccaacagcacaaatctcaactgaaggtttagagggcccaggggctcgtgataggaggctgaccagactggattttttggaatggccactgtag

SEQ ID NO: 233765 - DNA, 339 bp, Artificial Sequence
  Description of Artificial Sequence: Synthetic coding sequence
tccgttgccgctttcgccgtatccgcagtcgcctcccagtgggagcggaccggaaagccgttcaaccccttactgggggaaacttatgaactcatcagagaagacttggggtttagatttattagcgagcaggttagtcatcacccgcctattagtgcctttcactccgagggccttaatcatgactttctgttccacggcagtatatatcccaaactgaaattttgggggaaaagcgttgaagcggaacctcgcggaactatcacgctcgagcttctcaatgtgaatcaacgccatctgagggcaaaacataagtcccctaccaacgcaggacgctag

SEQ ID NO: 233766 - DNA, 2664 bp, Artificial Sequence
  Description of Artificial Sequence: Synthetic coding sequence
atgatgtcagacgagaagaaccttggagtctctcagaagctcgtctcgccatcaagatcgacctccagctgtagttccaagcaaggctccagacaagactcctgggaagtggtcgagggattgaggggcgagatgaactatacgcaggaaccccctgtccagaaaggctttttactgaaaaagagaaaatggccgctgaaggggtggcataagcggtttttctacctggacaaagggattctcaaatacgctaagtcgcagaccgatattgaacgcgagaaactgcacggctgcatagatgtcgggttatcggtcatgagtgtcaaaaaaagtagcaagtgtatcgacttagacaccgaagagcatatttaccatctgaaggtgaagagcgaggaagtttttgatgaatgggtgtccaagctgcgccatcatcgcatgtaccggcagaacgagatagcgatgtttccgcacgaagtgaatcatttttttagtggtagtacaattaccgacagctcctcgggagtctttgactcaattagctcccggaaacggtcctccatctccaagcagaacctgttccagaccggctctaacgtctcattctcatgtggcggagaaacacgcgtgcctttgtggctacagtcatccgaggacatggaaaagtgctcaaaagacttggcacattgccatgcttatctcgtagagatgagtcagctcctgcagtcaatggacgttctgcaccggacctacagcgcccctgcaattaacgccattcaggggggttccttcgagtcccctaaaaaggagaagaggagtcataggaggtggcggagtcgggctatcggaaaagacgccaaaggaacgctgcaggtgccaaagcctttctctgggcctgtgcggctgcattcatcaaaccctaatctttccacgctcgattttggagaagagaagaactacagtgatggttctgagacaagcagcgaattcagcaaaatgcaggaagacctttgccacatcgcccataaggtctattttacgttgcgctccgcctttaatattatgagcgccgaacgggagaaactgaagcaactaatggaacaggacgcctctagctctccctccgctcaagtcattgggcttaaaaacgccctgagcagtgcacttgcccagaacacggatttgaaagagcgcctgcgtagaatccacgccgagtccctcctgttggactcgcctgccgtcgccaagtctggggataatctcgccgaagagaactcgcgcgatgagaacagggccctggtccatcagctgtcgaatgaaagccggttatccattaccgatagcttgtccgaattctttgatgcccaggaagtactgctgagtcccagctcctcggagaacgagatctccgatgatgacagctacgtgagtgatatttccgataatctgtccctggacaatctctcaaatgacctggacaacgagcgtcaaactctcggccctgtgcttgactcaggtagggaagcaaaatctcgcaggcgcacctgtttgccagccccatgcccttcatcctcaaatatctctctctggaacatccttaggaataacatcggtaaggacctgtcaaaagtggctatgcccgtcgaattgaatgagcccctaaatactctccaacgcctatgtgaggagctggaatatagcgagctactagataaggctgctcagattcccagccctctggaaagaatggtgtacgttgcagcatttgctattagtgcgtatgcatcttcctattaccgcgctggcagtaagccttttaatccagtcttgggagaaacatacgaatgcattcgggaagataaagggttccaatttttcagtgagcaggtaagtcatcaccctcctattagtgcctgccatgctgaaagcagaaattttgtgttctggcaggacgtgagatggaaaaataaattttggggcaaatctatggagatagtgcctattggaaccactcatgtaactcttccagtgttcggtgaccatttcgagtggaataaggttacgtcgtgtatccacaatattctgtccggacagcgctggatcgagcattatggcgagatcgtgattaagaatttacatgacgactcctgttattgtaaggttaactttataaaggccaagtactggtcaacgaacgctcacgagattgaaggaacagtttttgataggagcgggaaggctgtgcaccgcctctttggcaaatggcacgaatccatctattgcggcggaggttcttcatctgcctgtgtttggagagcgaatccgatgccgaaggggtatgagcagtactatagcttcacccaattcgccctggagttaaacgagatggacccaagttctaaaagtctgctgccccctacggatacccggtttcggcctgaccagagattcctcgaggagggtaatctggaggaggctgagattcaaaagcagcgtatcgaacagctccagcgtgaacgaaggagagttttggaggaaaatcacgttgaacaccagccgagattttttagaaaatcagacgacgatagctgggtatctaatgggacttacttagaattgcgtaaggatctggggttctctaagctggatcatccggtcttatggtag

SEQ ID NO: 233767 - DNA, 2571 bp, Artificial Sequence
  Description of Artificial Sequence: Synthetic coding sequence
atgatgagtgacgagaagaatttgggtgtctcccaaaagctcgtaagcccatcgagatcaacatcatcttgttcgtccaagcagggctctaggcaggattcctgggaggttgttgagggtcttcgaggtgaaatgaattacacacaagaaccaccagtacagaagggcttcctactgaagaagcggaaatggcccttgaaaggctggcacaagcgattcttttacctggataagggcatcctgaaatatgctaaatcccagacagacatcgagagagagaagttgcatggctgtatcgacgtgggcttgtcggtgatgtctgtcaagaaaagtagcaagtgtatagacttggataccgaggaacacatttaccatctaaaggtaaaaagtgaggaggtgttcgatgaatgggtgagcaagcttcgtcatcacaggatgtatcggcagaacgaaatagctatgtttccccacgaagtcaatcatttcttcagcggctccaccataaccgatagctcctctggcgtattcgactcaatcagttcaaggaagcggagttctatcagtaagcagaacctgttccagaccggttccaacgtatctttctcttgtggaggggagacacgcgtccctctgtggttgcaaagcagcgaggacatggagaagtgtagcaaggacttggcgcactgccatgcatacctggtggaaatgagccagctgctgcagtccatggacgtgctccaccggacctacagcgctcccgcaattaacgctatccaggtgccgaaacctttttccggcccagttaggctgcattcctccaaccctaatcttagcactttggactttggagaagagaagaattattccgatggttccgaaacatcctccgagtttagtaaaatgcaagaagatctgtgtcacatagctcataaagtgtattttacgttgagatctgcttttaatatcatgtctgccgagcgagaaaaactgaagcagttgatggagcaagatgcctctagctctccatccgctcaggtgattggactcaagaatgccctctcaagcgccttagctcagaacacagatctgaaggaaaggctgcgtcgtattcatgccgaatccctgctattagacagcccagctgtcgcaaagagcggtgataatctcgccgaggaaaatagccgcgacgagaacagggcgctggtccaccagctgtcgaatgaatcccgactgtcaatcacggacagtctgagcgagttttttgacgcccaggaggtactgctcagtcctagctccagcgagaacgaaatatcagatgacgactcatacgtgagcgacatctctgacaatctgagtctcgacaacttaagcaacgatctggacaacgagcgtcagactctggggcctgtgctcgatagcgggagggaagcaaagagtaggcggagaacctgcctgccagccccttgcccctccagcagcaatatcagcctctggaacattttgcgcaacaacatcgggaaagatctgagcaaagtggccatgccagttgagctgaacgaacctttgaacaccctccagagactgtgcgaggagcttgagtactccgagttgctggacaaagccgctcagattccttccccattagaacgcatggtttatgttgccgcatttgccatttctgcctacgcctcgagttattaccgcgcaggaagcaaaccttttaatcctgtgttgggtgaaacgtacgagtgcatacgggaggataagggattccaatttttcagtgagcaagtgtcccatcatcccccaatttccgcttgccacgcagagagtcgcaatttcgtattctggcaggacgtgaggtggaagaataagttttggggaaaaagcatggagatcgtgccaatcggaactactcacgttactttaccagtattcggggatcattttgaatggaataaagtgaccagctgcattcacaacatcctcagcggccaaaggtggatagaacactacggtgagatagtgataaagaacttacacgatgactcatgttactgcaaagttaacttcattaaagcaaagtactggtccacaaatgctcatgaaattgaaggtaccgttttcgacaggtcaggcaaagcagttcataggcttttcggaaagtggcacgagtctatttactgtgggggtggcagctcaagcgcatgcgtgtggagggccaatccaatgcctaaggggtatgagcaatactacagcttcacccagttcgcactggagctgaacgagatggacccaagctccaagtcactcttgcctcctactgacacacgattcaggcccgatcagagatttctggaggaggggaacctggaggaggctgagatccaaaagcagcgtattgagcaactccagcgggaaaggaggcgtgtgttggaagagaatcacgtagaacaccagcccagattcttccgaaagtccgatgatgactcctgggtaagtaacggtacctatttagagttgcgcaaagatttgggcttcagcaaattagaccatcctgttctgtggtag

SEQ ID NO: 233768 - DNA, 2556 bp, Artificial Sequence
  Description of Artificial Sequence: Synthetic coding sequence
atgatgtccgacgaaaaaaacttgggagtgtcccagaaacttgtgtcccccagtcgcagtacatcttcctgctctagcaagcaaggatctcgccaagatagttgggaggtggtggagggactgcgcggagaaatgaactacacacaggagcctcccgtccagaagggcttcctgttaaagaagcgcaaatggcctcttaaaggatggcacaaacgcttcttttacctcgataagggcatactgaaatatgcaaagagccaaaccgacatagagagagaaaagttgcacgggtgcattgacgtgggcctcagtgtgatgagcgtcaagaagagctcaaagtgtatcgatctggatacagaagagcatatttaccacttaaaggttaagtctgaggaggtatttgacgagtgggtttcaaagctaaggcaccatcgcatgtacaggcagaatgaaattgccatgttcccgcacgaagtgaatcatttcttttcagggtcaactatcaccgatagcagttctggcgttttcgactcgatcagctccaggaaaagatcatccatttccaagcaaaatctctttcagaccggaagcaacgtctctttttcctgcgggggtgagaccagagtgcctctttggttacagtccagtgaggacatggagaagtgctctaaagacctggcccattgtcacgcgtacctggtggagatgtcccaattgctgcagtctatggacgtcctgcaccgcacttactccgcgccagcaatcaatgcgattcaggggggaagctttgaatctccaaaaaaggaaaaacgctcccacaggagatggcgcagcagggcaataggcaaggacgccaaaggaacacttcaagtgccaaagccattctcaggacccgtgaggttacactcctccaaccctaacctgtcaactctcgatttcggtgaggagaaaaactatagcgatggcagcgaaacttccagcgaatttagtaagatgcaagaggacctatgccatatcgcacataaggtgtacttcacattgagatcagcctttaatattatgtctgctgagcgtgaaaaactgaaacagctgatggagcaggacgctagcagtagtccttctgcgcaagttattgggctcaaaaacgctctctctagcgagaattccagagacgaaaacagggctctcgtacatcagctgagcaatgagtcaaggctgtcaataactgattcccttagtgaattctttgacgcccaggaggttctactctccccttctagctcagagaatgagatctccgatgacgacagctatgtctcggacatttctgataaccttagccttgacaatctgagtaatgacctcgacaatgagagacagaccctaggccctgttctcgactccgggagggaggccaagagtcgcaggaggacttgtttaccagctccatgcccttcttcctctaacatctctctttggaatatactgagaaataatatcggcaaggaccttagtaaagtcgcaatgccagtagaactgaatgaacctctgaacaccctccagagattgtgcgaggaactggaatatagcgagctactggataaagctgcccagatacccagtcctctcgaaagaatggtgtatgtggcagcctttgccatcagcgcctatgcaagctcctactatcgagccggaagcaaaccctttaatcccgtgcttggggagacttacgagtgtattcgcgaagacaagggatttcagtttttctcagagcaggttagtcatcaccctccaatcagtgcctgtcacgccgagtctcggaattttgtcttctggcaagacgtgcgatggaagaataagttttgggggaaatctatggaaattgtacccatcggaaccacccatgtcacacttcctgtgtttggcgatcattttgagtggaacaaggtgacatcctgtattcacaatattctctccgggcagagatggattgaacactatggggagattgtgatcaagaacctgcacgacgactcatgctattgtaaggtcaacttcataaaggctaaatattggagcaccaacgctcatgaaattgaagggactgtgttcgaccgctccggaaaagccgtgcacaggttgtttggcaaatggcacgaatctatatactgtggtggtggctcttcctccgcatgcgtgtggcgggctaatcctatgccaaaggggtacgaacagtactatagtttcacacagtttgctcttgagctcaacgagatggatccgtcaagcaaatccctgctcccaccaactgatacaagatttcggcctgatcagagattcctcgaagagggcaacttagaggaggcagaaatacagaaacagagaattgagcagctgcaacgcgagcgccgaagggtgctggaggagaatcacgtcgagcatcagccaagattcttcagaaaatccgacgatgactcttgggtctcaaatggaacttatctggagctaagaaaggatcttggcttctccaagctggatcaccctgtgttatggtag

SEQ ID NO: 233769 - DNA, 2556 bp, Artificial Sequence
  Description of Artificial Sequence: Synthetic coding sequence
atgatgagtgacgagaaaaatttgggcgtgtctcaaaagctggtgagcccatctagatcaacaagttcatgctcctccaaacaaggcagccggcaggattcatgggaggttgtcgagggactccggggtgagatgaattatacacaagaaccacccgtgcagaaaggatttctgttaaagaaacggaagtggccattgaaaggctggcacaagaggtttttctatcttgacaagggtatactgaagtacgcaaagagccaaactgacatcgaaagagaaaaactgcacgggtgcatcgatgttggcctctctgtcatgtccgtgaaaaagtcaagtaagtgcatcgacctcgacaccgaggaacatatctaccacctaaaagtaaagagtgaagaggttttcgacgaatgggtctcaaaattgcggcaccaccgcatgtacagacagaacgaaatcgccatgttcccgcatgaggtaaaccacttttttagtgggtccacaatcactgactcatcatctggggtgttcgacagcatctcttcacgcaagcgtagctcgatctccaaacagaatctgttccagaccggatcaaacgtatctttctcatgcggtggggaaacacgcgtccctctgtggctacagtcctccgaggacatggaaaagtgttccaaggacttggcccactgccacgcttatttggtcgagatgtcacaacttctacagtctatggacgtcctgcacagaacatattcagccccagcaatcaacgccattcagggtggcagtttcgaaagcccgaagaaagaaaagcggagtcacaggaggtggcggtcccgtgctatcgggaaagacgccaagggaaccctccaggtcccaaagccgttctcaggacctgtgagactgcacagctccaaccccaatttgagcactctggatttcggcgaggagaaaaactactctgacggttctgaaacgagttccgaatttagcaagatgcaagaagatctatgtcatatcgcacataaagtttattttacgttgcgttccgcttttaacattatgtctgcagagagagagaaactgaagcaactcatggagcaagacgcttcttcttcaccctccgcccaagtcataggacttaaaaatgccctcagttcagagaacagcagagatgaaaatcgggctctagttcaccagctgtcaaacgaaagccggctctcaataacagactccctgtcggagttctttgacgcccaagaagttcttctctcgcctagttccagtgagaacgaaatcagcgacgatgactcctatgtcagcgacatctcagataatctctccctggataacttatctaatgatctggacaacgagaggcagaccctaggaccagtactggacagcggaagggaggctaaatcaaggaggaggacctgtctccccgcaccctgtcctagcagctctaatatctcactgtggaacatcctgcgcaataatattggcaaagacctgtcaaaggttgccatgcctgtggagctgaacgagcccttgaatacgctccagcgtctttgcgaggagttggaatattctgaactacttgacaaggccgcacagattccatcccccctcgagagaatggtgtacgtggccgctttcgctatcagcgcatatgcctcgtcttattaccgggcaggatccaaacccttcaatccggtactgggagaaacttacgagtgcatcagagaggacaagggcttccagtttttttccgagcaagtgtcccaccaccccccaatctccgcttgccacgccgaaagtcgcaactttgtgttctggcaagatgtacggtggaaaaacaaattctggggaaaatctatggagattgtgcccatcgggactacccacgttaccctcccagttttcggagatcatttcgagtggaacaaagtaacctcttgtattcacaatatcctctctggtcagaggtggatcgagcactacggagaaatcgtcataaagaacctccacgatgattcatgttactgcaaagtcaacttcatcaaagccaagtactggtccacaaacgcccacgaaattgaggggacagtgtttgatagatccggcaaggcagtgcaccggctgttcgggaaatggcacgaatcaatctactgcggcggaggctcatcgtccgcgtgcgtgtggcgagcgaaccctatgcccaaaggatatgagcaatattacagcttcactcagtttgccctggaactgaatgagatggacccatcatctaagtcccttttaccccctactgacacccgatttaggccggatcagcggtttctggaggagggtaaccttgaggaggcggaaattcaaaagcagagaattgagcaattacagcgtgaaagacgcagagtcttggaggagaatcatgttgagcatcagccacggttctttaggaagagtgacgatgatagctgggtctccaatggaacatacctggaactcaggaaagatctgggcttttcaaagctcgaccaccctgtgctgtggtag

SEQ ID NO: 233770 - DNA, 2571 bp, Artificial Sequence
  Description of Artificial Sequence: Synthetic coding sequence
atgatgtctgatgagaaaaacctgggcgtcagtcagaagcttgtcagcccctcaagaagtactagctcatgcagttccaagcaagggagcaggcaagacagctgggaggtggtggagggcctccggggtgagatgaattatacgcaagaacctccagtccagaaggggtttctgctgaagaaaagaaagtggccgctgaaaggctggcataaacggttcttttatttggacaaaggcatcctcaagtacgcgaaatcacagaccgacatagagcgggaaaaactgcacgggtgtatcgacgtgggcttgtcggtgatgagtgtgaaaaagtcaagtaaatgcatagaccttgacacggaagagcatatctaccacctaaaagtgaagagcgaggaggtattcgatgagtgggtgtcaaagttgaggcaccatagaatgtaccgtcagaacgaaatcgcgatgttcccgcacgaggtaaatcatttcttcagtggttcgaccataactgatagtagcagcggcgtctttgactccatttcttccagaaaaaggtcctcaatttccaaacagaacctcttccagacagggtccaatgtgagctttagctgcggtggagagactcgcgtccctctgtggctgcaaagctcagaggatatggaaaaatgctccaaggacctggcccattgtcatgcctatctggtggaaatgtcacagctcctgcagtccatggatgtgttgcaccggacctattctgcgccagccattaatgctattcaagttccaaagcctttctccgggcctgtccggttgcatagcagtaatcccaacctttccaccctggactttggagaagagaaaaattattctgacggcagtgaaaccagcagtgagtttagcaagatgcaggaagacctttgccatatagctcataaagtgtacttcacactacgctcggcctttaatattatgagtgctgagagggaaaagctcaagcaactgatggagcaggacgcctcgagcagtccttccgcccaggtcatcggccttaagaacgccttgtctagcgcccttgcacaaaacaccgatctgaaggaacggttaaggaggatccatgccgaatcactgttgctggacagccccgcagtagctaaaagcggcgacaacctcgctgaggagaactcccgtgatgagaaccgcgctctggtgcatcaattgtcgaatgagtcaaggttgtcgattacagatagccttagcgagttttttgatgcccaagaggtcctgctttcaccatctagttccgaaaatgagatcagcgatgatgattcctacgtctccgacatatcagataatctcagcttagacaatctctctaatgatctcgacaatgagagacagaccctgggcccagttctggattccggtagggaggcgaaaagccgacggcgaacatgcctaccagcaccatgtcccagtagttctaacatcagcctgtggaacatcctccgcaacaacattggcaaggacctgtccaaggtagccatgccggtagaactcaatgaaccgcttaatacattacagcgcctgtgtgaagagttggagtactccgaactgttggataaggctgcacagattccaagccccttagagcggatggtttacgtggctgcttttgccattagcgcttacgcctcctcttactaccgagctggctctaagccctttaacccagtactgggagagacctacgaatgtatccgtgaagacaaggggtttcaatttttcagcgagcaggtttctcaccaccccccaatctccgcctgccatgctgagtcccggaactttgtgttttggcaggacgtgaggtggaaaaacaagttttgggggaagagtatggaaattgttcccatcggcaccactcatgtgacgctgccagtgttcggagaccactttgaatggaataaggtaacctcatgcatccataatatcctgagcggccagagatggattgagcactatggtgaaatcgtgattaagaacttgcacgatgattcttgctactgtaaggtgaattttataaaggcaaaatactggagcaccaacgcccatgagatagaggggaccgtcttcgatcggtccggaaaagctgtacatcggttatttgggaagtggcacgaatcaatatactgcggtggcggaagtagttcagcttgcgtatggcgcgcaaaccctatgcccaaagggtatgagcaatactatagttttactcagttcgcgctggaactgaatgaaatggacccctccagtaagtccttgctcccacctaccgatactaggtttcggcctgatcagaggtttttagaggaaggaaacctggaagaggccgaaattcagaaacagcgaatcgaacagctgcagagagagaggaggagggttctcgaggaaaatcacgtagagcaccagcctagattcttcaggaagagcgatgacgatagctgggttagcaacggcacctacttagagcttcggaaagacttgggattctccaaattggaccatccagtactgtggtag

SEQ ID NO: 233771 - DNA, 2463 bp, Artificial Sequence
  Description of Artificial Sequence: Synthetic coding sequence
atgatgtccgatgaaaagaatttgggcgtctctcagaaactggtctcgccgagccgatccaccagctcatgcagctctaagcagggctctcgccaagacagctgggaggtcgtagagggactgagaggcgagatgaactatactcaggagccacctgttcaaaagggattccttcttaaaaaacggaaatggcctctcaaggggtggcacaagcgatttttctatctagataaggggattctaaaatacgcaaagagccaaacagatattgaaagggagaagttgcacgggtgcattgatgtagggctgagtgtgatgtcagtgaagaaatcaagcaaatgcattgacttggataccgaagagcacatctatcatctgaaggttaagtcagaggaagttttcgatgagtgggttagtaagctgcgccatcatcgaatgtaccgacaaaatgagatagcgatgttccctcacgaggtgaatcacttttttagcggctcaaccataacggactcgtccagtggcgtctttgatagcatatctagccgaaagcgctcgtctattagcaagcagaaccttttccagacaggatccaatgtatcgtttagctgcggtggcgaaactcgtgtccccctatggcttcagtcatccgaggatatggaaaagtgctcaaaggatctcgcacattgtcatgcatatttggtagagatgagtcaactcctccagagtatggatgtgctccaccgcacatacagcgcgccagcgatcaacgcaattcaagtccccaaacctttctccggccctgtgcgtcttcactcttctaatcctaatctgtcaacgctcgactttggcgaagagaagaactacagcgatgggtccgaaacatctagcgagttctccaagatgcaggaagacctatgccatatcgcccataaggtctatttcaccctgcgttctgccttcaacatcatgagcgcagagcgggagaagcttaaacagttaatggagcaggatgcctcttctagtcccagtgcccaggtaatcggccttaagaatgctctctccagcgaaaatagccgggatgaaaacagggcgctcgtgcaccagctgtccaatgagagccgattgagcatcacagactcactaagcgaattcttcgacgctcaggaggttctcttgtctccctctagttctgagaatgaaattagcgacgatgacagttacgtgtcggatattagtgataacctgagcctcgacaacctctctaacgacttggataacgaacgccagaccctggggcctgtgttggacagcggacgggaggctaagtcaaggagacgaacttgtctgcctgcgccatgtccttccagcagcaacatcagcctgtggaacatactgaggaacaatatagggaaggacctgtcgaaagtagccatgccagtcgaattgaacgagcccctgaacacccttcagaggctgtgcgaagaattggagtacagcgagctgctcgataaggcagcccagatcccaagcccacttgaaagaatggtttatgtagcagctttcgcgatctccgcgtacgctagtagttactaccgcgcaggaagcaaaccctttaatccagttctgggcgagacgtatgaatgcatcagggaagataagggatttcagttcttttctgaacaggtgtcccatcatccaccgattagcgcctgtcacgccgagtccagaaatttcgtgttctggcaggacgttcgatggaagaataaattctggggcaaatccatggaaatcgtgccaattggcactactcatgtgactttgcccgtgtttggcgatcacttcgagtggaacaaagtcacttcctgtattcacaacatcctgtcaggccagcgttggatcgaacattatggcgaaatcgtgattaaaaatctgcatgacgatagctgctactgcaaggttaattttataaaggccaagtattggtctacgaacgcccacgagattgaagggacagtgtttgacaggtctggcaaagccgtgcataggctgttcggaaaatggcacgaaagcatctactgtggaggtggatcatcttcagcttgtgtttggcgagccaaccctatgccaaaaggttatgaacaatactatagcttcacgcaatttgccctggaattaaatgaaatggatccttcgtccaagtccctcctccccccaacagacactcgctttcgacctgatcagcggttccttgaggaaggtaatttggaggaagcagaaatccagaaacagaggatcgagcagctgcagagagaaaggcggagggtcctggaagagaaccatgttgagcaccagccaagattttttcgcaaaagtgatgatgactcttgggtgtccaatggcacttacctggagctgcgcaaggatttggggttctctaagctggaccacccggtactctggtag

SEQ ID NO: 233772 - DNA, 339 bp, Artificial Sequence
  Description of Artificial Sequence: Synthetic coding sequence
atgatgagcgatgaaaagaacctgggcgtttctcagaagcttgttagccccagccgctcaacatctagctgctcttcaaaacagggctcgaggcaggactcatgggaggtggtggagggtctccgtggggagatgaattacactcaggaacctccagtgcagaaaggcttcctgttaaaaaagagaaaatggccactgaagggatggcacaagaggttcttctatcttgataagggaatcctgaagtacgcaaagtctcagactgacattgagagggagaagctccacggatgtattgatgtgggactgagtgttatgagtgttaaaaagtcctcttag

SEQ ID NO: 233773 - DNA, 186 bp, Artificial Sequence
  Description of Artificial Sequence: Synthetic coding sequence
atgatgagcgatgagaaaaatcttggggtgtcccagaaactggtgtcaccaagtcgttcaacgtcatcttgtagttcgaagcagggtagccggcaagattcttgggaggtggtcgaaggacttagaggcgagatgaattacacccaggaaccacccgttcagaaaggatttctgctcaagaagtag

SEQ ID NO: 233774 - DNA, 2463 bp, Artificial Sequence
  Description of Artificial Sequence: Synthetic coding sequence
atgatgagtgatgagaaaaaccttggggtgagccaaaaactggtctccccctctagaagcacctcaagttgctctagcaaacagggaagcaggcaggatagttgggaggtagtggaaggccttcgaggggaaatgaactacacccaggaacctcctgtacagaaagggtttctgcttaaaaagcggaaatggccactcaaaggctggcacaaaaggtttttttacctcgacaaggggatcctgaagtacgcaaaatcccagacagatattgaaagggagaaactccatggatgtatcgatgtcgggctctccgtgatgtctgtcaagaaaagttcgaagtgtatcgatctggataccgaagagcacatttaccatctgaaggtgaagtctgaggaagttttcgatgaatgggtgtcaaagctgcgacaccatcgtatgtacaggcaaaacgaaatcgccatgttcccccacgaagtgaatcacttcttctcaggaagtaccatcacagattcctcttccggggtgtttgacagcatctcttctcgaaagcgctcctcaatttctaagcaaaatctcttccagacaggctcgaatgtgtcttttagctgcgggggagagactagagttcctctgtggctacaatcctcggaggacatggagaagtgctccaaagacctggctcactgtcatgcttacctggttgaaatgtcccagcttctgcagagcatggacgtactacataggacctattctgctccggctatcaatgccattcaggtgcctaagccattttccggaccggtgcggttgcactcatctaatcctaatctgtccacccttgattttggagaggagaagaattacagcgatggctcagagacatcctcggagtttagtaaaatgcaggaggacctttgccacattgcccataaggtttatttcaccctccgtagtgccttcaacataatgagtgctgagcgagagaagctcaagcagctcatggagcaggatgcttcctcttcaccgtctgcccaggtgattggactcaagaatgcgcttagttccgaaaactctcgggacgagaaccgggctctcgttcaccagttgtcgaacgagtctcgcctgagtataacagactcactcagcgagttctttgacgcgcaggaggtgctcttatcaccaagttcctcggagaatgaaattagcgatgacgattcatatgtctctgatattagcgataatttgagcctggacaatctgagcaacgatctcgataatgagcgccaaacacttgggcctgtacttgatagtggtagagaggctaaatctcgcagaaggacctgcctgcccgcaccatgcccttctagcagtaatattagtctctggaatatcctcagaaataacataggcaaggacctctcaaaagtcgccatgcccgtggaactaaacgagccccttaacactctccaaagactttgcgaagagctggaatactccgaacttttggataaggcagcccaaatcccatcccctctggagcgaatggtgtacgtggctgcatttgctatcagtgcctacgcgtctagttattatcgagccggtagcaagccattcaaccccgtcctgggggaaacctatgaatgcatcagagaggacaaaggctttcagttcttctccgagcaagtctcgcaccatcctccaattagcgcttgtcacgccgaatcacggaacttcgtcttctggcaggacgtcaggtggaaaaacaagttctggggtaaatctatggagatcgtacccatcggcaccactcacgttacactccccgtctttggcgaccatttcgaatggaacaaggtcacctcatgtatacataacatcctgtcagggcagcggtggatcgaacattacggcgaaatcgtgatcaagaacctgcatgatgacagctgctactgtaaggttaacttcatcaaagcaaaatattggagcacaaatgcccacgaaattgaggggactgtgtttgatcgtagcggcaaagcagtgcatcgactgttcggcaagtggcacgaatccatttactgcggcggagggtccagttcagcctgtgtgtggcgcgctaacccaatgcccaagggttacgagcagtactattccttcacacagtttgccctcgaattgaatgaaatggatccaagctcaaaaagcctgctgccccctaccgatactcgatttcgaccagatcaacgattccttgaagaaggcaatcttgaagaagcggaaatccaaaagcagaggatcgagcagcttcagagggagcggagacgggtcctcgaggagaaccatgtcgaacaccagccacgcttttttcgcaaatctgacgacgactcttgggtgtcaaacgggacctatctcgaactccggaaggatttgggtttctcaaagctcgatcacccagtgctgtggtag

SEQ ID NO: 233775 - DNA, 270 bp, Artificial Sequence
  Description of Artificial Sequence: Synthetic coding sequence
atgatgtcagacgaaaaaaatctgggcgtgagtcagaagctggtgtctccttcacggtccaccagtagttgttcgtccaagcagggcagccggcaggattcatgggaagttgtggaaggcctgcgcggagagatgaattacacccaggaaccaccggtgcagaagggctttctgctgaagaagcgcaaatggcccctgaaaggatggcataagcgatttttctacctcgacaagggaattcttaagtacgcaaagagccagacagattag

SEQ ID NO: 233776 - DNA, 2640 bp, Artificial Sequence
  Description of Artificial Sequence: Synthetic coding sequence
atgaaggaggaggcatttctccgcagacggttttcactgtgtcctccgagttccactccccaaaaggttgatccgcgaaagctcaccaggaatctgttgctgtcaggagataatgaactatatccactatctccagggaaggacatggagccaaacggcccttccctgccgagggacgaaggcccaccaaccccctccagcgccaccaaggtccccccagcagaatacaggctgtgtaacgggtccgacaaagagtgcgtgtcgccgactgcgagagtcacaaagaaggagaccctcaaagctcagaaagaaaattatcgccaggagaagaagagggccactcgccagctcctcagcgccctaactgatccctcagtagtaatcatggcagatagtctgaaaatcaggggcacgctaaaaagctggaccaaattgtggtgtgttttaaagcctggcgtgctgctgatttataaaacgcccaaagtcggccagtgggtgggaactgtgttgctgcattgttgcgagctgatcgaaagaccttctaaaaaagacggcttctgctttaaactattccaccctctggaccagtctgtctgggcggtgaagggaccgaagggtgagagtgtaggaagtattacgcagcccctgccttcttcctacttaatcttccgcgctgcatctgagagcgacggacgatgttggctggacgccctggagctggctctcaggtgcagtagccttctcagactcggcacttgtaaacccggaagagacggtgagcctgggacaagtccagacgctagcccgtcttccctgtgcggtctgcctgctagtgccacagtccaccctgaccaggacctcttccccctgaatggcagctccctggagaacgacgccttcagtgataaaagcgagcgcgaaaaccctgaggaaagtgatacggaaacgcaggaccactccagaaagactgaaagcgggagtgatcagagcgagacgcccggtgcccctgtgcgtcgaggtacgacttatgtggagcaggtgcaggaggagctgggcgagctgggggaagcctctcaggtagaaaccgtgtcagaggagaacaaaagtctgatgtggacactacttaagcaactcagacccggaatggacttatctcgggtcgtcttgcccactttcgtgctggaacctcggtctttcctgaacaaattgtcggattactattatcacgcggacttgctctccagagcagcagtcgaggaggacgcttactctcgcatgaagctagtgctgcggtggtacctcagcggattttacaagaagcccaaggggattaaaaagccctacaaccccattctgggtgaaacattccggtgctgctggttccatcctcaaacagattccaggactttctacatcgccgagcaggtaagtcaccatccaccagtatctgcttttcatgtgagcaaccggaaagacggcttctgcataagtggcagcatcacagctaagagcaggttctatggcaactctctaagcgccttgcttgacggaaaagctactttgaccttcctaaatagggcggaggattacacactcactatgccctatgcccattgtaaagggatcctttacggtaccatgaccctggagttgggcggaaaagtgaccatcgagtgcgccaaaaataatttccaggcccagctggaatttaagctgaaacctttcttcggaggcagcacttccattaaccaaatttccggaaagattacgagtggcgaagaggtgttggcaagtctatctggacattgggaccgtgacgtttttatcaaggaggaggggtccggctcttcagctttgttttggaccccctccggcgaagtcaggcgccagcgactcaggcagcacaccgtcccactggaggagcagactgagctggagagcgagcggctttggcagcacgtgacaagagcaatcagcaagggcgatcagcacagggccacacaggagaagttcgccctggaggaggctcaacggcagagagccagagaaaggcaggagtcactaatgccctggaagccgcaactctttcatctcgaccccataacacaggagtggcactatcgctatgaggaccatagtccctgggaccccctcaaagatattgcccaattcgagcaagatggcatcttacggactctgcaacaggaagcagtggcgcgtcagactactttcctcggcagtccaggccctagacatgagcgttccggccctgaccagcgcctgaggaaggcgtccgatcagccatccgggcactcccaggcaaccgagagctctggctccactcccgagtcctgccccgaactgagtgatgaggagcaggacggagacttcgtgccaggaggcgagtccccgtgccccagatgcaggaaggaggccaggcgactgcaagcacttcacgaggccattttatctatccgagaagcacaacaggagctgcatcgtcatttatcggccatgctgtcttccaccgctcgagcggcacaggcaccaacgcccggactcctgcagtcacctcgcagttggtttctgttgtgcgtattcttggcgtgccagctgttcataaatcacatactgaagtag

SEQ ID NO: 233777 - DNA, 2436 bp, Artificial Sequence
  Description of Artificial Sequence: Synthetic coding sequence
atgaaagaagaagctttcctgcggaggcgcttttctttatgcccgccatcctccactcctcagaaagtggatcctaggaagctgaccagaaacttactcctctccggagacaacgaactatatcccctgtcccctggcaaagatatggagccaaatggaccatcactgcctagggacgaaggcccaccaaccccgtctagcgcgaccaaggtacccccagccgagtacagactttgcaacgggtcggacaaagagtgtgtttcccccaccgcgagagtgacaaaaaaagagacgctcaaagctcaaaaagagaactacaggcaggagaagaagcgagccacccgacagcttcttagcgctttgactgaccccagcgtcgtcataatggcagactcactgaagggccctaagggagaatccgttggctccatcacccagcccctcccgagcagctacttgattttcagggccgcaagcgaatccgatggcagatgttggcttgatgcccttgaactagccctgagatgctcgtccctgttacggctcggcacttgtaagccaggcagagacggagaacccggaaccagtccggatgcgagtccctcgtccttgtgcggcttgccagcaagcgccactgtgcatcctgatcaggatctttttcccttgaacggcagctcgctggagaatgatgccttcagcgacaagagtgaaagggagaatccagaagagtcagatacagaaacccaggatcattcaaggaagactgaatctggctcagatcagagcgagaccccaggcgctccagtgaggcgcggaactacatatgtggagcaggtgcaagaggagttaggtgagctcggagaggcttcccaggtggagaccgtaagcgaggagaataagagcttgatgtggaccctccttaagcagcttcggcctggaatggacctgtctcgggtcgtccttcctaccttcgttttggaaccacggagctttcttaacaaactgagtgactactactatcatgctgatttgctgtcccgggcagctgtggaggaggatgcctattctcggatgaagttagtcctgcggtggtacctttcagggttttacaagaagcctaagggcataaagaagccttacaatcccatcctgggggaaacttttagatgctgttggttccatccacagacagattcgagaacattctatatcgcagaacaggtcagtcaccacccccctgtgagcgcgttccacgtatcgaatagaaaggacggattctgcatctctggatctattacagctaagagcaggttctatggaaactccctttcagcactgctggacggaaaggctactctcacattcttaaacagagccgaggactacaccttaaccatgccgtacgctcattgtaagggcatactgtatgggactatgaccctcgagctcggaggtaaggtgaccatagagtgcgcaaaaaataactttcaggctcagctcgaattcaaactgaagccatttttcgggggtagtacttcaattaaccaaatatccgggaaaataacctctggcgaggaagttctggcctcccttagtggacactgggatcgggatgtttttatcaaagaagagggctcaggcagttccgcgctgttctggacacctagtggagaggtgaggcgacagagacttaggcagcacaccgtgcctcttgaggagcagacagaactagagtccgagaggctgtggcagcacgtgaccagggccatttctaaaggtgatcagcaccgcgcaactcaggaaaaatttgccctggaagaagcccaacgccagcgggctcgggagcgacaggagagtttgatgccatggaagccccagttatttcacctggatcctattacccaggagtggcactatcgctacgaagaccacagtccatgggatcctctgaaagatattgcccaattcgaacaggatgggatactgcgcactctccagcaagaagctgtcgcgaggcagaccacctttttaggttcaccagggccacggcatgaacgctctggacctgaccagagacttcggaaggcgtccgatcagccctctgggcactcacaggcgaccgagagctcggggagtacgcctgaaagttgcccagagctgtccgatgaagaacaggatggggacttcgttccgggtggagagtcaccttgtcctcgatgcagaaaagaggccaggagacttcaggccctacatgaggctatccttagtattcgagaagcccagcaggaactgcaccggcacctgagtgcgatgctgagcagtactgccagagctgctcaggcacccaccccaggcctcctgcagtctcctcgcagctggttcctattgtgcgtctttctcgcatgccaactgtttatcaaccacattctcaagtag

SEQ ID NO: 233778 - DNA, 1320 bp, Artificial Sequence
  Description of Artificial Sequence: Synthetic coding sequence
atggacctttcccgagttgttctgccgacctttgtgctggaacctcgttcatttctgaataaattaagtgactactactaccacgccgatctcttgagcagggcagcagtagaggaggacgcctactctagaatgaagctcgttctgcgttggtacctgagtggcttctataaaaaacccaaaggaattaagaaaccttacaatcctatcctgggcgaaacttttcggtgttgttggtttcacccccagaccgattccagaactttctacatagcggaacaagtgagtcaccaccccccagtgagtgcatttcatgtgtcaaaccgcaaagatggtttttgtatctcaggctcaattactgccaaatctcgcttttacggcaatagtctcagcgccttgctggacgggaaggcaacactgacctttctcaacagggccgaggactacacgcttaccatgccttatgctcactgcaagggcattttgtacggaacgatgacgctcgagttaggagggaaggtcactattgaatgtgccaagaacaacttccaggctcagctggagttcaagttgaagccattctttggaggatcaacttctataaatcagattagcggaaagatcacttcaggagaggaagtgttagcctcacttagtggccattgggaccgggacgtgtttatcaaagaagaggggagcggcagctctgcccttttttggactcccagcggggaagtgagacgacagaggctccgacagcatacagtccctcttgaagagcaaactgaactcgagtcagaacgcctgtggcagcacgttactagagcaattagcaaaggagaccagcatagagccactcaagagaaattcgccttggaagaagctcaacgacaacgagcacgggagcgccaggaaagcttgatgccgtggaaaccccagctgtttcacctggacccaatcacccaagagtggcactataggtatgaggaccactcaccatgggatccgttaaaagacattgcacagtttgaacaggatgggatcctgagaaccttgcagcaggaagctgtagcacgtcaaacaaccttcctagggagccccggacccaggcacgagcgcagtgggcctgaccagcgcctccgtaaggcgtcggatcaaccctctggccacagccaagcaacggagagctcaggatccacccctgagtcatgcccagaacttcatggaaccgggtcgactggtacagatccacgcccacctgccgagcctccgatcctcgtccccgcactaagagttccaggggtttccgcagtacactag

SEQ ID NO: 233779 - DNA, 2436 bp, Artificial Sequence
  Description of Artificial Sequence: Synthetic coding sequence
atgaaggaggaggctttcttgcgcaggcgtttctccctctgtcctccaagttctactccccagaaggtggaccctcgcaagctgaccagaaatcttctcctgagcggcgataatgagctttatcccttatctccaggcaaggacatggagcctaatggaccctctctgccacgggatgaggggccacccacaccctctagcgccaccaaggttccacccgcagagtaccgattatgcaatggcagtgacaaagaatgcgttagccccaccgcgagggtgaccaagaaagaaactttaaaagcacagaaggaaaattaccgccaggagaaaaaaagggctaccaggcagctactcagcgccctcacagatccttctgtcgtgattatggccgactcactgaaaggacccaagggggagagtgtgggctctataactcaaccacttccgtcgtcctacctgatttttagggctgccagcgagagcgatggccgatgctggctggacgcattagagctcgccctgagatgtagtagtctgctgaggctcggaacctgtaagccaggacgagacggcgaaccaggaacatcccctgacgccagcccatcttccctgtgcggcctccccgcatcggcaaccgttcaccccgaccaggatctgtttcccctgaatggcagctctttggaaaacgatgcctttagcgacaagagtgagagagagaaccctgaggagtctgacacagaaacccaggaccacagccgcaagacagagtcaggaagcgatcaaagtgaaacccccggtgctccggttaggcgcggaaccacctatgtcgagcaggtccaggaggagctcggtgagctgggggaagcatcacaagtggagactgtgagcgaggaaaataaaagcctgatgtggacgctgctcaaacagctgcgccctgggatggatttgtcacgtgtggtactgccgacattcgtgctggaacccagaagcttcttaaacaagctaagcgattactactatcatgcagaccttttgtctagggctgccgtagaggaagacgcgtattcaaggatgaagctcgtgcttcgctggtatctgagcgggttttataaaaagccaaaaggcattaaaaagccttacaatccaatacttggtgagacctttcgctgttgttggttccatccccagaccgatagcagaactttctacattgcggaacaggtcagccaccatcctcccgtctccgcctttcatgtctccaatcgcaaggatggattttgtatcagcgggtccatcacggcgaagtcaagattctacggcaattctctgagcgctctactcgacggaaaagccaccctcacatttttgaatagggcagaggattacaccctcactatgccgtacgctcactgtaagggcatactgtacggaaccatgactctcgaactgggcggtaaggtcaccatagaatgtgctaagaataatttccaagcacagctggagtttaagctcaagcccttctttggcggaagtacatctatcaaccagatatcaggaaagattacaagcggcgaggaggtgctggcatctctctccggacactgggaccgggatgtatttattaaagaagaaggatcaggctcttcagcgttgttctggacgcctagcggagaggtgaggcggcaacgtctgcggcagcacacggttccactggaggaacagaccgagcttgagagtgagcggctgtggcagcacgtcaccagggctatttccaaaggagatcagcatcgggctacccaagagaaatttgctctggaggaggcccaacggcaaagggccagggagaggcaggagtccctcatgccctggaaacctcagctgttccacctcgatcccattacgcaggagtggcactatcgatatgaggatcactctccatgggacccattaaaagatatcgcccagtttgagcaggacgggattctgagaaccttacagcaggaagccgtcgctcgccagactacgtttctcggttctcccggaccacgccacgaacgcagcgggcctgaccaaagactgcgaaaggcatctgatcaaccttccggccactcacaggcaacggagtcaagcggatcaacccccgaaagttgcccagagctgtctgacgaggagcaagacggagatttcgtgcccggaggcgaaagtccgtgtccgaggtgccggaaggaggcccgaaggctgcaggctctccacgaagcaatcctcagcatcagggaagctcagcaggaactgcacaggcacctctccgctatgttgagttccaccgcgagggctgctcaagctcctactcccggattgctgcagtccccacggtcttggtttcttctctgtgtgttccttgcctgtcaactctttatcaatcacatcctgaaatag

SEQ ID NO: 233780 - DNA, 375 bp, Artificial Sequence
  Description of Artificial Sequence: Synthetic coding sequence
atgaaggaagaggcttttttgagacgaagatttagcctctgccccccttctagcacaccgcagaaggttgaccccagaaagcttaccagaaatttgcttcttagcggcgataacgagttgtatcccctctccccaggaaaggacatggagcctaacggtcctagcctgccacgggatgaaggacctcctacaccctcatccgcaacaaaagtgcctcccgctgagtatcgcctgtgtaacgggtccgacaaggagtgcgtgtctcctactgcccgtgttactaagaaagaaacactgaaagctcagaaagagaactaccggcaagaaaagaaacgggctacccgtcagttgttgtccgctctgaccgatccctag

SEQ ID NO: 233781 - DNA, 297 bp, Artificial Sequence
  Description of Artificial Sequence: Synthetic coding sequence
atgaaagaggaggcttttctacggcgacgcttctctctgtgtcctccaagttctacacctcagaaggtagaccccaggaaacttactagaaacctgttgctgtcaggggacaacgaactctacccactcagtcccggaaaggatatggagccaaatggaccttcccttccccgagacgaaggcccacccacccctagtagcgctactaaggtgcccccagcggaatatcgtctgtgcaatgggagcgacaaagagtgcgttagccctaccgctagagtaaccaagaaggagacttag

SEQ ID NO: 233782 - DNA, 420 bp, Artificial Sequence
  Description of Artificial Sequence: Synthetic coding sequence
atgaaagaggaagctttcttaagacggaggttctcactgtgcccaccttctagtaccccacagaaagtggacccccgtaagttaactaggaaccttctgttgtcgggtgataacgagctctatccattatcacctggcaaagacatggagcccaatggtccttcattgcctcgcgatgagggcccacccactcctagcagcgcgactaaggtaccaccagccgagtacagattgtgtaacggctccgataaggagtgtgtaagcccgacggcacgggtgactaaaaaggaaaccctgaaagcgcagaaagaaaactaccgacaggagaagaagagggctacacggcagctactgtcagccctgaccgacccatccgtcgtaatcatggccgacagtcttaagatccggggaacactgtag

SEQ ID NO: 233783 - DNA, 273 bp, Artificial Sequence
  Description of Artificial Sequence: Synthetic coding sequence
atgaaagaagaggccttcctaagacggaggttttccctgtgccccccaagtagtacaccacagaaggtggatcccaggaagctcacaaggaacctgcttctcagtggcgacaacgaactgtacccactctccccgggtaaggatatggagcctaacggccctagtctcccacgagacgaaggccctccaacgccctcgagtgctacgaaagtgccgccagctgagtaccgcctgtgtaatggaagtgacaaagagtgtgtgtcaccaacttag

SEQ ID NO: 233784 - DNA, 210 bp, Artificial Sequence
  Description of Artificial Sequence: Synthetic coding sequence
atgaaggaggaagccttcttgagacgcaggttcagcctgtgcccaccatcgagcacccctcagaaagtggacccgagaaaactaacgaggaacttgcttctgagcggtgataacgagctgtatcctttaagtcccggtaaggatatggaacctaacggcccttctctcccgagggatgaggggcctccaactcctagctctgctacttag

SEQ ID NO: 233785 - DNA, 1299 bp, Artificial Sequence
  Description of Artificial Sequence: Synthetic coding sequence
tataaccctatcttgggggaaacattcaggtgctgctggttccacccccaaacagacagtaggaccttctatatcgctgaacaggtttcacaccaccctcccgtgtccgcatttcacgtatctaataggaaggatgggttctgcatttcaggctctatcactgccaagtcaaggttttacggcaacagcctgagcgcgctccttgacggaaaagctacactaacatttctgaatcgggcagaggattatacgctaactatgccttacgcccactgcaagggcatcctgtacgggacgatgactttggaactagggggaaaggtgaccatcgagtgtgccaaaaacaacttccaagcacagctggagtttaagcttaagccgtttttcggagggtccacaagcatcaatcagatttcaggtaagatcacttctggcgaggaagttttagctagtctgagtgggcactgggacagagacgtctttattaaggaagaggggtctggcagttcagcgctgttttggacgccaagcggtgaggtgcggcgtcagcggttaagacaacacaccgtgccattggaggaacagaccgaactggagagcgaaagattgtggcagcacgtgacccgggcaattagcaagggcgaccaacaccgcgcaacacaagagaagttcgctctcgaagaagctcagcggcagcgggctagggaaagacaagaatcactgatgccctggaagccccagctattccatttagaccccattacccaggaatggcactaccgatatgaagatcactcaccttgggacccactgaaggacatcgcccagtttgaacaggacggcattctgcgcacccttcaacaggaagccgtggcccgacagaccactttcctgggaagccccggtccaaggcatgagaggagcgggccagatcagaggctccggaaggctagcgaccagccatcaggccactctcaggccacggagagtagcgggagtacccctgagtcctgtcccgagctctcggacgaagagcaggatggagactttgtcccgggaggggaaagcccctgccccagatgtaggaaggaggccagacggctgcaggctctgcacgaagccattttatccatccgagaggctcaacaggagttacaccgtcacctcagtgccatgctgagcagtactgctcgggcagcgcaggcccctaccccagggctcctgcagagtcctcgaagttggtttctgctgtgcgtgttcttagcgtgccagctcttcatcaatcatatattgaagtag

SEQ ID NO: 233786 - DNA, 1533 bp, Artificial Sequence
  Description of Artificial Sequence: Synthetic coding sequence
atgtgcgtgccccaccgacagggtcaccaggaaggggatagccagggagcggagggggagctgccagccggtgaggagccccgtagtttccttaacaaactgtctgactactattatcatgcagatttgctgagccgggctgccgtggaggaggacgcttattctcgcatgaagcttgttctgaggtggtacctcagcgggttctacaaaaagcccaaaggcatcaagaaaccctataaccctatactcggtgagacttttagatgctgctggtttcacccacagacagacagccgcactttttatattgcggagcaggtgtcccaccatccgccagtgtccgcctttcacgtctctaaccgaaaggacggcttctgtatttcgggctccatcacggcaaagtctcgattctatgggaattcgctttccgcgcttctggacggtaaagccacactgacctttttgaaccgggcagaggactatacgttaacaatgccctatgctcactgcaaaggcattctgtatggaactatgactctggagctcgggggaaaagttacaatcgaatgtgccaaaaataacttccaggcacagttagaattcaagctcaagcccttctttggtgggtcaactagcatcaaccaaattagcggcaagattaccagcggggaagaggtgctggcttctctgagtggtcactgggaccgcgacgtctttatcaaggaggagggatctggatcttccgcactgttctggacgccaagtggcgaggtgagaaggcagcgtctgcgacaacatacagtccctcttgaagaacagacagagctagagtctgaacggctctggcagcacgtcacacgcgcaatctcaaaaggggaccagcatcgtgccacacaagagaagtttgccctggaagaagcccagaggcagagagccagagaacgacaggagtctctgatgccgtggaaaccccagctttttcatttagatccaataactcaggagtggcattacaggtacgaagaccactccccctgggacccgctgaaagacatcgcccagttcgaacaagacgggatcctcaggaccctacaacaggaagcggttgcccgacaaacaaccttcttgggatccccgggacctaggcacgagagatccggcccagatcagaggctgcgtaaagcttcggatcagcctagtgggcactctcaggctaccgagtcctcagggagcaccccagagtcctgccccgaactgtccgacgaagagcaggacggtgattttgtcccagggggagagtccccatgcccaaggtgtagaaaagaagctcgacggctacaagccttacatgaagcaattctgagcatacgtgaagcccagcaggagctgcatcgtcacctcagtgcaatgctctcttccacagccagggctgctcaagcccctactcccggactgttacagtcacccaggagttggtttctgttgtgcgtgttcctggcctgtcaactgtttatcaatcacattcttaaatag

SEQ ID NO: 233787 - DNA, 2805 bp, Artificial Sequence
  Description of Artificial Sequence: Synthetic coding sequence
atgtcatccgacgaaaagggtatctccccagcccataagacctcaactcccactcatcgcagtgcctcctccagtacatcctctcaaagggacagccgccaatccatacacattctggagaggactgcctccagctccaccgagcctagtgtctctcgtcaacttttggagcccgaacctgtacctttgagtaaggaagcagatagctgggaaatcattgagggtctgaagattggccagactaatgttcagaagcctgataaacatgaaggtttcatgctgaaaaagcgcaagtggcccctgaagggttggcacaagagattcttcgtcctggacaatggaatgctgaagtacagcaaagcgccattggacatccagaaagggaaggtgcatggatccattgacgtggggttgagcgttatgtccatcaagaagaaggcccgaagaatcgatttggatactgaggagcacatttatcacctcaaagtgaagagtcaggattggtttgatgcgtgggtgagtaaactgcggcaccatcgcctgtaccgccaaaatgagatagtgagatcaccaagagatgcatccttccatatttttccgagcacctcaacagctgaaagctcgcccgctgcaaacgtaagtgtgatggatggaaaaatgcagcccaactcttttccttggcaaagccccctcccatgtagtaactccctcccggctacgtgcactaccggccagagcaaagtcgccgcttggctgcaagactctgaagagatggataggtgtgctgaagatctcgcccactgtcaatcaaacctggttgagctgtccaaactactgcagaacctcgagatcctgcagaggacacaatcagccccaaactttaccgacatgcaagccaactgcgtggacatttccaagaaggacaaacgggtgacccggaggtggcggacaaaaagcgtcagcaaggatactaagattcaattacaggtgccgttctccgccactatgagtcccgtgagactccactcatctaatcccaatctgtgtgctgatatagagtttcagactcctccatcgcatttgaccgaccccctggaaagctcgacggactacaccaaacttcaagaggaattttgtctgatagcccagaaggtgcacagtcttctcaagagcgctttcaattccatcgccatcgagaaggagaagttgaaacaaatggtgtccgaacaggatcactccaagggacactcaactcagatggctcggctcaggcagagtttaagccaggctttgaaccagaacgctgaacttcggtctagactcaaccggatccacagcgagtcaatcatctgtgatcaagtggtctccgtgaacattattccttcccctgatgaggctggtgagcagatccacgtgagtctgcctttatctcagcaggtggcaaatgagtctagactatcaatgtcagaatccgtcagtgagttctttgatgctcaggaagtgctgctgtccgcttcgtctagtgaaaatgaggcaagcgacgatgaatcttacatttcagacgtctcagacaatatctcagaggataacacatcggtggccgacaacatctctcggcaaatcctgaacggtgagctcacagggggagccttcagaaacggcaggcgagcttgtttacccgctccatgtcccgatactagcaatattaatttatggaatatcttaagaaacaatatcggaaaggatctgagtaaggtatccatgccggttgaactcaatgagccactgaatactctgcagcacctttgcgaggaaatggagtattcggaactgttggataaggcgagtgaaacagatgacccctatgagagaatggttctggttgccgcatttgccgtctcggggtattgcagtacttactttagggccggttcaaaacccttcaatccagtgttgggtgagacatacgaatgtatcagggaggacaagggcttcagattcttctcagagcaggtgtcacatcaccccccaatcagcgcatgtcactgcgaaagcaaaaattttgtgttttggcaggacatcagatggaagaacaagttctggggaaagagcatggagatcttgcccgtgggtacccttaacgtgatgctacctaagtacggggattactatgtctggaacaaagttactacctgcatccataatattctctccggacgtcgatggatagagcactatggcgaggtgaccatccgcaacacgaagtcaagcgtgtgtatctgtaagcttacgttcgttaaagtgaactattggaacagtaacatgaacgaagtgcaaggcgtggtgattgatcaggaaggaaaagccgtctacaggctgtttggtaaatggcacgaaggcctgtactgtggggtggctccatcagcaaaatgtatctggcggcctggcagcatgccaactaattatgagctttactacggatttacaagattcgccattgaactcaatgaactcgaccccgtccttaaggatctcctgcccccaacggacgcccgtttccggcctgaccagcgatttctggaggaggggaatctggaggcagccgcttccgaaaaacagcgggtcgaggagttacagcggagcagacgacgatacatggaggaaaataatctggaacatattccaaaattttttaagaaggtaatcgatgccaatcagcgcgaggcttgggtgtctaacgacacctactgggaactgcggaaggatcctggattctcaaaagtcgattcgcctgtgctgtggtag

SEQ ID NO: 233788 - DNA, 2817 bp, Artificial Sequence
  Description of Artificial Sequence: Synthetic coding sequence
atgcaccagctctccctgatccgaggcaacaggggccgatctattcatattctggaacgtactgccagcagctctaccgagcctagtgttagcagacagttactggagcctgaacctgtccccttatccaaggaggcagacagctgggagattattgaaggactgaagatcggacaaaccaacgtgcaaaagcctgataaacacgagggattcatgttgaagaagcgtaagtggcctctcaaagggtggcataaaaggttcttcgttctggacaacggaatgctcaagtatagcaaggctccactggacattcagaagggaaaggttcatgggtctatcgatgtgggcctaagcgtaatgtccataaaaaagaaagcacggagaattgatttggatacagaagagcatatttaccacctaaaggtaaagtcacaggattggtttgacgcctgggttagtaaactacgtcaccaccggctgtatcgtcagaacgaaatcgtacgcagcccaagagatgcaagtttccatatcttcccaagcacctctacagcagagtcaagccccgctgctaatgtgtccgttatggacggcaagatgcagccaaatagctttccttggcagtctccactcccatgtagtaacagcctacctgcaacatgtacaaccgggcagtcaaaggtggctgcgtggctgcaagatagtgaggagatggaccggtgcgccgaagacctggcccactgccagtccaacctcgtggagctctcaaaactgcttcaaaacttggagatcctgcagcgcactcaatctgcccctaactttacggatatgcaagccaactgcgttgatatctcgaaaaaggataaaagggtcacgcgaaggtggcgcacaaaaagcgtcagcaaagacactaaaatccagctgcaggaaggaccccctgctaaggggcagttttccaccaccagaagaagacagaggttggcggcagcagtcgcaactactgtccccttcagcgctaccatgtcccctgtgcgcttacacagtagcaacccaaatctgtgcgctgatatcgaatttcagaccccgccatcacacctgaccgacccccttgagagcagcacggactacactaagctgcaagaagagttttgcttgattgctcaaaaagtgcactcacttctcaaaagcgctttcaattccatcgctattgaaaaggagaaactcaagcagatggtctcggagcaggaccatagcaagggtcactcaactcagatggcacgactgcgacagagcctctcacaagccttgaaccagaacgccgaactaaggtcaaggctgaaccgaatccatagtgagtcaataatctgcgaccaggtggtgagcgttaatatcattccatccccggacgaggccggagagcagatccatgtgtcccttccactgtcccagcaggtcgcaaacgaatcaagactcagcatgtccgagtcagtatctgagttcttcgatgcccaggaggttctactgtcggcatcctcgtcagagaatgaagcctctgatgatgagtcctacattagcgacgtgagcgacaatatctctgaagacaatacaagcgtggctgataacatcagccggcagattctgaacggggaacttaccggcggtgcctttagaaatggacgacgggcatgcttgcccgctccctgcccagatacaagcaacatcaatctatggaatattcttagaaataatatcggtaaggaccttagtaaagtgtcgatgcccgtggagttgaacgagcctctcaacaccttgcagcatctgtgtgaggagatggagtacagcgagcttctggacaaggcatccgaaaccgatgacccatacgaacgtatggttctagtggccgcttttgccgtaagcggctactgtagcacctacttcagggcgggatcaaaaccatttaaccccgtactgggcgagacctacgaatgtatccgagaggataaagggtttcgtttttttagtgagcaggtcagtcatcaccctcccattagtgcctgccactgtgaaagcaaaaacttcgtgttttggcaggacatcagatggaagaataaattttggggcaaaagcatggagattctgcctgtcggtaccctgaatgtcatgctgccaaagtacggtgattactatgtgtggaacaaggtgacgacctgtatacacaacatcctgtccgggagacgctggatcgagcattatggagaggttaccattcggaatacaaagtccagcgtttgcatctgcaagttaactttcgtgaaggttaactattggaattccaatatgaacgaagtacaaggagtcgtgatcgaccaagagggcaaagctgtctaccgtttgtttggcaaatggcatgagggactgtactgcggcgtggcaccatccgctaaatgcatatggcgccctggtagcatgccaacaaactatgaactctattacgggttcaccaggtttgctattgaactgaacgagttggatcctgtgctcaaggacctccttccaccaaccgatgcacggtttcgccctgaccagagatttttggaagaggggaacctggaggccgcagcaagcgaaaaacagagagtggaagaactgcagagaagtaggagacggtacatggaggagaacaacctggagcatatccccaaatttttcaaaaaggtgatagacgcaaaccagagggaagcctgggtgtccaacgacacatattgggaactgagaaaggatccaggcttttcaaaggttgactcaccagtgttgtggtag

SEQ ID NO: 233789 - DNA, 2697 bp, Artificial Sequence
  Description of Artificial Sequence: Synthetic coding sequence
atgtcgagtgacgaaaagggaattagccccgcacacaagacctccactccaacacatcggagcgcgtcaagcagcacaagttctcagcgggactcccgccagtcaatccacatactggaaagaactgctagcagttcaaccgagccatctgtttctcgccagttgttggagcccgagcccgtcccgctgtccaaggaggcggatagctgggagattattgaagggctcaagattggtcagactaatgtccagaaaccagacaaacatgaaggctttatgctgaaaaagcggaagtggccactaaagggctggcataagcggttcttcgtactagacaatggaatgttaaaatactccaaggccccattggacatccaaaaggggaaagtccatggctctatcgacgtgggcctgtctgtcatgtcgatcaagaagaaggccaggcgcattgacctggacaccgaggagcacatatatcacctaaaggtgaagtcgcaggactggttcgatgcctgggttagcaaactgcggcaccatcgcctataccgtcagaacgaaattgtgaggtcccctagggacgcctcttttcacatttttccatccacgagtacggccgagtccagcccagctgccaacgtttccgttatggacggtaagatgcagcccaacagcttcccctggcagtctcctctgccttgctcaaattctcttcccgcaacctgcactaccggacagtccaaagtagcagcctggctgcaggacagtgaggagatggacaggtgcgccgaagatctcgcgcactgtcagagcaacctggtcgaattgagcaagctgcttcaaaatttagagatcctacagagaactcagtcagctcccaattttacagacatgcaggctaattgcgtggatattagcaagaaggacaagcgcgtcacacgtcgctggagaactaaatccgtttccaaagacacaaaaatccagttgcaggtcccttttagtgcgaccatgtcaccagtgcggctgcactcatcgaatcccaacctgtgcgcagacattgaattccagactccaccctctcatctcaccgaccccttagagtctagtacagactataccaagctccaggaagagttttgcctgattgcacaaaaagtgcattccctgctcaaaagcgccttcaactccatcgccattgaaaaagagaagctgaagcaaatggtctccgaacaggatcatagcaaaggccattccacacagatggctcgtttgcgccagtccctgagtcaggctggagaacagatccacgtgtcacttccactgtctcagcaggtggccaatgagtctcgcttgtcgatgagcgaatctgtgagtgagtttttcgacgctcaggaggtattactgtcagcttcctccagcgagaacgaggcctcagacgacgagagctacatttccgatgtaagcgataacatctctgaagacaacacatcagttgcagataacatctcacggcagatccttaacggcgaactgaccggcggagccttccgcaacggccgacgggcttgccttcccgctccttgtccagacacttctaatataaatttgtggaatattctgcgcaataacatcggcaaagatctatccaaagtcagcatgcctgtggagctgaatgaaccgttaaacactttacagcatctatgtgaggaaatggaatacagtgaattattggataaggcgagtgagaccgatgacccatacgaacggatggtgctggtggcagctttcgctgtaagcgggtattgcagcacctacttcagggctggctctaagccattcaatccagtgcttggggagacctacgagtgtatccgagaagacaagggcttccggttcttttctgaacaggtcagccaccaccccccaataagcgcgtgccactgtgagagtaaaaattttgttttctggcaggatattagatggaaaaacaagttttggggcaaaagcatggagatcttgcccgtcggcaccctcaacgtcatgctgccaaaatacggcgactactatgtttggaataaggtcaccacctgcatccacaatatattaagtggtaggaggtggatagaacactacggggaggttacaatccggaacacaaagagcagcgtgtgtatatgtaagcttaccttcgtcaaagtgaactactggaattccaatatgaatgaagtccaaggggtcgtgattgatcaggagggcaaggccgtgtacaggctgtttggcaagtggcacgagggattgtattgcggcgttgcaccatcagctaagtgcatttggagacccggatctatgcccacaaactatgagctgtattacgggttcacacggttcgcaattgagcttaatgaactcgaccctgtactgaaggacctgctgccacccaccgatgccagattccgcccagaccagagattcctggaagaaggcaatttagaagctgccgctagcgagaagcaacgggtggaagagctgcaacgatcccgccgacgctatatggaagagaataatttggagcatattcctaagttcttcaaaaaagtcatcgacgccaatcaacgcgaggcttgggtgagcaatgatacttactgggaactcaggaaggatcctggtttttcaaaggtcgatagtccggtcctgtggtag

SEQ ID NO: 233790 - DNA, 573 bp, Artificial Sequence
  Description of Artificial Sequence: Synthetic coding sequence
atggatggtaaaatgcaacccaactcttttccatggcagtcaccattgccttgtagcaattccttgcccgcaacttgtactacaggacaatcaaaagtggcagcttggttacaagacagcgaagaaatggatcggtgtgcggaggatctggcccattgtcaatccaatctcgtcgaactgtcgaaactcctgcagaatctggaaatcctacagaggacccagtctgctcccaattttacggacatgcaggcaaactgcgtggacatctcaaaaaaggataagcgcgtgacacgcaggtggcgtaccaaaagtgtgtccaaagataccaaaatccagttacaggtgcctttttcagcaacaatgtccccagttaggctgcacagctctaatccaaacctgtgtgccgatattgaattccagacgccgcctcctaaccatttcggcattcttagcgtattactgcagccttacagtttaaaaaaaaaaaagaaaaaaaagaaaaagtccaccccgtcactggaatctcgcattaaaggtgcggagtacaagattcagagtcttacctcattatag

SEQ ID NO: 233791 - DNA, 2880 bp, Artificial Sequence
  Description of Artificial Sequence: Synthetic coding sequence
atgagttccgatgaaaaaggcatcagcccggctcataaaacttcaacacccacgcataggagtgcctcctcctcaacctcctctcagcgagatagccggcaatctatccacatcctggagaggaccgcatctagttccaccgagccatccgtctctagacagcttctggaacccgaacctgtgccactgagcaaggaagccgactcatgggaaatcattgaaggcctgaagatcggccagactaatgtgcagaagccagataagcacgaggggtttatgctcaagaaacgcaaatggcccctgaagggatggcacaagcgcttcttcgtcttggacaacggcatgcttaagtactcaaaggcccctctggatatccaaaaaggaaaggtgcatggctctattgatgttgggttaagcgtgatgtctatcaaaaaaaaagcccgtaggatcgatttagacacagaggagcatatttaccacctaaaggtgaagagccaggactggttcgacgcatgggtcagcaagctaaggcatcatcggctttaccgccagaacgagatcgtgcgttcaccacgcgacgcatcattccatatattcccctcaactagcaccgccgaaagttcccccgcagctaacgttagcgtaatggatggcaaaatgcagcctaactccttcccctggcagtctccactgccatgtagcaattcactgcctgccacgtgtaccacgggtcagtctaaggtggctgcatggctccaagatagcgaggaaatggatcgttgcgcagaggacttagctcactgccagtcgaacctggtggaactgagcaaactgctccaaaacctagaaattctgcaaaggacgcagagtgctcctaacttcactgacatgcaggcgaactgtgtagatattagcaagaaggataagcgggtcacacggagatggcggacaaaaagtgtatccaaagatactaaaatccagctgcaggagggccctcctgccaaagggcagttttccaccacgaggcggcgacaaagattggccgcagcagtggcaactacggtgcctttctcagcgaccatgtctccggtccgtctgcacagctctaacccaaatctgtgcgcggacatagagttccaaacccccccaagccacctgacagacccactggaatccagcactgactataccaaactccaggaggagttttgtctaatagcacagaaagttcattccctgttaaaatccgctttcaactccattgccatcgagaaggagaaactgaagcagatggtctcagagcaggaccactctaagggccatagtacgcagatggctcggctgcgccaaagtctgtcgcaggctctgaaccaaaatgccgagctgcggagtagactgaacagaattcacagcgagtctattatctgtgatcaggtggtctccgtaaatattatccctagcccagatgaggccggagagcagattcacgtgagcctgcctctctcgcaacaagttgccaatgagtcgcggctgtctatgagcgagtcagtttccgagttcttcgatgcccaagaggtgctcctatccgcttcaagcagtgagaatgaggcctctgatgatgagtcctacatatcagatgtgagcgataacatttctgaggataacaccagtgtggccgacaatatctccagacaaatcttgaatggcgaacttactggaggcgcatttcgtaacggtcgtagagcctgtctgcccgcaccctgtccagataccagcaacatcaatctgtggaatatcctaaggaacaatatcgggaaagatctgagcaaagtttccatgcccgtggaactaaatgagccactgaataccctgcagcacctctgtgaggagatggagtacagtgaactgcttgataaagcctcggagaccgacgacccgtatgaacgaatggtccttgtcgccgcttttgccgtgtcaggctactgtagtacctattttcgagccggaagcaagcccttcaatcctgtgctcggagagacctacgaatgcattcgcgaggataaggggttccgattcttttcagaacaagtgtctcaccacccgcctattagcgcgtgtcattgcgagtccaaaaactttgtgttctggcaagatataagatggaaaaataaattctgggggaagtccatggaaatccttcccgtgggaaccttgaacgttatgttacctaagtatggagactattatgtatggaataaagttacaacatgtatccacaatatactaagcggcagaagatggatcgagcattacggcgaggttaccatacgaaacacgaagtcttctgtctgtatctgtaaactaacatttgtcaaagttaattactggaacagcaatatgaatgaggtacagggcgtggttatcgatcaggagggaaaggccgtgtaccggctattcgggaagtggcatgagggattgtactgcggcgtcgctccatccgccaaatgcatttggcgtcccggtagcatgcccaccaattatgagctctactacggctttacccgattcgccattgagttgaatgagctggaccccgttctgaaagacctccttcctccaacagatgccagatttcgaccggaccaaagattcttagaggagggtaacttggaggccgctgcctctgagaagcaacgggtcgaagagctccaacgcagccggaggaggtatatggaagaaaacaacctggagcatatacccaagtttttcaagaaggtaatcgacgccaaccaacgagaagcctgggtgtctaacgacacctactgggaactcaggaaggaccccggttttagtaaagtggacagccccgtgctgtggtag

SEQ ID NO: 233792 - DNA, 2712 bp, Artificial Sequence
  Description of Artificial Sequence: Synthetic coding sequence
atgtcctctgacgagaaaggaattagccccgctcataagacttccaccccaacgcaccggagtgctagctcaagcacctcaagtcagagagattctcgtcagagcatccacatcctggagaggacagctagctcaagcacagaaccaagcgtgtcacgccagcttctggaacccgagccggtgcctctatcgaaggaggccgactcttgggaaattatagaaggattaaagatcggccaaaccaatgtgcagaagcctgacaaacatgaggggttcatgcttaagaaaaggaaatggccgctcaaggggtggcacaagcgctttttcgtcctcgataacggaatgcttaaatactcgaaagccccactagatatccagaagggtaaggtgcatggatcaatcgatgtgggattatccgtgatgagcataaaaaagaaggcgcgaagaattgatctcgatacagaagagcacatatatcatttaaaggttaaatcccaagattggttcgacgcctgggtttctaagctaaggcatcaccggttatatagacagaacgaaattgtgagatcacccagagacgcttccttccacatattcccatctactagtaccgctgagagctcgccagccgcaaatgtgtccgttatggatggcaaaatgcaaccaaactctttcccatggcagtctccccttccctgttcaaatagtctcccagcgacatgcaccacggggcagtctaaggtagccgcttggctacaggatagtgaggaaatggatcgatgtgctgaggacttagctcactgtcagtctaaccttgtagagctctccaagttgctgcaaaatctggagatcctccaacggacacagagcgctccaaacttcacagatatgcaggtgcctttttcagccactatgagccccgtcagactgcattcatctaacccaaatctgtgcgccgacattgagttccagacccccccaagccacctgacggatcctctggaatcttctacagattatacaaagttgcaggaagagttctgtctgatagcccaaaaggtgcatagcctgttgaaaagcgccttcaactcgatagcaatcgaaaaagagaaactgaaacagatggtcagcgaacaggaccactcgaaagggcatagcacgcaaatggcaaggctacggcagtcgctctctcaggccttgaatcaaaatgcggagctccgttcccgcctcaataggattcattctgagtcaattatttgcgaccaggtcgtgagcgttaacattatcccttccccagacgaggcaggcgagcagatccacgtcagtctcccactgagtcagcaagtggccaacgaatcgaggctttctatgtcagaaagtgtaagcgaattttttgatgctcaggaggtcctgttaagcgcatcatccagcgagaacgaggctagtgatgacgaatcatatatatcggatgtctccgataacattagcgaggataataccagcgtcgccgacaacatcagcaggcaaatactgaatggtgaattgactggcggagcgttcaggaacggtaggcgggcttgtctgcctgctccctgccccgacacctcaaatatcaatctgtggaatattctcaggaacaacatcggcaaagacctgagcaaagtcagcatgcctgtcgaacttaacgaacccctgaacaccctgcagcatttgtgtgaagaaatggaatatagtgaattactggataaagccagcgaaacagacgatccatatgagcgcatggtgctggtggccgcattcgctgtttccggatattgcagcacttattttagagcaggctccaagccctttaatcccgtcctgggtgaaacttacgagtgcataagagaggacaaggggtttcgctttttttcagagcaagtgtcccaccacccccctatctcagcctgccactgtgaaagtaagaacttcgttttctggcaggatatcagatggaaaaacaagttttggggaaaaagcatggagatcctgcccgtgggaacccttaacgtgatgctgcccaaatacggggactattatgtatggaacaaggtgactacctgcattcacaacattctcagtgggagacggtggattgaacactacggcgaagtgactatccggaacaccaaatcgtccgtatgtatctgtaaattgacatttgtcaaagtgaattactggaatagcaatatgaatgaggtgcaaggcgtggttatcgaccaggaagggaaagcagtgtaccgcctgttcggaaaatggcacgaagggctttactgcggagtggccccatctgctaagtgcatttggagacccggatctatgcccactaattatgaactctattatggttttactcgcttcgccatcgaacttaacgaattggacccagtgctgaaagacctgcttcctcccacagacgcaaggtttcgcccagaccagagattcctggaggaaggaaacctggaagctgccgcaagtgagaaacagcgggtggaggagctacagcggtcgcggagaaggtatatggaggagaacaacctggagcatatccccaagtttttcaaaaaggtcatcgacgcaaaccaacgggaagcctgggtgagcaacgatacatactgggaactgagaaaagatccaggattttcaaaggtggactcgccggtgctttggtag

SEQ ID NO: 233793 - DNA, 2529 bp, Artificial Sequence
  Description of Artificial Sequence: Synthetic coding sequence
atggactttcaagagcgtgatcctccttttctccctgagagtgctcaatccagtaaaccttcttccgctcagcaagccagcgaactgtgggaagtcgtcgaggagccccgagtgagactgggaactgagggcgtgatgcctgaaaggcaggagggtcacttgctcaaaaagcgcaagtggccactgaagggctggcataaacgatactttgtcctagaagatgggattctgcattacgccacaacgcgccaggatataaccaagggcaagctgcacggaagcatcgacgtgaggctgtcggtcatgtccattaataagaaggcccagaggatagacctcgataccgaggacaatatctatcacctgaaaatcaaatctcaagatcttttccagagttgggtagcccaactacgggcacatagactcgcgcacagactcgatatgccaagaggaagcctccctagcactgctcaccgcaaggtgcccggtgcccagctgccaacggcagcgaccgccagtgcccttccgggattgggcccaagagagaaagtatccagctggctgcgagatagtgacggcttggatcggtgttcgcacgagctgtctgaatgtcaaggcaaactgcaggagctgcaccgcctgcttcagagccttgagagcttgcatcgtataccgtctgcacctgtcatcccaacccatcaggcctccgttaccaccgaaagacctaaaaagggcaagaggacatcgcggatgtggtgtacccagagttttgccaaagacgacacaattgggagggttgggagattgcacgggtctgtacccaacctgtctcgctacttggaaagccgggacagcagcggcacgcgcggactgcctcctaccgattatgcccacttacagcggtccttctgggctcttgcacagaaagtgcactcatcactgtcttcagtgcttgccgctcttacaatggagcgtgatcagttacgcgacatgcaccagggtagcgaactatcccggatgggcgtctctgaggcttctacagggcagcgccgtctgcattccctttccactagttctgacactaccgcagattcatttagttccctcaaccccgaagaacaggaggctctgtacatgaagggacgcgaacttactcctcaactgagccagacctccatactctccctggctgattctcataccgaattttttgacgcctgcgaggtattactaagcgctagctcctcagagaacgagggcagcgaagaagaagaaagttgcacctccgagattactacatctctctccgaagaaatgcttgatctgcggggtgccgaaagatgccaaaagggtggctgcgttccgggtagacctatgggaccgccacgacgtcgatgtcttccagctgcctccgggcctggagcggatgtgtcgctttggaatatccttaggaacaacatcgggaaagatctgtcaaaagtgtccatgcctgttcaattgaatgagcctctgaatacacttcagaggctctgcgaggagttggagtattcttctctgctcgatcaggcatccaggattgccgacccgtgcgaaaggatggtctatattgctgccttcgccgtgagcgcctactcatccacgtaccatcgggcagggtgcaagccatttaatcccgttctcggagagacctatgaatgtgaaaggcccgacaggggatttcggttcatctccgaacaggtgtcacaccatcctccaattagtgcttgccacgctgagtcagagaactttgcattttggcaggacatgaagtggaagaacaaattttggggcaagagcctggagatagtgccggtgggcaccgtgaacgtgagcttacctaggtttggtgatcatttcgaatggaacaaagtgacgtcatgcattcacaacgtactgagcggccaaagatggatcgagcactacggagaagttctgattaggaatacacaggatagctcctgccattgtaaaatcacgttctgtaaggctaagtattggtcctcgaatgtacacgaggttcagggcgctgtgctgagcagatcggggcgagtgctccatcgtctgtttggcaaatggcacgagggtctttatagggggcctaccccgggtggtcagtgcatctggaagccaaattccatgcctccagaccacgaacgcaacttcggcttcacacagttcgccctagaactgaacgaactgacggcagagcttaaacggagtttaccctctaccgataccaggctgaggcccgatcagaggtacctggaagagggaaatatccaagcagccgaggcccagaagagaaggatcgagcagctccagagagacagacggaaggtaatggaggagaacaatatcgtccatcaggcaagattctttaggcggcagaccgatagttccggcaaggagtggtgggtaacgaacaacacatattggcgattgcgggctgaacctgggtacggcaacatggatggtgccgttttatggtag

SEQ ID NO: 233794 - DNA, 2529 bp, Artificial Sequence
  Description of Artificial Sequence: Synthetic coding sequence
atggacttccaggaacgcgacccaccctttttgcccgaatcagcccagtcatcgaagcccagtagcgcccaacaggctagcgagttatgggaggtggtcgaggagccgcgagtgcgccttggaaccgagggcgtgatgccagagcgacaggagggccacctcctgaagaaacggaaatggcccctgaaggggtggcataaaaggtatttcgttctggaagacggcattctgcactatgccactacaagacaggatatcacaaaaggcaagttgcacggaagcatcgatgtgcggctgagcgtcatgtcaataaataagaaagcccagagaatagacttggacaccgaagacaatatctatcaccttaaaatcaagtcccaggacctgtttcagtcttgggtcgcccagctgcgtgcccaccggctggcacacagattagacatgccccgtggctctctccctagcaccgctcaccgcaaggtgcctggggcacagctgcccactgctgcgacagcctctgctctgccgggactaggcccaagagagaaggtctctagttggttgagggacagcgacgggctcgataggtgctcccacgagctatcagaatgccaaggtaaattacaggagctgcacaggctgctccagagtctggaatcgctgcaccggataccatctgctccagtgatcccgacccatcaggcctccgtcaccaccgaacgccctaaaaagggtaaacgtacaagtagaatgtggtgcacccaatccttcgctaaagacgataccatcgggcgagtgggaagactgcacggctcagtgcctaatctgtcccgctatctggagtcacgggactcctccggcacaaggggcttgccaccgacagactacgcacatctccaaagatccttctgggccctcgcacagaaggtccactccagcctttcaagtgtactggccgcactcacaatggaaagggatcagctacgcgacatgcatcaagggtctgaactgtctcggatgggtgtgtccgaggcctctaccgggcaacgcagactacactccttgagtaccagtagtgacacaaccgccgatagcttcagcagcctgaatcccgaggaacaggaagctctgtacatgaagggacgtgaactcactccacagctgtcccagaccagcatccttagcctggccgactcacacaccgaattttttgacgcgtgtgaggtgctgttatctgcaagtagttccgaaaatgagggttccgaagaggaagaaagctgcactagcgaaatcacaacatctctgagcgaggaaatgttagaccttaggggtgccgagcggtgccaaaaaggaggttgtgtacctggacggccaatggggcctcctcggagaaggtgtttgccagcagccagcggcccaggcgctgatgtatcgctctggaacatcttgagaaacaatatcggcaaggatttgagcaaagttagtatgcccgttcaactcaacgaacctctgaataccctgcagaggctgtgtgaagaacttgaatactcttctttgctcgaccaagcctcgcgaatcgcagacccatgcgagagaatggtttacatcgcagcattcgcggtctccgcgtacagttcaacgtaccacagagccggttgcaagccctttaaccccgttttgggcgagacttacgagtgcgaaagacctgaccggggttttaggttcattagtgagcaggtgtcacaccatccccctatctcagcctgtcacgccgaatccgaaaattttgctttttggcaggacatgaagtggaagaacaagttttggggtaagtcgctggagatcgtgcctgtggggaccgtcaacgtgtctctgccacgatttggcgatcactttgaatggaataaggtcacaagctgcatacacaacgtgctgtccgggcagcgctggatcgaacactacggtgaggtcctcattaggaatacccaggactcgtcgtgtcactgcaagattactttttgtaaggcaaaatactggtcatctaacgttcatgaggtgcagggagccgtgctctctcggagcggcagagtgcttcacagactctttggcaagtggcacgagggactgtatcggggacccactcctggcggacaatgcatttggaaacccaattcaatgccccctgatcacgagcgcaactttggttttactcagtttgccctggagctgaatgaactcaccgccgagctcaaaagatccctgccaagcaccgacactaggctaaggccagatcagcggtatttagaggagggaaacatacaagccgcagaggcgcagaaaagacgaatcgagcaattgcaaagggatcgcagaaaggtgatggaggaaaacaacattgtgcaccaggccagattctttcggagacagacagacagtagcggaaaagagtggtgggtgacgaataatacttattggaggttgcgggctgagccaggatatggtaatatggacggcgctgtcctctggtag

SEQ ID NO: 233795 - DNA, 2670 bp, Artificial Sequence
  Description of Artificial Sequence: Synthetic coding sequence
atggagggaggtttagctgacggcgagcctgacaggacctctctcttaggcgactccaaggacgttctgggcccttcaacagtcgttgctaacagtgacgagtcacaacttctcactccgggaaagatgtctcagcggcagggaaaggaggcctatccgactccaacaaaggacctgcaccagccatccttatctccggcttctccccattcacaagggttcgagagaggtaaggaagatatttctcagaataaggatgaatccagcctctcaatgagcaaaagcaagagtgaatccaagctctacaacggctctgagaaagattcatccacaagtagtaaactgaccaagaaagaaagtctcaaagttcagaaaaagaattaccgggaggaaaagaagcgcgctacgaaagagctcctctctaccataaccgacccaagcgtgatagtgatggctgattggctcaaaattcggggaacactgaagtcctggaccaaactctggtgtgtcctgaagcccggagtcctgctcatctacaagactcagaaaaacgggcaatgggttgggaccgttttacttaatgcctgtgagattatcgagaggccctcaaagaaggatggcttctgtttcaaactcttccacccactcgaacaaagcatttgggctgtcaagggtcccaaaggcgaggcagtaggttctattactcagccactgccttccagctacctgattatcagagccacttcagagtccgatggcaggtgctggatggacgcactggagcttgctttgaagtgcagctctttgctgaagagaacaatgattcgagaaggaaaggaacacgatctttctgtgagcagtgactccacacatgttacattctacggcctgcttagggcaaataatctgcactccggggacaacttccagctcaacgacagcgagatcgagcggcaacattttaaggaccaggatatgtattctgacaaatccgacaaagagaacgaccaggaacatgacgagagcgacaatgaggtcatgggtaaatctgaggagtctgacacagataccagtgaacggcaggatgacagttatatcgaacccgagcccgtggagccccttaaggagactacatacacagaacagtcccatgaagagttaggcgaggcaggagaggcttcacagacagagactgtctccgaggagaataaaagcctaatatggaccctgctgaaacaggtgcggcctggcatggaccttagtaaggtggtgttgcccacatttattcttgaacctcgatcctttttagacaaactttcagactattattatcacgccgacttcttaagcgaagccgctttagaggaaaatccttactttagacttaagaaagttgtgaaatggtatctcagcggcttttacaagaaacccaaaggcctgaagaaaccatataatccgattcttggagaaacttttcggtgtctgtggatccatccacggacaaattctaagaccttctacatagccgagcaggtctcgcaccacccccctatcagcgccttttatgtttccaatcgaaaagacgggttctgcctcagtgggagtatattggcaaagtccaaattttacggaaacagcctgtctgctatcctggaaggtgaagctaggctgactttcctgaacagaggcgaggattatgttatgactatgccctacgcccattgcaaaggaatactctacggcacaatgacactggagctagggggtacagtcaatatcacttgtcaaaagacaggttactccgcaatcctcgagttcaaattgaaacccttcctggggtcgtctgactgtgtgaatcagatttccgggaaactgaagctgggcaaagaagtgctcgctaccctcgagggacactgggactctgaggtgttcataaccgataaaaaaacggacaatagcgaagtattctggaatcctactcctgacattaagcagtggcgtctgatccgacacactgtgaagtttgaggagcagggcgattttgaaagcgaaaagttgtggcagcgcgtgacccgtgcgatcaatgcaaaggatcagactgaggcaacgcaggagaagtacgtcctggaagaggcccagagacaagcagcacgcgatagaaagacgaaaaatgaggagtggagttgcaagctttttgagttggaccctctcacaggagagtggcattacaagtttgcagatactaggccgtgggatccccttaatgacatgatccagtttgaaaaggacggagttatacagaccaaagtcaaacacaggacgcctatggtcagcgtgcccaagatgaaacacaaacctacccgtcaacagaagaaagtggctaagggctactctagccccgagcctgatattcaggactcaagtggttcagaggcacagtctgtcaagccctcgacgaggcgtaagaagggaatagagctcggcgacattcagtcgtccattgagtccattaaacagactcaggaggaaatcaaaaggaacattatggcccttcgtaatcatctcgtctcgtcaactcccgcaacggattattttctgcagcaaaaagactacttcataatcttcctccttattctgctacaggtgattataaactttatgttcaaatag

SEQ ID NO: 233796 - DNA, 2544 bp, Artificial Sequence
  Description of Artificial Sequence: Synthetic coding sequence
atgtcacagcgtcaggggaaggaggcttaccccacaccaacgaaggacctgcatcagccatcactgagtccagcgtctccgcactcacagggctttgagcgagggaaggaggacattagtcagaataaagatgaatcgtctttaagtatgagcaaaagcaaaagtgaatctaagttgtacaatggatccgaaaaggatagctcaacatcctctaaattgactaaaaaagaatccctgaaagtgcagaagaaaaattatcgggaggaaaagaagagagcaaccaaggaattgctgagtacaataacggatccttctgtgattgtgatggccgactggttaaagattcgaggaaccctgaaaagctggactaagttatggtgtgtgttaaagcccggagtgcttttgatctacaaaactcaaaaaaacggtcagtgggtgggcacagtcctgctcaatgcctgcgagattatagagcgcccatcgaagaaggatggcttttgctttaagcttttccaccctctggagcagtccatatgggccgtaaagggtccaaagggcgaagcggttggatcaatcacccagcccctgccgtccagctacctcattattcgagccacgagcgaatctgacggtagatgctggatggacgccctggagctggctctcaagtgctctagtttactgaaaagaacaatgatccgggaaggcaaggagcatgacttatcagtaagctcggatagcacacatgtgaccttttatggcctgctgagggccaataatcttcattccggcgacaatttccagctgaacgattcggaaatcgaacggcagcatttcaaagatcaggatatgtactccgacaagagtgacaaggagaacgatcaagaacacgatgaatctgacaacgaagtgatgggcaagtccgaggagtccgataccgacacttcagaaaggcaagatgacagctacattgaaccagagccagtagaacctttgaaagaaacaacatacacagagcagtctcatgaggaactgggagaagccggagaggcctcccaaaccgaaacagtatctgaggaaaacaagtcgctgatatggaccctgctgaagcaggtgcgcccagggatggatttgtcaaaagttgtccttccaacatttattctggaaccgaggtccttcttagataaactgagcgattattactatcacgcagatttcctgtccgaagcagccttagaggagaacccatatttccggcttaagaaggttgttaagtggtacctctctgggttctataaaaaacctaagggcctgaagaagccttacaatcctatattaggggaaacttttagatgcctgtggatacacccaaggacgaacagcaagaccttttatatcgccgagcaggtgagccaccacccaccaatttctgctttttacgtgtccaatcgcaaggacggtttttgcctcagcggctcaattctcgccaaaagtaagttttatggcaactccctgtccgccattctggagggagaagcccgtctgaccttcctaaatagaggcgaagactacgtaatgactatgccctatgcccattgcaagggaattctttacggcaccatgaccctcgagttaggcggtaccgttaacatcacttgtcagaagactggttattcggcaattctagaatttaagcttaagcctttcctgggttccagcgactgcgtcaatcaaatctccggaaagctcaaactcggcaaggaagtgctggccaccttggaaggccactgggactcagaagtttttatcaccgacaagaaaacagataactcagaagtcttctggaatcccacaccggacattaaacagtggagactcatcaggcacacagtgaaatttgaagaacagggagactttgaaagcgaaaaattgtggcaaagggtgactcgggcaatcaacgcgaaagaccaaaccgaggctacccaggagaaatacgtgcttgaagaagcccagcgacaggccgctagggataggaagaccaagaacgaggaatggtcgtgcaagttgttcgagctggatcccctcacaggcgaatggcattacaaatttgccgacacccggccttgggatcccctgaatgatatgatacaatttgaaaaagatggcgtgatccaaacaaaagttaagcacagaacccctatggtgagcgttccaaaaatgaaacataagccaacaaggcagcagaaaaaagtggccaaaggctacagcagtcctgagccagatatccaggacagtagcggcagcgaagcacaatcagttaaaccatccacgagacgcaaaaagggtattgagcttggagatattcagtcttctatagagtctattaaacagacacaggaagagattaagcggaatattatggctttgcgcaatcatctcgttagttcaacccctgccactgattattttctgcagcaaaaagattatttcatcatatttctcttaattctgctgcaggtcataatcaacttcatgtttaaatag

SEQ ID NO: 233797 - DNA, 2544 bp, Artificial Sequence
  Description of Artificial Sequence: Synthetic coding sequence
atgtcacagcggcaaggcaaggaagcctaccccactcccacaaaggacctgcaccaacctagcttaagccccgcttcacctcactcccagggttttgaacgcggaaaggaagacatctcacagaacaaggacgagtcatccctttccatgtctaagagtaagtcagagtctaaactgtacaacggaagtgaaaaagactcctccactagctcaaagttgacaaaaaaggagtcgcttaaagtccagaaaaaaaactatagagaagaaaaaaagcgcgcaactaaagagcttttgtctaccattaccgatccgtctgtcattgtgatggccgattggttgaaaattaggggaactctgaagtcttggactaagttatggtgtgtgctgaagcctggagtcctcctgatatacaaaacacagaagaatggccagtgggtgggaactgtgctgctgaatgcatgcgagattattgaaagacctagcaaaaaagacggattctgcttcaaactgttccatcccctagaacagtccatctgggctgtgaagggtcccaagggcgaggccgtgggatcgatcactcagccattgcctagttcatatttgattattcgcgcaacttccgaatcagacggaaggtgctggatggatgctttagagcttgcactcaagtgcagctctttgcttaagaggacaatgatcagggagggaaaagaacacgacctgtcggtgagttcagacagtacccacgtcaccttctacggcctattaagagcaaataatctccattctggcgacaactttcagttgaacgactccgaaatagaacgccagcacttcaaggatcaggatatgtattcagacaagagtgacaaagagaatgatcaagagcacgacgagtcagacaacgaggtgatgggcaagtctgaggaaagcgacaccgatacgtctgaaaggcaggatgactcatacattgagccagagccagtagaacccctcaaagagactacttataccgaacagtcccatgaggagctcggtgaagctggagaggcgtcccagactgagaccgtcagtgaagaaaacaagtcattgatttggacactccttaaacaggtcagacccggaatggatctgagcaaggtggtgctccccacttttattctggagcctcggagttttctggataaactcagtgactattactaccatgcagatttcctctcagaagctgcacttgaggaaaacccgtacttcaggttgaagaaggtagttaagtggtacctgtcaggcttttataagaagccaaagggcctcaagaaaccatataacccaatactcggggagactttccgctgcctgtggattcatccacgaaccaactctaagaccttttatatagccgagcaagtgtcccatcatcctcccatttctgctttctacgtgagcaatcggaaggatgggttctgtctcagtggttctattctggcaaaaagcaaattttacggtaactccctgagcgccatccttgaaggggaggctagacttacttttcttaaccggggtgaagattacgttatgactatgccttatgcccattgcaagggtatcctttacgggactatgacactggaactcggcggaaccgttaacattacctgtcaaaaaaccggctactcagccatcctcgaattcaagttgaagccttttcttggctcgtcagattgcgtgaatcagatctctggaaaactaaaactggggaaagaagtgttagcaactctggaagggcactgggactccgaggtgttcatcacagacaagaaaacagataactcggaagtattttggaatcccacgccggatataaaacaatggcgacttatccggcataccgttaaattcgaggaacagggagatttcgagagcgagaaactttggcaacgggtgacgcgggcaatcaacgcgaaggaccagaccgaggctactcaagagaagtatgtgctagaagaggcacagcgtcaggctgcacgcgatcgcaagacaaagaatgaggagtggagctgtaagctcttcgaactcgaccccttgactggtgagtggcactataagtttgccgataccaggccttgggacccactcaacgacatgatccagtttgaaaaagacggggtgatacagaccaaagtgaaacacaggaccccgatggttagcgttcctaaaatgaaacacaagccaacccgccaacagaagaaagttgctaaaggttattcaagccccgaaccggatatccaggatagctcagggagcgaggcgcagagcgtgaaaccaagcacacgaaggaagaaggggatcgaactgggagatatccaatcttctattgagtcaatcaagcaaacgcaggaggagatcaaaaggaatatcatggccctgagaaatcacctggtgagttccacgcctgctaccgactactttctgcaacagaaagattacttcataatattcctgctgatactgctgcaggtgataattaattttatgttcaaatag

SEQ ID NO: 233798 - DNA, 2187 bp, Artificial Sequence
  Description of Artificial Sequence: Synthetic coding sequence
atggagggagggttagccgacggggagccggaccggacttcccttctgggcgactccaaggacgtcctcgggccttcgactgtggttgccaactcagacgagtcccagcttcttaccccagggaagatgtcgcaaaggcagggtaaggaagcctacccaacaccaacaaaagatctccaccaaccgtctctctcacctgcgagccctcacagccagggattcgaacgaggcaaagaggacatcagccagaacaaggacgagtcttccctatctatgtctaaatctaagtctgaaagcaagctgtacaatggtagtgagaaggatagcagcacttcttccaagctgactaagaaggaaagtctgaaagttcagaagaagaattatagagaagagaagaaacgtgcaacaaaagagctcttgtcgactatcacagacccgagcgtaatcgttatggcagactggctaaaaatcagagggaccctgaaaagttggacaaagttatggtgcgttctgaagcctggtgtgctgctcatctataaaacacagaaaaatggccagtgggtgggaactgtgttactgaatgcgtgcgagatcatcgagcggccatcaaagaaagacggcttttgcttcaaactcttccaccccctggaacagtctatctgggccgtgaaaggaccaaaaggagaagccgttggaagcatcacacagccgttgccatctagttaccttatcataagagcaacctcggaaagtgatggcaggtgctggatggacgcgctggagttggcactcaagtgtagctccctgttgaaacggactatgatcagagaggggaaagaacacgacctgtctgtgtcgagcgactcaactcatgtcacgttttacggattactaagggcaaataatctgcactccggcgacaactttcaactgaacgattctgaaatcgaaagacagcacttcaaggaccaggatatgtattctgataaaagcgacaaagagaatgatcaggaacacgacgagtccgataacgaggttatggggaaatccgaggaatctgatacagacacctcggagcgccaggacgattcttacatcgagcccgagcctgtcgaaccgctcaaggagaccacatatacggaacagagtcacgaggagctcggcgaggcaggtgaagcctcccagaccgagacggtgtctgaagagaacaagtccctgatttggaccttgctgaagcaggtgagaccgggaatggacttgagcaaagtggtactcccaacattcatcctggaaccaagatcatttttagacaagttgtccgactactactaccacgcagatttcctctccgaggccgcactagaggagaatccctactttcggctgaagaaggttgtgaaatggtacctgtctggattttacaaaaagccaaaagggctgaaaaaaccttacaacccgattctcggggagactttcaggtgtttgtggatccaccctagaaccaattccaaaaccttctacatagccgagcaagtgagccaccatccaccaatctctgctttctacgtctccaatcgtaaagacggcttttgcctgtcaggcagtatactagccaagagcaaattttacggaaactcattatcagctatattggagggggaggccaggttgacattcctgaatagaggggaggattatgtgatgaccatgccctacgcacattgcaaaggaatcctgtacggaaccatgacattggaattaggcggaaccgttaatattacctgccagaagaccggttattccgcaattctcgaatttaagctcaagccatttctggggtcgtccgactgcgtgaaccagatcagtgggaagctgaagctggggaaggaagtgctggctaccttggaaggtcattgggattctgaggtatttattaccgacaagaaaacggacaactctgaagtattttggaatcccacgcctgatatcaagcaatggcgcctgatccgtcatactgtgaaatttgaggagcagggagactttgagtccgaaaaactgtggcagagggttacccgcgctatcaatgcaaaagaccagaccgaggcaacgcaggagaagtatgtcctggaggaggcccagaggcaagccgcaagggatcgtaagaccaagaacgagaagaagaaatag

SEQ ID NO: 233799 - DNA, 2625 bp, Artificial Sequence
  Description of Artificial Sequence: Synthetic coding sequence
atggaaggcggtttggcagacggtgagccagaccgtaccagcgctaacagtgatgagtcccagctactgaccccgggaaagatgagtcagcgtcagggcaaagaggcgtatcctactcctactaaggacctgcatcagccatcattatcaccggcttccccacactctcagggattcgaaagaggaaaagaagacatctcccagaataaagatgagtcaagtttgagcatgtctaagtctaaaagtgaaagcaagctgtataacggcagtgaaaaagactcctcgacaagctctaagcttacaaaaaaagagtcactcaaggtgcagaagaagaactatcgagaggaaaagaaacgggctaccaaggagttgctgagcaccatcacagatccatctgtgattgtgatggcagattggctaaagatccgcggaactctgaagtcctggactaagttgtggtgcgtgttaaagcccggagttctactgatctacaaaactcagaaaaacggtcagtgggtcgggaccgtactccttaacgcttgcgaaatcattgagagaccttccaaaaaagatgggttctgcttcaaactcttccatccactggaacagagcatttgggccgtgaaaggtcccaagggcgaagccgtaggaagcatcacgcagcccctcccttcaagttacctgattattcgggctacatcagaatccgatggacggtgctggatggatgccctcgaactcgctctgaaatgctcctccctgctaaagcgcactatgattcgtgagggaaaggagcacgatttgtcggtgtcttcagattctacccatgtcactttctacggacttctgcgcgcaaataacctgcacagcggcgataacttccagttgaatgactccgaaattgaaaggcagcattttaaagaccaggatatgtattccgacaaaagtgacaaagagaacgaccaggagcacgacgagtccgacaacgaagtgatgggcaagtcggaggaaagcgataccgatacaagcgaaaggcaggatgattcctacatcgagccggagcccgtggagcctctcaaagagacgacctacacagaacagagccacgaagagcttggggaagcgggtgaagccagccagaccgaaacagtttctgaagagaataaaagtctcatctggacgctgttaaaacaggtgaggcctggtatggacctgtcaaaggttgtactgcctacatttatcctggagccgcgaagcttcctcgataaattgagcgactactactatcatgctgacttcctctccgaggctgctctcgaggagaacccttattttaggcttaagaaggtggttaagtggtatctgtcagggttctacaagaagcccaaaggactgaagaagccatacaatcctatcctgggagagacattcagatgcttgtggatccatccgagaacgaactcaaaaaccttttacatcgctgaacaagtgtctcaccatcctcctattagtgccttttacgtatctaatagaaaggatggattctgtctgagcggctcgatcctcgcgaagtccaagttttacggcaatagcctgagcgcaatcctcgagggagaagccagactgacattcctcaatcgtggggaagactacgtcatgacaatgccttacgcccattgcaaaggcatattgtatggaaccatgacgctcgagctcgggggaaccgtgaacattacgtgtcagaaaactggttattccgcgatcctggagttcaagctcaagccgttcctcggcagctctgactgtgtgaatcagatttcagggaagctgaagctgggcaaggaagttcttgcgacactagaagggcattgggattctgaagtatttataaccgacaagaagaccgataacagtgaagtgttctggaatcccacgccagatatcaaacagtggagactaattagacataccgtgaaatttgaagagcagggggattttgaatccgaaaaactgtggcagcgggtgacgcgtgcgataaatgccaaggatcagactgaggcgacacaggaaaaatatgtactggaagaagcccaaagacaagcagcacgggaccgtaagacaaaaaacgaagaatggtcttgcaaactgtttgagctggatccactgactggggagtggcactataaatttgccgataccaggccttgggaccccctaaatgatatgatacagtttgaaaaagacggcgtgatccagaccaaagtaaaacatagaacacccatggtgtccgtgcctaagatgaaacataagccaaccaggcagcagaagaaagtggctaaaggatattcatccccggagcctgatatccaggattcttccggaagcgaggcacaatctgtgaaaccaagcacacggagaaagaagggcatcgaactgggcgacattcagtcatctattgagagcatcaagcagacacaggaagagattaagagaaatattatggctctacggaaccatctcgtgagcagtacccccgcaacagactactttctccagcagaaagactattttatcatctttctgctgatcctgctgcaagtgataattaacttcatgtttaagtag

SEQ ID NO: 233800 - DNA, 162 bp, Artificial Sequence
  Description of Artificial Sequence: Synthetic coding sequence
atggagggcggattggctgatggcgagcccgatcgcacctctcttctgggtgattctaaggatgtactggggccatccactaatagcgatgaatctcagttactcacgcctggcaagatgagtcagcggcaaggaaaggaggcctacccaaccccaacatag

SEQ ID NO: 233801 - DNA, 231 bp, Artificial Sequence
  Description of Artificial Sequence: Synthetic coding sequence
atgtcacaaaggcagggtaaggaagcttacccgacaccaaccaaggaccttcaccagccatcattgtcacctgcgtccccacacagtcagggcttcgagaggggtaaagaagacatttcccagaacaaagacgagtccagtctctctatgagcaaaagcaaatccgagagtaagctctacaatgggtcggagaaggactccagcacttcgtcaaaattaacgaaaaaatag

SEQ ID NO: 233802 - DNA, 177 bp, Artificial Sequence
  Description of Artificial Sequence: Synthetic coding sequence
atggagggcggactcgcggacggggagccagaccggacatcgttgctcggtgactctaaagatgtcctcggtccatccactgtcgtagctaatagcgacgaatctcagctgctgacccctggcaaaatgagccagcggcagggaaaggaggcctatcctacaccaacgaaggattag

SEQ ID NO: 233803 - DNA, 336 bp, Artificial Sequence
  Description of Artificial Sequence: Synthetic coding sequence
atgagtcagagacagggtaaagaggcttaccccacgccaactaaagatctgcatcagccatcactgtcacctgcctccccacattcgcagggcttcgaacgcggtaaggaggacatcagccagaataaggatgaaagcagcctgagcatgagcaagtctaaaagtgaaagcaagctatacaacggttccgaaaaggatagtagcacttcttctaaattgactaagaaagagagtctgaaggtgcagaagaagaattaccgcgaggagaagaagcgcgctaccaaagagcttttgtctacgattactgatcccagcgtcattgtgatggcggactag

SEQ ID NO: 233804 - DNA, 2226 bp, Artificial Sequence
  Description of Artificial Sequence: Synthetic coding sequence
atgccctaccgacgggtgacctctggtcgcctgctgtcacttgccgctccaaaaatggcctccatcatggagggcccactgagcaagtggaccaacgtgatgaagggctggcagtaccgctggttcgtgctggactacaatgccggtctgctctcatattacacctcaaaggacaagatgatgagagggtcacgcaggggctgtgtcagactgcgaggagctgtcattggaattgatgacgaggacgatagcacatttacgatcacagtcgatcagaaaacgttccactttcaggcccgtgatgcagacgagagagaaaaatggatccacgctcttgaggagactattcttcgccacactctgcagctgcagggcctagacagcggcttcgtgccaagtgttcaggattttgataagaaacttacagaagcagatgcgtatttgcagatcctaattgagcagctcaagctgttcgatgacaagttgcagaactgtaaagaggacgagcagcgcaagaaaatcgagacactgaaagagacgaccaacagtatggtggagtcaattaagcactgcattgtgctcctccaaattgccaagtctacaattaatccagtggacgccatctaccaaccaagtccccttgagcccgtaatttcaaccatgccctcacagacagtcctgccaccggagccggtgcaattgtgcaagagcgagcagcggccttcatccctgcctgtcggacctgtgttggccacgttgggccaccaccagaccccaacacccaactctacaggctcagggcactctcccccttcttctagcttgacatcgccctcccacgtaaacctgagccctaataccgtgcctgagttttcctacagcagctctgaggatgaattttacgacgcagacgaatttcaccagagcggcagttctcctaagcggctcattgattccagcggaagtgcctctgtactaacccacagttccagtgggaatagccttaagcggccagacaccacagagtcattgaattctagcttgagcaatggcactagtgacgctgacctgttcgattcccatgatgacagggatgacgatgccgaggcaggcagtgtggaagagcacaaaagcgttatcatgcacctgttgagtcaggtgcgactaggcatggatctcaccaaggtggtgcttcctactttcatattggaaaggcggtcactccttgagatgtacgccgatttctttgctcacccggatcttttcgtgtctatttcggatcagaaagatccaaaagacaggatggtacaggtcgtgaaatggtatctgtccgcctttcacgctggtcgaaagggaagtgtcgccaagaaaccatataacccgatcctgggcgagatcttccagtgccactggaccttgcccaatgatacggaggaaaacacagagctggtgtccgagggtcctgtcccgtgggtgtcaaagaattctgtgacattcgtcgcagagcaggtcagccaccatcctcctatcagtgccttttacgcagagtgcttcaacaagaagattcagtttaatgcacatatttggacgaagagtaaattcttgggcatgtccatcggcgtgcacaatatcgggcagggatgcgtgtcttgtctcgactacgacgaacattacatactgacctttcctaacgggtatggtaggtctatcctgactgtaccatgggtcgagctgggaggcgagtgtaatatcaattgcagcaaaaccggttacagcgctaacataatatttcacactaaaccattctacgggggaaaaaaacaccgcatcacagctgagattttcagccccaatgataaaaaatcattctgctcgatagagggcgagtggaacggcgtgatgtacgctaaatacgcaactggcgagaacactgtcttcgttgataccaaaaaactgccaattataaagaagaaggtgagaaagctggaggatcagaacgagtatgaatcaagatccttgtggaaagatgttacgttcaacctgaagattcgcgatattgacgctgccacagaagcaaagcacagattggaggaacggcagagggccgaggcgagagaacggaaggaaaaggagattcagtgggaaacacgtctgttccacgaggacggagaatgctgggtgtatgatgagcccttgctgaagcgcttgggggcagccaagcactag

SEQ ID NO: 233805 - DNA, 1881 bp, Artificial Sequence
  Description of Artificial Sequence: Synthetic coding sequence
atggccttcctcctggccacctgcggaggtttggatagtggatttgtcccttcagtgcaggactttgacaagaagcttaccgaagccgacgcatatctgcagatcctgatcgagcaattaaaactcttcgacgacaagctgcagaactgcaaggaggatgagcagagaaaaaaaatcgagaccctgaaggagacaacaaactccatggtggagagtatcaaacattgtattgtactccttcagattgctaaaagcactataaacccggtagacgccatttaccaaccctcacctttggagcctgttatctcgacaatgcccagtcaaactgtattaccccctgaacccgttcagttatgcaagtcagagcaaaggcctagttccctccctgtgggcccagttctggccacacttggccaccaccagacaccaacgcctaacagcactggatcagggcacagcccgccatccagttccttgacctcacccagtcacgttaatttgagcccgaacaccgttcccgagttcagctattcaagctcagaggatgagttttatgacgccgacgaatttcatcagagcggatcctcccctaagagattgatcgattccagcggctcagcttccgtcctaactcacagtagctctggcaactccctgaaaaggcccgacactactgagtccctaaacagcagtctgtccaatggcacatctgacgccgacctttttgatagccacgatgacagagacgatgacgctgaggccggttcagtggaagagcataagagcgtcattatgcatttgttatctcaggtgcgcctcggaatggacctgacaaaggtagtcctcccgactttcattttggaaagacgctcactactcgagatgtacgcagacttctttgcccacccagatctcttcgtctccatctccgatcaaaaggatcctaaagatcgaatggtacaggtggtaaaatggtacctaagcgcctttcacgccggtcgaaagggatccgtggctaaaaaaccctacaaccctattctgggggagatattccagtgtcactggaccctccccaacgacaccgaagagaatacggaacttgtttcagaggggcctgtgccctgggtgagtaaaaacagcgttacatttgtcgccgagcaggtatcccaccatccacctatttcagcattctacgcagaatgcttcaacaagaaaatacagtttaacgctcacatctggaccaaatccaaattccttggaatgagcatcggggtacacaacattggacagggctgcgtgagttgtctggattatgacgaacattacattctcacatttccaaatgggtatggaaggtccatcctaactgtcccatgggtggaactgggcggagagtgtaatataaactgttcaaagactgggtactcagctaacatcatctttcacacaaagcccttttacggaggaaagaagcaccgcattaccgccgagatcttctcacctaacgataagaagtccttttgtagtatcgagggtgaatggaatggagtgatgtacgcgaagtatgccacaggggaaaacactgttttcgttgacacaaagaaactgcccattattaaaaaaaaggtccgcaagttggaggaccagaacgagtacgagagtaggtccctatggaaagatgttacattcaatctaaaaattcgggacattgatgcagcaaccgaggctaaacaccgactcgaggagcgccagcgggctgaagcacgggaacggaaggaaaaagagattcagtgggagacccgcctctttcacgaagacggagaatgttgggtttatgacgagcctctgctcaagagattaggagccgcaaagcactag

SEQ ID NO: 233806 - DNA, 2265 bp, Artificial Sequence
  Description of Artificial Sequence: Synthetic coding sequence
atgccatatcggagagtcaccagtggacggctgctgtcactggctgcgccaaagatggcctcgataatggaagggcctttgtccaagtggactaacgtgatgaagggatggcaataccgctggtttgtgctggactacaacgccggattattgagttactatacatccaaagacaaaatgatgagggggtctagacggggatgtgttaggctacgaggcgcagtgatcgggattgatgacgaggatgatagcacctttacaatcacagtggaccagaaaacgttccacttccaggccagggatgccgatgagagagagaaatggattcatgctctcgaggaaacgattctgaggcacacattacagcttcagggcctcgatagcggatttgtccccagcgtgcaggattttgacaaaaaactgacagaagctgatgcctatctgcagattttgatcgaacagctgaagctattcgatgacaaactccagaattgcaaagaggacgagcagcggaaaaagatcgagaccctgaaagaaactactaatagcatggtggagtccattaaacactgtattgtgttacttcagattgccaaagatcaaagcaacgccgagaagcatgctgacggtatgatcagcacgattaaccccgtggatgccatctaccagccttctcctctggagcccgtcattagcacaatgcccagtcagacagtcctgccccctgaacccgtgcaactgtgtaaaagcgaacagcgtccaagctcactgccggtcggaccagtactcgcaacgttggggcaccaccaaactcctacgcccaatagcactgggagcggacacagtccaccgagctcaagcctcacctcaccgtcacatgtgaatctctccccaaatacggtgccagaattctcatattcgtcgagtgaagacgagttctacgacgccgacgagtttcaccagtccggatcctcccccaaaaggctgatagacagctccggatccgcgagcgtgctgactcactcctcatcaggaaactccctaaaacggcctgacacaaccgaatccctcaattctagcctttccaacgggacctctgacgccgatctgttcgatagccacgatgacagagatgatgacgctgaagccggatctgttgaggagcacaagtccgtcataatgcacttgttgtcccaggtgcgcctgggaatggatttgacaaaggtggtgctgccaacttttattctcgagcgacgttccttgttggaaatgtatgccgatttctttgcgcaccctgacctgtttgtgtccatatctgatcagaaagacccaaaagaccgaatggtccaagtggtgaagtggtatttatccgcttttcacgccggtcggaagggctccgtggctaaaaagccttataacccgattctgggagagatcttccaatgtcactggacacttcctaatgacacggaggagaacacagaactggtaagcgagggaccggtgccctgggtcagcaagaattcggtgaccttcgtcgccgagcaggttagccaccaccctccgattagtgccttttacgcggaatgctttaacaagaagattcaatttaacgcccatatctggaccaagtctaagttcctgggaatgtctattggtgttcacaatataggccagggttgcgtgtcttgcctggattacgacgagcactatattctaaccttccccaatggatatggcagaagcattcttacggtaccgtgggtggaacttggcggtgagtgcaacatcaattgttcgaagactggatactccgctaacatcatttttcacaccaaacccttctacggaggcaagaagcatagaatcacagcggaaattttttcacctaacgacaagaaaagtttttgcagcattgagggagagtggaacggcgtgatgtacgccaagtatgcaacaggcgagaacactgtgtttgtggacaccaagaagttgcctatcattaaaaagaaagtaagaaagcttgaagatcagaatgaatacgagagccggtccctgtggaaagatgtcacatttaacctaaagatccgagatattgatgcagccacagaagccaaacatcggctggaggagcggcaacgggcagaggcgagagagagaaaggaaaaagagattcaatgggaaacacggctgtttcatgaagatggtgaatgttgggtctatgacgaacctctgctgaagaggcttggggctgctaaacactag

SEQ ID NO: 233807 - DNA, 2172 bp, Artificial Sequence
  Description of Artificial Sequence: Synthetic coding sequence
atggcctctataatggagggaccgttgagcaagtggaccaacgtgatgaaggggtggcagtatcgctggttcgtgctggactataatgccggactgctcagctattataccagcaaagataagatgatgcggggatccaggaggggttgtgttaggttgaggggagcggtgattggcattgatgacgaggacgattccacgtttaccataactgtagatcagaaaaccttccactttcaggcgcgagacgctgacgagagggagaagtggatacacgcccttgaggagactattttgcgccacacactacagctccagggcctggacagcggctttgtgcctagcgtgcaggacttcgacaaaaagttaactgaggctgacgcatacctgcaaattctgatcgaacagctgaaactctttgatgataagctgcagaattgtaaggaggatgagcagcgtaaaaaaattgaaacacttaaagagacaacgaactcaatggtcgagagtattaagcactgcatagtcttactccagatcgccaagagcaccattaatcccgtggacgcaatttaccaaccctccccactggaacctgtgatctccactatgccatcacagacagtcctgcccccagagccagtgcagctctgtaaatcggaacagcgccctagttccctacccgtgggcccagtgctcgctaccctgggccaccaccaaacaccgactcctaacagcaccggttccggccatagcccaccaagctctagcttaacaagcccctctcatgtgaatttgagtcccaatacagtccccgagttttcatatagctcttctgaggacgaattttacgatgccgatgagtttcaccagtctggttcttcaccaaaacgcttaatcgactcttcaggaagtgcgtccgtgctgacacattcgagctctggaaatagccttaaaaggccagacacaactgagtctctgaatagcagcctttcgaacggcacgagcgatgccgacctgtttgacagccatgacgaccgtgatgacgacgctgaagccggatccgtggaagaacataaatccgtgatcatgcacttgctgtcacaggttcggcttgggatggatctcacaaaggtcgtgctgccgacattcattctggagagaaggtccctcctggaaatgtatgccgattttttcgctcaccctgatctgtttgtgagcatttcagaccagaaggatcccaaggacagaatggtgcaagttgtgaagtggtacctgagtgcctttcacgccggtagaaaaggtagtgtcgccaagaaaccatataaccctatcctgggagaaatttttcagtgtcactggacccttcccaacgacaccgaggaaaacacggaactggtcagtgagggtcctgttccctgggtgtccaagaactcggtgacttttgtggcagaacaggtgtcccaccatccccctatttcagccttctatgcagaatgttttaacaaaaagatccaattcaacgcccacatctggacaaagtccaagttcctgggtatgtccattggcgtccacaatataggacagggatgcgtcagttgtctggattatgatgaacattatattctaacttttcctaatggttatggcaggagcattcttacggtgccctgggtcgagctggggggtgaatgcaacataaattgctccaaaacagggtactctgcaaatataatttttcacaccaaacccttctacgggggtaagaaacaccgcatcacagctgagatcttctcaccgaatgataaaaaaagcttttgctccatcgagggcgagtggaacggcgtcatgtacgctaaatatgccacaggcgaaaatacagtgtttgtggacacgaaaaaactgccgatcattaaaaaaaaggtgcggaagctggaagaccaaaacgagtacgagagcaggtccctgtggaaagacgtgaccttcaaccttaaaatacgcgatattgacgcagcaactgaggcaaaacaccgccttgaggaacgtcagcgcgcagaagccagagagaggaaagagaaagagatccagtgggagacacggctgttccatgaagatggcgagtgctgggtgtatgacgaacccctccttaagcgactgggagccgcaaaacattag

SEQ ID NO: 233808 - DNA, 2211 bp, Artificial Sequence
  Description of Artificial Sequence: Synthetic coding sequence
atggcatccattatggaagggccattatccaagtggacaaatgtgatgaagggctggcagtatcgctggttcgtcttagattacaacgcaggcctgctgagttactatacgtctaaagataagatgatgcgaggaagccgccgaggctgcgtgcggctgcgaggggctgtaatcggaatagacgatgaggacgactccacattcaccattacagtcgaccagaagacatttcactttcaggccagggatgcggatgaaagggagaaatggatacacgccctcgaggaaacgatcctccgacacactctgcagttacagggccttgatagcggcttcgtccctagtgtacaagattttgacaaaaagctaacggaagccgatgcttacctgcagattctgatcgagcagctcaaactgtttgacgataagctacagaactgtaaggaagatgagcaacggaaaaaaattgaaactttgaaagagacaactaatagcatggtggagtcaatcaaacactgtatcgtgcttctgcagatcgccaaggaccagagcaatgctgagaaacacgccgacggcatgatatccactattaacccagttgatgccatttatcagcctagccctcttgagcccgtcatcagcaccatgccatctcagacggtcctccccccagagcccgttcagctgtgtaagtccgaacagaggccatcttcgctacccgtgggtccggtgctcgccactctggggcatcaccagactcccacgcccaacagcactggctccgggcacagcccaccgagtagcagtctgacctcaccctctcacgtcaatttatcacctaacacggtgccagaattttcttattcctcttcagaagacgagttctatgatgcggatgaattccaccaatccgggagcagcccaaagagattgatcgatagctcaggcagtgctagcgtcctgactcattcaagctcagggaacagcctgaagcggcctgacacaacagaatctctaaattcgagtctcagcaatgggacttctgacgccgatctctttgactctcatgacgacagagatgatgacgctgaagccggttccgttgaggagcataagtcagtcatcatgcatcttctcagccaggtgaggctggggatggatctgaccaaggttgtgcttcccaccttcatattggaaagaaggagcctgcttgaaatgtacgccgacttttttgcccaccccgatttgtttgtgtctatctcagaccaaaaagacccaaaagacaggatggtccaggtcgttaagtggtacctctctgcattccatgctgggaggaaggggagcgtggcaaaaaaaccgtacaaccctatacttggggaaatctttcagtgccattggacgctcccgaatgataccgaagagaacacagagctggtgtctgaaggacccgtaccttgggtctccaagaatagtgtcacatttgtggccgagcaggtgtcacatcaccctccgattagcgccttctatgctgagtgctttaataagaagatccagttcaacgcccacatctggacaaagtctaaattcctagggatgagtatcggcgtacataatattggacaggggtgcgtttcttgcctggactacgacgagcattacatccttacctttccaaacggttatgggagaagcatactgaccgtcccatgggtggagttgggaggcgagtgcaacatcaattgcagcaaaactgggtattccgccaacattatattccacaccaagccgttctacggaggcaaaaaacatcgtattacagccgagatattctcacctaatgataaaaagagtttttgctctatagaaggtgaatggaatggggtaatgtacgcgaaatacgccaccggagaaaatacagtgtttgtggacactaaaaaattgccaataataaagaagaaagtgagaaaattggaggaccagaacgaatacgaatcgagatctctgtggaaggacgtcacctttaatctgaaaattcgagacattgatgccgcaacagaagctaagcataggcttgaggagcgccagcgtgccgaggcccgagagcgaaaagagaaagagattcaatgggagacgcgcctgtttcacgaggacggcgaatgctgggtgtatgacgagcctctgctcaaaaggcttggtgctgctaagcactag

SEQ ID NO: 233809 - DNA, 1716 bp, Artificial Sequence
  Description of Artificial Sequence: Synthetic coding sequence
atggtagagagcattaagcactgcatcgtgctgctgcaaatcgcaaaagaccagtccaatgcagaaaagcatgcggacgggatgattagcaccatcaatccagtggatgcgatatatcagccctcccccctggaaccagtaatcagcaccatgccaagccagacagtccttcctcctgagcccgttcagctatgcaaaagcgaacagagaccttcaagcctgcccgttggtccagtgctcgcaacactcggccaccaccagacgccaaccccaaatagcacaggaagcggccatagtcccccttcctcttcgctcactagcccaagccacgtgaaccttagtccaaacaccgtaccagagttctcctatagctcatcagaggatgagttttacgatgctgatgagttccatcagtccggttcgagcccaaagcgcctgatcgacagcagtggcagtgcttccgtgctgactcacagctcatctgggaactcgctgaagcgtcctgacactactgagtcactgaactcttcactttcgaacggtacaagcgatgcagatctgtttgatagccacgacgacagagacgatgacgccgaggccggatccgtggaggagcacaagtccgtgataatgcaccttctgtctcaggttcgcctgggtatggacctgaccaaagtcgtgcttccaacctttatcctcgagaggcgatctctattggaaatgtacgctgatttctttgcacacccagatctcttcgtctcaatcagcgatcagaaagatccgaaggatcggatggtgcaggttgtcaagtggtacctgtccgcttttcacgcgggtcgcaaaggaagcgttgctaagaaaccatacaacccgattctcggtgagatatttcagtgccactggacactccctaacgacactgaggaaaacaccgagttggtctctgaaggccctgtaccatgggtgtcgaagaattctgtgacctttgtggccgagcaggtctctcatcatccgcctatcagtgccttttacgccgagtgtttcaacaaaaaaattcagtttaacgcccacatatggactaaaagtaaattccttggcatgtccattggcgtacataatatcggccagggctgcgtgtcatgtctggactacgatgaacactatatcttgacctttcccaatgggtatgggaggtcgatcctcacggtgccttgggttgaactgggaggcgagtgcaatatcaattgttcaaagaccggctacagtgctaacatcatcttccacactaagcccttctatgggggaaaaaagcaccgtataaccgccgaaattttcagcccaaacgataaaaaaagcttctgctctattgagggagagtggaatggtgtcatgtacgccaagtacgcaacgggcgaaaatactgtcttcgtcgacactaagaagctgcccattattaagaaaaaggtgcggaagctggaagatcaaaatgaatatgagtctaggagtctgtggaaggacgtgacgttcaacttgaagattcgggatattgatgcagccacagaggctaagcaccgcctcgaagagcggcagagagctgaggcaagagagagaaaagagaaggagattcagtgggagacacggttgttccacgaggacggggagtgttgggtgtacgatgagccgcttttaaagcgtctgggcgctgctaaacactag

SEQ ID NO: 233810 - DNA, 2241 bp, Artificial Sequence
  Description of Artificial Sequence: Synthetic coding sequence
atggcctcaattatggaaggcccattgtccaagtggacaaacgttatgaaaggatggcaataccggtggttcgtgctggactataacgcgggacttttatcatactatacttcaaaggacaagatgatgagggggtcacgtcgagggtgtgtgcggctccggggagccgtgattgggatcgacgatgaggacgacagtacattcactattactgtagaccagaaaaccttccactttcaagcgcgagatgccgatgagcgggagaaatggattcacgccctcgaagagactattttaagacatacactgcaactgcagatctccacgactctggcctttttccagtccagcggaatttccccagtcttagagttttccaagatcattgggctggactcaggattcgtgcctagcgtccaggatttcgataagaaactgaccgaagccgacgcctatctccagatcctcatcgaacagctgaaactattcgacgataagctgcagaattgcaaggaggacgagcagaggaagaaaattgagactctgaaggagaccacaaatagcatggtcgaatcgatcaaacactgtatagtgctactgcagattgctaagtccacaattaatcctgttgatgccatttaccagccttcccctcttgaaccagtgatcagcaccatgcctagccagaccgtgttgccacccgaaccagttcagttgtgtaagtccgagcaacggcctagcagcctgcctgtgggcccagtgctggccaccctagggcaccatcagaccccgacacctaatagcacaggctccggtcattcaccaccgtccagctctctaactagtcctagtcatgttaatctgtcccctaacactgtaccggagttcagctattcttcctcggaagacgaattttatgacgcagatgagttccatcagtccggctcatcacctaaaagactgattgattcctcagggtctgcaagtgttctcacacacagcagttccggcaacagtctgaagcggcctgacaccaccgaatctctgaattcttccttgtctaacgggacatccgatgcagacttgttcgattcacacgatgatcgggacgacgacgcggaagccggtagcgttgaagaacacaaaagtgtgattatgcatttgctttcccaagtgcggctggggatggatctcacgaaggtggttctcccaacatttattctggagagacgaagccttctcgaaatgtacgccgatttcttcgcacatccagatctgtttgtgagcatatccgatcagaaggatcccaaggacagaatggtgcaggtcgtgaagtggtatctgtctgctttccacgccggtcggaaggggtctgtcgctaagaaaccgtacaatccaatcctcggcgaaatctttcagtgccactggactctacccaatgacactgaagagaacaccgaattggtatccgaggggcctgtgccctgggtctcaaagaactccgtcacctttgtggccgaacaggtctcccatcaccccccaatctccgccttctatgccgagtgttttaataagaaaattcagttcaacgcacacatctggacgaagtctaaatttctgggaatgtctataggcgtgcacaatatagggcaaggctgtgtgagttgtctggattatgatgagcactacatcttgacattccccaacggctacggcaggagcatcctgaccgtgccatgggtcgagcttgggggagagtgtaacattaattgctccaaaaccgggtattctgctaacatcatttttcataccaaaccattttatggcggaaaaaagcaccgtataacagccgaaatattcagcccaaacgacaaaaaaagcttttgcagcatcgaaggtgaatggaacggggtgatgtacgccaagtatgcaacaggtgaaaacaccgtgtttgttgataccaagaagttacctatcattaaaaagaaggtgcgcaaactcgaagaccagaatgagtatgagtcccgctcactgtggaaggatgttacattcaacttaaagatccgggacattgacgcggctaccgaggccaagcaccgcctcgaggaacgccagcgcgctgaggcacgggagcgaaaagaaaaagagatccagtgggaaactcggctctttcacgaggatggggagtgttgggtgtatgacgaacctttgctcaagaggctgggtgccgcaaagcattag

SEQ ID NO: 233811 - DNA, 2160 bp, Artificial Sequence
  Description of Artificial Sequence: Synthetic coding sequence
atggcgtctattatggaaggacctctgtcaaagtggaccaacgttatgaaggggtggcaatacaggtggtttgtgctggactacaacgcaggactgctgtcatactacactggtgctgtaattggaatcgatgacgaggatgactcaacattcaccattacagtggatcagaagacctttcattttcaggctagagacgccgatgaacgtgagaaatggatacatgccctggaggaaactatcctgcgccacacactacagcttcaagggctggattccggctttgtgccgtcggtgcaggactttgataagaagctgaccgaagccgacgcctaccttcagatcctgattgagcagcttaaactttttgacgataaactacaaaattgcaaggaggatgagcagagaaagaaaatagagactctgaaagaaaccaccaattccatggtggaatctatcaaacactgcatcgtactgctgcaaattgccaaggaccaatccaatgccgagaagcacgccgacggcatgatttccacaattaaccctgtcgatgcgatataccaaccctctcctctggaaccagtaatcagcacaatgccatcccagaccgtgctgcccccagagcccgtccagctgtgcaagtcggaacagcggccatcttctctgcctgtggggccagtcttggcaacccttggccatcaccaaacacctaccccaaactctaccgggtcaggccattcgcccccaagtagcagcctgacaagcccgagtcacgtgaatttgagtccaaatacagtcccagaattcagctatagcagttctgaagacgaattctatgacgccgacgaatttcaccaaagtgggtcttctccgaagcgcttaattgacagcagtgggagtgcctccgtcctcactcattctagctctggcaattcactgaaacgacccgatacaactgagagcctgaatagttcactgtccaatggcacttccgatgccgatctcttcgactctcacgatgacagggatgacgatgccgaggccggatcggtggaggagcataaatctgttatcatgcatctgctctcccaggttcgccttgggatggacctcacaaaggtggtgcttcccacgtttattttggaaagacggtctctcctggaaatgtacgccgacttcttcgcccacccagatctatttgtctccattagcgaccagaaggatccaaaggatagaatggtccaggtggttaagtggtatctttctgccttccacgctggaaggaaaggctctgtggccaagaagccctacaatcctatattgggggagattttccagtgccactggacactccctaacgataccgaagagaacacagaactggtgagtgaggggccagtgccgtgggtcagtaaaaactctgtgacattcgtggccgaacaggtgagccatcatccgccaatatccgccttctatgcggagtgtttcaataaaaagatccaatttaacgcacacatttggacaaagagtaaatttttgggtatgtctattggggtgcataacataggccaggggtgcgtttcctgtttagattacgacgaacactatatcctcacgttccctaatggatacgggagaagtatactgacagtgccctgggtggagctcgggggagagtgtaatatcaattgcagcaaaaccggctatagcgccaatattatcttccatacaaagccattctatggcggtaagaagcaccgcattacagcggagatattctcacctaatgacaagaaaagcttctgcagcatcgagggtgagtggaacggagtaatgtacgctaaatacgctacaggagaaaacaccgtattcgtagacacaaagaaactcccgattataaaaaaaaaggtgcgcaaactggaagaccagaacgaatatgaatcaaggtccctgtggaaagacgtcacctttaacctgaagattcgcgacatcgatgccgctaccgaggccaagcataggcttgaagaacgtcagagagccgaggccagagagcgtaaagagaaggagattcaatgggaaacccggttatttcacgaggacggggagtgctgggtgtacgatgagcctctcttgaaaagactgggagctgcaaagcattag

SEQ ID NO: 233812 - DNA, 1677 bp, Artificial Sequence
  Description of Artificial Sequence: Synthetic coding sequence
atggtggaatcaatcaagcactgtatcgtgctgttgcagatagcgaagtccacaattaaccctgtggacgccatctaccagccttctccattagaacctgttatctccacaatgccttcccagacggtgctgccgcctgagccggtccagctttgcaagagcgagcagcggccaagctctttgcccgttggacctgtgctggcaaccttagggcatcatcagacacccacaccaaactctaccggctctggacactcccctccctctagtagtctcacaagtccttcgcacgtgaatttatcacctaacacagttcccgagttctcttactcaagttcggaggatgagttttacgatgccgacgaattccaccagagcgggtcctctcctaaacgcttaatcgactcgtccggtagcgctagtgtgttgactcatagctccagcggaaactctttaaagaggcctgacacaacagaatcgctcaactcgagccttagtaatggaacctcggatgcggatcttttcgattcccatgacgaccgcgatgacgacgcggaggcaggctcagtggaagagcacaagagtgtaattatgcatctgctctctcaggtacgacttggaatggacctaacaaaagtcgtcctgccgacctttatcctggagagacggtcactgctggaaatgtatgcagactttttcgctcatccagatcttttcgttagtatatctgatcaaaaggatcctaaggatagaatggtacaggtggtgaaatggtatctgtccgctttccacgccggacgtaaggggagcgtggctaaaaagccgtataaccctattttgggggaaatttttcaatgtcattggacactgccaaacgatacggaggagaataccgaattagtgtccgaaggcccagtgccttgggtgtccaagaactcggtaacctttgttgccgagcaggtgagtcaccacccaccgatctcagcattttatgccgagtgcttcaataagaagattcagtttaacgcgcacatctggaccaagtccaagtttcttggcatgtctatcggcgtccacaatattggccagggttgtgtatcatgcctggactatgacgagcattatatcctcacatttcccaacggctatggtaggtcaatcttgaccgttccatgggtcgaacttgggggagagtgcaacattaattgctcgaaaaccggatactctgcgaatatcatctttcacaccaagcctttctatggcggaaaaaagcaccgtattactgctgaaatattctcccctaacgacaaaaaatccttttgctccatagagggagagtggaatggggtgatgtatgccaaatatgcgacaggagaaaacactgtgttcgtggacactaaaaagctcccaattattaagaaaaaggtccgtaagctagaggatcagaatgagtacgaatctaggtccctgtggaaagacgttacatttaacctgaagattagggacatcgacgcagccactgaggccaagcaccggctcgaggaaaggcagcgagcggaggccagggagaggaaggaaaaggagatccagtgggaaacacgattgttccatgaagatggagagtgttgggtgtatgatgaacctcttctgaaaagactgggcgcagcaaagcactag

SEQ ID NO: 233813 - DNA, 99 bp, Artificial Sequence
  Description of Artificial Sequence: Synthetic coding sequence
atggtggagagtatcaaacactgcatcgtgcttctgcagatagcgaaggatcagtcgaatgcggagaaacacgcggacggtatgatcgtatccctatag

SEQ ID NO: 233814 - DNA, 1677 bp, Artificial Sequence
  Description of Artificial Sequence: Synthetic coding sequence
atggtggaatctatcaagcactgtatagttttattacagattgctaagtccacaattaatcctgtggatgcaatttaccagccgtcccctttagagcctgtaatctccactatgccctcacagaccgtgttgccaccagaaccggtccagctgtgcaagtcagaacagcgcccatctagcctgcccgtagggccagtgctcgctacacttggccatcaccagacgcctacccctaattctaccggaagcggccatagtccaccatcctctagtctaacctcaccaagccacgttaacctctcccccaacaccgtgcctgaattctcttacagttcctctgaagacgagttttacgatgccgatgaattccaccagtcaggctcaagccctaaacggctcattgacagctccgggagcgcgtctgtactcacccactccagttccgggaactcgcttaagcgccctgacaccacagagtcactcaactctagcctcagcaatggaacaagcgacgctgatctcttcgatagccacgacgaccgggacgacgacgccgaagccggtagtgttgaagaacacaaaagtgtgattatgcacctcctttcacaggttcgattaggaatggatttgaccaaggtagtgcttccaacttttatcctagagcggcgatcactgctggagatgtacgcggattttttcgcccatccagacctgttcgttagcatctctgaccagaaagacccaaaggataggatggtccaagtcgtaaagtggtacctatcagccttccatgcaggtcggaaagggagcgtcgccaagaaaccctataaccctatattaggggagatttttcagtgccattggacgctgcccaacgataccgaagagaacactgaattggtgagcgagggacccgttccatgggtcagtaaaaattccgtcacgttcgtggccgagcaggttagtcaccatcccccaatttcagccttctacgccgaatgcttcaacaaaaaaatccagttcaacgctcatatctggaccaagtcaaagtttctaggcatgagtattggcgtccataatattggacagggttgtgtgtcttgccttgattacgacgaacattacattttgacgttccccaacggttacggccgatccatcctgactgttccttgggttgaactgggcggtgaatgcaacataaactgctctaaaacgggttattctgccaatattatcttccataccaagcccttctatggcggaaagaaacacaggatcaccgcagagatcttcagccccaacgacaagaaatcattctgctccatcgagggggagtggaacggagtgatgtatgccaagtatgctacaggcgagaacactgtgttcgtcgatacaaaaaaactcccaatcatcaaaaaaaaggtgcggaaactagaggaccagaacgaatatgagtcccgaagcctgtggaaggacgtgacatttaatttgaaaattcgggacattgacgccgctactgaagctaagcaccggctggaggaaagacagcgcgctgaggctagggagagaaaagaaaaagaaattcagtgggagaccagactctttcacgaggacggtgagtgctgggtgtatgacgagcctttgctaaagcgcctcggtgcggcaaagcactag

SEQ ID NO: 233815 - DNA, 1968 bp, Artificial Sequence
  Description of Artificial Sequence: Synthetic coding sequence
atgggctgttgctgttgttggctcgtctttactgaagctcgggatgccgacgagcgggaaaagtggatccacgcactcgaagaaaccatcctgcggcacacactacagctgcagggcttggacagcgggttcgtgccctccgttcaggattttgataagaaactgacagaggccgatgcttacctgcagattttgatcgagcaactgaagctctttgacgacaagttacagaactgtaaagaggatgagcagcggaagaagattgagaccttaaaggaaacgactaacagcatggtggaatcaataaaacactgcattgtgttgcttcagatcgcgaagagcaccattaatccagtggacgctatataccaaccctctcccctggagcctgtcatctcaacaatgccatcccagactgtactccccccagagccagtacagctgtgcaagtctgaacagcgcccttcctctctgccagtcgggccagtactggccaccctcggtcaccaccagacgccaacaccaaatagcaccggatctggacacagtccaccctcaagctctttgacgtccccttcccacgttaatctttctcccaacaccgtcccagaattctcgtatagttcatccgaagacgagttttacgacgccgatgagtttcaccagagtggttctagtcccaaaagacttatagacagttccggatccgcctccgttctgacccactctagttccggcaacagtttgaagaggccggatactaccgaaagcctcaactcgtctttgagtaacggcacatctgatgctgacttgttcgactcgcacgacgatcgcgatgacgacgcagaggctgggtccgtggaagagcacaagagcgtgatcatgcatcttctgagccaagttcggctggggatggatctcactaaagtggtgcttcccactttcattttggagagacggtccctactggagatgtacgccgatttcttcgctcatcctgacctgtttgttagcatatcagaccagaaagaccctaaagaccggatggtacaagttgtgaagtggtatctgtccgccttccatgcagggagaaaaggctctgtggccaaaaagccatacaatcctatcctgggggaaatattccaatgtcattggactctacccaatgataccgaagagaataccgagctagtgtcagaagggccagtgccatgggtgtcaaagaatagcgtcacattcgtggctgagcaggtcagtcatcacccaccaataagtgcgttctacgcagaatgtttcaacaaaaagatccagttcaatgcacacatttggaccaaatccaagtttctaggcatgtcaataggggtccacaatattggccagggatgtgtttcttgtctggactatgatgaacattacattttgacattccccaacgggtatggaagatctatcctcactgtgccgtgggtcgaactcggtggagagtgcaacataaactgttcaaagaccggttattccgcaaatattatcttccataccaagcccttctacggcggaaagaaacaccgcattacagctgaaattttttcacccaacgataaaaagtcattctgctctatcgagggggagtggaacggagtaatgtatgctaaatacgcaacaggtgaaaataccgtgttcgtagatacgaaaaagttgcccataataaaaaagaaagtgcgtaaactcgaggaccagaatgaatatgagtcgcggagcctctggaaggatgtgacatttaatttaaaaattcgcgatattgacgccgctacagaagccaagcatcggctggaagagcgacagagggcggaggcccgagagaggaaggagaaagagattcaatgggaaactaggttgttccacgaagacggagagtgctgggtatatgatgagccgctgttaaagcggcttggggcagctaagcattag

SEQ ID NO: 233816 - DNA, 330 bp, Artificial Sequence
  Description of Artificial Sequence: Synthetic coding sequence
atggtggagagtattaagcattgtatcgttctattgcagatcgccaagagcaccattaatcccgtcgacgcaatctaccagccctctccccttgaacccgtgatcagcaccatgcctagccaaactgtgctgcctccagagccagtccagctttgtaaatcagagcagagacctagctcactgccagttggccctgtgctcgcgacactaggtcatcaccaaacacctacccctaacagtacaggatcaggccattctcccccatccagcagcctgacttccccatcacacgtaaatcttagccctaacaccgtccctgaattttcgtag

SEQ ID NO: 233817 - DNA, 1170 bp, Artificial Sequence
  Description of Artificial Sequence: Synthetic coding sequence
atggaaggggctctggctgcgaattggtcggctgaagccgctaacgcttctgccgctcccccaggcgcagagggcaaccggacggcagggcctccccgaaggaatgaagctctggctcgggtggaggtcgcagtactatgccttatactgctgttagcactcagtggaaatgcctgcgtcctgttggccttgcgaactacccggcagaaacacagcagattgttcttttttatgaaacatttgtcaattgccgatctggtggtcgccgtctttcaggtgcttcctcaactactttgggacatcacatttcgtttttatggcccagatctgctctgcaggttagtcaagtacttgcaggttgtcggaatgtttgccagcacctatctcctcttactgatgtccctggatcgctgcctcgctatctgccagcctctgcggagcctcagaagacggactgatcggctcgcagtcctggctacctggctggggtgcctggtagcaagcgcccctcaggtgcacatctttagtcttcgggaagtagccgatggggtgtttgattgctgggccgtcttcattcagccttggggaccaaaagcctacattacctggattacgctcgcggtgtacattgtgccggtcatcgtactagctgcctgttacggactcattagctttaaaatctggcagaacctcagactgaaaacggcagccgcagccgctgccgaggcccctgaaggcgcagcggcaggcgatgggggacgcgtggccttagccagggtctccagcgtgaagctaatttcaaaggcgaaaatcagaaccgttaaaatgaccttcatcatagtgctggcatttattgtctgttggaccccctttttcttcgttcagatgtggtcggtgtgggacgctaatgcccctaaagaggccagtgcctttatcatagtgatgttactagcctccctgaacagctgctgtaatccttggatctatatgctgtttactggacatctgttccacgagctggtgcagcggtttctgtgctgctccgcttcttacttgaaaggcaggcgcttgggtgaaaccagcgcgtcaaagaagagtaattcctcaagcttcgtgctgtctcatcgaagtagttcacaacggagttgcagccagccaagcacagcatag

SEQ ID NO: 233818 - DNA, 132 bp, Artificial Sequence
  Description of Artificial Sequence: Synthetic coding sequence
atggaaggggctctcgccgcaaattggagtgccgaggccgctaacgcttccgcagcacccccaggcgctgaggggaacaggactgcaggcccaccccgtagaaatgaggccttagcccgagtggaagtatag

SEQ ID NO: 233819 - DNA, 279 bp, Artificial Sequence
  Description of Artificial Sequence: Synthetic coding sequence
atggaaggggcactcgcagcaaattggtcagcagaggcagccaacgcctcggccgcacctcccggagcagagggaaatcgcacagccggtcctccacgccgaaatgaagccctcgcccgtgtggaggtggctgtcctctgcctcattttgctcctggccctgtctggaaatgcctgcgtcttgcttgcccttagaacaacaagacagaagcactcaagattatttttttttatgaaacaccttagtatcgctgacctggtcgtggccgtctttcaatag

SEQ ID NO: 233820 - DNA, 1518 bp, Artificial Sequence
  Description of Artificial Sequence: Synthetic coding sequence
atggcctcaggaaggcgtgcccctcgcacaggtctgctcgagctgagagccggtgccggttctggagctggcggagagaggtggcagcgcgttctgctgtccctagcagaagacgtgctgaccgtatccccagccgacggcgaccccggacctgagcctggggcacccagggagcaggagccagcgcaacttaacggggctgcggaacccggagctggtccaccccagctccccgaggctctcctgctccagcgcagacgggttaccgtgagaaaggcagacgctggcggtctagggatttctattaagggcggaagggagaataagatgccaatactcatctctaaaatcttcaagggactcgctgccgatcaaaccgaggctctattcgttggagacgcaattctgagcgtgaatggcgaagaccttagcagtgccacacatgacgaggcagtgcaagtgctcaaaaaaacaggcaaggaagtggtgctggaggtgaagtacatgaaggacgtttccccatactttaaaaattcaacaggagggacatctgtggggtgggacagccccccagcttccccgctacagcgccagcctagttctcctggtccaacacctagaaacttctccgaggccaagcacatgtcacttaagatggcatacgtgagtaaacgatgcactccgaacgaccccgagcccaggtacctggaaatttgctcagccgacggccaagatacactcttcctacgtgccaaggacgaggcttccgctcggtcctgggcgaccgccattcaggcccaggtgaacacactcactccacgggtcaaagacgaactccaggctcttctagctgccacgtccaccgctggcagccaggatattaagcagatcggctggttgactgagcaactgccttccggcggtactgcccctacattggctctattgaccgagaaggagctgctgctgtacctgagtttaccggaaacccgggaggcactcagcagacctgcccgaactgcccctctgatagctacccggctggtacactctgggcctagcaagggctcagtgccctatgatgccgaactttcatttgcgctgcggaccgggacccgacatggagtcgatacccatttgttcagcgtggagagcccgcaggagctggcagcatggaccagacagctggtggatgggtgtcaccgggcagctgagggcgtgcaagaggtgtccacagcctgtacatggaacggaaggccctgctccctgtccgtccacatcgacaagggatttactctgtgggccgcagaacccggagccgctagagccgttttacttcgacagcccttcgagaagctgcagatgagcagtgatgatggcgcaagcctcctcttcctcgatttcggcggagccgagggggagattcaacttgatctccatagttgtccgaagactattgtgtttattatccattcctttttgagcgccaaagtcacacggcttggcttgctcgcctag

SEQ ID NO: 233821 - DNA, 441 bp, Artificial Sequence
  Description of Artificial Sequence: Synthetic coding sequence
atgggattcctgagaagactgatctatagaagaagacccatgatttacgtggagtcctccgaagagtcaagcgatgaacaacctgatgaagtggagtctccaacccagtcccaggatagtaccccagcagaagagagggaggacgagggcgcttccgctgctcagggacaggaaccggaggccgattcacaggaattggtgcaaccgaagacaggatgtgaactcggtgatgggcctgacacgaagcgtgtatgtctgaggaatgaagaacagatgaagttgccagcagaaggacctgagccagaggctgacagccaggaacaggtgcatccaaaaactggctgcgaacgcggagatggcccagatgtgcaggagcttggactccccaaccctgaggaagttaagacgccagaagaagacgaaggccagtcccagccgtag

SEQ ID NO: 233822 - DNA, 336 bp, Artificial Sequence
  Description of Artificial Sequence: Synthetic coding sequence
atgtctgagctgctgagggcgaggagccagtccagcgagcggggaaatgatcaggagtcttcccagcctgtcggtagcgttattgtccaagagcctacagaagagaagcggcaggaagaagagcctccgacagacaatcaggggatcgctccctccggggagattgagaaccaggccgttcctgctttccagggtcccgacatggaagcctttcagcaggaactggccctgttaaaaatcgaagatgaacccggtgacgggccagacgtgcgtgagggtatcatgcctacatttgaccttacaaaggtgttagaggctggtgacgcacagccctag

SEQ ID NO: 233823 - DNA, 195 bp, Artificial Sequence
  Description of Artificial Sequence: Synthetic coding sequence
atgtccgaactgctcagagcccgaagtcagtcatccgaacggggaaacgaccaggagtctagtcagccggttgggtcagtaattgttcaggagcctacagaagagaaaaggcaggaagaggagcctccaaccgacaaccagggaatagctccatccggtgagatcgaaaaccaagccgttcctgcatttcagtag

SEQ ID NO: 233824 - DNA, 342 bp, Artificial Sequence
  Description of Artificial Sequence: Synthetic coding sequence
atgtccggtcaccagaggacgcgctctcgctcccgcgagaggcgcgatgaccaggattctaaccatcctgtgggcgcagtggttgcccaagagttaccaagtaatgaccaattgcaacaggaggagccacctattgaatcacaagactatacgccgggtcaggaacgggatgagggagccttggattttcaggttttgggcctggcagcctatctgtgggaactgactcggtccaaaacaggtggtgagagaggagatggacccaatgtgaaaggggagttcctgcctaacctcgagcccgtgaaaatccctgaggctggagaaggccaacccagtgtctag

SEQ ID NO: 233825 - DNA, 342 bp, Artificial Sequence
  Description of Artificial Sequence: Synthetic coding sequence
atgtctggtcaccaacgaactcggtctagatcccgcgagcgtcgagacgatcaggattctaatcacccagtcggagccgtggttgcccaggaattgccgtctaacgaccagcttcagcaagaggagccccctatcgagtctcaggactatacgcccggtcaggaacgagacgagggagccctggattttcaggtgttaggtctggcggcttacttgtgggagctgactagaagcaagaccggcggtgaaagaggggacggacctaatgtgaagggggagttcctacctaacttggagcctgtgaagatccctgaagcaggtgagggccagcctagcgtatag

SEQ ID NO: 233826 - DNA, 1458 bp, Artificial Sequence
  Description of Artificial Sequence: Synthetic coding sequence
atggccgcagtgtggcagcaggtattggccgtggatgcccgatataacgcatacagaacaccgaccttcccgcagttcagaacgcagtacattaggaggagaagtcagctcttacgggagaacgccaaggcaggacaccctccagccctgagacggcagtacctaagactgcgtggccagttgctgggtcaacggtatgggccactctctgaacccggaagcgcacgcgcttactcaaacagcatagtgcgaagttcacggactacgctagatagaatggaggatttcgaggacgaccctagagccctcggagccagaggccaccggagaagcgtaagccgcggttcctatcagctccaagcccagatgaaccgggcagtgtacgaagacaggcctccagggagcgtagtcccaaccagcgccgcagaggcctcccgcgctatggccggtgacacatcactgagtgagaactacgcttttgcgggaatgtaccatgtgtttgaccagcacgtcgatgaggcagtccctagggtacgattcgctaatgacgaccggcaccggctcgcctgttgcagtctcgatggttctatcagcttgtgccagctggttcccgcaccccctacagtgctgagagtgctgcgcggtcacactagaggggttagcgacttcgcctggtccctcagtaatgacatcctggtcagtacatctctggatgccaccatgcgaatatgggcttcggaggacgggcgatgtattcgggagatcccagaccccgattccgctgaactgctgtgttgcactttccaacccgttaacaataacctgacagtcgtcggcaatgcgaaacataacgtgcacgtgatgaatatcagtacaggaaagaaggttaagggcggaagctccaaactgactggcagggtgttggctttgtcatttgacgctcccggtaggctgctgtgggcaggcgacgatcacggcagtgtattttcgtttctcttcgatatggcgaccgggaaactcacaaaggcaaaacgactggtcgtacatgaggggtcccctgtcactagcatttctgcacggagctgggtgagccgcgaagccagagatccatccctattgatcaacgcatgcctgaataagctgctgctttatagggtcgtggacaatgaaggcacattgcagttaaagagatcatttccgatagagcaatcgtcacatccagttcgctcaatcttctgtccactcatgtcatttaggcagggcgcttgcgtcgtcaccggcagcgaggatatgtgcgtgcatttctttgacgtagaacgggcagccaaggccgcagttaataagctgcagggacactctgctccagttctggatgtgagcttcaactgcgacgagtctctgcttgctagctcagatgccagcggcatggtgattgtgtggcgccgagagcagaaatag

SEQ ID NO: 233827 - DNA, 309 bp, Artificial Sequence
  Description of Artificial Sequence: Synthetic coding sequence
atgagcgctagagtgaggagtaggtcacggggtcgcggagatggacaggaggctcctgacgttgtcgcattcgtggcccctggagagtcacagcaggaggagcccccaaccgacaaccaggacatagagcctggccaggagcgggaaggaacccccccaatagaagagagaaaagtggaaggggactgtcaggaaatggatcttgagaagaccagatcagagcggggagacggctccgatgtcaaagagaagacccccccaaatcccaagcatgctaaaactaaagaggcaggagacggccagccatag

SEQ ID NO: 233828 - DNA, 1575 bp, Artificial Sequence
  Description of Artificial Sequence: Synthetic coding sequence
atgagtgataacggggaactagaggataagccacccgcaccccctgtgcgcatgtcttccacgatcttctctacagggggtaaagaccctctctccgccaatcattctctgaagccgttgcccagcgtacctgaggaaaagaagccaagacacaaaatcatttctatttttagtgggacggagaaaggatcaaagaagaaggagaaagagcgccctgaaattagtcctccgtcagattttgagcatactatccacgtgggttttgacgcggtcacaggcgaattcacgggtatgcccgagcaatgggccaggctactgcagacctccaatatcacaaaactggagcagaaaaagaatccccaagcagtgctagacgtcctgaagttttacgacagcaataccgtaaagcagaaataccttagctttacacctcccgaaaaagatggctttccatctggcacccccgcactcaatgctaaggggacagaggccccagctgtcgtaactgaagaggaagacgacgatgaggagaccgctccccctgtgatcgcgcctaggcccgatcacaccaagtctatatatacaagaagtgttattgatccagtgccagccccagtcggtgacagtcacgtggatggggctgctaagtctctagacaagcagaagaagaaaaccaagatgaccgatgaagaaatcatggagaaacttcggactattgtatcaattggggacccaaagaagaagtacacccgctatgaaaaaattgggcagggggcttctggcaccgtgtttactgccacagacgttgcgctggggcaagaagttgctatcaaacagattaatctgcagaaacagcccaaaaaagaattgatcatcaacgagattctggtgatgaaagaactcaaaaatccaaatatcgtgaactttctggattcctatttggtaggtgatgagctgttcgtggtgatggagtatctggccggaggctccctgacagatgtggttaccgaaacctgcatggatgaggcacaaatcgctgccgtttgcagagaatgtttgcaggctttagagttcctgcacgcgaaccaggtcattcaccgggacattaagtcagacaacgtcctacttggcatggaggggagtgttaaactgaccgacttcggtttttgcgctcagatcacccctgaacaaagtaagaggagtacaatggtgggcactccatactggatggcccctgaggtggtcacccgtaaggcctatggacctaaagttgacatttggagcttgggcatcatggcaattgaaatggtagagggggagcctccttatctgaacgagaaccctctgcgggcactgtacctgatcgccacaaatgggactcctgagttgcaaaaccctgagaaactttccccaatcttccgcgacttcctcaatcgatgcttagagatggacgtagagaaacgagggtccgccaaggagctcttacagcacccctttctgaagctagcgaaacctctgagcagcctcaccccactgattatggcggcaaaagaagcaatgaagtccaaccgctag

SEQ ID NO: 233829 - DNA, 1680 bp, Artificial Sequence
  Description of Artificial Sequence: Synthetic coding sequence
atgtccgatgggctggataacgaagagaagccccctgctcctccgctcagaatgaacagtaacaatagggactccagtgctctgaaccattcatccaaacccttaccaatggcgcctgaggagaagaacaaaaaagcacgcctccgatccatttttccaggtggcggtgataagaccaacaagaaaaaagagaaggaaagaccagaaatctctctcccatccgactttgaacataccattcatgtcggcttcgacgctgtgacaggcgaatttacacctgacttatatggaagccagatgtgtcctggcaaactgccagaaggaattcctgagcaatgggccaggcttctgcaaaccagcaatattactaaactcgaacagaagaaaaacccgcaggctgttcttgacgtgctgaaattctacgattctaaagaaaccgtgaataatcagaagtacatgagtttcacatctggcgataagagcgcccacgggtacatcgctgcccacccctcctccacgaaaaccgccagcgaaccccctctagcccctcctgtgtcagaggaagaggacgaggaagaggaggaagaagaggacgaaaatgagccccctcccgttatcgccccacgtcccgagcacacaaagagtatctatacccgttctgtggttgaatcgattgcctccccagcagtgcccaataaggaggttacacccccttccgccgagaatgccaattcgtctaccctgtacaggaacacggaccggcagcggaagaaatctaaaatgactgacgaggaaatccttgagaaactgaggtcgatcgtgagtgtgggtgaccctaagaagaagtacacccgattcgagaagataggccaaggcgctagtggaacggtgtatactgcgctggacattgccaccggccaggaagtggcaatcaagcaaatgaatctgcagcagcagccgaaaaaagagctgatcattaatgagatactggtcatgcgcgagaataagaacccaaatatagttaactatctcgactcatacttggtaggagacgagctatgggtggtcatggagtacttagcgggaggcagcctgaccgatgtagtgactgagacttgcatggacgaaggccaaatagcagccgtgtgtagggagtgcctccaggccctggacttcttacacagcaatcaggtcatccatagagacattaaatctgataacatcctcctgggcatggacgggtctgtgaagctgaccgacttcggcttttgcgcacaaatcacacctgagcagtctaagcggtcaaccatggtcggtacaccatactggatggcccctgaggtagtcacacgtaaagcatacggcccaaaagtggacatctggtccctcgggattatggctatcgaaatggtcgaaggcgaacccccttaccttaatgagaatcctctacgggcactgtaccttatcgccaccaatgggaccccagagctccagaatcctgaacgattgtcggctgtgtttagagacttcttgaataggtgcctggaaatggatgtggatcgacgcggaagtgccaaggagctcctccagcacccgttcttgaagctagccaagccactgtcatccttaacccccttaattatcgccgctaaagaggctatcaaaaatagctcccggtag

SEQ ID NO: 233830 - DNA, 1743 bp, Artificial Sequence
  Description of Artificial Sequence: Synthetic coding sequence
atgagtgatggacttgataacgaggagaagcctcccgcaccgcctctgagaatgaattccaacaaccgcgatagttcggcactgaatcatagttcaaagccacttcctatggcacctgaggaaaaaaacaagaaggcaagattgcgctcaatatttcccggaggcggtgataagacaaacaaaaagaaggaaaaagagaggcccgagatcagcctcccctcagatttcgaacataccattcacgtcggcttcgatgccgtgacaggtgagtttacgaactcgcctttccagacctctaggcccgttacagttgcctccagccagagtgaaggcaagatgccggatctgtatggaagccagatgtgcccaggcaaattacctgaggggatccctgagcagtgggctcgactgcttcagacctccaacattaccaaactggagcagaaaaaaaaccctcaggcggtgctcgatgttttaaagttctatgacagcaaggagactgtgaacaaccagaaatatatgagttttacttcaggtgataagtccgcacacggttacatcgccgcacatcccagcagcaccaagacggcttcggagcctcctttagcacctcctgtaagtgaggaagaggacgaggaggaagaggaagaagaagacgaaaacgaacctccaccagtgattgcaccgcgtcctgagcatacaaagagtatctataccaggtccgtcgtggagtctattgcatctccagcagtcccaaacaaggaggtgaccccaccgtccgccgagaacgctaatagctctactctgtatcggaacacggatagacaaaggaaaaaaagcaaaatgactgatgaagagatccttgagaaactcagaagtattgtttctgtcggcgacccaaaaaaaaagtacacaaggttcgagaaaatcggccagggcgcatcaggaactgtttacactgccctggacatcgccacgggtcaggaggtcgctattaaacagatgaatctccagcagcagccaaagaaggaattgatcatcaacgaaattttagtgatgagggagaacaagaaccctaatattgtcaactacttagactcttacttggtgggcgacgaattgtgggtggtgatggaatatctggctggcggatccctgaccgatgtcgttacggaaacctgtatggatgagggacagatagcagccgtttgtagggaatgccttcaggcgctggacttcttgcattccaatcaagtgattcatagggacatcaagtcagacaacattctgctggggatggatgggagcgtgaagctcaccgatttcggtttctgtgctcagatcacgcctgagcaatctaaaagaagtaccatggtgggcacaccctattggatggcgcctgaagtggtgaccaggaaggcttatggaccaaaagttgatatttggagtctagggatcatggccattgaaatggtcgagggggagcccccatatcttaatgagaatcccctgagggccctctatttgatagccacgaacgggacccccgaacttcagaaccccgagcggctctctgcagtgtttagggacttcttaaataggtgcctggagatggacgtagacagacgcggttcagcaaaggagctcctgcagcatccattcctgaaactggccaaacccctgtcctcgcttacaccactgataatagctgccaaagaggccataaagaatagctccagatag

SEQ ID NO: 233831 - DNA, 1635 bp, Artificial Sequence
  Description of Artificial Sequence: Synthetic coding sequence
atgtccgacggcctggataacgaggagaaaccgcctgccccaccactgagaatgaactctaacaatcgcgactctagcgctctgaaccactcgtctaagcctctgcccatggccccagaagaaaagaacaaaaaggcccgactccggtccattttcccaggcggaggggacaagactaataagaagaaggaaaaagagagacccgagatctctctgccgtctgactttgagcataccattcatgtggggttcgacgccgtgactggagaattcactggaatccccgaacagtgggccagacttcttcagacaagcaatatcaccaagctagagcagaaaaaaaatcctcaggccgtcctcgatgtcctgaagttttatgacagcaaggaaaccgttaacaatcaaaagtacatgagttttacctcgggcgataaaagtgcgcacgggtacatcgctgcccaccccagtagtacaaagacggcttcggaacctcctctcgcacctccggtgagcgaagaggaagacgaggaagaagaggaggaagaggacgagaatgagccccctccagtcatcgctccccgtcccgaacacacgaagagcatatacactcgctcagtggtggagtcgattgcttcccccgctgtccccaataaagaggtgacccctcctagcgccgagaatgcaaactcgagtactctgtatcggaacacagaccgccagaggaaaaagagcaagatgactgacgaagaaatcttagagaaactccgctccatcgtgagtgtgggggaccctaaaaagaaatacacccggttcgagaaaattggtcagggagctagcggcaccgtctatactgctttggatattgccacaggacaagaggttgccataaaacagatgaatctgcagcagcagccaaagaaggagctgatcattaacgagatccttgtgatgcgcgagaataagaacccgaatatcgtcaattatctggactcttaccttgtcggagacgagctctgggtcgttatggagtatcttgctgggggatccttgacagatgtagtcacagaaacctgtatggacgaaggtcagatcgccgcagtgtgtagggagtgtttacaggccttggattttctgcacagcaatcaagtgatccatagggatatcaagtccgataacatcctcctcgggatggatggatctgtgaaactgactgatttcggattttgtgcccagattacaccagagcagtccaagagaagcaccatggtcggaaccccgtattggatggcccctgaggtagtcacgagaaaagcttatggtccgaaggtagatatttggtctctgggcatcatggccatcgagatggtagaaggggaacccccttacctgaatgagaatcctttaagagccctttatctgatcgcaacgaacggcaccccagaactccaaaatcccgagcgcctttccgcagtgtttagggattttcttaatcgttgtctagagatggacgtggatagacgcggaagtgcaaaagaattattgcagcatccatttttaaagttagccaagccactgtcatctctgacccccctgattattgctgcgaaggaggccatcaagaacagtagcagatag

SEQ ID NO: 233832 - DNA, 1680 bp, Artificial Sequence
  Description of Artificial Sequence: Synthetic coding sequence
atgtcagatggattagacaacgaggagaagccacccgctccaccattacgcatgaattcgaataatcgcgactcctctgccctaaaccacagttcgaaacctctccctatggccccagaagagaaaaataagaaggcaagactgcgatcaatctttcctggcggaggtgataagactaacaagaaaaaggagaaggagcgtcccgaaatttctctcccttccgactttgagcacaccatccacgtgggcttcgacgcagtgaccggggagttcacacccgatctttacggatcacagatgtgccctggcaagctccctgaagggattcccgagcaatgggccaggctactgcaaacctccaatatcaccaagcttgagcagaagaagaacccacaagccgtgctggacgtgttaaagttttacgacagtaaggaaactgtaaacaatcagaaatatatgtcatttacgtccggggataaatccgcccacgggtacatcgctgcacacccgagctccacgaagacagctagtgaaccccctcttgctccccctgttagcgaggaggaagatgaggaagaagaagaagaggaggacgagaacgaacccccacctgtgatcgctcctagacccgaacacaccaaaagcatttacacgcgctctgtcgtcgaaagcatcgcctcacccgctgtccctaacaaagaagtcaccccaccatcggcagagaatgccaactcctccactctctatagaaacacggaccgacaacggaaaaagtcgaaaatgacagacgaggagatactggagaagcttcgcagtatagtgagtgtgggcgacccaaagaagaaatatactagattcgaaaagattggtcagggggcttccggcaccgtgtatacggcacttgatatcgctacgggtcaggaagtggccatcaagcagatgaatctgcaacagcagcccaagaaggagctcatcattaatgaaatcctcgtcatgagggagaacaagaacccgaacatcgtgaactatctggattcttacctggtgggagatgagttgtgggtggtgatggagtatctcgcgggtggtagcctgacagacgtggttaccgaaacctgcatggatgagggccagattgctgcggtttgccgggagtgcctgcaggcgttggactttctgcactcgaaccaagtcatacaccgggacataaagtcagacaacatcctgctggggatggatggatctgtgaagcttacagactttggattctgtgcccagattacacctgaacagtcaaaaagaagcacgatggtcggcacaccctattggatggctccggaggtcgtgaccaggaaagcctatggcccaaaagtggacatatggagtttgggtattatggcaatcgaaatggtcgagggagagcccccttatctgaacgagaatccgctgagggcattgtatctgatcgcaactaacggcacacccgagctacaaaaccctgagcggctcagcgccgtgttccgcgacttcttgaaccgctgcctcgaaatggatgtcgataggagaggttccgcaaaagaactgctccaacatccatttctgaaattagccaagcctctgtcaagcctgacaccactgattatcgctgccaaagaggccatcaaaaatagcagccggtag

SEQ ID NO: 233833 - DNA, 1698 bp, Artificial Sequence
  Description of Artificial Sequence: Synthetic coding sequence
atgagtgacggcctcgacaatgaggaaaagcctcctgcgcctccacttagaatgaattcaaataacagggactcaagcgctctgaaccattccagtaaaccgctgcctatggccccagaggagaaaaacaagaaagcacggctacggtcaatcttcccaggcggaggagataagaccaacaagaaaaaagaaaaggagaggccagagatttccctcccctccgatttcgagcatactattcacgtaggcttcgatgctgtgacaggagaattcacgaattctccttttcagacttccagacctgtaaccgtcgcatcgagccagtcggagggtaagatgggcattcccgagcaatgggcgagactgctgcaaacaagtaacattactaagttggagcagaagaagaatccccaagccgtcttggacgtgctgaagttttacgactctaaagaaactgtgaacaaccagaagtatatgtcgtttaccagcggagacaaatccgcccacgggtacatcgctgcccaccctagctcaacaaaaaccgcctcagaaccaccactcgcacctcccgttagtgaagaagaggacgaggaggaggaggaagaagaagatgaaaacgagcctcccccagtaattgctcccaggcccgaacacaccaaatccatctacacaagatccgtcgtggagagtatcgcctctcctgccgtccccaacaaagaggtcacaccaccgagtgcagaaaatgcaaattctagtacactatacagaaatacagaccggcagagaaagaagagtaagatgactgacgaagagatcctggaaaaactaagaagtattgtatctgttggcgatccaaagaaaaagtacacccgattcgaaaaaatagggcagggggcatctggaaccgtttacaccgctctggacattgccacaggtcaggaagtggcgatcaaacaaatgaacctgcaacagcaacccaaaaaggagttgatcattaacgagatcctcgtgatgcgggagaataagaaccctaacatagtgaactacctcgatagctatctggtcggagatgaactgtgggttgtgatggagtatctcgccggaggatcgcttaccgacgtggtaacggagacttgcatggacgaggggcagattgccgctgtgtgcagggagtgtcttcaggcacttgacttcttacatagtaaccaagtcatccacagagatatcaagagcgacaatatcttgctcggcatggacgggtcggtgaaactgaccgatttcgggttctgtgcccagatcacacctgagcagagcaagcgcagcaccatggtcgggactccctactggatggcccctgaagtggtcacgcgtaaggcctacgggccaaaggtggacatatggtcattaggtattatggcaatcgagatggtagaaggcgaacctccctacttgaatgagaatcctctacgggcactgtacttgatagccaccaatgggacccccgagttgcaaaacccagaacgcctgtccgcagtgttccgcgattttctgaatcggtgccttgaaatggacgtggatcgccgaggtagcgcaaaggaactgttgcagcatcccttcctcaaactggctaagcctctatcctcactgacccctctcattatagccgctaaggaagccatcaaaaattcatccaggtag

SEQ ID NO: 233834 - DNA, 1635 bp, Artificial Sequence
  Description of Artificial Sequence: Synthetic coding sequence
atgagcgatggcctggacaacgaagagaaaccaccagcgcctccgctgagaatgaattccaataatagagattcctctgcactgaaccacagttcaaagcctctccctatggctccagaagaaaaaaacaagaaggcgaggctgcgctccatatttcccggtggaggagataagacaaacaagaagaaagagaaagagcgaccagaaatttccctcccgtctgattttgagcatacaattcatgtaggctttgacgcagtcactggcgagtttactgggattccagagcaatgggctagattattgcagacgtctaatatcactaaactggagcaaaagaagaatccccaggccgtcctggatgtccttaaattctatgactccaaggagacggtcaataatcagaagtacatgagctttacctcgggagataaatcagcccacggctacattgccgcacacccctcttccaccaaaactgcatcagaaccaccgctggccccacctgtgtcagaggaagaagacgaggaggaagaggaagaggaagatgagaatgagcctccccctgtgatcgctccccgtcctgaacacacaaaatccatttacacgagaagtgtggtggagtccatagcaagtcctgccgttcctaataaagaagtgactcccccatcagctgagaacgccaactcttcaactctatacaggaacaccgaccgccagcggaagaagagtaaaatgacagacgaagagatcttagaaaagctgcgctcaatcgtgtcagttggcgaccccaagaagaaatacactagatttgaaaagatcggtcaaggtgccagtggcactgtttataccgccctggatatcgccacaggtcaggaggttgcaattaagcagatgaatctgcagcagcagccaaaaaaagaattgatcattaacgaaatcctggtcatgcgggagaacaagaacccgaatatcgttaactatttggattcctatctagttggcgacgaattatgggtggtgatggagtatcttgccggaggctcactgacagatgttgtcactgagacttgcatggacgagggtcagattgcggctgtctgccgcgaatgcctccaggctcttgactttctacattctaaccaggttatccatagagatattaaatcagataacattctgctgggcatggacggctctgtgaaattaaccgacttcgggttctgcgcacagataactcccgagcagtctaaacggtctaccatggtgggtactccatattggatggcccctgaggttgtcactaggaaggcctatgggcctaaagttgacatctggagcctgggcatcatggccatcgagatggtcgaaggcgaaccaccctacttgaatgaaaaccccctgcgagctctgtacttaattgccacaaatgggacgcccgaactgcagaacccggagcggctgtctgccgttttcagagattttctcaacaggtgcctagagatggacgtcgaccgcaggggcagcgctaaagagctattgcaacatccctttctcaagctcgccaagcctctgagcagcctcacaccattgataattgccgcaaaagaagcaattaagaactcgagccgttag

SEQ ID NO: 233835 - DNA, 546 bp, Artificial Sequence
  Description of Artificial Sequence: Synthetic coding sequence
atgtcggatggcttggacaacgaagaaaagccgccagcgcctcctttgcggatgaacagcaataaccgcgactcttcggctctaaaccattcatcaaaacctcttccaatggctccagaagaaaagaataaaaaagccagattacggagcattttccccggtggcggagacaagacaaataaaaaaaaagagaaagagcggcctgaaatctctttacctagtgactttgagcataccatccacgtgggtttcgatgcggtcaccggagagtttactaattcccctttccagaccagcagacctgtgactgtggcaagctcccaaagcgaaggcaagatgcccgacctgtatggtagtcagatgtgtcctggcaaacttcctgagggaattcctgagcagtgggctagacttctgcaaaccagtaacatcacaaagctggagcagaaaaaaaacccacaggccgtgctggatgtgctgaagttttacgacagcaaagagacagtaaacaaccagaagtacatgtcgttcaccagtggggataaatag

SEQ ID NO: 233836 - DNA, 1635 bp, Artificial Sequence
  Description of Artificial Sequence: Synthetic coding sequence
atgtctgacgggcttgacaatgaggaaaagccgcctgccccaccactgagaatgaacagcaataatcgagattccagcgctctgaaccactcatccaagcctctacccatggcccctgaggaaaaaaacaaaaaggccagactacggagcattttccccggtggaggtgataaaacaaataagaagaaggagaaggaacggcctgaaatatctttacccagcgattttgaacacaccatccacgtgggttttgatgcagtaactggagagtttactggcatccccgagcagtgggccaggttactgcagacaagcaacataacaaagcttgagcagaagaagaacccccaagctgtcctggacgttttgaagttctatgattctaaggaaactgtcaataatcagaagtacatgagcttcaccagcggagataaaagcgcccatggttacattgcagcacacccaagttctaccaaaacagcttccgagccccctctggcaccgccagtctctgaggaagaagacgaagaggaagaggaagaggaagacgagaatgagccccctcctgtcatcgcgccacgcccagaacataccaagtccatatacacccggagtgtcgtcgaatcaatcgcctcccctgccgtgccgaataaagaagtgactcccccaagcgctgagaacgctaatagttctacattataccggaataccgataggcagaggaaaaagtctaagatgactgatgaggagatcctggaaaagctcaggtccatcgtgtctgtgggcgatccaaagaaaaaatacacgcgcttcgagaagatcggccagggcgcatcagggacagtgtacacggccctggacatcgcgaccggccaggaagtcgctataaagcagatgaaccttcagcagcagccaaagaaggagttgatcattaacgagatactggtgatgagggagaataagaatccgaatattgtgaactacctggactcttaccttgtgggcgacgaactgtgggtagttatggaatacctggccggaggctcgctgacagatgttgtcaccgagacatgcatggatgagggccagatcgccgcagtgtgtagggaatgtctacaggccttagactttctccactctaaccaggtaatccatcgggacataaagtccgataacattctcctgggcatggatggctccgttaaactgacggactttggcttctgtgcgcaaatcaccccagaacagtctaaaaggtccacgatggtgggcaccccttattggatggcaccagaggtggttactagaaaagcctacgggcctaaagtcgatatctggtcactcggtatcatggctatagaaatggtggaaggtgagcccccatatctgaacgagaaccctctaagggccctgtatctgattgccacaaacggaactcccgagctgcagaaccccgagcgactgagcgcggtgttccgggatttcctcaatcggtgtctggaaatggacgtggaccggcgtggaagcgccaaggagctgttgcagcacccgttcctgaagcttgcaaagccactgtcaagcctaacgcctctgattatcgctgccaaagaagcgatcaagaattcctcaagatag

SEQ ID NO: 233837 - DNA, 1743 bp, Artificial Sequence
  Description of Artificial Sequence: Synthetic coding sequence
atgtctgacggtctggacaatgaggagaaacccccagcccctcccctgcggatgaacagcaacaacagagattcatcggctctgaatcattcttcaaagcccctgcctatggcgcctgaggagaaaaataagaaagcgagactcagatctatcttccctggtggaggcgataagactaacaagaaaaaagaaaaagagaggccggagatcagcctgccctctgacttcgagcatactatacatgttgggtttgatgctgttactggcgaattcacaaactcccccttccagacatcaaggcctgtgacagttgcatccagccaatcagagggcaagatgcctgacttgtatggatcacagatgtgtccgggtaagctgcccgaaggaatccccgagcagtgggccaggctcttgcagacaagcaatataaccaaactagagcagaagaaaaatcctcaagccgttttagacgtcctgaaattttacgacagcaaggaaaccgtgaataatcagaaatatatgagtttcaccagtggggacaagagcgcacatggatacatcgccgctcatccatcatcaacaaagaccgcctctgagcctcctttggcgccaccagtgagtgaagaagaagacgaggaggaagaagaggaggaagacgagaatgagccccctcccgtcatagctccccgaccagagcacaccaagtcaatctacacccgaagcgtggtcgagagcattgccagtcctgccgttccaaacaaagaagtgacgccaccctcagcagaaaatgctaattcatccactctatatcggaacactgatcgtcaacggaaaaaatctaagatgacagatgaagaaatcttggaaaagctccgtagcatcgtctctgtgggagatcctaaaaagaagtacactcgatttgagaagatcgggcaaggtgcctctggtacagtctatacagctttggacattgccaccggccaggaagtggcgattaaacagatgaacctgcagcagcaacctaaaaaagagttaattatcaatgaaatcctcgtgatgagggaaaataaaaatcctaacatcgtgaactacttggacagctatcttgtcggcgatgagctgtgggtggtgatggagtaccttgctgggggaagtttgaccgacgtggtcaccgaaacctgcatggatgagggccagatcgccgcagtgtgccgggagtgcctccaggctctggactttttgcactcaaaccaggtgatccacagggacataaagtccgacaatatcctgctcggaatggacggttccgtcaagttgacagacttcgggttctgtgctcagattacccctgagcagtccaaaaggtcaactatggtcggcactccctactggatggcacccgaggttgttacccgaaaggcctatggaccaaaagtggacatttggagcctgggcatcatggcaattgaaatggtggagggggaaccgccataccttaatgagaaccctctgcgagcactttacctgattgctaccaatggcacccctgagctgcagaaccctgagcgccttagcgccgtgtttcgggactttctcaatcgctgcctagagatggacgtcgacaggaggggcagcgctaaagagcttcttcagcaccctttcttgaaactggccaagccactaagtagtctgaccccattgataatcgcggcaaaagaggccattaagaactctagtaggtag

SEQ ID NO: 233838 - DNA, 1698 bp, Artificial Sequence
  Description of Artificial Sequence: Synthetic coding sequence
atgtcggatgggctggacaatgaggagaaacctccagcacctccgctgcgcatgaactcaaataatcgcgactcttcggccctcaatcacagctccaaacccctcccaatggctccagaggaaaagaataagaaggccagacttcggtccatctttccgggagggggtgacaagaccaacaagaaaaaagagaaggaacggcctgagatctccttgcctagtgattttgaacataccattcacgtcggatttgatgccgtgactggagaatttactaacagcccatttcagacctcgcgtccagttacagtcgcgtcatcgcaatctgagggcaaaatggggattcctgaacagtgggcacgtctgttgcagacttctaatattactaagctagagcagaaaaagaacccacaggccgtgttggatgtgctgaaattctacgatagtaaagaaaccgtaaacaaccagaagtatatgagctttaccagcggggacaagagtgcccacggctacatcgccgctcacccctcgtcgactaagaccgcctcagaacctccccttgctcccccagtgtctgaggaagaagatgaagaggaagaggaagaagaagatgaaaacgagcccccacccgtgatcgctccacggccagaacatacaaagtcaatctacacccggtcagtggtggagtcaattgctagccccgctgttcctaacaaagaagtgactccaccgtctgcggagaatgccaattcctctactctctataggaataccgaccgacaacgaaagaagtcaaaaatgacggacgaagagatcctggaaaaattacgcagtatcgtgtcggtgggagatccgaagaagaaatacactcgttttgagaaaatcgggcagggcgcttcaggaacggtatatacggcacttgacattgcgaccggccaggaggtcgccattaagcagatgaatctgcaacagcagcccaaaaaggagcttatcatcaatgagattttagtgatgcgtgaaaataagaacccaaatattgtgaactacctggacagctatctcgtgggagacgaactgtgggtggtgatggagtacctggccggtggcagcctgactgatgtcgttaccgaaacatgtatggacgaaggccaaatcgccgcagtctgtcgggaatgtctgcaggcactggatttcctgcacagtaaccaggtaattcaccgggatataaagtccgataatatcctcttgggaatggatgggtcggtgaagctcactgactttggcttctgtgcgcagattacaccagagcagtctaagcggagtacaatggtgggaaccccctactggatggcacccgaggtcgtaactagaaaggcctatgggccaaaagtagacatctggagcctcgggatcatggctattgagatggtggagggcgaaccgccatacttaaacgagaaccccctgcgggcactgtatctgattgccactaatggaactcctgagctccagaacccagaaaggctaagtgcggtgttcagggacttccttaatagatgtctagagatggacgtcgaccggagaggttcagccaaggagttactccagcacccattcctgaaactggcaaaacctctcagtagccttacacccttaatcatcgctgctaaagaagccataaagaattcctctagatag

SEQ ID NO: 233839 - DNA, 2046 bp, Artificial Sequence
  Description of Artificial Sequence: Synthetic coding sequence
atgtttcgaaagaagaagaaaaagcggcctgaaatctctgcgcctcagaatttccagcaccgggttcacacctcctttgatccgaaggaaggcaagtttgtcgggctgccccctcagtggcagaatatactggacaccttgcggagacctaaacccgtggtcgatccttctaggatcaccagagttcaactccagcccatgaagacagtggtacggggtagcgccatgcccgtggatggatatataagcgggctgctcaatgatatccagaagctgtccgtgataagcagtaatacactgcgaggtcgttcacccaccagtcgcaggcgggctcagtcgcttggactgttgggtgacgaacattgggcaacagaccctgatatgtacttacagtcccctcaatcagaaaggaccgacccacacggactgtatctgtcttgcaacgggggaacgcccgcaggccataagcagatgccgtggcccgagccacaatcgccccgagtcctacccaacggtctggcagcaaaggcacagtctttaggtccagctgagttccagggcgcatcccagcggtgtcttcagctcggcgcttgtctccagtcatctcccccaggggctagccccccaacgggcacgaaccggcacggaatgaaagcagctaagcatgggagcgaggaagctcgaccccagagttgtctcgtgggaagtgcaactgggaggcctggcggagagggctcgcccagccctaagacacgggagagctcgctcaagcgtagacttttcagaagtatgttcctgtctactgccgctaccgccccaccatccagtagtaaacccggtccgcctccacagtcgaaaccaaatagttcctttagaccccctcagaaggacaatccgccaagtctggtggcgaaggcccagagtctcccctcagaccagccagtgggaacgttttcgccactgactacctcggatacatccagcccacagaaaagcctgagaaccgcacccgcaactggtcagctgccgggtaggagcagccctgccggatccccgagaacctggcatgcacagatctcaacgtcaaatctgtacctgccgcaggatccgacggtcgcgaaaggcgctctggcgggagaggacacaggtgtcgtcacccatgaacagtttaaggccgctctgcggatggtagtggatcagggggatcccagattgctcctggactcttatgttaagattggcgaaggcagtactggtattgtctgcctcgccagggagaagcacagtggtcgccaggtagctgtgaagatgatggacctcagaaagcagcaacgacgggagttgctgttcaacgaagtggtgatcatgcgcgactatcagcatttcaatgtggtggagatgtacaaatcctacttggtcggagaggaactctgggtgctgatggaatttcttcagggcggagccttgacggatatcgtctcccaagttcgccttaacgaggagcagatagctaccgtatgcgaagccgtcctgcaggcactggcctatctgcacgcgcagggtgttattcacagagacatcaaatctgacagcatcttattaacattagacggccgtgttaagttgtctgattttgggttttgcgctcagatatccaaagacgttccaaagcggaagagcttggtagggactccctactggatggcccctgaagtgatttcacgctctctgtatgccacagaggtagatatctggagcttagggatcatggttattgaaatggtggatggcgagccaccctacttctctgatagccccgtgcaagcgatgaaaagactgcgcgactcccctccccctaaacttaaaaactcacacaaggtgtcgcctgttctcagggatttcctggagcgcatgttagtccgggaccctcaggaaagagccactgcacaggagttgttggatcatccctttctcttgcagactggcttacctgagtgcctggtgcccctaatccagctgtacaggaaacagacctccacctgctag

SEQ ID NO: 233840 - DNA, 2046 bp, Artificial Sequence
  Description of Artificial Sequence: Synthetic coding sequence
atgttccgcaagaagaagaaaaagcgacctgaaatttcagctccccagaacttccagcatagagttcatacatcttttgatccaaaggagggtaagttcgtggggcttccaccccagtggcagaacatcctggacactcttaggaggccaaagcctgtggttgatccaagccgaattacccgcgtgcagctccagccaatgaaaactgtcgtgagaggcagcgctatgcctgtagatggctacattagcgggctgctgaacgacattcaaaaactgtctgtgatttcgagcaatactcttaggggccgttcccctacctcgcggcgtagagcccagtctctcggcctgctcggcgatgaacactgggccacagaccccgatatgtacttacaatccccgcagtcagagaggactgatccacatgggctctatctgagctgcaatggaggaactcccgctggccataagcagatgccctggccagagccacagtccccaagggtccttcccaatggacttgccgctaaggcccagagcctcggccctgccgagtttcagggagcttctcagcggtgcctgcaactgggcgcttgtcttcagagcagtcctcctggagctagccctccaaccggaactaataggcacggaatgaaagcagccaagcatggctcggaggaagcacgtcctcagagttgtctggttggttccgctactggaaggcccggaggtgagggctcacctagtccaaagacgcgtgaaagttccctgaagcggagactatttcgctcaatgttcctgtctactgccgctaccgcccctccaagtagttccaagcccggtcccccaccccagagcaagcccaacagtagtttcaggccccctcagaaagacaatcccccaagcctcgtggctaaagcgcagagcctacccagcgaccagccggtcggcacattctcccccctcacaacttccgacacaagctctccccagaaaagtcttaggaccgcgccagctacgggtcaacttcccggacgctcctctcctgctgggagccctcgaacctggcatgcccagattagcacatccaacttgtatctgccacaggaccctacagtcgcaaagggagcactggctggtgaagacaccggcgtggtgactcatgagcagttcaaggccgcacttcgcatggtagtggatcaaggagatcccagacttctgctggacagttatgtgaagatcggggagggctccaccggcatcgtttgcctggcgagggagaaacacagtggcagacaagtcgcagtgaagatgatggacctaagaaagcagcaacgtagggaattgcttttcaatgaagtggtaattatgcgggattaccagcattttaacgtagttgaaatgtacaagtcttacctggtgggtgaggaactgtgggtgctgatggagttcctgcagggcggagcactaaccgacattgttagccaggtgagattgaatgaagagcaaatagcaactgtctgcgaggctgtgctgcaagctctggcgtacctgcatgcccagggtgtgatacaccgggatatcaaatccgactctatcttgcttacacttgacggcagggtaaagttgtctgacttcggtttttgtgcccaaattagtaaggatgtccctaaacgcaagtctttagtgggaaccccatactggatggccccagaagtgatctctaggtcactgtacgcaacggaagtcgatatctggtccctgggcattatggtgattgagatggtggatggtgaacccccatacttttcagatagtcccgtgcaggctatgaagcgactgcgcgatagtccacctcccaaactgaaaaactctcacaaagtatctcctgtcctccgtgactttctggagcgcatgcttgttcgcgacccacaggaacgcgctacagcacaggaactgttagatcacccatttctactccagaccggcctgcccgagtgcctggtgccccttattcagctttatagaaaacagacctcgacatgctag

SEQ ID NO: 233841 - DNA, 2046 bp, Artificial Sequence
  Description of Artificial Sequence: Synthetic coding sequence
atgtttcgtaaaaagaagaagaaaaggcctgaaatttccgcccctcagaactttcagcacagagtacataccagtttcgacccaaaagagggcaagttcgtgggcttgcctccacagtggcaaaacattctcgacacactgaggcgtccaaagcccgtcgtggatccaagcaggatcacacgggtgcagttacagcccatgaagaccgtagtgagagggtccgccatgccagttgacgggtatattagcggacttctgaacgacatccagaagctcagcgtgatttcgtccaatacgttgcgtggacgatctcccacctctaggaggcgcgcacagagcctcggactcttgggggacgaacattgggctacagaccccgacatgtatctccagtcccctcagtctgaacggaccgacccacacggcctgtatctgtcttgtaatggtgggactcctgcaggccataaacagatgccatggcccgagccgcagtcacccagagtcttgccaaacgggctggcagccaaagctcaaagcttggggcctgccgagtttcaaggcgcttcccaacgctgcttgcagttgggagcctgtctccagtcgagccccccaggggctagccccccaacagggactaataggcacgggatgaaggcggctaagcatggatccgaggaggctagacctcagagctgtttagtgggtagtgctaccggcagaccgggtggcgagggatctccttcccctaaaacccgtgaatcttcgttaaaaaggcgcttgtttagaagcatgttcctgtccacggccgcaaccgcccctccctcctcttccaagccaggtcctccaccgcaaagtaaaccaaactccagtttcaggcctcctcaaaaggataacccaccgtccctagtggctaaagcacaaagcctgccctctgatcagcccgtaggcaccttttctcccctaactacctctgacacttctagtccgcaaaagtcgctgcggacggccccagccacaggccagctgccaggcaggtcctctcccgctgggtccccccgtacctggcacgcacagatctcaactagcaatctgtatttgccacaagaccctacagtggctaagggggctctggccggagaagacacgggcgttgtgacccacgagcaatttaaggctgccctgagaatggtcgttgaccagggcgatcccaggcttctgctggattcttacgtcaagatcggcgagggaagcaccggtattgtgtgtttggctcgggagaagcacagcggcaggcaggtcgccgtgaagatgatggatctgcggaagcagcagaggagagagctactcttcaatgaagtcgtcattatgcgagactatcaacactttaatgtcgtggagatgtacaaaagctacctggtcggtgaggagttatgggtcctgatggagtttctccaaggtggcgcattaacggatattgtctctcaggtgcggctgaacgaagagcagatcgccactgtatgcgaagcagtcctgcaggccctggcctatctgcatgcgcagggagtgatacaccgtgatattaaatccgattccatccttctcactttggatggaagagttaagctgagcgatttcggcttttgcgcacagataagcaaggatgttcccaaacgaaaatctctggttggaacaccgtactggatggcaccagaggtgatctctcgctccttgtacgctacagaggttgacatctggagtctgggcattatggttatcgagatggtagatggggaacctccctatttctctgattccccggtccaggcaatgaagaggctccgggattcccctcctcctaaactcaaaaactcccataaggtatcaccagtccttcgcgattttctggagaggatgctggtaagggaccctcaggagcgggcaaccgctcaggagctgcttgatcatccattcctgcttcagacgggactccctgagtgcctggtgccattgattcagctctacagaaaacagactagcacttgttag

SEQ ID NO: 233842 - DNA, 369 bp, Artificial Sequence
  Description of Artificial Sequence: Synthetic coding sequence
atgttccgcaagaagaagaagaagcggcctgagatttccgcgccacagaatttccagcatagggttcatacgtcctttgacccaaaagagggcaagttcgtgggcctgcccccacagtggcagaacatcctggataccctgcgccgtcctaaacctgtggttgatccctcaagaatcacgagggtccaactccagcccatgaaaactgtggtgaggggcagcgcaatgccagtagacggttacatttctggactgttgaatgatattcagaagttgtctgtcatcagcagcaacaccctgcggggtagaagccccacgagtaggaggcgagcacaaagtctcggactgctcggcgacgagcattggtag

SEQ ID NO: 233843 - DNA, 372 bp, Artificial Sequence
  Description of Artificial Sequence: Synthetic coding sequence
atgtttcgtaagaaaaaaaaaaagcgtccagaaatctcagcccctcagaacttccagcacagagtgcacacatcctttgatcctaaagagggaaaattcgtcggcctccccccacagtggcagaatatattggacactctcagaagaccgaaaccagtggtggatcctagccgcatcacccgtgtacaattgcagccaatgaaaactgtcgtcagggggagtgctatgccggtcgatggctatatttctggacttttgaacgatatccagaaattgtctgtgatctcgtctaacactttgagaggtaggagcccgacctccaggcgtagggcccagtccctggggctgttaggagacgaacattgggcttag

SEQ ID NO: 233844 - DNA, 330 bp, Artificial Sequence
  Description of Artificial Sequence: Synthetic coding sequence
atgtttcgaaagaagaagaagaaacgtcccgagataagcgctccccaaaatttccagcatagagtccacactagcttcgacccaaaagaaggaaaatttgtgggacttcccccacagtggcagaacatcctcgacacactgagaagaccaaaacctgtagtcgatccatcgaggataacacgagttcaactgcagcctatgaagactgttgtacggggttctgctatgcctgtggatgggtatatttcagggctgctcaatgatattcagaagctcagcgtgatctccagtaataccctgagaggacgttctccaaccagtagacgctag

SEQ ID NO: 233845 - DNA, 339 bp, Artificial Sequence
  Description of Artificial Sequence: Synthetic coding sequence
atgttccgtaaaaaaaagaagaagcggcctgagattagtgctccccagaattttcaacacagagtccataccagctttgatcccaaggaaggaaagtttgtggggctgccgccacagtggcagaatatccttgataccctccggaggcccaaaccagtggtggacccgtctcggattacaagggtccagttgcagcctatgaagacagtggtgagaggcagcgcaatgccagtcgacggttacattagtgggctcttgaacgatattcagaagctgtctgttatcagcagtaatactcttaggggtcgttccccaacttcgaggcgcagagctcagtag

SEQ ID NO: 233846 - DNA, 2046 bp, Artificial Sequence
  Description of Artificial Sequence: Synthetic coding sequence
atgtttaggaagaagaaaaagaaacgaccagagatctcagcaccccagaacttccaacaccgcgtgcacacatcattcgatcctaaggaagggaaatttgttggtctccctcctcagtggcaaaatatcctggatactttaaggaggcctaagccggtggtggacccctcaaggattacacgggtgcagctgcagcccatgaaaacagtggtcagaggatccgccatgcccgttgatggttatattagtgggcttctcaacgacatccagaaattatccgtcatatccagcaataccttgcggggacgatccccaacatcaagaaggcgcgcacaatctctcgggctcttgggagacgaacactgggccaccgacccagatatgtacttgcagagtccccaaagcgagaggactgatccacatggtctatacctgagttgtaacggcggtacgccagctggccacaaacaaatgccatggcctgagccgcagtctcccagagtactccccaatggactagcggcaaaagctcagtcactgggtcccgctgagttccagggggcatctcagcgctgcctgcagctaggcgcatgtctccagtctagtccacctggcgcaagtccgcctaccgggaccaaccgacatggcatgaaggcagctaagcatggctccgaggaggcgaggccacaatcttgtctggtcggcagcgccactggccgtcccggtggagaaggctctcctagtcctaagactcgggagagttcccttaaacgacgactgtttcggagcatgtttctgtctacagcagccactgcacccccatcctccagtaaacccggtccgccacctcagtccaaaccgaattcctctttcaggcccccacagaaagacaatcccccttctctggtcgctaaagctcaatctctgccctccgatcaaccggtaggaaccttttcaccactgactacctccgatacatcatcccctcagaaatccctccgaacagcgccagccacgggacaattgcctggacggtcctccccggctggctcaccacggacctggcacgctcagatctctacctccaacctgtatctaccacaggatccaaccgtggccaaaggggctttggctggggaagacactggcgtggtgacacatgaacaatttaaagcagccctgaggatggtggtggatcaaggagaccccagactgctgctggactcgtacgtgaaaattggtgaaggttccacaggcattgtttgtcttgccagggaaaagcactcagggaggcaagtggctgtgaaaatgatggatctccggaaacaacaacgccgtgaactgctattcaacgaggttgtgattatgcgcgactaccagcacttcaatgttgttgagatgtacaaaagctatctcgttggggaggagctctgggttctcatggagtttcttcagggaggggctctaactgatatcgtgagtcaagttcgactgaacgaggagcagatcgcaacagtctgtgaagccgtcctgcaggcgttggcatatttacatgcccaaggagttattcacagggatattaaatccgactcgatcttgttgacactcgatggcagggtaaagctttctgactttggtttctgtgcgcaaatctctaaagacgttcccaagcggaagagtctggtaggcacaccttactggatggcacctgaggtgatctctcggtccctatacgccacagaagtggacatttggtcgctcggtatcatggtaattgagatggtggacggggagcccccttattttagtgactctcctgttcaggctatgaagcgtttgcgggacagccctccacctaagcttaagaactcccacaaagtttcgcccgtgttaagggatttcttggagcgcatgctggtgagggatccacaggagagagccaccgcacaggagttacttgaccacccattcctgctgcagaccgggcttcccgagtgtctggtgccattgattcagctctacaggaagcagacatcaacatgttag

SEQ ID NO: 233847 - DNA, 855 bp, Artificial Sequence
  Description of Artificial Sequence: Synthetic coding sequence
atgttcagaaagaagaagaagaagcgacctgaaataagcgcccctcaaaacttccagcatagggtccatacttcattcgatcccaaggagggtaagttcgtgggccttcctccccagtggcagaatatcttggacacactgcggagacccaaacctgtggttgaccccagtcgaatcacaagggttcagctccaacccatgaagacggttgtgcggggatccgccatgcccgttgacgggtacatatcaggattgctaaatgatattcagaagcttagtgtcatcagttctaacaccttaagaggccgaagcccaacaagccggaggcgggctcagagtctcggattgctgggcgacgaacactgggctacagatcccgacatgtatttacagagcccacagagcgagagaactgacccgcacggactgtatttatcatgtaatggaggtacccctgccggtcacaaacaaatgccttggcctgaacctcagtcccctagagtgctgcctaatggcctggctgctaaagcacaatccttgggccctgcggaattccaaggtgcctcgcagagatgtcttcagttgggagcatgtctgcagtccagcccaccaggcgcttccccaccaaccggcaccaaccgtcacggcatgaaagctgctaaacatggttccgaagaagccagaccacagagctgtctcgtgggctctgccactggcagacctgggggtgaaggtagcccctcgccaaagaccagagagagtagcttgaagcgtagactctttcggtccatgtttctcagcaccgcagcaaccgccccaccctcctcatctaaaccgggtccgcctccccagtag

SEQ ID NO: 233848 - DNA, 318 bp, Artificial Sequence
  Description of Artificial Sequence: Synthetic coding sequence
atgttcaggaaaaaaaagaagaaaagaccagaaatctcggcaccccagaacttccagcatagagtacatacctccttcgatccaaaggagggaaaatttgtggggctgcccccacaatggcagaacatccttgacaccctccggaggcctaaacctgtcgtggacccgtccaggatcaccagagttcaactacagcctatgaaaacagtcgtgcgcggttccgcaatgcctgtggacgggtacatctctgggctcctgaacgatattcagaaactgtctgtcattagttccaacaccctgagaggcagatcaccttag

SEQ ID NO: 233849 - DNA, 441 bp, Artificial Sequence
  Description of Artificial Sequence: Synthetic coding sequence
atgattaatatgggggacagccatgtagataccagcagcacagtgagtgaggcagtggcggaggaggtaagccttttctcaatgactgatatgattctgtttagtctaattgtgggactcctgacgtactggttcctgttccgtaaaaaaaaggaggaggtgccagagttcaccaaaattcaaacattaacgagcagcgttagggagagttcattcgtagagaagatgaagaagaccgggcgtaacatcattgtcttctatgggtcccagacagggactgccgaagagttcgctaatcgcctgtctaaggacgcccatcgatacgggatgcggggtatgtctgcagacccagaagagtacgatttagccgatctgtctagcctgcctgagattgacaacgccctggtggtgttctgtatggcaacatacggggaaggctag

SEQ ID NO: 233850 - DNA, 519 bp, Artificial Sequence
  Description of Artificial Sequence: Synthetic coding sequence
atgatcaacatgggcgacagtcacgtggatacaagttccaccgtctctgaagctgtggccgaagaggtgtctctgttctctatgaccgatatgatcctcttcagtttgatcgtgggcttgctgacctactggtttttgttccgaaagaaaaaagaagaggtccccgaattcaccaagatccagaccttaacttcatctgtgagggagagttccttcgtggagaagatgaagaaaactggtaggaatattattgtgttctacggcagccagacaggcactgctgaagagtttgcaaacagactctccaaggatgcacatcgatacggaatgcggggaatgagcgccgaccccgaggagtatgatctggccgacctctccagtcttccagagatcgacaatgccctcgttgtcttttgcatggctacctatggagaaggagatccaacggataatgctcaggacttctacgactggcttcaggagaccgacgttgatctctccggagtcaagtttgcttag

SEQ ID NO: 233851 - DNA, 189 bp, Artificial Sequence
  Description of Artificial Sequence: Synthetic coding sequence
atgatcaacatgggcgactctcacgttgacacatcctccacggtgtccgaggccgtggctgaggaggtgagccttttttccatgactgacatgattctgttctccctcatcgttgggctcctaacttactggttccttttccgtaagaagaaggaagaagtacccgagttcactaaaattcagacttag

SEQ ID NO: 233852 - DNA, 1107 bp, Artificial Sequence
  Description of Artificial Sequence: Synthetic coding sequence
atgggaaagtacgtcgataaaagactcgagcagttgggagctcaacggatctttgagctgggacttggcgatgacgacgggaatctggaggaagactttatcacatggagggaacaattttggccagccgtctgtgagcattttggggtggaggccaccggcgaagagtcctccatcagacagtacgaactagtcgtgcacactgatatcgacgcagcaaaggtatatatgggcgaaatgggtcgacttaagagctacgagaaccaaaagcctccttttgatgccaagaaccctttcctcgctgcagttacaaccaatcgaaagctgaaccagggcactgaaagacacctgatgcacttggagttagacatatctgactctaaaatacgatacgagagcggggaccacgttgccgtgtaccctgcaaatgactccgccctggtgaaccaactgggtaagatactgggcgcagacctcgatgtcgtaatgtcgctcaacaatctggacgaggagagtaacaaaaagcatccattcccatgccccacaagctacaggaccgctttgacgtattacttggacattacgaatccaccccgtaccaacgtactgtatgaactagcccagtacgcctctgagccaagcgagcaggaactattaaggaagatggcctcttccagcggcgaggggaaagagctctaccttagttgggtggtcgaagctcgcaggcatatactggctattttacaggactgtccaagcctaaggccgccaatcgaccacctgtgtgagctcctgcccagattgcaagctaggtattatagtattgcttcctcatctaaagtgcacccaaactcagttcatatctgcgccgtggtggtggagtacgaaaccaaagcaggtcggataaataaaggcgtggccactaattggttgagggccaaggagccagcaggcgaaaacgggggacgggcactcgcagtaccaacaagcaccagtgtgggcatgcatggaacctggccaggaatgtgcaggacccccagcacgacctcctggctgagttccggtccatggagtacccgtaggagatggactacctcccgcaattag

SEQ ID NO: 233853 - DNA, 120 bp, Artificial Sequence
  Description of Artificial Sequence: Synthetic coding sequence
atgataaatatgggcgattcccatgttgacacatcatctacggtgagtgaagcggtcgcagaggaggtatccctttttagcatgacggatatgattctgttctccttaattgtgggatag

SEQ ID NO: 233854 - DNA, 501 bp, Artificial Sequence
  Description of Artificial Sequence: Synthetic coding sequence
atgattaatatgggggattcacatgtggatacttcttctacagtctcggaagcagtcgccgaagaggtttctctgttttccatgaccgatatgatcctcttcagcctgatcgtgggcttgctgacttattggttcctgtttaggaaaaagaaagaggaggttcctgagtttaccaaaatccagactctgacctcgtctgtcagggagtcctctttcgtcgagaagatgaaaaaaacaggcagaaatatcatagtgttctatggcagtcaaactgggacagctgaggagttcgccaatagactgtcaaaagacgcacacaggtacgggatgagggggatgtccgccgaccctgaagagtacgaccttgcagatctgagtagccttccagagatcgataatgctctggtggtcttttgtatggccacctacggcgaaggcgatcctactgataacgcacaggacttctatgactggctacaggaaaccgacgtcgatctgtag

SEQ ID NO: 233855 - DNA, 567 bp, Artificial Sequence
  Description of Artificial Sequence: Synthetic coding sequence
atgattaatatgggcgacagccacgtagatacctccagtaccgtaagcgaagccgttgcagaagaggttagcctgttcagcatgacagacatgattctcttcagtctgatcgtgggtctgcttacatattggtttctcttccggaaaaaaaaagaagaggtgcctgagttcaccaaaatccagacactgacaagctctgtgcgagaaagcagttttgtggagaagatgaagaagacaggaaggaatattatagtcttctatgggtctcagactggaaccgccgaggagtttgcaaatagactcagcaaggatgcacaccgttatggaatgcggggtatgtctgccgatcccgaggaatacgacttagcagatttgagttccctcccagagatagacaatgccttagtcgttttttgtatggctacgtatggagaaggagatcctactgataacgcacaggatttttacgattggctccaggaaaccgatgtcgatctgtcaggggtgaagttcgctgtgtttggtctagggaacaagacctacgagcattttaacgccatggggtag

SEQ ID NO: 233856 - DNA, 189 bp, Artificial Sequence
  Description of Artificial Sequence: Synthetic coding sequence
atgatcaacatgggggatagccatgttgacacttcctctactgtctctgaagccgtggcggaagaggtgtctctgttctcgatgaccgatatgattttattttctcttatcgtggggttattaacctactggtttctgtttcgtaaaaagaaggaggaggtgcctgagttcaccaaaattcagacctag

SEQ ID NO: 233857 - DNA, 1722 bp, Artificial Sequence
  Description of Artificial Sequence: Synthetic coding sequence
atgggaagcagatggccggcagttcctccttggggtttgcagatacacgtctcagagcgccaaccatcacgccctcctccttgtccccagcagccaggccaggctacttgcgaaacattgtcttccgcacctgaccctagcaccacaaggatgagcccaccttgtccgcagcctcagtctgctcccggaggtatcggctgttggagactgaaagtgttcgggctcggaaataaaacatacgaacatttcaatgccatggggaagtatgtggataaacgattagaacagcttggagctcagaggatattcgagctaggactgggagatgatgacggcaatctcgaagaggattttataacatggcgggagcaattttggcccgcagtctgcgaacattttggagtcgaagccactggcgaagagtcttccattcgacagtatgagcttgtggttcatactgacattgacgcagctaaggtgtatatgggagagatgggaagattgaagtcatacgaaaatcagaagccaccgttcgatgcaaagaacccctttctggcagctgttacgaccaatcgaaaacttaatcaggggactgaacggcatctgatgcacctggaactggatatctcagatagtaaaatccgatatgagagcggagaccacgtggccgtctacccggcaaacgattcagctcttgttaaccagctgggaaagatcctcggggctgaccttgacgtggtgatgtcattgaacaatctcgacgaagaatctaataaaaaacacccatttccctgtcctacctcgtataggactgccctaacctactacctagacataaccaatccacccaggacaaacgttttgtatgagctcgcacagtatgcctcagagccaagcgaacaagagctccttcgcaaaatggcgtctagctccggagaggggaaggagctgtacctaagctgggtggtggaggcgaggcgccatattttagctattttgcaggattgtccctctctgcgccctcccattgatcatctctgcgagctccttcccaggctgcaggcaaggtattattctatagccagttctagtaaagttcatcctaactctgtacatatctgtgccgtcgtggtggaatatgaaacgaaagcgggaaggatcaataaaggggtcgctaccaattggctgcgtgccaaggaaccagcaggcgagaacgggggtagggcactggtccccatgttcgtcaggaaatctcaattcaggcttccatttaaggccaccaccccagtcataatggtcggaccagggaccggagtggctccctttatcggattcattcaggagcgagcctggttacgacagcagggaaaggaagtcggagaaaccctcctgtattacggttgccgcaggtccgatgaagactatctgtacagggaggaactggcccagtttcatcgggatggagcactcactcagctcaatgtggccttttcaagagagcagtctcacaaggtttatgtgcagcacctgctcaagcaagaccgagaacacctctggaaactgattgaggggggtgcacacatatatgtatgcggaacaccctcttcttgtccaggtatgcacggaacctggccaggaatgtgccgcacaccctcaaccacttcctggctctcaagtggtccttggtccactcggaggaggtggacgacatctcggaattag

SEQ ID NO: 233858 - DNA, 423 bp, Artificial Sequence
  Description of Artificial Sequence: Synthetic coding sequence
atgatcaatatgggtgactctcacgtcgacacaagcagcacggtgagcgaggccgtcgccgaggaggttagccttttctccatgacagacatgatactgttctcccttatcgtggggctgctgacttattggttcctctttcggaaaaagaaggaggaagtgcccgagtttacaaaaattcagacactcacatccagtgtgcgggagagcagcttcgtcgagaagatgaagaagacgggccgtaacatcatcgtcttctatggatcgcaaacgggaactgctgaagagttcgccaacagattgtccaaagatgcccatagatatgggatgcgtggaatgtccgccgaccctgaagagtatgacctggccgacttatcctctctgccagagatcgacaatgccctagtggttttctgtatgtag

SEQ ID NO: 233859 - DNA, 2043 bp, Artificial Sequence
  Description of Artificial Sequence: Synthetic coding sequence
atgattaatatgggtgatagccacgtcgacacgtccagcactgtgagcgaggctgtcgctgaagaagtgagcctattctctatgacagacatgatactgttttctctgattgtgggactactgacatattggtttctgtttcgaaaaaaaaaagaagaagtgcctgaatttactaaaattcagacccttacatcgagcgtgcgcgagtctagtttcgtggagaagatgaaaaagacgggacgcaatatcattgtattctatgggagtcagaccggaaccgccgaggagtttgccaacagacttagcaaagatgcccacaggtacggcatgcggggtatgtcggccgatcccgaggagtacgacctggcggatctctcttctctccccgaaattgataatgccctggtcgttttttgcatggctacttacggggagggcgaccccacagataatgcccaggacttctatgactggttacaggagactgacgttgacctgagcggcgtgaagtttgctgtgtttgggctgggaaataagacgtacgagcactttaatgcaatgggcaagtatgtggacaagcgcttagagcaactgggagctcagcggattttcgaactcggccttggagacgacgatggcaacctagaggaggacttcattacgtggcgggagcagttctggccagccgtttgtgagcacttcggggtggaggctacaggggaggagagctcaattcgtcagtacgagctcgttgtgcacactgacatagatgcggcaaaggtgtatatgggcgaaatgggtcgactgaagtcctatgagaaccaaaaaccacccttcgatgccaagaatccatttctcgcagctgtgaccactaatcgcaaactgaaccaaggtaccgagaggcacttaatgcatctcgagctggatatctccgactccaagatccggtacgaaagcggcgatcatgtagcggtttacccagcaaacgattccgcccttgtgaaccagctcggaaaaatcctgggtgctgatctggacgttgtcatgtcgctgaacaatctggatgaggagtccaacaaaaaacacccctttccttgccctacctcctacagaacggcccttacttactatctggatattactaatccccctaggactaacgtattatatgagctggcccagtatgcctcagaaccctccgaacaggagctgctgaggaaaatggcctccagttcaggtgagggaaaagagctgtacttatcttgggtggtagaggccagacggcacattttggcaatcctacaggactgtccttcactgcgtcccccaatcgaccatctgtgcgagttgctgcctcgcttacaggcacgttattatagtatcgcttccagctctaaggttcacccaaactccgtgcacatatgcgcagttgtggtggaatacgaaaccaaggctggtagaatcaataagggagtcgcaacaaattggctacgggctaaggagccggcaggggagaacgggggaagggcactggttcccatgtttgtaagaaaatcccagtttcgattgccttttaaggcaacaactccggtaatcatggttggaccaggtacaggcgtcgccccattcatagggttcattcaggagagggcctggcttagacagcagggcaaagaagtgggagagacattgctctactatggctgtaggcgcagtgacgaagattatctatatagggaagaactggcgcaatttcatagggatggggctttgacacagctgaatgtagccttctcacgggaacagtcacataaagtgtacgtccagcacctactcaagcaggatagagaacatctctggaagctcattgagggtggggctcatatctatgtctgtggcgatgccaggaacatggccagggacgtgcagaatacattctacgatatcgtcgccgaattgggggctatggagcatgcgcaagcagtggattatatcaaaaagctgatgaccaagggcaggtatagcctggacgtttggtcctag

SEQ ID NO: 233860 - DNA, 1467 bp, Artificial Sequence
  Description of Artificial Sequence: Synthetic coding sequence
atgcccaggacatctacaactggttgccgcaggcagacttggatttccctggggtcatcatcacggctggaagaagacttcatcacgtggagagagcaattttggccagctgtgtgcgagcacttcggggtggaggcaacgggagaagaatccagcatacggcagtacgagctggttgtccacaccgacatcgacgccgctaaggtttacatgggagagatgggccgactgaagagctacgagaatcagaagccaccgttcgatgccaaaaatccttttttggccgctgtcacgacaaacagaaagcttaatcagggtaccgaacgccacctgatgcacctcgaattggatatcagcgatagtaagatcagatatgagagcggagaccatgtcgctgtttaccccgctaatgactcggccctggtcaaccagctggggaagattctcggagcagatctcgacgtcgtcatgagcctgaataacctggatgaggagagcaataagaagcatccattcccttgtcctacctcgtacagaaccgctcttacctattacctggatattactaaccccccaaggaccaatgtgctgtacgagctcgctcagtacgcatccgaaccctctgaacaggagttgctcagaaagatggccagcagtagcggagaaggaaaagagctgtacttatcatgggtggtcgaggccaggcgccatatcctagcaatcttgcaggactgccccagtctccgcccacctattgatcacctttgtgaactgctcccacggctgcaggctaggtactactctattgccagcagctctaaagtccaccccaacagcgtccacatttgcgctgttgttgtggagtacgagaccaaggctggcagaattaataagggtgtcgcaacgaattggctccgtgccaaggagcccgcaggcgagaatggcggacgcgcattggttccaatgtttgtgaggaagagccagtttcggctcccgttcaaggctacaactcccgtgataatggtgggtcctgggacgggagtggcacctttcattggcttcatacaggagagagcatggcttaggcagcagggcaaggaggtgggcgagactcttctgtattatgggtgtcggcgttccgatgaggattacctttaccgggaagaattggcccagtttcaccgcgacggcgctctcacgcaactcaatgtagctttctcaagggaacagtcccacaaagtgtatgtacaacacctcctgaaacaggaccgggaacatctatggaagctaattgaagggggagcccacatatacgtgtgcggcgatgccaggaacatggctcgtgacgtgcaaaacacgttctacgacatagtagccgagctgggcgctatggagcatgctcaagctgttgactacattaaaaagctgatgaccaaggggagatattctctggacgtgtggagttag

SEQ ID NO: 233861 - DNA, 402 bp, Artificial Sequence
  Description of Artificial Sequence: Synthetic coding sequence
atgttgtctccggaagcggagagggtgttgaggtacctggtggaggtggaagaattggcggaagaagtgttagccgataagaggcaaatagtcgatctggatacgaagaggaatcagaaccgcgagggcctgagggctctgcagaaggacctatcattgagcgaggatgtaatggtttgtttcggaaacatgttcatcaaaatgccccatcctgaaacgaaagaaatgatagaaaaagaccaggaccatctggacaaagagatcgaaaagctcaggaagcaattgaaagtgaaagtgaaccgtctgttcgaggcccaagggaaacccgaattgaaaggctttaatctcaaccctttgaaccaggatgagcttaaggctctcaaggttattttgaagggctag

SEQ ID NO: 233862 - DNA, 1605 bp, Artificial Sequence
  Description of Artificial Sequence: Synthetic coding sequence
atgaagtttacactgggcctcgggtcccgggcttggcgggtgagttgggagggggcagccgcagccgcagcgggacctggggctggaggaagcgctctacgatgcagggctcagcgcgtgagtagccccagactcggccgaagaggatcccgcctgagtggcgctctcccactatgcttatctcggggagggggaggcgctcaagcacttccagattgtgctggacccagtccaggacaccctgggcaccctggagctaggcagttggctggacctttagccatggagcagacgtatggcgaagtgaatcagcttggcggtgtttttgtgaacgggcgtccactacctaacgcaattaggctgaggatcgtggagcttgcgcagctgggcatccggccatgcgatatctcccgccagctacgagtcagccacgggtgcgtgtctaagatacttgctcgatataacgaaactggaagtatcctgcctggtgcaattgggggttcaaagccacgggttacaactccaaacgttgtgaaacatattagagattacaaacagggcgaccccggaatctttgcttgggagattcgggatagactgttggccgatggagtgtgtgacaagtacaacgtgcctagtgtttcttcaatcagtcggatactgagaaataaaattggctccctggcccagcccggtccttacgaggcttctaagcaaccacctagccagcccaccctgccttacaaccacatctaccaatacccttacccttctccggtttctcccaccggagccaaaatggggtctcatcctggagtcccaggtacagccggacacgtttcaattccaagatcatggcccagtgcacacagtgtttcaaacatcctgggcatccgaacattcatggagcaaacaggggctcttgccggttccgagggcacggcatattcccccaagatggaggactgggcgggagttaatagaactgcctttccagcgaccccggctgtcaatggccttgagaagccagcattggaggccgatattaagtacactcagtctgcgtcaacattaagcgccgtcggcggttttttaccagcatgcgcctatcccgcaagtaaccaacacggcgtatactcagcacccggtggtgggtaccttgcgccaggtccaccctggcccccagcccaggggccacctctggctcctccaggcgctggcgttgccgtgcacggtggcgaattagctgcagctatgacatttaagcaccccagcagggaaggttccctgcctgctccagccgcaagaccccgaactccaagcgtagcctataccgattgtccttcacgcccacggccaccaaggggatcctctccacgtactagggccagaagagagcggcaggcagaccccggtgcccaggtttgtgccgcagctcccgctatagggaccggtagaattggaggcctggctgaggaagaggcaagtgcgggaccccgtggcgctcggcctgcctctccccaggcgcagccctgcctctggccagatccgccacatttcctctactggagtggcttcctcggcttttccgagctggggttctag

SEQ ID NO: 233863 - DNA, 1185 bp, Artificial Sequence
  Description of Artificial Sequence: Synthetic coding sequence
atggatatgcactgcaaggccgatcctttttctgccatgcatcctggtcatggcggtgtgaatcaactgggcggtgtgttcgtaaatggcaggccgcttcccgacgtggttcgacagcgaattgttgagctggcacaccagggagtgcggccatgcgacatcagcagacaactcagagtttcacacggttgcgtgtcaaagattttgggaagatattacgagaccggatcgatcaagcccggagttatcgggggttctaagcccaaggttgcaacgcccaaagtagtggataagatcgctgaatataagcgccaaaatcccaccatgtttgcttgggaaattagggaccggttactggccgaaggcatctgcgacaatgacaccgtgcccagcgtgagtagcatcaacaggatcattcggactaaagtccagcaacctttccacccgacacccgatggggcaggaactggcgtgacagctccaggccacacaattgtgccctctacagcgtctcccccagtgtcgagtgcttcaaacgatccagtgggaagttactccatcaacgggattctgggaatccccaggtcaaatggagaaaagagaaaaagggacgaggacgtatctgaaggttcagtgccgaacggagatagccagtccggggttgattccctgcgcaagcatctgcgggcagacacgttcacccagcagcagctggaagccctggaccgcgtgttcgagcgcccttcgtaccctgacgtgtttcaggctagtgagcacattaaaagtgaacaaggtaatgagtactccctgccagcacttacccccggtctggacgaggtcaagagctccctgtctgccagcaccaatcccgagcttggcagtaatgtgagtgggacacagacctacccggtcgtgacggggagggacatggcatccacaaccctgcccggatatcccccacacgtcccgccaacaggccagggtagctaccccaccagtacattagctggtatggttccagggagcgagttctccggcaacccctattctcatccccaatacacagcgtacaacgaggcgtggagattctcaaatccggctttgctgagcagtccatactactactcagctgcccctaggggatctgcaccggctgctgccgctgcagcatatgaccggcattag

SEQ ID NO: 233864 - DNA, 1191 bp, Artificial Sequence
  Description of Artificial Sequence: Synthetic coding sequence
atggacatgcactgtaaggctgacccttttagtgccatgcatcctggccacgggggagtcaatcagcttggcggtgtgttcgtgaatggtcgcccactcccagacgtagtacgacagcggatcgtggagctggcccatcagggtgtgcggccttgcgatattagcaggcagctcagagtcagtcacggctgcgtgagcaagattctgggcaggtactacgagacagggtctattaaaccaggtgtgattgggggtagcaagcccaaggtggcgacccctaaggtagtggacaaaatcgccgagtataaaagacaaaatccaaccatgttcgcctgggaaatccgagatcggttgttagccgagggcatttgcgacaacgacacagtgccttcggtctcatctatcaatcgcatcattcgcacaaaggtgcagcaaccctttcaccctacacctgatggtgccggaaccggcgtgacagcccctgggcataccattgtacccagcacggcctctcctcctgtctcttcggctagcaacgatccagtcgggtcctatagtatcaacgggattcttggaattcctcgtagcaatggagaaaagcgaaagagagacgaggacgtcagcgagggctccgttcctaatggcgattcacaaagtggagttgactcattgagaaagcatcttcgtgccgacacgttcacacagcaacagttggaagccctggacagagtgttcgagcgcccttcatatcccgatgtgtttcaagcctctgaacacataaaaagcgagcagggaaatgagtacagcctgccggcactcacacccggtttggatgaggtcaagagtagcctcagcgcgagtactaatcctgaacttggatcaaatgtgtcaggtacacagacttaccccgttgtaaccgggagagatatggcttctactaccctgcctggctatcctccccatgtgccgccaacaggacaaggcagttaccccacatccactctggcaggcatggtgcccgaggccgctgttgggccaagttcctccctcatgtcaaagcctggccgaaagcttgccgaggtcccaccatgcgtacaaccaactggagccagcagtccggctacccgcacagccacaccaagcaccagacctacaactaggctaggagattcggccactcccccttactag

SEQ ID NO: 233865 - DNA, 990 bp, Artificial Sequence
  Description of Artificial Sequence: Synthetic coding sequence
atgttcgcctgggagatcagggatcggctcctagccgagggaatttgcgacaacgatactgtgcccagtgtgagcagcattaataggatcatccggacaaaggttcagcagccgttccacccaacacctgacggcgctgggacaggcgtgaccgcacccggtcatactatcgtcccatcaaccgcctcaccacccgtgtcctcagccagtaacgatcccgtcggctcctattctatcaacggcattctgggaatcccaagaagcaatggagagaagagaaagcgcgatgaggtggaggtgtacactgatcccgctcacatccgtggaggaggcggattgcaccttgtctggactttgagagacgtgtccgaggggtcagtcccaaatggggacagccagtccggagtggacagccttcgtaaacatttgagagcagacacattcacacaacaacagctggaggctttggacagggtgtttgaacggccttcttacccagacgtgttccaggcctctgagcatataaagagcgagcaaggaaatgaatattccctgccagcccttacaccaggattagatgaagttaaatcaagtttgtcggcaagcacaaatccagaactgggcagtaacgtgagcggaactcagacataccctgtggttacgggcagggatatggccagcaccactctgcccggttacccaccccatgtgcctccgacgggccaaggatcctatccaacatccacattggcaggtatggtgccgggaagcgagttctccgggaacccctactctcatcctcagtatactgcatacaatgaagcatggaggttctccaatcccgctctgctctcgtctccttattattactctgcagctccgagagggtcacttccattgcttcccctgcctatgaccgcgaccagctataggggcgatcatatcaagttgcaagccgattcatttggcttacacatcgtgcccgtatag

SEQ ID NO: 233866 - DNA, 1260 bp, Artificial Sequence
  Description of Artificial Sequence: Synthetic coding sequence
atggatatgcactgcaaagccgatccattcagcgcaatgcatcccggtcacggaggcgtgaaccagctgggaggcgtgttcgttaatggaaggcccctccctgacgtagtgcggcagaggattgttgagttggcacaccagggtgtgcgaccctgcgacatcagtcggcagctgagagtaagccacggctgtgtctcgaaaatcttaggcagatattacgaaacgggaagtattaagcccggtgttatcggaggttccaaaccaaaagtggcaactcccaaggttgtcgacaagatagcagaatacaagcgacagaatccaactatgtttgcttgggaaattcgcgaccgcctactagccgagggaatctgtgataacgataccgtccctagtgtctcgtccattaacaggataatacggacgaaagttcaacaaccgttccatcccactcctgacggtgccggtacaggtgtgaccgcaccagggcataccattgttccaagcacagcctcgccaccggtatccagcgcgtctaacgatcccgtgggctcttacagcattaacggtattttaggtatcccaagatctaatggagagaagcggaagcgcgacgaggtggaggtgtacaccgatcctgcacatatcaggggcggaggtggactacatctggtgtggacactgcgagatgtgagtgagggcagcgtacctaacggcgattctcaatcaggcgtggactcattacgcaagcatctcagagccgacaccttcacacagcagcagctcgaagcgttggacagagtcttcgagcgtccctcgtatccggacgtttttcaggcaagcgagcatataaaaagcgagcaaggcaatgagtatagcctaccggctttaacaccgggtctcgatgaagttaagtctagtctgagtgcatccacaaatccagagctgggcagtaacgtgagcggtacccagacgtatcccgtagttactggaagagacatggcaagcacgaccctgccaggatatcctcctcatgttccccctaccggacaaggaagctatcctacttcgaccttggccggaatggtacccgaggcggctgttggccctagcagctccttgatgagcaaaccaggacgtaaactcgctgaggtgcctccttgcgtgcaacctaccggtgccagctcccctgcaacacggacagccaccccttccactcgtcccaccactagactgggtgattctgccacacccccatactag

SEQ ID NO: 233867 - DNA, 645 bp, Artificial Sequence
  Description of Artificial Sequence: Synthetic coding sequence
atggatatgcattgcaaagctgatcctttctctgcaatgcacccaggtcatgggggtgtcaaccaactggggggagttttcgttaatggaagaccgctgcctgacgtggttcgacagcggatagtggaactcgcgcaccagggcgtacggccttgcgatatttccaggcagcttagagtgtcacatggctgcgtcagcaaaatcctgggaagatactacgagaccggcagtattaagccaggcgtaatcggaggctctaagccaaaagtcgcgacccctaaggtcgtcgacaagattgcggagtacaagaggcagaaccctaccatgttcgcatgggagatccgcgacaggctgctggcggaagggatttgcgataatgacaccgtcccgtctgtgagttctatcaataggatcatccgaactaaggtgcagcaacccttccaccctacaccggacggggctggcaccggggtgaccgcccctggtcataccatcgtgccttctaccgctagtccccctgtgtcaagtgcctctaacgacccagtggggtcttatagtattaacggcattctggggattccccgatcaaacggggaaaagagaaaacgtgacgaggtggaagtctataccgatccagcgcattag

SEQ ID NO: 233868 - DNA, 1254 bp, Artificial Sequence
  Description of Artificial Sequence: Synthetic coding sequence
atggatatgcattgtaaggcagatccgttctctgccatgcatccaggccacggcggagtgaatcagttgggcggagtctttgttaatggcaggcccctccccgatgtggttagacagcggatagtggagctcgctcatcaaggcgtcagaccttgtgatattagtagacaattaagggtctctcacggttgcgtgtcaaagatacttgggcgatactacgagactgggtccataaagcccggtgtcatcggcggatccaagccaaaggtggctacacccaaggtggtggataaaatcgccgaatataagaggcaaaatcctaccatgttcgcttgggagattagggatcgacttctggcggaaggaatttgcgacaatgacaccgtgccttcagtgagcagcattaatcgaataatccggacgaaggttcagcagcccttccatcctactcccgacggcgcagggaccggtgtgaccgctcccggtcacaccattgtgccctcaaccgccagccctcccgtatcttccgcttcaaacgatccagttggctcatatagtattaacggaattctcggtatcccacgtagcaacggggagaaaagaaagagagacgaggtggaggtctatacagatcccgctcacatcagggggggtggtggcctgcacctagtgtggacactgagggacgtgtctgagggaagcgtccccaatggcgacagccagtcaggtgtagatagccttcgtaaacacctgcgagccgacacgtttactcagcagcaattggaagccctagatcgcgtatttgaaagaccgtcttacccagatgtcttccaggcgtccgagcatatcaagagcgagcaagggaatgagtactcgctgcccgctctgactcccggactggatgaagtgaagtcgagcttatctgcctctactaaccctgaactgggttcaaatgtgagcggcacacagacttaccccgttgtgactggacgcgatatggcatctaccaccctgcccggttacccccctcatgtgcctcccacaggccagggttcataccccacctccacccttgctggaatggtgcccggatcagagttctccggaaatccctactcacatccccagtacactgcctataacgaggcctggagatttagcaacccagcattgctctcaagtccatactactactctgccgcacctagaggctctgcaccagccgcagcagctgcagcatacgacaggcactag

SEQ ID NO: 233869 - DNA, 621 bp, Artificial Sequence
  Description of Artificial Sequence: Synthetic coding sequence
atgactacgttggctggggcagtgcctcgtatgatgcggccaggcccaggccaaaattatcctagaagtggctttccactggaagtcagcacacctctaggacaaggccgagtaaaccagctgggtggagtttttatcaacggcagacccctgcctaaccacattcgacacaaaatagttgagatggcccatcacggcatccgcccatgcgtgatatcacgtcaacttcgcgtttcccatggatgtgtttcaaagattctatgcagataccaagagaccggctcaatccgccctggcgcaataggcggaagcaagccaaaacaggtgacaacccctgacgttgagaagaaaatagaggagtacaaacgtgagaatcccggaatgttttcctgggagatccgggacaaacttctcaaagacgcagtctgcgatcgtaatacagtaccatctgtcagcagcatttctcgcatccttcgcagcaagtttggcaagggagaggaggaggaggccgatttggagaggaaggaggccgaggagagcgagaaaaaggcgaagcactcaatcgatggaattttgtcagagcggggaaaagcccttgtctccggcgtcagtagtcattag

SEQ ID NO: 233870 - DNA, 1224 bp, Artificial Sequence
  Description of Artificial Sequence: Synthetic coding sequence
atgactacgttggctggggctgtgcccaggatgatgcgcccagggcctgggcagaactatccccgttccgggtttccattggaggtgagcaccccactgggtcaggggagggtgaaccagctcggaggagtatttattaacgggcgaccactgccaaatcacatacgccacaagatcgttgagatggcccaccacggtatcagaccttgtgtgatttcccgccagctccgggtctctcatggctgtgtcagtaagattctgtgtcggtaccaggagaccgggtccatccgtccaggagcgattggcggatcaaagccaaagcaagtcactacgcctgatgtggaaaaaaagattgaagagtataagcgcgagaacccgggtatgtttagctgggaaatccgggacaaactgttaaaagatgccgtttgcgaccggaacactgtgccatccgtctccagtatcagccgcatccttcgcagcaaattcggcaagggtgaggaagaagaggcagacctcgaaaggaaggaggcggaagagagtgaaaaaaaagctaaacatagtattgacggcatccttagtgaacgagcctctgcccctcagtctgacgagggctccgatattgatagtgagccagacctgcctctgaaaaggaaacaacggagatctcgcaccacattcaccgctgaacagctagaagagctcgaacgcgcttttgagagaactcactatccggacatatacacccgtgaggaactggcccagagagctaaactcaccgaggcacgagtacaggtgtggttctctaaccggagagccaggtggaggaaacaggcgggtgccaaccagctcatggcttttaatcacctgattcctggaggctttcctcccacagcaatgccgactctgccaacctaccagttgtcggaaactagttaccaaccgactagtatcccccaagcggtgtcagatccctcctccaccgtccataggcctcagccactgccgccatcaaccgtacaccaatctactatacccagcaaccctgattcatcctccgcttactgccttccttcgacaagacacggtttttcatcttacactgatagctttgtcccaccatccggcccatcgaatccaatgaatccaaccataggcaacggattgtctcctcaggtcccatttattatctcatcccagatctcacttggtttcaaatccttctag

SEQ ID NO: 233871 - DNA, 1212 bp, Artificial Sequence
  Description of Artificial Sequence: Synthetic coding sequence
atgactactctggccggagccgtgcccagaatgatgagacctggccctggtcaaaattaccctcgctcgggcttccccttggaagtgtccacacctctcggccagggccgagtcaatcagcttgggggagtcttcataaacgggcgtccccttcccaaccatattcgccacaaaattgtggaaatggcccaccacggtatccgcccatgtgtgatttcccgacaactcagggtctcacacggttgtgtgtccaagatcctctgcagatatcaggagaccggctccatccgtccgggagccatcggaggctctaagcctaagcaggtgacaactcctgatgtggagaaaaaaatcgaggagtacaagcgcgagaatcctggcatgttcagttgggagattcgtgacaaactcctgaaagacgcggtgtgtgatagaaacactgttccctctgtgtcttcaatctctagaattctccgcagcaagttcggcaaaggcgaggaggaggaggcggacctcgagcgtaaagaggcagaagagtccgaaaagaaggcaaaacactccatcgatggcatcctgtccgaaagagcaagcgcacctcagtctgatgagggatccgatatcgatagcgagccagatctcccactcaagaggaagcagaggaggtctcgcaccaccttcactgccgaacaactggaagagttagaacgcgcttttgaacgaacacattacccagacatctatacccgcgaagagcttgctcagcgggctaaactgacagaggcccgtgttcaagtatggttctccaacagacgcgcacggtggcggaagcaggctggcgctaaccaactgatggccttcaatcatcttattcccggtggcttccccccaaccgcaatgcccaccttaccaacatatcaattgtccgagacaagttatcagcccacttccattccgcaggcagtatcagacccaagctcaacagtgcaccgcccacaaccgctgcctccatcaactgtccaccagtcgactattcccagcaatcccgattcatcttctgcttattgtcttccatctacacgccacgggttcagtagttatacggactctttcgtcccccctagtggcccatccaatcctatgaatccaacaatcgggaatggtctgagcccacaggtgcccttcatcatctcatcacaaattagccgcaaatag

SEQ ID NO: 233872 - DNA, 1440 bp, Artificial Sequence
  Description of Artificial Sequence: Synthetic coding sequence
atgacgacactcgccggtgccgtgcctagaatgatgcggcctggccctggtcagaattacccacggtccgggtttcccttagaggtgagcacccctttaggacagggacgtgtaaatcagctggggggagtctttatcaacggaagaccgttacctaatcacatccgccataaaattgttgaaatggcccaccatgggatccgcccatgcgtgattagtcggcagttgagagtaagtcacggatgcgtcagcaagatactttgcagatatcaggaaacaggctcaattcggcctggggcaatcggagggtctaagcctaagcaggtgacgaccccggatgttgagaaaaagatagaagaatacaagcgcgagaacccaggcatgttttcctgggaaatccgcgataagctgttgaaagatgctgtgtgcgaccggaataccgtccctagcgtgagctcaatcagcagaatcctgaggagcaaattcggtaagggggaggaagaagaagccgatcttgaacggaaagaagccgaggaaagcgagaaaaaggctaaacacagcattgatggaattctctctgaaagagcttccgcaccacagtctgacgagggttccgacattgattctgaaccagatctgccactgaagcgaaagcagcgcagatcaaggacaaccttcacagcagagcagctggaggagttagagcgcgcatttgagagaacacattatcccgatatctatactcgcgaggagcttgctcagcgagccaagctgaccgaagcccgtgtacaggtctggttttctaaccgcagggccagatggcgcaagcaagccggagccaaccaattaatggcattcaatcatctcatccctggcggtttcccaccgacggctatgcccaccctgccaacctatcagctcagtgaaacatcataccagcccacctctatcccccaggcagtgagtgacccgagtagtactgtgcatagacctcagcccttgcctccttcaacagtacatcagagcaccatcccttcgaacccagacagttcgtctgcatactgtctaccatctacaagacatggcttcagctcctacaccgactcattcgtccctccaagcggcccatcaaatcccatgaaccccaccattggaaacggcctgtctccacaggttatgggcctcctgactaaccacgggggtgtccctcaccagccccagacggattacgccctctcaccactcacaggcggactggagccgacaacgaccgtatcggcatcttgttcgcaacgcctagatcatatgaaatctcttgactctctcccaacctcacagtcttattgtccgcctacatattcaactaccggctattcgatggaccccgttacaggatatcagtacggacaatatggccagagcaagccctggaccttctag

SEQ ID NO: 233873 - DNA, 1518 bp, Artificial Sequence
  Description of Artificial Sequence: Synthetic coding sequence
atgacaacacttgccggagcagtgcctcgaatgatgcgcccaggtcccggtcagaattacccgagatctggtttccccctggaagtgtccacacccttgggtcagggacgagtcaaccagctcggaggcgtattcattaacgggagaccccttcccaatcatattcgtcataagattgtggagatggctcatcatggtattagaccttgcgtaatttcccgccagcttcgcgtatcacatggatgcgtaagcaagatcctttgtcgatatcaggagacagggtcgatccgacctggagcgataggcggttctaagccaaaacaggtaacaaccccagatgtcgagaaaaaaatcgaggaatataagagggagaacccgggtatgttctcctgggagatcagggacaaattgctgaaggatgccgtgtgtgaccggaatacagtgccaagtgtgagcagcatttctcgtatcctccggagtaagttcggaaagggcgaggaagaagaggcagacctggagcggaaggaggctgaggagtccgagaaaaaagctaagcattcaatcgatggaatcttgtctgagagggcctccgcacctcagagtgacgagggctctgatatcgactcggaacccgaccttcctttgaagcgaaaacagaggcggtcccgcacaaccttcacagccgagcaattggaagaactcgaaagggctttcgaaagaacacattacccagacatttacactagagaggagctggcacagcgcgcaaagttaacagaagcaagagttcaggtgtggttttccaatcgcagagccagatggaggaagcaggccggagccaatcagttgatggccttcaatcacctcataccgggtgggttccctcctacagctatgcctactctgccgacataccagctgtctgagacttcttaccagcctacttcaatcccacaggccgtttcagaccctagctctacagtgcaccgccctcagcctctgcccccaagcactgtacaccagtccactataccttccaatcccgactcctcgagcgcgtattgtttgccatccacaaggcatggctttagctcatataccgactcgttcgttccaccatcgggcccatctaaccctatgaacccaaccatcggtaatggtctgagtccccaggttatgggcttgctgacaaaccatgggggagtgccacaccagccccagacagattatgccttgtccccattaactggtggcctggaacctactaccaccgtgtcggcctcttgttcacagcggctggaccatatgaagtccctcgacagcctgcccaccagtcagtcttattgccctcccacatactctacgaccggatattccatggatcctgtaactggttatcaatacggtcagtatggacagagcgccttccattatttgaaacccgatattgcttggttccaaattttgctgaatacctttgacaaatcaagcggtgaggaggaggacctggagcagtag

SEQ ID NO: 233874 - DNA, 1455 bp, Artificial Sequence
  Description of Artificial Sequence: Synthetic coding sequence
atgactaccctcgccggagccgtccctcggatgatgcggcctgggccagggcaaaactatccgcgtagtggattccctttggaggtgtctactccactcgggcaaggtcgggtgaaccagctgggaggggtgttcatcaacggcaggcccttaccgaatcatattcggcacaaaatcgttgagatggcccaccatggcattagaccttgcgtgatcagccgccagttgcgcgtgtcccacggttgtgtgtccaagatcctctgccgataccaggagaccgggtccattcggccaggcgctattggtggctctaagccaaagcaggttactactccagacgttgagaagaaaatcgaagaatacaagcgggagaatcctggcatgttcagctgggagattcgggacaagctgctaaaggatgcagtatgcgacaggaataccgtaccctcagtgagcagtatctcccgaattctgaggtcaaagttcggcaaaggggaggaggaggaagccgacttggaaaggaaggaagcagaggagagcgagaagaaagcaaagcacagcatcgacggtattctcagcgagagagccagtgccccacagagcgatgagggctctgatattgatagtgagcctgacctaccactgaagcgtaagcaacggcgatcgcgcaccactttcacagccgagcagttggaggaattggagcgagcatttgaaaggacccactaccctgatatctacactcgggaagaactggcccagcgggcaaagctcacagaagccagggtccaggtgtggttctctaatcgcagagccaggtggcgtaagcaggctggcgcaaatcaactgatggcctttaatcacttgataccagggggtttcccaccgaccgctatgcccacactgcccacgtaccagctgtcagagacctcctaccagcccactagcatcccacaggctgtttctgatccatcttccacagtgcatcgaccccagcctctaccacctagcacagtccatcaatcaacaatcccgagcaatccggatagttctagcgcctattgtctcccttccactcgccatgggttctccagctatactgatagtttcgtcccacccagtggacccagtaacccaatgaacccaaccatcggaaatgggctctccccacaggtcatgggactcctgaccaaccacggcggtgtaccccaccagccgcagactgactacgcactgtcccctctgactggaggattggaacccactactacagtgtctgccagttgtagccagcgattggatcatatgaaaagtctggactctctccctacatcgcagagctattgccccccaacgtattctacaaccgggtattctatggaccccgttaccggatatcagtacgggcagtatggccagagcgctttccattacctgaaaccagacattgcatag

SEQ ID NO: 233875 - DNA, 1452 bp, Artificial Sequence
  Description of Artificial Sequence: Synthetic coding sequence
atgacaactctggcaggagctgttccgaggatgatgcgccctggtccaggccaaaactaccctaggagcggattcccacttgaagtctccacaccgttggggcagggcagagttaaccagctgggaggggtttttatcaatggaaggccactgccaaaccacattcgacacaagatcgtagagatggcacaccacggtatccgaccttgcgtgatcagcagacagcttagggtcagtcatgggtgcgtgagcaaaattctatgcagatatcaggaaactggctctatacggcctggggcaatcggtggctctaagcccaaggtgacaacccccgacgtggagaagaaaatcgaggagtacaaacgagagaatccgggtatgttctcctgggagatacgcgataaactgttaaaggacgctgtgtgcgacaggaatacagtacccagtgtgagcagcatctcccgcatactgaggagcaagttcggcaaaggagaggaggaggaggcagacctggaacggaaggaggctgaggagtccgaaaagaaggccaaacatagtatagatggcattctcagtgagagagcgtctgcgccacagtcagatgagggcagcgacatcgacagcgagcccgacttgcctttgaaacggaagcagcgcaggtctcgaacgactttcaccgctgagcagctggaagaacttgagagggccttcgagaggacccattaccccgatatctacacacgggaagaactcgcccagcgcgctaaactgactgaagcgagagtgcaggtctggttttctaatcggagggctcgctggcgtaagcaggcaggcgcaaaccagcttatggcgtttaatcacctcatacccggaggctttcccccaactgctatgccaaccctgcctacataccagttaagtgaaacatcgtatcagcccacctcaatcccacaggccgtctccgacccatccagcaccgtgcatcgcccacaacccctccctccaagcactgtgcatcagtccaccattcctagcaatccagattctagctctgcctactgccttcccagtacccgccacggattctcttcctataccgattcatttgtgccaccttcaggtccctccaacccaatgaatcctacaattggtaacggattgtcgcctcaggtcatgggtctgctcaccaatcatggcggtgttccacatcagcctcagaccgattacgccctctcccccctgacggggggactggaaccaaccaccactgtgtcagcctcctgcagccagcggctagatcatatgaagtcactggatagtcttcctacaagtcaatcttattgtcctccgacctactctacgaccggatacagcatggaccccgtgactggttaccagtacgggcagtatgggcagtctgctttccattacctgaagcctgacatagcgtag

SEQ ID NO: 233876 - DNA, 648 bp, Artificial Sequence
  Description of Artificial Sequence: Synthetic coding sequence
atgaccacactggctggagcggtaccacgaatgatgcgtcctggccctgggcagaactaccccagatctggattcccattggaggtatccacgcctctcggacaggggcgagtaaaccagctcggtggcgtttttatcaacgggaggccgctgccaaatcacattcgccacaaaatcgtggagatggcacatcacggtatcagaccttgtgtgatctctaggcaactgagggtgtctcacgggtgcgtttccaaaatcctatgccgctaccaggaaaccggatctatccgcccaggtgctataggcggaagtaagcctaaacaagtgacaaccccagatgtggagaagaagattgaagaatataagagagagaatcccggtatgttttcctgggaaattcgggataagttgctcaaagatgccgtgtgtgaccgcaacacagttccctccgtgtcatctatcagcaggatccttcggagtaaatttggaaaaggcgaggaggaggaagccgatcttgaaaggaaggaagcggaggaatccgagaaaaaagcaaagcacagcattgacgggattttaagcgagagaggtaagaggtggaggctgggcagacggacttgctgggtgacttggagggctagtgcgtcatag

SEQ ID NO: 233877 - DNA, 822 bp, Artificial Sequence
  Description of Artificial Sequence: Synthetic coding sequence
atgcatcaggacggaattagttcaatgaaccagctgggtggcctgtttgttaatggcagaccactccccctggatacccgtcagcagatcgtccggctggctgtgagcggtatgcgtccgtgcgacatctcccgcattttgaaggtgagtaatgggtgtgtgtcaaagatcctcggtcggtactatcgcactggggtgctggaacccaaaggaattggcggaagtaagccgcgtctcgccacccctccggttgttgccaggatcgcgcagctgaagggcgagtgccccgcactgttcgcctgggagatacagcgccaactgtgcgctgagggtctgtgtacccaggataaaacaccgtcggtctccagtatcaacagagtgcttcgcgcactgcaggaagatcaaggcctcccttgtaccaggctaagaagtcctgccgtattagccccagccgttctcacaccgcattcaggatccgaaacccctagggggactcatcccggaacaggccatcgcaatagaactatctttagcccatctcaggcggaagcccttgaaaaagaattccagcgaggccaataccctgacagcgtggcaagggggaagctggccaccgccacgagccttcctgaagacacggtgagagtatggttcagcaacagacgcgcaaagtggcggaggcaggaaaagctgaagtgggaaatgcagttgcccgctgtcccctggcagtgcgcacacagctcccctgcctgccctgggaccactggttctctcctgttgagtgcagtcctgggaaattctacccggaaggtcagcgaatag

SEQ ID NO: 233878 - DNA, 1032 bp, Artificial Sequence
  Description of Artificial Sequence: Synthetic coding sequence
atgaaccagttgggcggactgttcgtaaacggtcgacccctcccgttagacactaggcagcagatcgtgaggcttgccgtgtctggcatgagaccgtgcgatattagcaggatcttgaaagtctctaatggctgcgtgtccaagatactcggccgttactatcgtaccggggtcctcgaacctaagggcataggaggatctaaaccaagactggcaaccccgcctgtggtggcaagaatcgcgcagttgaagggggagtgccctgccctcttcgcatgggagatacagagacagctctgcgcagaggggctctgcacacaggataaaactcctagcgtaagctctatcaaccgggtgctgcgagctctccaggaggatcaaggacttccctgtactcgcctgagatcccctgcagttttagcgccagctgtgctgaccccacattctggctctgagacgcctagaggcacacaccccggtacaggtcaccgtaaccggaccattttctcaccatcccaagctgaggctctggaaaaagaatttcagcgtggacagtatcccgattcagttgcaagaggaaaactggctactgctacaagcctgcccgaagatacagtgcgcgtgtggttctctaatcgacgggctaagtggcggaggcaggaaaagctaaagtgggaaatgcaactgccaggagctagccaaggtctgactgtacccagagtcgcccctggtatcatcagtgctcaacaatcccccggatccgtgccgactgctgctctccctgccctggaacccctcggaccatcctgttaccagctgtgttgggccactgctcccgagagatgcctctctgatacccccccaaaagcgtgcctgaagccttgttgggggcatctgccgccacagcccaatagtctggattccgggcttttgtgcctgccttgtccatcatctcactgccacctcgcaagtctgtctggatcccaggccctactgtggccaggctgtcctcttttgtatggcctggagtag

SEQ ID NO: 233879 - DNA, 1047 bp, Artificial Sequence
  Description of Artificial Sequence: Synthetic coding sequence
atgcaccaggatggcatctcgtctatgaaccagttaggaggcttgtttgtgaatggacgccctctcccattggatacacggcagcagattgtgcggctggcagtgtccggtatgcgcccttgtgatatctccaggatcctcaaagtctcaaacggatgcgtttccaaaatcctcggccgatactatcgcaccggcgttctcgagcctaaggggatcggcggttccaagcccaggttagctacgcccccagtggtggcaaggattgcacagctgaaaggcgagtgccccgctttgtttgcatgggagattcagaggcagctgtgcgcagaagggctctgtactcaggacaagacccctagcgttagctcgattaacagagttctgagggctctccaggaggaccagggcctaccatgcactaggctcaggagtcctgccgtgctggcacccgcagtgcttacaccgcattccgggagcgagacacctcgaggcacacatcctggaacaggccacagaaacagaacgattttcagtccctcacaggccgaggcactggaaaaggagtttcagagaggtcagtaccccgattcggttgcccgtggaaagttggcaacagctacgtcactgccagaagataccgtgcgtgtgtggttttccaaccgacgggctaaatggcgcaggcaagagaaactgaaatgggaaatgcagttacctggggcatcccagggtctcactgttccaagagtggcccctggcattatttctgcacaacagtctcctgggtctgttccgacagcggctttacctgccttagaacctttgggcccttcgtgctatcaattgtgctgggcaactgccccagagcgctgcctgtcagacacgcctccaaaggcctgtctcaaaccttgctgggactgcggctctttcctacttcccgtaatcgcaccctcctgcgtcgacgtcgcctggccctgcttggatgcatccctggcgcaccatttgatcggcggtgccggtaaagctaccccgactcacttttcccattag

SEQ ID NO: 233880 - DNA, 1563 bp, Artificial Sequence
  Description of Artificial Sequence: Synthetic coding sequence
atggctgcactccccggaaccgtacctcgcatgatgcggccagctcctggccagaattatccaaggacgggctttcctctggaagtgagtacacccttaggacagggccgagtaaaccagttaggcggtgtattcatcaatggaagaccactgcctaatcacatccgacataagattgtagagatggctcaccacggtattcgaccttgtgtgatctctcgccagttgagagtctcacacggatgtgtgtctaaaatcctttgtaggtaccaagagactggttctatcaggcccggagctattggtgggtctaaaccccgacaggtggccaccccagacgttgaaaaaaaaattgaggagtacaagcgagaaaatcctggcatgtttagttgggagattagagacagattactgaaggacgggcactgcgatcgaagtaccgtcccttctgggctggttagctccatcagccgtgtattgcgaatcaagttcgggaagaaagaggaagaagatgaggctgacaagaaagaggacgatggcgagaagaaagcgaagcactcaatcgatgggattctcggggacaaaggcaatcgcctggatgagggctctgatgtagaatcagaaccagatcttccattaaagagaaagcagcgacggtccagaactacatttactgcagagcaattagaagaactcgaaaaagcctttgagcgcacccactaccccgatatctacactagagaggagctggcccagcgcaccaaacttacagaagcaagagtgcaagtgtggtttagcaacaggcgggctcgctggaggaaacaggccggagctaaccagctggccgcatttaaccacttactccccggtggattccctcccacaggcatgcccactctcccaccctaccaactgcccgactccacttaccccacgacaactatcagtcaggacggcggtagtaccgtgcatcggcctcaacccctacctccttccactatgcatcaaggcggacttgctgccgcagcagctgccgctgataccagtagcgcttacggcgcaagacacagcttttcttcatacagcgatagcttcatgaatccggctgctccaagcaaccatatgaatcccgtctccaacggactgtccccccaggtgatgagcattctggggaatcctagtgccgtgccaccacaacctcaagcagatttcagcataagtcctcttcatggcggtctcgacagtgctacctcaatcagcgcgtcctgttctcagagggcggatagcattaaaccgggtgatagcctcccaactagccaggcctactgcccaccaacctactccacaaccggctattccgtcgaccccgttgctggctaccaatatggacaatacggtcaatccgaatgtcttgtcccctgggcatcacctgtgcctattccctctcccaccccgagagcctcttgcctatttatggagtcgtacaaagtagtcagcggctgggggatgagcatttcacaaatggagaaattaaagtccagccagatggagcagttcacctag

SEQ ID NO: 233881 - DNA, 1557 bp, Artificial Sequence
  Description of Artificial Sequence: Synthetic coding sequence
atggcagccctgcctggtaccgtccctcggatgatgcggcctgcccctggccaaaactatccccgaacagggttcccactggaagtgtccacgcctttggggcaggggagagttaaccaactgggaggggtgttcattaacgggagacctctgcccaatcacattcggcacaaaattgtggaaatggcccatcacggcattcggccatgtgtgatcagccgccagttgcgagtgtctcatgggtgtgtgagcaagattctgtgtagatatcaggagactggaagcatccggcctggagccatcgggggatcaaagccacggcaagtcgctacccctgacgtggaaaagaagatcgaggaatataagagggagaatcccggtatgttctcatgggaaatccgcgatagacttctgaaagacgggcattgcgaccgatccaccgtcccttctgtgtcctctatttccagggtgctacggatcaagttcggtaagaaagaggaggaagatgaggccgacaaaaaggaagacgacggggagaagaaggccaagcattccattgatggtatacttggcgataagggtaatcgtctcgacgagggtagcgatgtggaatcggaaccggatctacctttaaaaaggaagcaacggcgaagcagaactacctttaccgccgaacaactcgaggaactggaaaaggctttcgagaggacccactaccccgatatctacacccgggaggagctggcccagcggactaagttgactgaagccagagtccaagtctggttctcaaatcgaagggcacgatggcggaagcaggctggcgctaatcagttggccgcttttaaccatttgctgccaggaggcttcccccctactgggatgccgacgcttccgccataccagctaccagactctacttaccctacaacgacaattagccaggatggcggttcaacggtccatcggcctcagccccttccaccttctacaatgcaccagggtggtctcgccgcagcggcagccgctgccgacactagctccgcttatggggcaaggcactctttctcatcttactctgatagttttatgaaccctgctgcccctagtaaccatatgaacccagttagcaatggactgtcaccacaggtgatgagtatcctgggtaatcctagcgccgtccctcctcagccacaggcggatttttccatatctcccctccatgggggtctggactccgccaccagtatctcagcaagttgtagccagagagccgatagcatcaagcctggtgattcccttccaacttcccaggcctactgcccacccacctatagcaccacgggatatagtgtggaccctgtggctggttatcagtacggccaatatggacagtcagagtgcctcgtcccgtgggcctcacctgtacctattcctagtccgactccaagggcttcttgcctgtttatggagagctataaagtggtgtccggttggggaatgtcgatctctcagatggagaagttaaaatcttcgcagatggagcagttcacatag

SEQ ID NO: 233882 - DNA, 1518 bp, Artificial Sequence
  Description of Artificial Sequence: Synthetic coding sequence
atggctgccttgcctggaacagtgcccaggatgatgaggccagcaccgggacagaattatcccaggacgggttttcccctggaagtctccacacctctcggtcagggacgcgtaaatcaattgggtggtgtctttattaacggcaggcccttaccgaaccacattcgccacaagatcgttgaaatggcccatcacggtatccgcccatgtgtaatctcccgacaattacgggtgtctcacggttgcgtgtccaaaatcctgtgccgataccaggaaaccggtagtattagacccggagcaatagggggttccaaacctcgacaggtcgctacccccgacgttgagaagaagatcgaagagtacaagagagaaaaccccggtatgttctcatgggagatccgtgatagactcctgaaagacgggcattgtgacagatccactgtgccatctggtttagtctcatctatatctagggtgttgaggatcaagtttggaaaaaaagaagaggaggacgaggcagataagaaagaagacgacggggaaaaaaaggcaaagcactcaatcgatgggattctcggcgataagggaaacagactcgacgagggttccgatgtggagagcgagcccgacctgccactcaaaaggaagcagcgacggagccggaccacattcacagcggagcagttggaagagctcgagaaagcttttgagcggacacactaccccgatatctatactcgcgaagaactggcccagaggaccaagctgaccgaggcccgtgtgcaggtctggtttagcaaccggagagcaagatggcgcaaacaggctggcgctaaccagctggctgcttttaatcatctgttacctggcggattcccccctacagggatgcccactttacccccatatcaactgcctgactcaacttatcccacaacaaccatctctcaggacggtggaagcactgttcacagaccgcagccgcttccaccttccactatgcaccaggggggtctggccgctgcagcagccgctgcagatacgtcctctgcctatggtgcccgacattcctttagctcttacagtgattccttcatgaatccagccgcaccatccaaccacatgaatcctgtgtccaatggtctctcacctcaggtcatgagtattcttgggaatccttctgctgttcctccgcagccccaggccgattttagcattagtcctctccacggcggattggatagtgctacctctatcagtgctagctgttcccaaagggcagattcaatcaaaccaggggattccttacctacctctcaagcctactgcccccctacctacagcactacggggtattctgtcgatccggtcgctggctatcagtacggccagtatggccaaacggccgtggattacttggctaaaaatgtgagtctgtctacccaacggcgaatgaaattgggggagcactctgcggttctggggctgctgcccgttgaaaccgggcaagcgtactag

SEQ ID NO: 233883 - DNA, 1026 bp, Artificial Sequence
  Description of Artificial Sequence: Synthetic coding sequence
atggagcctgctttcggtgaggttaatcagttgggtggcgtgtttgttaacgggcgaccactcccgaacgctatccggttacgaatcgtggaactggctcagttggggataaggccgtgcgatatcagtcgccagctgagagtgagccacggttgcgtttccaaaatactagcgagatacaatgaaactgggtcaattctgccgggtgcgattggaggatccaagcctagagtgaccacccccacagtggtcaagcacatccgaacttacaaacagagggacccaggcatcttcgcctgggaaattagagatcgtttgctagctgatggggtgtgcgataaatacaacgttcctagcgtatcgtcaataagccgaatattgcgcaataagatcggcaatctcgcccagcagggacactatgatagctataagcaacatcaacccactccacagccagctctcccctataaccacatttacagttacccctcacccattacagcagccgctgccaaagtcccaactccccctggcgtgcccgctatccctggctccgttgctatgccgaggacctggcctagctcccacagcgtgacagacattctgggcattcgctccataactgatcaggtctcagactccagcccttatcattccccgaaggttgaggagtggtcttctttggggcgaaacaacttccctgcagccgctcctcacgctgtgaacgggctggagaagggcgctcttgagcaggaggccaagtatggtcaggctcctaatggtttgccagcggtgggtagctttgtttctgccagtagcatggccccatatcctaccccagcacaggtgtctccttacatgacttatagcgccgcaccgagcggatatgtggcaggccacggttggcagcatgcgggtggtacctcccttagcccacacaactgtgatatcccagcttcactggccttcaaaggaatgcaggctgctcgcgaaggctctcattcagttactgcctcagccctctag

SEQ ID NO: 233884 - DNA, 1026 bp, Artificial Sequence
  Description of Artificial Sequence: Synthetic coding sequence
atggagccagccttcggagaggtgaaccagttgggaggagtgttcgtaaatggaagacctctgcccaatgctatccgcctgaggatcgtggaactggcccagcttggcatccgcccttgcgacatttctagacagttgagggtcagtcacggttgtgttagtaagatccttgctagatacaacgagacgggctccatattacccggtgcaattggtggaagcaagccaagagtgacaactccaacggtcgtcaagcatatcagaacatacaagcagcgcgaccccggaatatttgcttgggaaatccgggacaggctgttggctgacggcgtttgtgacaaatacaacgtgccatcagtatcaagcatcagccgcatcctaaggaataaaatcggtaacctggcacagcagggccactatgattcgtacaagcagcatcagccaacaccacagccagccctgccatacaaccatatatacagctacccttctcctattaccgctgccgcagcaaaggttccgacacccccaggagtccccgcaattccagggagcgtcgccatgccacggacttggccctcgtcccattccgttactgacattctgggcatccgctctatcaccgaccaggtgagtgattcttcaccttaccattcacctaaagtggaggaatggtcctcactgggtagaaataatttccccgctgccgcaccccatgctgtgaacggcttagaaaagggggctctcgagcaagaggccaaatacggccaagcccctaatggcctacccgctgttggttcgttcgtgtcagcatcttcaatggctccttaccctacacccgctcaggtttcaccctatatgacttattccgccgcacctagtgggtatgtggccggacacgggtggcagcatgctggagggacttctctctctcctcataactgcgacattccggcttccctagcattcaaagggatgcaggctgctcgtgagggtagccattcggtaacagcctccgcactgtag

SEQ ID NO: 233885 - DNA, 183 bp, Artificial Sequence
  Description of Artificial Sequence: Synthetic coding sequence
agcgattccagtccgtaccacagccccaaagtcgaagaatggtccagcctcgggagaaacaattttcctgcagccgctccacacgccgtgaatggcctagaaaagggcgctctggagcaggaggccaagtacggacagatccaaaacttctttttgctgatgatatctcgcctgaagttttag

SEQ ID NO: 233886 - DNA, 912 bp, Artificial Sequence
  Description of Artificial Sequence: Synthetic coding sequence
atgggtcgaccgcttctgctgcctctgcttcccttactgctcccgccagcctttttacagcctagtggttctaccggaagtgggcctagttacctgtacggagtcacccagcccaaacatctgtctgcttcaatgggcggttcagtggagatccccttttctttctattacccgtgggagctcgccactgcccctgatgtgagaatttcttggcgccgtgggcactttcatcgtcagagcttttactcaacccgacctccctctatacacaaggactatgtgaaccgcctgtttttgaactggacagagggtcagaagtcagggtttttgcggatatctaatcttcagaaacaggatcagagtgtttacttctgtagggtggagctagatacacggtcaagtggcaggcaacagtggcagagcattgaagggacaaagctgagtataactcaggccgtcaccaccaccactcagcggccatcaagcatgacaactacttggcggctttcttctacgactacaaccacaggactgcgcgtcacgcagggcaaacgaagatctgattcttggcacatttctctggaaactgccgtgggggtggccgttgctgtaaccgttcttgggatcatgatcctgggactgatatgtctcctgcggtggcggcgacgcaagggtcagcagagaacaaaggcaacaactcccgctcgcgaaccattccaaaatacggaggagccctatgagaacatccggaatgaaggtcaaaataccgacccaaaacttaacccaaaggacgatgggatcgtctatgcatctcttgccttgtcgtccagcacgtccccgagagctccacccagccatcggcctctgaagtcgcctcaaaatgagaccttgtatagtgtgttgaaagcctag

SEQ ID NO: 233887 - DNA, 693 bp, Artificial Sequence
  Description of Artificial Sequence: Synthetic coding sequence
atggggcgacctctattgttgcccttattgcctctcctgttgccaccagcgttcctgcagccatccggctctactggctctggtccctcctacctttatggtgttactcagccaaagcacctctctgcctccatggggggatctgtggaaatccccttttccttctactatccctgggagttagctaccgcgcctgatgtgaggatatcctggaggcggggtcactttcacaggcagagtttctattccacaaggccgccatctatccacaaagactacgttaatcgattatttcttaactggacggaggggcagaagtcaggattccttcggatttctaacctccagaaacaagatcagtctgtgtatttctgtagggttgaactggatacgcgcagttccggcaggcagcagtggcagtctattgaaggaaccaaactgtctattacccagggacaacaaaggaccaaggcaaccacccctgcccgagaaccgtttcaaaatacagaggagccttatgagaatattcgcaatgagggtcaaaataccgatcctaagcttaaccctaaagacgatggtatcgtgtacgcctcgctcgcgctgtcttcaagcactagtccaagggcaccacctagccacagacctctgaagtccccccaaaatgagacactatacagcgtactgaaggcatag

SEQ ID NO: 233888 - DNA, 528 bp, Artificial Sequence
  Description of Artificial Sequence: Synthetic coding sequence
atgggcaggccattgcttcttcccttgttgccactcctcctccctcccgctttcctgcagcccagtggcagcaccgggtctggcccttcctacctgtatggtgtcacccaacctaaacacctgagcgctagcatgggaggatcagtggaaattccttttagcttttactacccgtgggagctcgctacagccccagacgtgagaatatcatggcgacggggacactttcataggcagtctttctactcaaccaggcctccttctatccacaaagactacgtgaatcgtctgttcctgaattggactgaagggcagaagtccggattcctgaggatcagcaacttgcagaaacaggaccaatcggtgtacttttgcagagtggagctggacacaaggtcatcaggtcggcagcagtggcaaagtattgagggcactaaactgtcaataacccagggaaacccctcaaaaactcagcggtcccacatgcgcatttcgggaatgaaagacaagatccagattcccagttag

SEQ ID NO: 233889 - DNA, 492 bp, Artificial Sequence
  Description of Artificial Sequence: Synthetic coding sequence
atgggtcgcccactgttgcttccattgttacccctgctgctgccacctgcgttcttacagccgtctggaagcaccggatcgggaccttcatacctgtatggcgttacccagccaaaacatcttagtgcgagcatgggcggaagcgtggaaatccccttctcattctactacccctgggaactggccaccgccccagacgtgcgcatctcttggcgacggggtcactttcaccggcagtctttttattctacccgcccaccgagtatccacaaggactacgttaaccgcctttttctgaattggacagagggccagaagagcggctttttacgtatcagcaacttacagaagcaggaccaatctgtttacttttgcagagtcgaactggatacccgttccagcggcagacagcaatggcaaagcattgagggcactaagctgtccatcactcaagggcagcagaggaccaaggccaccaccccagctagatag

SEQ ID NO: 233890 - DNA, 684 bp, Artificial Sequence
  Description of Artificial Sequence: Synthetic coding sequence
atgggacgccctctgcttctccccctgctgttactgctgcaaccgccagcattcctgcagcctgggggatcgactggaagcggacccagttacctttatggcgtcacacagcccaagcatctttccgcttccatgggcggatcagtagagatcccgttcagcttctactatccatgggagcttgccatcgtcccaaatgtccgaatttcttggcgacgcggtcacttccacggacagagtttttacagtactagacctccttccatccacaaagactatgttaaccgcctgtttctcaattggactgagggccaggaatcggggttccttcggatttccaatttgcggaaggaagatcagtctgtctacttttgccgagttgagctggacaccagacgttccgggcgacagcagcttcaatcaattaagggtaccaaactgactatcactcaggccgttactacaaccactacttggaggccatccagcaccactacaattgctgggctgcgggtaacagaatccaagggtcacagtgagtcctggcacctgtccctcgatactgcaattagagtggccctggcagtcgctgttctgaaaaccgtgattttggggttgctgtgcttgctcctgctgtggtggagacgtaggaaggggtctcgggctccctccagtgacttctag

SEQ ID NO: 233891 - DNA, 999 bp, Artificial Sequence
  Description of Artificial Sequence: Synthetic coding sequence
atgggaagagctagctatggcggttcccctgtgggccatcagtcatcatccgaccaccctcgagctaaaacctgcaggagccccgttcgagacggtcccaggacactgtgcggcgtcccaactgtagcccttagtctgcattttctgagagaagccagctccggctcacggacctgtggccgacgaacttcactgtgcacttcagccaagagtagctggacataccggagcgcactacggcaaccactccaccgcgcaccccttttgcctggccagctttgctggtcaccccgacctttggagaagaataaagctatgggacgccctctgctcctgcccctcttgttgttattgcagccccctgcctttctgcagcccggaggcagcactggctcagggccatcttacctgtacggggtgactcagccaaaacacttgagcgcaagtatgggtggaagcgtcgagatccccttttcgttttattacccctgggaactcgccatcgtacccaatgtgagaatctcgtggcgcagaggacacttccacggccagtcattttacagcacacgacccccaagcatccacaaggattacgtaaataggttattcctgaattggactgaaggtcaggaaagtggttttttgcgaattagcaatctgaggaaagaggatcaaagcgtttacttttgccgagtggaattagatacaagacgaagtggtagacagcagctgcagagcattaagggtactaagctgacaattacacaggccgtgaccacaaccactacttggagaccatcctctaccactacaattgccggactccgcgtgacggagagcaaaggccactcagagagttggcacctctctctcgacaccgcgatacgggttgcactcgctgttgccgtattgaaaacagtaatcctgggtctcctgtgcctcttactgctgtggtggagacggcgtaagggtagcagagctcctagctctgacttctag

SEQ ID NO: 233892 - DNA, 384 bp, Artificial Sequence
  Description of Artificial Sequence: Synthetic coding sequence
atggggaggcccttactcctacctctgctgctcctgttgcagccccctgccttccttcaacccggtggtagtacagggagcggccctagttacctgtatggagtgactcagcccaagcaccttagcgcttcgatgggcggttccgttgagatacctttttctttctactatccatgggaactggctatcgtcccaaacgtcaggatatcctggcgcagaggtcattttcatggccagtcattttattccacaagacccccatccattcacaaagattacgtgaatcggctgttcttgaactggacggaaggccaggaaagtggtttcctgcggatttcaaaccttaggaaggaggaccagagtgtctacttctgccgggtttag

SEQ ID NO: 233893 - DNA, 684 bp, Artificial Sequence
  Description of Artificial Sequence: Synthetic coding sequence
atgggcaggccccttcttctgccactactgttactactacagcctcccgcattcctgcaaccgggaggttctacaggcagtggtccatcttacctgtatggagtcacccagcctaagcacctctctgcatccatgggtgggtctgtggagattcccttttcattttactacccctgggaattggcgattgtgcccaacgttcgaatatcttggagacgcggacatttccatggacagtctttttactcaacgaggccaccgagcattcacaaagattatgtgaaccggctgttcctgaactggactgaggggcaggaatctggctttctgcgtatttccaatctacggaaagaagaccagtcagtatacttttgcagggtggaattagacacaagacggagtgggagacagcagctgcagagcatcaaaggaaccaagctgaccattacacaggccgtgacaaccaccaccacctggcggccaagctccacaacaactatcgccggactgcgagtgaccgagagcaagggacacagtgagtcatggcacctttccttggatacggccatcagggtcgccctggcagtcgctgttctgaagactgtgattctgggcttattgtgtttattactgttgtggtggagacgacgtaagggatctcgcgctccttcctctgacttctag

SEQ ID NO: 233894 - DNA, 384 bp, Artificial Sequence
  Description of Artificial Sequence: Synthetic coding sequence
atgggcaggccccttctgctccctctgctcttattgctccaaccacctgccttcctgcagccagggggaagcaccggatctggtccatcctacctttatggagtgacacagcctaaacaccttagcgcttccatgggaggtagtgttgaaatccctttctccttctattatccgtgggagctcgccattgtgcccaacgtgaggatcagctggcggaggggacattttcacggacaatctttctactccacaagacctccttccatccacaaagattacgtcaatagactgttcttaaactggactgaaggacaggagtctggctttctacgaattagcaacttacgtaaggaagaccagagtgtgtacttttgtagagtctag

SEQ ID NO: 233895 - DNA, 183 bp, Artificial Sequence
  Description of Artificial Sequence: Synthetic coding sequence
atgggacgacctctcctcttgcccctgctgcttctgctgcagccacctgcctttttgcaaccgggtttatgtgagcctgcgctttccgaactcgaccggggtagcggcgaacgattaccccaagatctaaaaccggctgaaggtgggcctgtttgcgtgtttctgccgtcccgtgcaggctag

SEQ ID NO: 233896 - DNA, 366 bp, Artificial Sequence
  Description of Artificial Sequence: Synthetic coding sequence
atgggtcggccacttctgcttccacttctcctcctccttcagcccccagcatttctgcaacccggaggttccactggctctggtccttcatacctgtacggggtcacgcagcccaagcacctttctgctagcatgggaggatctgtcgagattcctttctcattctattatccctgggagttagccatagtgccaaatgtgcgaatctcctggcggagaggccattttcatggacaatccttctactctaccagacccccttcaattcacaaagactacgtcaataggttgttccttaattggacggaggggcaagagtctggattcttacgaattagtaaccttagaaaagaagaccagagctag

SEQ ID NO: 233897 - DNA, 384 bp, Artificial Sequence
  Description of Artificial Sequence: Synthetic coding sequence
atgggtcgaccactgcttctgccgttgttactactcttacagcccccagctttcctgcagccaggcggatcaacagggagcggcccttcatatctctacggagtcactcagcccaaacacctttccgcttctatgggcggaagcgtggagattccattcagcttctattatccgtgggagctagctatagtacccaatgtgcggatcagctggcggcgagggcacttccacgggcagtctttttatagtacacgtcccccttccatccacaaggactatgttaaccgcctgtttctcaactggactgaaggccaggaatccggctttttgcgtatcagcaacttgaggaaagaggatcagtctgtgtacttctgtcgcgtgtag

SEQ ID NO: 233898 - DNA, 684 bp, Artificial Sequence
  Description of Artificial Sequence: Synthetic coding sequence
atgggacgtccacttttgctgcctctgctcttgctgctgcagccgccagcctttcttcaaccaggaggatccactggctctggcccaagctatctatatggagtcacgcagcccaagcatctgagcgcatccatgggtggttccgtagagatccccttttcattttactatccttgggagctggctatcgtgccaaatgtgcgaatttcgtggcgcagggggcactttcatggccagtccttttattccacacgcccaccgtctatacacaaggactatgtaaatagactgttcttgaactggaccgagggccaggagtccgggttcctccggatcagtaacctaaggaaagaagaccagtccgtctacttttgccgagtggagctagacacaagaaggagtggacggcaacaactgcaatcgattaagggaacaaagttaactatcacacaggcggtgactaccaccaccacctggaggcccagctcaacgactaccatcgcaggcctgagggttactgagagcaaaggccattcagagagttggcacctctcattggatactgccatcagggttgctctggccgtggccgtgctgaagaccgtgatcctcggcctcttgtgcttgctactgctttggtggcgcaggaggaagggttcacgcgctccttcatctgacttctag

SEQ ID NO: 233899 - DNA, 450 bp, Artificial Sequence
  Description of Artificial Sequence: Synthetic coding sequence
atgggtcggcctctgctgctacctttgctcctcctattacaaccccctgcttttctgcagccaggactctgcgagcctgccttgtcagagcttgatcgagggtccggcgagaggcttccccaggacctgaagccggcagagggagggccagtgtgcgtgttcttgccttcacgagccggtcatcccgagatccgagaggcagccgtggcggttcatcagggtgatcagacacatcatcatcctggctgtcacaatcaccaccacttggaagctcagcaacacaaccaccattcccgtccccaaggacatagaaaacagagagctttaaggattatggcccctaagagtgggcattgtcaccagggctgcattgggtgcagatgcgcgcagaactgccacttcggcacagccgttccccctcctcctgtcgtagaagaaaaggagcggtag

SEQ ID NO: 233900 - DNA, 816 bp, Artificial Sequence
  Description of Artificial Sequence: Synthetic coding sequence
atgggacgggcttcttacggtgggtctcctgtggggcaccagtcgtcatcagaccatcccagagccaagacctgtcgaagccccgtaagggacggacccagaaccctctgtggggttccgacggttgcgttatcgctgcactttttgcgcgaggcttcttcagggtcccgtacctgtggcaggcgcaccagcttatgcacctcagcaaagagttcttggacatacaggtccgggcgtctgagctggcagtcaatcaaaggaactcatcttaccatcacccaggcgcttagacaaccactgcacagagccccactgctccctggccaactgtgctggtctccgaggcctctcgagaagaacaaggcaatggggagaccactgttgcttccgctgttactgttactccaaccaccggcttttctgcaacctggcctgtgtgaacccgcattgtcagaactggataggggttcgggtgagaggctcccccaagatctgaaacccgctgaaggcggtcctgtgtgtgttttcctaccctcccgggctggacatcctgagatcagggaagccgcagtcgctgtgcatcagggggaccagactcaccatcacccaggctgtcacaatcaccatcatctcgaggcgcagcaacacaaccaccattctagaccccagggtcaccggaagcagagagccctgcggattatggctcccaaaagcggccattgccatcaagggtgcatagggtgtcggtgcgctcaaaactgccactttggcactgccgtaccccctcctccagttgtagaggaaaaagaaagatag

SEQ ID NO: 233901 - DNA, 684 bp, Artificial Sequence
  Description of Artificial Sequence: Synthetic coding sequence
atgggaaggccactgcttttgcccttactcctgctgctccagccccctgccttcctccagcctgggggatccaccggatcaggcccttcctacctctacggcgtgacccagcctaaacatctgtcagcctcaatgggcggatccgtggagattcccttctcattttattacccgtgggagttggccatcgtgcccaacgtgcgtatttcctggagaagggggcatttccacggacagagcttttactctacacggcctccatccattcacaaagactatgtgaaccgcttgtttcttaactggactgagggccaggagtctggcttccttaggattagtaacttacgaaaggaggaccagagtgtctatttctgcagagtcgagttggatactcggagatccggtcgccagcagctgcagtctatcaaaggaactaagctgaccatcacccaagctgtcacaaccaccactacctggcgacccagctctacaacaacaattgccggtctgcgagtgacggagtcaaaaggtcactcagagtcatggcacctatctctggatacagctatccgggtggcgttggccgtggctgtgttgaaaaccgtgatactgggcctgctttgcctactgctgctgtggtggcggagacgaaaaggctctcgggctcctagctccgacttctag

SEQ ID NO: 233902 - DNA, 327 bp, Artificial Sequence
  Description of Artificial Sequence: Synthetic coding sequence
atgggaagagcttcatatggagggtccccggtgggccaccaatctagtagtgatcatcctcgagctaagacctgcaggagccccgtgagggatggacccagaaccctgtgtggagtaccaacggttgcgctctccttgcacttcttgagggaggcaagctccgggtcccgaacatgtgggagacgcaccagcctgtgtacttccgcaaagtccagctggacatacaggagcggacggttgtcttggcagagcatcaagggaactcacctcacgatcacacaagccctccggcagcctcttcaccgggctcctctacttcctggatag

SEQ ID NO: 233903 - DNA, 384 bp, Artificial Sequence
  Description of Artificial Sequence: Synthetic coding sequence
atgggtcggccactgttgctccccctgctcctgttactccagccacccgcttttttgcagcccggtggatctacaggctcaggcccatcctacttgtatggcgtgacccagcccaaacatttgagtgcgtctatgggcggttctgtggagattccattcagtttctactatccgtgggagctggcaattgtgccaaatgtcaggattagctggcgaaggggccactttcacggccagagcttttactctacgcggccaccctcaatacataaagattatgtcaatcgtctctttctgaattggacagagggacaggaaagtgggttccttcggatttctaacctaaggaaagaggatcagtctgtatacttttgtagagtttag

SEQ ID NO: 233904 - DNA, 738 bp, Artificial Sequence
  Description of Artificial Sequence: Synthetic coding sequence
atgacctcgtcatatggccatgtattagaacgccagccagccctagggggtcgtctcgactccccaggcaacttagacacactgcaggctaaaaaaaatttctccgtttcacacttacttgacctagaagaagctggtgacatggtcgccgctcaggccgacgagaatgtcggagaggccggacgctccctgctcgaatctcctgggcttacatccggatcggatactcctcagcaggacaatgaccagcttaatagtgaggagaaaaagaaaaggaaacaaaggaggaataggacaacgtttaatagcagtcagctgcaagccctcgaaagagtgttcgagcgcacccattatcccgacgcctttgtccgggaggacctggctcggcgtgtgaaccttacagaggctcgcgttcaagtatggttccagaatcgacgcgctaagttccgacggaacgagagggcaatgctcgccaacaagaacgccagcttgctcaagtcatactcaggcgatgtaacagccgttgaacaacctattgtacctagacccgcaccaaggccaactgattaccttagctgggggactgcatctccttactcagctatggccacatacagcgcaacatgtgcgaacaatagccccgctcagggcatcaatatggctaatagtatcgccaacctgcggctgaaggctaaagaatactctctgcagagaaaccaagtgcctactgtgaattag

SEQ ID NO: 233905 - DNA, 654 bp, Artificial Sequence
  Description of Artificial Sequence: Synthetic coding sequence
atgactagcagctatggacatgtgctcgaaagacagcccgcattagggggacggctcgacagtcccggaaatcttgacacactgcaagccaaaaagaacttttccgtcagccacctcctcgatctggaggaagccggtgacatggtcgcagcccaggccgatgaaaacgttggggaagctggccgatccctcctcgagagtcccggtctgacctccggatcagacacccctcaacaagataatgatcaactgaacagcgaggagaagaagaagcgcaagcagcgaagaaatcggactactttcaacagctctcagctgcaagccctcgagcgcgtctttgagcgcacacactatccagatgcttttgtccgggaagatctcgctcggagggtgaacctaacggaggcaagggttcaggtgtggttccagaaccgcagagccaagttccggcgtaacgaacgcgcaatgttggcaaacaagaacgcctctttgctcaaaagctatagtggcgatgtgactgccgtggaacagcctatcgttccgagacctgccccacggccaacagactatctcagctggggcacagcttcaccctatagaagtagcagcctaccaagatgttgtttacatgaaggactacacaacgggttttag

SEQ ID NO: 233906 - DNA, 762 bp, Artificial Sequence
  Description of Artificial Sequence: Synthetic coding sequence
atggacagcgctgccgctgcttttgcccttgataagccagccctcggccctggaccaccaccaccaccacccgctctcggacccggagactgcgcccaggctaggaagaatttttccgtatcccatctattggatcttgaggaagtggctgctgccggacgcctggcagcgaggcctggcgcacgcgcagaggccagggaaggagccgctagagagccatctggcggatcttctggctcggaagccgctcctcaggacggtgaatgcccatctcccggaaggggctccgccgcaaagagaaagaagaagcagcgaaggaacaggaccacattcaacagctcccaactgcaagcgttggagcgggtcttcgagcggacacactatcccgatgccttcgttcgagaagagctggcaagaagagtgaatctgtccgaggccagggtgcaggtgtggtttcaaaacagacgggcaaaattcagaagaaatgaacgagcaatgctggccagtaggagtgctagccttttgaagtcatactcgcaggaagcagccatagagcaaccagtggcccctcgcccaactgcgctcagtcctgattacctaagctggaccgctagctccccatactccacggtgcccccttacagcccaggaagtagtggccctgccactccaggagtgaacatggcgaatagtattgcttccctgagactgaaggccaaggagttttccttacaccacagccaagtgcctaccgtgaactag

SEQ ID NO: 233907 - DNA, 855 bp, Artificial Sequence
  Description of Artificial Sequence: Synthetic coding sequence
atggactacagctaccttaattcatatgacagttgcgtagcagcgatggaagccagtgcatatggggattttggggcatgcagccagcccggaggttttcagtattccccactcaggcctgcctttcccgctgcagggcctccttgtcctgcccttgggtcctcgaattgcgccctgggagctctaagggatcaccagccggcaccctattctgccgttccttacaaatttttcccagagccgtcaggcttacacgaaaagcgaaagcaaagacgtatacggacaacttttacgtcagctcagttaaaagaactggagcgggtgtttgccgaaacccactaccctgacatctatacccgagaagagctggcgcttaaaatcgacctgacagaggcgcgagtacaagtgtggttccagaataggcgcgcaaagtttagaaagcaagaaagagccgcttctgccaagggggctgccggagcggctggtgcgaagaagggcgaggctcggtgcagctccgaggatgacgactccaaggagtcaacctgctccccaactcctgacagcacagcaagcctaccccctccaccagcacccggactggccagccctaggctgtctccctcacccctgccagtcgccctcggatcgggcccagggccaggcccagggccacagccactgaaaggggcactctgggcaggagtggctggcggtggaggcggtgggccaggagctggagcagccgagttgctgaaggcttggcagcccgctgaatccggcccaggcccattttccggggtgctgagttcttttcatcggaagcctggcccagcccttaagacaaacctcttttag

SEQ ID NO: 233908 - DNA, 1800 bp, Artificial Sequence
  Description of Artificial Sequence: Synthetic coding sequence
atgaaactgttaaaactgacgggttttatcttctttctcttcttccttactgagtctctgacactcccaactcagcctcgggacatcgagaacttcaattcaactcagaaattcattgaggataatatcgagtacatcactattatagcctttgcacagtatgtccaggaggccactttcgaggagatggaaaagctggtcaaggacatggtggaatataaggatcgatgcatggctgacaagacccttcccgaatgctcgaaactacccaataacgtcctgcaagaaaagatttgcgccatggagggtcttcctcagaaacataatttctcgcattgctgttccaaagttgatgcccagcggagattgtgctttttttacaacaaaaagtccgacgtcggattcctgccccctttccctaccctggaccccgaagagaaatgtcaggcatatgagtcaaacagagagtcccttctgaatcacttcctgtacgaggtggcgagacgcaatcctttcgtttttgcacccaccctcctaaccgtagccgttcactttgaggaggttgccaaaagttgctgtgaggaacaaaataaagtaaactgcctccagacacgggctatcccagtcacgcagtacttgaaagccttttccagctatcagaaacacgtgtgtggggcactcttgaaattcggaacaaaagtggttcattttatttatatcgctattctgagccagaagttcccaaaaatcgagttcaaagaattgatttcactggtggaggacgtgtcaagcaattacgacggctgctgtgagggggatgtcgtgcagtgcatccgtgacaccagcaaggtgatgaaccacatctgcagtaagcaggactccatttcgtccaagatcaaagaatgctgcgagaagaaaattcccgaaagggggcaatgtattatcaactctaacaaagatgatcgcccaaaagacctgtcgttgagagaaggcaagttcactgatagtgaaaacgtgtgtcaggaacgggacgccgaccccgacactttttttgccaaattcacattcgagtattctcgacggcacccagacctcagtatccctgagttgctaagaattgtccaaatctataaagatctgctacggaattgctgcaatacagagaatcctcctggatgctacaggtacgctgaggataaattcaatgagacaactgagaagagcttaaaaatggtacaacaagaatgcaagcacttccaaaacctgggcaaggacggtctgaagtaccactatctcattcgactcacgaagatcgccccacaactctcaaccgaggagctcgtgtcattgggtgagaagatggttacagctttcaccacttgctgcactctatctgaggagttcgcctgcgttgacaacctagcggacctggtcttcggcgagctctgcggggtgaatgagaatagaacgatcaatcccgctgtggaccattgttgcaaaaccaattttgcctttcgcaggccatgctttgagtccctgaaggccgacaagacgtatgttcctcccccatttagtcaggatttattcacattccatgctgacatgtgccagagccagaacgaggagctgcaaagaaagactgaccgcttccttgtcaatctggtcaaactcaagcacgagctcaccgatgaggagctgcagtctctcttcaccaattttgcaaatgttgtggataaatgctgcaaagcggaaagccctgaggtctgctttaacgaggaaagccccaagatcggcaactag

SEQ ID NO: 233909 - DNA, 945 bp, Artificial Sequence
  Description of Artificial Sequence: Synthetic coding sequence
atggatgctttcaaggggggaatgtccctggaacgtctccccgaaggcctccgccctcccccaccgccacctcacgatatgggtcccgcttttcacttggctcgaccagccgatccaagagagcccttggagaacagcgcctcagaatcctcagacacagaactgcccgagaaagaacgcggaggcgaaccgaagggcccagaagactctggcgcaggcggaacaggatgcgggggagctgacgaccctgcaaaaaaaaagaagcagcgcaggcagagaacacactttaccagccagcagttgcaggaactcgaggccacctttcagcgcaatcggtacccagacatgagcatgcgcgaggaaattgctgtttggactaacctcaccgagcccagagtgcgcgtttggttcaagaaccgcagagccaagtggcgcaaacgcgagcggaaccaacagttggatttgtgtaagggtggctacgtaccgcagttttccggtcttgtgcagccctacgaggatgtttacgcagccggttactcttataataactgggccgctaaatctttggctccggcacctcttagcactaaaagtttcactttcttcaattctatgtcaccactgtcatctcagagcatgttctccgctcccagcagtatatcttcgatgaccatgccatcaagcatgggcccaggtgctgtccccggtatgcccaacagtggattgaataatatcaacaacctgacaggtagctcgttgaattctgccatgtcccctggtgcgtgcccttatggaactcccgcttccccatattccgtctacagggacacctgtaattcttccttggcttcccttcgactgaaaagcaaacaacactcaagttttggctacggtggtttgcaagggcctgccagtgggctcaacgcgtgccagtacaattcatag

SEQ ID NO: 233910 - DNA, 345 bp, Artificial Sequence
  Description of Artificial Sequence: Synthetic coding sequence
atggacgcttttaagggcggaatgagtctcgaaagactccccgagggactacgcccaccgccacctccccctcatgatatgggaccagcattccatctggcaagaccagccgaccctagagagccgctggaaaattccgcgagtgagagttcagatacagaactgcctgagaaagagcgtgggggagagccgaaggggccagaggacagcggggctggaggtaccggatgcgggggtgccgacgaccctgccaaaaagaagaagcaacgccgacaaaggacccacttcacctcacagcaactccaagaattagaggcaactttccagcgaaatcgatatccctag

SEQ ID NO: 233911 - DNA, 945 bp, Artificial Sequence
  Description of Artificial Sequence: Synthetic coding sequence
atggacgccttcaaaggcggtatgtctttagagaggttgccagagggccttcggcctccgccacccccaccacacgatatgggccctgcatttcatcttgcccgtccagccgatcccagagagccactggagaactctgcgagcgaatcaagtgacactgagctcccggagaaagagcgtggtggggaaccgaagggtcccgaagattctggagctggtggcaccggctgcggcggtgcagacgatcccgcaaagaaaaaaaaacagagaagacagcgaacccatttcacttctcagcaactccaggaacttgaggcaacttttcaacgcaatcgctatcctgacatgtctatgagagaggagatcgcagtctggaccaacctcacggagccacgtgtaagggtatggttcaagaacaggcgggctaaatggcggaagcgggagagaaatcagcagctggacctgtgtaaggggggatacgtgcctcaattcagcgggctagttcaaccctacgaggatgtgtacgccgcaggttactcatacaacaactgggctgcaaagtctctggccccagcccctctgtccaccaaaagctttaccttctttaattcaatgtctcctttgagttctcagagcatgttctcagccccttccagcatctccagtatgaccatgcctagcagtatggggccaggtgctgtgcctggaatgcctaacagcggtttaaacaacatcaataatcttacaggttcatccttgaacagtgctatgagtcccggagcctgtccgtacggcacaccagcctccccatactctgtttatagggatacatgcaacagctcattggcctcgctgaggctcaaaagtaaacaacacagcagttttggatatggcggactgcagggaccagcttctgggctgaatgcctgtcagtacaactcatag

SEQ ID NO: 233912 - DNA, 396 bp, Artificial Sequence
  Description of Artificial Sequence: Synthetic coding sequence
atggacgctttcaaagggggaatgtcattagagaggctgcccgaagggctgcgcccacctccacctcccccacatgatatgggtccagcttttcatctcgcccgacccgctgacccacgcgagcccttagagaattcagctagtgagtcgtccgataccgagctacccgagaaggaaagaggtggcgaacctaagggccctgaagattcaggggcagggggaacgggatgtggcggagccgacgatcccgcaaagaagaaaaaacagcgcagacagcggacacacttcacttcccagcagctccaggagctggaagccactttccagcgcaatcgttatcctgatatgtcaatgagggaggagattgcagtttggaccaacctcaccgagccctag

SEQ ID NO: 233913 - DNA, 975 bp, Artificial Sequence
  Description of Artificial Sequence: Synthetic coding sequence
atgaactgcatgaaagggcctctgcacttggaacaccgcgctgctggcaccaaactctctgctgtgtccagctcttcatgccaccacccacaaccactggcgatggcatccgtcctggcccctggccaacctcggagtctggactcttctaagcatcgcttggaggtacatacaatttcggacacaagctccccagaggccgctgagaaggataagtctcagcagggaaaaaatgaagatgtcggggctgaagacccatccaaaaaaaaaagacagcggagacaaaggactcattttacatctcagcaactgcaggaactcgaggccactttccaacggaacaggtatcctgatatgtcgaccagagaagaaatagccgtgtggactaacctgaccgaggcccgagtgcgagtctggtttaagaataggcgggctaagtggaggaagagggagcgcaatcaacaggccgagctgtgtaagaacggctttggtccccaattcaatgggttaatgcaaccgtatgacgatatgtacccaggatacagctataacaactgggcggcaaaaggcctgacgagtgcttcactgtcaacaaagagtttcccttttttcaattctatgaatgtgaatccgttaagctcacagagtatgtttagtcctccaaacagtatttcctctatgagcatgtcaagctccatggtgccatcagccgtgaccggagtacccggtagcagccttaacagtctgaacaatctcaataacctgtctagcccttctcttaacagtgccgtacctacgcctgcctgcccttacgcgccacctacacctccctacgtgtaccgggatacctgcaattctagtctggctagcctgagactgaaggctaaacagcactcctcatttggctacgcatcagttcaaaaccctgcgagtaacctctcagcctgccagtatgctgtggaccgccctgtttag

SEQ ID NO: 233914 - DNA, 954 bp, Artificial Sequence
  Description of Artificial Sequence: Synthetic coding sequence
atggagacgaattgtagaaagttagttagtgcatgtgtccagttgggcgtccagccagctgctgtggagtgtctgttttctaaagattccgagatcaagaaagtcgagttcactgatagtcctgagagtaggaaagaagctgcctccagcaaattcttcccccgtcagcatccaggggcaaacgagaaagacaagagtcagcaggggaaaaatgaggacgtgggcgcagaagatcccagcaagaagaagagacagaggaggcagcggacccattttactagccaacagttgcaagagctggaggcaacttttcagcggaatcggtatccggacatgagtacaagagaggaaattgctgtatggacgaacttgacggaggccagagtcagagtgtggttcaaaaatagacgcgctaaatggcggaaacgtgaacggaaccagcaggccgagttgtgcaagaatggcttcggcccacagtttaatggcctgatgcaaccatatgatgacatgtatcccggatatagttacaacaactgggctgcaaagggtctgacatcagcatccttgtcaaccaaaagctttcctttctttaactctatgaacgtaaatcccctatcttcccagtctatgttttcgccacccaactccatctcttctatgtcaatgagctcgagcatggtcccgtccgccgtgacaggcgtgcctggttctagcctcaactcccttaataacctgaataacctctccagcccttccctcaactccgcagtcccaactcctgcctgcccatatgcaccccctaccccaccgtacgtttacagagatacctgtaactcctcgttggcctccctgagacttaaggctaaacaacattcctcatttgggtacgcttcagtgcagaatcctgcgtctaacctcagcgcttgccagtacgccgtcgatcggcctgtatag

SEQ ID NO: 233915 - DNA, 816 bp, Artificial Sequence
  Description of Artificial Sequence: Synthetic coding sequence
atggagaccaattgtagaaagctcgtcagcgcatgtgtacagctggaaaaagacaagtcgcagcaagggaagaacgaagatgtgggcgctgaggacccctctaagaaaaagaggcagcgcaggcagagaacacacttcacaagccagcaactgcaggagttggaggccacatttcaacgcaaccgctacccagacatgagcacgcgggaagagattgcagtgtggaccaatttgacagaggctcgagtaagggtgtggtttaagaatcggagagcgaagtggcgaaagcgggaacgcaatcagcaagcagaactctgcaagaacggattcggaccacagttcaacgggcttatgcagccttacgacgacatgtatcccggttactcatataacaattgggccgcaaagggattgacaagtgcgtctctgtctactaagtcattccccttcttcaactctatgaacgtaaatccgctcagctctcagtctatgtttagcccgccaaatagtatctcctccatgtctatgtcgtcctctatggtgccatccgcagtaacgggagtgccaggaagcagcttaaattcactgaataaccttaataacctgagctccccgagcctcaactccgccgttccgacgcccgcttgtccatatgctccccctaccccaccttatgtttacagagacacatgcaactccagcttggctagtctcagacttaaagctaagcagcactctagttttgggtacgcctcagtgcaaaaccccgcaagtaaccttagcgcatgccagtacgcggtcgacaggcccgtatag

SEQ ID NO: 233916 - DNA, 954 bp, Artificial Sequence
  Description of Artificial Sequence: Synthetic coding sequence
atggaaaccaattgcaggaaattggtcagtgcttgtgtacaattgggagtgcagccggcagcggtcgaatgtttgttctcaaaagattccgaaataaagaaggtcgagtttacggactcgcccgagagccgcaaagaagccgcatcctccaaatttttcccacgacagcaccccggagctaatgagaaagataaaagtcaacagggtaaaaacgaggacgttggggcagaagatccctctaagaagaagcgtcagcgcagacagcgtacccatttcacttcacaacaactgcaggaactcgaagcaacctttcagaggaatcgataccccgacatgagtacgagggaggagatagccgtgtggaccaacctgacagaggcccgagtacgggtctggttcaaaaaccgcagggccaagtggagaaagcgcgaaaggaatcaacaagctgaattgtgtaagaacggttttggtcctcagttcaatggactgatgcagccctacgatgacatgtaccctgggtactcttacaacaactgggccgctaagggcctgacctccgcgagcctatctactaagagtttccccttcttcaatagcatgaatgtaaatcctctcagctcccaatccatgttttcgcctccaaactctatcagctctatgtcaatgagttcgtccatggtgcccagcgctgtgaccggagttcctggaagttctctgaattctctcaataatctaaacaacttgtctagccccagcttaaactctgctgtgcctacaccagcctgtccatatgcccctcccaccccaccatacgtctacagagacacatgcaattcttctctggcatcccttcgcctcaaggcaaaacagcacagctcttttggatatgcttccgtccagaatccggcttctaatttgagtgcctgccagtacgcagtcgacaggcccgtgtag

SEQ ID NO: 233917 - DNA, 873 bp, Artificial Sequence
  Description of Artificial Sequence: Synthetic coding sequence
atggaaacaaattgtcggaagctggtttccgcttgcgtacaactcggggttcagccagccgcagtcgagtgtctcttcagcaaggactccgaaatcaagaaagtcgagttcacggactcccctgaatctaggaaagaagccgctagctctaagttctttcctcgccaacaccccggtgccaatgaaaaagacaaaagccagcaggggaaaaacgaggacgttggcgctgaagatccatccaagaagaaaaggcagaggcggcagcggactcactttacaagccagcagttgcaggaactcgaggcaactttccagaggaacaggtatccagacatgagcacacgggaggagattgccgtctggacgaatcttactgaggccagagttagagtttggttcaaaaaccggcgtgccaaatggagaaaaagggagcgcaaccagcaggctgagctgtgtaaaaacgggtttggccctcagttcaatggactgatgcagccatatgatgacatgtacccagggtattcttataataactgggcggcaaaggggctgacctccgcctccttgtccactaagtccttcccttttttcaactctatgaatgtcaacccgctgtctagccagagcatgttcagcccgccaaactccatatcgagcatgtctatgtcctcttccatggttcctagcgccgttacaggcgtccccggatcgagcctgaactccctcaataaccttaacaatctgagttctcccagccttaactccgcagtgccaacacccgcatgcccatacgccccacctaccccaccttatgtgtatagagatacttgcaatagctcactggcttcccttcggctcaaggccaaacaatag

SEQ ID NO: 233918 - DNA, 357 bp, Artificial Sequence
  Description of Artificial Sequence: Synthetic coding sequence
atggagaccaattgtcgaaagctggttagcgcgtgcgtccagctggagaaggataagtcccagcagggcaaaaatgaggatgtgggtgctgaggacccctctaagaaaaagcgccagcggagacaaaggacccattttacctctcagcagttgcaagagttggaagctactttccagcggaaccgttatcccgatatgtccacccgcgaggaaatcgctgtgtggaccaacctgaccgaagcaagagtcagggtctggttcaaaaacagaagggccaagtggagaaaacgcgaaagaaatcagcaggccgagttgtgtaaaaatggctttggccctcaattcaacgggttgatgtag

SEQ ID NO: 233919 - DNA, 909 bp, Artificial Sequence
  Description of Artificial Sequence: Synthetic coding sequence
atggagtttgggctacttagcgaggcggaagctcgttctccagcgctatcgctgtctgatgccggtactcctcacccgcagctccctgagcacggttgcaagggtcaggaacatagcgattccgagaaagccagcgcaagccttccaggcggatctcctgaagatggaagtctcaaaaagaagcagcggaggcaacgcacacattttacaagccaacagctgcaggagcttgaggcgactttccagaggaaccggtatcctgacatgtccactagggaggagattgcagtctggacaaatctgaccgaggcccgtgtgcgggtgtggttcaagaacaggcgcgctaaatggcgcaaacgcgagagatcgcagcaggccgaactgtgtaaggggtccttcgcagcccctctcggaggtttggtacccccatacgaggaagtttacccagggtacagctacgggaactggccacctaaggccctggcaccacccctcgctgcgaaaacttttccgttcgcttttaactcagtcaatgttggacccttggcttctcagccagtcttcagcccaccttcctctatcgcggcaagcatggtacctagtgcggctgcggcaccagggaccgtaccaggtcccggtgcgctgcaggggcttgggggtggcccaccaggtctcgcccctgctgcagtcagctctggagccgtgagttgtccatacgcctctgccgctgcggctgcagctgccgctgcttcgtcaccatacgtgtacagggatccttgcaattcatccctcgcatcactgagacttaaagccaagcaacacgcttccttctcgtatccagctgtgcacggtcctccccctgctgcaaacctgagcccctgccaatatgccgtagagaggcctgtctag

SEQ ID NO: 233920 - DNA, 909 bp, Artificial Sequence
  Description of Artificial Sequence: Synthetic coding sequence
atggagtttggacttttatctgaagcggaggccagatcccccgctttatcactgtcagacgccggaacccctcatcctcagctacccgagcacggttgcaagggccaagagcacagcgactcagagaaagcctctgctagcttgcccggtgggagccccgaggatgggtccctaaaaaagaagcagcgacggcaacgaactcactttacttctcagcagctccaggagctcgaggctacatttcaaaggaaccgctaccccgatatgtctactcgtgaggaaattgcggtatggacaaacttgacagaggcacgggttagggtctggttcaagaaccggagagccaagtggcgcaagagggagagatcccaacaagcagagctgtgcaaaggatctttcgcagctccccttggcggtctggtgcctccctacgaggaggtgtatccaggatacagctacggaaactggccacctaaggccctcgcaccacccctcgcggcaaagaccttccccttcgcgtttaactccgtgaatgtggggcctctcgcgtctcagccggtattcagccccccatccagcattgccgcttccatggttccaagcgcagcggctgcccctggaaccgtgcctggcccaggtgcattacaaggactaggaggtggaccaccgggactggcaccagccgctgtctcctccggcgctgtgtcatgcccatacgctagtgccgctgccgctgccgcagccgctgcttcttcaccttacgtttacagagatccatgtaactccagcctggcttcgctgagactgaaagccaagcagcacgcctctttttcctatccggctgtgcatggccctccccctgcagcaaacctcagtccttgtcagtatgctgtagagagacccgtgtag

SEQ ID NO: 233921 - DNA, 1179 bp, Artificial Sequence
  Description of Artificial Sequence: Synthetic coding sequence
atggagctcgtggccggttgttacgaacaagtgctgttcggattcgcagtgcacccagaacccgaagcatgcggcgaccacgaacaatggaccctggttgccgatttcactcatcacgcacacactgcttccctgagtgcagtagctgtgaacagtcgcttcgtagtcacgggcagcaaggatgagaccatccacatctatgacatgaagaagaagatcgagcacggggctctggtgcaccatagtgggaccatcacatgtctgaagttctacggcaataggcatctaatctcaggtgccgaggacgggttaatttgcatttgggacgcaaagaagtgggaatgcctgaagtctattaaagctcacaagggccaggtgacattcttatccatccatcccagcggcaaactggccctatcggtgggcacagataagactctgcgcacatggaatcttgtcgaaggaagatctgcctttattaagaacattaaacagaacgcacatatagtcgaatggtcacctaggggggagcagtacgtcgtcattattcagaataaaatcgacatatatcaattggatacagcctctataagtggcactatcaccaacgaaaagagaatcagcagtgttaaattcctgtcagagtccgtgctggccgtggctggcgacgaagaagtgatccggttctttgattgtgatagcctggtatgcctgtgcgaattcaaagcgcacgagaatagagtcaaggacatgttctcattcgaaatcccagagcaccacgtcatcgtgagtgcctcgtctgatggcttcattaaaatgtggaaactcaagcaggataaaaaagtgccaccctcattgctgtgtgagatcaacaccaatgccaggctgacatgcttgggagtgtggttggacaaggtggctgatatgaaggagagtctgccccctgccgctgaacccagccctgtgagcaaggagcagtcaaaaattggcaagaaagaacctggggatactgtccacaaagaagaaaagaggagcaagcctaataccaagaaacgcggtctgactggtgatagtaaaaaggctacaaaagaatccggccttatctcaactaagaagcgcaaaatggtggagatgctggagaagaaacgaaaaaaaaagaagataaagactatgcagtag

SEQ ID NO: 233922 - DNA, 3372 bp, Artificial Sequence
  Description of Artificial Sequence: Synthetic coding sequence
atgtccggcaccagctcacacgagagtttttatgactccctgtcagacatgcaggaagagagtaagaatacagatttttttcctggactttccgcctttctctcacaggaggagatcaataagtcactggacctagctcggcgtgctattgcggactcagagacggaagactttgactcagagaaggaaatcagccagattttttcaacctcccccgcatcactctgtgagcatccctcacacaaggagactaagctgggcgagcatgccagtcgaaggcctcaagataatcgttccactccagttcagccacttgccgagaaacagactaagagcattagcagtccggtgagtaagaggaagcctgccatgagccccctgctcactaggccctcctacatacggagcctgcgcaaggccgagaaacgtggtgccaagacaccaagtaccaacgttaagccaaaaacccctcaccagcgcaaaggtggacctcagtctcagctatgtgacaaggccgctaacctgatcgaggagctcacatcaatatttaaggcagccaaacctagaaaccgctctccaaatggcgaaagctcatcaccagattctggctacctgagccccaagaatcagccaagcgctcttctctccgcctcagcatctcagtcgccaatggaagatcagggggaaatggagcgggaagtgaaatcccccggagcgaggcattgctaccaagataatcaggatttagccgtgccgcacaataggaagtcccatccacaaccgcacagtgcgttgcactttcccgcagccccacggttcatccagaagctcaggagccaggaggtcgccgaaggaagccgggtttacctagagtgtcgcgtcaccgggaatcccaccccgagagtaagatggttttgtgaaggcaaagagctccataacaccccagacatacagatccattgcgagggaggcgacctccatactctgataatcgcagaggccttcgaggacgataccgggaggtatacatgtttggctaccaaccctagcggatcggacaccactagcgccgaggtcttcatcgagggcgcttctagcactgatagcgattctgaatcccttgcatttaagtcccgggcaggcgcaatgccccaggcacaaaagaaaaccacctctgtcagtttgactataggaagcagcagtcccaagacaggcgtgaccacagcagtcatccagcctttgagtgtgcctgtgcaacaggtgcacagccccacatcatacctctgtcggcctgatggaaccacgaccgcttatttcccacccgtgtttacaaaagagctccaaaataccgccgttgcagaagggcaggtcgtagtgctcgaatgtagagttcgcggtgccccacctttgcaagtgcagtggtttcgccaaggttctgaaatacaagacagcccggatttccggattctgcaaaaaaagcccagatccaccgctgaaccagaggaaatttgtacactggtgatcgctgagaccttcccggaggacgccggaatatttacatgctccgccagaaatgactacggaagtgcaacatccacagcccaattagtggtgacctcggctaataccgagaactgctcctacgagagcatgggcgaaagcaacaacgaccactttcagcatttcccaccacctccaccaattctggaaactagctcactggaactggcctcaaaaaagccttccgagatccagcaggtgaacaaccctgagctgggtttgtcacgggctgccttacaaatgcagttcaatgcggctgaacgcgaaactaatggagtgcacccgagccggggtgtgaatggcttgataaacggcaaggccaattcgaataagagtctgccaacccccgcagtgctgctgagtcctacaaaagaacccccaccgttgcttgccaagcctaaattggggttccctaaaaaggcatctaggactgccaggatcgcaagcgacgaggagatccaggggactaaggacgccgtcatacaggaccttgaacgcaagcttcggtttaaggaagatcttctgaacaatggccagcctaggctaacttacgaggaaagaatggctaggcgtctgctgggtgcagattccgccactgtgttcaacatccaggagccggaggaggagactgcaaaccaagatatcggctctcctcacgccagtgtggggtcaccattggacggccagaaggaatacaaggtttcaagttgcgaacagaggctgatctccgaaattgagtacagactagagcggagcccagttgatgagagtggcgacgaggttcaatatggtgatgtgcctgtggagaacgggatggcacccttttttgaaatgaaactgaaacattacaaaatcttcgagggcatgccagttacatttacctgcagggtagctgggaacccgaagcccaagatttactggtttaaagatggtaaacaaatatcccctaaaagcgaccattatacgatccagcgagacctggacggaacatgctctctccacaccactgcctctactctcgatgacgacggaaattataccatcatggccgctaatcctcagggtaggatcagctgcactggacggctcatggtgcaggcggttaaccaaagaggcagatcacccaggagtccaagtggccacccacacgtccggagacccaggtccaggagcagagactccggagacgagaacgagcccatccaggagcgattctttcggccacatttccttcaggctcccggagaccttaccgtccaggagggcaaattgtgtcgtatggactgcaaggtttccggtctgccaacaccagatctttcatggcaactggacgggaaaccggttcgaccagacagcgcccacaagatgcttgtgagggaaaatggtgtgcattctttgatcatagagcccgtgacatcaagggacgccggaatatatacctgtattgccacgaatagggcaggacaaaatagtttttctctcgaactggtcgtggctgctaaggaagcccataaacctcccgtgttcatcgagaaactgcagaatacaggggtcgccgatgggtaccctgtcaggttggaatgtcgggttctcggagtccctccacctcaaatcttttggaagaaagaaaatgagagcttgacacacagtaccgacagggtctctatgcaccaagataatcacggctacatctgtttgctgatccaaggggctactaaagaagacgctggatggtataccgtgtccgccaagaatgaagcaggaattgtgtcttgcaccgcaaggctcgacgtttacatctcgcgccactag

SEQ ID NO: 233923 - DNA, 2019 bp, Artificial Sequence
  Description of Artificial Sequence: Synthetic coding sequence
atgagcgccctcgctagtaggtccgctcctgctatgcaaagttcagggtcgttcaattatgccaggccaaagcagttcatcgctgcccagaatctgggacctgcctctggccacggcaccccagcatccagcccctctagctccagccttccttcccccatgtctcctacccctaggcagtttggcagagcccctgtgccaccatttgctcagccgtttggggctgagccggaggccccatggggaagctcaagccccagcccccctcctcctcctccgcctgttttttcacctacagcagcattcccggttcctgatgtttttccgctgccccctcctccacctcctcttccatcccccggacaggcctcacattgcagcagcccagcgacccggtttggccactcacagacccccgctgcgttcctgtcggcgctgctcccttcgcagcctcctcctgctgcagtcaatgccctggggttaccaaaaggggttacacctgcaggattcccgaaaaaggcctcccgcacggcgaggattgcctctgatgaagaaatccaggggacgaaagacgctgtcatccaggatttggaaaggaagctccggttcaaggaggatttactgaacaatggccaacccagattaacctacgaggaacggatggctcggagactgttgggagcagatagtgctactgtgtttaacatccaggagccagaagaagaaacagccaaccaggagtacaaggtctcttcgtgcgaacagcgcttgatcagtgagattgagtatcgcctagagcggagtcccgtcgatgaatcaggggacgaagtgcagtatggcgacgtacccgtcgaaaacggcatggccccattctttgaaatgaagttaaagcactataaaatttttgaaggcatgcccgtcacctttacgtgccgtgttgccggaaacccgaagcctaagatctactggtttaaggacggaaagcagatatctcccaaatccgatcactatacaatacagagggacctcgatggaacttgctccttgcatactaccgcttcgacactagatgacgacgggaactacaccatcatggccgcaaacccgcagggcagaatttcttgcaccggtcgccttatggtccaggccgtaaatcagaggggcagatctcccaggtctccctcaggacaccctcatgtgcggagaccacgatcacggagtagagacagcggtgacgagaacgaaccaatacaagagcgatttttccgtcctcattttttgcaggccccaggcgatctcactgtgcaggaaggtaaattatgtcggatggactgcaaggttagcggtctgcctacccctgacctcagctggcagctggacggaaagccagtgagacccgattctgcccataagatgttagtgcgcgaaaacggagtccatagcctgattattgaaccagtgaccagtcgtgatgctggaatatatacatgcatcgcgactaatcgtgctggccagaactccttctcattagagctagtggtggccgctaaggaggctcacaaaccacctgtgtttattgagaagctccaaaatacgggcgtggccgatgggtacccggtacggctagaatgcagggtccttggcgtccccccaccacagattttttggaagaaagagaacgagtctcttacccattcgacagacagagtctcaatgcatcaggataatcacggctacatctgcctgctcatccagggcgcaacaaaagaagatgccggatggtacacagtcagcgcaaaaaacgaggcagggatagtctcctgtacggcacggctcgacgtatatacccagtggcaccagcagtctcagtcgacgaaacctaagaaggtgagaccatccgcctcacgctacgctgcactgagcgaccaaggtctggatatcaaagccgcattccagccggaagcaaaccctagccacttgactctcaacactgccctcgtcgaatctgaggacctgtag

SEQ ID NO: 233924 - DNA, 2334 bp, Artificial Sequence
  Description of Artificial Sequence: Synthetic coding sequence
atgccacaagctcaaaagaaaaccacctccgttagtctgactattggcagcagctcacctaaaaccggggtgactacagccgtcatccaaccactgagcgtgccggtgcagcaggtgcatagtcccacgtcatacttgtgtcgtcctgacggcactaccacagcatactttcctccagtctttacaaaggagttgcagaacacagccgtagccgaaggccaggtggtggttttagaatgccgggttagaggcgctccccctctccaggtacagtggttcagacaaggctccgagattcaggactctcccgattttcgcatcctgcagaagaagcccaggtccacagcagagcctgaggaaatctgcactctggtcattgcagagactttcccagaggacgctggtatttttacatgttcagccagaaatgattatggcagcgccacgagtacggcacaactggtcgtcactagcgctaatacagagaactgctcttatgagtccatgggcgagtctaacaatgaccacttccaacactttccacctcctccgcctattctcgaaacatcttcgctggagctggccagcaagaaaccctcagagattcagcaggtgaacaatcccgagttgggcctgtctcgagccgcactgcagatgcagtttaatgctgctgagcgcgagaccaatggcgtgcacccctcaagaggcgtgaatggattaatcaacggtaaggctaattcaaacaagagccttcccaccccagcagtgctgctatctcccacaaaggaaccacccccacttctcgccaaaccaaaattggggtttcctaaaaaagctagcaggacagccagaattgcctcagatgaagagatacagggcacgaaagatgcggtcattcaggacttggagaggaagctgaggttcaaggaggatctccttaataatggtcaacctcgtctgacttatgaagagagaatggcaaggaggcttctgggtgcggactccgcgacagtcttcaatatacaagaaccagaagaagaaacggctaaccaggaatacaaagtttcaagctgcgagcaaaggctcatctccgagattgagtacaggctcgaacgatccccagtcgatgaatcaggggatgaggtgcagtatggcgacgttcccgtagagaatgggatggccccatttttcgagatgaagctcaaacactataaaatttttgagggtatgcctgtcaccttcacgtgtcgcgtggccggaaatccaaaaccaaaaatctattggtttaaggacggcaagcagatttcaccgaaaagtgaccattatactattcagcgtgatctggatggaacttgtagcttacatacaaccgcctcgacccttgatgatgacggcaactacactattatggcagccaaccctcaggggcgaatttcctgtactggtagattaatggtccaggcggtcaaccagcggggacggtctcctcgatcccctagcggacacccacatgttcggagacctcgcagtcggtcccgagactctggcgacgaaaacgagcctattcaggaacggttctttcgcccacattttctccaagcgcctggagatttgaccgtgcaggaaggcaaactctgcagaatggattgtaaagtctctggtttgccaacccccgacctctcctggcaactggatggcaaacctgtgcgcccagatagtgctcataagatgctggtgagggagaatggtgtccactcactcatcattgagcctgtgacatcacgtgacgctggcatctatacctgcatcgccacaaaccgagcaggccagaactccttttcactcgagctcgtcgttgcagcaaaagaagctcacaagccacctgtctttatagagaagcttcagaacaccggagtggccgatgggtaccccgtgaggcttgaatgccgcgtgctcggtgtgccgcctccccagattttctggaagaaggagaatgagtctctgacccatagtactgacagggtatctatgcaccaggacaaccatggctacatctgtctcttgatccagggagcaaccaaggaagacgctgggtggtacacggtaagcgcaaagaatgaggccggaattgtctcctgcacggcaaggctggacgtgtacacccagtggcatcaacagtcacagtctactaagcccaagaaggtgaggcccagcgccagccggtatgccgcactttccgaccagggactcgacataaaagctgctttccagcccgaggccaatccttcccacctgactctgaacactgctctggtggaatccgaagacctatag

SEQ ID NO: 233925 - DNA, 3321 bp, Artificial Sequence
  Description of Artificial Sequence: Synthetic coding sequence
atgtccgggacttccagccacgagtcgttttacgactctctgagcgatatgcaggaggagtccaaaaacaccgatttcttcccagggctgtctgcctttttgtcacaggaggagattaataagtcattggatctcgcacgacgggcaatcgccgatagcgagaccgaagattttgatagtgagaaggaaatcagccagattttctcaacgagtccagcaagtctatgcgagcacccgtctcacaaggaaactaagctcggggagcacgccagtcgcagacctcaagataacagaagcacgccagtgcagcccttggcagagaaacagactaagagtatcagtagtccggtgagcaagagaaaacctgcaatgtcaccactgctcactaggccatcctatattaggtcacttcgaaaggctgagaaacgcggtgcaaaaaccccgagcacaaacgtgaaacccaaaacaccacaccagagaaagggaggcccacaaagccaattgtgtgataaggcagcgaatttgatcgaggagctcacctcaatcttcaaagccgctaagcctcgcaacagatctccaaacggggaatccagctcccccgactctggctacctgtcacctaaaaatcagccatctgctctcctcagtgcctccgcatctcagagtcctatggaggatcagggggagatggaacgtgaagtaaagagcccaggcgcacggcactgttaccaagacaatcaggacttggctgttccccacaaccggaagagccacccccagccccattcggctctgcactttccagcagcgccaagattcatacagaagcttagatctcaagaagtggctgagggctcacgggtttacctggagtgtagggttactggcaaccctacgcctcgcgtgaggtggttttgcgagggtaaagagttgcacaatacaccagatattcagatccactgtgaaggtggagaccttcatacgctgatcattgcggaagcattcgaggacgataccggaaggtacacttgtctggccacaaacccttcgggatctgacaccacatccgccgaggtttttatcgaaggcgcaagctctactgattccgattccgaaagtcttgcgttcaagagccgcgctggagctatgcctcaggctcaaaagaagaccacatctgtcagtttgaccattggttcaagctctccaaaaactggcgtaactactgccgtcatacagccacttagcgtgcctgtgcaacaggtgcattctcctacctcttatctgtgtaggcccgatgggaccactaccgcatacttcccccctgtctttaccaaggaactccagaacaccgccgtcgccgaagggcaagtcgtcgtgctggagtgtagagttaggggcgctccacctttacaggtccagtggtttagacaagggtcagaaattcaagatagcccagacttccgcattctacagaaaaagccgaggtctacggctgaaccagaggagatatgtactctggtgatagccgaaaccttcccagaagacgcaggaattttcacctgttccgcgaggaatgattacggtagcgccacttcaaccgcgcaactcgtggttaccagcgccaacacagagaattgctcttacgaaagtatgggcgagtcaaataacgaccatttccagcacttcccccctcctccacctatcttggaaacaagttcactggagttagctagcaaaaagccaagcgaaatccagcaggttaataacccagagctgggattatcccgggctgccttgcagatgcagtttaatgctgcagagagagaaacaaatggggtacaccctagcaggggcgttaacggcttaatcaacggtaaagcgaacagcaataagagcctgcccacccctgccgtgctactgagcccaacaaaagagcctccccctctgctggctaaacccaagctgggctttccaaaaaaggcttcccgaaccgctaggatcgctagtgacgaggaaatccaaggcacaaaagatgcagtcatccaggatttagagcggaagctgcgttttaaggaagacctccttaacaacggccagcctcgactgacttatgaagagcgaatggcccgtaggttactcggggcagatagcgctacagtgtttaatattcaggagcccgaggaggagaccgctaatcaagaatacaaagtatcttcatgtgagcagagactcatctctgagatcgagtatagactggaaaggagtccagtcgacgaaagcggggatgaggtccagtacggcgatgtccctgtggaaaacggaatggcaccatttttcgaaatgaagctgaagcattataagattttcgagggaatgcccgtcactttcacctgccgtgtagcaggaaacccgaagccaaaaatatactggttcaaagatggcaagcaaatctccccaaagagtgatcattacacaattcagagagatcttgacggcacctgctcactgcacaccaccgcctctacactggatgatgacggtaactataccatcatggcagcaaacccacagggccgaatcagttgcaccggcaggctgatggtgcaagccgtcaaccagaggggtaggagccccaggagcccaagtgggcatccacacgtgcgcagacctcgtagcaggagtagggactctggggacgaaaacgagcctatacaagagcggttctttcggcctcactttctgcaggctccaggagacctcaccgtgcaggaagggaaattgtgcaggatggattgtaaggttagcggtctgccaacccctgatcttagctggcagctcgatggcaagcccgttagacccgactcagctcacaaaatgctggtgcgcgaaaatggcgtccacagtttgatcattgagccagtcacgagtcgggacgccggtatatacacatgtattgctacgaacagagccggtcagaacagcttctcgctggaactggtagttgctgccaaggaggcacataagcctccagttttcatcgaaaagttgcaaaacacgggagtggctgatggatacccagtccgattggagtgcagggttctgggcgtaccaccaccacaaattttttggaagaaggagaacgaaagtttgacccacagtactgaccgcgtgagtatgcaccaggataatcatgggtatatatgcctactaattcaaggagcgaccaaagaggacgccggatggtacactgttagcgcaaagaatgaagcaggcatcgtcagctgcaccgccagacttgacgtttacatatcaaggcactag

SEQ ID NO: 233926 - DNA, 1233 bp, Artificial Sequence
  Description of Artificial Sequence: Synthetic coding sequence
atgtcaccgcttctgacacgaccttcctacataaggtcactgagaaaagccgagaaaagaggagccaaaactccctccacgaacgtcaagccgaagacaccacatcagagaaagggcggacctcagagccaactttgcgacaaggcagccaatctgatcgaagagcttacatcaatctttaaagctgcaaagcccaggaaccgcagtcctaatggcgagagcagttctccagacagcggttacctgtcaccaaagaaccagccaagcgcactgctttccgctagcgcgagccagtcccctatggaggaccagggcgagatggagagagaagttaagagccccggagcgcgtcactgctatcaggataaccaggacctagccgttcctcacaatcggaaatcccacccgcaaccccactcggctctgcatttcccggctgcacctaggttcatacagaaacttcggagccaggaagtcgcagaaggctcaagagtgtatctcgaatgtcgcgtgactggcaatccaaccccccgtgtcaggtggttctgcgaaggcaaggaactgcataacacacccgatatccaaattcactgtgaagggggagacttacatactttgattattgctgaagccttcgaggacgatacaggacggtatacttgtctcgccaccaatccgtccggctccgacaccacatcagcagaagtatttatcgagggggcatcctccacagattcagacagtgaatccctcgctttcaaatcccgggctggcgcaatgccccaggcacaaaagaaaactacctccgtgtccttgaccataggaagctcttctccgaaaacgggcgtaaccacagctgtaatccagccgctgtcagtgcccgtccaacaggtgcactcgcctacctcctacctgtgccgtccagatggaacaacaacagcctactttccccctgtgtttacaaaagagctgcagaatacggcagtcgctgagggccaggtcgtcgtgcttgaatgtcgagttcgcggtgccccacccctgcaggtgcaatggttcaggcagggctccgagattcaagacagccccgattttcgcattctgcagaagaagccaagaagcactgccgaaccagacgtgctctacgtcttcgtgagggtgcgttgtcaccagatgaagatacaatattataacctggcacacctgatctcgagctggctgagctcattcctgtag

SEQ ID NO: 233927 - DNA, 3006 bp, Artificial Sequence
  Description of Artificial Sequence: Synthetic coding sequence
atgccgcaggcacaaaagaagacgaccagtgtatctctgaccatcgggagctcatcccctaagacaggtgtgacaaccgccgtgatccagccgctcagtgttcccgtccaacaagtacacagtccaaccagttatctgtgccggcctgacgggacaactactgcttactttccaccagtcttcaccaaggagctccaaaacaccgcggtcgctgaaggccaggtggtggtcctggaatgcagagttcgcggtgcacctcccttgcaggtgcaatggtttcggcagggaagcgagatccaggatagtcccgatttcagaattctgcaaaagaaaccaagaagtaccgcagagccagaggagatttgtaccttagtgatagccgagacctttccagaggacgcagggatctttacctgtagtgccagaaacgactacgggagtgccacaagcactgcgcagttggtggtcacttctgccaataccgaaaattgttcctatgaaagcatgggcgaaagcaataatgaccatttccaacactttccaccccctccacccatactggaaacgtcttctttggagcttgcttcgaagaagccgagcgagatccagcaggtcaataaccctgaacttggattatctagagctgctctccagatgcagttcaacgctgccgagcgcgagactaacggggtgcacccaagccgaggtgttaacggtctgattaacggcaaagctaattcgaacaaaagcctgcccaccccagccgtgctactgtcccccactaaagagcccccaccacttctcgctaagccaaaactggatcccctgaaactgcagcagctgcagaaccagataaggctggagcaggaggccggtgccagacagcctcccccagctcccagatccgcgcctccatcaccccctttccctccccctccggcatttcccgagctggccgcttgcactccacccgcaagccccgaacctatgtccgccctggcatcacggtctgccccagccatgcaatcctctggcagttttaattacgcacggccaaagcaatttatcgcagctcaaaacttagggcctgcttcagggcacggcacaccagccagttcccccagcagttcgagcctaccaagccctatgagccccacacctcgacagttcggaagagctccggtacccccatttgcccagcccttcggagcagagcccgaggccccatggggttcaagcagcccaagccccccaccccctcctccccctgtcttttctcccacagctgcttttcctgtaccggatgtgtttccccttcctccaccacctccccctctaccttctcccggtcaagcctcacattgcagcagtccagctacaaggttcggccatagtcagacaccagccgcttttctgtctgctctattacccagtcagccaccacccgctgcagttaacgcactgggactgcccaagggggtcacccccgcaggtttccctaaaaaagcctccagaactgctaggattgcttccgacgaagagatccagggtacaaaagatgcggtcatccaggacctagagagaaaactgagattcaaagaggaccttctcaacaacggccagccccgacttacgtacgaagaacggatggcaagaaggctcctcggggcagactctgcgactgtattcaacatccaggagcccgaagaagaaacagcaaatcaggagtataaagtgagttcttgcgagcagaggctgatatctgagatagagtatcgtttggaacgtagtccagtcgatgaaagcggcgacgaggtccagtatggcgatgtaccggtggaaaatggaatggccccatttttcgagatgaaactaaaacactataagatcttcgagggcatgcccgtaacctttacatgtcgggttgccggaaaccctaagccaaagatttactggtttaaggacggaaagcaaatctcccccaagtctgatcattacaccatccagcgggacctcgatggcacatgttctttgcatacaaccgcctcaaccctggacgatgatggaaattatactattatggccgctaacccccagggccgaatctcttgcaccgggaggctaatggtccaagcagtgaaccagagaggaagaagtccgagatcacccagcggccacccacacgtgcgcagaccaaggagccggtctcgagatagtggtgacgaaaacgagcccattcaagagaggttctttcggcctcattttctgcaggctccgggtgacctgacagtgcaggagggaaaactctgtaggatggactgtaaggtgtctggcttgccaaccccagatttgagctggcagctagatggcaaacccgtgcgtcctgattctgcccataaaatgctggtcagggaaaacggagtccactcattaattatcgaacctgttacttcgcgggacgctggtatctacacgtgtatagcaactaaccgggctgggcaaaactccttctcgctggagctcgttgtcgccgcaaaggaggctcacaaaccaccagtcttcattgaaaaactgcagaatactggcgtcgctgacggatacccagtgcggctcgaatgtcgagtcctgggagtgcctccacctcagattttttggaagaaggagaacgagagcctcacccactccactgaccgggtgtccatgcatcaagataatcacggttatatttgtctgctaatccagggagctaccaaggaggacgccggatggtacaccgtgtctgctaagaatgaggccggaatagtatcgtgtacagccagactcgacgtttacactcagtggcaccagcagagtcagagcacaaagccgaagaaggtgaggcccagtgcctctcgctacgccgctctttctgaccaggggttggacattaaggccgctttccaaccagaggctaacccttcccacctaacacttaatacggctctggtggagtccgaagatttgtag

SEQ ID NO: 233928 - DNA, 483 bp, Artificial Sequence
  Description of Artificial Sequence: Synthetic coding sequence
taagggaaacccgtgcgacctgattccgctcacaagatgctggtgagagagaatggcgtccatagcctcatcatagagccggtgacatcacgcgatgcgggaatttacacctgtatagctactaatagggctggccaaaactctttcagtctggagctcgtcgtcgcagctaaagaggcccacaagcctccagtgtttattgaaaagctgcagaacactggcgtggctgatggctatcctgtccgccttgagtgcagagtgctgggcgttcccccaccacagattttctggaagaaagagaacgagagtctcacacactccacggaccgtgtgtccatgcatcaggacaaccacggttacatctgcctgctgatccagggcgcaacgaaagaagacgccggttggtacacagtatctgctaagaatgaggctggcatcgtatcttgcaccgcccgactcgacgtgtatatcagcaggcactag

SEQ ID NO: 233929 - DNA, 1539 bp, Artificial Sequence
  Description of Artificial Sequence: Synthetic coding sequence
aaaaacactgacttttttcctggcctgtccgctttcctttcccaggaggagataaacaagagccttgatctggcgcgacgcgctattgctgatagcgaaactgaggatttcgattctgagaaggagatctcacagattttctccacctcccccgcttctttatgcgaacacccctcccataaggaaactaagcttggcgagcacgcgtccaggcgccctcaggataaccgatccacccccgtgcaacccctggccgagaaacagactaagagtatttccagcccggtcagtaaaaggaagcccgcaatgagccccctcctgactcgaccctcgtacattcgttccctaaggaaggcggagaagagaggagcgaagactcccagcacaaacgttaagccaaagacacctcaccagcgcaaggggggtccacagtcccagctctgcgataaagccgctaaccttattgaggaactcacatccatttttaaggccgctaaaccccgtaacaggtccccaaacggcgagtcctccagtccagattccggctatttgtctccaaagaaccagccgtccgccttgctgtctgcttcggcatctcaaagcccaatggaggatcaaggagaaatggaaagggaggtgaagagcccaggagccagacattgctatcaggataaccaggatctagcagtgccccacaataggaagagccaccctcagcctcactccgctctgcacttccctgccgcacccaggttcatccagaagcttaggagccaagaggtggctgagggatctcgtgtgtacctggaatgtagggttactggcaaccctacacccagggtaaggtggttttgcgaaggaaaagagctccataacacacctgatattcagatacattgtgaggggggtgacctgcatacgctgattattgccgaagcgttcgaagacgacaccggccgttacacttgcctcgccaccaatccgtctggctcagataccacctccgccgaagtgtttatcgagggcgcatcatccacggactctgattctgagagcctcgcctttaaatcacgagccggagcaatgccccaagcgcaaaaaaagaccacaagcgtgtccctgacgataggctctagttcccctaaaactggcgtgactacagccgtcatccagcccctttccgttcctgttcaacaggttcatagcccaacctcctatctgtgccgccctgatgggacaaccaccgcatactttcccccagttttcaccaaagagctccagaatacggctgtcgctgagggtcaggtggtggtgctggagtgtcgagtcagaggcgctcccccactgcaggtgcagtggttcagacagggaagcgagattcaggatagcccagattttagaattttacagaagaaacccaggtccacggccgaacctgacgttctctacgtcttcgtcagggtgcggtgccatcagatgaagattcagtactacaatctggcacatcttatctcttcttggctgtcgagcttcctgtag

SEQ ID NO: 233930 - DNA, 87 bp, Artificial Sequence
  Description of Artificial Sequence: Synthetic coding sequence
atgagtggtacgtccagtcatgaatcgttctacgacagcctttccgatatgcaggaagagtcaaagaatactgatttctttccatag

SEQ ID NO: 233931 - DNA, 690 bp, Artificial Sequence
  Description of Artificial Sequence: Synthetic coding sequence
atggcggcacagccattgaggcatagaagcaggtgcgctacgccaccacgcggagatttctgcggcggaaccgaacgggcaatcgaccaagccagctttacgaccagcatggaatgggatacccaggttgtgaaaggatcctcgcctttagggcctgccggattaggcgcagaagagcctgccgcagggccacagctgccttcctggctgcaacctgaaaggtgtgccgtgtttcagtgtgcacagtgccatgcagtattggctgattctgtgcatcttgcctgggacctgtctcggagtctgggagccgtggtcttcagtcgggttacaaacaacgttgtcctcgaggcgccatttctcgttggcatagagggttccttaaaagggagcacgtacaaccttcttttctgtgggagctgtggtatccctgtgggattccatttgtactctacacacgctgccctggccgctctgcgcggacacttctgcctgagtagcgataagatggtgtgttatctgctgaaaactaaagctatcgttaacgctagcgagatggatattcagaacgtccccttgtctgaaaagattgctgaactgaaagaaaagatcgtgctcacccataacaggctgaagtctttaatgaagattctgagcgaagtaacgcccgatcaatcgaagcctgaaaactag

SEQ ID NO: 233932 - DNA, 816 bp, Artificial Sequence
  Description of Artificial Sequence: Synthetic coding sequence
atggcgtcacctgggtgcttgtggctgctggctgtagctctactcccatggacatgtgcatcccgcgctttgcagcacctggaccctccagcacccctacctctcgtgatctggcatggaatgggaagcaggtacgtggcccagacgggactcgaacttctggcatcgtccaacccccctgcatcttcgtaccagagtgctggcatgatcggcgacagttgctgcaacccattgtcaatgggagctatcaaaaagatggtggaaaaaaaaatccctgggatttacgtcctgagcctggaaattggcaagaccctgatggaagacgtcgagaacagtttcttcctcaatgtgaactcccaggtgacaaccgtctgccaggccctggcaaaggacccaaagcttcagcagggctataatgctatgggcttcagccaagggggtcagttcctgcgggctgtggcccagcggtgcccttccccaccaatgatcaatcttatcagcgttgggggacagcaccaaggcgtttttggcctgccgagatgccccggtgaaagctcgcacatctgtgatttcatcaggaagactctcaatgccggtgcttattcaaaggtggtccaggagcgtctggtgcaggctgaatactggcacgatccaattaaggaggatgtatatcggaatcactcaatttttctggcggatattaatcaggaacgcggtatcaacgagagctataaaaagaatctgatggctcttaagaaattcgtgatggtcaaattcctgaacgatagcatcgtcgatccagtggactctgagtag

SEQ ID NO: 233933 - DNA, 921 bp, Artificial Sequence
  Description of Artificial Sequence: Synthetic coding sequence
atggccagtcccggatgcctctggctattggcagtggcactactaccctggacctgtgcaagtcgcgcacttcagcatctggatcctccagctccgttgcctctcgttatctggcatgggatgggcgactcctgctgcaacccactgtcaatgggcgctattaagaagatggtggagaagaagatccccggaatctatgtgctcagcctggagattggcaagaccctaatggaggatgtggagaactcctttttcttaaatgtgaacagccaggttaccacggtatgtcaagcactcgcaaaagacccgaagttgcagcagggatacaacgctatgggcttcagccaagggggacaatttttgagggccgttgcacagcggtgcccgagtcctcctatgattaatctgatttcagtcggaggacagcatcagggagtgtttggtctgcccagatgcccaggtgagagtagccacatatgcgactttattcgcaaaaccctgaatgcaggcgcttactccaaggtggtccaggaaagactagtccaggcagagtattggcacgacccaatcaaggaggacgtttatcgtaatcactccattttcctagccgatattaaccaagagcgtggcataaatgaaagctacaagaagaacctgatggcactgaaaaagtttgtgatggtgaaatttttgaatgatagcatcgttgatccagtagattctgagtggtttggcttctacaggagtggacaagccaaggaaaccatcccgttgcaggagacctcgctgtatacacaggacaggctgggcctgaaggagatggataatgctgggcagctggtttttctcgcgaccgagggcgaccacctccagctgagcgaggagtggttttatgctcatattatccccttcctcggatag

SEQ ID NO: 233934 - DNA, 612 bp, Artificial Sequence
  Description of Artificial Sequence: Synthetic coding sequence
atggcttctcctggctgcctgtggctcctagcagtggcacttctgccctggacatgcgcgagtcgcgctctacagcacctcgacccccctgctcccctcccattggtgatttggcatggtatgggagttttcggactgcccaggtgccctggcgaaagtagccatatttgcgactttataagaaagacgctgaatgcaggcgcatattccaaggtggtgcaggagaggcttgtccaagcggagtactggcacgacccaatcaaagaagatgtctaccgtaatcactcaatctttctcgccgatataaaccaggagcgtgggatcaacgagagttataagaagaacctcatggctctgaaaaaatttgtgatggttaaatttcttaatgattccatcgtggaccctgtcgattcagaatggttcggattttaccggtctgggcaggctaaggaaacaattccgctccaggagaccagtctctatacccaggatcgcctaggtctcaaggaaatggacaatgccggacaactggtctttctggccaccgaaggcgaccatctccaattgtccgaagagtggttctacgctcatattattccatttctaggctag

SEQ ID NO: 233935 - DNA, 921 bp, Artificial Sequence
  Description of Artificial Sequence: Synthetic coding sequence
atggcttccccaggttgcctttggctcctggcagtcgctctgcttccatggacctgcgcctctcgggcactacagcacctggaccccccagcacctctaccattggtgatctggcacggcatgggagactcatgctgtaacccactctccatgggtgcaatcaagaagatggtcgagaaaaaaattcccggaatctatgttctctcacttgaaattggcaagacgctcatggaggatgtggaaaattcattcttcttgaacgtcaattcacaggtcaccaccgtgtgccaggccctcgccaaagaccccaagctccagcagggttacaacgctatgggcttttcccagggaggccagtttctgcgggctgtggctcaacgctgccccagcccaccaatgattaatctgataagcgtgggaggacagcaccagggagtgtttgggcttcctagatgccctggtgagagctctcacatttgcgactttattagaaaaacactaaacgctggcgcttattccaaggtcgttcaggaaagactcgtacaggcagagtactggcatgatcctatcaaggaggacgtgtatcgaaaccatagcatctttctggccgacattaaccaggagcgtggaattaacgaatcgtacaagaagaacctcatggcacttaagaagttcgtaatggtcaagtttctgaacgattctatcgtcgatccagtcgacagcgagtggtttggcttctatagaagcggccaggcgaaagaaaccattccactgcaggagacctccctatacacccaagataggctcggactgaaagaaatggacaatgccggacagttagtgttcctggctaccgaaggagaccatctgcagctctcagaggaatggttttacgcacatattatcccatttttgggctag

SEQ ID NO: 233936 - DNA, 909 bp, Artificial Sequence
  Description of Artificial Sequence: Synthetic coding sequence
atgctaggactttgtggccagagactgcccgctgcctgggtactacttctcctgccgtttttgcctttactcttgcttgccgcaccagccccacatcgagcaagttacaagcctgtaattgtggtccatgggctttttgacagctcgtacagcttccggcatctactggaatacatcaacgaaactcaccccggaaccgtggttactgtgctcgatctctttgacggcagagagtcactgaggcccctgtgggagcaagttcaggggtttcgcgaagcagtcgtgcctatcatggcaaaagcccctcagggagtccatctgatctgttatagccagggaggactggtgtgccgggctctgctgtctgtgatggatgatcacaacgtcgacagcttcataagcctctcctcccctcaaatgggacaatacggtgacactgattacctgaagtggctgttccctactagtatgagatctaatttgtaccgtatttgctattccccatggggccaggaattttcaatctgtaactattggcatgatccccatcatgacgacctgtacctgaatgcctcttcgtttttggctctgattaacggtgaaagggaccacccaaacgctaccgtgtggcggaagaattttttgcgggtggggcacctcgtgctgatcggaggtcctgatgacggcgttatcactccgtggcaaagctccttcttcggtttttacgacgcaaatgagacagtgctggagatggaggaacagctggtgtacctaagggattcatttgggttaaagaccttattagcgagaggggcaattgtgaggtgtccaatggctgggatttcccacacagcttggcactcaaacaggaccctgtatgagacttgcatcgagccatggctgagttag

SEQ ID NO: 233937 - DNA, 927 bp, Artificial Sequence
  Description of Artificial Sequence: Synthetic coding sequence
atgaagtcttgtggcagcatgttgggcctatgtggccaaagactgcccgcagcttgggtcctcctcttattgccatttctgcctctgctgctgctggccgctcccgcaccgcatagagccagttacaagcccgttatagtcgtccatggtttgttcgattctagctatagttttcggcaccttcttgagtatatcaacgagacccatcccggaactgtcgtcaccgtccttgacctctttgatgggcgagaaagcctgagaccactatgggagcaggtccaggggtttagagaggccgtcgttccaatcatggccaaagctccccagggggtgcatctgatatgttattctcaagggggactggtttgccgggcactgttatcagtcatggatgaccataatgtcgatagcttcataagcctgtcaagtccacaaatgggacagtatggagataccgattacctcaagtggcttttccccacaagcatgcgatcaaatctgtatcggatttgttattcaccgtggggacaagaattttcaatttgcaattattggcacgaccctcaccatgatgatctctacctgaatgcgtcctcttttctggctctcattaatggggaacgggatcaccctaacgcgaccgtctggaggaagaatttcttaagggttggacacctcgtcctgataggaggacccgacgacggcgtcatcacgccgtggcagagctccttctttgggttttacgatgccaatgagaccgtactggagatggaggagcagttagtttatctgcgcgattcttttggattgaaaaccctgctggcgagaggggctattgtccgttgcccgatggctggaataagccacacagcttggcactctaaccggacactgtatgaaacctgtatcgagccatggctgagctag

SEQ ID NO: 233938 - DNA, 909 bp, Artificial Sequence
  Description of Artificial Sequence: Synthetic coding sequence
atgctgggactgtgcggacagaggctccccgctgcgtgggtacttctcctgctgccattcctgcctctcctgttgttggccgctccggcaccccatagagcttcttacaagcccgtgatcgtcgtacatgggttattcgattcatcctattctttccgtcatttgctggagtatatcaacgagacccatcctggcactgtggtgactgttctggacctgtttgacggcagggaatccttacggccactctgggagcaagtccaaggttttcgtgaggctgtcgtgcccattatggccaaggctccccaaggtgtccacctgatctgttactctcaggggggtctggtgtgcagagcccttctgtctgtaatggatgatcataacgttgatagctttatttctcttagttctccccagatgggccagtacggcgataccgattaccttaagtggctgttccctaccagcatgcgaagtaacctttatcggatttgttactcaccgtggggacaggagttttccatctgtaactactggcatgacccccaccatgacgacttgtatctaaatgctagctcattcttggcgctgataaacggagagcgcgaccatcctaacgccacagtgtggagaaaaaactttctccgtgtaggtcaccttgtgctgattggcggacccgatgatggagtgattacaccttggcagagcagcttctttgggttttacgacgccaacgaaactgtgctggaaatggaagaacaactggtttatctccgagatagctttggactgaaaacactgctggccagaggtgctattgtacgctgtccaatggcagggatctcacatacagcatggcacagtaacaggacactctacgaaacatgtattgaaccatggctgagctag

SEQ ID NO: 233939 - DNA, 909 bp, Artificial Sequence
  Description of Artificial Sequence: Synthetic coding sequence
atgctgggtctctgtggtcagagactgccagccgcttgggtcctactgctcctgccatttttgcccctgctgctgcttgcggcaccagcccctcatagggcttcgtacaaacctgtgatcgtcgtgcacgggttattcgatagctcctacagctttaggcatctattagagtatattaacgagacccatcctgggaccgtcgtcaccgtattggacctgtttgatgggagagagtcccttagacccctgtgggaacaagttcaaggttttagagaggcggtcgttccaattatggctaaagcgccacagggagtccacctgatctgctactcgcaggggggattggtgtgccgcgctctcctgagtgtgatggacgaccataacgtcgacagtttcatttccctgtccagtccacagatgggacagtatggcgacacagactatcttaaatggctgttcccaaccagcatgaggagcaacctgtatcggatctgctacagcccatggggacaggaattcagcatttgtaattactggcacgatcctcatcacgacgacttgtacctaaacgccagcagcttcctggctttgatcaacggggaaagagatcatcccaatgctactgtgtggcgcaagaacttcctccgggtgggacacctggtcttaattggcggacctgacgacggagtgattactccctggcaatcgagctttttcggtttctatgacgcaaatgaaaccgtgcttgagatggaggagcagttagtatacttgcgggactcttttggactcaagactcttcttgcccgaggggcaatcgttaggtgtccgatggctggaatcagtcacacagcatggcactctaaccgtactctttacgaaacatgcatcgagccctggctctcttag

SEQ ID NO: 233940 - DNA, 927 bp, Artificial Sequence
  Description of Artificial Sequence: Synthetic coding sequence
atgaaatcgtgcgggagcatgctcggcttatgggggcagcggctgccagcagcgtgggtgttactccttctcccgtttttgccattgttactgttagctgcgcctgctcctcatcgggagagctacaaacccgtgattgttgttcatggattgtttgatagcagctactcctttcgtcacctgctggagtacattaacgagacgcatcctggaaccgtagtgaccgtcctcgatctttttgatggtcgagagtccctgaggcccctgtgggaacaggtgcaggggttccgggaggccgtggtcccaatcatggccaaagccccacagggtgttcatctgatttgttattcacaaggcggtctggtctgcagagctttgcttagcgtgatggatgatcacaatgtcgacagttttatctcattgagtagccctcagatgggccagtatggcgacaccgattacttgaaatggctgttccctacatcaatgagatctaatctctataggatttgctactctccctgggggcaggaattctcgatctgtaattactggcacgaccctcaccacgatgatttgtatcttaatgcaagcagctttctggccctaattaatggagaaagagaccatcccaacgctactgtttggcgaaagaacttcttgcgcgtgggtcacctggtgctgatcggtggcccagatgatggagtgattacgccctggcagagctcattttttggattctacgatgctaacgagacagtgttggagatggaagagcagctcgtgtatttgcgagattccttcggcctgaagacccttttggcgcgaggggctatagtacgctgtccaatggccggtattagtcacaccgcatggcattctaacagaaccctttatgaaacttgtattgagccctggctctcctag

SEQ ID NO: 233941 - DNA, 927 bp, Artificial Sequence
  Description of Artificial Sequence: Synthetic coding sequence
atgaaatcctgtggctcaatgcttggcctgtggggtcagagactccccgctgcgtgggtcttgctgctgctgcccttcctgcccctcctgcttctggccgctcctgcgccacaccgggcaagctacaaacctgtcatagtggtccacggcctatttgatagttcctacagcttccggcatcttcttgagtacatcaatgagactcatcctgggacagtggttaccgtgcttgacctctttgacggccgagaatccctccgaccgctgtgggaacaagtgcagggatttagggaggctgttgtccccatcatggctaaggctccccagggcgtccacttaatttgttattcccagggtggcctagtctgcagagcattattgagcgtgatggacgaccacaatgtcgactctttcatttctttatcatcccctcagatgggacagtatggtgacactgactaccttaagtggctttttcctacgagtatgcgcagtaatctgtatcgcatttgctacagcccatgggggcaggagttctctatctgcaactactggcacgatcctcaccatgatgacctgtacttgaacgcttcctcttttctcgctctcataaacggcgaacgcgaccatccaaatgcgaccgtttggagaaaaaactttctgcgcgtgggtcatctcgtcctcattggaggtccagatgacggcgtgataacaccatggcagagctcatttttcggtttttacgatgcaaatgagaccgtattggagatggaggaacagttagtatatctgcgggactcatttggtttgaagaccctgttagctcgcggagccatcgtgagatgcccaatggcgggaatatctcacaccgcctggcattcgaaccgaactttatatgaaacctgtatagaaccctggctttcctag

SEQ ID NO: 233942 - DNA, 909 bp, Artificial Sequence
  Description of Artificial Sequence: Synthetic coding sequence
atgctggggttgtgcggtcagaggctgcctgctgcctgggttttgctcctgctcccctttctgcccctcctgcttcttgcagcgccagctcctcaccgtgcgtcatacaagcccgtaatcgtggtccacggactgtttgacagttcctatagctttcgtcatctcttggaatacattaatgagacgcacccaggaacagtcgttacagtcctcgacctcttcgatggcagggaatccttgaggcctctgtgggagcaggtccagggctttagagaggccgtcgtgcccattatggccaaggcaccccagggagtgcacttgatctgttatagtcagggcggtctcgtgtgtagagcccttctgtccgtgatggacgaccataatgttgattctttcatatcgctctcctcccctcagatgggacagtacggggataccgattacctcaaatggctcttccctacttccatgcgtagcaatctctatagaatttgttactcgccctggggacaggagttttccatctgtaactattggcacgatccccaccacgatgacttgtatctgaacgcaagctccttccttgccttaatcaacggagagagggaccaccctaatgctacggtgtggcgaaagaatttcctgagggtgggacatctagtgctcattggcggacccgacgacggagtgattactccctggcaatctagtttcttcgggttctacgatgccaacgagaccgtcctggaaatggaagaacagctcgtctacctcagagactcttttggactcaaaaccttgctggcccgtggtgcaattgtccggtgtccaatggccggaatctcccacaccgcatggcacagtaacaggacgttgtacgaaacctgtatcgaaccatggctgtcctag

SEQ ID NO: 233943 - DNA, 909 bp, Artificial Sequence
  Description of Artificial Sequence: Synthetic coding sequence
atgctcggcttgtgggggcagcgcttgccagcggcatgggttcttctcttgctgccatttctgcctctgctgctgctcgccgctcctgcccctcatagggagagctacaagcctgtgatcgtggtgcatgggcttttcgactcaagctactctttccgtcatctgttagagtatattaacgaaacacacccagggaccgtggtcaccgtgttggacctttttgacggcagagagagtctgagacctctgtgggagcaggtccagggattccgagaagcagtggtccccataatggctaaagcaccccagggagtgcatcttatttgctattcccagggtggcctggtgtgccgcgcactcctgtctgtgatggacgatcacaatgtcgacagttttatctctctgagctcccctcagatgggccagtatggggacacggactatctcaagtggctctttcccacaagtatgagaagcaatctgtataggatctgctattctccctggggacaggagttttctatttgcaactattggcacgatccccaccacgacgatttatatctcaatgcaagctcatttttggccctgatcaatggcgagcgcgatcaccccaacgctaccgtttggcggaagaactttctgagggttggccacctcgtgctgattgggggacctgacgatggagtgatcactccatggcagagcagtttttttggcttttatgacgccaacgagacagtgctggagatggaagaacagctcgtctatctcagagacagttttgggctgaagactctgctagcacgaggcgctatcgtgcgctgtcccatggctggaattagccataccgcctggcacagcaatcggactctctacgagacttgcattgagccttggctgtcgtag

SEQ ID NO: 233944 - DNA, 909 bp, Artificial Sequence
  Description of Artificial Sequence: Synthetic coding sequence
atgttaggattatggggacagcggctccccgctgcctgggtgttattgctcctcccctttcttcccctcttgctgcttgccgctccggcaccccacagagaatcctacaagcctgtaattgtcgtgcatggcctgttcgatagtagctattcatttcgccatctacttgagtatataaacgagacacatcctggaacggtggtgacagttctcgaccttttcgatgggagagagagccttcgcccattatgggagcaggttcaagggtttagggaggccgtagtgccaatcatggccaaagctccccagggcgtgcacctcatctgttacagccagggcggattggtgtgccgggcattgctgagcgtgatggacgatcataacgtggactcttttatttccctgagctcacctcaaatgggtcaatacggtgatacagactacctgaagtggctattccctacttccatgcggagtaacctctatcggatatgctacagcccatggggtcaggaattctctatctgcaattactggcacgaccctcaccacgacgatctgtatcttaacgcaagtagcttccttgcattgattaatggtgagcgtgatcaccccaacgccactgtgtggcgtaagaacttcctcagggtggggcacctcgtcctgataggtgggcctgacgacggggtgatcactccatggcagtccagcttctttggcttttatgacgctaatgaaacagtcttggaaatggaggagcagctagtgtaccttcgcgactcatttggacttaagactctcctggctaggggagccatcgtgaggtgccccatggccggaatctctcatactgcttggcactctaataggaccctctatgagacctgtatcgagccctggttaagctag

SEQ ID NO: 233945 - DNA, 909 bp, Artificial Sequence
  Description of Artificial Sequence: Synthetic coding sequence
atgctaggactatgggggcagagactcccggctgcctgggtccttcttttgttaccctttctgcccctgctcctgctggcggctcccgctccccacagggagtcgtataagccagtcattgtcgtgcatggcctgttcgatagcagctacagcttccggcacttgctggaatatattaacgaaacacaccccggtactgtagtgacggttctcgacctgtttgacgggagggagagtctacgcccattgtgggaacaggtgcagggattcagggaggcagttgtcccgataatggctaaagcacctcagggggtccatttgatctgctactctcagggcggactagtctgcagggccctcctgtctgtaatggacgatcacaacgtcgactcctttatcagcctgtcaagcccacagatgggccagtacggcgatacagactatctaaagtggctctttccgacttctatgcggagtaacctgtatcgcatctgctactccccttggggacaagagttctctatatgtaattactggcacgacccccaccatgacgacctgtacttgaacgccagctctttcctggccctcatcaacggggagcgagaccaccccaatgctacagtatggcggaagaacttccttagggttggccatttggtgctcataggcggaccagacgatggggttatcacaccatggcagagctcattttttggcttctacgacgccaacgagacggtgctggagatggaagagcaactggtgtacctgagagattctttcggactcaaaaccctcctggccaggggagccatagtgcggtgcccaatggccggaataagtcacactgcctggcacagtaaccggaccctgtatgaaacgtgcattgagccatggctctcttag

SEQ ID NO: 233946 - DNA, 909 bp, Artificial Sequence
  Description of Artificial Sequence: Synthetic coding sequence
atgctcggtctttggggtcagcggcttccagctgcgtgggtgctgttattacttcccttcctccctctgctgctgctggcagcgccagctcctcaccgggcaagctacaagcccgtgatcgtcgtccatggcttgtttgattccagctactcctttaggcatttactcgaatatatcaacgagacccaccctgggaccgtagtcacagtgcttgatttgttcgatggacgcgagtcactgagaccattgtgggaacaggttcaaggcttccgggaggccgtggtgcccatcatggccaaggcccctcaaggagtccacctgatctgttacagccagggaggactggtctgtcgagcactcctctcggtcatggacgaccacaatgtcgactcattcatctcattaagcagcccacaaatggggcaatacggcgacacggattaccttaaatggctctttccaacctccatgagaagtaatttgtaccgcatctgctattctccctgggggcaagagttctcaatttgcaactattggcatgacccccaccatgatgacctttatttaaacgcctcttcctttttggccttaatcaacggtgaaagggaccatcccaatgcaacagtgtggcgcaagaacttcctgcgtgtagggcatctcgttctcattggcggaccagacgacggagtcataacaccgtggcagtccagttttttcggcttttacgatgctaacgagacagtcttagaaatggaggagcagctagtatacttgagagactctttcgggttgaaaaccctgttagcacgcggtgcaatcgtgcgctgtccaatggcaggtatctctcacaccgcctggcatagcaatcgaaccctatatgagacctgtatcgagccctggctgtcatag

SEQ ID NO: 233947 - DNA, 909 bp, Artificial Sequence
  Description of Artificial Sequence: Synthetic coding sequence
atgctcggcctctggggccagcgcttgcctgctgcctgggtgttgctgttactgccttttctacccttgctactcctggcagctcctgcaccccatcgggcttcatataagcccgttatcgtagtgcatggccttttcgatagctcttattcatttcggcacctgctcgaatatataaacgagacccatcctgggactgtggtaaccgtgctcgatctgtttgatggtcgagaatccttgcggccactctgggagcaggtccagggatttcgggaagcagtggtgccgatcatggcaaaagcccctcagggtgtgcacctgatctgctactcgcagggcggtctagtgtgcagggccttactctcagtcatggacgaccataacgtggattcattcatatcattatccagccctcagatgggccagtacggagataccgattatctgaagtggttgttcccaacgtccatgcgatcaaatttgtaccgcatttgttatagcccctggggccaggaattctccatttgcaattattggcatgaccctcaccatgatgacttgtacctcaacgcctcaagcttccttgcactgatcaatggggagcgcgatcatcccaacgccacagtttggaggaagaacttcctgagagtcgggcacctcgttctcattggcggaccggatgacggcgtgataacaccctggcagtcgtcattttttgggttctatgacgccaatgaaaccgtgctggagatggaagagcagcttgtctatctgcgggacagcttcggtctaaaaaccctgctggccagaggggctatcgtgaggtgccccatggcaggtatctcccatacggcttggcattcgaatagaactctgtacgagacctgtatcgagccctggctcagttag

SEQ ID NO: 233948 - DNA, 909 bp, Artificial Sequence
  Description of Artificial Sequence: Synthetic coding sequence
atgttaggtctgtgggggcagcgcctgcccgcagcctgggtgctgctccttctcccctttttgccactgttgctgctggcggcaccggctccccatagggcatcttataagccggtaattgtggtgcatggtttgttcgatagcagctactccttccgacacctattggagtacatcaatgaaacccacccaggaactgtggttaccgtcctggatttgttcgacggccgagagagcctcagaccactgtgggagcaggtccagggtttcagagaagccgtggtgcctataatggccaaggcgcctcagggggtgcacctcatttgctattcgcagggaggactggtttgtcgcgcactgcttagtgtcatggacgaccacaatgtagatagcttcatctccctcagctccccacagatgggtcagtacggagacactgactatttgaagtggctgttccctacttccatgcgctccaacctctataggatctgctatagcccttggggacaggaattctccatttgtaactattggcatgacccccaccacgacgatctgtaccttaacgcctcaagcttcctcgctttaattaacggcgaacgggatcatcccaatgccacagtctggcgtaaaaatttcctgagggtgggccacctagtgttgattggcggtcctgatgacggcgtgatcactccttggcaatcatcattctttggcttctacgatgcaaatgaaacagtgttggaaatggaggaacagctggtatacctccgagactcttttggactgaagacactactggcccgaggagctattgtacgttgccccatggccggaatctcgcacacagcctggcacagtaatcgaacactgtacgagacgtgtattgaaccttggctgagctag

SEQ ID NO: 233949 - DNA, 927 bp, Artificial Sequence
  Description of Artificial Sequence: Synthetic coding sequence
atgaagtcctgcggcagcatgttgggcctgtggggccagcggcttcctgcagcttgggtactgctgcttcttcccttcctacctttattgctcctggcagcacccgctcctcatcgggcatcctataaacccgtaattgtggtccatggtctgtttgattcaagctatagctttaggcatctcctcgaatacattaacgaaactcatcccggtaccgtagtcacagtcctggacctgttcgatggccgtgaaagtctgagaccactctgggagcaggtccaggggttccgcgaagccgtcgttcctattatggccaaggcaccccaaggcgtacacctgatatgctacagccaggggggactcgtgtgtcgtgcattactgtcagtgatggacgaccacaacgtcgattcattcatctcactgtcttccccgcaaatgggacagtacggggatactgattatcttaaatggctgttccctacctctatgagaagtaatctgtatcggatttgctactcaccctgggggcaagagtttagcatttgcaattattggcatgatccacatcacgatgacttatacctgaatgcctcgagctttctggccttgataaatggggagagggaccaccctaacgcaacagtgtggaggaagaattttcttcgggtggggcacttggttttaattggaggccctgacgacggcgttatcactccatggcaaagctccttttttggcttctatgatgctaatgagaccgttctggagatggaagagcaattagtgtacctgcgcgattccttcggcctcaagactttgctagctcggggagcaatagtcaggtgtcccatggccggaatttcccataccgcctggcattccaacaggacactgtacgagacgtgcatagaaccctggctgtcatag

SEQ ID NO: 233950 - DNA, 282 bp, Artificial Sequence
  Description of Artificial Sequence: Synthetic coding sequence
atgctcggcctgtggggtcagagactgccagctgcttgggttctgctcttacttccatttctcccactgctgcttctggccgctcctgctccccaccgggcaagttataagcccgtcatcgtggtgcatgggctctttgattcttcctattcttttcgtcacctgctggaatatatcaatgagggggcactttgcgccggactctgctttctgtcatggatgatcacaacatggattttgagtagcccttctccactgcatagatgggacagtatggaatag

SEQ ID NO: 233951 - DNA, 543 bp, Artificial Sequence
  Description of Artificial Sequence: Synthetic coding sequence
atgctcggactgtgcgggcaacgtttgccagccgcatgggtcttgctactgctcccttttctgcccctgctactcctggctgctccagcgcctcacagagcatcttataagcctgtgatagtggtgcacggcctgttcgactcatcgtactccttccgacatcttcttgaatacataaacgaaactcacccaggtaccgtcgtgactgttttagacctcttcgacgggagagaatctttgaggccactgtgggaacaggtgcaaggcttccgggaagctgtcgtacccattatggcaaaagctccgcagggtgtgcatctcatctgctacagccaggggggactggtttgccgcgcactgttaagcgtgatggacgatcacaatgtggactcgttcattagcttaagcagcccgcagatggggcagtatggggacaccgactaccttaagtggcttttccctacctctatgcggagcaatctgtatagaatctgttacagcccatggggtcaagaattctcaatttgcaactactggcactag

SEQ ID NO: 233952 - DNA, 927 bp, Artificial Sequence
  Description of Artificial Sequence: Synthetic coding sequence
atgaaaagttgtgggtccatgctaggtctatggggacagcggttgcctgcagcttgggtgctcctactgctcccatttctgcccctgctgctactggccgctcccgcaccacaccgagcatcgtacaaaccggtaatcgtggtccacggattatttgatagttcctattcatttcgtcatcttctggagtacatcaacgaaacccaccccggtacggttgttaccgtgctggatcttttcgacgggcgtgaatctttgcggcctctctgggaacaggtgcaaggatttcgggaggccgtcgtgcctataatggcaaaagcccctcagggtgtgcacctcatctgttactcacaagggggactggtgtgtagagccctgcttagcgtgatggatgatcataacgtggattcctttatctctctctcttcccctcaaatgggtcagtatggtgataccgactacctgaagtggcttttccctactagcatgcgcagcaatctctacagaatctgctatagcccatggggccaggaattctctatctgcaattactggcacgaccctcatcacgatgatctgtatctgaatgcctctagctttcttgccctcattaatggagagagggatcaccccaacgccacagtgtggcgcaagaattttctgagggtcggacatcttgtgctgattggaggcccagacgacggcgttattaccccatggcagtcatctttctttggtttctacgacgcgaacgaaacagtcctggagatggaggagcagctggtgtatctgcgagactcattcggccttaaaaccctgctcgcccgaggagcaatagtgcgctgccctatggccggaatctcgcataccgcatggcactccaatagaactctgtatgagacatgcatagaaccgtggttatcatag

SEQ ID NO: 233953 - DNA, 603 bp, Artificial Sequence
  Description of Artificial Sequence: Synthetic coding sequence
atgttagggctttggggtcagaggttgcccgcagcctgggtgctcctgctgctgccttttttgccgctgcttctgctcgctgctccagctccccatcgtgaaagctataagcccgtgattgtggtacatgggctctttgactctagttacagcttccggcatctgctggagtatatcaacgaaacccaccccggaaccgtcgtgaccgtgttagaccttttcgatggacgggagagcctgcgtccgctgtgggagcaggtgcaggggtttagagaggcagtcgtcccaattatggcaaaagccccacaaggcgtccatctgatctgttactcccaaggaggcctcgtctgtagagccctcttgtctgtcatggacgaccacaacgtggatagttttatctcgctctcctcaccacagatgggacagtacggagacacggattacctgaaatggctctttcccacttccatgcgctccaacctgtaccgcatatgttattccccatggggccaggaattttctatctgtaactactggcacgacccccaccatgacgacctctacttaaacgctagctctttcctcgctctgattaatgggtag

SEQ ID NO: 233954 - DNA, 477 bp, Artificial Sequence
  Description of Artificial Sequence: Synthetic coding sequence
atgctgggactctggggacagcggctgcccgctgcctgggtgctcctgcttctgcccttcttgccactgctcttgctcgccgcaccagctccccaccgggagtcttataaacccgtgatcgtagtccacggactgtttgacagtagctattccttcaggcatctgctcgaatacattaatgagatgggccagtacggagacactgactacctgaagtggctgtttcccactagtatgcgaagcaacctgtatcggatttgttatagcccatggggccaagagttttctatatgcaattactggcacgacccccatcacgacgatttgtatctgaacgcttcaagcttcctagccctgattaacggggagcgggaccacccaaatgccaccgtctggaggaagaacttcctgagagttggacatctcgtgttgatcgggggacctgatgacggggtaatcacaccatggcaatcatag

SEQ ID NO: 233955 - DNA, 543 bp, Artificial Sequence
  Description of Artificial Sequence: Synthetic coding sequence
atgctgggcctctggggtcagcgtctgcccgcagcctgggtgctcctgcttctgcctttcctgcctctcctgctactcgctgcgcctgccccacatagggcctcttataagccagtgatcgtcgtccatgggttgttcgattccagctactcttttcgacacctgctggaatatatcaatgagacccatcccggaacggtggtgactgttttggatctttttgacggccgtgaaagtctgaggcccctttgggaacaggtccaaggttttcgagaggcagtggtcccaattatggccaaggcccctcagggggtgcacctgatttgttactcccagggcggactggtgtgcagggccttgctgtctgtgatggacgatcacaatgtagattcgttcatcagtttgtcatccccacaaatggggcagtacggtgacaccgactatttgaaatggctctttcctacctccatgcgtagcaacctatataggatatgctattccccttggggccaggaattttccatctgcaactactggcattag

SEQ ID NO: 233956 - DNA, 477 bp, Artificial Sequence
  Description of Artificial Sequence: Synthetic coding sequence
atgctgggtctttggggtcaaaggttgcctgccgcttgggtgctgttgctactgccttttctaccgctgctcctcctcgctgcaccggctccccacagagccagttataaaccggtgatcgtcgtgcatgggttatttgactcatcatacagttttaggcatctgttggaatatattaatgaaatgggacagtacggtgacaccgactatctgaaatggctatttcccacttcgatgcgttcaaacttgtatcgtatctgttactctccttggggacaagaattttcaatttgcaattactggcatgacccacaccacgatgatttgtaccttaacgcttcatcatttctcgcattaatcaacggcgaaagggaccaccctaacgctaccgtttggaggaagaactttctaagagtcggacacttagtgctgatcgggggaccagacgacggtgtgatcactccatggcagagctag

SEQ ID NO: 233957 - DNA, 543 bp, Artificial Sequence
  Description of Artificial Sequence: Synthetic coding sequence
atgctgggactgtggggtcagagactgcctgctgcctgggtgcttctgttgcttccattcctgcccctcctccttctggccgcacccgctcctcatcgggcttcctacaaacccgtcatcgtcgtccatggactgtttgatagcagttatagcttccgccaccttctcgaatatataaatgaaacccacccgggtactgtcgtcacagtgcttgacctgtttgatggtagagagtccctgcgtccactgtgggaacaggtgcagggctttcgcgaggcagtggttcctatcatggcgaaggcccctcagggggttcacctgatatgctactctcaaggaggacttgtctgtcgggctctactgtccgttatggacgaccataacgtagactctttcatcagtctgagttccccacaaatgggtcaatatggggacactgattatctcaagtggttgtttccaacgtccatgcggtcaaatttgtatagaatctgctactccccttgggggcaggagtttagtatttgtaattactggcactag

SEQ ID NO: 233958 - DNA, 909 bp, Artificial Sequence
  Description of Artificial Sequence: Synthetic coding sequence
atgcttggtctttgggggcaacgccttccagccgcttgggtgttgctgcttctgcctttccttccactcctgctgctggctgcacccgctccacaccgagcgtcatataagcctgtcatcgtggtgcacggactgttcgactctagctatagcttcaggcatctgctggaatatataaatgaaacacatccgggaacagttgtcacagtcctggatctgtttgacggcagagaatccctgcgacccctctgggagcaggtgcaaggattcagagaggccgtggtgccaatcatggctaaagcccctcagggcgtccatcttatttgctattcccagggcggtctggtgtgcagagctttattaagtgtgatggacgatcataacgtcgatagctttatcagcttgtcaagcccccagatgggtcagtatggggacacagattacctgaagtggcttttcccgacctccatgcggtccaacctgtatcgcatttgctactctccctggggccaggagttcagcatctgcaactattggcacgacccccatcacgatgacctttatctgaacgcgagcagtttcctggcactgatcaacggcgagagggatcaccccaacgcgactgtctggcgaaaaaacttcctgcgcgtgggtcacctggtactgatagggggaccagatgatggcgtaatcactccttggcagagtagttttttcggcttctatgatgccaatgaaaccgtcctcgagatggaggaacagctcgtttatctgcgcgattcttttggcttgaagaccctcctagcgcgaggtgcaatcgtgcggtgtcctatggctggaatttcccacacagcctggcactctaataggaccctatatgaaacttgcattgaaccctggctatcctag

SEQ ID NO: 233959 - DNA, 909 bp, Artificial Sequence
  Description of Artificial Sequence: Synthetic coding sequence
atgcttggtttatggggacagagactgccagccgcttgggttttgttactgcttcctttccttccattactcctgttggcagcccctgcccctcatcgcgcttcctacaagcccgtcatcgtggttcacggattatttgattcaagctattcgtttcgtcacttgttggagtatattaatgaaacccatcccggaacggtagtgaccgtgctggacctgtttgatggcagggagtcccttcgaccattgtgggaacaggtacagggctttagggaggcagttgttccgatcatggccaaggctccacaaggcgttcacctcatttgctacagccaagggggtctggtgtgtagggcactgctgtcggtgatggatgatcacaacgtcgactccttcatcagtctatcttctccacagatggggcaatatggggatacggactacctgaaatggctgttcccaacctccatgaggtcaaacctgtaccgcatttgctatagcccatggggccaggaattttcgatatgcaattactggcacgatccacatcacgatgacttgtatttgaacgcaagttcctttttagcgctgatcaatggggagagagatcatcccaatgccacagtctggagaaagaattttctaagagtgggtcatttggttctcattgggggacccgacgacggcgtgataaccccctggcagtcatcgttttttgggttctatgacgcgaatgagacagttcttgagatggaggaacaactggtgtacctgcgagatagtttcggtttgaagacactgcttgctcgtggagccattgtacgctgtccaatggcaggcatcagtcacactgcatggcactctaatcgaactttatacgaaacctgtatagagccttggttgagctag

SEQ ID NO: 233960 - DNA, 927 bp, Artificial Sequence
  Description of Artificial Sequence: Synthetic coding sequence
atgaagagctgcgggtctatgttgggactgtggggtcaaagattacctgccgcttgggtcttgctcttattaccattcctacccctactgctgttggccgctcccgcacctcatagggcctcctacaaaccagtgatcgtcgttcacggcttgttcgactcctcatacagctttcggcatctcctggagtatataaacgagactcacccaggaactgttgttaccgtcttagatttgttcgacggaagagaatctctgcggcctctttgggagcaggtgcagggcttccgcgaggcagtcgtccctatcatggcgaaagcccctcagggtgtgcacctcatttgctacagccagggtggattagtctgccgcgctcttctcagcgtgatggacgaccacaacgtcgattcctttatcagcctgagttcaccccagatgggtcagtatggggacacggactacttaaagtggttgttcccaaccagtatgcgtagcaacctctatcgaatatgttactctccttggggccaggaattttctatttgcaattactggcatgatcctcaccacgatgacttgtacttgaacgcaagctcctttctggctctgattaacggggaaagggaccatcccaacgctaccgtttggcgcaaaaatttccttcgcgtgggtcacttggtgctaattggaggcccagacgacggtgtgatcacaccgtggcaatcttctttttttggattctatgatgcgaacgagactgtcctggagatggaagagcagctggtttacctaagggattcgtttggactcaagacactgctggcgaggggagctatcgtcagatgtccgatggctggtatatcccacaccgcatggcatagcaatagaacgttgtatgagacatgcatagagccatggctctcctag

SEQ ID NO: 233961 - DNA, 282 bp, Artificial Sequence
  Description of Artificial Sequence: Synthetic coding sequence
atgctcggcctctgggggcagcgactgccggctgcctgggttcttctgctgctgccttttttacctctgctgcttttagccgcacccgctccacatcgtgcttcctataaaccggtgatcgtcgtccacggcctcttcgatagcagctatagttttagacacctcttagagtatatcaacgagggagctttgtgtgctggcctctgctttctgtcctggatgattaccacttggatcctgtcctctccatcgccgctgcacagatgggacagcatggaatag

SEQ ID NO: 233962 - DNA, 909 bp, Artificial Sequence
  Description of Artificial Sequence: Synthetic coding sequence
atgctcggactgtggggacagagactgccagctgcctgggtcctccttctgctcccatttttacccctattgcttctggccgctccagccccacaccgggcttcatacaagcctgtgattgtggtgcacggactgtttgactccagctactcatttcgccacctgcttgagtacattaacgaaactcatcctggcacagttgtcaccgtgctggacttgtttgatggaagggagagcttgcgccctctgtgggagcaagtccagggcttccgtgaagctgtcgttcctatcatggcaaaggctccgcagggtgtccacctgatctgctacagccagggcggactggtgtgcagagccctcctgagtgtgatggacgatcataacgtggacagcttcatctccctgtcttcgccgcagatgggccaatacggagatacagattacctaaagtggctcttccccaccagtatgcggtccaatctttatcgtatttgttattctccatggggacaggagttctctatatgcaattactggcatgacccgcaccacgatgacctttatcttaacgccagctcatttctagcgttgattaacggggagcgtgatcaccctaatgcaaccgtgtggagaaagaacttcttaagagttgggcacctcgtgttgattgggggaccagacgatggcgtcattacgccttggcagagcagcttttttgggttctatgatgccaacgagaccgtactggagatggaagaacaactggtttatcttcgtgatagcttcggactgaagacactcctggccaggggggctattgtgcggtgtcccatggcgggaatttctcacactgcatggcactcaaacaggaccctatatgagacctgcatcgaaccatggctgtcatag

SEQ ID NO: 233963 - DNA, 477 bp, Artificial Sequence
  Description of Artificial Sequence: Synthetic coding sequence
atgctgggcctctgtgggcagaggttgccggcagcttgggtcctattactgcttcctttcttacccctgctgctcctcgcagccccagcgcctcacagggcctcatacaagcccgtgattgtggtgcatggactgtttgactcatcctactccttcagacacctcctcgagtacatcaatgagatggggcagtacggggataccgattacctaaaatggctgtttccaaccagtatgcggtccaatctgtataggatttgctactccccatgggggcaggaattttccatctgtaactattggcatgacccccatcatgacgacctatatctgaatgcctcttcgtttctggccctcatcaacggggaacgcgaccatccaaatgcaaccgtgtggcgaaaaaatttcttgagggttgggcacttggtgcttatagggggtcccgacgatggcgtgatcactccttggcaatcctag

SEQ ID NO: 233964 - DNA, 711 bp, Artificial Sequence
  Description of Artificial Sequence: Synthetic coding sequence
atgctggggctatggggccagcgactccccgctgcttgggtcctgctgctgctgcctttcttgccgcttctcctcctggctgccccagcgccacacagagagagttacaaacccgtgattgttgtgcatggactgttcgattctagttacagctttcggcatctcctcgaatacataaacgaaacccatcctggcaccgtagtgacggttctcgatctcttcgatggccgagagagtctacgtcctctctgggagcaggtccagggatttcgggaggccgtagtccccattatggcaaaggcacctcagggtgttcacctgatttgttactcgcaggggggactcgtttgtcgagcccttttgtccgtaatggacgaccataatgtggactctttcataagcctgtcgtcaccccagatgggccagtatggagataccgactacttgaagtggctgttcccaaccagtatgagatctaatttataccggatttgctactcaccctgggggcaagaatttagtatttgtaactactggcatgatccgcatcacgatgatctgtacctgaacgcctccagcttcctcgcactgattaatggtgaaagagatcatccgaacgccaccgtgtggagaaagaatttcctgagagttggacatctggtgctgatcggcggtcctgacgatggcgtaatcaccccttggcagtcctag

SEQ ID NO: 233965 - DNA, 543 bp, Artificial Sequence
  Description of Artificial Sequence: Synthetic coding sequence
atgttaggactctggggccagcgtctacctgccgcttgggtcctgctgctgctgcctttcctcccccttttgcttttggctgcccctgctccacatcgcgcatcgtataaacccgtgattgtggtgcatgggctctttgactctagctatagtttcagacacctcctggagtatatcaacgagacccacccaggaacagtagtaacagtgctagatctgttcgatgggagagagtccctccgcccactgtgggaacaggtgcagggttttcgagaggctgtggtaccaatcatggccaaagctcctcagggcgtgcacctgatctgttattcgcaagggggactcgtatgccgtgctttgttgtcagtcatggatgatcataatgtggacagcttcatctccttgtcatcccctcagatggggcaatacggcgataccgattatctcaagtggttatttccaacatctatgaggtcaaacctgtacaggatctgttacagcccatggggacaggaattttctatttgcaattactggcattag

SEQ ID NO: 233966 - DNA, 711 bp, Artificial Sequence
  Description of Artificial Sequence: Synthetic coding sequence
atgctgggactgtgggggcagcgactcccggctgcctgggtactcctgctccttcctttcctgccactgttacttctggcggcaccagcaccgcatcgcgaaagctataagccagtcatcgtggtgcatggtctcttcgactcatcatactccttcaggcatctcctggaatacatcaatgagactcaccccggtaccgtggtaacagtgctggatctgtttgatggaagagagtctctacgcccactgtgggagcaggtgcaggggttccgggaagccgtggttccgataatggccaaagctccccagggcgtccatctaatctgttattcccaaggaggtcttgtgtgccgagctctcctctcagtgatggacgatcataatgtcgacagcttcattagcttaagttcaccccagatgggccagtatggagacacggattatctgaaatggctgttccctacttcgatgcgaagtaacctataccgcatttgttacagcccttggggtcaggagttttcaatctgtaactattggcatgacccccaccacgatgacctgtatctgaacgcatcctccttcctggctctaattaatggtgaaagggatcatcccaacgccaccgtctggaggaagaacttcctccgtgtgggccacctggtgctgatcggaggtccagacgatggagtcattacaccatggcagagctag

SEQ ID NO: 233967 - DNA, 603 bp, Artificial Sequence
  Description of Artificial Sequence: Synthetic coding sequence
atgctcggcttatggggacagcggttgcctgccgcatgggtcctgttgctcttaccgttcttgcctctgctgcttctggccgctcccgctccccaccgcgctagttataaaccggtgatcgtggtacatggcttgttcgattccagttattccttccggcacttgttagagtacatcaacgagactcatccaggcaccgtcgttaccgtgctcgatctgtttgacggcagagaaagcctgaggcctctgtgggagcaggttcagggttttagagaggccgtggtccctattatggcgaaggcgcctcagggagtgcatcttatctgctatagccagggcggattggtgtgcagggctctgctcagcgttatggacgaccataacgttgactcgtttatcagcttgagctcccctcagatgggacagtacggcgacacagactacctgaagtggctcttcccaaccagtatgcgctctaacttgtaccgaatctgttatagcccatgggggcaggagtttagtatctgtaactactggcatgatccccatcatgacgacctttacttgaacgctagcagctttctcgcactgatcaatggctag

SEQ ID NO: 233968 - DNA, 909 bp, Artificial Sequence
  Description of Artificial Sequence: Synthetic coding sequence
atgctcggtctatgggggcaaaggcttcccgcagcgtgggttcttctcttgctgccttttctgcctcttttgctgctcgccgcaccagcaccccaccgagcaagttacaagcctgtgatcgttgttcatggtctattcgacagtagctacagcttccggcacctcttggaatatatcaatgaaacacaccctggcactgtcgtcactgtcctggacctgttcgatggccgagagagcctgagacctctgtgggagcaagtccaggggtttcgggaagctgtagtgcccataatggccaaggccccacaaggcgtccacctgatatgttacagccagggtggacttgtttgtcgggcactgttgtccgtgatggacgatcacaatgtggatagcttcattagcctcagttcaccccagatggggcagtatggtgacaccgattacctgaaatggttatttccaacttcgatgaggtccaatctgtaccgcatatgctactcaccttggggccaggagtttagcatttgcaactactggcacgacccacaccatgacgatctgtatttgaacgcctccagcttcctcgctctgataaacggtgaacgagaccacccaaatgccacagtttggagaaagaactttttacgcgtcggccacttggtgctcattggcggaccagacgacggcgtcataacaccctggcaatcgtctttttttgggttttacgatgcgaatgagaccgtcctagagatggaggaacagctcgtgtacctacgggattcttttggcctcaagaccctattggccagaggcgcaattgtgcgctgccctatggcgggaatcagccacaccgcctggcattcaaatcggaccctctacgagacatgtatagagccttggctcagttag

SEQ ID NO: 233969 - DNA, 603 bp, Artificial Sequence
  Description of Artificial Sequence: Synthetic coding sequence
atgctcggtctatggggtcagcggcttccagccgcatgggtgttgctgcttctgccattcctgccgctgctacttttggcagcacccgcaccacaccgcgcttcctataaacccgtcatcgtcgtccatggactgtttgattcctcctacagcttccgccatttgctcgaatacatcaatgaaacccacccgggaaccgttgtaactgtactagatctgttcgatggacgggagtctcttcggcctttgtgggaacaagtgcaaggcttccgagaagctgtagtccctatcatggcaaaggctccacagggagttcacctgatttgttacagccagggtgggctggtatgtcgagccctgttaagcgttatggatgatcacaacgttgattccttcatcagcctgtcttccccgcagatggggcagtacggcgacacggactacctcaagtggttgttccccactagcatgagatcaaacctctacaggatttgctactccccatgggggcaggaattctcgatctgtaactattggcatgatccacatcacgacgacctttatctcaatgcaagttcctttctggccctaatcaatggctag

SEQ ID NO: 233970 - DNA, 729 bp, Artificial Sequence
  Description of Artificial Sequence: Synthetic coding sequence
atgaaaagctgcggctccatgctggggctgtgggggcagagactgccagcagcctgggtgctcttattactcccttttctgcctcttctgttgctagccgctcccgcacctcaccgggaatcttacaaacccgtcatcgtagtccatggtttgtttgattcatcatacagttttcgacatcttcttgaatatattaatgaaacacacccgggaaccgtggtcactgtgctggatctcttcgacggacgggagtcactgcggccattatgggagcaagtccaagggtttcgtgaagcagttgtgccaattatggcaaaggcccctcagggggtgcatctgatctgttattcacaaggagggttggtctgccgggctctgctgtccgtgatggacgaccataacgttgattcctttatcagcctttcctctccgcagatgggacaatacggagacaccgactatcttaagtggctcttccccacctctatgcgttccaacctatacagaatctgctactctccatggggacaggagttctcgatttgcaactactggcatgatcctcaccatgatgatctgtacctgaatgcgagtagcttcctggcactcatcaacggcgaaagagatcatccaaacgctactgtatggcgcaaaaattttctgagagttggacatttggtgctgatcggcggacccgacgacggggtgattacgccctggcagtcatag

SEQ ID NO: 233971 - DNA, 711 bp, Artificial Sequence
  Description of Artificial Sequence: Synthetic coding sequence
atgctcggcctttggggacagcgcctcccggcagcctgggtcctcctgctgctcccattcctccccctcttgttgctggccgctcccgctcctcatcgggagtcatacaaacccgtcattgtagtgcacgggctttttgatagcagctacagctttagacacttattggagtatataaatgagacccacccagggacagtcgtgaccgtgctcgacttgttcgacggcagggagtcactaagacctttatgggaacaggtgcagggctttcgcgaagctgtcgtgccaatcatggcaaaggctccacagggcgtacatctcatttgctatagccagggtgggctggtctgccgtgctttgttatctgtgatggacgatcacaatgtggacagctttatttctctctcttcacctcagatggggcaatacggagacactgattatttgaaatggctttttcccacgtccatgcggtctaatctgtatagaatctgttacagtccatgggggcaggaattttcgatctgcaactattggcacgatccccatcacgatgatctttacctgaacgcctcatcctttctcgcattgatcaatggggaaagagaccaccctaacgctacagtgtggaggaagaattttctcagagtgggccatctggtgctgatcggcggacctgatgacggcgtgataaccccctggcagtcttag

SEQ ID NO: 233972 - DNA, 543 bp, Artificial Sequence
  Description of Artificial Sequence: Synthetic coding sequence
atgttaggattatggggccaaagattacctgccgcatgggttttactgctactgccctttctccccctgttactgctggctgcaccagcccctcacagagccagctataaacctgtgatagtggtgcacggcttgtttgattcttcctacagtttccggcatctgctggaatatatcaacgagactcatccgggaacggtggtgacagtactggatttgttcgatggcagggaaagcctgaggcccctgtgggagcaggtccaagggttccgtgaggcggtggtgcctatcatggcgaaggcacctcagggggttcacttaatttgttatagccagggaggcttggtgtgccgcgctctactatctgtcatggatgatcacaatgtggatagcttcatctcactctcttctccacagatgggccagtacggggacacagactatttgaaatggttgttccccacatctatgcgcagcaatttataccggatctgttactccccgtggggccaggaattctcaatatgtaactattggcactag

SEQ ID NO: 233973 - DNA, 477 bp, Artificial Sequence
  Description of Artificial Sequence: Synthetic coding sequence
atgctcggtctgtggggtcagcggctgcccgctgcatgggtgctccttctgctgcccttcttgccattattattattagcggctcctgcaccacaccgggcttcatacaaacctgtcatagtggtacatggtttgtttgattctagctatagttttagacacctgctggagtatatcaacgaaatgggacagtatggagacacggattacctcaaatggctttttcccacatcaatgaggtccaacctctataggatctgctacagcccctggggtcaggagttcagcatttgcaactactggcacgatcctcaccatgacgatctgtatctgaatgcctccagttttctggctctgatcaatggggagcgcgatcatcccaacgccaccgtctggcgcaagaattttctgagggtcgggcatctggtactcatcggaggaccagatgacggggttattaccccatggcagtcttag

SEQ ID NO: 233974 - DNA, 603 bp, Artificial Sequence
  Description of Artificial Sequence: Synthetic coding sequence
atgttgggtctgtgggggcaacgtctacctgccgcatgggtgctactgcttcttccctttcttcccttgctgctcctggcggcacccgctccacatagagaatcttacaagcctgtgattgtggttcacggtctgtttgacagctcctactcattcagacacctcttggagtacataaacgagacccacccagggaccgttgtgactgtgctcgatctcttcgatggcagggagagtctgcgtcccctctgggagcaagtgcaaggcttccgcgaagccgttgttcctatcatggctaaagcgccacagggggtccaccttatttgctacagccagggaggcttggtttgtcgcgcactgctttcggtcatggatgatcataacgtcgactccttcatctccctcagctcacctcaaatgggacagtacggtgatactgactacctgaaatggctgttccctacttcaatgagaagcaacctttatcgtatctgttatagcccgtggggccaggagttctccatctgcaactactggcacgatccacatcatgacgatctctatctcaacgcctctagtttcctcgcactcatcaatgggtag

SEQ ID NO: 233975 - DNA, 603 bp, Artificial Sequence
  Description of Artificial Sequence: Synthetic coding sequence
atgcttggcctgtgcggtcagagactgcctgctgcatgggtcctgctgctgctcccatttcttccactgcttctactagctgcacccgctccgcatcgtgcctcctacaagcctgtgatagtggtacacggactttttgacagctcctacagctttaggcatttgctggaatacatcaacgaaacacatcccggtacagtggtcacagttctggacctgtttgacgggagagaaagtctccgtcccctgtgggagcaggtgcagggattccgtgaggccgtggtgcccatcatggcaaaggcgcctcagggggttcatctgatttgttactcgcagggagggctggtgtgccgtgcccttctgagcgtgatggacgatcataatgtggattctttcatttctctgtcctcaccccagatgggtcagtacggggacacagattacctaaagtggcttttccccacgagtatgcgatctaacctgtatcgcatctgctactctccctggggccaggaattttctatatgcaactactggcacgatccacaccatgatgatctgtacctgaacgccagttcctttctggccctgatcaatggctag

SEQ ID NO: 233976 - DNA, 441 bp, Artificial Sequence
  Description of Artificial Sequence: Synthetic coding sequence
atggatgaccacaacgtggattcatttatcagcctgagttctcctcaaatgggccagtatggtgatactgactacctcaagtggctgttccccacctcaatgagaagcaacctgtacagaatctgctactctccatggggacaagaattttcaatttgtaactattggcacgatccacatcatgatgacttgtatctaaatgcctcttcattcttagccctgatcaatggtgaaagggaccatccaaatgccactgtttggaggaaaaacttcttacgagtcgggcacctcgtacttattggaggcccagatgatggagtgatcacgccctggcagagctctttttttggcttctatgatgccaatgagaccgtgttggagatggaggaacagttaccagtggggtcctctgtgaaggccaatcacggagtgcagggttag

SEQ ID NO: 233977 - DNA, 477 bp, Artificial Sequence
  Description of Artificial Sequence: Synthetic coding sequence
atgctcggattgtggggccagagactgcctgccgcttgggtcctgttattgctgccgttcttgccacttctactcctggctgcaccagctccacaccgggcatcatacaagcccgtgatcgtagttcatgggttgttcgacagtagttattcattcagacatctcttggagtatataaacgaaatggggcagtacggtgacacagattaccttaaatggttgtttccgaccagcatgaggagtaacttatatcgcatttgttacagtccatggggacaagagttctccatttgcaactactggcatgacccacatcacgatgatctctacctcaatgcctcttcctttcttgcgttaattaacggagaacgcgaccacccaaacgccacagtttggcgcaagaattttctccgggtgggtcatctcgtactaatcggaggcccagacgatggcgtgattaccccttggcagagctag

SEQ ID NO: 233978 - DNA, 909 bp, Artificial Sequence
  Description of Artificial Sequence: Synthetic coding sequence
atgctcgggctctggggacaaaggttaccagctgcttgggtgcttctcctgcttccattcctgccactccttcttcttgcggctcctgcacctcaccgagccagttacaaacctgttatagtggtgcacggactgttcgatagttcttactcattcaggcacctactggagtatatcaatgagactcatccgggaactgtagtgaccgtgctcgacctgttcgacggcagagaatcactgcgccctctgtgggagcaagtgcaaggcttccgcgaggcagttgtccccatcatggctaaagctccccaaggcgtccatttaatatgctattctcaaggcggactggtgtgtagggccttattgtcagtcatggatgatcataatgtggattcatttatctctctcagttctccacagatgggtcagtatggagacacagattacctcaagtggcttttcccgacctccatgcgtagcaatctttaccggatttgctacagcccctggggccaggaatttagtatatgcaactattggcacgatccccaccatgacgacctctatttgaatgcgagcagtttcctggccctgatcaatggggagcgtgatcaccctaatgctaccgtttggagaaaaaattttctccgcgtgggccacctggtcctgatcgggggacctgatgatggggttatcaccccttggcagagcagcttttttgggttctacgatgcaaacgaaacagtcctcgagatggaggagcaacttgtgtacctaagagattcgttcggattgaagactctgcttgctcggggagcgatcgtgaggtgtccaatggctgggatatctcataccgcctggcactctaacagaactctctacgaaacctgcattgaaccatggctatcctag

SEQ ID NO: 233979 - DNA, 909 bp, Artificial Sequence
  Description of Artificial Sequence: Synthetic coding sequence
atgctagggctgtgggggcaaaggcttccagcggcatgggtcctgctgctgctgccatttctgcccttactgctcttggcagcccctgccccacatagggcttcttacaaacccgtgattgtcgtccacggcttatttgattcaagctacagctttaggcacttgcttgaatacatcaatgaaacccacccaggcacagtggtgaccgtgctggacttgttcgacggtcgagaatccctaaggcccctctgggagcaggtgcaggggttccgcgaggctgttgtcccgatcatggcaaaagctccccaaggcgtgcacctcatctgttatagccagggcggactggtgtgcagggctctgctgagcgtcatggatgatcacaacgtcgactcttttatcagtctctcctctccacaaatgggacagtatggggacacggattatctgaaatggctgtttcctactagcatgagaagcaacctgtacagaatatgctactctccgtggggccaagagttcagtatctgtaattactggcacgacccgcatcatgatgatctctacctgaacgctagctcatttctcgcactcatcaatggagagagagaccatcccaacgctaccgtatggaggaaaaacttcctcagagtgggtcaccttgtcctcatcggcggaccggacgacggagtcataaccccatggcagagtagtttctttggcttctacgacgcgaatgaaacagtgctggaaatggaagagcagctggtatacctgcgagacagcttcggtctaaagaccctgcttgccagaggagcaattgtgcgatgtccaatggctggtatatctcatactgcttggcacagtaataggacgctgtacgagacctgcatcgagccctggttgagctag

SEQ ID NO: 233980 - DNA, 909 bp, Artificial Sequence
  Description of Artificial Sequence: Synthetic coding sequence
atgttgggcctatgggggcagaggttgccagccgcttgggtgctgcttttgctaccattcttacctttactgctgcttgctgccccagccccacaccgggcaagctataaaccagtcatcgtcgtccacgggcttttcgacagctcctacagtttccgccacttgctcgagtacatcaatgaaactcaccccggtaccgtggtgactgtgctggatctattcgatggaagagaatccctgcgcccattgtgggagcaggtgcagggctttagagaagccgtagtcccaatcatggccaaagcaccacagggcgtccacctcatctgttattcccaagggggtttggtctgtcgggctctcttgagtgtgatggacgaccacaatgtcgattcatttatttccctatcttccccacagatggggcagtacggcgataccgactatctgaagtggcttttccccacctcaatgcggtccaatttgtatcggatctgctacagcccttgggggcaggagtttagtatctgtaattattggcatgacccccaccacgacgacctgtatctgaacgcaagctccttcctcgctcttattaacggggagcgcgaccacccaaacgcgacagtgtggaggaagaattttcttagggtgggtcacctggtgctgattggcggacctgatgatggcgtgatcaccccttggcaatcctccttctttggcttctatgacgctaacgaaaccgtcctggagatggaggaacagctcgtttatttaagagacagcttcggactcaaaactttgctcgctaggggagctattgttcgttgtcccatggccggaatcagtcacaccgcatggcatagtaatcgcaccctttacgagacatgtattgagccatggctgtcctag

SEQ ID NO: 233981 - DNA, 282 bp, Artificial Sequence
  Description of Artificial Sequence: Synthetic coding sequence
atgctcggcctgtggggtcagcggttgcctgctgcctgggttctgctcttacttccttttctcccactcctcctattagctgcccctgctccccaccgtgaaagctacaagccagtcatcgttgttcacgggctgttcgactcgtcctattcattccggcatctgctggaatacatcaacgaaggagctctgtgtgctggcttatgtttcctgtcatggatgattaccacttggatcctgtccagtccctcacccctccatcgctgggattcgatggaatag

SEQ ID NO: 233982 - DNA, 603 bp, Artificial Sequence
  Description of Artificial Sequence: Synthetic coding sequence
atgttggggctttggggtcaacgtcttcccgctgcatgggtgctcctgctgctccccttcctcccacttctgctcttagctgcgcctgctccccaccgagcgagttacaagcctgtcatcgtggtgcacggtttgttcgactcttcatatagctttcgccacctgttagagtatatcaatgaaacacacccagggacggtggttactgtcctggatctgtttgatgggcgtgagtcactaagaccattatgggaacaggttcaggggttccgagaggctgtcgtcccaattatggcaaaagccccacagggagtgcatcttatttgctacagtcagggcggactggtgtgccgggctcttctctcggtcatggacgatcataacgttgattcctttataagcctgagctctccccaaatggggcaatacggcgacaccgattacttgaagtggctctttcctacatcgatgagatccaacctttatcggatttgttatagcccttggggacaagaattctccatctgtaactactggcatgacccgcatcacgacgacctttacctgaatgctagttcatttctagccttgatcaacggctag

SEQ ID NO: 233983 - DNA, 603 bp, Artificial Sequence
  Description of Artificial Sequence: Synthetic coding sequence
atgctgggcttgtgggggcagcgcctgccagccgcatgggttctgctgttgctgccttttctgccactgctcttgcttgctgccccagctccccaccgcgcaagctacaagccagtgatcgtagtccatggcctgttcgattcatcctactcttttaggcacctgttagagtacatcaatgaaacccaccccggtaccgtggtgacagttttggatctgtttgatggcagagagtcgctaagacccctctgggaacaggtacagggctttcgcgaggcagtagttcctattatggctaaagctccccagggagtgcacctaatttgctacagccagggaggtctcgtctgtcgcgcattactgtccgtcatggacgaccacaacgtcgatagtttcatttcactttcatccccgcagatgggacagtatggcgatacggattatctgaagtggttattccctaccagtatgcggagcaacttgtatcgtatctgctacagcccttggggtcaagaattctctatctgcaactactggcatgatccccatcacgacgacctgtacctcaacgccagttcttttctggccctgataaacggctag

SEQ ID NO: 233984 - DNA, 909 bp, Artificial Sequence
  Description of Artificial Sequence: Synthetic coding sequence
atgctaggcctctggggccagagactgcctgccgcatgggttcttctgcttcttccattcctccccctgttgcttctcgctgcacctgctccacaccgggcttcgtacaagcctgttatagtcgtccatgggcttttcgatagttcttactcatttcgccatctcctggagtacatcaacgaaacacatccaggtacagtggtgacagtgctcgacctgtttgacggcagagagtcgctgaggcccctttgggagcaagttcaggggtttcgagaagcagtagtgccgatcatggccaaggcaccccagggcgtacacctcatttgttactcccagggcggacttgtgtgtagggcactcctttccgtgatggatgatcacaatgtagatagcttcatttcgttgtctagccctcagatgggccagtatggcgatacagactatctgaaatggctgtttcctaccagcatgaggtcaaacctctataggatctgctacagtccctggggccaagaatttagcatttgcaattactggcatgatcctcaccacgacgatctgtacctgaacgcttccagcttccttgcccttattaatggagagagggatcatcctaatgctacagtttggcgaaaaaattttctgagagtgggacacttggtgctaatcggcggaccagacgatggcgtcataacaccttggcagagctcgttcttcggcttttatgacgccaacgagacggtgctcgaaatggaagagcagcttgtgtatttacgtgactcctttggcttgaaaacattgctggctcgaggagcgatcgtccgatgtcccatggccggaatttcccatactgcatggcattccaataggaccctgtacgagacctgcatagagccatggctgagctag

SEQ ID NO: 233985 - DNA, 906 bp, Artificial Sequence
  Description of Artificial Sequence: Synthetic coding sequence
atgttagggctgtgtggccaaaggttgcctgccgcttgggttctactactgctgccttttctaccattactgctgctggcggcaccagcgcctcacagagcgtcttacaaaccagtgatcgtggtgcatggcctatttgacagctcctacagcttcagacatctgcttgagtatataaacgaaactcacccaggcaccgtggtgactgtgctggatcttttcgacgggcgtgaatccctgcgtccgttatgggagcaagtacaaggctttcgggaggctgtcgtgccaatcatggcaaaggccccacaaggagtacatctgatttgttatagccagggcggactggtgtgtcgtgccctactgtcagtgatggacgatcacaatgtggacagctttatctcactttcttcccctcagatgggacaatacggcgacacggattatctgaagtggctctttcctacctcaatgagatccaacctgtatagaatttgttatagtccttggggccaggagttctccatttgtaactactggcatgacccgcatcatgacgatctgtatcttaacgcttcctctttcctcgcgttgatcaacggcgaaagggaccaccccaacgctacagtctggcgaaaaaattttctccgtgtggggcacctcgtgctgataggcggacccgacgatggagttatcaccccctggcagagttcgtttttcggcttttacgatgctaatgagaccgttctggaaatggaggaacaactacccgcacgcccaacacatcaatcagaacttttacttctcagactggtgtgccttaagccgccacggcgaaaaaagcccgcatgtcgcgtgcagcgacaatcagagagctggggtcctggtttgtcgtgcgcacttagttag

SEQ ID NO: 233986 - DNA, 477 bp, Artificial Sequence
  Description of Artificial Sequence: Synthetic coding sequence
atgctgggtctgtgggggcagcggctgccggctgcttgggtcctcctccttctgccctttctgcccctgttgctactggctgctcccgctccccaccgggagtcctataaacctgtcattgtggttcatggcctatttgactcctcttatagctttcgtcatctgctggaatacatcaacgaaatggggcagtacggggacaccgattatctcaaatggctgtttcctacaagtatgcgctctaacctctaccgaatttgttattctccatggggccaggagttctccatttgtaattattggcacgacccccaccatgacgatctttacctcaatgcgagctcttttctcgccctgatcaatggggaaagagatcatcccaatgccacagtttggcgcaaaaactttctgagagttggccaccttgtcctcattggtggccctgacgacggcgtgattacaccttggcaatcgtag

SEQ ID NO: 233987 - DNA, 543 bp, Artificial Sequence
  Description of Artificial Sequence: Synthetic coding sequence
atgttggggctgtgggggcaacgccttcctgctgcatgggttctgcttttactccccttcctgcctttgttgctcctcgcagctcctgccccacatagagctagctataaacctgtgatagtggtccacggattattcgactccagttactcgtttcgccatttgcttgagtacattaacgaaacacatcccggaactgtggtcaccgtgctcgacctgtttgacggaagagaaagtctgcgacctctatgggagcaagtccaaggcttcagggaagctgtggttccgattatggcgaaagcaccgcagggcgtgcacttgatttgctacagccaagggggactggtgtgcagggccctcctgtcagttatggatgaccacaatgttgattctttcattagtttgagcagtccacaaatgggacagtacggcgatactgattacttaaaatggctctttcctaccagcatgcgaagcaatttatacaggatctgctactccccttggggacaggagttctccatctgcaattactggcactag

SEQ ID NO: 233988 - DNA, 603 bp, Artificial Sequence
  Description of Artificial Sequence: Synthetic coding sequence
atgctgggcctgtggggacaacgcctccctgccgcatgggtgttgctgctgttgcccttcttgcctctgttgctgttagccgcacctgcaccacacagagcctcttataagcccgtcattgtggttcacggactcttcgactccagttactcgttccgtcatctgctcgaatacattaacgaaacccacccaggaacagtagtgaccgtgctggatcttttcgatgggcgtgagtctctccggccattgtgggagcaagttcaaggcttccgcgaggccgtggtgcctatcatggcaaaagctccccagggcgtgcacctaatctgctattcgcaggggggtctggtgtgcagagcccttctgtcagtgatggatgaccacaacgttgactcattcatatcactgagtagccctcagatgggacaatacggcgacaccgattatttgaaatggctgttccctacttcaatgaggagcaacctctaccgcatttgctactctccgtggggacaggaattttctatttgtaactactggcatgacccccaccacgatgatctctacctgaacgccagctccttcctggccttgatcaatggctag

SEQ ID NO: 233989 - DNA, 909 bp, Artificial Sequence
  Description of Artificial Sequence: Synthetic coding sequence
atgctgggactttggggtcagcgcctgcctgcagcctgggttcttctgctccttccttttctgcctctccttctgctggctgcaccagcgcctcatcgtgcttcatacaaacctgtgatcgtagtccacggcctattcgatagttcctattcgtttcgccatctacttgagtatatcaacgagactcacccagggaccgtggtaacagtactcgatttatttgacggcagagagtcccttcgacccctttgggagcaagtgcaaggttttcgggaagccgtagtgccaatcatggccaaggctcctcagggcgtgcacttgatctgttactcccagggcggtttggtgtgcagagcgctcctctccgtaatggacgaccataacgtcgacagctttatttctctatcttctccacaaatgggacagtacggtgatactgattatctcaaatggctattcccaacctccatgcgcagcaatctgtatcgaatatgttactccccctggggtcaagagttctccatctgcaactactggcatgatccccaccatgatgacctctacttgaatgcctccagttttctggccttaatcaacggggagcgtgaccacccgaacgccaccgtttggcgaaaaaattttcttcgagtgggacacctggtgctgatcggtggccctgacgatggtgtgattacgccatggcagtcctctttctttggtttctacgatgctaatgaaactgttttggaaatggaagagcagctagtgtacctacgggatagctttggactgaaaacactgctggcacgcggagctattgtacgctgtcccatggctggaataagccacactgcttggcattccaaccggacgctttatgaaacttgcattgagccatggctaagctag

SEQ ID NO: 233990 - DNA, 909 bp, Artificial Sequence
  Description of Artificial Sequence: Synthetic coding sequence
atgcttggactatggggtcagcgcctccccgctgcctgggttctgctgctgctcccgttcctgcctctgctgctcctagccgctccagcccctcatcgtgcctcgtataagcccgtcatcgtcgtccacggcctgtttgacagttcatatagctttcgacatctgctggagtacatcaatgagacccaccctgggaccgttgtgacggtcctggacctcttcgacggacgtgaatccttaagaccattatgggaacaggtgcaagggtttcgggaagctgtagttccgataatggccaaagcccctcagggggtgcacctcatatgctacagccagggtggattggtatgccgggctttgctgtctgtgatggacgatcacaacgtcgactccttcatatctctgtcgagtccacagatgggtcagtacggagacacagattatctcaaatggcttttccccactagcatgagaagtaatctgtataggatctgctacagtccctggggccaggagttttcaatttgcaactattggcacgacccacatcatgacgatctgtatttaaacgcctcctcctttctagctctgattaacggggagcgtgaccatccaaatgccaccgtgtggaggaagaactttctccgtgtcggccatctggtcctgatcggcggtcctgacgatggcgtgataactccttggcagtcgagcttctttggcttttatgacgctaatgagactgtgctggaaatggaagagcagctggtgtacctccgggattctttcggtctgaagacacttttggctcgcggagccatcgtacgttgtcccatggccggaatatcccataccgcatggcattccaacaggaccctttatgaaacatgtatcgaaccctggcttagctag

SEQ ID NO: 233991 - DNA, 282 bp, Artificial Sequence
  Description of Artificial Sequence: Synthetic coding sequence
atgcttgggctgtggggccagcgcctccccgcagcttgggtactgttgctgctcccttttttacctctgttactgctcgctgctccagcccctcaccgcgcaagctataaaccagtgatcgtggtccacgggcttttcgattcttcttattctttcagacacctgttagagtacatcaatgaaggcgctctctgtgccggtctgtgcttcttgagctggatgattaccacatggattttgtcttcccccagtcccttgcacagatgggattccatggaatag

SEQ ID NO: 233992 - DNA, 282 bp, Artificial Sequence
  Description of Artificial Sequence: Synthetic coding sequence
atgttaggattgtgtggtcagcggctgcctgcagcttgggtacttctattacttccatttctcccactgcttcttctggctgcccctgctccgcatcgggcatcctataagcctgtaattgtagtgcacggcctgttcgactcttcctatagtttccggcatctgctggaatatatcaatgaaggggctctttgcgctgggctctgtttcctttcatggatgatcacgacatggatcttatcctctccttcgccactccaccgctgggacagcatggaatag

SEQ ID NO: 233993 - DNA, 909 bp, Artificial Sequence
  Description of Artificial Sequence: Synthetic coding sequence
atgctgggcctgtggggccagaggctccccgctgcatgggttcttttattgctgccatttctcccgctgctgctgctggcagcccctgcgcctcatagagccagttataaacctgtgatcgttgtacacggactgttcgattcttcctacagtttcaggcatcttctggagtacataaacgaaactcaccctggaaccgttgtcaccgtgctggatttgttcgacggtcgggaatctctgaggcccctctgggagcaggtccaaggctttcgcgaagccgttgttccgatcatggcaaaagcaccacagggtgtgcatttgatctgctacagccaggggggactggtatgccgggcactgcttagtgtgatggatgatcataatgttgactcttttataagtctgagttcgccccagatgggccagtacggagatactgactatttgaagtggcttttcccaacatcgatgaggtctaatctctatcggatttgctatagcccatggggccaggaattctctatctgtaactactggcacgatccccaccacgacgatttatatttgaacgcctcatcattcttggctctgattaacggcgaacgggaccaccctaatgccacagtgtggcgtaaaaattttttgcgggtgggtcatctagttctgattgggggaccagacgatggagtcattaccccctggcagagctctttctttggcttttatgacgccaacgagaccgtgctggagatggaagagcagttggtctacctccgagactccttcggccttaagacgctgctggcgagaggcgcaatcgtacgctgtccaatggcaggtatcagccacaccgcgtggcattcaaatcgaaccctatatgagacctgcatcgagccatggctttcatag

SEQ ID NO: 233994 - DNA, 909 bp, Artificial Sequence
  Description of Artificial Sequence: Synthetic coding sequence
atgctgggcctgtggggccaaaggcttcctgcagcctgggtgttgctgctactgcctttcctgcctctcctgctcttagccgctccggctccccatagggcctcctacaagccagtcatcgtcgtgcatggcctttttgacagcagttactctttccgccatctgctggaatacattaatgaaacccatccaggaactgtagtcaccgtattagatctgtttgatgggcgtgagtcactacgcccactctgggaacaggttcaggggttcagggaggccgtggtccctattatggccaaagccccacaaggcgtgcatctaatttgttattctcagggtggacttgtatgccgagccctgctgtcggtcatggatgatcataacgtggattcattcatcagtctctcctcgccccaaatgggccagtacggcgacaccgattacttaaagtggctgttccctacttcaatgcgtagtaatttatatcgcatttgttattcgccatggggccaggagtttagcatctgcaattattggcacgatccccaccacgatgacctgtacttgaatgcgagttccttcctggccctaataaatggggagcgcgatcatccgaatgcaactgtgtggcgcaaaaattttctccgggttggacatctggttctcattggtgggccagacgacggggtcattacgccctggcaatcgagcttttttggcttctatgacgcgaatgagacagtgcttgagatggaagagcagctcgtctacctgcgtgactcgtttggattgaagacattgctggcacgtggcgcaattgttagatgtccaatggctgggatttcacataccgcatggcactctaataggactttgtacgagacatgcatagaaccttggttaagttag

SEQ ID NO: 233995 - DNA, 543 bp, Artificial Sequence
  Description of Artificial Sequence: Synthetic coding sequence
atgcttggcttgtggggccagaggcttcctgctgcttgggtgctgctgttgctacctttccttccactgctgcttctggcagcaccagcccctcatagagaaagttacaaacccgtgattgtggtgcacgggctctttgacagtagttattcttttcgtcaccttctggaatatatcaatgaaactcacccaggcactgtggtgaccgtgcttgaccttttcgacggacgcgaaagtctgcgtccactttgggaacaagtgcagggcttcagagaagccgtggtcccaatcatggccaaggcaccacagggggttcatctcatatgctacagtcaaggcggactggtttgcagagcgctgctgagtgtcatggacgaccacaatgtggactcctttataagtctcagctcccctcagatgggccagtatggcgacaccgactatctcaagtggctctttccgacatcgatgaggagcaacctctataggatctgctatagtccttggggtcaagaattttctatctgtaactattggcactag

SEQ ID NO: 233996 - DNA, 543 bp, Artificial Sequence
  Description of Artificial Sequence: Synthetic coding sequence
atgcttggcttatggggacagcgcctcccagccgcatgggtgctgctgcttcttccttttctgcccctcctgctgctcgcagcacccgctccccacagagagtcctacaagccggtgatcgtagtccacggactgtttgactcctcgtactctttccggcatctactggaatacattaatgaaacacaccccggtactgtcgtgaccgttctggatctgttcgacggacgagagtctttgcgccctttatgggagcaggtccagggatttcgtgaggctgtcgttcctattatggcaaaggccccacaaggggtgcacctcatttgttactcccagggtggccttgtttgtagagctttgctgtcagtaatggatgatcataacgttgacagctttatcagtttatcctcaccacagatgggccagtatggcgacacagactatctaaagtggctctttcctaccagcatgcgctctaacctgtataggatttgttattctccgtggggccaggagtttagtatttgtaattactggcattag

SEQ ID NO: 233997 - DNA, 282 bp, Artificial Sequence
  Description of Artificial Sequence: Synthetic coding sequence
atgcttggcctctgggggcagcgactccccgctgcctgggtactcctcctgctgccgttcctgccactcttacttctggctgctcccgcacctcacagagagtcgtacaaacccgtcatcgttgtacacgggttattcgatagcagttactctttccgccatctcctggagtacatcaatgaaggagccttatgtgcgggtttgtgcttcctgagctggatgattaccacatggatcctcagcagcccatcacctctacacagatgggattctatggaatag

SEQ ID NO: 233998 - DNA, 711 bp, Artificial Sequence
  Description of Artificial Sequence: Synthetic coding sequence
atgctggggctgtggggccaacggctcccagccgcatgggttctgcttctgttgccttttctcccactgttgttactggctgctccagcaccacaccgcgagtcttacaagccagtgatagttgtgcatggtctctttgactcctcatacagttttaggcacttgctcgaatacataaacgagactcaccctgggacggtcgtaaccgtcttggatctatttgatggtagggagagtttacgacccctgtgggaacaggtgcaaggattccgggaggcagttgtgcctattatggccaaggccccacagggagtacatctgatatgttacagccaggggggactggtttgtagggctctgttgtccgtcatggatgatcacaacgtggattcgtttatctccttgagttcaccacagatgggccaatatggtgacaccgattatctgaagtggctgttcccgacctctatgaggtctaatctttataggatttgttacagtccttggggacaggagttctccatttgtaactactggcatgacccccaccatgacgatctgtacctgaatgcctctagcttcctcgcactgattaatggagaacgtgaccatcccaacgctactgtctggaggaaaaacttcctgagagtcggccatctcgtgctcatcggcggacctgacgatggtgtcattacaccttggcagagctag

SEQ ID NO: 233999 - DNA, 165 bp, Artificial Sequence
  Description of Artificial Sequence: Synthetic coding sequence
tgacacgatgacctatacttgaatgcctcaagtttccttgccctgattaatggagagagagaccatcctaacgcaactgtatggcgaaagaacttcctccgggtcggccatttagtactgattggaggcccagatgatggcgtgattaccccctggcaatcttag

SEQ ID NO: 234000 - DNA, 711 bp, Artificial Sequence
  Description of Artificial Sequence: Synthetic coding sequence
atgctggggctgtggggacaacgcctgcctgccgcttgggtgcttctcctgttgccatttctcccattgctgctgcttgcagctcctgcccctcatagggagagttacaaacctgttatcgtggtacacggcttgttcgactccagctactccttcagacatctccttgagtacatcaatgaaacacaccccggaaccgtggttacagtgctggacttgttcgacggcagagagagtctgagacctctttgggagcaagtgcagggattccgggaggcagtcgtaccaattatggccaaggcccctcagggtgtacacctcatctgctattcccagggagggcttgtgtgcagggctctgctcagcgtaatggacgaccacaatgttgattcctttatttctctgagctccccacagatgggccagtacggcgacacagattacctgaagtggctcttccccacctccatgaggagtaatctctatcgcatttgttacagtccgtggggccaggagttttctatttgtaactattggcatgaccctcaccacgacgatttgtatctcaatgcctcctcgtttctggccctgataaatggtgaaagagatcaccctaacgcgactgtgtggcggaaaaactttctgagggttggccatctggtcctgattggtggacccgatgacggagtaataacaccttggcagtcttag

SEQ ID NO: 234001 - DNA, 909 bp, Artificial Sequence
  Description of Artificial Sequence: Synthetic coding sequence
atgcttgggctttgggggcaacggctcccagccgcatgggtgctcctgctcctcccgttcttgcccctcctgctgctagcggcaccggcaccacaccgcgctagttataagccggtgattgtagtgcacgggttgtttgattcgtcatacagcttccgccacctgctggaatacataaatgagactcaccccggaactgtagtgaccgtattggacttattcgacggacgagaaagccttcgcccactctgggaacaggtccagggctttcgcgaagccgtggttccaatcatggccaaagcccctcaaggagttcacctgatctgttactcacaaggcggactggtctgcagggcgcttctttcagtcatggacgaccataacgttgattcatttattagcttgagcagtccccagatgggccagtatggcgatactgactacttgaaatggttatttcccactagcatgcgtagtaacctgtatcgtatctgctactctccgtggggacaggagtttagcatatgcaattactggcatgatccacaccatgacgacctgtacttgaacgccagctccttcttagccctgatcaatggggaacgggaccatccaaatgccacagtgtggcggaagaattttctgagggttggccacttggtcctgatcggcggtcccgacgatggcgtgattaccccttggcagtcctcctttttcgggttttatgacgcaaatgaaaccgtgctcgagatggaagaacagctagtgtatttgagagacagcttcgggctcaaaactctgttggcaaggggagctatcgtgcgctgtccaatggcgggtatctcacacactgcatggcactctaataggacgctgtacgaaacatgcatcgagccctggttgtcttag

SEQ ID NO: 234002 - DNA, 909 bp, Artificial Sequence
  Description of Artificial Sequence: Synthetic coding sequence
atgctgggcctttggggtcaacgactccctgccgcttgggtcttactgcttcttcccttcttgcctctcctgctgctggccgcacctgccccacacagagccagctacaagcctgtaatagtggtacacgggctattcgattcttcgtactccttccggcatcttctggagtatatcaatgaaacgcaccctggcacagtcgtcactgtgctcgacctcttcgacggtcgggaatccctgcggcctctatgggagcaggtgcagggtttcagagaagccgtcgtgccaatcatggcgaaagctccgcaaggcgtgcacctcatttgctactcccagggtggcctggtctgtcgagctttgctcagcgtgatggatgatcacaatgtcgacagcttcatatcactgagcagcccacaaatgggtcagtacggagatacagattatcttaagtggctatttcctacctctatgcgctcaaatttgtacagaatctgctatagcccatggggtcaggagttttccatttgcaattattggcacgatccacatcatgacgatctgtatttgaatgctagttcctttttagcacttatcaacggagaacgagaccaccccaatgccactgtatggcgaaagaatttcctcagggtcgggcacctggtacttattggaggcccagatgatggcgtgatcaccccatggcagtcgtcattctttgggttttacgatgccaatgaaaccgtgctagagatggaagaacagctagtctacctcagagattcttttggacttaagacgctgttggcccgtggggctattgtgcggtgtccgatggccggaatttcccacacggcctggcatagtaaccgtactctgtatgaaacgtgtatcgaaccgtggttatcctag

SEQ ID NO: 234003 - DNA, 909 bp, Artificial Sequence
  Description of Artificial Sequence: Synthetic coding sequence
atgctcggtctttggggacagagactgccagcagcatgggttttgctcctgctacccttcctacctctgttgctactggctgccccagctccccatcgggcatcttacaagcctgtaatagtcgtgcacggacttttcgactcttcatattcattccgccacctactagagtacatcaacgagacacaccccggaaccgttgtgacggtccttgatcttttcgacgggagggaatcgctgaggccactgtgggagcaagtccagggctttagagaggctgtagtccctattatggctaaggcccctcagggagttcacctcatctgttacagtcagggcggtttggtgtgcagagccttgctgagtgtgatggatgaccataacgtggattcttttatatccctatcttcgccacaaatgggccagtacggtgatacagattacctgaaatggctgttccccacctcgatgaggtccaacctgtaccgtatctgctacagtccttgggggcaggagttcagtatctgtaactactggcatgatcctcaccacgacgatttgtacctcaacgcgagttcttttttggcgctgatcaacggggagcgcgaccatcctaacgccaccgtgtggcgaaaaaactttttgagagtggggcatctggtcttaatcggtggccctgacgatggcgtgatcacgccctggcagagctctttctttggattttacgacgcaaacgagactgtgttagagatggaggagcagctggtttacttaagagatagtttcggattgaagacacttttggccaggggcgctatcgtgcggtgccctatggctggaatctcccacacagcctggcattctaataggactctgtacgaaacttgcattgagccctggcttagctag

SEQ ID NO: 234004 - DNA, 441 bp, Artificial Sequence
  Description of Artificial Sequence: Synthetic coding sequence
atggatgaccacaatgtggactcattcattagtctctcatcgccccagatgggacagtacggtgatactgactacctgaaatggctttttccaactagtatgaggagtaacctgtaccggatatgctacagtccctggggccaagaattttctatctgtaattactggcatgatccccaccacgatgatttatatttgaacgcatcttcatttctggcactcataaacggagaacgggaccaccctaatgcgacagtctggagaaaaaattttctaagggtgggccacctggttctgatcggcggacctgatgatggcgtcattactccttggcagagctcattcttcggcttctacgacgctaacgagaccgtgctggaaatggaggagcaactccctgtaggatcctccgttaaggccaatcacggcgtgcagggttag

SEQ ID NO: 234005 - DNA, 927 bp, Artificial Sequence
  Description of Artificial Sequence: Synthetic coding sequence
atgaaatcatgtggatctatgcttggcctgtggggacagaggctccctgctgcttgggtcctcctcctgctcccattcctcccactcctcttgctcgcggctcccgcaccacaccgggctagctacaaaccggtgattgtggttcacggcctgttcgatagttcttatagctttagacacctactcgagtacatcaacgaaacccaccccggtacggtcgttaccgtcctggatctgtttgacggccgtgagagtctccggcctctttgggagcaagtgcagggtttcagagaggccgtcgtgccaatcatggccaaagctccacaaggcgtgcacctgatctgttattcacagggcggactggtttgtcgggcacttctcagcgttatggatgaccacaatgttgacagctttatttcgctgtcctcccctcagatgggacaatacggggatactgactatctgaagtggctgtttccaacgagtatgaggtctaacttataccggatctgttacagcccctgggggcaggaattcagcatttgcaattattggcacgacccccatcatgatgacctctatcttaatgcttcctcattcttggcgctgataaatggcgaaagagatcaccctaatgcaaccgtgtggcgaaagaactttctgcgcgtgggccatctcgtgttaatcggagggcctgacgatggcgttatcaccccctggcagagcagctttttcggattttatgatgcgaacgaaacagtattggaaatggaggaacagcttgtgtatttgagagacagcttcggactgaagaccctcctcgcccgaggagcaattgtgaggtgcccaatggctggaatcagccatactgcttggcactccaaccgaactttatatgaaacctgtatcgagccttggctatcttag

SEQ ID NO: 234006 - DNA, 882 bp, Artificial Sequence
  Description of Artificial Sequence: Synthetic coding sequence
atgggatccagggctgagctatgtacccttttgggtggtttcagctttctgctcctgttgattccaggcgaaggtgcgaagggcggttctctgcgcgaaagccagggcgtgtgctctaaacaaaccctagttgtccccctccactacaacgagtcttactcccagccagtctacaaaccatacctaacgctttgtgccggtaggaggatctgtagcacctacaggactatgtatcgcgttatgtggcgggaagttcgacgtgaggtccagcagactcacgctgtgtgctgtcaggggtggaagaaacgacacccgggagccctgacctgcgaggcaatctgcgctaaaccatgtctcaacggaggtgtgtgcgtaagaccagaccagtgtgaatgcgctccaggctgggggggtaaacactgtcatgttgacgtagacgaatgcaggaccagtataactttatgcagccatcactgcttcaacacagcgggttcttttacatgcgggtgtccgcatgacttggttcttggggtggacggccgtacctgcatggagggatcccccgagccccctactagcgcaagtatcctctctgtggcagtgagagaagcggagaaggatgagcgggcactgaaacaagagattcacgaactacgtgggagactggagcggttggagcagtgggcgggtcaagctggcgcttgggtacgagcggtcctgcctgtgcctccagaagagctgcagcctgaacaggtcgctgaactctggggtcgcggagaccgaattgaatctctgtcagaccaggtgctgctcctcgaggaacgcctaggtgcttgctcctgcgaggataatagcctcgggctgggtgtcaatcataggtag

SEQ ID NO: 234007 - DNA, 906 bp, Artificial Sequence
  Description of Artificial Sequence: Synthetic coding sequence
atgctcggtttgtggggtcagaggctcccagctgcttgggtcctacttctcctgccttttctgcccctcttacttttggcggctcccgctcctcacagagcttcgtataaacccgtgatagtggtgcacggccttttcgatagtagttacagctttcgtcatctcctggagtatatcaacgaaacccaccctggcaccgtggtgactgtgctggacctatttgacggacgcgaatctttgcgacccctgtgggagcaggttcagggcttccgcgaagcagtcgttcctatcatggcaaaagcccctcagggggttcacctgatttgctatagtcagggcggtctcgtctgtagggcgctgcttagtgtcatggacgaccataatgtggattcctttataagcctaagttccccgcagatggggcagtacggcgatacagattacctcaaatggcttttccctacctcgatgcgttcaaacttgtaccgcatctgctacagcccgtgggggcaggagttctccatctgtaactattggcacgatccccaccacgatgatctgtacctgaatgcctctagctttctggccctgatcaacggggagagggaccatcctaacgccactgtgtggcgcaaaaattttttaagggtaggccatttagtcttaattgggggaccagatgatggagtcatcactccgtggcagagtagcttttttggtttctatgacgctaatgagaccgtacttgaaatggaagagcagctgcctgctaggcccacgcaccagagcgaactccttctactgcgtctcgtgtgcctaaaacccccacgccgtaaaaaaccagcatgcagagttcagagacagtccgaaagttgggggccaggattaagttgcgccctgagctag

SEQ ID NO: 234008 - DNA, 909 bp, Artificial Sequence
  Description of Artificial Sequence: Synthetic coding sequence
atgctgggactctggggacagcgacttccagcggcttgggtgctacttctgctccccttccttccactgctgttgttggcggctcctgccccacaccgtgagtcctacaagcctgtgatcgtggtacatggtcttttcgattcctcctactcttttcgacatcttctggaatacatcaacgagacccaccctgggacagtggtgactgtgctcgatctcttcgacggtcgggagagcctgcggcctctgtgggaacaggtccagggcttccgtgaggcggtggttcctatcatggccaaggccccacagggcgtgcatctaatttgctacagccaagggggactagtctgtcgcgctctcctcagcgtgatggatgaccacaacgtggactcctttattagcttgtctagccctcagatggggcaatacggcgatacagactatcttaaatggctttttcccacaagcatgaggagtaacctatacaggatctgttattccccctggggccaggagtttagtatttgtaactattggcacgatcctcaccacgacgacctctaccttaacgccagtagctttcttgctctgatcaacggagaaagagaccaccccaacgccacggtctggaggaaaaactttctcagagttggacacttggtccttattgggggtcctgacgacggggtaatcaccccctggcagagctcgttctttggattttatgacgcaaacgagaccgtcctcgagatggaagagcagctcgtttacctcagggactcttttggcctgaagacacttctggccaggggcgctatcgtgcgatgcccaatggcgggaattagccacacagcttggcactctaatagaacgctgtacgagacatgcattgagccgtggctatcatag

SEQ ID NO: 234009 - DNA, 441 bp, Artificial Sequence
  Description of Artificial Sequence: Synthetic coding sequence
atggacgatcacaacgtcgattctttcatctcgctgtccagtccccagatggggcagtatggcgacaccgactacctgaagtggctgtttcccacctccatgcgctccaatctctataggatctgctactcaccttggggccaggaattttccatttgcaattactggcacgatcctcaccatgatgacctgtacctaaacgcctcatctttcctggccctaattaacggtgaaagggatcatcctaatgcaacagtgtggaggaaaaactttctgagggtcggccacctggtgctgataggtggaccggatgatggggtcattaccccatggcagtcatccttcttcggcttctatgatgcgaatgaaactgtcctcgaaatggaagagcaattacctgtaggcagctccgtgaaagccaatcatggggtgcagggatag

SEQ ID NO: 234010 - DNA, 882 bp, Artificial Sequence
  Description of Artificial Sequence: Synthetic coding sequence
atggggtccagagcagagctttgcacattgctgggcggttttagtttcctgttgctgctcattcctggagaaggcgcaaaaggtggcagcctgagggaaagtcaaggggtctgttccaagcagaccctcgtggtgccactccactacaacgagtcctactcccaacccgtgtataagccttacctgaccctgtgcgccggaagaaggatctgcagcacatatcgaacgatgtatagggtgatgtggagggaagtgaggagagaggttcaacagacacatgcagtctgctgtcagggctggaaaaagcggcaccccggtgctctgacctgcgaggcgatctgtgccaagccatgtcttaacggaggggtttgtgttcgccctgatcagtgtgagtgtgctcccggatggggtggcaagcactgccatgttgatgtggacgaatgcagaacaagcataactctgtgttctcaccattgtttcaacacagcgggatcattcacctgtgggtgtccccacgatcttgtgctaggtgtagatggacgaacttgtatggaaggcagtcctgagcccccaacttcagcttccattctgagcgttgcagtgcgggaggccgaaaaggacgagcgcgctttaaagcaagagattcacgaattacgtggcaggctggagcggcttgagcaatgggcaggtcaggctggcgcttgggtcagggctgtcctgccggtgccccctgaagagctgcagccagaacaggtggccgagctgtggggccgtggagatcggatcgaaagcctgtccgatcaggtgctgctcttggaggaaaggctgggggcttgttcatgcgaggacaactctctcggtttgggtgtaaatcaccgatag

SEQ ID NO: 234011 - DNA, 906 bp, Artificial Sequence
  Description of Artificial Sequence: Synthetic coding sequence
atgttgggtttgtggggacaaagactgccggctgcctgggttctgctgctgctaccctttttaccactgctcctgctggcggctcccgctccgcaccgggcatcttacaagcctgtgatcgtcgtgcacgggctgtttgacagcagctatagctttcgccacctcctggagtatatcaacgaaacgcatcccggtacggtggtcacagtgctggatctgttcgatggccgagagtcattacggccactctgggaacaggtgcagggcttccgagaggccgtcgtccccattatggctaaggccccacagggtgtgcacttgatctgctatagtcaagggggactcgtctgccgcgctctgctaagcgtgatggacgaccataatgtggactcttttataagcctttcatctcctcagatgggtcagtacggcgatacagattacctgaagtggctgtttcccaccagtatgcggtcaaacttgtaccggatttgctactctccttggggtcaagaattctcaatctgcaactactggcatgatccacaccacgatgatctgtatttgaacgccagctcgttcttggccctgatcaatggagaacgggatcaccctaatgccaccgtatggcgcaagaacttcttaagagtcgggcatcttgtgctgatcgggggaccagatgatggggtcattacaccgtggcaatcttcttttttcggcttttatgatgctaacgagacagtgctggaaatggaagagcagctccccgctagacccacccaccagtctgagttattacttctgcgcctagtgtgcctgaaacctccgaggagaaaaaaacctgcttgtagggtgcaacgccagagcgaaagctgggggcctggactgtcctgcgccttgagctag

SEQ ID NO: 234012 - DNA, 441 bp, Artificial Sequence
  Description of Artificial Sequence: Synthetic coding sequence
atggacgatcataacgtcgattccttcatatctctttcttccccgcagatgggacagtatggagataccgactaccttaagtggctgtttccaaccagcatgcgaagcaatctgtacagaatatgctactcgccgtggggacaggaattcagcatatgtaactattggcatgacccacaccatgatgacctttatctgaacgcctcgtccttcctcgccctcatcaatggggaaagagaccaccctaatgccaccgtttggcgaaaaaatttcctgcgggtgggacatctcgttcttatagggggaccagatgacggggtgatcaccccgtggcaaagcagttttttcggcttttacgatgcaaacgaaactgtcttagagatggaagaacagttgcccgttggctctagcgtcaaagccaatcacggcgtgcaggggtag

SEQ ID NO: 234013 - DNA, 906 bp, Artificial Sequence
  Description of Artificial Sequence: Synthetic coding sequence
atgttggggctgtggggccagcgcttaccagcagcctgggttctccttctgttaccattcctgccactgttgctgctggctgctcctgcccctcaccgcgcaagctataaaccagttattgtggtgcatggtctgttcgacagttcctacagcttccgccacttgttggagtacattaacgagacccaccccggtactgttgtgaccgtgctcgacctgttcgacggacgagaatccttacgcccactgtgggagcaggtacagggatttcgtgaagccgtagtgcccatcatggcaaaagcgccacagggggttcacctgatctgctactctcagggtgggctcgtgtgcagggcacttctcagcgtgatggacgaccacaacgtggactcttttatctccttgagctcgccgcagatgggtcagtatggtgacacagactatcttaaatggctattccccactagcatgagatccaatctctaccgcatttgctactctccctggggccaagagttttccatttgcaattattggcacgacccgcaccatgatgatctctacctgaatgcgagcagtttcctggctttaataaacggcgaaagggaccaccccaatgccaccgtctggcgaaaaaacttcctgagagtgggccacctggttctgatcgggggtccggacgacggggtaattacaccctggcaaagctctttcttcggcttttatgatgctaatgagactgttctggaaatggaggaacaattgcccgcacgacctacgcatcaatcagagctgctccttctgaggctggtgtgcctgaagcccccaaggagaaaaaaacccgcttgtcgcgtacagcggcagagcgaatcttggggccctggcctgtcctgcgcgttgtcttag

SEQ ID NO: 234014 - DNA, 441 bp, Artificial Sequence
  Description of Artificial Sequence: Synthetic coding sequence
atggatgaccacaatgtagacagttttataagtctgtcctctccacagatgggccagtacggagataccgattacctcaagtggttattccccactagcatgcgatccaatctctacagaatttgttatagcccatggggccaagagttctccatttgcaattactggcacgacccccaccacgatgacttgtacttaaacgcctcctcctttcttgctctcattaatggggaacgcgaccaccctaacgcaacggtctggagaaagaattttctgagagtcggacaccttgtactgataggtggtccagatgatggtgtgattactccatggcagtcaagcttctttggcttttacgatgccaacgagaccgtactggagatggaagagcagctgccagtcggcagctcggtcaaggctaatcacggcgttcaaggttag

SEQ ID NO: 234015 - DNA, 882 bp, Artificial Sequence
  Description of Artificial Sequence: Synthetic coding sequence
atgggctcccgagctgaactttgtacattgttgggaggattctcctttctgttgttgttgatccccggtgagggggcaaagggcggatctctgcgggagagccagggggtgtgctcaaaacaaaccttggtcgtgccattgcattataatgagtcttacagccagccagtgtacaagccttatttgacgctatgtgcaggtcgccgtatctgcagcacgtatcggacgatgtatagagtgatgtggcgagaagttagaagagaagttcagcagacccacgccgtctgctgccagggctggaagaagaggcatccaggagccctgacctgtgaggccatatgcgcaaaaccttgtctgaatggaggcgtttgcgtcagacccgatcagtgcgaatgtgcacctggttggggcggaaagcactgtcacgtggacgtggatgaatgtcgcacaagcataactctgtgctcacatcactgcttcaacacagctggcagttttacatgcggctgcccccacgacctagtgctgggggttgacggccgtacttgcatggaaggaagccccgagccgcctacaagcgcctcaatacttagcgtggctgtgcgggaggctgagaaagatgaacgcgctctgaaacaagagattcacgaactgaggggtaggttggaacggctcgaacagtgggccggacaagctggggcatgggtgcgcgctgtgttgcctgtgcctccggaggaactccagccggagcaggtagctgagctgtggggcaggggggacagaattgaatcactcagcgatcaagtgctcctgcttgaagaaaggttgggcgcttgctcatgcgaagacaattcccttgggctgggtgtgaatcatagatag

SEQ ID NO: 234016 - DNA, 882 bp, Artificial Sequence
  Description of Artificial Sequence: Synthetic coding sequence
atgggatccagggccgagttgtgcactttactgggaggattttcatttctgctgctcttgatccccggtgagggagctaaagggggttctctccgggagtctcagggtgtgtgttccaaacagacccttgtcgttccgctgcactacaatgaatcatatagtcagcccgtgtataaaccctatttgacactgtgcgccggtaggcgcatttgtagcacttacaggaccatgtatagagttatgtggcgcgaggtgcgccgtgaggtccaacagacacacgccgtgtgttgtcagggatggaaaaagagacacccaggagcactcacatgtgaagccatatgcgccaagccgtgtctcaacggcggtgtgtgtgtgaggcctgaccagtgcgagtgtgccccaggctgggggggtaaacactgtcacgtggatgtggatgaatgtaggacgagcatcaccctgtgttctcaccactgtttcaacactgctggaagtttcacctgcgggtgcccccatgatctggtgctgggcgtggacggacggacatgcatggaaggctctcccgaaccgccaacaagcgcctcaatcctgtcagtggctgtgcgggaggccgaaaaagacgagagggctttgaagcaagagatacacgagttgagggggcgtctagagcgccttgaacagtgggcaggccaggcgggtgcttgggtgagggccgtgctcccagtccctcccgaggaacttcaacccgaacaggtggccgagctgtgggggagaggagatcggatagagtcactgtccgaccaggtgctactgcttgaggagcggttgggtgcgtgctcatgcgaggataactccctcggcctgggtgtcaatcataggtag

SEQ ID NO: 234017 - DNA, 909 bp, Artificial Sequence
  Description of Artificial Sequence: Synthetic coding sequence
atgctcggtctttgggggcaaaggctccctgctgcctgggttttattgctgcttccattccttccgctgctgttgctcgccgctcccgcaccacatcgagcgagctataagcccgtgattgtcgtgcacggactgttcgattcaagttacagctttcgtcacctgctcgagtacatcaacgagacccacccaggcaccgtcgtcacagtgctggacctcttcgacggtcgcgagagcctgcgacctctctgggagcaagtgcaggggtttcgcgaggctgtggtgcccatcatggccaaggccccacaaggagtgcatctcatttgctacagccagggtggactggtgtgtcgcgctttgttatccgtgatggatgatcacaacgtagattcatttatctctctgtccagtccccagatgggacagtacggagataccgactatctgaagtggttgtttcccacttctatgagaagtaatctgtaccggatttgctactccccctggggacaggaattcagcatctgcaattactggcatgacccacaccacgatgatctctaccttaatgccagtagctttctggccctcattaatggcgagagggatcacccaaacgccacggtgtggcggaaaaacttcttaagagtgggacacctggtgttaattgggggacctgacgacggggtgatcacaccatggcagtcatcattcttcggattttacgacgccaacgaaacggttctggagatggaagagcagcttgtatacctgcgcgatagcttcggacttaagactctgctggcccgaggagcaatagtacggtgcccaatggctggcatatcacacacagcatggcatagcaaccgcacattgtacgagacctgcattgaaccctggctgtcatag

SEQ ID NO: 234018 - DNA, 441 bp, Artificial Sequence
  Description of Artificial Sequence: Synthetic coding sequence
atggatgaccataatgtggacagttttatctcattgagtagccctcaaatggggcaatacggggacaccgactatcttaaatggctcttcccaaccagcatgcggtcgaacctataccgcatttgctatagcccatgggggcaagaattttccatctgtaattactggcacgacccacaccatgacgacctttacttgaacgcctccagcttcctcgctctgattaacggggaaagggaccatcctaacgcaactgtgtggcgtaagaatttcctgcgagtgggccatttggtgctgattggtggcccagacgacggcgtgatcacaccttggcaatcaagcttttttggattctacgatgctaacgaaacggtactagaaatggaagaacaacttcccgtcggctcaagcgtgaaagcgaaccacggggtccagggctag

SEQ ID NO: 234019 - DNA, 909 bp, Artificial Sequence
  Description of Artificial Sequence: Synthetic coding sequence
atgctgggtctctggggccaaagattacctgccgcatgggtgctcctgctcttgcctttcctacccctgctgctgttagcggctccagcaccacaccgtgcttcctacaaaccagtcatcgtcgtgcatggtctcttcgattccagttacagttttagacatctgctcgaatatatcaatgagacacatccaggcactgtggtgactgtattagacctttttgatgggagagaatcgctgaggcccctgtgggagcaggtgcagggcttccgcgaagcagttgtccccattatggccaaagccccacagggggtccatttgatatgctactcccagggcggattggtatgtcgcgcacttctcagtgtgatggacgatcataacgtcgactcttttatttcattatcgtcaccccagatgggccagtacggcgatactgattacctgaagtggctgtttcccaccagtatgcgctctaacctgtatcgaatctgttacagtccgtggggccaggagttctcaatctgtaactattggcatgaccctcaccatgacgacctttacttgaacgccagctctttcttggcactgatcaatggtgagcgagaccaccctaatgccactgtctggagaaagaacttccttcgcgtgggacacctggtgcttatcgggggacccgacgacggagttatcacaccatggcagagcagctttttcggattctacgatgcaaacgagactgtgctggagatggaggaacagctggtgtatctgcgggactctttcggactcaagacactgcttgcgagaggcgcaattgttaggtgtccaatggctggtatcagccacactgcctggcactctaacagaaccctgtacgagacctgtattgagccatggctctcatag

SEQ ID NO: 234020 - DNA, 441 bp, Artificial Sequence
  Description of Artificial Sequence: Synthetic coding sequence
atggacgaccacaacgtcgattctttcattagtttatcctcaccccagatgggacagtatggtgacacagactacctcaaatggttattccctacaagcatgcgcagcaacctgtaccgcatctgctacagtccatgggggcaggagttcagtatctgcaattactggcacgatcctcatcacgatgacctttacctcaatgcatcctctttccttgctctgatcaatggcgagagggatcaccccaatgctaccgtgtggcggaagaacttccttcgcgtaggtcacttagtgctcataggcggaccagatgatggcgtgatcacaccctggcagagcagtttcttcggtttttatgacgccaatgagactgtgcttgaaatggaggagcaactgccagttggttccagcgtcaaggcgaaccatggtgtgcaggggtag

SEQ ID NO: 234021 - DNA, 906 bp, Artificial Sequence
  Description of Artificial Sequence: Synthetic coding sequence
atgctgggattgtggggacagagactccccgcagcctgggtgctgctacttctgccattcttacccttattgcttctggcagcgccagcaccccaccgagcttcatataaacccgttatcgtcgtgcacggtctgttcgacagtagttactccttccgccatctactcgagtacattaacgaaacacacccgggaacggttgttactgttctagatctcttcgatgggagagaaagcctgaggcccctgtgggagcaagtccaagggtttagggaggcagtggtgcccataatggcaaaagccccacaaggggtacatcttatctgctactcgcaggggggactggtgtgccgagctctcctgtcagtcatggatgatcacaatgtggactcgttcatatccttatcttctccccagatgggccagtatggggacacagactacctgaaatggcttttcccaacttcgatgagaagtaacctatacaggatttgttattctccttggggacaagagttcagcatttgcaactattggcacgaccctcaccacgacgatctgtatctgaatgctagctcattcttagcactaatcaacggggagagggaccatcccaatgcaactgtgtggagaaagaacttcctgagagtggggcacttggtgctgattgggggaccggacgacggggttatcacgccatggcaatcctcttttttcgggttctatgatgcaaatgaaaccgtactcgaaatggaggaacagctgcccgcaagacccactcaccaatcagaactgttactgctcaggttagtgtgtctgaaaccacctcggaggaaaaaacctgcttgtagagtccagagacaatcagaatcttgggggccagggttgagttgcgccctgtcttag

SEQ ID NO: 234022 - DNA, 906 bp, Artificial Sequence
  Description of Artificial Sequence: Synthetic coding sequence
atgctgggtttgtggggccaaagattgcccgcagcgtgggtgttgctgctgctgcccttcctccccctgttacttctggccgcacccgcacctcaccgagagtcgtataagcccgttatagtggtccacggactgtttgacagttcctactctttccgacacctgctggagtatatcaacgagacacaccccggaaccgtggttacggtcctggacctcttcgatggaagagaaagcctgcgcccattatgggaacaggtgcaggggtttcgggaggccgtagtcccaattatggccaaggctccgcagggtgtccacttgatctgctattctcagggcggactggtgtgccgtgcactgttatcagtgatggacgaccataacgtcgactcctttattagcttgtcttcaccacagatggggcagtacggcgacacagactacctgaaatggctgttccccaccagcatgcggtctaacctgtatagaatctgctattcaccttgggggcaggaattttccatttgcaactattggcacgacccacatcacgatgatttgtacctgaacgcctcgtcattcttggctctcataaatggcgagcgagatcacccgaacgcgacagtgtggcgtaagaatttcctgcgtgtgggccacttagtgttgattggtggcccagacgatggtgtgattacaccttggcaaagttccttctttggcttctacgatgctaatgaaacagtgctggaaatggaagaacaactgcccgctaggccgacccaccaatccgagcttctgctgctcaggctggtgtgtttgaaaccgccacgcaggaaaaagcctgcttgtcgcgtgcagaggcagtccgaatcttggggacccggactgagctgcgctctgtcttag

SEQ ID NO: 234023 - DNA, 906 bp, Artificial Sequence
  Description of Artificial Sequence: Synthetic coding sequence
atgttaggcttgtggggacaacgtctcccagccgcttgggtattgctactcttgccttttcttccgctgctccttctggccgctcccgctccacatagagcaagttacaagccagtgatcgtggtgcacggactgtttgatagttcctactcctttcgccacctgctggaatatattaatgagacccaccctggcacagttgtgacagtgctggatctctttgacgggcgtgaatcgttaaggcccttatgggagcaggtgcagggcttccgagaagccgtcgtgccgatcatggctaaggcccctcaaggggtacacctcatctgctatagtcaggggggactggtctgcagagctttgttatccgttatggacgaccacaatgtggactcttttatctccctttcgagtcctcagatgggccagtacggcgatacagactacctcaagtggctgtttcccacaagcatgagaagcaatctgtatcgcatctgctactccccatggggccaggaattcagcatctgtaactattggcacgacccccaccacgatgacctctacctgaacgccagtagctttctggcgctgataaatggcgagcgtgaccacccaaatgcgactgtctggagaaagaacttccttagagtgggacacctggtgctgatcggcggacctgatgacggggttattacgccctggcaatcctctttttttggtttctacgatgccaatgaaacggtcctggagatggaggagcagctgccagccaggcctactcaccaatccgaactcttgctgctgcgattggtgtgtctcaagccccctagacgcaaaaagcctgcatgtcgtgtgcagcgtcaatctgagtcctggggtcctggcctctcctgcgcattgtcctag

SEQ ID NO: 234024 - DNA, 909 bp, Artificial Sequence
  Description of Artificial Sequence: Synthetic coding sequence
atgttgggactgtgggggcagcggctcccagccgcttgggtgcttctcttactgccgttcctccctttactgctgcttgccgcaccagcccctcatcgggctagttacaagcctgtcatagtcgtacacggtctgtttgatagctcctactccttccgccacctcctggagtatatcaacgaaactcaccctggtactgtggtgaccgttcttgatctgttcgacggccgagagtcattgcgccctctgtgggaacaagtccaggggttcagggaggccgtggtgcctatcatggcaaaggccccacagggagttcacttgatttgttatagccaaggcggtcttgtatgccgagcactcctgtccgtgatggatgaccataatgttgattcattcatctctctaagtagtccacagatgggacagtatggtgacacagactatcttaagtggctcttccccacatccatgcgctcaaacctgtatcgaatttgttattctccatggggacaggagttcagcatttgcaactactggcacgaccctcaccatgacgacttgtatctgaacgccagcagtttcctcgccttaatcaatggtgaacgcgatcacccgaatgcaacagtgtggaggaagaattttctgcgggtggggcatcttgttctgattggcggacccgatgatggggttattaccccgtggcaaagctctttcttcggattttacgacgcaaatgagaccgtgttggagatggaagagcagttagtttatcttagagattccttcggtcttaaaacactgctggccaggggtgccattgtccgctgcccaatggcgggtatctctcatacagcctggcactcgaaccggaccctatacgagacatgcatcgagccttggctaagctag

SEQ ID NO: 234025 - DNA, 3606 bp, Artificial Sequence
  Description of Artificial Sequence: Synthetic coding sequence
atgaatttcgaaggtttggatcccggactcgccgaatacgctcctgccatgcacagtgctctggacccggtgctagatgcccacctaaatcccagcctgctgcagaacgttgagctggatccagagggcgtggctctggaagccctaccggtgcaggaatctgtgcacataatggaaggagtgtactccgagcttcactctgtcgtggcagaagttggggtcccagtgtctgtgagccatttcgacctgcatgaagagatgctctgggtagggtctcatgggggacacgccacaagcttcttcggacccgcactggaacggtattcaagctttcaggtcaacgggtcggatgatattcgccagattcaaagcctagagaacggtattctgtttctgacaaaaaacaacctgaagtatatggctaggggcggacttattattttcgactatctgcttgatgagaacgaggacatgcattccctgctgctaacagacagctccacccttctcgtgggcggtctgcaaaaccatattatcgagattgacctgaacactgtacaggaaacacaaaagtatgcagtggagacacctggagtcaccatcatgagacagaccaaccggtttttcttttgtggccacacgagtggaaaagtaagtctgcgagaccttagaaccttcaaagttgaacatgagtttgacgctttttcgggttctctgtcagactttgatgtccatgggaacctcctggccgcttgtggcttctcctctcggctcaccggactagcttgtgacagatttctgaaggtttacgacttgaggatgatgcgggctatcacgccactccaggtacatgtggaccccgctttccttcgcttcatcccgacctatacttcgcgcctggctattatctcccaatcaggacagtgccagttttgcgagccaaccgggctagccaatccggctgacatatttcacgttaatcctgttggacctctactgatgactttcgatgtgtccgcctctaaacaggccctggcgttcggggacagcgaagggtgcgtgcacttgtggacggattcgccggagccttcattcaacccttattctcgcgaaactgaattcgctttgccctgcctggtggatagcctgccccctctcgattggtcccaggatctgctcccactgagtttaatcccagttccactcaccacagacacactcctttcggattggcctgctgccaactcggctccagccccacgtcgtgcccctcccgtcgatgcagagattttgagaacaatgaagaaggttgggttcatcggctatgcccctaacccacgtactcggctgagaaatcagattccttaccgccttaaggaaagcgattctgaattcgacagcttcagccaggtcaccgagagtcctgttgggagggaagaggagccccacctgcatatggtcagcaaaaaataccgaaaggtgacgatcaagtactccaaactgggccttgaagattttgatttcaagcactataataagaccttattcgcaggtctcgaacctcatattcctaatgcctactgcaattgcatgattcaagttctttactttctggaacctgtgaggtgtcttatccagaaccacctttgccagaaggagttttgcctggcatgtgagttagggtttctttttcatatgctcgacctcagcagaggggatccgtgccagggtaataacttcttaagagcgtttagaaccattcccgaagcgtctgccctagggttgatcttggctgacagcgacgaggctagtgggaaggggaacctcgccagactgatccagagatggaaccgcttcatcctcacccagctgcaccaagatatgcaggagcttgagatcccacaggcctacagaggggcagggggttctttttgcagctcaggggattcggttattgggcagctgttcagctgcgagatggaaaattgcagcctgtgccggtgcggatcggaaacagtgagagcctccagcacactcctcttcacgctcagctatcctgatggatccaaatccgataaaactgggaagaactacgatttcgcgcaggtgcttaagagatcaatctgtttagaccaaaacacacaggcctggtgtgacacatgtgagaagtaccagccaactatccagactcgtaacatcaggcacttgccagacatcctggtgataaactgcgaggtgaattccagcaaggaggccgacttctggcggatgcaggcagaagtcgccttcaaaatggccgtgaagaagcacggcggagagatcagcaaaaacaaagagtttgccttggccgactggaaagaactggggtccccagagggtgtgctagtgtgtccttcaatcgaagagttgaaaaatgtgtggctgccattctctatccggatgaagatgaccaagaacaagggactcgatgtttgcaactggacagacggagatgagatgcaatgggggcctgccagggcagaagaggagcacggcgtgtacgtgtatgacttaatggctactgttgtgcacattctagacagccgcactggaggctcactggtggctcacataaaagtgggcgaaacctatcaccagcgtaaagagggagtgacgcatcagcaatggtacctttttaacgatttccttatcgagccaatcgataagcatgaagcagtccaattcgacatgaattggaaggtccctgcgatcctctattatgtgaaaaggaatctgaacagccgatataacctcaacattaagaatccaattgaggcatccgtgctcctagccgaggccagcctggccagaaaacagagaaagacacatacaacgttcatccctctcatgctgaacgaaatgcctcagattggcgaccttgtggggctggatgctgagttcgtcacacttaacgaagaagaggccgagttacgcagcgacgggacaaaaagcactataaagccatctcaaatgagcgtagctcggattacgtgcgttcgcggacaggggcctaatgagggaataccgtttatagacgattatattagcactcaggagcaagtcgtggattaccttactcaatactctggaatcaagcccggagatcttgatgcaaaaatctcctctaagcatctcaccactctgaaatctacataccttaagttacgttttctaatcgatatcggggtcaaattcgtgggacatggtctccagaaagacttccgcgtaatcaatctgatggttcctaaggaccaagttctggacacagtatatttattccacatgcccaggaagcgcatgatttccctgaggttcttggcctggtattttctggatctgaagatccagggtgaaacccacgatagcattgaggatgctagaacagccctccaactgtaccgcaaatacctcgagttaagcaagaacgggacggaacccgagtcttttcacaaggttcttaaggggttatacgagaagggaaggaaaatggactggaaagtcccagagccagagggccagacatcacctaagaacgcagcagtctttagttcagtgttggcgctttag

SEQ ID NO: 234026 - DNA, 3609 bp, Artificial Sequence
  Description of Artificial Sequence: Synthetic coding sequence
atgaacttcgaaggcttggacccgggactggccgaatacgcgccagcgatgcactctgctctggaccccgtgcttgacgctcatcttaacccaagcctcctgcaaaacgtggagcttgatcccgagggcgtggccctcgaggcactcccagtacaggagtccgtgcacatcatggaaggagtgtactccgagctgcattccgttgttgctgaagtgggtgttccagtgagcgtttcacattttgatctccatgaagaaatgctatgggtcggatcccatggaggccatgctacctctttctttggacccgcactcgaaaggtatagttcatttcaagtgaatggctcagatgacatcaggcagattcaaagtctggagaacgggattctgttcctcacaaagaacaacctgaagtatatggcaagagggggactaatcatctttgattacttactggacgaaaacgaagatatgcactcgctactgctgaccgactcttcaactctcttggtaggcggactgcaaaaccatattattgaaattgacctgaatacggttcaagagactcagaaatacgctgttgagacgcccggtgtcactataatgagacagaccaacagatttttcttctgcgggcacacttctggcaaagtgagcctccgcgacctgcgaaccttcaaagtcgagcatgagtttgacgcattttctggatccctgagcgacttcgacgttcacggaaatctgctagcagcatgtggcttttcatctcggttaacaggactggcatgtgaccggtttcttaaggtctacgacctccggatgatgcgcgctatcacaccacttcaggtacacgtggatccagccttccttaggttcatacccacatacaccagcagattagccattattagtcaaagtgggcagtgtcagttttgcgaacctactggcctagccaacccagccgacattttccatgtcaatcccgtgggtccactcctaatgacatttgatgtgtcagcttctaagcaagccctggcctttggcgacagcgaaggttgtgtgcatctgtggactgactcgcctgagccctcatttaatccatattctagggagactgagtttgccttaccatgtcttgtggatagcttgccccctttggattggagtcaggacctcctgccactatcactcattccagtgcccctaacaacagacacactgctgtccgattggccggctgccaatagtgcaccagctcctcgaagggcccctccagtggacgccgagatcctgcggaccatgaaaaaggttggcttcataggctacgcaccaaaccccagaacccggctgcgaaaccagatcccttatcggttgaaagaaagcgacagtgaattcgacagtttttctcaagtaacggagtcacctgtgggaagagaagaagaaccacacttacacatggtcagcaagaagtaccgcaaagttactattaaatactccaagttgggactcgaggacttcgattttaagcattacaacaagacattgttcgcgggattggaacctcacatccccaatgcttattgcaactgcatgatacaggtcctttacttcttggagcctgtgaggtgcttaatccagaaccacctctgccagaaggagttttgtctcgcatgcgaacttggctttctgttccacatgcttgatctaagcagaggggacccgtgtcagggcaataacttcctccgagcctttaggaccatcccggaagcatcagctcttggactgatcctggcagactccgatgaggcgtcgggcaaaggcaacctggcccgattaattcagaggtggaacagattcattctgacacagctacaccaggatatgcaggagcttgagatcccccaggcctatcggggagcgggtggaagttctttctgttcttccggcgattctgtgatagggcagttgttttcttgtgagatggaaaattgttctctctgcaggtgtggcagtgagactgtccgcgcttcctccaccctcctgtttactctgtcgtaccccgatggaagcaagtcggataagacgggcaagaactatgatttcgcgcaggtcttgaaaagatccatctgcctggaccagaatacacaagcgtggtgtgatacatgtgaaaaataccaacccacaatccaaacccgaaacatcaggcacctgcctgatatcctggtaatcaactgcgaggtgaactcatcaaaggaggccgatttctggcggatgcaggcagaagtagctttcaagatggccgtcaaaaaacatggaggggaaatctcaaaaaacaaagagttcgcactggcagattggaaagaattgggatcacctgaaggtgtgctggtgtgtccatctattgaagaactcaagaatgtgtggctgcccttttctattcgcatgaagatgaccaagaacaagggcctcgacgtgtgtaactggactgatggtgacgagatgcagtggggtcccgctagagctgaggaagaacacggcgtttacgtgtacgatttgatggccacagtggtccacatcctggattccaggaccggaggctctctggtcgcacatatcaaagtgggagaaacctaccaccagcgtaaggagggtgtgacccaccagcagtggtacctgttcaatgacttccttattgagcccatcgacaagcacgaggccgtacagttcgacatgaattggaaagtaccggcaatactctattatgtcaaaagaaatctgaactcacgctataatcttaatattaaaaatcccattgaggcctccgtcctgctggccgaggctagtttagccaggaagcagcgcaaaacacacacgactttcatacctttaatgctcaatgagatgccacagatcggggacctcgttggcctggacgctgaattcgtgaccctgaatgaagaggaagctgaactgcgctcagacggcaccaaatcgacaatcaagcccagccaaatgtctgtggcacgaatcacatgtgtgcgcggtcaggggccaaatgaaggcattcccttcattgatgactacataagcactcaagagcaagttgttgactatctgactcagtatagcggaatcaagcccggagacctggacgccaagattagctccaaacatcttacaacacttaaatccacgtatttgaaacttaggttcttaatagacattggcgtgaagtttgtgggccacggcctacagaaggactttcgcgtgatcaatctcatggtgccaaaagatcaagtgctggacacagtgtatctgttccacatgccaagaaagcggatgattagtctcagattcctggcctggtactttctcgacctgaagatccaaggcgagactcatgattcaattgaggatgccaggacagctctgcagctgtatagaaagtacctagagttgagcaaaaacggaaccgagcctgagtcgttccataaggtcctcaaagggctgtacgagaagggccgtaaaatggactggaaggtcccagagcctgaggggcagacttctcctaaaaacgctgccgttttcagcagcgtgctagcattgtag

SEQ ID NO: 234027 - DNA, 3597 bp, Artificial Sequence
  Description of Artificial Sequence: Synthetic coding sequence
atgaattttgaaggtctggaccctggactggcggaatatgcacctgcaatgcatagcgcgctggaccctgttctggatgcgcacctgaatccgtcattgctccagaatgtggagctcgatcctgagggagttgccctcgaggcactgccagtgcaggaatccgtgcacatcatggagggcgtgtatagcgaactgcacagtgtggtggcggaagtaggggtccctgtctccgtgagccacttcgacctgcacgaagaaatgctatgggtaggcagtcacgggggtcatgccacaagtttcttcggccctgccctggaacgctattccagctttcaggtgaatgggtcagacgatatccgccaaatccagtcccttgaaaatggcatactgtttctgaccaagaacaatctaaagtacatggccaggggagggcttatcatatttgattacctgcttgatgagaacgaggatatgcattctttactcctgactgacagttccaccctattggtggggggattacagaatcacataatcgagattgacctgaacacagtccaagaaactcaaaagtacgcagtggaaacacctggggtgactataatgcggcagactaaccgcttctttttctgtggacacactagcggcaaagtatccctgcgagacctcagaactttcaaagtagaacacgaatttgatgcgttttctgggagtctgtctgatttcgacgtgcacggtaatctattagcagcctgtggtttctcctcacgactgaccggcctcgcttgcgatcgtttcttgaaggtgtacgatctgcgtatgatgcgtgcaatcacgcccctgcaggttcacgtggatccagcctttctgcggttcatcccaacatataccagccggctggctattatctcccagtctgggcaatgccagttctgcgaacccacaggccttgccaatcctgccgatatctttcatgttaacccagtgggccctctgctcatgaccttcgatgtgagtgcaagtaaacaggctttggccttcggagactccgaaggatgcgtgcacctgtggactgattctccagagccatcatttaatccttactcgcgcgaaaccgagttcgcgctaccgtgtctggtcgacagtctgccacctctagattggtcccaggatctgctccccctttccctgattcctgttcccctgactactgacaccttgcttagcgattggcccgcagctaattctgcaccagcgcctcgcagagccccaccagtcgatgcggagatcttaaggacaatgaaaaaggtaggattcattggttacgctccaaaccctaggacaagactgaggaatcagattccctatcgcctgaaggagagcgatagcgagtttgactcttttagccaggtaacagaaagtccagtgggtcgggaagaagagcctcatctccacatggtgtctaagaaatacagaaaagttaccataaagtactctaagctcggtttggaggacttcgattttaaacactataataaaaccctatttgccggtctggagcctcacatccccaacgcttattgtaactgtatgatacaggtgctttactttttggagcccgtgcgttgcttgatccagaaccatctctgccaaaaagaattttgcctggcttgtgaactcggtttcctgtttcacatgctcgatctgtcaagaggggacccttgtcaaggaaacaattttctgcgcgctttccgcaccataccagaggcatcagctctgggcctgatattggcagactcggacgaggctagtggtaaagggaatctggccagactcattcagcgctggaaccggttcatactgacccagctccaccaggacatgcaggaacttgaaattccgcaagcataccggggagctggaggctcctctttttgctccagcggggacagtgtgatcgggcagttgttcagttgtgaaatggagaattgttcattgtgtcggtgcggaagcgaaacggtgagagcatcttcaacgctgttgttcacattatcctacccagacgacaaaacaggtaaaaattacgacttcgcgcaggtacttaagcggagcatatgtttagaccagaatactcaggcctggtgcgacacatgcgaaaaataccaaccaaccatccaaactcggaacatcagacatcttccagatatcctggttatcaactgtgaggtgaacagttcaaaggaggctgacttttggaggatgcaggctgaggtggcgttcaagatggcagttaagaagcatggaggagagatttctaaaaacaaggagttcgcgttggcagattggaaagaacttggctcgccggagggagtgctcgtctgcccatctatcgaggagctcaaaaatgtatggctgccctttagtattaggatgaaaatgaccaagaacaaaggtctcgatgtctgcaattggactgacggcgacgaaatgcagtggggccctgcacgggctgaagaagaacatggagtgtatgtctacgatctcatggccacggtggtgcacatactagattcacgcacgggcggatctttggtggcacacattaaggtgggggagacctatcaccagaggaaggaaggagttacccaccagcaatggtacctgttcaacgactttctgattgaacccatcgacaaacatgaggcagtgcagtttgacatgaactggaaagttccggctatcttatactacgtgaagagaaatctgaatagccgttacaacttgaatattaagaacccaattgaagccagcgtgttgctggctgaggcttcgctggccagaaagcagcgtaaaacacacaccaccttcataccattgatgctcaatgagatgccacagatcggcgatctggtgggcctggatgcggaatttgtgaccctgaatgaggaagaggctgagctgagaagcgatggaactaaatccactattaagccaagtcaaatgtcagttgcacggatcacttgtgtgaggggacagggacctaatgaggggatacccttcatcgatgattacatatcgactcaggaacaagtggttgactacctgacacagtacagtggaatcaagcccggagacctcgatgccaagatcagctcaaagcacctcacaactctcaaaagtacttaccttaagctgcgctttctaatcgatattggcgttaagttcgtcggccacgggctgcaaaaagatttcagagtgattaacctgatggtgccgaaagaccaggtgctcgatactgtttacctattccatatgccccgaaagcgcatgatctctcttcggtttttagcgtggtacttcttggatttaaaaatacagggagagacgcatgatagtatcgaggacgccagaaccgctttacagctctaccgcaagtatctagaactttcaaaaaatggcacagagcccgagtcgtttcacaaagtcctcaagggactctatgaaaaaggcagaaagatggattggaaggtgccagaaccagaaggccaaacgtcacccaaaaacgccgctgtattctcatcggtgctcgccttgtag

SEQ ID NO: 234028 - DNA, 3609 bp, Artificial Sequence
  Description of Artificial Sequence: Synthetic coding sequence
atgaattttgagggactggaccccggtctggccgagtatgcccctgctatgcactcggctctggatccggtgctagacgcccatctgaatccctcacttttgcagaatgtggagttagaccctgagggggtcgctctggaagctttacccgtccaggaaagtgtgcacatcatggagggagtatactccgagctgcactccgtggtggccgaggttggagtgcctgtatctgtttcacattttgacctgcacgaagaaatgctctgggtcggatcgcacggaggccacgctacgtccttcttcggtccagcgctcgaacggtattcctcctttcaggtgaacgggtccgatgacattaggcaaattcagtctttggagaatggcatcctctttctgaccaaaaacaacctgaagtacatggccagaggcggtcttattatttttgactaccttctggacgagaatgaagacatgcactcacttctgctgactgattccagtacgctcctggtgggcggactgcagaaccatatcatagagatcgacctcaacacagtgcaggagacacagaagtacgccgtcgaaacccctggcgtgacaatcatgcgtcaaacaaaccggttctttttttgcgggcacaccagcggcaaagtgagtctccgggacctcaggactttcaaggtggagcacgagtttgacgccttcagcggaagtctaagtgactttgacgtgcacggtaacctacttgcagcctgtggattttcttctaggctgaccggcctagcatgtgaccggttcctgaaggtgtatgacctgagaatgatgcgcgctatcactcctttgcaggtgcatgtggaccccgcttttttgagatttattccaacatacacttcacggctcgccatcatcagccagtccgggcagtgtcaattttgcgaacccaccggactggctaacccggctgacattttccacgtgaacccagtggggccactgctcatgacattcgatgtgtctgcctctaagcaggcattagccttcggagattcagagggctgtgttcatttatggaccgattcccccgagccttcctttaacccatactctcgggaaaccgagttcgcacttccatgcttagtggactctctgcccccattggactggtcccaagatcttcttcccctctcactaatccctgtgccactcacgactgacaccctgctcagcgattggccagcagccaacagcgctcccgcacctagacgcgctccaccagttgacgccgagatcttgcgcaccatgaaaaaggtgggtttcatcggttatgcaccgaatccacggacgaggctgcgcaatcagattccctaccgcctgaaggagtctgactcagaatttgacagcttctcacaggttacagagagtccggtgggcagagaggaggaaccacatctccatatggtctctaagaagtaccgcaaggtgaccataaagtactccaagcttggacttgaggacttcgactttaagcactacaacaaaaccctgttcgctggactggagccccatatcccgaatgcatactgcaattgtatgatccaggtcttgtacttcctcgagcctgtcaggtgtctaatccagaaccacctttgtcagaaggaattctgcttggcttgcgagctcggatttctttttcacatgctggatctctctcgaggcgatccctgtcaaggaaataacttcctcagggcgttccggaccattcctgaagcctctgctcttgggctgattctggccgattccgatgaagcttccggcaagggaaatctggctcgacttatccagcgatggaatagattcattttgacccagctgcatcaggatatgcaagagctcgagatccctcaggcttataggggtgccggtggttcttctttctgctcttcaggcgattcagtgataggccaactgttcagctgcgaaatggagaactgttcattatgccgctgtggcagcgagaccgtcagggcatccagcactttactgtttaccctgagttatccggatggctccaaatcagacaagacagggaaaaactatgacttcgctcaggtcctaaagcggtctatttgcctcgaccagaacacccaggcttggtgtgatacttgtgaaaaataccagcccacgattcaaacccggaacataaggcatctgcctgatatcttggtgatcaattgcgaagttaattcctccaaagaggcggacttctggaggatgcaggctgaggttgccttcaagatggctgtgaagaagcacggtggagagataagtaaaaacaaggagttcgcccttgctgattggaaagagctcggctccccggaaggtgtgttagtatgccctagcatcgaggagctgaagaacgtctggctcccattttcaattagaatgaaaatgacaaaaaataaggggctggacgtttgcaattggaccgacggggatgagatgcagtggggtcccgcaagagctgaggaagaacacggcgtctatgtgtacgacctgatggccacggtagtgcacatccttgacagccgcactggcggttcactcgtagctcatatcaaggtgggagagacttaccaccagcgcaaggagggtgtgacgcatcaacagtggtatctctttaacgattttttaatagagccgatcgataaacatgaagccgttcagtttgatatgaattggaaggtgccggcaatattatattatgtaaagcgcaacttaaatagcaggtataatcttaatattaagaaccccatcgaggccagcgttctgctggctgaggctagcctggcccgaaaacaacggaagacacatacgaccttcatccccctcatgcttaacgagatgcctcaaattggcgacctggtgggccttgatgccgagtttgtgaccctaaacgaagaggaggctgaactgaggagcgatgggaccaaaagcacaattaagccgtcacagatgtccgttgctaggatcacttgcgtgcggggacaggggcctaatgaagggatcccttttatcgacgactacattagtacccaggaacaggtggtggattatctgacccagtatagtggcattaaacccggtgatcttgacgctaagataagctccaaacatcttacgacactgaagtctacctacctgaagctacgctttctcattgatatcggtgtgaaattcgtgggacatgggctccagaaggattttagagtaatcaaccttatggtccctaaggaccaggtgctggacacggtatacctgttccacatgcctcgcaagaggatgatcagtcttcggttcctcgcttggtattttctagatctgaaaatccagggggagactcatgatagcattgaggatgccaggacagctctccagctttacaggaagtaccttgagctttccaaaaacggaactgaacctgagtcttttcataaagttctcaagggactttacgagaaagggagaaaaatggattggaaggtgcctgagccggaggggcagaccagcccaaagaatgccgctgtcttctcttccgtgctggccctgtag

SEQ ID NO: 234029 - DNA, 987 bp, Artificial Sequence
  Description of Artificial Sequence: Synthetic coding sequence
atggatgctgttcttttggagcactttccaggtggcttagatgcattcccctcgtcctattttgatgaggacgacttcttcaccgaccaatcttctcgggatccactggaggacggggacgaactgctcgcagatgaacaggccgaagtcgagtttttgtctcaccagcttcatgaatattgctatcgcgatggtgcttgcctgctgctgcagccagccccacccgcagcccctctggccttggcacctccaagctctggcggactcggagagcccgacgacggaggcggaggaggctactgctgcgaaaccggcgcaccacccggaggttttccatactcaccaggatctcctcctagctgcctggcttacccttgcgccggtgctgctgttttaagcccaggcgctcgcctgagaggactttccggcgctgccgctgccgcagcacggagaagacggagagtcagaagcgaggcagagctccagcagctgaggcaggcggcaaacgtccgggaaagacggaggatgcagagcatcaatgatgcttttgaggggttgcggtcccacattccaactctcccgtacgaaaaacgcctgagtaaggtcgacactctccgtctggccattgggtatatcaactttctgagtgagttggttcaggcagacctgcccctcagaggtggcggtgcaggcggttgtggaggaccaggcggagggggaagattgggtggcgacagtcccggttcacaggcccagaaggtgatcatctgtcaccggggaacgcgctctccatccccaagcgaccccgattacggcctaccccctctggcagggcactccctgagctggaccgatgaaaagcaactcaaagaacagaatatcatacgcactgccaaggtgtggacaccagaggatccacggaagctgaatagcaagtcttcttttaacaatatcgagaatgaacctccatttgagttcgtttcctag

SEQ ID NO: 234030 - DNA, 852 bp, Artificial Sequence
  Description of Artificial Sequence: Synthetic coding sequence
atgaacggcgaagagcagtattatgcggctacccagttatataaagacccgtgtgctttccagcggggacccgctcccgagttttccgcgagccctccagcttgtttgtatatgggccgacagcctcctccccctcctccgcatccgtttcctggggcactaggggcattagagcaaggctcgccacctgacatttctccctacgaagtgcctccgcttgcagacgaccctgcagtggctcacttgcaccatcacctccctgctcagctggctctgccacatccccctgccggaccgttcccagaaggggcagaacccggagtgctggaagagccaaaccgagtgcagctaccattcccctggatgaaatccaccaaggcccatgcctggaaaggccagtgggccggtggggcttacgctgccgagcccgaggaaaacaaacgaacacgcacagcttacacaagggcacagttgttggagttggagaaagaatttctctttaataagtacatatcgcgccctagaagggtcgaactggcagtcatgttaaacctgactgagcgccacataaagatctggttccagaaccgccgaatgaagtggaagaaagaggaagacaagaaacgcggtggcggaaccgcagtgggcggtggcggtgtagccgagcctgagcaagactgcgcagtcacctccggcgaagagctcctcgcacttcctcctcccccacctcccggaggcgctgtgcccccagccgcacctgttgccgctcgtgagggcagactgcctcctgggctatctgccagcccacagccatcttcagtggctccacggcgtccgcaggagccgagatag

SEQ ID NO: 234031 - DNA, 1398 bp, Artificial Sequence
  Description of Artificial Sequence: Synthetic coding sequence
atgctgccactgtggactctctctttgcttttgggcgcagtggcgggtaaagaagtgtgttatgaaagactgggatgtttttcggacgatagtccttggtccgggattactgaacgcccattgcacatcttgccatggtcccccaaggatgtgaacactaggtttctcttgtataccaatgaaaatcccaacaatttccaggaagttgctgccgatagttcctcaatctccggcagtaattttaaaaccaacaggaagacccgcttcatcatccacggttttatcgacaagggcgaggagaactggctggctaacgtgtgcaagaacctctttaaagtggagtccgtcaactgtatatgtgtcgattggaaggggggatctcgtaccggctacacccaggctagccagaacatccggatcgtaggcgctgaggtggcctattttgtggagtttttgcagtccgcctttggctactcaccctcaaatgtgcacgttattggacattctctgggcgcacacgcggctggggaggctggcagacgtaccaacggcaccatcggcaggatcacaggactcgatcctgctgagccttgctttcagggcactccagagctggtgagactcgatccctcagacgcaaaattcgtggatgtaattcacacagacggcgctccaatagttcccaatctcggattcgggatgagtcaagtggtaggccacttagacttctttccgaacggcggtgtggagatgccgggatgtaagaaaaatatactgagtcagatcgtcgatatcgacggaatctgggaaggtactcgtgattttgcagcctgtaatcacctgagatcttacaaatactacactgatagcatcgtaaatccagacggttttgctggtttcccatgcgcttcctacaatgtattcactgccaacaaatgttttccatgtcctagcggaggatgcccacagatggggcattatgctgatcgctacccaggcaagactaacgacgttggtcaaaaattctacctcgacacgggggacgcaagtaacttcgccagatggcgctacaaggttagcgtgacccttagcggcaagaaggtaaccggacacatacttgtctctctgttcggcaacaagggaaattctaagcagtatgaaatcttcaagggaacattgaaaccagactccactcattctaatgagttcgactccgatgttgatgtgggggatctgcaaatggtcaagtttatttggtacaacaatgtgattaatccaacattacctagagtgggagcttcaaaaatcatagtggaaactaacgtggggaagcagtttaatttctgctcgcccgaaacagtccgcgaggaagtccttctgacattgaccccctgttag

SEQ ID NO: 234032 - DNA, 3372 bp, Artificial Sequence
  Description of Artificial Sequence: Synthetic coding sequence
atgaacagtccaaacgaatccgcggatgggatgagcggaagggagcccagcctggaaatactgccacgcaccagcctccacagcattccggtcaccgtggaggtgaaacctgtactcccccgagcgatgccctcgtcaatgggtggcggaggcggaggctctccctcaccagtggaactgagaggggcactagtgggtagcgtggatcccacgctgcgcgaacagcagctccagcaggaactgctcgcacttaaacagcagcagcagcttcagaagcagctccttttcgctgaattccagaaacaacacgaccatttaacccggcagcacgaagtacaattgcagaaacatctgaagcaacagcaggagatgttagcagctaaacagcaacaggagatgctggcagcgaaaagacaacaagagcttgaacagcagcggcaacgcgagcagcagcggcaggaagaactggaaaagcagcgtctggagcaacaactgcttatcctgagaaataaggagaaaagcaaagaaagcgccatagcttccaccgaagttaaactgcgtctccaggaattcctgctcagcaagagcaaggaacctacaccaggtggcctgaaccacagcctgccgcagcaccctaaatgttggggagcccaccacgcgagcctggaccagtcctcaccacctcagtctggccctcctggtactccgccaagctataagctgcctctgcccggaccgtacgacagcagggacgatttcccactccgaaaaactgcaagcgaaccaaacttaaaggtaaggtccagactaaagcagaaggttgcagaaagacggtccagtcccctgctaaggcgcaaagacggaacggtgatttccacgtttaaaaagcgggcagttgagattactggcgcagggccaggtgcaagctctgtttgcaacagtgctccgggatccgggccaagctctccaaactcctcacacagtaccatagctgaaaacggttttacaggatctgtgccaaatatcccaactgagatgctgccccagcaccgggcacttccactggattcgagccccaatcagttctccctgtatacaagcccatctctgccaaacatttctcttggtttgcaagcgacagtcacagtgaccaactctcacctcactgcaagtccaaagttgtctacccagcaagaagccgagcgccaggcactgcagagcctgcgccaaggaggcacactgacaggaaaatttatgtccactagcagtatccccggttgtttactcggtgtcgccctagagggagatggctctccacatggtcatgcttcacttctgcaacacgtcctgctcttagaacaggccagacagcagtctactttgattgccgtgccactccatggacagagtcctctggtgaccggcgaaagagttgccacctccatgagaaccgtcggcaagttaccaagacatcgaccactctcgcgaacacagtcctcaccgttgcctcagtccccccaagcactgcagcagctggtcatgcagcagcaacatcagcaattcctagagaagcaaaaacagcagcaattgcagctagggaaaatattgacaaagactggagagctgcctagacagcctacaactcacccggaagagactgaagaggagctgaccgagcagcaagaggtgctgttaggagagggtgctttgaccatgccaagggaggggtccaccgagtccgaaagcacacaagaggatctggaagaagaggatgaggaagatgacggcgaagaagaagaagattgtatacaggtaaaagacgaagagggggagtcgggcgctgaagagggtcccgaccttgaggagcctggagccggatacaaaaagctgttttctgacgctcagccattgcagcccttgcaggtgtaccaggctcctctctctctggctaccgtgcctcaccaggctctgggacgaacccaatcctcccccgcagcccctggtggaatgaagtcaccgcctgaccagcccgtcaaacacctgttcactacgggagtggtatacgatacattcatgctaaagcatcaatgcatgtgcgggaatactcacgtccatccagaacatgctggtagaattcagtccatctggtccagactgcaggagactggcctgttaagtaagtgtgagcgaatcaggggacgaaaagccactctggacgaaatacagaccgtccactcagaataccacaccctgctctacgggacgtccccacttaatcgccagaaactggattcaaagaagctgctcggcccaattagccagaaaatgtatgccgttttaccatgtggtggtataggagtggactcagacacagtatggaacgaaatgcattcgtcatcagcggtccgaatggctgtcggatgcctgctggaactcgcatttaaggttgccgcaggggaactgaagaacggcttcgccataattcggccaccgggtcatcacgcagaggaaagtaccgctatgggtttttgcttctttaatagcgtagccatcaccgccaagttattacagcagaagctgaacgtgggaaaagttctcatcgttgactgggacattcatcatgggaacggcactcaacaggccttttataacgatcccagcgttctctacatttctctgcacaggtacgacaatggaaacttttttccaggttcaggggcaccggaggaagtgggagggggaccgggagtgggttacaatgtgaacgtggcttggaccggcggagtcgatccccctatcggagatgtggaatacctaaccgccttcaggactgttgtgatgcccattgcccacgaattcagccccgacgtggtgctggtgtcagcaggtttcgatgctgtcgaaggccatttaagccctctggggggatacagcgtaactgcacgttgttttggccatctgacccgtcagcttatgactttagcagggggacgcgtcgtgctggccctggaaggcggacacgatcttactgccatctgcgacgcctctgaggcatgtgtgagcgcactccttagcgtggagctccaacctcttgatgaggccgtactccagcagaaaccaaatataaatgcggtggcgacgctcgagaaagtcatcgagattcagagcaagcactggtcttgcgtccagaagtttgccgcaggcctgggacgcagtttgcgtgaagctcaggctggggagaccgaggaggccgaaaccgtttcagcaatggccctgctgagcgtgggcgcagaacaggcccaggcagccgcagcgagggaacactccccgaggcccgctgaggaacctatggagcaggaaccggcactgtag

SEQ ID NO: 234033 - DNA, 1128 bp, Artificial Sequence
  Description of Artificial Sequence: Synthetic coding sequence
atgaatacctcccacctgcttgcactgctgctccccaaaagtccacaaggggagaataggagcaagccactaggaactccgtataacttctcagagcactgtcaggactccgtggacgtcatggtgttcattgtgacatcttactcaatcgagaccgtggtgggtgtcctggggaacctgtgcctaatgtgtgtcacagtacgccagaaggaaaaggcaaatgtaactaatctgctaatcgctaatctggctttctctgacttcttaatgtgcctgctctgccagcccttgactgctgtctacaccatcatggactactggatttttggagaaaccctctgcaaaatgtcagcctttatacagtgtatgtctgtgaccgtgtcgatactttctctggttctggtggccctggaacgccaccaactcatcattaatcccactgggtggaagccgagcataagccaggcgtacctgggaatcgtgctgatatgggtgatcgcttgcgtgctgtcactccccttcttagctaattctatcttggagaatgtgtttcacaaaaaccactcaaaagccttggaattcctcgctgataaagttgtgtgcacagaaagttggcctttggctcatcatcgcacgatttacacgacatttctcctcttgttccagtattgtctcccgcttggatttattctagtctgttatgcccgtatctatcgcagactgcagcgccaaggaagggtcttccataaagggacatatagtctgagagctgggcatatgaaacaggtcaacgtggtgcttgtcgtgatggttgtggccttcgctgtgctgtggctccccctgcacgtgttcaacagtttagaagactggcaccatgaggctattcccatctgtcatggtaatctcatattcctggtgtgccacctgctggcaatggcttccacatgtgtcaaccccttcatctatggttttctgaatacaaattttaagaaagagataaaggcactagttttgacatgtcagcagtcagctccacttgaggagtcggaacatttaccacttagcaccgtccatactgaggtgtccaagggctcactgcgactgtcaggcaggtccaaccctatttag

SEQ ID NO: 234034 - DNA, 1128 bp, Artificial Sequence
  Description of Artificial Sequence: Synthetic coding sequence
atgaatacttcacacttactagctcttctgttgccaaagtccccacagggagagaacagatccaaacctctgggtactccgtacaatttctccgaacactgccaagattccgtagacgttatggtatttatcgtgaccagttactctatcgagacagtggtgggagtgctgggaaatctttgtctcatgtgtgtcaccgtcagacagaaggagaaggccaatgtcaccaatctgctcattgctaatctggccttcagcgacttccttatgtgtctactgtgtcagcctttgaccgctgtctataccattatggattactggattttcggagaaacactatgtaagatgagcgccttcatccaatgcatgtctgtcacggtgtccattctctctctagtgctggttgcgctagaaaggcatcagttgattatcaatccaaccgggtggaaacctagtatcagccaggcttacttaggaatagtcctaatatgggtgatcgcttgcgtcctgagtctgcccttcctcgccaatagcatcttagaaaatgtctttcacaaaaaccatagcaaggcactcgagtttctcgccgacaaggtcgtctgtaccgaatcatggcctctggcccaccatcgaacaatctatacaacattcctgctcctttttcagtactgtctgccactgggctttatcctcgtctgttatgccaggatctacagacgactccagcggcagggtcgtgtgttccataagggaacatattccctcagggccggtcatatgaagcaggtcaacgttgtgctcgtggttatggtagtggcatttgcagtgttgtggttacccctccacgtgtttaatagtctggaggactggcaccatgaggcgatcccgatttgccacggcaacctcatttttttagtgtgccacctgctcgcaatggcatctacctgtgtcaaccctttcatttatggcttcctgaacacaaattttaagaaagagattaaggcgcttgtcctgacctgtcagcaaagcgcccctttggaggaaagtgagcatctcccactcagtacagtacataccgaggtctcaaaggggtcgctgcgactgagtggacgctccaatcccatctag

SEQ ID NO: 234035 - DNA, 1797 bp, Artificial Sequence
  Description of Artificial Sequence: Synthetic coding sequence
atgctgaaacttgtgggaggcggaggcggacaggattgggcctgctcagttgccggtaccagcttaggcggtgaggaggcggctttcgaggtcgccagacccggagaccaaggtaaggcaggagggggatcaccgggatgggggtgcgcaggaattcctgactcagctccaggtgccggtgttctccaggcaggcgctgtgggccctgccagggggggacagggggctgaagaggtgggcgagagtgccggaggtggcgaagaaaggcgcgtgcgtcatcctcaggcgccagctctgcgtcttctcaaccgaaagccccagggagggagcggagaaattaaaacgcccgaaaacgatcttcagaggggacggctgtcacggggaccacgcactgcccctcctgctcctgggatgggggatcgcagcggacagcaggaacggagtgtgccacattctcctggcgctcctgtaggaacgagcgcagccgcagtaaatgggctgctgcacaatggatttcaccctccacccgtacagcctcctcatgtctgttcacgcggtcccgtggggggaagcgatgcggctccacagcggttgccgctcctccctgagctccagcctcagcccctactgccccagcatgacagtcctgctaagaagtgccgattgcgaaggaggatggacagcggcagaaaaaaccggcctccctttccatggttcgggatggatatcggaggaacactcgtgaaacttgtgtactttgaacccaaagatatcaccgccgaagaggaacaggaggaagttgaaaatctgaaatcaattagaaaatatttgacctctaacacagcatatggaaagactgggattagagacgtgcatttagagctgaagaatctaacaatgtgtggtcggaagggaaatctacattttatcaggttcccatcatgcgccatgcaccggtttatccaaatggggtctgagaaaaacttttcatccctgcatacgacactgtgtgctactgggggtggtgcattcaaatttgaagaagattttcgcatgatcgccgatctgcagctgcataaactggacgagctggactgtttaatccaaggactactgtatgtggattctgtcggcttcaatgggaagcccgagtgctactacttcgaaaaccctaccaaccccgagctctgccagaagaagccatattgtctcgataacccatacccaatgctgttggtaaacatggggtccggggtttcaatacttgccgtctattcaaaggataattataagagggtgactggtacttccttgggtggcggaactttcctgggtctctgctgcctgttaaccggctgcgagacctttgaagaagctttggagatggccgcaaaaggcgactccacaaacgtcgataaactggtgaaggatatttacgggggtgactacgaacggtttgggctgcaaggaagtgcagttgcatcaagctttggaaacatgatgagtaaggagaaacgagattccatctccaaggaggacctggccagagccaccctggtgacaattaccaacaatatagggtcgatcgcaaggatgtgcgcccttaacgaaaatattgaccgtgtggtcttcgtgggaaactttctgcggattaacatggtgtcaatgaagctcctggcttatgctatggatttctggtcaaagggacaacttaaagcattatttctggaacatgagggatattttggagcagttggggcactcctggaactgtttaaaatgaccgatgacaaatag

SEQ ID NO: 234036 - DNA, 945 bp, Artificial Sequence
  Description of Artificial Sequence: Synthetic coding sequence
atgaaactcataaacggtaagaaacaaacctttccttggtttggcatggacatagggggaacgctcgtaaaactggtgtatttcgaaccgaaagacatcacagccgaggaggagcaagaagaggtggaaaatctgaaatctatccgcaagtaccttactagcaacacagcatacggaaagacaggcattagggacgtccatctagagctcaagaatcttactatgtgcggtagaaaagggaacctgcatttcattagatttccatcctgtgccatgcatagatttattcagatgggttcagaaaagaatttttcatccctccatacgactctttgcgcaaccggtggtggtgccttcaaatttgaagaagattttagaatgatagcagacctgcaactgcataaactcgacgagctcgactgcctcatccaaggtcttctatatgtcgactccgtgggcttcaatggcaagccagaatgctattacttcgagaaccccaccaatcctgaattgtgtcagaagaaaccttactgtctggataatccttatcctatgctcttagtgaacatggggagcggtgtgtccatccttgcagtatattctaaagacaattataaacgggtcaccggcaccagttttgggaacatgatgtcaaaagagaagcgggacagcatttccaaagaggacttggcccgagccacccttgtgaccatcaccaacaacatcggctcgatagcccgtatgtgtgccttgaatgagaatatcgatcgggtcgttttcgtcggaaactttctccgcataaatatggtctcaatgaaactgctggcttatgccatggacttctggagtaagggccaactcaaggcgctgtttttggagcacgagggatactttggggcagtgggcgcactgctggagctattcaaaatgacagatgataagtag

SEQ ID NO: 234037 - DNA, 1122 bp, Artificial Sequence
  Description of Artificial Sequence: Synthetic coding sequence
atgaaattgatcaatggaaaaaagcagactttcccctggttcggcatggacattggcggaactctcgtgaaactggtgtactttgagccgaaagacatcaccgctgaggaggagcaagaggaagtggagaacctcaagtctataagaaaatacctgacttctaatactgcttatgggaagactggcattcgcgatgtgcacctggaactcaaaaacttaacgatgtgcggtcgcaagggcaacttacacttcatccgattcccctcttgcgccatgcacaggtttatacagatgggatccgagaagaatttttctagcctccacaccactttgtgcgctacagggggtggagcttttaaatttgaagaggattttaggatgattgccgaccttcaactgcataaactggacgagttggattgcttgatccagggactgctgtatgtcgattccgtgggattcaatggtaaaccggagtgttattactttgaaaaccccaccaaccccgaactgtgtcaaaagaaaccttattgcctggacaacccctacccgatgctgcttgtcaacatgggatcgggtgtgagtatcctggccgtgtattctaaagacaactacaagagagtcactggcacaagcctggggggtgggacgtttctgggtctgtgctgtctcctgacgggatgcgagaccttcgaggaagcactagagatggcagcaaaaggagacagcacaaacgtcgacaagttagttaaggatatctacggcggtgactacgagcgctttggcctgcaggggagcgctgtcgcttcatcctttggtaatatgatgtctaaagaaaaacgggattctatttcgaaggaggatttagcaagagccaccttggtgactatcactaacaacattggctctatcgcccgtatgtgcgccctgaatgaaaatatagaccgggtggtattcgtcggtaattttctgcgaattaacatggtgtctatgaagcttctagcatatgccatggacttttggtccaagggacagctcaaagctctctttttagaacacgagggttactttggagcggttggcgcactgttagagcttttcaagatgacagatgacaagtag

SEQ ID NO: 234038 - DNA, 1203 bp, Artificial Sequence
  Description of Artificial Sequence: Synthetic coding sequence
atggcaaagtccaagcacgcattattgccattttgccacgggatgatgcagcaggaggggttacaccaaatgcagagcctggacctcggactgctgtccctgcagaacagcttcccttggttcggcatggatatcggagggactctggttaaactggtctacttcgagcccaaagatatcactgctgaggaggaacaggaagaggtggaaaatttaaagagtataaggaaatacctgaccagtaacacagcatatggcaagaccggcatcagagatgttcatctggagctcaagaaccttacaatgtgtgggcgaaagggtaaccttcactttatccgcttccctagttgcgccatgcacagattcatacaaatgggcagtgagaagaactttagctctctccacacaacactatgcgctacagggggaggtgctttcaagttcgaagaggactttaggatgatagccgacctgcagcttcacaagctggacgagctggactgccttatccaaggtctgctgtatgtggattccgtaggattcaatggcaaacccgagtgttattactttgaaaacccaacaaacccagaactttgtcaaaagaaaccctactgccttgataacccttatccgatgctcctggtcaatatgggctcaggggttagcatcctcgctgtttactctaaggataattacaagagggtgactgggacatctctggggggtggtacattcttagggctgtgctgcttgctcaccgggtgcgaaacttttgaggaagccttagaaatggctgccaaaggcgacagtaccaacgtggacaagttggtaaaagatatatacggaggggattacgaacgttttggcctgcaaggaagcgcggtcgcctccagcttcggtaacatgatgtcgaaagaaaagagagacagcatctccaaggaagacctagcccgtgcaaccctggtgactattacgaacaatataggatccatcgcaaggatgtgtgccttaaatgagaatatcgatcgcgtggtgtttgtaggcaatttcctgagaatcaatatggtctccatgaagctgcttgcttacgcaatggatttctggagcaaaggacagctgaaggccctgtttctcgagcatgagggttatttcggcgctgtaggggcattgcttgagttattcaaaatgaccgacgacaagtag

SEQ ID NO: 234039 - DNA, 1386 bp, Artificial Sequence
  Description of Artificial Sequence: Synthetic coding sequence
atgggcgacaggtctggccagcaagagaggagcgtgccccacagcccaggtgcacccgtcggcacctcagcagccgcagtcaacgggctgctccacaatggttttcacccaccacctgttcagcctccccacgtgtgttctaggggacccgtcgggggaagcgatgcggctccgcagaggctgcccctgcttcccgagttacagccacaacctctcttgccccagcacgattctcccgctaaaaaatgtagactgagacgcaggatggactcggggagaaagaacaggccaccatttccatggttcggcatggatatagggggtacgctggtgaaattagtctattttgagcccaaggacatcactgccgaggaggagcaagaagaagtcgaaaatctcaagagcatccgtaagtacctcacaagcaatacagcctacggcaaaaccggaatccgcgacgtccacctggaactgaaaaacctcacaatgtgcggccgtaaggggaacttgcattttatccgtttcccaagttgcgcaatgcaccgattcatccagatgggatcagaaaaaaacttctcctcattacacaccaccctgtgcgccacaggcggaggtgcattcaaattcgaagaagacttccgaatgatcgcagacctccaactgcataagttggacgagctcgattgtctgatccagggactcctttacgtggactccgttggtttcaatggtaaaccagagtgctattacttcgagaatcccactaacccagagctgtgtcagaaaaaaccttactgcctggataacccgtaccctatgctgctggtgaacatggggtctggtgtcagcatcctggccgtgtattcgaaagacaactataaacgcgttacggggactagtttaggtggaggcacctttctcggcctgtgctgtctgctcacgggatgcgagacctttgaagaagcactggagatggccgcaaagggagactccaccaacgttgataagctcgtgaaggacatctatggcggtgattatgagcgatttgggcttcagggctccgcggtggctagcagtttcggcaatatgatgtccaaggagaaaagggactcaatcagcaaggaggatttggcaagggcgacgctggtgacgattactaataatatcgggagtatcgcacggatgtgtgccctgaacgaaaacattgacagagtggtgtttgtcggtaactttctgaggatcaatatggtgtccatgaagctgctggcatatgccatggacttctggtctaagggccagttaaaagctctgtttttggagcatgaagggtatttcggcgcagttggggcattattggaactgttcaaaatgactgatgacaaatag

SEQ ID NO: 234040 - DNA, 1713 bp, Artificial Sequence
  Description of Artificial Sequence: Synthetic coding sequence
atgagacggctaggtccattccatccccgagtgcactgggcagcacctccttcactgagctccgggctgcatagactcctgttcctgcgagggactcggatccctagttccactaccctttctcctccgcgacacgatagcctctccctggacggaggaaccgttaacccccctcgcgtacgggagcccactgggagagaagcgtttgggccaagccccgctagttccgactggcttccagcacgctggaggaatggtcgtggcggtcgcccacgagccagattatgctccgggtggacagccgctgaggaggccagacgtaatccgacactcgggggattacttgggaggcagagactgctgctgcggatgggtggcggtaggcttggcgcacctatggaacgacatggcagagcatcagctacttctgtttcatctgctggtgaacaggctgctggggaccccgaggggcgacgtcaagagcccctgcgtcgaagggcctctagcgcttctgttccagcggttggagcttcagctgaggggacccgcagagaccgtctgggaagttatagtggacctaccagcgtgagtcgccagcgggtcgagagcctccggaaaaagcgacccctctttccctggtttggactcgatatcggtggtactcttgttaaattggtatattttgaaccaaaagatatcactgcggaagaagaagaggaggaggtggaatctcttaaatccattcggaagtacctcactagcaatgtagcttatggatccaccgggatccgtgatgtgcacctcgaacttaaagatcttactctttgcggaaggaagggaaacctacacttcattaggttccccacccatgacatgcccgcattcattcaaatggggagagacaaaaatttcagctctttgcacaccgttttctgcgcaaccggcggaggcgcttacaaatttgagcaagactttctgaccataggcgacctgcagttgtgcaagctagacgagctcgattgtttaatcaaaggcatactgtacatcgactctgtggggtttaatggtcgaagccagtgctactatttcgagaatcctgcagactctgaaaagtgccagaagttaccgtttgacctcaagaacccataccctttactcctagtgaacatcgggtcaggggtgtccattctggccgtttactctaaggacaattataaacgggttaccggcacctccttaggaggcggaaccttttttggcctgtgctgcctgctgaccggatgcacaaccttcgaagaggcactggagatggcaagcaggggagactctacaaaagtcgataagctcgtcagagatatctacggcggtgattatgagaggtttggccttccaggatgggcagtggcttctagtttcggcaatatgatgagcaaagaaaagagagaggccgtgtccaaggaggacctggccagagccaccttaataacaattacaaacaacattgggtccatcgccagaatgtgtgccttaaatgagaacatcaaccaggttgtgtttgtcggaaattttcttaggattaacaccatcgccatgagactcctggcatacgctttggattactggtccaaggggcagctgaaggctctgttctctgaacacgaagggtattttggcgctgtaggagctctgctcgagctgctcaaaatcccttag

SEQ ID NO: 234041 - DNA, 1161 bp, Artificial Sequence
  Description of Artificial Sequence: Synthetic coding sequence
tccggccgtgttaatccggctggagggcttggatgttccgagtcaggaacatttggaggaccacccgcacccatcgtgtttccgtggttcgggctcgatataggcggaacgttagtcaaactcgtctatttcgaacctaaagatatcactgctgaggaagaggaagaggaagtcgagtcacttaaaagtattcggaaatatctgacatctaacgtagcatatggatctaccggtatcagggacgtgcacttggaactgaaagatctgacattgtgcggcaggaagggtaatctgcacttcattcgcttccctacccatgatatgccagccttcatccagatggggagagataagaatttcagctcacttcacacagtgttttgcgccactgggggaggagcctacaagtttgagcaggattttctcacaatcggggatctgcagctgtgcaaactagatgaactcgattgcctcattaagggcattctctacatagattctgtgggctttaacggaaggtcccagtgttattatttcgagaaccccgcagactccgagaagtgtcaaaaactgccttttgaccttaaaaacccttacccactgctgttggtgaacattggcagtggtgtatccatcctagctgtctacagtaaggacaactataagcgcgttactggaacctcactgggaggcggaaccttttttggactgtgctgtctgctcactgggtgcactacatttgaggaagcccttgagatggcctcccgaggggacagtaccaaagtagacaagctcgtcagggatatttatggcggagactacgagaggttcggtttgccaggttgggctgtggctagctcttttggaaatatgatgtctaaggagaagagggaggcagtgtccaaagaggacctagctcgggcaacgcttatcacgattactaataatatcgggagcatagcccgtatgtgcgctttgaatgaaaacatcaatcaagtcgttttcgtgggaaattttctgagaattaatacgatcgccatgcgactgttggcttacgctctggactactggtccaaggggcagcttaaggcgcttttcagtgagcacgaaggatatttcggcgctgtgggggcattgctggagttacttaaaataccctag

SEQ ID NO: 234042 - DNA, 840 bp, Artificial Sequence
  Description of Artificial Sequence: Synthetic coding sequence
atgcccgcattcatacagatgggcagagataagaacttctcatctctgcatacagtgttctgtgctactggcggtggggcatataaatttgaacaggatttcctgactataggtgacctccagctgtgcaaactggatgaattggactgtctgatcaagggaattctgtatattgactctgtggggtttaatggtaggtcgcagtgctattattttgagaatccggctgattcggagaaatgccagaaactccccttcgatttgaagaatccctacccactgctgttggttaacatcgggtcaggtgtgagcatcctggccgtgtattccaaagacaactataagcgtgtcaccggcacctccctggggggtggcacatttttcggtctgtgttgcctgctcaccggctgcactactttcgaagaggcccttgaaatggcatctcgtggggacagtaccaaagtggataagttagtacgtgatatctacgggggagactatgaacgctttgggcttcctggctgggccgtggcatcctcgtttggcaacatgatgtccaaggagaagagagaggctgtgtctaaagaagatctcgccagagcaactctgattaccatcaccaataatataggatccatagcacggatgtgcgccttgaatgaaaacatcaatcaggtggtgtttgtgggcaacttcttgaggatcaatacaatcgccatgaggctgctggcgtatgcactcgattactggagcaaggggcagctcaaggcgttattcagtgaacacgagggctatttcggggcagtgggagcacttctggagctgttaaagattccctag

SEQ ID NO: 234043 - DNA, 1113 bp, Artificial Sequence
  Description of Artificial Sequence: Synthetic coding sequence
atgaagatcaaagatgccaaaaaaccctcgttcccttggtttggaatggacattggcggaacccttgtcaagttatcttacttcgaacctatcgacatcaccgcggaggaggaacaggaggaggtcgagagtttaaagtcaatccggaagtatttaacttcgaacgtcgcttacgggagtaccggtattagagacgttcacctcgaactgaaagacctgacactcttcggacgcagaggcaacttgcactttatccgtttccccacccaggacctacctaccttcattcagatgggacgggataaaaatttcagtacccttcagaccgtcctctgtgccactgggggaggagcttacaagttcgagaaggacttcaggacaatcggtaacttgcatctccacaaacttgatgagctggattgcctagtcaagggcttgctctacatagattcagtttccttcaatggccaagcagagtgttactatttcgcaaacgcctccgaacccgagagatgtcagaaaatgcccttcaacctcgacgacccgtaccctttactggtagtgaacatcgggtctggagtttccatcctcgcagtgcattccaaagacaactataaaagagtcactggcactagtctaggcggaggcacttttcttggtctctgctctttgctgaccgggtgtgagagtttcgaggaagccttggaaatggcttcgaagggagattcgactcaggctgataaactggttcgggacatatatgggggagattacgagcgatttggactgcccggatgggcagttgccagttcttttggcaatatgatctacaaggagaagagagaatccgtgtcaaaggaagacctcgcaagagccacgcttgtgacaattactaacaacattggctctgtggccagaatgtgtgctgtgaacgagaaaattaatagagtcgtcttcgtcgggaacttccttcgagttaatacattgagtatgaaactgctggcctacgctctggattattggtctaagggacagctgaaggccctgttcttggaacacgaggggtattttggagccgtgggagcactgctgggtctccctaacttctcatag

SEQ ID NO: 234044 - DNA, 2322 bp, Artificial Sequence
  Description of Artificial Sequence: Synthetic coding sequence
atggccgagtgtggagcctctggctctgggagctccggcgactctctcgacaagagtattactctccctcctgacgagatctttcgcaacctcgagaacgctaaacggtttgccatcgatatcggaggctcactgacaaagcttgcatactactccacagtgcaacataaggtggccaaggtgcgcagcttcgaccattcaggtaaagatacagaaagagagcatgagccgccatacgagattagcgttcaggaggagatcacagcgagactgcacttcatcaaattcgagaacacatatattgaagcgtgcctagacttcatcaaagaccacctagttaacaccgagacaaaggtgatccaggctaccggtggtggggcttacaagttcaaggacctgatcgaagaaaaattgaggctgaaggtggataaggaggacgtcatgacctgcctgattaaaggatgcaatttcgtgctcaagaacattccccacgaagcctttgtgtaccaaaaggacagtgatcccgaatttcggtttcagactaatcatcctcacatttttccgtaccttctcgttaacatcggatccggggtgtcaatcgtcaaggttgaaacagaggaccgattcgaatgggtaggaggaagtagcatagggggaggcaccttctggggcctgggtgcgctgcttacaaagaccaagaaatttgacgaattgttgcacctggcctccagagggcaacatagtaacgtcgacatgctggtgagggacgtatacggcggagcccaccagacactggggctcagtggcaacctgatagctagttcatttggtaaaagcgctaccgcagaccaggagttttccaaggaagacatggcgaaaagtctgctgcacatgatcagtaatgacattggacagctagcctgcttacacgctaggcttcacagtcttgaccgcgtctattttggtggcttctttattagaggtcatcctgtgaccatgcgcacaattacatactctattaatttcttcagtaagggggaggtgcaggcattgttcctccgtcacgaaggatacctcggcgcaatcggagccttccttaagggagcggagcaggacaaccccaaccagtacagctggggggaaaattatgccggttctagtggtcttatgagcgccagcccggaacttgggccagcccagcgtgcacgctccggcactttcgatctgctggagatggatcgtctcgaaaggcccctggtagacttgcccctgcttctggatcctccttcgtacgttcctgacacagtggacttgactgacgatgccctggcacggaaatattggctcacatgttttgaagaggccttggacggcgtcgttaagcgtgcagtcgcgagccaacctgactctgtggatgccgcagaacgggctgagaagtttaggcaaaaatattggaataagctacagacgcttagacaacagccatttgcttacggaactctgactgtccggagcctcctcgacacaagggagcactgcctgaacgagttcaacttcccggatccgtatagtaaggtcaagcagagggagaacggtgtggcattacgctgctttccaggcgtcgtgcggtccttagacgctctgggatgggaagagcgccagttagcactcgtgaaagggctgctcgcgggtaatgtgttcgattggggcgctaaagcagtgtccgccgtcttggagtctgacccttactttggtttcgaggaagccaaaaggaagctgcaggaacgcccatggctcgtggacagctattctgagtggctccagcggctcaagggcccacctcacaagtgcgccctgatcttcgctgacaatagtggaatcgatattatattaggagtgtttccatttgttagagaacttctgttacgcggtaccgaggtgatcctggcgtgcaactctgggccagctttgaatgatgtgacccacagcgagtccctcatagtcgccgagcgtatcgcgggaatggacccagttgtgcacagtgccctccaggaggaacgacttctgctagtccagactggctcctcctctccgtgtctcgatctgtctcgcctggacaaaggtctggcggctctagtgcgtgagcgaggcgctgacctggtggtgattgaaggcatgggcagggccgtacacacaaattatcacgccgcactacgctgcgagtcactcaagctcgccgtcattaagaacgcttggctggccgagcggttgggtggccgactcttttctgtaatattcaaatacgaggtccctgccgaatag

SEQ ID NO: 234045 - DNA, 1455 bp, Artificial Sequence
  Description of Artificial Sequence: Synthetic coding sequence
atgtttccaaatagtatcttagggagacctccgttcactcccaaccatcagcagcataacaacttctttacccttagcccaaccgtctattcgcatcaacagctgattgacgctcaattcaacttccagaacgccgacttgagccgtgccgtatccttgcaacagttgacttatgggaatgtgtccccgatacagacaagtgcctccccgctgtttaggggtagaaagcggctatcagacgagaagaatctacccctggatgggaagcggcagagatttcactctcctcaccaagagcccacagtcgtcaaccagattgtgccactctcgggtgaaagacgctactccatgccccctctcttccacacccattacgtccccgatatagtgcgctgtgtgccccctttccgagagatcgctttcctcgagcctagggagataactctgccagaggctaaagataagctttcccagcagatcttggaactttttgaaacgtgccaacagcaaatatccgatcttaagaaaaaggagctgtgtcggacacagctgcaaagggagattcagctgctgttcccacagagcagactcttccttgttggaagcagtctgaatgggtttgggacacgatcctccgacggcgatctatgcctagtggttaaagaggaaccttgcttttttcaggttaatcagaagacagaggccaggcacatcctgacactcgtgcataaacacttttgtacgcggctctctggatatattgagagaccgcagctcatccgcgctaaggtacccatcgtgaaattccgagacaaggtctcctgcgtggaattcgacctgaacgtgaacaatatcgtcgggattaggaatactttcttgctgcgcacctatgcctacttggaaaacagagtacgccctctcgtcctggtcattaaaaaatgggcttcacatcatcagattaatgatgccagtaggggtaccctatctagctacagtcttgttttaatggtcttgcactatctccaaaccctgcccgaacctatcctgccgtctctgcaaaagatctacccagagagctttagtcctgccatccagctgcatcttgtacaccaggcaccatgtaatgtgccaccttatctctccaaaaacgaaagtaatctgggcgacctgctgctgggtttcctgaagtactatgcaaccgagttcgattggaacagtcagatgatatctgtccgagaggccaaggcgattccccgtccagacgggattgaatggcggaataagtacatatgcgtagaagagcccttcgacgggacaaacaccgcacgagcggtccacgagaaacagaagtttgatatgattaaggaccagttcttaaaaagttggcatcgactgaaaaataaaagagatctgaacagcatattgcctgttcgcgcagccgtgctgaagcgctag

SEQ ID NO: 234046 - DNA, 1443 bp, Artificial Sequence
  Description of Artificial Sequence: Synthetic coding sequence
atgttccctaatagcatcctgggaagaccacctttcactccaaatcaccagcaacataacaactttttcaccctatcccccaccgtctattcgcaccaacagttaatcgacgctcagtttaattttcagaacgcagatttgagtcgcgctgtatcattacaacagctgacttacggcaatgtttcgcctatccaaacatctgcctcccctctgtttagagggagaaaacgtttgagcgacgagaaaaacctgcccctggacggaaagaggcagcgatttcactccccgcaccaggagccaacggtggtgaaccagatcgtccccctgtccggcgagagaaggtactcaatgcccccactcttccacacacactatgtgccagatattgtccgctgtgtcccccctttcagagaaatcgcattcctggagccacgcgaaataaccctccctgaggctaaagataaactgtcacagcaaattctcgagcttttcgaaacctgccagcaacagatctcagacctcaagaagaaagaactgtgccggactcagctgcaaagagaaatccaacttctgtttccccagagccgtttgttcctcgtcggctcatcccttaacggttttggtacgcgaagctctgatggcgacctgtgcttagtcgtgaaggaggagccagttaatcaaaagaccgaggcgaggcacatcctgacactcgtccacaagcacttttgcactcggttgagcggatacattgaaaggccacaattaattagggcaaaggtgcccattgtgaagtttcgggataaggtgagctgtgtcgagttcgacctgaatgtcaataatattgttgggatacgcaacacctttcttctgaggacctatgcatatcttgaaaaccgggtcagacctctcgtgctggtgatcaaaaaatgggcttctcaccatcagatcaacgatgcctcgaggggaacactgagtagctatagcttagtgctgatggtgctgcactatctccaaacactgcccgaaccaatcctgccaagcctgcagaagatctaccctgaaagtttttctcccgcaatccagctgcatcttgtacatcaggctccatgtaatgttcctccttacctatccaaaaatgagagcaatctgggagatctgctgctgggatttttgaaatactacgctaccgaatttgactggaacagtcagatgatttccgtgcgggaagcaaaagcaatcccgcgacctgatggaattgagtggcggaacaaatatatttgcgtagaggagcccttcgacggcacgaacactgctcgggcagtgcacgaaaaacaaaaattcgacatgattaaagatcagttcctaaaaagctggcatagattgaaaaataaacgtgatctgaactctatcttgccagtgagagccgctgttttgaaaagatag

SEQ ID NO: 234047 - DNA, 1455 bp, Artificial Sequence
  Description of Artificial Sequence: Synthetic coding sequence
atgtttcctaattccattttaggaaggccccctttcacacccaaccatcagcagcacaataacttctttacactatcccctacagtgtatagccaccaacagctgattgacgctcaattcaactttcagaacgctgatctctcgcgggcagttagtttgcagcagttgacctatggcaacgtgagccctattcagacttccgctagccctctattccggggtaggaaacggctgagcgacgagaaaaacctgcccctcgacggcaaaagacagcgtttccattcacctcatcaggaacctacggttgtcaatcagatcgtgccccttagcggcgagcgtcgctatagcatgccaccgctgttccatacacactacgttccagacattgtgcgctgtgtgcccccatttagggaaatcgcctttctcgaacccagagaaattactctaccagaagccaaggacaaacttagtcaacaaatactcgaacttttcgagacttgccagcagcagataagtgacctaaagaagaaagagctttgtcggactcagctacaacgggagatccagctactgttcccccagtctaggttatttctggttggatcaagcttgaacggatttgggactagatctagcgatggcgatctttgccttgttgtgaaagaggaaccatgcttttttcaggtcaatcaaaagaccgaagctcgacatatccttacactggtgcacaagcatttttgcactagactatcaggttacattgagcgtccgcaattaattagagccaaagttccaattgtgaagtttagagataaggtaagctgtgttgaattcgacttaaatgtgaataacatcgtgggcatacggaacacctttcttttgcggacgtatgcctaccttgagaacagggtcaggcccctcgtcctcgtcattaaaaaatgggcatcacaccaccagataaatgacgcttctcgcggtacactctcgtcctattccctggtgctcatggtacttcattatcttcaaacactacctgaaccaatcctgcccagtctgcagaaaatctaccctgaatcgttttctcccgcaatccagctgcatttggtgcaccaggccccttgcaacgtgccgccttatctgtcaaaaaacgagtccaacttgggcgatcttttgctcgggttcctgaagtattacgccacggaatttgactggaactcccaaatgatttccgtaagagaagccaaagccattcccaggccggatggcatcgaatggagaaacaagtacatttgtgtggaggaacctttcgacgggaccaatacggcacgagccgttcacgaaaagcagaagttcgatatgattaaggaccagttccttaaatcttggcacagactgaagaacaagagggatctaaactctatccttcccgtacgggctgccgtcctgaaaagatag

SEQ ID NO: 234048 - DNA, 1455 bp, Artificial Sequence
  Description of Artificial Sequence: Synthetic coding sequence
atgttccccaactctatattaggcaggcccccattcaccccgaatcaccagcaacataataacttttttaccctgtcccccacagtttactctcaccagcagctgattgatgctcagttcaattttcaaaatgcagacctatcacgcgctgtgagcctgcagcaactgacatatggtaacgtctctccaattcagacttctgcaagtccattattccgtgggaggaagcggttatccgacgagaaaaacctccccctagatgggaagcgccagaggttccattccccgcatcaggagcccacagtggtaaaccaaatcgttcccctaagcggggagagacgctacagcatgccacctctgttccacactcattatgtccccgacatagtgcgctgcgtcccccctttccgtgagattgcattcctcgagccaagggagatcacattgccagaggcgaaggacaagctgagccaacagatccttgaactctttgagacgtgccaacagcagataagtgatctcaagaagaaagagctgtgcagaacacaacttcagagagaaattcagttgttgttcccccagagcaggctatttctggtgggtagcagtctgaacgggtttggaacccgatcctcagacggcgatctttgcctggttgtaaaagaagaaccctgcttctttcaagttaatcaaaaaaccgaagctcggcatattctgactttagtccataagcacttctgcacccggttatccggatacattgagcgccctcagctcattagagccaaagtaccaatcgttaaattccgggataaagtgtcttgcgtggaatttgatcttaatgtgaataacattgttggaattcggaatacatttttgctccgcacatacgcctacctcgagaaccgggtcagaccactggtgttggtcatcaagaaatgggcctcacaccaccagataaatgacgcgagcaggggcaccctgtcttcatactctctggttttgatggtgctgcattacctgcagaccctgcccgagccgatcctccctagcttgcaaaaaatctacccagagagctttagccccgctattcagctccacctggtgcaccaagcaccgtgtaatgttcccccatatctgtcgaaaaatgagtccaatctcggcgacctcctgctcggcttcctgaaatattatgcaaccgagtttgattggaattcccagatgatcagtgtgcgggaggctaaagcgattccacgccctgacggaattgaatggcggaacaaatatatttgcgtcgaagaacctttcgacgggactaacacggcacgagcagtgcacgagaagcagaagtttgacatgattaaagaccaattcctgaaaagctggcaccgcttaaagaataagagagacctgaattcaattctgccggtgcgggcagctgtcttaaaaaggtag

SEQ ID NO: 234049 - DNA, 1476 bp, Artificial Sequence
  Description of Artificial Sequence: Synthetic coding sequence
atgagccttgtcgcttacgcttcctcagatgaatcagagcctgatgaggccgaaccagagccggaagaagaggaagcggtcgcacctacgagcggcccagctcttggtgggctgtttgctagtctgcccgctcctaagggtcctgcccttctgccacctcccccacagatgttggccccagccttcccaccgcctttattactgccaccaccaacaggcgacccaaggctgcagcccccaccaccactcccatttggacttggcggatttccccctccgccaggggtgagcccagccgaggccgctggggttggcgaaggactcgggctagggttaccctctccacggggacctgggctgaatctccctcctcccataggaggagcaggcccacccttgggccttccaaaacccaaaaagcgtaaggagcccgttaagatcgcagcgccagaattgcacaaaggcgatagcgattccgaggaagatgaaccaacgaagaaaaagaccattctgcaagggtcgagtgaggggactggcttgagcgcattgctaccacagcccaagaatctgactgtcaaggagacaaacagactgcttttaccccatgcctttagcaggaaacccagcgacgggagtcctgatacaaagccatcaaggctcgcatctaaaactaagacatcctctctggcccctgtggtcggcaccacaaccaccacaccctcgcccagtgccattaaggcagcagcaaagtcggccgcactgcaagtgactaaacagattacgcaagaggaggatgatagcgacgaggaggtggcacccgagaatttcttctctctgcccgagaaagccgaaccccctggtgtagagccgtacccctatcctattcccacagttcccgaggagctccccccaggcacagagcctgagcctgcgttccaggacgacgcagcaaatgctcccctggaatttaagatggctgcagggtcaagtggcgcaccatggatgccaaagcccggtgacgattacagctataaccagttttctacttatggcgacgccaacgccgctggcgcttattaccaagattattattccgggggttattacccagcccaggacccagcacttgtgccaccccaggagatcgcaccagatgcttctttcatcgacgatgaggctttcaagagacttcagggaaagcgtaacaggggaagggaggagatcaacttcgtggagattaaaggtgatgaccagttaagcggcgcacagcagtggatgacgaaaagcctcaccgaggaaaaaaccatgaagtccttctccaagaagaagggggaacagcctaccggacaacaacggaggaagcaccagatcacctacctcatacaccaggcaaaagaaagggaactggagctcaagaatacctggagcgagaacaaactgagccggcgtcagacacaggcaaagtatggcttttag

SEQ ID NO: 234050 - DNA, 1380 bp, Artificial Sequence
  Description of Artificial Sequence: Synthetic coding sequence
atgtctttggtcgcctacgccagtagtgatgagagcgaaccagatgaagctgaacccgagcccgaggaggaggaggcggtagccccaacaagtggacctgccttaggagggctgtttgcttctcttcccgcaccaaagggtccagcgctcctgcctccgccaccccagatgctcgcacctgcatttcccccaccccttctgctgcctccacccacaggcgaccccaggctccagccccctccacctctgcctttcggtctggggggttttccaccaccccctggggtctcacccgctgaagctgccggtgtcggtgagggactgggcttggggttacctagtcctcgcggacctgggcttaacctgccaccccctatcggaggggcaggtccccctctgggcctccccaaacctaagaaacggaaagaaccagtcaagattgctgccccagagctgcacaaaggtgattctgacagtgaagaagatgaacccactaaaaagaaaaccatactgcaaggttctagtgaggggacagggctgagcgctttactaccccaacccaaaaacttgactgtcaaagagacaaatcgcttactcctgccacacgcttttagtaggaagcccagcgacggtagtcccgataccaaaccaagtagacttgccagtaaaactaagacttccagcctcgccccagtggtagggacaaccactaccactccttctccttcggccatcaaggccgctgcaaagtcggccgcattacaggtcactaagcaaatcacacaggaggaggatgactctgacgaggaggtggcaccagaaaatttcttctcgctgcccgaaaaggctgaaccccctggggtagagccctacccctatcccattcccacagtcccagaggaattacctcctgggaccgagcccgaacccgcttttcaggatgatgctgctaatgcacctcttgaattcaagatggctgccggttccagcggcgcaccatggatgcccaagcccggagatgactatagttacaatcagttcagcacttacggtgacgccaatgccgctggagcgtactaccagtttaagcggctgcagggcaaacggaacagaggacgcgaagagattaatttcgtggaaattaagggagacgaccaactgagcggcgctcagcagtggatgaccaaatcactgacagaggaaaaaacaatgaaatctttttcgaagaagaaaggggagcagccaaccggccaacagcggaggaagcatcaaatcacatacctcatacaccaggccaaagagagggagctcgaactaaagaacacatggagcgaaaataagttaagtcggcgacagacgcaggccaagtacgggttctag

SEQ ID NO: 234051 - DNA, 1404 bp, Artificial Sequence
  Description of Artificial Sequence: Synthetic coding sequence
atgcttgcccctgcttttcctcccccattgctcctcccaccaccaacaggggatccacggctgcagcctcctcctccactcccgttcggcctggggggtttcccgcctcctccaggtgtctctccagcagaagcagccggagtaggagaaggcttaggtttgggcctgccttcacccaggggacctggacttaatcttccgcctccaatcggcggagctggcccacctctcggccttcctaagcctaaaaagagaaaggagccggtaaaaattgccgcacccgagctgcataaaggcgatagtgatagcgaagaggacgagccaacaaagaagaaaaccattctccagggatcatcagagggcacgggtctgagcgccctgctccctcaacctaaaaatttaacagtaaaggagaccaatcgcctgctcttgccacatgctttttcgagaaagccatccgatggctcacccgatacaaagccctcccgactcgccagcaagaccaagacaagctctctggcccctgtcgttggaactactactaccactccgtcgcccagcgcgattaaagccgctgccaagtccgctgcactgcaggtaactaagcagattactcaggaggaagacgacagtgatgaagaggttgccccagagaatttctttagcctacccgagaaagcagaacctcccggtgttgagccttatccgtatcctattccaacggtacccgaggaactcccacctggcaccgagcctgagcccgcttttcaggacgacgctgccaacgcacccctagagtttaagatggcagctggctctagcggcgctccatggatgcccaagcctggcgacgattattcctacaaccagtttagtacttatggagatgccaacgccgctggagcatactaccagggactgcagcagcaccttggacacagtccattgcggggtattatgcgcttcttaaacagcaagtctggcaagaggacctgcttcgtccccagctttgactattattccggcggatactacccggcacaagatccggctcttgtgcctccccaggagatcgcgccagatgccagctttattgatgacgaggcctttaagcgcctgcagggaaaaaggaatagaggaagggaggagatcaatttcgtggagattaagggagatgaccagctcagtggcgcacagcagtggatgaccaaatctctcaccgaggagaaaacaatgaagtctttctcaaagaagaagggcgaacagcccaccgggcagcaacgaagaaagcaccaaatcacttatttgatacaccaggcaaaggagcgcgagcttgaactgaagaatacgtggtctgaaaacaagctgtcgaggcggcagacacaggcaaaatatgggttttag

SEQ ID NO: 234052 - DNA, 3096 bp, Artificial Sequence
  Description of Artificial Sequence: Synthetic coding sequence
atgaaggtcactgtctgcttcggtaggacacgggttgttgtcccatgtggagacggtcatatgaaggtcttttccctgatacagcaagcagtcactagataccgcaaggcaatagcaaaagacccaaactactggatccaggtgcaccggctagagcacggagatgggggaatccttgatctggacgatatcctgtgtgatgtggccgacgataaagatagactcgtagccgttttcgacgagcaggacccgcatcatgggggagatggcacatctgcttcatccaccggaacccagagccctgagattttcggttccgaactgggcacgaacaacgtctcagcattccagccatatcaggcaactagcgagatagaggttacccctagtgtcttgagggcgaacatgcccctccatgtgcggaggtcatccgaccctgctttgatcggtctaagcactagtgtgagcgactcaaatttctccagcgaggagcctagcagaaaaaatcccactcggtggagcactaccgcaggatttttgaaacagaacactgcaggttccccgaaaacttgtgaccgcaaaaaagatgaaaactatcgaagcctgccacgcgacacgagtaactggtctaatcagttccaaagggacaacgctcggtcctcgctctcggcctcccatccaatggtggggaaatggctggaaaaacaggaacaggacgaggacggcacagaggaagataactccagagtcgagcctgtaggacatgcagacactggactcgaacatatcccgaatttcagcctggacgacatggttaagttagttgaggtcccgaacgacggtggtcccctggggatccatgtggtgccattttccgccaggggcggtaggacgctgggcctgctggtgaagcgcctggaaaagggtggaaaggccgagcacgaaaacctgtttagagagaacgactgtatcgtaagaatcaacgacggtgatctgcgcaaccgtcgctttgagcaggcacaacatatgttcagacaggccatgcgaaccccaatcatctggttccacgtcgtgccggctgcaaacaaagaacagtatgaacagctgtctcaatcggagaagaataactactactcctctagattttcgccagacagtcagtatattgacaatagatcagtcaacagcgctgggttgcatacagttcagcgcgctccaaggctcaatcatccacctgaacaaattgattcccacagcagactgcctcactctgcacatccctccgggaaaccccctagcgctccggcttccgcaccccagaatgtgtttagcaccaccgtatcaagtgggtacaataccaaaaaaataggaaaaaggctgaatatccagctcaaaaaaggtactgaaggactcgggtttagcataacaagtcgtgatgtcaccatcggcggaagcgcgccaatatatgtaaaaaacatacttcctaggggtgccgctattcaggatgggaggcttaaagcaggggacaggctcattgaggttaacggggtcgacctggtggggaagtcgcaggaggaggtggtgtccctcctgcgcagcaccaagatggaaggtaccgtctcgttgctcgttttccggcaagaagacgccttccatcccagagaacttaacgccgaaccatctcagatgcaaattcctaaggagaccaaagcagaagacgaggatatagtgttgacacccgatgggacaagggagttcctgacctttgaggtgccgctgaacgactcgggctcagccggattgggtgtcagcgtcaaaggcaataggagcaaagaaaaccatgctgacctgggtatatttgtgaagtctatcatcaatggtggagctgcaagcaaagacggccgactcagagtcaatgaccagctcatcgccgtgaacggcgaatctctgctcggcaaaaccaaccaggacgctatggagactttaagacggtccatgtctactgaaggaaataagcgtggcatgatacagttaatcgttgcaaggcgaataagtaaatgcaatgagcttaagtcccctggatccccgccaggcccagagctccccatcgaaaccgctctggatgaccgcgagcgcagaatcagtcactcgctgtactcggggatcgagggtctggatgagtcacctagcaggaatgccgcactgagccgcatcatggggaaataccagctgagccctacagtaaatatgccccaagatgacacagtgataattgaggacgacaggttgccagtactgccgccacatctgtcagaccagtcctctagcagctcccacgatgatgtaggtttcgtgactgccgatgcaggaacttgggccaaagcggctatcagcgattccgctgattgtagtctttcacctgatgtcgatcctgtgctggctttccagcgcgagggctttggcagacagagcatgtctgaaaagcgaacaaaacagtttagtgacgcgagccagttagactttgtgaagactaggaagtctaagagcatggatctgggaatcgccgacgaaacaaagctgaacaccgtcgatgatcaaaaggcgggttctcccagtagagatgtggggccatccctgggtttgaaaaagtctagctccctggaaagccttcagacagccgtcgcagaagtgacacttaacggtgatatccctttccataggcccagaccacgaatcatacgcggaagagggtgtaacgaaagcttccgagcggctattgataaaagctacgataagcccgcagtggatgacgacgacgaaggaatggagaccctggaagaggataccgaagaatcatcccgttccggaagagagtccgtttccacggcctcagaccagccctcccattctctcgagcgccagatgaacggaaaccaggagaagggggacaagacggaccggaagaaggacaaaacaggtaaggaaaagaagaaagatagggacaaagagaaagacaaaatgaaggcgaaaaaaggcatgttgaaaggactcggagacatgttctctctggccaagcttaagccagagaaacgatag

SEQ ID NO: 234053 - DNA, 3960 bp, Artificial Sequence
  Description of Artificial Sequence: Synthetic coding sequence
atgaaggtcacagtatgcttcggcagaactagggtggttgtcccgtgtggcgatggacacatgaaagtgttttccctgatccagcaggccgtgactagataccggaaagcaatcgcaaaggatcctaactattggattcaggtgcaccgcctcgagcatggcgacggcggtatcctagacctggatgacatcctgtgcgacgtagcagacgataaggacaggctggtggctgtgttcgatgagcaagaccctcatcatggaggggacggcaccagtgctagcagcaccggaacccagtcccctgagatcttcggctctgagcttggtactaacaacgtctctgccttccagccctatcaggctacaagcgaaatcgaggtgaccccgagtgtccttcgggctaacatgcctcttcacgtccgacggtcctcagaccccgctttaattggcttgtctacttccgtgagtgattccaacttttcatccgaggagcctagtcgtaagaatcctaccagatggtccacaacggcgggtttcttaaaacagaatacagccggaagcccaaagacttgcgacagaaagaaggacgagaactataggtcgctgcctcgagacacctctaattggagcaatcagttccagagagacaacgctcgcagtagcctgagtgcctctcatccgatggtcgggaaatggttggagaagcaggaacaggatgaagacggcactgaagaggacaacagccgggtggaaccagtggggcatgctgatactggactcgagcatataccaaatttttccctcgacgacatggtgaaactggtggaagtaccaaacgatggtggcccactgggcattcacgtcgttccatttagtgccagaggagggaggaccttgggtttgctggtgaagaggctcgagaaagggggtaaggctgagcatgaaaacctgtttagagagaacgactgtatcgtcaggattaatgacggcgacctgagaaataggcggtttgagcaagcccaacacatgttccggcaagccatgcgtacccctattatctggtttcatgtagtccccgctgctaacaaagagcagtacgagcaactttctcagtctgagaagaataattactactccagcagattctcacccgattcacagtacatcgataatcggtctgtcaactccgccggactacacacggtccagcgagcaccacgcctgaatcacccacccgaacagatcgattcccactctaggctcccccatagcgcccacccatccggtaaacctccctccgcccctgcctctgccccacagaacgtcttctccaccacagtgtcttctgggtacaatacgaagaagatcggcaagcgtctaaacattcaactgaagaaaggcacagaagggctggggttttccataacctcccgcgacgtcacgatcggcggatcagcccctatctatgtaaaaaatattctaccaaggggtgctgcaatccaggatggtcgccttaaagcaggggacaggttaattgaggtcaatggagtggacctcgtgggaaaaagtcaagaggaagtggtatctcttctgcgatcaactaagatggaaggtacagtctccttgttagtgtttcgccaagaagatgcctttcaccccagggaactcaacgctgagccctcccagatgcagatcccgaaagaaacaaaggcagaggatgaagatatagtgttgactcccgacggcacgcgggagtttctgaccttcgaggtgccactgaacgattccggctcggctgggctcggtgttagtgttaaaggtaacagatcaaaagagaatcacgccgatttaggcatttttgtcaaatctattatcaatggcggagctgccagtaaggacgggaggctgcgcgtgaacgatcagttgatcgcggtgaatggcgagtcactgctcggaaaaaccaatcaggatgccatggaaacacttcgaagaagcatgtcaactgaaggaaacaagaggggtatgattcaactgatagtggcaaggcgaatcagtaagtgtaacgagctcaaaagtcccggttcgcccccagggcctgaactgcccatcgagaccgccctggatgatcgcgagaggcgaatatctcacagcctgtactcaggaatcgagggcctggacgaatcccctagcaggaacgctgctctcagtcgcattatgggcgaatctggaaaataccagcttagccctactgtgaatatgccacaggacgacaccgtgatcatcgaagacgatcgactgccagtgctgcctccacacctctccgaccagtcatcaagcagctcccatgacgatgtcgggttcgtgaccgcggacgccggtacgtgggctaaggccgctatatccgactcggctgattgctcccttagtcccgacgtagatccggtgctggctttccagcgcgaaggcttcgggagacagtcgatgtcagaaaagaggactaaacagttctccgacgcctcccagctcgacttcgtcaagaccaggaaatcgaaatccatggacttaggcatcgcagatgagaccaagcttaataccgtggacgaccaaaaggccggttctccgtccagggacgtgggaccaagtcttggacttaagaaatccagtagcctggaatccctacagactgccgttgcagaagtcacccttaacggagacatacctttccatcgacctcgcccacgcattatcagagggaggggatgcaacgagtcttttcgggcagctattgacaagtcctacgacaaacccgcagtggatgatgacgacgaaggcatggaaacactggaagaggacacggaagagtcttctcgcagcggcagggagtcagtttccacagcctctgaccagccatcacacagcctcgaaagacagatgaacggaaatcaggaaaaaggtgataagaccgataggaagaaagataagaccgggaaggagaaaaagaaggaccgggataaggaaaaggacaaaatgaaggccaagaagggaatgctgaagggtctgggagacatgtttcgcatccaggctaagactcgagagttcagggaaagacaagcgcgtgaaagagactacgccgagatccaggattttcatagaactttcggctgcgatgacgaactcatgtacggtggagttagctcttatgagggatctatggcccttaatgccagaccccagtcccccagagaagggcacatgatggacgctctatatgcacaggtgaagaaaccaagaaacagcaagccttcacccgtggactcgaaccgctctacaccttcgaaccacgatcgcatccagcggttgcgccaggagtttcagcaggccaagcaggacgaagatgtcgaggaccggagacggacatactcattcgaacagccttggccaaatgctcgccctgctacacagtccggcagacatagcgtctcagtcgaagtccagatgcagcgccaacggcaggaagagcgggaatcatctcagcaggcccagcgccagtatagctctctgcccaggcaatctcgaaagaatgcatcaagcgtgagccaggactcttgggagcagaattactcaccgggagaagggttccagtctgcgaaggagaatcctcggtacagtagttatcaggggtccagaaatgggtacctggggggacacggattcaatgcaagggtgatgcttgagacacaggagctgctcaggcaggagcagagaagaaaggagcagcaaatgaagaagcaaccaccctctgaagggccttcgaactatgactcgtacaagaaagtgcaggacccgagctacgctccgccaaaaggcccttttcgccaagatgtccctccaagtcccagccaagtggctagattgaaccgactgcagactcccgaaaagggccgaccattctactcctag

SEQ ID NO: 234054 - DNA, 3933 bp, Artificial Sequence
  Description of Artificial Sequence: Synthetic coding sequence
atgaaggtgacagtgtgtttcgggagaacgcgagtggtggtgccatgcggggatgggcacatgaaggtcttttctcttattcaacaggctgtgactcgttacaggaaagcaatcgctaaggacccgaattattggatccaggtgcatcggctggagcatggagatggaggtattctcgatctagacgatattctgtgtgatgtcgccgatgacaaggatcggctggtcgccgtgttcgatgagcaggaccctcatcacggcggtgatggaacaagtgcgtcctccacagggacccagtcacctgaaatttttggctccgagctcggcacgaacaatgtctccgcttttcagccttatcaggccacatccgagattgaagtgacaccttctgtgctgcgagcaaatatgcctctccatgtgcggcgatccagcgatcctgctcttatcggcctcagtactagcgtgtccgattccaatttttctagcgaggaacctagcagaaagaatcctaccaggtggtcgactacggcgggattcctgaagcagaataccgccggttccccaaagacctgtgatcgaaaaaaggatgaaaactatcggtcgctgcctcgagacacttctaattggtctaaccagtttcaacgcgataatgctcgctctagtttaagtgccagccaccccatggtgggcaaatggctggaaaaacaggaacaggatgaagatggtactgaagaggacaattcacgagttgaacccgttggtcatgcagataccggattggagcatattccaaactttagcctagacgacatggtaaaactcgtggaagtccctaacgacgggggtcctctgggtattcatgtggtccctttttccgccagggggggtcggactcttggcctactggtcaagaggttagagaaagggggaaaagcagaacacgagaatctgttcagggaaaacgattgcatcgtgcgaatcaacgacggagacctccgtaacaggagattcgagcaggcccaacacatgtttcgtcaggctatgcgcaccccaataatatggtttcacgtggtgcccgcagctaataaggaacagtacgagcaactgtctcaatcagagaagaacaattactacagctcccgattcagccctgattcccaatacattgataaccggagtgtcaatagtgctggccttcacactgtgcagagagccccacggttgaaccacccaccagagcagatagactctcacagccggttgccacactccgctcacccgagcggcaagcccccttcggccccagcttccgcccctcaaaacgtgttcagcaccacagttagtagcggttacaacactaaaaaaattggcaaacgcctgaatatccaactgaagaagggtaccgaaggcttgggtttttcaattacctcccgggatgtcaccatcggcggttccgcacctatctatgttaagaacattttaccacgaggcgcagcaatacaggatggccgtcttaaagccggtgatcgcttgattgaggtcaatggagttgatctcgttgggaaaagtcaagaagaggtggtgtccttgcttagaagcacaaaaatggaggggaccgtgagcctgctggtcttcagacaggaagacgcatttcaccccagggagcttaaagccgaggacgaggacatcgtcctgacccccgatggcacgagggagtttctgacctttgaggttcccctcaacgactctggatcagctggccttggagtctcggtcaagggcaatagatcaaaagaaaaccatgcagatcttggaatctttgtaaagtccataatcaacggaggggcagcaagtaaagatggccgtctccgcgtaaatgaccaactaatcgccgttaacggggaatcattactgggaaagaccaatcaagatgccatggagaccttaagacgcagtatgtcaaccgaagggaataaacggggaatgattcagctaatagttgcaagacgcatctccaagtgcaacgaattaaagtctccaggcagtccgccaggccctgagctcccaattgagaccgccctcgatgaccgggaaaggcggatcagtcattctttatacagcggtatcgagggcttggatgagtcaccctccaggaacgcggcactgtcccggattatgggtaagtaccagctgtctccgacggtgaacatgccccaagacgataccgtaattattgaagatgacaggctgcccgtgttacccccacacctgagcgaccagtcaagctcttctagccatgacgacgtcggtttcgtcactgcggatgctgggacctgggccaaggcagcgatttcagatagtgcggactgttcattgagtcctgacgtcgaccccgtactggccttccagcgagaggggtttggcagacagatcgctgacgagactaagctcaacaccgtagacgaccagaaggcaggatcaccatctagggacgtgggcccttctcttgggctaaaaaaaagctcgagtctcgagagcttgcaaaccgccgtcgcagaagtgactctgaacggggatatccctttccatcgcccaagaccaaggataatacgcggacggggttgcaacgagagcttcagggcagccatagacaaatcttatgataagcccgcagtggacgacgacgatgaaggaatggaaacactcgaggaggacaccgaagaatccagtaggtccggcagggagagtgtgtctaccgcgtcagatcagccttctcactccttagaacggcaaatgaatgggaaccaggagaagggagacaagacggaccggaagaaggacaagacggggaaggaaaagaagaaggatcgggacaaagaaaaagacaagatgaaggccaagaaggggatgttgaaggggctaggggatatgtttaggtttggtaaacaccgcaaagatgataagatcgaaaaaacaggtaaaattaaaattcaagaatcattcactagtgaggaggagcggatacggatgaagcaggagcaggagcggatccaggcaaaaactcgcgagttccgcgaacgccaagcacgggagcgggattacgcagaaatccaggactttcatcgtacattcggatgtgacgatgagctcatgtatggcggtgtgtcaagctacgaggggagtatggccctgaacgctaggccacagtcacctcgggagggacatatgatggacgccctgtacgcacaggttaagaagccacgtaacagcaagccgagtccagtcgactcaaatcggagtacccccagcaaccacgaccgaatacagcgactgagacaggagtttcagcaagctaagcaggatgaagacgtggaagaccggcgtaggacatatagctttgagcagccctggcctaatgccaggcctgccacgcagtccggacgccattcagtatcagtggaggtgcagatgcagcgccaaagacaggaagagcgcgaatcgagccagcaagcccagaggcagtattcctctttgccacgtcagtcccggaagaatgcatcttctgtgagccaggattcctgggagcaaaactacagccctggcgaaggcttccaatcagcaaaggagaaccccaggtatagcagttatcagggctctcgcaacgggtatctgggtggccatgggtttaatgcccgagtgatgctggaaacacaggaactcttgcgccaggaacagaggcgaaaagagcagcaaatgaaaaagcaacccccaagtgagggaccttccaactacgacagctacaaaaaggtgcaggacccctcttacgctcctcccaagggtccctttcgccaagatgtgcctccaagccccagtcaggtggcccgactgaataggttacaaactcccgaaaagggccgtccattctactcgtag

SEQ ID NO: 234055 - DNA, 540 bp, Artificial Sequence
  Description of Artificial Sequence: Synthetic coding sequence
atgcagatacctaaagaaaccaaagcagaggacgaggatatagtgctcacccccgacgggaccagagagtttctgacattcgaggtccctctgaatgacagtggcagtgccggtctcggggtgtcggtgaaggggaacagatcaaaggaaaaccacgcagacctcggtatctttgtcaagagcataattaatggcggagcagcgagtaaagacggccgtctgagggtcaacgaccagctgattgctgtcaacggagagtcactgctcgggaagactaaccaggacgcgatggagaccttgagacggtcgatgtccacagaaggaaataagcgtgggatgatccagttgattgtagcccgaaggatatccaaatgcaatgaactcaagagcccgggatcccccccaggaccagaactgccgattgaaacagcgctggacgaccgcgaacgcagaatttcacacagtttgtacagcgggatagagggcctcgacgagtctccatcccgaaacgcagcactcagtcgcattatgggaacctag

SEQ ID NO: 234056 - DNA, 3006 bp, Artificial Sequence
  Description of Artificial Sequence: Synthetic coding sequence
atgaaagttactgtgtgtttcggaaggacgcgggtggttgtcccttgtggtgatggccacatgaaagtgttctcactgatacagcaggcagtgactcggtaccgaaaggcaatcgctaaagatcctaactattggatccaagtccacagactggaacatggagacgggggtatcttggacctcgatgacatcctctgtgacgtcgctgatgacaaggatcggctcgtggccgtatttgacgagcaggacccacaccatggcggagatggcactagtgcctcctctactggcactcagtcaccggaaattttcggttccgaattaggtaccaataatgtgtccgcattccagccttaccaggctacctcagaaatcgaggtcacacctagcgtgttacgcgctaatatgcccctgcatgtgaggagatcttctgatcctgccctgatcggcctgtctactagcgtgagcgattctaacttctctagcgaagagccatcgcgcaagaatccaacaaggtggtctactaccgctgggtttttgaagcagaacaccgctggttctccaaagacttgtgatagaaaaaaagatgagaactacagaagcctccctagggacacaagtaactggagcaatcagtttcaacgcgataacgcgaggtccagtctgtccgcgtcccaccctatggtgggcaaatggctggaaaagcaggagcaggatgaagacggtactgaagaggataattcgagggtggaaccagtggggcatgcggatacaggccttgagcacatccctaacttttccctggatgatatggtgaagctcgtagaagtcccaaatgatggtggcccattggggatccacgtggtgcctttctccgccagaggagggagaacactgggattgctggttaaacgcctcgagaagggcggaaaggcggagcacgagaacctctttcgcgagaacgactgtatcgtgcgtatcaatgatggagacctgcggaatagaaggtttgaacaggcgcagcatatgttccgacaggcaatgagaactcccattatctggttccacgttgttcctgctgccaacaaagaacagtacgaacagttgtcacaatccgagaaaaacaattactacagctcccggttcagccccgactctcaatacatagacaatagatctgttaactccgcaggcctgcataccgtacagagagcccctcggcttaaccatccacccgagcagattgattctcattccagactcccacacagcgcccacccaagtggtaagcccccttcggccccagcctctgctccccaaaacgtgttctccaccactgtgagttctggctacaatacgaagaagataggaaaaaggctgaacattcaactgaagaaaggcactgaaggactcgggttctccataacatctcgggacgtgaccattggcggttcagccccaatctacgtgaagaacatcttgccacggggagcagctatccaggacggaaggctgaaggccggagaccgcctgattgaggtgaatggcgtggacttggtgggaaaaagtcaggaggaggtggtctccctcctacgctctactaagatggagggcacagtatctctgctggttttccgacaagaagatgccttccaccctagggagcttaacgctgaaccttcacagatgcagattcctaaggaaacaaaggcggaggacgaggacattgtgctcacgccagatggcacacgcgagttcctgactttcgaagtaccactgaacgattccgggtcagcagggctgggtgtcagcgtcaaaggaaaccggtcgaaggaaaaccacgccgaccttggtatctttgtaaagagtattataaacggcggtgctgcctccaaggatggaaggctgcgcgtgaatgatcagttgattgccgtcaacggcgagtcactcttagggaagaccaatcaggatgctatggaaacgctgagacggtcaatgagcactgaggggaataaacggggaatgatccaactgatcgtcgccaggcggattagcaagtgtaatgagctgaagtcccctggaagtccgcctgggccagaactgcccatcgagaccgccttggacgatagagaacgcagaatttcccactcactgtactcagggattgagggcctcgacgagagcccttctagaaatgctgcacttagcagaatcatgggaaagtaccagctgtcccctaccgtgaatatgcctcaggatgacaccgtgattatcgaggatgatcgtttgcccgtcctgcctcctcacctgtctgatcaaagttcaagttcatcccacgacgacgtgggattcgtcactgccgatgcgggaacatgggctaaggcagccatcagcgactcggcagattgctctctctcccctgacgtagaccctgtgctggccttccaacgagaaggctttggccgtcagatcgccgatgagacaaagctgaatactgtcgacgaccagaaggcgggttctcctagcagggatgttggccctagcctgggactgaaaaagtcatcatccctggagtctctgcagactgcggtcgctgaggtaactctgaatggcgatattccctttcaccgcccaaggcctcgcatcattcggggacgcggttgcaacgagagttttcgggctgccatcgacaagagctacgataaaccagccgtggatgatgacgatgaagggatggaaacactcgaggaggacacagaggagtcttctaggtccgggagggagtccgtgtccacagcctccgatcagcccagccacagcctggagaggcagatgaatggaaaccaagaaaaaggagataaaactgacagaaaaaaggacaagacagggaaagagaagaaaaaggatcgcgacaaggagaaagacaaaatgaaagctaaaaaggggatgctgaaggggctcggggacatgttctctctcgcgaagctaaagcccgaaaaacgctag

SEQ ID NO: 234057 - DNA, 2967 bp, Artificial Sequence
  Description of Artificial Sequence: Synthetic coding sequence
atgaaggtgacagtgtgcttcggccgtacacgggtggttgtgccgtgcggcgatggtcacatgaaggtgttcagcctgatccagcaggccgtaacccggtaccgcaaggccatagccaaggatcccaattattggatacaagttcatcgcctggaacacggcgacggcggaattcttgacctggatgatattctatgtgatgtagccgacgacaaagatcggcttgttgcggtctttgacgagcaggatccccaccatggtggggatggaacttcagcgtccagcacaggcacacagagccctgaaattttcggctccgaactcgggactaacaacgtgagtgcgttccagccttaccaggcaacaagcgagatagaagtgacgccaagcgtcctgcgagcaaatatgcctctgcacgtacgacgctcatctgacccagccctcattggtttaagtactagcgtcagcgattctaatttttcttccgaggagccaagtcggaagaatcccacacgatggtctaccaccgctggatttctaaaacagaataccgccggatctccgaagacgtgtgataggaaaaaggacgaaaattaccgtagtcttccaagagatacctcaaattggtctaaccagtttcagagagataatgctcggtcctcgctgtcagcctcacatcccatggttggaaagtggctggaaaaacaagagcaggatgaagacgggacagaagaggacaactcccgtgttgaacctgtaggacacgcagacacagggctcgagcatatccccaacttctctttagacgacatggtcaaattagtggaagtgcctaatgatggaggccctctgggtatccacgtggtcccattcagcgcccgtgggggacgtacactgggcttgttggtgaagagactcgagaaaggagggaaagctgagcacgaaaacctctttcgggaaaacgactgcatcgtgcggattaacgatggagatctgagaaaccgcaggtttgaacaggcccagcacatgtttcgtcaggccatgagaacacctatcatctggtttcatgtggtcccagctgccaacaaggagcagtacgagcaactatctcaaagcgagaagaacaactattactcctcccggtttagcccggactcccaatatattgataacaggagcgtaaatagcgctggtttacataccgtccagcgtgcccctcgcttgaaccaccctcctgaacaaatcgacagtcactctagactgccccacagcgcacaccctagtgggaaacccccttctgcacccgctagcgctccccagaatgtcttctctaccacagtctccagcggatataatactaaaaaaatcggcaaaaggttgaacattcagctgaaaaagggaactgagggtttagggtttagtataacatcccgcgacgtgactattggtggctctgctcctatttatgtgaaaaacattctgccacgcggagcagccattcaggatgggcgactcaaagctggcgataggttaatcgaagttaatggtgttgacttggttggcaagagccaagaagaggtggtttctcttttacgatcaactaaaatggagggaacagtgtccctcctcgtgttcagacaagaggatgcatttcacccgagggagctgaaagccgaggatgaagacatagtcttgactccagacggcacgagagagtttttgacctttgaggttccactgaatgacagcggttctgcaggcctcggagttagtgtgaaggggaatcgatccaaggaaaaccacgcagatctcggcatttttgtgaagagtattattaacggcggagccgcttcgaaagacgggaggttacgggtgaacgatcagttaatagcggtgaatggagaaagtctgctggggaagaccaatcaggatgcaatggagactctgaggcggtctatgagcactgagggcaataaaagaggaatgatccagctgattgtagctcggcgaattagcaaatgtaacgaattgaagtcacctggtagtccacccggaccagaacttccgatcgagaccgcattagatgatcgagagcgcagaattagtcatagtctgtatagtggaatagaagggctcgacgagtctcccagtcgcaatgctgctctaagcagaatcatggggaaataccagctctcccccaccgtgaacatgcctcaggatgatactgtcatcatcgaggacgaccgccttcccgttctgcctcctcatctgagcgaccagagtagctccagcagtcacgatgacgtcggtttcgtgacggccgacgcagggacctgggccaaggctgcaatctccgatagtgcagattgttcactgtctcctgatgtggaccctgtgctggcttttcagcgggaaggcttcgggcgacagatagccgacgagaccaaactcaacactgtggatgaccagaaagctggaagtccctccagagatgtaggaccttccctggggctgaagaagagctccagtctagagagtctccagactgcagttgccgaagttacattaaatggtgacataccatttcaccgaccacgaccacggattatacggggaaggggctgcaacgaaagcttcagggcagctatagataagagctacgataagccggctgtcgatgacgatgacgagggaatggaaaccttggaggaggacactgaggaaagtagtcgcagcgggagagagtcagtgagcacagctagcgaccagccatctcatagtctcgagcgccagatgaatggaaatcaggagaagggggataaaactgaccggaaaaaggacaagaccggaaaggagaagaagaaggatcgagacaaagaaaaggacaagatgaaagccaagaaaggcatgctaaagggactgggcgacatgttctcactggcaaagttgaaacccgaaaagaggtag

SEQ ID NO: 234058 - DNA, 4062 bp, Artificial Sequence
  Description of Artificial Sequence: Synthetic coding sequence
atgaaggtgaccgtttgtttcggtcgcactagggttgttgtcccttgcggtgatggccacatgaaggtgtttagcctgattcaacaggcggttacccgttaccgtaaagccatcgccaaggatccaaattattggatccaagtgcacaggctcgaacatggggatgggggaatcctggatctggacgacatcttgtgtgacgtcgcagatgacaaagaccggctggtggccgtgtttgacgaacaggacccccaccatgggggtgacggcacttccgcctctagtacaggcacacaatccccagagatttttggatccgaactgggtacgaataatgtgagtgctttccagccataccaggcaacaagcgagattgaggtgacgccctcggtcctgagggctaatatgccactccacgtaaggcggtcttccgacccagctcttattggtctgagtacaagcgtgtctgatagcaatttcagctccgaggaaccatctaggaagaacccgacaaggtggagtaccactgctgggttcctgaaacagaacaccgccggaagcccgaagacttgtgacaggaaaaaggacgaaaattatagaagcctccctcgcgatacaagcaattggtccaaccaattccagcgcgataacgccaggtcaagcctgtcggcgagccaccccatggttggaaagtggctcgaaaagcaggaacaggatgaagatggaactgaagaagacaattcaagagtggaaccagttggccacgctgatactggcttagagcacatacccaacttttctctagatgacatggtcaagctcgtggaggtgccaaatgatggagggccactggggatccacgtggtgcctttcagtgcccgagggggacgaacattgggtctgcttgtcaagcgccttgagaaggggggtaaagccgaacacgaaaacctgtttcgtgagaatgactgcatcgttagaattaatgacggggacctgaggaataggaggtttgagcaagcccaacacatgtttcgacaagccatgaggactcccataatctggttccacgtggtgccagctgccaataaggagcaatacgagcagctttcccaatccgagaaaaataactactattctagccggttctcccccgatagccagtacatcgataatcgcagtgttaactcggcgggtttgcatacagttcagcgcgctcctcgcctgaatcaccctcccgagcagatcgactcccattcccgactgccacactcagcccacccttctggtaagcctcccagcgctcccgcttcagcgcctcaaaacgtttttagtaccacagtgagttctggatataataccaaaaagattggtaagcgcttgaatattcagctcaagaagggcaccgaaggcttgggttttagtatcacttcccgcgacgtgacaattgggggatctgctcccatttacgtgaagaatattctccctcggggagcagctatccaggatggtagactcaaggccggtgaccggttgatcgaagtgaatggcgtcgatcttgtcggtaagtcccaagaagaagtcgttagccttctgcgcagtacaaagatggaaggcacagtctctctgttagttttccggcaggaggatgcctttcacccaagggagttgaatgccgaaccgagccagatgcagatccccaaggagacgaaggccgaggatgaagacattgtgctcactcccgacggcaccagggaattccttacgttcgaggtccctctcaatgactccggtagcgcaggactgggagtatctgtcaagggaaatcggagtaaggagaatcatgccgatctcggcatcttcgtgaaaagtatcataaatggaggggctgcctccaaagatggaagactgagggttaatgatcagctgatcgctgtcaatggggagtctctcctgggaaaaaccaaccaggacgcaatggaaaccttgagaagatccatgagtaccgaaggcaataaacggggaatgatccagctgatcgtagcaaggagaatctcaaagtgtaatgaacttaaatcccccggaagccctcccggaccagaactccccattgaaacagcgctggacgaccgagaacggcgtattagccattctttgtatagcggaattgagggtctcgatgagagtccatccagaaatgccgcactgtctcgtatcatgggcaaatatcaactgtccccaaccgtgaacatgccgcaggatgacactgtgatcatcgaggacgatcgcttacctgtcctgcccccacacctgagcgatcaatccagtagctccagtcatgatgatgtagggtttgttaccgccgatgcaggaacatgggccaaagcagctatcagcgactccgccgactgctcactgtcaccagacgtcgatccagtgctagccttccagcgtgaaggcttcgggcgtcaatccatgtccgagaaacgcacgaagcagtttagcgatgctagtcagctggactttgtgaaaacccgtaagtcaaagtctatggacctgggaatcgccgacgaaactaaattgaatacagttgatgaccagaaggccggttccccttctagagacgtcggaccatccctgggtctcaagaaatcatcgtccctggaatctttgcaaacagccgttgccgaagtgaccctcaacggggatattccctttcaccgaccgcgacccaggatcatcagagggcgaggatgcaacgaatccttccgggctgcaatcgacaagtcttatgataagccagccgtcgatgacgacgatgagggcatggagactctggaggaggacactgaggaatcctctcgctcgggaagagaatccgtgtcaaccgcctccgatcagcccagccatagccttgagcggcagatgaacggaaaccaggagaagggagataagaccgaccggaagaaagataagaccgggaaagagaagaaaaaagatcgtgacaaggaaaaggacaagatgaaggccaagaagggcatgctgaaaggtctcggggatatgttccgcttcggcaaacaccgcaaagacgacaagattgaaaagacaggaaagatcaagattcaagaaagctttactagtgaggaggaacgtattcggatgaaacaagagcaagagcggattcaggctaagacccgggaatttcgtgaacgccaggccagggagagagactatgccgagattcaggatttccataggacttttggatgcgacgacgaattgatgtatggtggcgtgagctcttacgaggggtcaatggcccttaacgcccgacctcaatcaccgcgtgagggtcacatgatggacgcactctatgctcaggtcaagaagccacggaactccaaacccagtccagtggacagcaatcggtccactccgtctaaccacgaccggattcaaaggcttaggcaagagttccaacaggcgaaacaggacgaagatgtggaggatagacgcaggacctactcttttgagcagccatggccgaacgctagaccggctacccagagcggccgtcattcagtgtctgttgaagtacagatgcagagacagcggcaggaagaaagggaatcatctcagcaggcacagaggcagtacagcagcctcccgaggcaatcacgcaaaaacgcttcctctgtcagccaggactcatgggaacagaactactctccaggggaaggctttcagtccgcgaaagagaaccctcgatactcttcctatcagggatcacggaatggatacctgggtggccacggatttaacgcgagggtcatgctggaaacccaagaactgctgcgacaagagcagcggcgaaaagaacagcagatgaagaagcagcctccctccgagggcccatctaattatgacagctataaaaaggtgcaggatccttcatatgccccacctaaggggccttttaggcaggacgttcccccttctccatcccaggtcgccaggctgaaccgcctacagacccctgaaaagggcaggcccttttattcttag

SEQ ID NO: 234059 - DNA, 4071 bp, Artificial Sequence
  Description of Artificial Sequence: Synthetic coding sequence
atgaaggtcactgtgtgctttggccgtacgagggtggtggtgccctgcggcgacggacacatgaaggttttcagtttaatccaacaggctgtgacccgatacaggaaggccatagcgaaagaccccaattactggattcaggtgcaccgattagaacacggagatgggggaattctagacctcgacgacattctgtgcgatgtcgctgacgataaggaccggcttgtggcagtatttgatgagcaggacccccaccatgggggtgacggcactagcgccagtagtacaggcacgcagtccccagagatcttcggcagtgaacttggcacaaacaatgtttccgctttccagccctatcaggctacctctgagatcgaagtgactccaagtgttttgcgagcaaatatgcctctgcacgtcagacggagttctgatccagcccttattgggttgtcaaccagcgtcagcgattccaacttttcctctgaggagccttcaagaaagaaccccactaggtggagtactacagccggttttctgaaacagaataccgctggctcaccgaaaacctgcgacaggaagaaggacgagaattatcggtcccttcccagagacacctcaaattggtccaaccagtttcagagagataacgcccgaagctcactgtctgcttcacatccaatggtgggaaagtggctggagaaacaggaacaggatgaggacggaacagaggaggataacagtcgcgtagaacctgtgggccacgctgacaccgggttagaacacatccccaacttcagtctggacgacatggtgaagctagtggaagtcccaaacgatggcggaccattaggcatccacgtggtacccttcagcgccagagggggaaggactctgggacttttagtgaagcggctagagaagggcggtaaagccgaacatgagaatctcttcagggagaatgactgcattgtccgcatcaacgatggggatctgcgcaaccggcgtttcgaacaggctcagcatatgttcagacaagctatgcgaacgcccatcatctggtttcacgtggtcccggcagccaataaagagcagtatgagcagttgagccagtctgaaaagaacaattattatagcagccgcttcagccccgattcacagtacatcgacaacagatccgtgaactccgctgggctgcacaccgtacagagggccccacggctgaaccatccaccggaacagatagatagccatagtaggctgcctcactccgcccacccaagtgggaaacctccatctgctccggctagtgccccacagaacgttttcagcacgactgtgagctcagggtataacacaaagaagattggtaagcgcctgaatattcagctcaaaaagggcacagagggcctgggcttctccattaccagcagagatgttacgatcggagggtcagctcccatttacgtgaagaacattcttcctcgaggcgctgcgatccaggatgggaggcttaaagccggagacagactaatcgaggtgaatggggtcgacctggtcggtaagtcccaagaagaggtggtgagccttcttcggtcaaccaagatggaaggaacagtttcactcctagtgttccggcaagaagacgctttccaccccagggaactgaatgctgagccatcccagatgcagataccaaaagagaccaaggcagaggacgaggacattgtactgacgcctgacggtaccagagaatttttaaccttcgaggtccctttgaatgactccggctccgcaggactgggggtatccgtgaaagggaaccgttcaaaggaaaaccacgcggacctcggaatctttgtcaaatcaataataaatgggggtgcagcatcaaaggacggaaggttgagagtgaatgatcaattgattgctgtaaatggggaatctctcctggggaagacaaaccaggatgccatggagactctgagacgcagcatgtcaacagaaggtaacaagcgcggtatgattcagctgattgtcgccaggcgcatatccaagtgcaacgagttgaagtctccaggatctccaccaggtcccgagctgccaattgagactgctttagatgaccgtgaaaggcgcatatctcactcgctctattctggaatcgaggggctggatgagtcaccaagcagaaatgctgctctatcccgaattatgggggagagcgggaaatatcagctctcaccaactgttaacatgccgcaggatgataccgtcattatcgaggatgatagactacccgtgctgccccctcacctaagcgaccagtcatcctccagctcccatgacgacgtgggcttcgtgaccgcagacgctggcacatgggccaaggcggcaattagcgattcagccgactgctcactctctccagacgtcgacccagtccttgccttccagagagagggctttggtaggcagtccatgtctgaaaaacgcaccaagcagttcagtgacgcttcacagttagattttgtgaaaacgcggaagtctaaaagcatggacctgggcatagccgacgaaactaagctcaacacagtggacgaccagaaggccggttctccttcgcgcgacgtcggcccatcactcggcctaaagaagtcatcttcactcgagagtttgcagacggctgtcgcagaagttaccctgaatggcgatattccatttcaccgcccacggcctagaataatcagaggcaggggctgcaatgagagtttccgcgctgctatagacaaatcctatgacaaacctgctgtggatgatgatgacgaggggatggagactctcgaagaggacaccgaggagagctcgaggtcggggagagagagcgttagcacggcttccgaccaaccgtcacacagcctggaacgacagatgaacgggaatcaggagaagggagacaagaccgatcgaaagaaagataaaacaggaaaagagaagaagaaagatagggacaaggagaaggataagatgaaagccaaaaagggcatgcttaagggactgggagacatgtttcgatttgggaaacatcgaaaggatgacaagattgaaaagacgggtaaaataaaaatccaagagtccttcacctctgaggaagagagaatcagaatgaaacaggagcaggaaagaatccaggcgaaaacccgggagttcagagagcggcaggccagagaaagagattatgccgagatccaggactttcaccggacctttggctgcgatgatgagctcatgtatggaggcgtttcatcctatgagggctctatggcactgaatgccaggcctcaaagtcctagagaaggacatatgatggacgcactttatgcccaggtgaaaaaacccaggaattccaagcccagccccgtggatagcaatcgttctaccccctccaatcacgaccgtatccaaagattgcgacaggaattccagcaggccaagcaggatgaggacgtggaggaccgcagaagaacatacagctttgaacagccgtggcctaacgctagaccggcaacacagtctgggcgacattcagtatcagtagaggtccaaatgcagagacagaggcaggaagaaagggagtcgagtcagcaagctcagcgccagtactcgagtctgcctagacagtccagaaagaatgcctcttctgtgtcgcaagacagctgggaacaaaattacagccctggcgagggatttcagtctgcaaaagaaaatcccagatattcatcttatcaaggaagtcgcaatggttatctaggaggccacggattcaacgccagggtaatgctcgagacacaagaactgctccgccaggaacagcgaagaaaggagcagcagatgaagaagcagcctccaagtgaagggccttctaattatgatagttacaagaaagtgcaagatccttcctacgcaccacccaagggtccctttcgccaggatgtccctccgagccccagccaggtcgcccgtcttaaccgcttacaaacacccgaaaagggccgacctttttactcttag

SEQ ID NO: 234060 - DNA, 3891 bp, Artificial Sequence
  Description of Artificial Sequence: Synthetic coding sequence
atgaaggtgacggtgtgcttcgggaggaccagggtcgttgtgccctgcggtgatggacatatgaaagtattttcattaattcaacaggcagtcacacgatataggaaggctatcgctaaagacccgaactactggattcaggtgcacaggcttgagcatggagatgggggtattcttgatttagacgatatcctgtgcgacgtggctgatgacaaagaccgtttggtagctgtgtttgatgaacaagaccctcatcatggaggcgacggcacttcagctagttctacagggacacagtctcctgagatctttgggtccgagctaggtaccaataacgtgtctgcctttcagccataccaagctacttccgagattgaggtgacacccagcgtgctgagagctaacatgcctctccatgtccggcgatcctccgatccggctcttattggcctgtccacttctgtaagtgatagcaacttttctagcgaggaaccgtctaggaagaaccctacccggtggagcaccaccgccggatttctcaagcagaatacagcgggttcacccaagacttgtgaccgcaaagatgaagacggtactgaggaagataactctcgggtggaacccgtgggccatgccgataccggattggaacacattccgaacttctccctggacgatatggtgaagctcgtggaggtgcctaatgatgggggtcccctcggcattcatgtcgtgcccttctccgctaggggtggccgtaccctgggcctgttggtgaaacgtttggagaaaggcggaaaggctgaacacgagaatctgttccgcgaaaacgattgcatcgtgcggattaacgatggcgacctgcgtaacaggcggtttgaacaagcccaacatatgttccgacaggccatgcgcactccaataatttggtttcacgtggttcctgctgccaacaaggaacaatacgagcagctgtcccagtccgagaagaacaattactattcttcccgattttcccctgatagtcagtatatagacaatcgctccgtgaacagcgctgggctccacaccgtccaaagagcccctcgcctgaatcacccccctgagcagatcgacagccactctcgtttacctcactcagctcaccccagcggcaaacccccaagtgcacctgcaagcgccccacagaacgtcttcagcacgaccgtgtcgagcggctacaacactaagaagataggcaagcggttaaacattcagctcaagaagggaactgaaggccttggctttagcataacctctagggacgtgaccatcgggggttctgcgccaatttatgtgaaaaacattttgccaaggggagccgcaattcaggatgggcgacttaaagctggggatcgcctcattgaagtgaacggcgtcgacctcgtgggcaagtcccaggaggaagtggtttccctgcttaggagcaccaagatggagggaaccgtgtcgctcctggtctttaggcaggaggacgcctttcacccacgcgagctcaaagccgaggacgaggacattgtactcaccccagatggcacacgcgagtttctcacctttgaggtccctttaaatgactccggctctgctggcctcggcgtgtctgtcaagggcaacagatctaaggagaaccacgcagacctcggaattttcgtcaagtctatcataaacgggggagcagcctccaaggatggtaggttgcgcgtgaacgaccagctgatcgcagtgaacggcgaatctcttcttggtaaaaccaatcaagatgctatggagactctaaggcgctccatgtcaactgagggcaacaagcgaggcatgatccaactgattgtcgccaggcggatttctaaatgcaatgagctgaagagccccggtagtccacccggacctgagctgcctatagaaactgcattggacgaccgcgaaaggcggatatcccactctctgtacagcgggatcgaggggctcgatgaatcccctagcagaaacgcagcactctctcgaattatgggaaaatatcagctgtctcccacagtgaatatgccgcaggatgatactgtcatcatcgaagatgacagactgcctgttttgcccccacacctgagcgaccaatcctcatcctccagccacgacgatgtgggcttcgtgaccgctgacgctgggacttgggccaaggccgctatcagcgattctgcagactgctctctgtcccccgacgtagaccccgtgctggccttccagcgggagggcttcggaagacagtctatgtctgagaagcgtactaagcagttttctgacgcatctcaactcgacttcgtgaaaactcgaaagagcaagtctatggatttagggatagcagacgaaacaaagctcaacactgtcgatgatcagaaggctggctctccgagccgtgacgtcggtccctctctagggctgaagaagtctagttcgttggaatcactccagactgcggttgccgaagtgacattgaatggcgacatccctttccaccggcctcggccaaggatcatcaggggccgaggttgtaatgagtcattccgtgccgctattgacaaaagctatgataagccagctgttgacgatgatgatgaagggatggaaaccctcgaggaggacacagaagagtcttcgcgatccgggagagaaagtgtgtctaccgctagcgaccagcccagtcactctctcgagcgacaaatgaatggcaaccaggagaaaggcgataagactgacaggaagaaagacaagacaggtaaagagaagaaaaaggaccgcgacaaagagaaagacaagatgaaagccaagaagggaatgctcaaaggattaggcgacatgtttaggttcggtaagcataggaaagatgataagattgaaaagacaggtaaaatcaagatacaagagtcattcaccagtgaagaagaacgcatccggatgaaacaagagcaagagcgcattcaggccaaaactagggaatttagggaacgccaagctcgcgaacgagattatgcggaaatacaagactttcataggacattcggctgcgatgacgagctgatgtacggcggagtgtcctcttatgagggttccatggccctaaatgcacggcctcaatcccctcgggaagggcacatgatggacgctctgtatgcccaagtgaagaaaccacgtaattcaaaaccgtctccggttgattctaaccggagcaccccaagcaatcatgataggattcagagactgagacaggaatttcagcaggccaagcaagatgaagacgtggaagacaggagacggacctactcctttgagcaaccttggcccaacgctcggccagccacacagagtggccgacattcggtctccgtggaggtgcagatgcaacgccagcgacaggaagagagggagtccagccaacaagcccagagacagtactctagcctgccccgacagagtcggaagaacgcctcctccgtctcacaggatagctgggagcagaattattccccaggggaagggtttcagtcggctaaagagaaccctcggtacagcagctaccaggggagtcggaatggctacttagggggtcacgggttcaacgctcgcgtgatgctagaaacccaggaattgttgcgccaagagcagcgacgtaaggagcagcagatgaagaagcagcctcccagcgagggcccaagcaattacgactcttacaaaaaagtgcaggacccctcctacgcaccgcctaaggggccatttaggcaggatgtgccacccagccccagccaagtggccagactgaatagactccagacacccgagaagggtagaccattctacagttag

SEQ ID NO: 234061 - DNA, 3735 bp, Artificial Sequence
  Description of Artificial Sequence: Synthetic coding sequence
atgaaggtcacagtctgtttcggtaggacccgcgtggtggtgccatgtggcgatggccacatgaaagtgttttcacttatacagcaggctgtcacccgttaccgcaaagccatcgccaaggatccaaattattggattcaggtgcaccgcttggaacacggcgacggaggcattctggacctggacgatattctgtgtgacgttgccgatgataaggaccgactggtggccgtcttcgacgaacaagatcctcaccacggtggcgacggcaccagcgcttcaagtactggcacccagtctcccgagatttttggatccgaactggggaccaacaacgtctctgccttccaaccctaccaggccacaagcgaaatcgaggtaacgccaagcgtgctgcgggcaaatatgcccttgcatgttcgccgttcaagcgaccctgcgctgatcggcctgagcacaagcgtcagtgactccaacttctctagcgaggaacccagtaggaaaaatcctacaaggtggagcacgacggctggctttctgaagcagaacaccgccggaagtccaaaaacttgtgaccggaaggatgaggatggtactgaagaggacaattctcgggtcgagccagtgggtcacgccgatacggggctggaacacatcccaaacttctccttagatgacatggtcaagctggtggaggtgccaaatgacggtgggcctctgggaatccatgtggtccctttcagcgccagagggggacggacactgggactgcttgttaaacggctggagaaaggcggaaaggctgagcatgagaacctattcagagagaacgactgtattgtaaggattaacgacggagacttgaggaatcgaaggttcgagcaggcccagcacatgtttcgccaggccatgcggacaccaattatatggttccatgtggttcccgctgcaaataaggagcagtacgagcagttgagccagagtgaaaagaacaattactacagttcgagattttctccagatagtcagtatattgacaataggtctgtcaattcagcaggcctccacaccgtgcagagagctcctagactaaatcatcctcctgagcagatcgactcacattcccgattgcctcattccgcccaccccagcggaaagcctccctcagcccctgccagcgctccgcagaacgttttctccacaactgtgtcaagcggctataataccaagaagattggcaaacgactgaatatccagcttaagaagggaaccgagggattgggtttcagcatcactagcagggacgtcactatcggaggaagcgctcctatatatgtgaaaaatatcctgccacgcggagcggcaattcaggacggcaggctaaaagctggggacaggcttattgaggtgaacggcgtagatctagtgggtaagtcacaggaggaggttgttagcttgctgcggtccacaaagatggaaggcactgtgtcactccttgtgtttcggcaagaagacgccttccatcccagagaactgaaagctgaagacgaggacatagtgcttacccccgatggaaccagagaatttctgaccttcgaagttccactgaacgattctggatcagccggtctgggcgtttcagtgaagggaaatcggtcaaaagagaaccatgctgacctaggcatcttcgttaagtctattataaacgggggtgcggcatcaaaggacggccgtttacgggtgaacgatcagctcatcgctgttaatggggagagtttacttggaaagacaaaccaggacgctatggagacccttcgaagaagcatgtccaccgaggggaacaaacggggaatgatacagctcatcgtcgccagacgcatttcgaagtgtaacgagctcaagtcaccgggaagccctccaggaccagaactgccaatcgaaacggcgcttgacgaccgcgaacggaggatttcacacagcctgtatagcggaatcgagggcttggacgagtctccaagcagaaacgccgctctctcccgcataatgggaaagtatcaactctccccgacagtgaatatgccgcaggacgataccgtgattattgaagatgatcggttgcctgtgcttcccccacacctctccgaccagagttcaagctcctcccacgatgacgtggggtttgttacagcagacgccggaacatgggcaaaggcagcaatcagcgacagtgccgattgttccctttctccagacgtcgatccagtcctagcttttcagagagagggctttggccgtcaaagtatgtcagagaaaaggacaaaacagttctcagatgctagccagctggactttgttaagactaggaagtcgaagtctatggatctcggaagcagcccatcgcgagatgtcggtcctagcctcggcttaaagaagtctagcagtctggaatcactccagacggctgtggcagaggtgacactgaacggggatattccctttcatcgtccacgcccaaggatcatacgaggaagagggtgcaatgaatcctttagggcagctatcgacaagtcttacgataaacctgcagtggatgatgacgacgaggggatggagacattagaggaggataccgaggagtccagccggtcgggtagagaaagcgtgagtacagcgagtgatcagccttcacattctctcgaacgtcagatgaatggtaatcaagaaaagggcgataagacagaccggaaaaaggataagaccgggaaggaaaaaaagaaagacagggataaagaaaaggataaaatgaaggccaagaaaggtatgttgaaaggcctcggagatatgttccgaatccaagctaagacgcgggaattccgcgagaggcaagcgcgagagcgagactacgcggagatccaggattttcacaggacatttggttgtgatgacgaattgatgtacgggggagttagctcttacgaaggctctatggccctgaacgcccgacctcagtcccccagagagggacacatgatggacgccctctacgcccaggtcaagaaaccgcgtaacagcaagccgagtccagtcgatagcaatcggtctactccaagcaaccatgataggatccagcgactgcgacaggaattccagcaggctaagcaggacgaggatgtggaggatcgcagaagaacttattccttcgaacagccctggccgaacgcccgtccagccacacagagcggtcggcacagcgtgagcgttgaagtgcaaatgcagagacaaagacaggaagaacgcgaatcatctcagcaggctcaacgtcagtacagcagcctgcctaggcaaagtaggaagaacgctagcagcgtgtcccaggatagttgggagcagaattactcccccggtgagggatttcagagtgccaaggagaaccccaggtattctagctaccagggctcccgcaacggatatcttgggggtcacggttttaatgcaagggtgatgctggaaacacaggagctcctcaggcaggagcagaggcgcaaggagcagcagatgaaaaaacagcccccatctgaaggccctagtaattacgactcatacaagaaggtgcaggatccatcttatgctccacccaagggtccgttccgccaggacgtacctccatctccatcccaggtcgctcgtctgaatcgactccagacccctgaaaaaggcaggcctttttattcatag

SEQ ID NO: 234062 - DNA, 2244 bp, Artificial Sequence
  Description of Artificial Sequence: Synthetic coding sequence
atggtgaaactcgttgaggttcccaatgatgggggaccactcggcattcacgtcgtcccattttctgccagaggcggtagaacccttggtttgcttgtgaaaaggttggagaagggagggaaggcagaacacgagaacctgttccgggagaacgattgtatcgtacgcataaatgatggagatctgcgcaaccgaagattcgagcaagcccagcacatgttcagacaggcaatgcgcacccctatcatatggttccatgtggtccctgctgcaaacaaggagcagtacgaacaactctctcagtcagagaaaaataattactatagctcaaggttctccccagattcccagtacatcgataaccggtccgtgaacagtgccggacttcatacagttcagagagcccctcgtctgaatcatccaccagagcagatcgacagccacagcaggttaccccactctgcgcatccatctggtaagcccccttctgcacctgcctcagcccctcagaacgtgttcagtacaacggtgagtagtggctataacacaaagaaaattggaaaaaggcttaacattcagcttaagaaaggcactgagggactcggcttttctatcacgagccgggacgtcactatcggcggttccgcacctatctacgtcaaaaatatcctccccagaggagcagcaatacaggacgggaggctgaaggccggtgataggctcatagaggttaacggagtggacctggttggtaagtcccaagaggaggtcgtgagtttactgcggtccacgaagatggagggaactgtgagccttctggtctttaggcaggaagacgccttccatccacgagagctcaaagctgaggacgaagacatagtgctaactcctgacggtacgagggaattcctgacgtttgaggtgcccttgaatgacagcggctcagcgggacttggtgtttcagtcaagggcaacagaagcaaggagaaccacgccgatcttggtatcttcgtgaagtcaattatcaacggaggggcagcatcgaaggatggcagactgcgcgtgaatgaccagctgatcgccgtcaatggcgagagcctcttgggtaaaacaaatcaggatgcaatggagacactgcgcagatctatgtcgactgaggggaacaaacgaggcatgatacagttgatcgtggcccgacggatctcaaaatgcaatgagctgaaatcaccaggatcaccacctggacccgagttacctatcgagactgccttggatgatagggaaaggcgaatctcccatagcctatactccggaattgaggggctggacgagagtccaagccgaaacgcagccctcagcagaattatgggtaagtatcagctcagccccacggttaacatgccacaggatgacacagtgatcatcgaagatgatagactgcccgtgctgcctccacatctgagtgaccagtcaagctcctctagccacgacgacgtgggctttgtgactgccgatgccggaacttgggcaaaggccgcaattagtgattcagccgattgctccctttcccctgacgtcgaccccgtcctcgctttccagagggaaggtttcggccgacagagcatgagtgagaagcgtacaaaacaatttagcgatgcttctcaattggactttgttaaaaccaggaagtcaaagtcaatggatctcgtagccgatgagacgaagttgaataccgtggatgaccagaaggcaggatctcccagtcgggacgtgggccctagccttggcttgaaaaagagttccagcctggaaagcctacagacagctgtggctgaagtcacacttaatggcgacattccgtttcaccgacccaggccacgaatcattaggggaaggggttgcaacgaatcatttcgggctgcaatcgacaagagttatgacaagccagcagtggacgacgatgacgagggtatggagaccctggaggaagacaccgaagagagttccaggagcggtcgggaatctgtcagcactgcctctgaccagccatcccactctctggagcgacagatgaacgggaatcaggagaaaggcgataaaaccgacaggaagaaggacaaaacgggcaaggaaaaaaaaaaggaccgcgataaggagaaagacaagatgaaggccaagaagggcatgctgaagggtctcggcgatatgttttccctggcaaaactgaaaccagaaaagcgctag

SEQ ID NO: 234063 - DNA, 3801 bp, Artificial Sequence
  Description of Artificial Sequence: Synthetic coding sequence
atgaaagtgacagtctgtttcggtcgtactcgagttgtcgtcccctgcggggacggtcacatgaaggtattttcccttattcagcaggccgtgaccagataccgcaaagcgatcgcgaaagacccgaattactggatccaggtccatcggctggagcacggggacggcggtattctggacctggatgacatcttatgcgatgtggctgacgacaaagataggctagtggccgtgtttgacgagcaagacccacaccacggtggtgatgggacatccgcctcatcaactggaacccagtctccagaaatatttggaagcgagctggggacaaacaatgttagtgccttccagccctaccaggctacgagtgagatcgaagtcacacccagcgtgctcagggctaacatgcccctgcacgtcagaaggagttccgatcccgcactgatcggcctgtcaacaagcgtgtctgatagtaacttctcaagtgaagagccctctcgcaaaaaccctaccaggtggagcaccaccgctggatttctcaagcaaaataccgccggaagccccaagacgtgtgatcggaaagatgaggacggaacagaagaggacaatagtcgtgtagagcctgtgggacatgctgacaccggattggagcatatacctaacttctcgctggatgatatggtgaagctggttgaagtgcccaacgacggaggccctctcggtatccacgtggtgcccttcagcgcaagaggcggaaggaccctcgggctgctggtgaaacgtctggagaaaggcggaaaggccgagcacgaaaatcttttccgcgagaacgattgtatcgtgcggatcaacgacggcgatctcagaaaccgtcgattcgagcaggcacagcatatgttcaggcaggcaatgaggaccccaatcatctggttccatgtggtaccagcagcaaataaggaacagtacgagcagctgtcccaatcagaaaagaataactattactcatcccggttttcaccagacagccaatacatagacaatcggtccgtaaacagcgctggtctgcacaccgttcaaagggccccacggctgaaccacccgccagaacagatagactcccacagccggctgcctcattctgctcatccctccgggaaaccacccagcgcacctgcttctgccccacaaaatgtgtttagcacaacagtgtcttctggatacaacaccaagaaaatcggcaagaggctgaacattcagttgaaaaagggtaccgagggactcggtttctcgataacgtctcgggatgtgacaatcggcggttctgccccaatttacgtgaagaacatcttaccacggggtgccgcaattcaggacgggagattaaaagctggtgacaggctgatagaagttaacggcgtggaccttgtgggtaagagccaagaggaggtggtgtcacttctgcgctctacaaagatggagggaactgtgtccttgctcgtatttagacaggaggacgcgttccacccgagggagctcaaagcagaggacgaggacatcgtcctcactcccgacggcaccagggagttccttaccttcgaggttcctctgaatgatagcgggtctgctggcctaggagtgagtgtcaaaggcaatcgatctaaggagaatcatgctgatctggggattttcgtgaaaagcattattaacgggggagcggctagcaaggacggcagactgcgggtgaatgatcagctgattgctgtgaatggtgagtcactcctcggtaaaaccaaccaagacgccatggaaacgctgaggagaagcatgtccaccgaaggcaataagagaggaatgattcagctcattgtggccaggcgcatctcgaaatgtaacgagctgaaatctccagggtcgcccccaggcccagaactgcccatcgagactgcgcttgatgaccgtgagcggaggatttctcatagtctgtatagtggcatcgaaggactcgacgagtccccatcacgcaacgcagccctctcccggatcatgggcaaataccagttatcccccactgtcaatatgccgcaagacgataccgttataatcgaagacgatcgtctgcccgtgctcccacctcacctgtcggatcagagctcatctagcagccatgatgacgtgggcttcgtgaccgccgacgcgggtacttgggccaaggcagctatatcagatagcgccgattgttctctctcgccggacgtggaccccgtactggccttccagcgcgaggggtttggcagacagattgccgatgaaacaaagctgaacacagttgacgaccaaaaggcaggttccccgtcccgggacgttggaccctcattgggcctgaagaaaagcagctccctggaaagtctccagactgccgtcgcagaggtgacccttaatggagacataccatttcatcgacctaggccaaggatcatacggggacggggttgcaatgaaagctttcgggctgctatcgacaagagctatgacaaaccagccgtggacgacgacgacgagggaatggagactctggaggaggatactgaagagagctcgcgaagtggtcgggaaagtgtgagcactgccagcgatcaaccgagtcactctctcgagaggcagatgaatggcaaccaggaaaagggggacaaaaccgatcggaagaaggacaaaacaggaaaggagaagaagaaagatagagacaaggaaaaagacaagatgaaagccaaaaagggtatgctgaaggggctgggtgatatgtttaggtttgggaaacaccgaaaggatgacaagatcgagaagactggcaaaatcaagatccaagagtcatttacaagtgaagaggaacggatcaggatgaaacaagagcaagagcgtatccaggccaagacacgagaatttagagagcgccaggctagggagcgggactacgccgagatacaagatttccacagaacttttggctgcgatgacgaactgatgtacggtggcgtgtccagctacgagggcagcatggctctgaacgcacgccctcagtctccacgcgaaggccatatgatggatgccctgtacgcccaggtgaagaagccaagaaacagcaagcccagccccgtggattccaaccgctcgacacccagcaatcacgacaggatacagcgcctacgtcaagaattccagcaggctaaacaagatgaggatgtggaagataggcgacggacctattccttcgaacagccatggccaaacgcacggccagccactcagtcaggtcggcattccgtgtccgtggaagttcagatgcaacgacagaggcaagaagagcgggaaagttcacaacaggcccagcggcagtactcttcactccctcggcagagtcggaaaaatgccagcagtgtttcacaggattcttgggagcaaaattacagtcctggggagggtttccaatctgcaaaggagaacccccgatattcttcttaccagggttctcgcaacggatatcttggcggtcacggctttaatgcccgtgtgatgctggagacccaggaactccttaggcaggagcagcggaggaaagagcagcagatgaaaaaacagccgccaagcgagggaccatcaaactacgactcttataagaaagtgcaagatccttcttacgctccaccaaaaggcccattcaggcaagacgtgcctccatcaccttcccaagttgcaaggctcaatcggctccagactcctgagaagggaagacccttctactcatag

SEQ ID NO: 234064 - DNA, 4023 bp, Artificial Sequence
  Description of Artificial Sequence: Synthetic coding sequence
atgaaggtgacggtttgcttcgggcgaaccagggtggtcgttccctgcggcgatggtcacatgaaggtattcagcttaatacagcaggctgttacccggtatcgcaaggcaatcgcaaaggatccaaactattggatccaggtgcacaggctggagcatggtgatggaggcatcttggacctagatgatatcttatgtgatgtggctgacgacaaagatcgtctagtcgctgtcttcgacgaacaggatcctcaccacggcggagacgggacctcagccagttctacaggcacccagtcccccgaaatctttggaagcgaactgggaaccaataatgtgagcgcctttcagccatatcaggccacaagtgaaatcgaagtgaccccatcggtgctacgggctaatatgcctctgcacgttcggaggagctcagatccagcattaatcggcctctctacttccgtgtcagactctaatttctcatccgaggaaccctcaagaaagaatccaacacgatggtccactacagcaggttttcttaagcagaacacggcaggctctcccaagacgtgtgataggaagaaggacgaaaattatcgatccctccctcgcgatacgtcaaactggagcaatcaattccaacgggataacgcccgttctagcttgagtgcttctcaccccatggttggcaagtggcttgagaagcaagagcaggacgaagacggtactgaggaagataattctcgcgttgaaccagtggggcatgctgacacaggcctcgaacacatacccaatttcagcctggacgatatggtcaagttggttgaggtgccgaacgacggcggacctctcggaattcacgttgtgcctttcagcgctcggggagggaggaccctgggattactcgtgaagcgcctcgagaagggcggtaaggccgagcatgaaaacctttttcgggaaaacgactgcattgtgcgcatcaatgacggggacttgcggaaccgcagattcgaacaggctcaacacatgtttagacaagccatgcgcactcccattatctggttccacgtggtgcccgctgccaacaaggaacagtacgaacagttgagtcagtctgaaaaaaataactactactctagccggttcagccccgactcacagtacattgataacaggtccgttaactccgcagggttgcatacagttcaaagagctcctcggctaaatcatcctcctgaacaaatagactctcatagccgtctgcctcactcggcacatccgtccggaaagccaccctctgctccagcttcggcgcctcagaatgtctttagcactaccgtttctagtggttacaacacaaaaaagattggaaagcgacttaacatacagctgaagaagggcaccgaagggttgggcttttccattacgtcccgtgatgttactatcgggggatcggcacctatttacgtcaagaacatccttcctaggggcgctgctatacaggatgggcgtcttaaagctggagatcgccttatcgaagtaaatggtgttgacctggttggaaaatctcaggaagaagtggtgtctttgctgcgcagtaccaaaatggagggtacagtctcccttctggtttttagacaagaggacgccttccacccgcgtgagttaaaggccgaagacgaggatattgtcttaacaccagacggcacgagggagtttctgaccttcgaggtccccctgaacgattccggctctgccggtctcggagtctctgtaaagggaaataggagcaaggagaatcacgcagacctcgggatatttgtcaaatcaatcattaacgggggtgcagcttcgaaagacggacggctgagggtaaacgaccagctgattgcagtgaatggggaatcgctgctcggtaaaactaaccaggacgctatggaaaccctccgacgatctatgagtaccgagggcaacaaaagggggatgatccagctgatcgttgcgagacgcatttccaaatgcaacgagctgaagagccctgggagccccccaggacccgaactgccaattgagactgcgctggatgatagagagcgccgaatctcgcatagtctgtattctggcatcgagggtctggacgagtccccttctcgaaacgctgccttgtcccgcatcatgggcaagtatcagctatcccctaccgtcaatatgccgcaggatgataccgtcatcatagaggacgacaggttgccggtcctgccacctcacctctctgaccagagctctagctcctcacatgacgacgtcggattcgtcacggccgacgctggtacctgggctaaagccgctatcagcgacagcgctgactgttcgctgagcccggacgtggaccccgtgttggcatttcagagagagggattcggaaggcagtctatgagcgaaaaaagaaccaagcagttctcggatgccagccagctcgactttgtcaagactcggaagagcaagtcaatggacctcggtatagctgacgaaactaagctgaatacagtggacgatcagaaagccggaagcccctctcgcgatgtaggaccgtctctcggcctgaaaaagtctagctctctggagtccttacagaccgcagtggccgaagttacgttgaatggtgacattccattccatagaccacggcctaggatcatcagaggaagaggctgcaacgagtcatttcgagccgcaatcgataaaagctatgacaaacccgcagtcgatgatgatgacgagggtatggagacattggaagaagatactgaggagagttccagatccggccgagagagcgtgtctaccgcaagtgaccagccatctcactctcttgagcgccagatgaatgggaatcaggagaaaggggacaagacggaccggaagaaggataagacaggcaaagagaagaagaaagatcgagataaagagaaagacaaaatgaaagctaagaagggaatgctgaagggccttggagacatgttcaggtttggtaagcaccgcaaagacgataaaatcgagaagactggcaagataaaaattcaagaatcttttacatcagaagaggagaggatccgaatgaagcaggaacaagaaagaattcaggccaagactagagagtttcgcgagcggcaggctagggagagagactacgcagagattcaggatttccacaggacctttggctgcgacgatgagctgatgtatgggggagtaagcagttatgagggatccatggccttaaacgctcggcctcagtcaccgagggaaggccacatgatggatgctttgtacgctcaggtcaaaaagccacggaacagtaagccgtcacccgtcgatagtaatagaagcaccccgtcaaaccatgatcgaatccaacggttgcgccaggagtttcaacaggcaaagcaggacgaggacgtggaagacagaaggaggacttactcgtttgagcaaccctggccaaacgctagaccggctacacaatccgggaggcacagcgtctccgtggaagtgcagatgcagagacagagacaggaagagagggagagttcccagcaagcgcagcgccaatactcatccctgccacgacaatctcggaagaacgcaagctccgtgagtcaagactcttgggaacagaactactccccaggcgagggtttccaatccgctaaggagaatcccaggtacagctcttaccagggtagtagaaacgggtacctcggcggacatgggttcaatgcccgagtgatgctggagacacaggaactcctgcgccaggagcaacggagaaaagaacagcaaatgaaaaagcagccacccagtgagggacccagtaattacgactcctataagaaggtgcaggatccttcctacgccccaccaaagggccctttcagacaggacgtgcctcccagtcccagtcaggtcgctaggcttaatcgactgcagacccctgagaaagggaggccattctacagttag

SEQ ID NO: 234065 - DNA, 1119 bp, Artificial Sequence
  Description of Artificial Sequence: Synthetic coding sequence
atgaatcgctctcacaggcatggggctggttctggctgcctgggcaccatggaggttaagagcaagtttggggctgaattccgtcgcttctccctggagaggagtaaacctgggaagtttgaagagttctacggcctactacagcacgtacataaaattccgaatgtggacgtgctagtgggatacgccgacatacacggtgacctgcttcccattaacaatgacgataattaccacaaggcggtgtcaactgctaatcccctccttcggatctttatccagaaaaaagaggaagccgactattctgcgttcggcacagatacgctgattaaaaagaaaaatgtgttaacaaatgtgctcaggcctgataatcatcgcaaaaagcctcatattgttatcagtatgccccaggactttagacccgtttcttccataatcgatgtcgacattctgccggagacacaccggagagtgcgcttgtacaagtatggaaccgagaagcccctcggcttttacattagagatgggagctccgtgcgggtgactccccacgggctggaaaaggtccctggcatctttatctctagactggtgccaggtggcctggcccagagcactggactgctggcggttaacgacgaagtcctggaagtcaatggaatcgaagttagcgggaaatctcttgaccaggtgacggatatgatgatcgctaacagcaggaacctgataattaccgtaaggcctgcgaaccagagaaataatgtggtccggaattcacgcacttcaggttcgagcggccaatcaaccgacaacagcttgctcggatacccccagcaaatcgaaccttcattcgaacctgaggacgaagactcagaagaggatgatataataatcgaagataatggtgtaccacaacaaatccctaaagccgttccaaatacggaatctctggaatcattgacccaaattgagctgagcttcgagagcggtcagaatggatttatcccttctaacgaggtgtccctcgccgctattgcatcatcctccaacactgagttcgagactcatgcccctgaccagaaattgctggaggaagacggcacgataatcacactctag

SEQ ID NO: 234066 - DNA, 1131 bp, Artificial Sequence
  Description of Artificial Sequence: Synthetic coding sequence
atgaataggagttttcataaaagtcagaccttgagattctacgattgcagcgcggttgaggttaagtccaaattcggggctgagttcagacgctttagtttggatcgacataagcctggaaagtttgaagacttttataagttggtggtgcacacgcaccacatctccaatagcgatgtgaccatcgggtacgccgatgtgcatggagacttgctcccaattaataatgacgacaatttctgtaaagccgtcagtagtgcgaatcccctcttgcgggtgtttattcaaaagcgggaggaggccgaaagaggctcccttggcgctggctctctgtgtaggcggcgacgggctttgggagcattgcgggatgaaggcccaaggcggcgtgcacatcttgatatcggactccccagagacttccgacccgtttcatccattatcgacgtggatctcgttcccgaaacacaccgcagggtgagactgcatcgccacggatgcgaaaaaccactgggattttacatccgcgatggggctagcgtaagagtcactcctcacggactcgagaaggtccccggtatattcatatctcggatggttcctggcggactggctgaatcgaccggcctgctcgcggtgaatgacgaagtgctcgaggtcaacggaattgaggtggccggaaagacactggaccaggttaccgacatgatgattgccaatagccataacctgattgtgacagtgaagcctgccaaccaacggaataatgtcgtccggggtggtcgagccctgggtagctctgggcctccctcagacggcacggctggttttgttgggccacccgcaccacgtgttttgcagaatttccatcctgatgaagccgaatccgatgaggacaatgacgtggtgattgaggggactcttgaacctgccaggccccctcagactccaggggctccagctggctctctgtcacgggtcaatggagccggactcgcgcagcgtctgcagcgtgatctggctctcgacggaggtctccagcggctgctatcttccctacgggctgaccccaggcactctctggctctgccacccggaggggtggaagaacatggccctgcagtgacactttag

SEQ ID NO: 234067 - DNA, 1236 bp, Artificial Sequence
  Description of Artificial Sequence: Synthetic coding sequence
atggccgaggccgagctgcataaggaacgcctgcaggcaatcgccgagaaaagaaagcgacagacggagattgagggaaagagacagcaactggatgagcaaatactgctgctgcaacatagcaaatccaaagtcttgcgagaaaagtggctgttgcagggcattcccgcaggtactgctgaagaagaggaagcacgcaggagacagtcagaggaagacgaattcagagttaagcagttggaggacaatatccaacgcctggagcaagaaattcagactctagaaagcgaggagagccaaatcagcgctaaggagcagataatcctggagaaacttaaggaaacagaaaagagtttcaaggacttccaaaaaggcttctctagtaccgatggtgacgcagtaaattatatctcaagtcagctgccagacctacctatactgtgttctaggacggcagaaccttctcctgggcaggacggcacttcccgggctgccgcagtgtatgcgatggagattaacgtggagaaagacaagcagactggcgaaaccaaaattctatctaccagtacgatcggccctgagggagtacaccagaagggagtaaaggtgtatgacgatggtaccaaggtagtgtatgaggtcaggtctgggggtactgtggtggagaacggggtacacaaattgagtacgaaagatgtggaggagctgatacagaaagcagggcagtctagcctgggcggtggacatgtcagtgagagaactgtcatagcagacggaagcttatctcacccaaaagagcacatgctgtgcaaagaagctaaactcgaaatggtgcacaagagtcgaaaggatcattcatctggaaaccccggacagcaggcgcaggcccctagcgccgctgggccagaagctaatttagatcaacctgtgaccatgatctttatgggatatcagaatatcgaggacgaggaggaaaccaaaaaggtcctgggctatgatgagactatcaaggctgaactcgttctgatcgatgaggatgacgagaaatctctgcgagaaaaaaccgtcacagacgtgagcacaattgacggaaacgccgctgaattagtaagtggacggcctgtaagtgacacgacggagccttcatctccagagggaaaggaagaatcactcgccacagaacctgcaccaggaacgcagaaaaaaaagcgctgccagtgctgcgtggttatgtag

SEQ ID NO: 234068 - DNA, 1140 bp, Artificial Sequence
  Description of Artificial Sequence: Synthetic coding sequence
atggagatggccgaagctgagctgcataaagagcgactgcaggccatagcagagaagaggaagaggcagacagaaattgaggggaagcggcagcaattggatgagcagatacttctgctccagcactcgaaaagtaaggtcctgagggaaaaatggttactccagggaatacccgcaggcactgcagaagaagaagaagccagaagacggcagagtgaagaggacgaattccgcgtgaagcagttggaagacaatatacagcgcctggaacaggaaatccagaccttagaatctgaagagagccaaatctcggcaaaggaacagattattctggaaaaattgaaggagactgagaagtcctttaaagactttcagaaaggtttcagtagcaccgacggagccgtgtacgctatggagatcaacgttgagaaagacaaacagacaggagagaccaaaatactctccacttctaccatagggcctgaaggcgtgcaccagaaaggagtcaaggtgtacgacgacggaacaaaggtagtctacgaggtccgctccggtgggacagtggtcgaaaacggggtccataagctcagtacaaaagatgtggaagaactcatacagaaggcaggacagtcctccttgggtggagggcacgtcagcgagaggacagtgatagcagacggaagtctgtcgcatccaaaagagcacatgttgtgcaaagaagccaaactggagatggtgcataagagcaggaaagatcacagttccgggaacccagggcagcaggcccaggctccctccgccgcaggcccagaagcgaatctggatcaacccgtcactatgatattcatgggatatcagaatatcgaggatgaggaggagacaaagaaggtgttggggtatgacgagacaataaaagcggagctggtattgattgatgaagatgacgaaaagtctctgcgggagaaaactgtcacagatgtttccactattgatggcaacgcagccgagttggtctctggcaggccggtgtccgacactacagaaccgtccagcccagagggcaaggaggagtccctggccaccgagccggctcctggaacacagaaaaaaaagagatgccagtgctgtgtcgtgatgtag

SEQ ID NO: 234069 - DNA, 1242 bp, Artificial Sequence
  Description of Artificial Sequence: Synthetic coding sequence
atggagatggcagaggccgaactgcataaggagcgcctccaggccattgctgagaagcgcaagaggcagacagagattgaaggaaagcgacaacagttagacgagcaaatcttattactacaacatagtaagtctaaggtcttacgggagaagtggctgctccagggtatcccagcaggcaccgctgaggaagaggaggcccgtagacggcaatcagaggaagacgagttccgggtaaagcaactcgaggacaatattcagagacttgagcaagagatccaaactctggagtccgaggaatcccagataagcgccaaggagcaaataatcctcgagaagctcaaagagacagaaaagagctttaaggacttccagaagggtttctctagcacagatggtgatgccgtgaactacatcagctctcaattacctgacctgccaatcctgtgctcgagaaccgccgaacccagtcctggacaggacgggactagccgcgctgccgctgtctatgccatggaaattaacgtggagaaggataagcagacaggtgagactaaaatactgtctactagcacaattggcccagagggcgttcatcagaagggagtcaaggtgtacgatgatggtaccaaagtagtatatgaagtaaggtcaggcggaacggtggtggaaaatggagttcacaagttgtcaacaaaagacgtagaggagctgatccagaaggcaggccagtctagtcttggaggaggccatgtttcagagcgcacagtaattgccgatggttccctgtcccacccaaaggaacacatgctttgtaaggaggctaagctggaaatggtacacaaatctaggaaagatcactccagcgggaatcccggacagcaggcccaagccccatccgctgccggacctgaagccaatttggatcagcccgttacgatgatttttatgggctatcagaatatcgaagatgaggaagagacaaaaaaagtgctcgggtacgatgagaccatcaaagcagaactggtgctgattgatgaggacgatgagaagagtttacgcgaaaagaccgtcacggacgtaagcactatcgacgggaatgcagccgaattggtgagcggtagacctgtgtcggacaccacagagccgtcctcgccagaagggaaagaggagtccctggctaccgagccagctccaggcactcagaagaagaagcggtgccagtgttgtgtagttatgtag

SEQ ID NO: 234070 - DNA, 1167 bp, Artificial Sequence
  Description of Artificial Sequence: Synthetic coding sequence
atgggcagagctcggaggttccaatggccattgctcctcctgtgggcagccgctgccggacccggagccggacaggaagttcagaccgaaaatgtcacggtggccgagggaggggtagcagagattacttgccgccttcatcagtatgacgggtcgatcgtcgtcattcagaatcctgcgcgacagaccctattcttcaacggcacccgcgcattaaaggacgagcgctttcagctggaggagtttagccctcgcagagttcgcatccggctgagcgacgccagactcgaagacgaaggtggatacttctgccagctgtacactgaggatacgcaccaccagatcgccaccttgaccgtcttggtcgccccagaaaatccggtcgtcgaggtgcgggagcaggctgtcgaagggggtgaagtggaacttagctgtctggtgcccagatccaggcccgcagcgactttgcgctggtacagagaccggaaggaattgaagggcgtgagttcttctcaggagaacggcaaggtctggagtgtggcatctaccgtcagatttagggttgaccgtaaagacgatgggggtataataatatgtgaagcccagaatcaggcgctgcccagcggacactccaaacaaacccagtacgtgctagacgtgcagtacagccctacagccaggatccatgcctctcaagccgttgtgagagagggtgacacactggtgctcacctgcgccgtgaccgggaaccccaggccaaatcagatccggtggaacagggggaatgagagcctccccgagagagctgaagcggtcggggagacactgacacttccagggctggtctctgcggacaatggcacctatacatgcgaggcctccaacaagcacgggcacgcacgcgctttgtacgtgttagttgtttacgatcctggggctgttgtcgaagcccagaccagtgtgccatacgcaattgtcggtgggatcctggccctgctcgtgttcctcatcatctgcgtgctcgttggcatggtctggtgctccgtccgccagaagggctcctacttgacacacgaagcctcggggctggatgagcagggggaagccagggaagcgttcctgaacgggagcgacggacataagcggaaggaggagttttttatctag

SEQ ID NO: 234071 - DNA, 1068 bp, Artificial Sequence
  Description of Artificial Sequence: Synthetic coding sequence
atgggcaagcttgttgcactggtcctgctgggcgtgggcctctccctagtaggagagatgttcttggctttcagagagcgggtgaacgcctcgcgggaagttgaaccagtggaacccgagaattgtcacttaatcgaggagttagaaacaggtagcgaagatctcgaaattttgcccaatggcctggctttcatatcatccggactcaaatatcctggcattaaatcatttaatccgaatagtccgggaaaaatactgttaatggatttaaacgaggaagatcctaccgtgctcgagctgggcatcactggatcgaaattcgatgtcagttcttttaatccacatgggatctcaaccttcactgacgaagataatgccatgtatttgttggtggtgaatcatcccgacgcaaaaagcactgtggagttattcaagtttcaggaggaggagaagtccctcttacaccttaaaactattcggcacaagctgctcccaaatctgaatgacatcgttgccgtcggacctgagcacttctatggtaccaacgaccattatttcctcgacccatatctgcagtcctgggaaatgtaccttggccttgcatggtcctatgtggtgtactacagcccatctgaggtccgagtagtagctgaggggtttgacttcgccaatggcataaatatctcaccggacgggaagtatgtgtatattgcagagctgctggcccataagattcatgtttacgaaaaacatgccaattggacgttgacacctctgaagagcttagacttcaatacccttgtcgataacatcagcgtggaccctgagactggcgatctctgggtgggatgtcacccaaacggaatgaaaatcttcttctatgatagcgagaacccacctgccagcgaggtcctgcggatccaaaacatactgaccgaggagcctaaagtcacacaggtgtacgctgagaacggcacagtgctgcagggctcaactgtggcatccgtttacaagggcaagctccttatcggaacagttttccacaaggccttgtactgcgaattgtag

SEQ ID NO: 234072 - DNA, 1017 bp, Artificial Sequence
  Description of Artificial Sequence: Synthetic coding sequence
atggcagcgggttgtagcgaagcgcctcgccctgcggctgccagtgatggtagtctcgttggccaggctggagttttgccctgcctggagcttcccacatatgctgcagcgtgtgcactggtaaactcaaggtattcatgcctggtagctggaccacatcagcgtcacatagccctgtcacctaggtaccttaaccggaaacgcacaggtataagggagcaactcgacgccgagctgcttcgatatagcgaatccctcctcggggtcccaattgcttatgataatattaaggttgtcggcgaactgggcgacatctacgatgaccaggggcacatccacctgaacatcgaggcggactttgtgatcttttgtcccgagcccggtcaaaaactgatgggtatcgtgaacaaggtttcatccagccacatcggctgtttagtccatggctgtttcaatgcgtccataccaaagcctgaacagctctcagctgagcaatggcagactatggaaatcaatatgggcgacgagctggagtttgaagtttttaggctggactcggacgccgctggggtcttttgcatccgtggtaagcttaatatcacctcactgcagtttaaacgcagcgaggtgtctgaagaggttactgagaatggaaccgaggaggcagccaagaagcctaagaagaaaaaaaaaaaaaaggaccccgagacatatgaggtcgacagtggcaccacgaaattggctgatgatgccgacgacacaccgatggaagaaagcgctctgcagaacactaataacgccaacgggatatgggaggaggaacctaaaaaaaaaaagaagaaaaaaaagcaccaagaggtgcaggaccaggatcctgtatttcaaggaagtgattcttcggggtatcaatccgaccacaagaagaaaaagaaaaaaagaaagcactccgaagaagctgagtttacaccacctctgaagtgcagtccaaagcggaagggtaaatctaactttctttag

SEQ ID NO: 234073 - DNA, 1059 bp, Artificial Sequence
  Description of Artificial Sequence: Synthetic coding sequence
ggcgctgcaggaggatgcggattggcaggggatagggccggtctaggagaaagactgctcgccctgcgtaaccgcctgaaagcatcaagagaggtcgaatccgtcgacttgccgcattgccatctcataaagggtatcgaagctgggtcggaggacatcgacattctgccgaacgggctagccttcttcagtgtaggcctgaaattcccaggactgcactcctttgccccagataaaccaggaggaatactgatgatggacctgaaagaggagaaacccagagccagagagctccggattagcagagggttcgaccttgcaagttttaaccctcacgggattagcacttttatcgacaatgatgatacagtctatctgttcgtagtgaaccaccccgagttcaaaaatacagtcgaaattttcaagttcgaagaggcagagaacagtttgctccacctgaagaccgtgaaacacgagttgttaccgtcagtaaatgatatcacagctgtgggaccagctcacttttatgctactaatgatcactatttctcggacccgtttttgaaatacctggagacttatctgaacctgcactgggctaatgtggtctactacagtcccaacgaggtcaaggtggtggccgaagggtttgattcagccaacggcatcaacatctccccagacgataaatatatctatgtagccgacatcctcgcccatgaaatccatgttctggagaagcacactaacatgaatctcacacagctgaaggtcctcgagttggatacattggtagataacttatccatcgacccaagttctggggatatttgggtcggctgtcaccccaatggacaaaagttgtttgtgtacgaccctaataatccaccgtcttcagaagtgctccgcatccagaacatcttgagcgaaaaaccaaccgtcacaacagtctacgcgaacaacggcagcgttctccagggcagtagcgtggcatctgtctatgacgggaagctgctcatcggcaccctctatcatcgcgctctttactgtgaactctag

SEQ ID NO: 234074 - DNA, 1128 bp, Artificial Sequence
  Description of Artificial Sequence: Synthetic coding sequence
atggcgcctcccaccgagttgctggcacgtcctgaaagaggatccgcccctggttccagagccatgggcaggctcgtggcagtgggactcctaggcatcgccctcgcattgttgggtgaacgactcttggccctgagaaaccgactgaaggccagcagggaagtcgaatctgtggatcttccacactgccacttaattaaaggcattgaggcaggatcggaagatatcgatatcttgcctaacggactagcgttcttttctgtcggccttaagtttcccggactccactcctttgccccagataaacccggtggcatactgatgatggatctcaaggaggagaagccacgagccagagaactgagaataagccgcggatttgacttagccagtttcaaccctcatggaattagcacattcattgataacgatgatactgtgtatctgttcgtagtgaaccatccagagtttaaaaatactgtggaaatttttaaattcgaagaggcagaaaattctttactgcaccttaagactgtcaagcacgagctgctgcctagcgtgaacgacatcacggccgtcggtccagcccatttctatgccacaaatgatcattacttctccgatcccttcttgaagtatctggaaacatacttaaacctgcactgggccaatgtggtgtactactcccctaacgaggtgaaagtagtggctgagggatttgactctgcaaacggcataaatattagccccgatgacaagtatatttacgtagctgacattctagctcacgaaatccatgtcctggagaaacatacgaacatgaatctcacccagttgaaggtgttggagctggatacgctcgtggataatctctccatcgacccgtcttccggtgatatctgggtcggctgtcatcccaatggccaaaagctctttgtctacgacccaaataaccccccaagctccgaggtgctgagaatacaaaacatcctgtctgaaaagccgaccgttaccaccgtctatgctaacaatggttcagttctacaggggtcatcagtggcttctgtctacgacgggaagctgttaattggaaccttatatcaccgggctctgtattgtgagctttag

SEQ ID NO: 234075 - DNA, 1029 bp, Artificial Sequence
  Description of Artificial Sequence: Synthetic coding sequence
atgggcaggcttgtcgcagtgggacttttgggaattgctttggcactgcttggagaacggctcctggccctgagaaatagactaaaggcgagtcgggaagttgaatcggtcgacctccctcattgccacctgattaaaggcatcgaggccggaagtgaagatattgacatattgccaaacggattagcgtttttcagtgttggactgaagttcccgggactgcacagctttgcgcctgataagcctggtggcatactcatgatggaccttaaagaggaaaagccgcgagcacgcgagttacgtattagcagaggatttgacctggcctcttttaacccccacggcatttcgacgttcatcgataacgagttcaagaatactgtcgaaatattcaagttcgaagaagccgagaactctctgctacacctaaagaccgtgaaacatgaacttctgccttctgtgaacgatataactgccgtggggcctgcccacttttacgctaccaacgaccattatttttccgaccccttcctcaagtatctggagacttaccttaacctacattgggccaatgtcgtgtattatagcccgaacgaggtgaaagtggtagctgagggattcgactcggccaacggaataaatatttcccccgatgacaagtatatttacgtcgctgatatcctggcacacgagattcacgtgctggagaagcacactaacatgaacctcacccagttgaaagttctcgagttggatacattggtggataacctgagcatcgatccgagctcaggtgatatttgggtgggttgccatccaaacggtcagaagctgttcgtatacgatcctaacaatcccccttcctcggaagtgcttcgaattcaaaacatactcagcgagaagcccacggtcacaaccgtctacgccaacaacgggtccgtgttgcagggttcgtccgtagcaagcgtgtatgatggaaaactgctcatcggtacactatatcaccgtgcgttgtactgcgagttatag

SEQ ID NO: 234076 - DNA, 1065 bp, Artificial Sequence
  Description of Artificial Sequence: Synthetic coding sequence
atgggtaagttggtcgccctggttttgctaggtgtaggactctccctggttggagagatgtttctggcattccgcgaaagggtgaatgcttctcgcgaggtggagccagttgagcctgagaattgtcatctgatagaggagctcgagtcgggatcagaggacatagatatcctgccaagcgggctagcattcattagtagcgggctgaagtaccccggaatgcctaattttgccccagatgaacctgggaaaatcttcctgatggacttaaacgaacaaaatcctcgtgcgcaggctctcgagatctccggaggctttgataaggagctgttcaaccctcatggaattagcatatttatagacaaagataatacagtttatctttatgtcgtcaaccatccgcatatgaagagtaccgtggaaatcttcaagttcgaagagcaacagcgctctctggtctacctcaaaacaatcaaacacgagcttttaaagtccgtcaatgacatagttgttcttggacccgagcagttttacgcaacacgcgaccactacttcactaattcgctgctgtccttttttgaaatgattctagacctgagatggacatacgtcctgttttactcccctagagaggttaaggttgttgctaaaggcttctgtagcgctaacggcattactgtgtctgccgatcagaagtatgtctacgtcgcagacgtggcagccaagaacattcacatcatggagaaacatgacaattgggacctcacccagctcaaagtcatccaactgggcacacttgttgacaaccttaccgtggatcccgcaactggagacatcctcgctggttgccaccccaaccccatgaagctgttgaattacaaccctgaggatcctcctgggtcggaagttttaaggatacagaatgttctgagcgagaagccgagggtaagcaccgtctacgccaataatggctctgtcctccagggaactagtgtcgcaagtgtgtatcatggcaaaatccttattggaacagtgttccacaaaactctttactgcgagctgtag

SEQ ID NO: 234077 - DNA, 1572 bp, Artificial Sequence
  Description of Artificial Sequence: Synthetic coding sequence
atgatgctgcggggaaacctaaagcaagtgcgaattgagaagaatcccgctaggctaagggcgcttgaatccgcggtgggcgaatcagagccagcagcagcagctgctatggccctggctttggccggtgaacctgctcccccagctccagcccctccagaagaccatcccgatgaagagatgggttttaccattgatatcaagtcctttctaaaaccaggtgagaaaacgtatacccagcgttgtagattatttgtaggcaatcttccaaccgatataaccgaggaagattttaagagactgttcgagagatacggagagccatccgaggtgtttatcaaccgtgacagaggcttcgggttcatccggctggagtcacgaaccctagctgaaatcgccaaggcagagctcgatggcaccattcttaagagcagacccttgagaatcagatttgctactcatggtgccgctttgaccgtgaagaacctgtccccggtggtgtctaacgagctgctagaacaagcatttagccagtttggcccagtggagaaagccgtcgttgtggtggacgaccgaggaagagcaaccggtaagggtttcgtggagttcgctgcaaagccccctgcgcgtaaggccctggagagatgtggagacggcgcattcctgctaactacaacacccagaccagtgatcgtagaaccaatggagcagtttgatgacgaggacgggctacccgaaaagttgatgcaaaaaacccagcagtaccataaggagagagaacagcctcccagattcgcccagccagggacatttgagttcgaatacgccagcagatggaaagcgcttgatgagatggaaaaacaacagcgtgagcaggtcgaccgcaatatccgcgaggcgaaagagaagctcgaggcagagatggaggctgctagacacgaacatcagctaatgctgatgaggcaggaccttatgcgccgtcaggaagagctgcggcgattggaggaactcagaaatcaagagctccagaaacggaagcagatccaactgagacacgaggaggagcacaggaggcgagaggaggagatgatccgccacagggagcaggaggagctccggagacagcaagaggggttcaagcccaattacatggaaaaccgcgagcaggagatgcggatgggcgatatgggcccaaggggggctattaatatgggagatgctttctcacccgctcccgctggaaatcaggggcctcctccaatgatgggcatgaatatgaacaaccgcgcaaccatccccggtccacccatggggccagggcctgccatgggccctgaaggtgcggctaacatgggaacccccatgatgcccgataatggcgcagtccataatgacaggttcccgcaaggcccaccttctcagatgggatcccctatgggctctcgcacagggagtgagacccctcaggcaccgatgtctggtgttggaccggtaagcggcggaccgggaggctttgggcgaggatcccagggcggaaattttgaaggaccgaacaaaaggagaagatactag

SEQ ID NO: 234078 - DNA, 1392 bp, Artificial Sequence
  Description of Artificial Sequence: Synthetic coding sequence
atgggattcaccatcgatattaagagctttttaaagccaggtgagaaaacatatacccagaggtgtagactctttgtcggcaacctgcctacagatataaccgaagaggatttcaaacgactcttcgaaagatacggcgagccctctgaggtgtttataaatagggatagggggtttggtttcataagattagagtcccgcaccctggccgaaatcgccaaggcggagttggatggcactatcctcaaatctcgcccactgagaatccgattcgcaacacatggagcggctctgaccgtgaagaatctgtctcctgtagtatcaaatgagctcctggaacaggccttcagccaatttgggccagtggaaaaggcggtcgttgtggttgacgaccgtggccgtgccactggcaagggcttcgtggaattcgccgcaaagccaccagcgaggaaggctctggaaaggtgtggcgatggagcctttctgcttacaacaaccccacgtcctgtgatcgttgaacccatggagcagttcgatgatgaggacggcctgccagagaaactgatgcagaaaactcagcaatatcataaggagagagagcagccgcctcggtttgctcaacctgggacgttcgagttcgaatacgcgtcacgttggaaagcattagacgagatggagaaacagcaacgcgagcaggtggatcgtaatattcgggaggcaaaggaaaagctggaggctgagatggaggcagcgcgacacgagcatcagctcatgcttatgaggcaggacctgatgaggaggcaggaggaattacgcaggctagaagaattacggaaccaagagctgcagaaacgcaagcagattcagctgcgccatgaggaagagcatcgaagacgggaagaggagatgatccgacaccgtgagcaggaggaactgcgccgacaacaggagggattcaagcccaactacatggagaacagggagcaggaaatgagaatgggagatatgggacccagaggagccattaacatgggtgacgccttctcacccgcacccgctgggaaccagggcccacctcccatgatgggcatgaacatgaataacagagctaccattccgggtccaccaatggggccaggccctgccatgggcccagagggcgctgccaatatgggcacgcctatgatgccggataacggcgctgtacacaacgaccgtttcccacaaggccctcccagtcaaatggggagccctatgggttccaggacaggctctgaaacaccccaggctcctatgtccggggtgggtccggtttcaggcggaccagggggatttggccgaggatctcaaggcggaaattttgagggaccgaataagcgcagaagatattag

SEQ ID NO: 234079 - DNA, 747 bp, Artificial Sequence
  Description of Artificial Sequence: Synthetic coding sequence
atgatgcttaggggaaacttaaagcaggttaggatcgaaaagaatcccgcaagattacgagccctggaatccgcggttggtgaatcggagcctgcagcagctgcagctatggcgctggctctcgcgggtgagcccgcaccaccggctcctgcacccccagaggaccacccagacgaggagatggggttcacaatcgacataaaatcgtttctcaaaccaggggagaagacctacacccagagatgtagactgtttgtgggcaatctgcctactgacatcactgaggaggacttcaagcgattgttcgagagatacggggagccatcagaggtcttcatcaaccgcgaccggggatttggatttattcgacttgaatccaggacgctcgctgagatcgccaaggctgaactcgacggtactatcctcaaatctagaccactgagaatccggtttgccacgcatggagccgcactgaccgtgaagaatttgagccctgttgtgtcaaacgaattgctggaacaggccttttctcaatttgggcctgtcgagaaagctgttgtggtagtagacgacagaggcagggctacgggtaagggatttgtggagtttgctgctaagccacctgcccgaaaagcgctcgagcgctgcggggacggggcattccttctaacaactactcctcgcccagtgatagtggagcctatggaacaattcgatgatgaagatggtctgcccgagaagctctag

SEQ ID NO: 234080 - DNA, 309 bp, Artificial Sequence
  Description of Artificial Sequence: Synthetic coding sequence
atgtctgagaaatcagttgaggccgcagcggaactgtccgctaaagacctgaaagagaaaaaagaaaaggtcgaggaaaaggcctctagaaaggagcgcaaaaaagaagtggttgaggaagaggagaacggggctgaggaggaggaagaggaaaccgccgaggacggggaagaggaggacgaaggcgaagaggaggacgaagaggaagaagaagaggatgacgagggaccggctctgaagagagcagccgaggaggaagatgaggcagaccctaagcgccaaaaaaccgaaaacggagcctcagcttag

SEQ ID NO: 234081 - DNA, 315 bp, Artificial Sequence
  Description of Artificial Sequence: Synthetic coding sequence
atgtccgagaagagcgttgaggccgcagcagagctatccgcaaaggatctcaaagagaagaaggagaaagtggaggaaaaagcgagtcgcaaagaacggaaaaaggaggtggtcgaagcgcctgtgccactggtggtgatggtgggaaaggcctgctcacagccagaagccacaccgtctcccggaccacacagacggcgtcgtaccggtttacggagaaagaagaaaaagctcccaagaatggaaagaagaaaaatgaagggcaagaaaaaaatgcgcaagaaaaagaagaggatgatgaagggaccgaggtag

SEQ ID NO: 234082 - DNA, 306 bp, Artificial Sequence
  Description of Artificial Sequence: Synthetic coding sequence
tctagggacccagcctgtcgcgcagccgagttaagcgccaaggatttgaaagagaagaaagagaaggtcgaagagaaagcctcccggaaggagcgaaagaaggaggtcgtggaagaagaggaaaatggggctgaagaggaggaggaggagacagcggaggatggggaagaggaagatgagggggaagaggaagacgaagaggaagaggaggaggacgatgaagggccagccttgaaaagagcagcagaggaggaggatgaagccgatcctaaaagacaaaaaaccgagaacggcgcatcggcctag

SEQ ID NO: 234083 - DNA, 528 bp, Artificial Sequence
  Description of Artificial Sequence: Synthetic coding sequence
atgcaacggaggctcgttcagcagtggagtgtggccgtcttcctgctgtcttacgctgtcccctcttgcggacgctctgtcgagggattgagtagacgcctcaagcgggctgtctccgagcaccagctgttgcatgataaggggaaaagcatacaagacttacgacgcaggttctttcttcatcatctaatcgcggagattcatactgctgaaattagagccacaagcgaggtgtcgccaaattctaagcccagcccgaatactaagaaccatcctgtccggtttggcagcgacgatgaggggaggtacctgacccaggaaaccaacaaggttgaaacatataaagaacaaccattaaagacccctggcaagaaaaaaaagggcaaaccgggtaagcgtaaagaacaggagaagaaaaagcgtcggacccgatctgcctggctggattccggtgtaacagggtctggcctggagggagaccacttaagcgatactagtactacttcccttgagctggattcaaggtag

SEQ ID NO: 234084 - DNA, 630 bp, Artificial Sequence
  Description of Artificial Sequence: Synthetic coding sequence
atgcagcgcagattggtgcaacagtggagcgtcgccgtgttccttctttcctacgcagtgccttcatgcggcagaagtgtcgagggcctgagccggagactgaaaagagctgtttcggagcaccagttgcttcatgacaaggggaagtccatacaggacctgcgtcgacggttcttcctacatcatctcatcgcggaaatccataccgccgaaatcagggcaacaagtgaagtgtcacctaactcaaagccttctccgaacaccaagaatcacccggtgcgcttcggctcggacgacgagggaagatacctgacacaggaaacaaataaagtggaaacgtacaaagagcaacctcttaaaacacctggaaaaaagaaaaaagggaagccaggaaagcggaaagaacaagaaaaaaagaagcgcaggactaggtccgcgtggctcgattctggagtgacaggttccggactagaaggagaccacttgtccgataccagcactactagcctggaacttgattcacggaccgcactcctctggggcctgaaaaagaagaaagagaacaatcggagaacccaccacatgcaactaatgatttcccttttcaagtctcccctgctgcttctttag

SEQ ID NO: 234085 - DNA, 528 bp, Artificial Sequence
  Description of Artificial Sequence: Synthetic coding sequence
atgcaacggagacttgtgcagcagtggtctgtggccgtatttctgttaagctatgctgttccgagctgtggtagatcagttgaaggcctttcgagaaggctaaagagggccgtcagcgagcaccaattgttgcacgataaggggaagtcaattcaggaccttagaagacggttcttcctacaccatctcatcgcagaaatccacaccgccgagattagggccacgagcgaagtgtctcctaatagcaaacccagcccaaataccaagaaccaccctgtgcggttcgggtctgatgatgaaggtcgctaccttacccaggagactaacaaggtcgagacctacaaggaacagccattaaagactcccggaaagaaaaaaaaaggtaaaccaggcaagaggaaggagcaggagaagaaaaaaagacggacaaggtccgcatggttagactcaggggtcaccggttcaggcctggagggagatcatctgagcgacacatcgaccacttcgctggaactcgactcacgatag

SEQ ID NO: 234086 - DNA, 534 bp, Artificial Sequence
  Description of Artificial Sequence: Synthetic coding sequence
atgcaacggaggctggttcagcagtggtccgttgccgtttttttactgtcatacgcagtgcctagctgtgggaggagtgttgaaggattgtccaggcgattgaagcgtgcagtgtcagaacaccagctgctccacgacaagggcaaatcaatccaagacttgcgcagacgcttctttcttcaccacctcattgcagaaattcacacagcagagatcagggccaccagcgaggtgagtccaaatagcaagccaagtcccaatacaaaaaaccaccccgtacgctttggatctgacgacgagggtaggtaccttacacaggaaacaaataaggtcgaaacctacaaagagcagccactcaagactcctggaaagaagaagaaagggaaacccggaaaacggaaggagcaggagaaaaagaagagacggacacgcagtgcctggctcgatagtggcgttacgggatccggtctggagggcgaccacctatccgacaccagcaccacatccctggaactggactcccggcgacattag

SEQ ID NO: 234087 - DNA, 528 bp, Artificial Sequence
  Description of Artificial Sequence: Synthetic coding sequence
atgcagaggcgattggttcagcagtggtccgtggcagtgtttctgctttcgtatgccgtgcctagctgcggacggtctgtggaaggcttgtcacggcgactgaagcgcgctgtgtccgagcatcagctgcttcatgataagggaaagtctattcaagatttgcgtcggagattcttcctgcaccatctgatcgcagaaattcataccgccgaaatcagagctaccagcgaggtttcacccaattcaaagccatcaccgaatacaaagaaccaccctgtgcggttcggttccgacgacgagggaagataccttacccaggagacgaataaagtcgagacatacaaggagcagccattgaagacgcccggaaagaaaaaaaaaggaaaacctgggaagcgcaaagagcaagagaagaaaaagaggaggacccggtctgcatggctggactcaggggtgaccggatctggcctggagggcgatcacttatcagatacctctactacaagcctggagctcgacagcaggtag

SEQ ID NO: 234088 - DNA, 81 bp, Artificial Sequence
  Description of Artificial Sequence: Synthetic coding sequence
acagcactcttgtggggactgaagaaaaaaggcaagcagcagaagaacaccagctatgctactaacgatttgataatctag

SEQ ID NO: 234089 - DNA, 630 bp, Artificial Sequence
  Description of Artificial Sequence: Synthetic coding sequence
atgcaacggagattggtgcagcagtggtctgtcgcagtgtttctgctgagttatgctgtgccttcgtgtggtcgatctgtcgagggactgtcaagaaggctgaaacgggcagtatctgaacaccagctgctgcatgacaagggaaaatctatccaggacttgaggaggagattctttctgcaccatctaatagctgagatacataccgccgaaatccgggcaacgtctgaggtgtcgcccaacagcaaacccagccctaacaccaagaatcatcccgtccgctttggctcagacgacgaaggtaggtaccttacacaggagaccaacaaggtcgaaacctacaaagagcaacctttaaagactccaggaaaaaaaaaaaagggcaagcctggtaaaaggaaggagcaggaaaagaaaaagaggcgcacaaggtcagcctggttagactctggcgtgaccggttctggtctggagggggatcacttaagtgataccagtacaacgtctctcgaactcgactctaggaccgctttgctttggggcttgaaaaagaagaaagaaaacaacaggcggactcaccatatgcagttgatgatctccctgttcaagagccctctccttttgctctag

SEQ ID NO: 234090 - DNA, 534 bp, Artificial Sequence
  Description of Artificial Sequence: Synthetic coding sequence
atgcaaaggcgactggtgcagcaatggagcgtagcagtgttcctcttgtcttatgctgtcccaagctgtggaagaagtgtggaaggactgtcccgccgactgaagcgcgcagtgtcagagcatcagctgcttcatgataagggcaagagcatccaggatctccggagacgctttttccttcaccaccttatcgccgagatccacacagccgaaattcgggcaacatctgaggtttctcccaactccaaaccttccccaaatactaagaatcatcccgtccggtttggcagcgacgatgagggacgatatctcacccaggagacaaataaggtggagacatacaaggagcagccccttaaaaccccaggtaaaaagaaaaaaggaaagccagggaaacgaaaagaacaagaaaagaagaagagacgtaccaggagtgcatggttggattctggtgtcacaggatctggccttgagggtgaccacctttccgacactagtacgacaagtcttgagctcgattccagacgacactag

SEQ ID NO: 234091 - DNA, 519 bp, Artificial Sequence
  Description of Artificial Sequence: Synthetic coding sequence
atgcaaaggcggttggtccagcaatggtcagtggccgtttttctgctgagctacgccgtcccgagttgcggaaggagcgttgaagggctgagcaggcgattgaagcgcgctgtgagcgagcaccaactgctgcacgataaaggaaagtccatacaggatctgcggcgacgctttttcctgcaccacctgattgccgaaatccacactgccgagatcagagccacgtcggaagtctccccaaacagtaaaccctcacccaacactaaaaatcaccccgtgaggtttggctcagacgacgaaggaagatatctgactcaagagacaaataaggtagagacttacaaggaacagccccttaagacgcccggaaagaagaagaaagggaaaccaggtaaaagaaaggagcaggagaaaaagaagagacggactagaagtgcttggctggactctggcgtgaccggctctggacttgaaggagatcacctttcagataccagcacgacaagtctcgagctgtag

SEQ ID NO: 234092 - DNA, 534 bp, Artificial Sequence
  Description of Artificial Sequence: Synthetic coding sequence
atgcagagacgtctggttcaacagtggtctgtcgctgtcttcctgctaagctacgctgttccttcgtgtggtcgaagtgttgagggactgtctcgaagactgaaacgtgccgtatcagaacaccagctgctgcacgataagggcaagagcatccaggatcttagaaggaggttcttcctgcatcacctcatcgcagagatccatactgctgagattcgcgcaacatcagaggtctcccccaattctaaacccagccctaacacaaagaaccaccctgtgcgttttggctcagatgacgagggaagatacctgacccaggaaactaataaggtggagacctataaggaacagcccctgaaaacgccaggcaaaaaaaaaaaagggaagccgggaaaaagaaaggagcaggagaaaaaaaaacgcaggaccagatctgcttggctggatagcggagtcacaggctccggtcttgagggggaccatctgagcgacacttctactacaagtctggaattggactcacgcagacactag

SEQ ID NO: 234093 - DNA, 891 bp, Artificial Sequence
  Description of Artificial Sequence: Synthetic coding sequence
atggtcgccgagaaagaaactctgtcactcaataaatgtcccgataaaatgccaaaacggactaaactcctggcacagcaaccacttcctgtgcatcaacctcatagcctggtgtctgagggatttactgtcaaagccatgatgaaaaactccgtagtaaggggaccacccgcagccggtgccttcaaggagcgcccaaccaaacccactgcatttagaaagttctacgagcggggtgattttcctatcgccctagagcacgactccaaggggaataaaattgcatggaaggtcgaaatcgagaagctggattatcatcactacctacctttgttcttcgacgggctctgcgaaatgaccttcccgtacgagtttttcgctaggcaaggcatacacgacatgctggagcacgggggaaataaaatcttgccagtgcttccccagctgattattcctatcaaaaatgctctcaacctgagaaatcggcaggtcatttgtgtcacactgaaggtgctgcaacatctggtggtgagcgcagaaatggttgggaaagcgcttgtgccttactatcggcagatattgcccgtcctgaatatctttaaaaacatgaacggaagttatagcctcccacgcctagagtgctcaggcgcaataatggccagatgcaacttagaccatttggggtcatctgacccacctacaagcgccagccaagtggctgaaatcattgtgaattccggcgatggcatcgactactctcaacagaagcgcgaaaatattggggatctaattcaagagactctggaagccttcgaacgctacgggggagagaatgcttttattaacataaaatatgtcgtgcccacgtacgagtcttgtctgctgaactag

SEQ ID NO: 234094 - DNA, 774 bp, Artificial Sequence
  Description of Artificial Sequence: Synthetic coding sequence
atggttgccgagaaagagaccctcagtttaaacaagtgtcccgataagatgcctaaacggactaaactgctggcacaacagccccttcctgtacaccagcctcactccctggtttccgaaggtttcactgtaaaggccatgatgaaaaactcggtggtgcgaggccctcctgctgccggagcattcaaggagcgcccaacgaaaccaactgcctttagaaagttttatgagagaggtgattttcccatcgccttggaacacgactccaagggcaacaagatcgcttggaaggtggagatcgagaagttggactatcatcactatctgcccctgtttttcgacggactgtgtgaaatgacattcccgtatgagttcttcgctcgccagggcattcacgacatgttggagcacggtggaaacaagattctgcctgttttgccccaactgatcattcccatcaaaaacgctcttaacttgcggaaccgtcaagtgatttgcgtgacattgaaggtccttcaacacctcgtagtaagcgctgagatggtaggcaaggctctggtgccctattataggcagattctacccgtattaaacatttttaagaatatgaacgtgaactccggtgacggtatcgactactcccagcagaagagagaaaatataggtgatctgattcaggagacactggaagcctttgaacgttacggcggagagaatgcatttattaacatcaagtatgtcgttccgacatacgagtcttgcctgctgaactag

SEQ ID NO: 234095 - DNA, 774 bp, Artificial Sequence
  Description of Artificial Sequence: Synthetic coding sequence
atggtcgccgagaaggagaccttaagtctgaacaaatgccctgacaagatgcccaaacgcaccaagctactggctcagcaaccactgcctgttcaccagcctcacagcttagtgtctgaagggttcaccgtgaaggctatgatgaagaatagtgtggtgcgtggtcctccagcggcaggtgccttcaaggaaagaccaaccaagcctacagcattccggaaattctacgagcggggtgatttccccattgccttagagcacgacagcaagggcaacaaaattgcctggaaagtggaaatagagaaactggattaccatcattacctacccttgttcttcgacggcctctgtgagatgacttttccttatgaatttttcgccagacagggcattcacgatatgctggagcacggcggtaacaagattctgccggtgctgcctcagctgataattcccattaagaacgccttgaacttgagaaatcggcaagttatttgtgtgacattaaaggttcttcagcatttagtcgtgtccgctgagatggtgggcaaagccttggtaccttattatcgccagatcttgccagtgctgaatattttcaagaacatgaacgtcaatagcggcgacggcatagactactcgcagcaaaagcgggaaaacataggtgaccttattcaagagacactggaagcttttgaacggtatggcggagagaacgctttcatcaacatcaagtatgtagtgcccacctacgaatcatgcttgctcaactag

SEQ ID NO: 234096 - DNA, 825 bp, Artificial Sequence
  Description of Artificial Sequence: Synthetic coding sequence
atgagcggggagtgtcagagcccccattgtcctggcacatccgcagagttcttctttaaatgcggggctcaccctacatccgacaaagagacatctgttgcattgcatctcatagctactaacagcaggaatatcacatgcatcacttgtaccgatgtgagaagccctgttctggtttttcagtgtaatagtaggcacgtgatttgccttgattgcttccatctgtattgcgtgacacgtctgaatgaccgacagtttgttcatgatccccagctcggctacagcttaccttgcgtagccggttgtcctaattcactcataaaagaacttcaccactttcgaatcctgggcgaggagcagtacaacaggtatcagcagtacggagccgaggagtgcgtgctgcagatggggggtgttctctgccctagacccggatgcggagccggtctcctccccgaacccgaccagagaaaagttacctgcgaagggggtaacggacttggttgtggcttcgccttctgcagggagtgtaaagaggcatatcacgagggcgagtgcagcgccgtgtttgaggctagtgggacgacaacacaggcctatcgagtcgatgaaagggccgctgaacaagcccgttgggaagcagcttctaaagagaccataaaaaaaacaaccaagccttgtccacggtgtcatgtgcctgtagagaaaaacgggggttgcatgcacatgaagtgccctcagcctcagtgccggcttgaatggtgctggaactgcggatgcgagtggaatcgcgtttgtatgggagaccattggtttgacgtgtag

SEQ ID NO: 234097 - DNA, 1107 bp, Artificial Sequence
  Description of Artificial Sequence: Synthetic coding sequence
atgattgtgtttgtcagattcaactccagccatgggttccctgttgaagttgactcggatacatccatttttcagcttaaagaagtggttgccaagaggcagggggtgccagcagatcagctgcgagtgatcttcgctggcaaggaactccgaaacgattggaccgttcagaactgcgacctggaccagcagtccatcgtccatatcgtgcagcggccatggcgaaagggtcaggaaatgaacgcgactgggggtgacgaccctcgcaatgctgcgggtggatgtgaaagagagcctcaatctctcacgagggtcgacctgtcttcttcggttctgccgggagactccgtgggtctcgcggttatactacacaccgactcccgtaaagactctccacccgcaggatcgcccgcaggacgctccatatataattctttctatgtttattgtaaggggccatgccagagagtgcagccaggcaaactgcgggtgcagtgttcaacttgtcggcaagctactctgacacttacgcaagggccaagctgctgggatgatgtactaatcccgaatagaatgtcaggcgaatgccaatcaccccattgtccgggaacgagcgccgaatttttttttaaatgcggtgcccacccaaccagcgataaggaaaccagtgtggctctgcatctcatagccaccaactccagaaacatcacttgtataacgtgtactgacgttaggtcccctgtgctagttttccaatgtaattctaggcacgtcatctgtctggattgctttcacttgtattgcgttacccgactcaatgaccgacagttcgttcatgatccccaactcgggtactcccttccatgcgtggcgggatgtcccaactctcttataaaagaactacaccacttcaggattcttggcgaggaacagtacaacaggtaccagcagtacggtgcagaagagtgcgttttgcaaatgggcggtgtgctctgtcccagacctgggtgtggggctggtcttttgcccgaacctgaccagaggaaggtaacatgcgaaggcggtaatggcctgggctgtggatacggccaacgtaggactaagtag

SEQ ID NO: 234098 - DNA, 825 bp, Artificial Sequence
  Description of Artificial Sequence: Synthetic coding sequence
atgtctggggagtgccagtcaccccactgccctgggactagtgctgagttctttttcaagtgcggagcccaccccacaagcgataaagaaacttccgtggcacttcacctgatagccacgaattctcggaatatcacatgtattacctgcactgatgtgcgctctccagtgttggtatttcaatgtaattcgagacacgttatctgtttagactgttttcacctgtactgtgtgacacgtttgaacgatagacagtttgtacatgacccacaactggggtactccttgccttgtgtggccggatgccctaacagtttaatcaaggaactccatcattttaggattctgggagaggagcaatacaacaggtaccaacagtatggcgcagaggagtgcgtgctgcagatgggcggagtcttatgcccccgtcccggttgtggggctggcctccttccagagccagatcagagaaaagtgacctgcgaagggggtaatggcttgggttgtggttttgctttttgccgggaatgtaaggaggcttaccacgaaggtgagtgctcagctgtgttcgaagcctcgggaacgaccacacaggcttaccgagtggacgagcgggctgccgaacaggccaggtgggaggccgcaagcaaagaaacaataaaaaagaccactaagccatgccccaggtgtcacgtccctgttgaaaagaacggtggatgtatgcatatgaaatgcccgcagccccagtgcaggttggagtggtgttggaattgtggctgcgagtggaacagggtgtgtatgggggaccattggttcgacgtgtag

SEQ ID NO: 234099 - DNA, 657 bp, Artificial Sequence
  Description of Artificial Sequence: Synthetic coding sequence
atgaacgcaaccggcggagatgatcccaggaacgcggctgggggttgtgagagggaaccccagagtctcaccagggttgacctgtcaagttctgtcctgccaggagattcagtgggcctcgccgtgatcctgcacacggattctcgcaaagacagtccacccgcagggagtcctgcaggacgatccatctacaatagcttctatgtgtactgtaaaggaccttgtcagcgagtccagcctggtaagctcagagtgcagtgttccacttgcagacaggctaccctgacgctgactcaagggcctagctgttgggatgacgttctcatacccaatcgcatgtctggagagtgccaaagcccccactgccctggaacgagtgccgaattctttttcaaatgtggcgctcaccctacaagtgacaaagaaacaagcgttgctctgcatctgatcgccactaacagtaggaacataacctgcataacgtgcaccgacgtccggtctcctgttctggtatttcagtgcaactcgagacatgtgatttgtttggattgctttcacctgtactgcgtgaccaggctgaacgaccgtcagtttgtgcacgatccccaactaggttatagcctaccttgcgttgtttctctgcttccatctcagtag

SEQ ID NO: 234100 - DNA, 951 bp, Artificial Sequence
  Description of Artificial Sequence: Synthetic coding sequence
atgatagtattcgtgaggtttaattcatcgcacggattccccgtggaagttgacagcgacacatcgattttccaactgaaggaggtcgtcgctaaacgtcagggagtccctgccgatcaactgcgcgtgatcttcgctggtaaggaactgagaaacgattggacagtgcaagaattctttttcaaatgtggggcacacccaacttccgataaagagacctccgttgccctgcatcttattgctaccaattctcgcaatatcacttgcatcacttgcaccgacgtgcgcagcccggtgctagtattccagtgtaactctaggcacgtgatctgcctggattgttttcacctgtactgtgtgacacggctgaacgatcgccagttcgttcacgacccccagctgggctatagtctcccctgtgtggctgggtgtcctaatagcttgattaaggaattacaccacttccggattttgggcgaagagcagtacaatagataccagcagtacggcgcagaggagtgcgtgctccaaatgggaggtgtgctttgccccaggcctggatgtggggcaggactcttgcccgagccagatcagaggaaggtcacctgtgaaggtggcaacgggctaggatgcgggttcgctttctgccgggaatgcaaggaggcctaccatgagggcgagtgtagcgcagtttttgaggccagtggcactacaacacaagcgtacagagtcgatgagagggccgcagaacaggctcgctgggaagcggcaagtaaagagactatcaagaagacgaccaaaccgtgtcccagatgccatgttcccgttgagaaaaatgggggatgcatgcatatgaagtgtcctcaaccccagtgcaggttggagtggtgctggaattgcggctgcgagtggaacagggtttgcatgggagatcactggttcgatgtgtag

SEQ ID NO: 234101 - DNA, 1314 bp, Artificial Sequence
  Description of Artificial Sequence: Synthetic coding sequence
atgatcgtctttgttcggttcaactcttcacacggtttccctgttgaggtcgattcagataccagcatttttcagctgaaagaagtcgtggccaagaggcagggcgtgccagccgaccaactgagggtgattttcgcagggaaggaattgaggaatgattggactgtccaaaactgcgatctggaccagcaaagcatcgtacatattgtgcaacgtccctggcgcaaaggacaggagatgaatgccaccggaggagacgatcctcgcaatgccgcagggggttgtgagagggagccccagtctctgacccgggtggacctcagttcgagtgtactgccgggtgactccgtgggacttgcggtaatcctgcacaccgactctcgtaaagattctccaccagctggcagccctgcgggacggtccatatacaactccttttatgtgtactgcaagggcccatgccaaagggtgcagccgggaaagctgcgggttcagtgttccacatgccgtcaggctacattgacactcacccaggaattcttttttaaatgtggagcccaccctacaagtgataaggagacttccgttgctctacatctcatagccactaactctagaaacattacttgcataacctgcaccgacgtccgtagcccagtcctcgtcttccagtgtaattctcgtcacgtgatctgtctggactgtttccatctgtattgcgtgacgcgtcttaatgaccggcagttcgtccacgatccacagctgggctactccctgccctgtgttgcagggtgtccaaattctctgataaaagaactgcatcactttaggatccttggtgaggaacagtacaacagataccagcagtacggcgctgaagagtgcgtgctccagatgggcggagtcctgtgtccgaggccgggatgtggcgcaggactgctgcctgagccggatcaacgtaaggtgacatgcgaaggtggcaacggcctagggtgtgggtttgccttttgtagagaatgcaaagaagcctatcatgaaggagagtgcagcgcagtgttcgaggcaagtggcaccacaacacaagcttatcgcgttgatgagagggcagccgagcaggcaagatgggaagctgcctcaaaagaaacgatcaagaagaccaccaagccatgtccaagatgccacgttccggtagagaaaaatgggggttgcatgcatatgaagtgccctcagccacaatgccgattggaatggtgttggaattgcgggtgtgagtggaacagagtgtgcatgggagaccattggtttgatgtctag

SEQ ID NO: 234102 - DNA, 1398 bp, Artificial Sequence
  Description of Artificial Sequence: Synthetic coding sequence
atgattgtgtttgtgagatttaattcctcgcacggtttccctgtggaggttgatagcgatacatccatttttcagctgaaagaggtcgtggccaagaggcagggtgtgcctgccgatcaactaagggtcatcttcgcaggtaaggagctacgcaatgactggactgtgcagaattgcgacttagaccagcaatcaattgtccatatcgtgcagcgcccatggagaaagggacaggaaatgaacgctaccgggggagatgacccacgcaacgcagccggtggctgtgagcgcgagcctcagtctctgacccgtgtggacctgtcaagctccgtactgccaggggacagtgtcggtttagctgttattctccacactgattcccgcaaggacagcccccctgcagggtctcccgcaggtagatccatctacaacagcttctatgtgtattgtaagggcccatgccagcgcgtgcagccagggaagctaagagtccagtgcagcacgtgcagacaggcgacactcacactgacacaaggccctagttgttgggacgacgtgttgatccccaaccgaatgagcggcgagtgtcaaagccctcactgtcctggcacttctgcagagtttttctttaagtgtggtgcccacccaaccagcgataaggagacctcagtagcactgcacctcatcgctaccaactccaggaatattacctgcattacctgcacggatgtcagaagtcctgtattagtcttccaatgcaacagccggcatgttatctgtctggactgttttcacctgtattgtgtgaccagactgaatgatcgccagtttgtgcacgatccacagctagggtactcactgccgtgcgttgccggttgccccaacagcctcattaaagagcttcaccacttccgcatcttaggggaggaacagtacaaccgctatcagcagtatggagcggaagaatgtgttctgcagatggggggagtcctgtgccccaggcctgggtgtggggctggcctgctccctgaacccgaccagagaaaagtgacttgcgagggaggcaatggtctgggatgcggatttgctttttgtagagaatgtaaagaagcttaccacgagggagagtgttcggcggtgttcgaggccagcgggactactactcaggcttatcgggttgatgaacgggcagctgaacaggccaggtgggaggctgcaagtaaggaaaccattaagaagaccaccaaaccatgcccgagatgccatgtcccagttgaaaagaacgggggatgtatgcatatgaagtgtccacaaccccagtgtaggctggagtggtgttggaactgtggctgcgagtggaatcgagtttgcatgggcgatcattggttcgatgtctag

SEQ ID NO: 234103 - DNA, 612 bp, Artificial Sequence
  Description of Artificial Sequence: Synthetic coding sequence
atgagcggcgagtgtcagtccccccactgccccggaacctccgccgagttcttttttaaatgcggggctcatcctaccagcgataaggaaacttccgtggctctccacctcattgctaccaattcacggaacataacctgtattacatgtacggacgtgaggagccccgttctggtctttcagtgtaactcgcgccacgttatctgcctcgactgctttcacctgtactgtgtaaccaggctaaacgaccgccaattcgtccacgaccctcagctaggatattcgctcccgtgcgtggcgggttgtcccaacagcctgatcaaagagctgcaccattttcgcatcctgggcgaggaacagtataatagataccagcagtatggggcagaagaatgcgtcctgcagatgggaggcgttctttgcccaagacccggttgcggggctgggctcttgcctgagccagatcagcgtaaggtcacatgtgagggcggaaatgggctcggctgtgggtttgccttttgcagggagtgtaaggaggcctaccacgagggcgaatgtagcgccgtgtttgaggcgagcgggacaactacccagcatagcggctgcacatag

SEQ ID NO: 234104 - DNA, 429 bp, Artificial Sequence
  Description of Artificial Sequence: Synthetic coding sequence
tcggtgtttgtcaggttcaactcgtcacacggatttcctgtggaggtggacagtgacaccagtatctttcagttaaaggaggtggtagctaaacgccagggtgtccccgctgaccagctgagggtgattttcgcagggaaggaactgagaaacgactggaccgttcagaattgcgaccttgaccagcagtccatcgttcacattgtacagcgaccttggcgcaagggccaggaaatgaatgctactgggggagacgaccctcgcaatgctgccggaggttgtgaacgtgaaccgcagtcgctgactcgcgtcgatctttccagtagcgttttgcccggtgactcggtcggactcgctgtcatcttacatactgattcacggaaagacagcccacccgctggttcacccggaaattgcctgcatgggtag

SEQ ID NO: 234105 - DNA, 429 bp, Artificial Sequence
  Description of Artificial Sequence: Synthetic coding sequence
atggctgcagtggttgctgccaccgctctgaaaggaaggggggctcggaatgctcgggttctgagagggattctagctggcgctacggctaataaagctagccataatagaactcgcgcactccagtctcactcatctccggagggtaaggaggagcccgagccgctgtcacctgaactggagtatatcccacgtaaacggggaaaaaatcccatgaaggccgtagggctggcgtgggccatcggattcccatgcgggatattgctgttcatattgacgaaaagggaggtggataaggatcgcgtgaagcagatgaaggcgcgacagaatatgcggctgtctaatacgggcgagtatgaaagccagagattcagagcatcatcacagtcggcaccaagtccagacgtgggctctggcgttcagacctag

SEQ ID NO: 234106 - DNA, 1086 bp, Artificial Sequence
  Description of Artificial Sequence: Synthetic coding sequence
atggcttggcaggggtggcctgctgcctggcagtgggtggccggatgttggctcctcctggtcctggtgctggtgctcctggtgtccccaagaggctgcagagccaggcgcggactgagaggtttactgatggcccacagccagcgtctgttatttaggatagggtactcgctgtatacgaggacctggctgggataccttttctatcgccaacaactgcgccgtgctagaaaccgctatcctaaaggccactctaagacacagccgcgtctctttaatggcgtgaaagtgctgccaatcccagtgctgtcagataactacagttacctgatcattgatacacaggctcagctcgccgtcgctgtagacccgtccgaccctagggctgtacaagcttccatagaaaaagagggcgttaccctggttgccattctctgcacccataaacactgggaccatagcgggggtaatcgagacctctcccgacgtcacagagattgccgcgtgtacggatctcctcaagatgggattccctatttgacacatcctctctgccatcaggatgtcgtgagcgtgggccgtttgcaaattcgggcactggccactcctggacatacccaaggacacctggtgtatctgcttgacggcgagccatataaagggccttcttgcctctttagtggagacctgctgtttctaagcggctgtgggcgaaccttcgagggaaacgcagaaactatgctttcttcactagacaccgtgctcgggctgggcgatgataccttgctgtggcccggtcacgagtacgctgaggagaacctgggattcgctggagtagtggagcccgagaacctagctcgcgaacggaaaatgcagtgggtccagcgccagaggctagagcgcaagggaacctgcccttcaacccttggggaggaaaggtcttacaatccgttcctccggacgcattgcctggcactgcaggaagctttaggccctggccctggtcctaccggcgacgatgattacagcagagcccaattgttggaggaactgaggagactcaaggacatgcacaagagcaagtag

SEQ ID NO: 234107 - DNA, 1158 bp, Artificial Sequence
  Description of Artificial Sequence: Synthetic coding sequence
atggctgcagtggtcgcagcaacagccttgaagggcagaggagccagaaacgccagggttttgagaggcatcctggccggagccactgccaataaagctagccacaatcgtacccgggctcttcaaagccactcatccccggaaggcaaagaggagccagaacctctgtctcctgagctggagtacataccacgcaagcgcggaaagaatccaatgaaggcagtgggcctggcgtggtactccttatatacacgtacttggctgggataccttttttacaggcaacagctgcggagagcaaggaaccgctatcccaagggtcattcaaaaacacagccgcgattatttaatggcgtaaaagtcttgccaattcccgttctctctgacaattatagctatctgatcattgatacacaggcacagctcgccgtggccgtggatccatcagacccccgagccgttcaggcgtccatagagaaggaaggggtgactctggtggctatcctgtgcactcacaagcattgggatcactccggtggcaaccgcgacctttctaggaggcacagagactgtcgggtgtatggatcacctcaggacggcattccttatctcacgcacccactgtgtcatcaggatgtggtgtctgtcggcaggctccagattcgggcactcgccacgcccggtcatactcagggtcatctcgtctatttgttggatggagagccttataagggcccttcctgcctcttttctggtgatttgttgtttctgtcggggtgcggtcggacatttgaaggcaacgcagagacaatgctttccagtctggataccgttctgggcctcggagacgataccctgctatggccaggtcacgaatacgccgaggaaaacctggggtttgctggtgtcgttgagccagaaaaccttgccagagaacgaaagatgcagtgggtgcagaggcagcgacttgagcgcaaaggcacatgccctagtacactgggcgaagaaaggagctacaacccctttctgaggacgcattgtctggccttacaggaggctctagggccaggaccaggaccaactggcgacgatgattacagcagggcgcaactgctggaagagctccgacggctcaaagacatgcataagtccaaatag

SEQ ID NO: 234108 - DNA, 1455 bp, Artificial Sequence
  Description of Artificial Sequence: Synthetic coding sequence
atggcagctggcggagaccacggctcacctgactcatatcggtcccctctggcctcccgctacgccagccccgaaatgtgtttcgtgttcagtgacaggtacaaattccgcacctggcgccaactttggttatggttggcagaagccgagcagacactcggcctgcctatcaccgacgagcaaattcaggaaatgaaatcaaatctcgagaacatcgacttcaaaatggcagccgaagaagaaaaaaggctgagacatgacgtgatggctcatgtgcacacattcggacactgttgcccaaaagcagcagggattatccatttaggcgctacttcctgttacgtaggcgacaatacagatctgattatcctgcgcaacgccttagacttgctgctgccaaagcttgccagagttatttcccgtctcgcagattttgcaaaagagcgtgctagcctcccaactctgggcttcactcacttccaacccgctcaactgactactgtgggaaagcgctgctgtttgtggatccaggacctgtgcatggaccttcagaaccttaagcgcgtgcgggacgatctcagatttcgcggtgttaaaggtacaaccgggacgcaggcctcttttcttcagctgtttgagggggacgatcacaaagtggagcaactggacaagatggtgacagagaaggctggcttcaagcgggctttcatcatcacaggccaaacatatacccgtaaagtggacattgaggtcctgtctgtcctggcatccctgggcgcttcagtccacaaaatatgcacagacattcgattgctcgcgaatcttaaagagatggaagaaccattcgaaaaacagcagattggatcctcagccatgccttataagaggaatcccatgcggtccgagcggtgttgttccctggccagacacttaatgacactggttatggatccactgcaaactgcttccgtgcaatggtttgaacggacactggatgactctgccaataggcgcatctgcctggcagaagcctttctaacagctgatacaatcctgaacactttacaaaatatcagcgagggccttgtggtatatccaaaagtaattgagcgtcgtatacggcaggaattgccctttatggcaacagaaaacataataatggcgatggtgaaggccggaggcagtcggcaggattgccatgaaaagattagggtcctgagccagcaggcagcctccgtagtaaaacaggaaggaggtgacaatgatctcatcgagcggatccaggtcgacgcttatttctccccaattcattcccagttagaccatttgcttgatccatcttcatttacgggcagagcatcccagcaggtccagcggttcctggaggaggaggtctatcccctgctcaagccttacgagtccgtcatgaaagtgaaggctgagctgtgtctctag

SEQ ID NO: 234109 - DNA, 237 bp, Artificial Sequence
  Description of Artificial Sequence: Synthetic coding sequence
atggtgggcctgaagaagaagtcagccgatgatgttaagaaagtgttccacatgcttgacaaagacaagtccgggtttatcgaggaagatgaacttggttttattctgaagggattctctcccgacgctcgagacctgtctgccaaggagacaaagatgcttatggccgcaggagataaggacggagatggcaaaatcggagttgacgagttttccactctcgtggccgagagctag

SEQ ID NO: 234110 - DNA, 333 bp, Artificial Sequence
  Description of Artificial Sequence: Synthetic coding sequence
atgtcgatgaccgacctcctcaacgctgaagacattaaaaaagccgtgggagcgttcagtgccaccgattcttttgatcacaagaagttctttcagatggtggggttgaagaaaaagagcgcggatgatgtaaaaaaggtatttcacatgttggacaaagataaaagtggctttatcgaggaggacgagttgggcttcatcctgaagggtttctccccagacgctcgggatctaagcgctaaggaaacaaaaatgcttatggccgcaggtgacaaggatggggatggaaagattggagtcgacgaattctctactctggtggcagaatcttag

SEQ ID NO: 234111 - DNA, 306 bp, Artificial Sequence
  Description of Artificial Sequence: Synthetic coding sequence
atgtctatgaccgatctgcttaatgccgaggatatcaagaaggcagtgggagcattctcagctactgattcattcgaccataagaagttttttcaaatggtgggcttgaaaaaaaaatccgcggacgatgtgaaaaaagttttccacatgctggataaggacaagagcgggtttattgaggaggatgaattggggttcatcctgaaagggttttcacctgatgccagagacctcagtgccaaggagactaagatgctcatggctgctggcgataaggacggagacggtaagattggggtggactag

SEQ ID NO: 234112 - DNA, 984 bp, Artificial Sequence
  Description of Artificial Sequence: Synthetic coding sequence
atgtccgatctgcaggaggaaggaaaaaacgcgataaatagtccgatgagccccgctctggtcgatgtgcacccggaggatacccaactcgaagaaaacgaagagaggaccatgattgatcccacctccaaggaggatcctaaattcaaggagttagtgaaggtactgctggactggatcaacgacgtgcttgttgaagagcgtattatcgtgaagcagctggaagaagacctttacgatggccaggtccttcaaaaactcctggaaaaactcgctggttgcaagctcaatgtggctgaggtgacacaatctgagatcgggcagaagcaaaagctccaaacagtactcgaggcggtgcatgatctgctccgccctagagggtgggctctaaggtggtcggtggatagcatccatgggaaaaatcttgttgctatactgcacctacttgtgtctttagccatgcactttagggcgccaattcggctgccagaacatgtgaccgtccaagtggtggtggttcgcaagcgggaaggactgcttcattcatcccacatttcagaagagctgaccactacaactgaaatgatgatggggaggtttgaacgtgacgctttcgataccctctttgaccacgccccagacaagctttcagtggtaaagaagtccctgattacattcgtgaacaagcacctgaataagctgaatctggaggtcacggaattggaaacccaatttgccgatggggtgtacctcgtgctcctgatgggcttgctggaggattacttcgtgccgctccaccacttctacctgactcccgaatcatttgatcagaaggtgcataatgtgtctttcgcctttgagcttatgttagacggaggattgaaaaaacccaaggctcggccagaggatgtcgtcaatctagatttaaaaagtacgctgcgggttctctacaacctattcaccaagtacaaaaatgtggaatag

SEQ ID NO: 234113 - DNA, 1239 bp, Artificial Sequence
  Description of Artificial Sequence: Synthetic coding sequence
atgctgggaatcataccgcttcccttcgggaagccacagccccagtctcggaggcggcctctacgccctcccagtgcctcaagtgcaagtagaccagctcgcggaagcctccggcgagccatggctacttccccccagaagtccccctcagtccctaaatctcccaccccaaagtccccaccttcccggaagaaggatgattcctttctcggcaaactgggcggaacgttagcgaggagaaagaaagcaaaggaagtgtcagagctccaggaggagggcatgaatgctatcaacctgcccttatcccctattccattcgaactcgacccggaggatacaatgttggaagagaacgaagtaaggactatggtggatcccaattcccgatctgaccctaaactgcaagagctcatgaaggtgctgatcgattggatcaatgacgtgctggtgggtgaaaggatcattgtgaaggatctcgcagaggacctatacgacggccaagttctccagaaattgtttgaaaaactggagtcagaaaagctgaacgtcgctgaggtgacacagagcgaaatcgcgcagaaacagaagctgcagactgttttggagaagattaacgagacgctgaaactcccccctcgtagcattaaatggaatgtcgatagcgtccacgcgaagtcactggtggccatcttgcaccttttggtcgccctatcgcagtatttcagagcacctatccggttgcctgaccacgtcagcatccaagtcgtcgtcgtacaaaagcgggagggaatcctccagtccagacagatacaagaggaaatcactggcaacactgaggcccttagtggtcgccacgagcgagacgcctttgacacactgtttgaccacgcccctgataaacttaacgtagtgaaaaagacgctgattacatttgtgaacaagcacttgaacaagctcaaccttgaagtgaccgaattggagactcagtttgctgatggggtgtatctggtgctcctgatgggccttctagagggatacttcgtccccctacacagtttttttctgacccctgactccttcgaacagaaagtccttaatgtcagtttcgcttttgagcttatgcaggatggcggtctggagaaacccaaacccaggcctgaggacattgttaactgcgatctgaaatcaacccttcgtgtactatacaatctcttcacaaaatatcgcaacgttgagtag

SEQ ID NO: 234114 - DNA, 873 bp, Artificial Sequence
  Description of Artificial Sequence: Synthetic coding sequence
atgaatgcgattaacctgccactttctccaattccatttgaattggaccccgaagacactatgctggaagagaatgaggtgcgtacaatggtggacccaaactctcggtccgatcccaagctgcaggagttaatgaaagtgttaatagactggatcaacgatgtccttgtcggcgagcgcattatcgtcaaggatctggctgaggacctgtatgatggacaggtgctgcagaagctgttcgaaaaactggaatcagaaaaactaaacgttgccgaggtaacccaaagcgaaattgcccagaagcaaaagctgcagaccgttctggagaagataaatgagacacttaagctgccccctcgctctatcaagtggaacgtggatagcgtccatgccaagagcttggttgctatcttacatctgctggtggctcttagtcagtactttcgtgctcctatccgcctgccagaccatgtgagcatccaggtggtggttgtgcagaagagggaagggattctgcaaagcaggcagatccaagaagagattacggggaatacagaggccctcagtggcaggcatgaaagagacgccttcgacacattgttcgaccacgcgccagacaaactgaacgtcgtgaagaaggtcggaaaaggctgtctcgggtggacagagggctcagaaatgcagcagaatattgggaagacgcacccatgctcactgcgggctagctgccagaattggtggcatcatctgacatcggctcacactgggctgtcgccgcttccttctatgtacctgagtgttccacattggatgctgcatctaggtctcttcccgagcatctctatgaactccctctcgagtcatcccggatag

SEQ ID NO: 234115 - DNA, 1119 bp, Artificial Sequence
  Description of Artificial Sequence: Synthetic coding sequence
atggccacatcaccacagaagagtccctctgtcccaaagagccccactcccaagagccctccatcccggaagaaggatgacagctttctgggaaaactcggagggacactggctcgcagaaagaaggcaaaagaggtttccgagctgcaggaggaagggatgaacgctatcaacctcccactaagccccatccccttcgaacttgacccagaagatactatgttggaagaaaacgaggtccgcactatggtggatcctaactcccgatctgatcccaagctccaggagctgatgaaagtcctcatcgactggatcaatgacgtgttggtcggagaacgaattattgtgaaagatctggccgaggacctgtacgatggacaggtcttacagaaactctttgaaaaactggaaagtgaaaagctcaacgtcgccgaggtgactcaatcggaaattgcccagaagcagaagctacagacagtgctggagaaaattaacgaaactctcaaactaccaccaaggtcaatcaagtggaacgtcgattcagtgcacgctaagagtctggttgcaatcctgcatttacttgtagcactgagtcagtacttccgggcaccaatccggctccccgaccacgtgtccattcaagttgtagttgtgcagaaaagagagggaatcctgcagtcccgccagattcaggaagagatcaccggtaacactgagtatgtgtctagccggcataagcgggacgccttcgacactctgtttgatcacgcgcctgacaaactgaacgttgtaaagaagaccctgatcacttttgttaacaaacacttgaataagctgaatcttgaggttactgagctcgaaactcagtttgcagatggcgtctatctggtccttctaatgggtttgttggagggctatttcgtgcctctgcattctttttttcttacacccgacagcttcgaacagaaagttctcaatgtgagtttcgcattcgaactgatgcaggatggtggcttggaaaagcctaaacctaggcctgaggacatcgtcaactgcgacctgaaatccactctgcgagtgctgtacaatttgtttacaaaatacagaaacgttgaatag

SEQ ID NO: 234116 - DNA, 1119 bp, Artificial Sequence
  Description of Artificial Sequence: Synthetic coding sequence
atggctacctctccacaaaagagcccaagcgtacccaagtcaccgacacccaaaagtcctccttcgaggaagaaagatgatagcttcttgggaaagctcggcggtactctggcacgcagaaaaaaagctaaggaggtgagtgaattgcaggaagagggaatgaacgcgattaatttgcctttaagcccaatcccattcgaactcgatcccgaggatacaatgctggaggagaacgaggtccggaccatggtggatcccaatagccgctccgacccaaagctccaggaacttatgaaagtccttattgattggattaatgacgtgctagtgggggagcgcatcatcgtgaaggatctggcagaagatctgtacgacgggcaggttctgcagaagctctttgagaaactcgagtccgaaaagctaaacgtggcggaggttactcagagcgagatcgcacagaaacaaaaactgcagaccgtgctggaaaagatcaacgagaccctgaaactgccgccaaggagtattaaatggaacgttgacagtgtccatgccaagtcactcgtggccatcctccacctactggtggcactaagccagtacttccgggctccaattaggctacccgaccatgtatccatccaagtggtggtggtgcagaagcgggaaggaattctacagagtagacaaatccaggaagagattacaggaaacacagaagccctgtctggacgccacgagagagacgccttcgacactctgttcgaccatgcacctgacaagttaaatgtggtcaaaaaaacactgatcacatttgttaacaaacacctgaataagcttaacctcgaagttaccgaactcgagacccagtttgccgatggcgtatatctcgtccttctgatggggctactggaaggttacttcgttccactccactctttcttcctgacaccggattcttttgaacagaaggtgctgaatgtcagctttgccttcgagctcatgcaggacggcggactcgaaaagccaaagccacggccagaggacatagtgaactgtgatttgaagagtaccctgcgtgtcctgtataacctgttcaccaagtacaggaacgttgaatag

SEQ ID NO: 234117 - DNA, 1095 bp, Artificial Sequence
  Description of Artificial Sequence: Synthetic coding sequence
atgagttctgcgccacggtctcccacacccagaccacggcgaatgaaaaaagatgagtcctttcttgggaaactcggcggaactcttgctcgcaaacgacgggcaagagaggtatctgacctccaggaagaggggaagaatgcaattaattcccccatgagcccagctctggtggacgtgcaccccgaagatacccagttggaggagaatgaagagaggaccatgatcgatccgacttctaaggaggatccgaaattcaaagagctagtgaaagtcctgctcgattggattaacgatgtgcttgtagaggaaagaatcattgtgaaacagctagaggaggatctatatgatggccaagtgctccagaagctactggagaaactagcgggttgtaagcttaacgtagccgaagtaacccagagtgagatcgggcaaaaacagaaattgcaaactgtcttggaggcagttcacgatctactcaggcccaggggatgggcccttagatggtctgtagatagtatacatggcaaaaacttggtggccattctgcatcttttggtgtccctcgccatgcacttcagggcccctatccgtctgcctgagcacgtgactgtgcaggtggtcgttgttagaaaacgggaaggcctactgcactcctcccatatcagtgaagagctgactactacgactgaaatgatgatgggccgatttgaacgagacgccttcgacaccctgtttgaccacgctcccgataagctatccgtcgtcaagaagagtctgattaccttcgtgaataagcacctcaacaaactcaacttggaggttaccgagttagagactcaattcgcagacggagtatacctcgtcctcctcatgggactactagaggactatttcgtgcctctgcaccacttttacctgactccggagagtttcgatcagaaggtgcacaatgtttcgttcgcattcgagctgatgcttgatggtggactaaagaaacctaaggcacggccagaagatgttgtgaatctcgatttgaagagcactttgcgggtactatataacctattcaccaagtacaaaaacgtggaatag

SEQ ID NO: 234118 - DNA, 1194 bp, Artificial Sequence
  Description of Artificial Sequence: Synthetic coding sequence
atgcaccatgtgtttaaggaccatcagcgaggcgaaaaaagggggttcctgtcaccagagaataaaaattgccgacggctcgagctgcggaggggatgcagttgcagctggggcctatgcagtcaggcgcttatggcttctctcgccggtagtctgctccccggaagtgacagatccggcgtcgaaacctccgaatacgcccaaggcggtgtatcagatcttcaggaggaaggcaagaatgctatcaacagtccaatgagcccagccctagttgacgttcacccagaagatacacaacttgaggaaaatgaggagcgaacaatgatcgatccgaccagcaaggaggacccaaagttcaaagaattggtgaaggtcctgctcgactggatcaacgatgtattagtggaggagcggatcatcgtgaaacagctggaagaagacctatatgacgggcaggtgctccagaagttgctagaaaagctcgctgggtgtaaactgaatgtggctgaggtgacccagtccgaaatcggtcagaagcagaaactgcagacagtgcttgaggccgtgcatgacctccttagacccaggggctgggctctgagatggagcgtagatagtatccacggtaaaaaccttgtggccatactgcacctcctcgtgtcccttgcaatgcatttcagggcaccaataaggctcccagagcacgtgaccgtgcaggtcgtggtcgtgagaaaacgagaaggcctcctgcactctagtcatatatccgaggagcttacaactacaaccgaaatgatgatgggtagattcgagcgcgatgcctttgacaccctcttcgatcacgcaccagacaagctgtcggttgtgaaaaaaagcctgatcaccttcgtgaataaacacttgaataaactcaatctcgaagtgaccgagctcgagactcagttcgccgacggcgtgtatctggtcctgttgatgggactactggaggactacttcgtccccctgcaccatttctatctgacgcctgagtcgttcgaccagaaggtgcacaatgtaagtttcgcctttgagctgatgctggacggtggtcttaagaagcccaaggccaggcccgaggacgttgttaatctggacctgaagagtacactgagagtgctgtataacttgtttaccaaatacaagaacgtcgagtag

SEQ ID NO: 234119 - DNA, 996 bp, Artificial Sequence
  Description of Artificial Sequence: Synthetic coding sequence
atggaaccagaatttctgtatgacttgcttcaacttcctaaaggggtagaaccacctgctgaggaggagttgtccaagggaggtaagaaaaagtatctgcctccaaccagcaggaaggaccctaaatttgaagagttacaaaaagttttgatggagtggattaatgcaaccctattgcctgagcatattgttgtgcgatccctcgaggaagatatgttcgatggactcattctgcaccacctcttccagagattagccgcactgaagttagaggcagaagacattgcacttactgcaacatcccaaaaacataagctaactgtggtgctcgaggcagttaatagatctttgcagctggaagagtggcaggcaaagtggtcagtcgagtccatctttaacaaagatctccttagcactcttcacctactcgtggctcttgcaaagcggttccagccggacctatccctcccaacaaatgtgcaagtggaagtgattaccattgagtccaccaaaagcggtctcaaaagcgaaaaattggtggaacagctaactgagtactccaccgacaaagacgagcctcccaaggacgtgttcgacgagttattcaagctagcacctgaaaaagtaaacgctgtcaaggaggctatcgtcaacttcgtgaatcagaagctcgatagactcggccttagtgtgcaaaatcttgacactcagtttgcggacggggtaatcctccttctcctgatcggccaattagaggggtttttcctgcatctgaaagagttctaccttacacctaactcgccagctgaaatgttacacaacgtgaccctggcgctcgagcttctgaaggacgagggattgctgtcatgtcctgtttcccccgaggacattgtgaacaaagacgctaagagcaccctcagggtgctatacggtctattctgcaaacatacccagaaggcacaccgcgaccgcaccccacatggcgcaccgaattag

SEQ ID NO: 234120 - DNA, 81 bp, Artificial Sequence
  Description of Artificial Sequence: Synthetic coding sequence
atggagccagagttcctctatgatctgttacagctacccaagggcgttgagccacccgctgaggaagagctgagcaagtag

SEQ ID NO: 234121 - DNA, 93 bp, Artificial Sequence
  Description of Artificial Sequence: Synthetic coding sequence
atggaacccgagttcctctatgacttgcttcagctgcccaaaggggttgagcctcccgcagaagaagagttatcgaagggagtctgtccatag

SEQ ID NO: 234122 - DNA, 996 bp, Artificial Sequence
  Description of Artificial Sequence: Synthetic coding sequence
atggagccagagttcctatacgacttgctgcagctgcctaaaggggtggagcccccagccgaagaagaactgtcaaaagggggtaagaagaaatacctgcccccaacatcacgcaaggacccgaaattcgaagagctccagaaagtactgatggagtggattaatgctaccttgctcccggagcacattgttgttcgctctttagaagaggacatgtttgatgggctgattctgcaccacttgtttcagcgcctagccgctctgaagctggaggcagaggacattgccctgactgcaaccagtcagaagcataagctgaccgtggtgctggaagcagtgaatagatcactgcaactcgaagaatggcaggcgaagtggtccgtggaatcaattttcaacaaggacctgctgagtacactgcaccttcttgtagcccttgccaaaagatttcagcccgacctctctctaccaacaaatgttcaggtcgaagtgatcaccattgaaagcaccaaaagcggactgaagtcagaaaagttagtggagcaattgacagagtattctactgataaagacgagcctcccaaagacgtctttgatgaactgtttaaactggcccctgaaaaggtaaatgcagtgaaggaggcgatcgtcaacttcgttaaccagaaactggacagactgggactgtctgtgcagaaccttgatacgcagtttgccgatggggtgattctgcttctgcttattggacaattggagggattcttcttgcacctcaaggagttttatttgactcccaatagcccagccgaaatgttgcacaacgtcaccctcgcactggagcttttaaaggacgaagggctgctaagctgtcccgtgtcaccagaggatattgttaacaaggacgccaagagcaccctcagggtgctgtatggactgttttgcaaacacacccagaaagctcatcgcgatcggactccacacggcgctccaaactag

SEQ ID NO: 234123 - DNA, 996 bp, Artificial Sequence
  Description of Artificial Sequence: Synthetic coding sequence
atggaacccgagttcctgtacgacttgctgcagctgccaaagggcgtggaacctcctgctgaagaagagctctcgaaagggggtaagaagaaatacctgcctcctacgtctcgtaaagatcccaaattcgaggaactgcagaaggtgctgatggagtggattaacgcgacactgctccctgagcacatagtggttcggtcccttgaggaagacatgttcgacgggctgattcttcaccatctttttcagcgactggcagctctcaagttggaggccgaagacattgcactaacagccacgtcccagaaacacaagctgacggtcgtgttggaagccgtcaataggagcctccaactggaggagtggcaggccaagtggtctgtggaatcgatcttcaacaaggatttgttgtcgactcttcatttgctggtcgcccttgccaagcggttccagcccgatctctctctcccaaccaatgtgcaggtggaagtcataacgatcgagagcaccaagtccggcctcaaaagtgagaagcttgttgaacagctaacagagtactcaaccgataaggatgagcccccaaaagatgttttcgacgagctatttaagttagccccagagaaagttaatgccgtgaaggaggctattgtcaattttgtgaaccaaaagttggatcgtttaggactgagcgtccagaatctcgatacacagtttgccgatggcgtgattctgttactcctgattgggcagctggagggtttttttctgcacttgaaggaattctacctgacaccgaattcgcctgcagaaatgctccacaatgttaccctggctctggagctgctgaaagacgaagggctacttagctgccctgtgtcccccgaagatattgtcaacaaagacgctaaatctacactccgggtactgtatggcctgttttgtaagcacacccaaaaggcgcacagggatcggactcctcatggtgcaccaaactag

SEQ ID NO: 234124 - DNA, 414 bp, Artificial Sequence
  Description of Artificial Sequence: Synthetic coding sequence
atggtgcccgcaaaggagcaagttcctggaagatgtgactcgacacagcggtgttttcccggtccgtccaattggacaggggcaggaggcagggcaggaagtcagccgtttgtgggagacgggactctgggaactcccaacttttgttgggatcacaaggagaaaagagcagcagagtcgcaactgcaggcctgggaagctatggaaccggagttcctctatgatctgctacagttgcctaaaggagtagagccccctgccgaggaggagttgtctaagggtggcaaaaaaaagtacctcccgccaaccagtcgtaaagatcctaaatttgaggagcttcagaaacacacgtggccctcaccggtgactggcaccggggacacgatttgcggcttggcaaggaagacttggtag

SEQ ID NO: 234125 - DNA, 1083 bp, Artificial Sequence
  Description of Artificial Sequence: Synthetic coding sequence
atggccgcagagagaggtgccggtcaacagcagagccaggagatgatggaagtcgatcgacgggtcgagtccgaagagagtggggatgaggagggcaagaagcatagctcgggaattgtagctgatttgtcagaacagtccctcaaggatggggaggagcgaggagaggaagacccagaagaggagcacgagctgcccgttgacatggagacgatcaatctcgacagagacgccgaggatgtggacctgaaccattaccggatcggaaagatcgagggctttgaggtactcaaaaaggtgaaaactctttgtctgagacagaatctgataaaatgcattgaaaatctcgaggagctgcaatcccttcgagagctcgatttatacgacaaccaaataaagaaaatcgagaatctcgaagctctgaccgagctggaaattttggatatctcttttaatctgcttaggaatatagaaggagtggataagctaacaaggctgaaaaagttattcttagtgaataacaagatctcaaagattgagaatctttcaaacctacaccagctgcagatgctggagttgggcagcaatcggatcagagctatcgagaacattgacacactgaccaacctggaatctctcttcctcggcaaaaataagattacaaagctccagaacctggacgcactgaccaatctgaccgtactgtccatgcagagcaaccggctgacaaagatcgagggtctgcagaatttagttaaccttcgcgaactgtacctgagccacaatggtattgaagtcatcgagggccttgagaataataataagctgactatgctggacatcgccagtaaccgcatcaagaagatcgagaacatcagccacctgacggaactacaggaattctggatgaatgacaacctcctggagagctggtccgatcttgatgaactcaagggggctaggagtctggagacagtgtatctggagcgaaatccactccagaaggatcctcagtataggaggaaggtcatgctcgctctaccaagcgtaagacagatagatgccacctttgttcgcttctag

SEQ ID NO: 234126 - DNA, 3993 bp, Artificial Sequence
  Description of Artificial Sequence: Synthetic coding sequence
atggaagacggagggctgacagccttcgaagaagatcagaggtgtctgtcgcaaagtcttccgctaccagtgtctgcagagggacctgctgcacaaactaccgcagaacctagtaggagtttttctagcgcccaccgtcatctgtcgcgtcggaatgggttgagtcgcctttgccagagccggactgcactgtctgaagaccggtggtcctcttattgtctgtcttcccttgcagctcagaacatctgtacgtccaaacttcattgtcccgctgcgccagaacacaccgacccctcagaacctcgcggaagtgtgagctgctgttcccttctacggggtctgtcatcaggctggtctagtccactcttgccagccccagtttgtaatccaaacaaggctatcttcaccgtcgacgctaagactacagagatcctggtggctaacgacaaggcttgcggtctgctgggttattcaagtcaggatttgatcgggcaaaagttgacacagttctttttgcgtagcgacagcgatgtagtcgaggccttgagtgaggagcacatggaagcagatgggcacgcagccgtggtctttggaacagttgtcgatatcatcagcaggtccggagagaaaatccccgtgtcggtgtggatgaagcggatgaggcaagaacgcagactgtgctgcgtcgtcgtccttgagcccgttgaaagagtgagcacatgggtggcctttcagtcagatgggaccgtcacctcctgcgactcattattcgcacacctgcacggatatgtatccggagaagatgtggccggacagcatattaccgacctgatcccctccgttcagctcccaccctccggccagcacattccaaagaacctgaaaattcagagatcggtaggccgagcacgagacggcacaaccttccctctctcactcaagctgaagtcacagccttccagcgaagaagcgacaactggcgaggcagcccctgtcagcgggtaccgcgctagcgtgtgggttttttgtactataagcgggttaatcacactgctgccagatggcacgattcatggcattaaccattccttcgccctgacactttttggttacggcaagacagagctgttaggaaagaacattacattccttatccctggtttttattcctacatggatttagcttacaattcttcgcttcagttgccagacctggcgagctgtcttgatgtcggcaatgagtccgggtgcggagagcgaactctcgatccctggcaaggacaagatcccgcagagggcggacaggatccgagaattaacgtagttctggccggaggccacgtcgttcccagggacgaaattcggaagctcatggaatcccaggacatattcacaggcacccagactgaacttatcgctggaggtcagctgctgtcttgtctgtctcctcaaccagcccctggtgtagataatgtcccagagggctcgcttcccgtgcacggagaacaggctctgccaaaagatcaacagatcaccgcgctgggcagggaagaaccagtggctattgagtcacctggacaggacctgcttggcgagtcaagaagcgaacctgtggatgtgaagcctttcgctagctgcgaagacagtgaggctcctgtaccagcggaagacggcggttccgacgcaggaatgtgtggactttgccagaaggcccaactcgaacggatgggggtttccggaccatcagggagtgacctctgggccggagccgcagtggccaagcctcaggcaaaaggacagctcgccggtggttcgctgttgatgcactgcccctgttatggttcagaatggggattgtggtggaggtctcaggacttggctcctagccccagcggcatggctggcctcagttttggtacccccacgctcgacgagccatggctgggggttgaaaacgatagagaggaactccaaacctgcttaataaaggaacagctgtcacagttgtctcttgctggcgctctggacgttccccatgcagagcttgtccccacggagtgtcaggccgtaactgcgccagtcagctcgtgcgacctgggtggtagagacttatgcggcggatgtaccgggtcttcaagcgcttgttacgccctggcaaccgatctgcccggaggtcttgaggccgtcgaagctcaggaggttgatgttaacagtttttcttggaacctgaaggaactgttcttttccgaccagactgaccaaacatccagcaattgcagctgcgcgacctccgagttacgggaaactccgtcgtccctcgcggtgggcagtgatccagacgtgggctccctgcaagaacagggcagttgtgttctggatgacagggagctgctcctcttgaccggaacgtgcgttgatttagggcaagggaggcgctttcgggagtcttgtgtgggccacgatccaactgaaccgctggaagtctgtctggtgtcatcagaacattacgcagcctcagatagggagtctccgggacatgtcccctctaccctggacgcaggcccagaagacacatgcccatccgctgaagaaccacggctgaatgttcaagtgacatcaaccccagtcatcgtgatgcggggagccgctggactccagcgtgagatacaagaaggagcctactccggaagttgctaccatagggatggcttgaggctcagtattcagtttgaagtgagaagggtggagctccaaggcccaacccccctgttctgctgctggctggtgaaagatttgctgcactctcagagagacagcgctgcccgaaccagactctttttggcaagcctgccgggatcaactcattcaaccgctgctgagctgacgggcccaagtctggtcgaggttttgcgtgctcgcccatggttcgaagagccacccaaagctgtggagctcgaaggtctggccgcatgcgaaggggaatacagccagaagtacagcactatgtctcctctgggctccggcgctttcggttttgtctggacggcagtggacaaagagaagaacaaggaggtcgttgttaagttcattaaaaaagagaaggttctggaggactgttggatagaggaccccaagctgggaaaagtgaccctggaaatcgcgatactctcaagggtcgagcacgcgaatataataaaggtcctggatattttcgagaaccagggatttttccaactggtgatggagaagcacggcagcggtctggatctcttcgcgttcattgaccggcatcctcgcctggacgagcccctggccagctatatcttcaggcaagttagggccggtcagagcaggctcgtgtccgcagtgggctatttaaggttgaaggacattattcatagggatataaaggacgagaatatagttattgcagaggactttacgattaagctcatcgattttggaagcgccgcatacttggaacggggtaaactattctacacattctgcggtacgatcgagtactgcgcacccgaagtgttgatggggaacccttaccggggaccagaacttgaaatgtggtcactgggagtcaccctgtacactctcgtatttgaagaaaacccattctgtgaacttgaagagaccgttgaagccgctatccacccgccatacttggtgagcaaagaactgatgagcctagtctctggactgctccagcctgtccccgagagacgaactaccctggaaaagctggtcacggacccttgggttacacagccagtgaacctggctgattatacttgggaggaggtcttccgggtgaacaagcctgaaagcggagtgctttcagccgctagtctggaaatgggtaatcgctctctgagcgatgtggcccaagcccaggaattgtgtgggggaccagtcccaggagaagctccaaatggccagggttgccttcatcccggagatccccgacttctcacatcttag

SEQ ID NO: 234127 - DNA, 3972 bp, Artificial Sequence
  Description of Artificial Sequence: Synthetic coding sequence
atggaagacgggggacttacagccttcgaagaggatcaaaggtgcctgagtcagtcgctccccttgcccgtgtccgctgaaggtcccgctgctcagaccaccgctgagccgtctcgtagcttctcaagtgcccacagacacctgagccgacgcaatggactgagtcgcctctgtcagtctcgcactgctttgagtgaggatcgctggagtagctattgcctctctagtctggccgcacagaatatatgcacctcaaaactacattgcccggctgcacccgaacatacagacccaagtgaaccacgaggttccgtgtcttgttgtagcctgctgagggggctgtcttcaggctggtcatccccactcttgccagcccctgtctgtaaccccaataaggcaattttcaccgtagacgccaagacaaccgagattctggtggctaatgacaaggcctgtggcctgctgggctattcttcacaggatctcattgggcagaaactgacgcaattcttcctgagaagcgacagcgacgtcgtcgaagcactctctgaagagcacatggaagctgacgggcacgctgcggtagtgtttggaacagtcgtcgacatcatctcgagatcaggagaaaagatccctgtcagcgtctggatgaagcggatgaggcaggaaaggagactttgctgcgtagttgttttggagcctgtggagagggtgtcaacatgggtggccttccagagtgacggcaccgtcacgtcttgcgacagtctgtttgcgcatttgcatggatacgtcagtggagaggacgtagccggacagcacatcacagacctgatcccttcggtccaactgcccccttcagggcaacacatccccaagaatttaaagatacagcggtccgtcggccgagcaagagacgggacgacatttcctctttcccttaaactgaagtcccagccgtcgagcgaagaggccacaactggagaagccgcaccagtttccggatatcgggcttcggtctgggttttctgtactatcagtggactgataaccctcctgcctgatggtaccattcatggaattaaccattcctttgccctgaccctcttcggatatgggaagacggagctgctcgggaaaaacatcacttttttgattcctggattctattcctacatggatctggcatacaactcctccctgcagcttcccgatttggcaagctgcctggacgtcggaaacgagtcgggttgtggtgagagaaccttagacccgtggcagggtcaggatccagctgagggcggacaggatccccgaataaatgtcgtcctggcaggcggacacgtcgtgccccgtgatgagattcggaaactgatggagagccaggatatatttaccggaacccagactgagctgatcgccggaggacagctcctgtcctgcctgtctccgcagccagcccctggggttgacaacgtgcccgaggggagtctgcccgttcacggggagcaggccctgcctaaagaccagcagatcaccgctttgggcagggaggagccagttgccatcgagagcccaggacaggacttgctaggcgagagccggtcagaacctgtggatgtgaaaccttttgccagttgtgaggatagcgaggccccagttccagcggaggacggcggatccgatgccggtatgtgcggcctgtgtcagaaagctcagctggagcggatgggtgtatccggacccagtggcagcgacctgtgggccggtgcggctgtggcaaagccccaggctaaggggcagttggcgggtgggtcactgttaatgcactgtccctgttacgggtccgaatggggactctggtggcgttcccaggatttggccccttcaccaagtgggatggccggtctgtccttcggcactccaacattggacgaaccctggttgggggtagaaaatgatcgggaggaacttcagacctgtttaatcaaagagcagctgagccaactttctctggccggtgccctcgatgtgccccatgctgagctggtgcccactgagtgccaagcagtaacagcgcctgtgtccagttgcgatctagggggacgggacttgtgcggcggatgtaccggaagctcttctgcctgctacgctttagcaacagacttacctggcggtctggaagccgtggaagcacaggaagttgacgtaaacagcttctcctggaacctcaaggagctattctttagcgatcagacagatcaaacaagcagcaactgtagttgtgccacgagcgaattgcgcgagaccccgagcagccttgctgtggggtcagatcccgacgttggatcgttacaggagcaaggatcttgcgtgttagatgaccgggaactgttgctgctgacgggaacttgcgtggatctggggcagggtagacggtttcgtgagtcctgtgtgggccatgatccaacagagcctttagaagtgtgcctagtttcctcagaacactatgctgcttcagatagggagtctccaggccatgttcctagtacccttgacgctggacctgaagacacctgcccgtccgcagaggagccccgactgaatgttcaggtgacctcgacacccgtcattgtcatgagaggcgcagcaggattgcagcgagaaatacaggagggagcatactccgggtcctgctaccacagggacgggttgcgcctttctatccagtttgaggtgcggagagtggagctacaaggcccaacacctctgttctgctgttggctcgtcaaagacctccttcactctcagcgggatagcgccgcacggacaagacttttcctcgccagcctgcccggatcaacgcacagcacagctgcggaactcactggaccatctttggtcgaggtgctcagggcccgtccatggttcgaggagcctcctaaagcggtggagctggaaggactggctgcgtgcgagggagagtacagccagaaatacagcaccatgtcccctttgggctctggcgcattcgggttcgtgtggaccgccgtggacaaagagaaaaataaagaggtcgttgtgaaattcataaaaaaagagaaggtcctcgaggattgctggattgaagatccaaagctcgggaaggtgacactggagattgctatactctcaagagtggagcacgccaacatcatcaaggtgcttgatattttcgagaatcagggcttcttccaactcgttatggaaaagcatggctccggcttggacctgttcgccttcatcgaccggcacccacgtttagacgagcctctggctagttatatctttcggcagcttgtatccgcggtgggatacttacgcctgaaagacattatccatcgtgacatcaaggacgaaaatatcgtcatcgccgaagactttaccattaagcttatcgattttgggtcggcggcttacctcgaaagaggcaaactgttttacaccttctgcgggaccattgaatactgtgcaccggaggtgttgatgggaaacccatacagggggccagaattggaaatgtggagcctgggtgtgaccctgtatactttggtgttcgaagaaaaccctttctgcgaactggaggagaccgtggaagccgctatccatccaccatatctcgtatccaaagagctgatgagcctggtctctggactgcttcaaccagttcccgaacgtcgaacaacactggaaaagttagtgaccgatccctgggtgactcagcccgtgaacctggccgactatacctgggaagaggtgttccgagtgaacaagccagagagcggcgtattgtccgcggcatcgctggaaatggggaatcgatctcttagtgatgtggcacaggcccaggagctttgtggtgggccagtgccaggtgaggcccctaatggtcaaggctgtctccatcccggagatccgagacttctgacttcttag

SEQ ID NO: 234128 - DNA, 378 bp, Artificial Sequence
  Description of Artificial Sequence: Synthetic coding sequence
atggaggatggtgggcttaccgcttttgaagaagaccagcgctgtctttcccagtccctgccccttcccgtgtcagcagaggggcctgctgcacagacaaccgcagagcccagccgctccttctctagcgcccatagacatctcagtcggaggaatgggctatctcgtttgtgtcaaagcagaacagccctttccgaggaccggtggtcaagttactgtctctcgagcctggctgcccagaacatttgtactagcaagctacattgcccggcagcacccgaacacaccgacccttctgaaccaagaggaagcgtcagctgctgtagcctgttgcggggacttagcagtggatggtcttctcctcttttgccagcctag

SEQ ID NO: 234129 - DNA, 3324 bp, Artificial Sequence
  Description of Artificial Sequence: Synthetic coding sequence
atgaagcgcatgcgccaggagaggaggttgtgctgcgttgttgtgctcgagcctgtggagagagtcagtacttgggttgcttttcagagtgatggaaccgtgacgagctgtgactcactgtttgcacacttgcatgggtacgtgtccggcgaagatgtggccggacagcacatcaccgacctgattccgagcgtgcagctacctcctagtggtcagcacattcctaaaaacttgaagatccagcggagtgtaggacgcgctcgcgatggaacaacttttccactgagcctaaagctgaaatcgcagccaagttctgaagaggctacgaccggggaggccgcacccgtgtccggatatagagctagtgtctgggtattttgtactatctctgggctgattaccctcctgcccgacggcactattcatggtattaaccatagcttcgcccttaccctgtttggctatgggaagacagaactcttagggaagaacatcacttttttaattcctggcttttattcgtatatggacttagcgtataattcatcgctacagctgcccgacttggcgagttgtcttgatgtcggtaacgagagcgggtgtggagaacgtaccctggacccctggcaggggcaggatcccgcagagggaggacaggaccctcggattaacgtggtcttagccggtgggcacgtagtcccacgagatgagatccggaaattgatggaaagccaggacatctttaccgggacacagaccgaactcatagcgggaggccagctgctcagttgtctgtcccctcagcccgctcccggtgtagataacgtgcccgaagggtctctgcctgtgcacggcgagcaggccctgcccaaagatcagcaaataactgctcttggccgagaggagccagtggccatcgagtcccccggacaggacctactgggagagtcacgctctgaacctgtcgacgtcaaaccttttgcatcctgtgaagactcagaggcccctgtgcctgctgaggacggcggaagtgatgccggtatgtgcggcctgtgccagaaggctcagttggaacggatgggggtgagtggtcctagcgggtctgacttatgggccggagctgctgtcgccaagccccaagccaagggacagcttgcgggaggctctctgctaatgcactgtccatgttatggctctgagtggggcctatggtggcgctcgcaggacctcgccccttccccctcaggcatggcgggtctgagttttggcactcctacactcgacgaaccatggcttggggtcgagaacgatcgcgaagaactgcagacttgcttaatcaaggagcagctcagccagcttagcttagccggagccctggatgtgcctcatgctgagttagtgcccacagagtgtcaggccgtgacagctcctgtgagcagttgcgatctcggaggtagagatctgtgtgggggatgcacaggcagcagtagcgcctgctatgccctggccaccgatctgccagggggtctggaggctgtggaggcccaggaggtcgacgtaaatagtttcagttggaaccttaaggagctgttcttttctgaccagacagaccagacttcaagcaattgctcttgtgccacatccgaactcagagagacccccagcagccttgctgtgggcagcgatcccgacgttggctcactgcaagagcagggctcatgcgtgttagatgatcgcgaactgctactgttgactggcacctgcgttgacctgggtcaaggaagaagatttagggagtcctgtgtgggccacgaccctaccgaaccactcgaagtctgcctcgtcagttccgagcattatgctgcaagtgatagagagtctcccggacacgtaccatccacactcgacgcagggcctgaagacacatgtccaagcgccgaggaaccacgattgaacgttcaggttacatcaacgcccgtgatcgtcatgagaggagccgctggattacagagagagatccaggagggcgcttatagtggaagctgttaccatcgcgacgggcttaggctctccatacagttcgaggtgcgtcgggtggagcttcagggaccgaccccattgttttgctgttggctggtcaaagatcttctgcattcccaacgggatagtgccgctcgcaccagactgttcctggcctccttaccgggatccacccactctacagcagcggaattgaccgggcctagcctagttgaggtgctgcgcgctagaccttggttcgaggaaccgccaaaagcagtggagctggaaggactcgcagcttgtgaaggagagtacagccaaaagtatagtacaatgtcccccctggggagcggggctttcggatttgtgtggacagctgtcgataaagaaaaaaacaaggaggtggtagtaaagtttatcaaaaaagagaaggtccttgaagactgctggatagaggacccaaagctaggaaaagtgaccttggaaatcgccatactgtcaagggttgagcacgcaaatattataaaggtgctggatatcttcgagaaccaggggtttttccagttggtgatggagaaacatggcagcggactggacctctttgcctttattgataggcaccctcgtttagacgagcctcttgcttcctacatatttcggcagctagtgtccgcggtgggatatctgagactcaaagacatcatccatagggacattaaagacgagaatatcgtgatcgcggaagacttcaccatcaagcttattgatttcggctctgccgcatacctggaaaggggtaagctgttctacaccttctgtgggaccattgagtactgcgctccagaagtgcttatgggtaatccttaccggggtcccgaactcgaaatgtggagcctgggcgtgactctgtacactctggtatttgaggaaaatcccttttgtgagctggaagagactgtcgaagccgcaattcaccctccctatttggtgtctaaggaactcatgtcgctcgtttcaggactgctgcagccggtaccagaacggcgaactacactggaaaagttggtgactgatccttgggtgacacaacctgtaaacctggccgattacacatgggaggaagtgttccgggtgaataagcccgagtccggggtgctaagcgccgcttccctggagatggggaaccggtctctgtcagacgttgcgcaggcccaggagctgtgcggcggtccagtgcctggcgaggccccaaacggtcaggggtgtctgcacccaggcgatccgcgtctcttgacttcttag

SEQ ID NO: 234130 - DNA, 3414 bp, Artificial Sequence
  Description of Artificial Sequence: Synthetic coding sequence
atggggtttcctgactctgcgcgagcgggtcaacgcagtctggtcgacatcatttccagaagcggggagaagatccccgtcagtgtgtggatgaagcgcatgaggcaagagaggcgactatgttgtgtcgtcgtgctggagccagtggaacgagtgagcacatgggttgcatttcaatccgacggcacagtgacctcatgtgactctttgttcgctcatctgcacggctatgtctccggggaagacgtggctggacaacacattaccgatctgatacctagcgtgcagctgccacccagtggacaacatatcccgaaaaacctcaagatccagcggtctgtcggtagagcacgagacgggacgacattccctctgtcattgaaactaaaatcccaaccaagctcagaggaggcgaccaccggcgaggccgctcctgtatcgggctacagagcttcagtttgggtattttgtactattagtggtttgatcacgctgctgccagatggtacaatacacggcatcaaccactcgtttgccttaactctgttcggctacggcaaaaccgagcttttaggcaagaacattacttttctcatcccaggattttactcatacatggacctcgcatacaatagctccctgcagttgccagatttagcctcttgtctggatgttgggaatgagagcgggtgtggtgagaggactctggatccttggcaggggcaggaccctgcagagggaggacaggatccccgtattaatgtcgtactcgccggaggacatgtcgtcccccgtgatgaaatcaggaagctcatggagagtcaggatatcttcaccggtactcagactgagttgatcgcgggaggccagctgctgtcctgcctttccccccagccagcccctggcgttgacaatgtacccgaaggcagtcttcccgtgcacggagagcaggccctgcccaaagaccaacagatcaccgctctgggaagagaagaaccagtagctattgagtcgcccggacaggatttactgggcgagagcagaagtgagccggtggatgtgaagcccttcgcctcgtgtgaagattcggaggcacctgtacccgcagaagatggcggttcagacgccggaatgtgtggcttgtgccagaaggctcaactcgagaggatgggtgtgtcaggtccctctgggagcgacctgtgggccggtgcagcagtcgcaaagccgcaagctaaggggcaacttgcaggcggatcacttctcatgcattgcccctgttatggatcagagtggggcctgtggtggcggtcccaagatctggcccctagccctagtggaatggcgggactctccttcggaacacctaccctggatgagccttggttgggagtggaaaatgaccgtgaagaattgcagacatgcttaattaaggaacagctgtctcagctttcacttgccggtgccctcgatgttccacatgcagagttggtacccaccgagtgccaggccgtgacggccccagttagctcttgcgacctgggtggcagggacctgtgtggaggatgcaccggctcatctagtgcctgttatgccctggccaccgacctccctggcggacttgaggctgtggaagctcaggaggttgacgtgaattccttctcatggaacctgaaggagctcttcttcagcgatcaaacggatcagacttccagtaactgctcatgtgcgaccagcgaactgagggaaacaccttcttccctagctgttgggtctgacccagacgtgggttctctgcaggagcagggcagctgcgtacttgatgaccgcgagctactgctgctgactgggacgtgcgtagatctgggtcaagggcgacggttcagagagtcctgcgtaggccacgatccaacagagcccctggaggtctgcctcgtgtcctccgagcattacgccgcttccgatcgcgaaagtccaggtcatgtaccttcaacgctggacgcaggtccagaggatacatgcccctcagctgaggaacctcgcttaaatgtgcaggtcaccagcacgccagttatagtgatgcggggagcagccggtttacagcgcgagatccaggaaggtgcttacagcggatcctgttaccacagggacggcttgagactatcaatacagttcgaggtgcgcagagtggaactgcagggccctacgcctctgttttgctgttggctggtgaaggatctactgcattctcagagggactcagccgctaggactagactgtttcttgcatcgctccccggatctacccatagcacagcggctgaattgacggggccaagtctggtcgaagttcttagagcaagaccatggtttgaggaaccccctaaagccgtggagctggaagggctggccgcttgtgaaggcgagtatagccagaagtacagtacaatgagtcccctgggctcaggagcttttggattcgtttggactgccgtggacaaagaaaaaaataaggaagttgtcgtgaagttcattaaaaaggaaaaggtgctcgaggactgttggatagaggatcccaaactggggaaggtgaccttagaaattgcgattctgtctcgggtggaacacgcgaacatcatcaaagtgctcgatatcttcgagaatcagggcttttttcaactggtgatggaaaaacacggatccggccttgatctgttcgccttcatagatagacaccctcggctcgatgagcccttagctagctatattttcagacagctggtttcagctgtcgggtatctacgcttgaaagacatcattcacagagacatcaaagacgagaatattgtgatcgccgaggatttcacaattaagctcatcgattttggatccgcagcatatttggagcggggaaaactcttctataccttttgtggaaccattgagtactgtgcgccagaggttttgatgggaaacccctatcgcggtccagagttagaaatgtggagcctcggcgtgacactgtacaccctggtgtttgaggagaatccattttgtgagttagaggagaccgtggaggccgctattcatcccccataccttgtttcgaaagaactgatgtctttggtttcaggtctgctgcagcccgttccagaacgtagaaccacgctagaaaaactggtgacagacccatgggtgacccagccagttaatctcgctgactacacttgggaagaagtattccgagtcaataagccagagtccggggtcctttctgccgcatccttagaaatggggaacaggtccctgagtgacgtggcccaggcgcaagaactttgtggtggtcccgtgcctggagaggctcctaatgggcagggctgtctgcatcctggtgatcccagactcctaacaagctag

SEQ ID NO: 234131 - DNA, 3432 bp, Artificial Sequence
  Description of Artificial Sequence: Synthetic coding sequence
atggaggatggcggtctgaccgcctttgaggaagaccagcgctgtttgagtcagtctttaccacttcccgtcagtgccgaggggcctgccgctcagactacggctgagccttccagatccttttcttcagcgcaccggcacctctcccggcgaaacggacttagccggctgtgtcaaagccggacggctttatcagaagaccggtggtctagttactgtctctcctctcttgcggcacagaatatatgtaccagcaagctccactgtcctgctgccccagaacataccgaccccagtgagccacgcggtagtgtgagctgctgttcactactcaggggactgagcagcggctggtcctcccctcttctgcctgcccctgtctgcaatcctaacaaagccattttcaccgtggacgccaagactacagaaattttggttgctaatgataaggcttgcggactcctggggtacagtagccaggaccttatcggtcagaaactgacccagttttttctgagatccgacagtgacgtggtggaggctctgagtgaggagcatatggaagccgacgggcatgccgcagtagttttcgggacagtggtggacataatctcccgttccggagaaaaaattcccgtatctgtttggatgaaaaggatgagacaagaacgcaggctgtgttgcgtggttgtccttgaacccgtcgaacgagtgtcaacttgggttgcatttcagagcgacgggacggttacaagctgtgactctttgtttgcccacctgcacggatatgtgtccggggaggacgtggccggtcaacacattaccgacttaatcccatcagttcaactacctccatctggacagcatattccgaaaaacttgaagattcagcgctccgtgggacgggcacgtgatgggaccaccttccccttgagcctgaagctcaagagccagccgagttccgaagaagctaccactggcgaggcggcacctgtgagtggctatagggcttccgtatgggtcttctgtaccatctcagggctgattactctgctgcccgacggtacaattcacggaatcaatcactctttcgctcttacgctgttcggttatgggaaaacagagttgctggggaagaatattactttcctgattcctggtttttatagttatatggatcttgcctataatagctccctccagctccctgatctagctagctgcctggatgtgggcaacgaaagtggatgtggggagcggaccctggacccttggcagggccaggaccccgcagagggcggtcaagacccaaggattaatgtggtgctagccggaggtcacgtggttccgcgtgacgagattaggaagctgatggagagtcaagacatctttactggaactcagaccgaactaatcgcagggggacagctcttgagctgtctgtcccctcagcctgcacctggcgtagataatgtgcccgaagggtcgctccccgtgcacggtgaacaggcccttccaaaggatcagcagatcacagctctgggacgtgaggagccagtagcaatcgaatccccaggacaggatctcctgggcgaatcccgaagcgagcctgtggatgtcaaacctttcgccagttgcgaggactctgaggcccctgtcccagcggaagacggcggttccgatgccggaatgtgtggactgtgtcaaaaagcccaactcgagcggatgggggtgtctgggcctagcggctctgacctgtgggccggagcagcagtggcgaaaccacaggccaagggacagctggcaggcggatcactgctcatgcattgcccgtgctatgggagtgaatggggactgtggtggcggtctcaagatttggctccctcacctagtgggatggccggactgagctttggcacgcctacgctggacgagccatggttgggtgtggaaaacgaccgggaggagcttcagacatgcctcatcaaagaacaactaagccaactctctctggccggagcattggacgttcctcatgcagagctggtgccaactgagtgccaagctgttaccgcaccagtgtcatcgtgcgatcttggcggacgggacctttgcggcggatgtactggctcttcatctgcctgctacgctctggcaaccgatttaccagggggtctagaggcggtggaggcccaagaggttgacgtaaatagcttctcctggaatttgaaagaactcttcttctcagatcaaaccgaccagacgtctagtaattgttcttgtgctaccagtgagttaagagagactccaagttccttggctgtgggctccgatcccgacgtcggatccctgcaggagcagggatcatgcgtgcttgatgatcgcgagctgctgctactgaccggcacctgtgtggacctaggacagggtaggcgtttccgagagtcctgcgtgggacatgatccgacggagcccctggaggtgtgtctggtcagcagtgagcattacgcagcatccgaccgtgaatcgccagggcacgtgccttccaccctggatgccggacctgaagacacgtgtcccagtgccgaggagccaaggctaaatgtccaagtaacttccactcccgtgatcgttatgagaggagcagccggactccagcgagagatccaagagggcgcttatagtgggagctgctaccaccgtgacggtctcaggctgagtatccagttcgaagtcaggcgagtagagctgcaagggcctactcctctattctgttgctggctggtaaaggacctgttgcactcccagcgggactccgccgctaggactcggttgttcctagcttcgcttcctggttcaacacactccaccgccgcagagctcacaggtcccagtctagtggaggtattgagggccagaccctggttcgaggagcccccaaaggcagtggagctcgaaggattagcagcttgcgaaggtgagtactcccaaaagtattcaaccatgtcacctttaggaagtggcgcattcggctttgtgtggaccgctgttgacaaagagaaaaataaggaagtcgtggtgaagtttattaagaaggagaaggttctggaggattgttggatagaggaccccaaactaggaaaggtcaccctggagattgctattcttagccgagttgaacacgcaaacatcatcaaggtgctggacatcttcgagaaccagggcttctttcagctcgtgatggaaaaacatggaagcggcctcgacctcttcgcttttatcgaccgccaccccagactggatgaacctctcgcaagttatattttccgacaagtaagagctggacagagtagagtgtcggtgaatgctgggttaggtgcgtgggtcaggtggttgcaacggtccgtgattcacacccgcttttcactatag

SEQ ID NO: 234132 - DNA, 1314 bp, Artificial Sequence
  Description of Artificial Sequence: Synthetic coding sequence
atggtccagatgatgagacaattcctgtatagagtcctgcctgaggattcatataaagttactaccgggaagctgcacgttagtttgacacgcttgaccgatggcgaaaatgttgtggtatccgagttcaccagcaaggaagaactgatcgaggctctgtattgcagctgttttgtgcctgtgtactgcgggctgatccccccaacctaccgtggcgtgagatacattgatggcggattcaccgggatgcaaccatgcgcattttggaccgatgccatcactatctcaactttctccgggcaacaggacatctgcccacgcgattgccccgctatcttccatgacttccggatgtttaattgtagttttcagtttagcttggagaatattgcgagaatgactcatgcgctgttcccgccagatctggtgatcctgcacgactactattatcgcggttatgaggatgctgtcctttacctgaggcgtttgaatgccgtataccttaacagctcctctaaaagggtgatttttcccagagtagaggtgtattgtcagattgagctggcccttggcaatgagtgtccagaacgtagtcagcctagcttacgcgctcggcaggccagcctggaaggcgctactcaaccacacaaggaatgggttccaaaaggcgatggccgaggtagccacggccctcctgtgtcgcagcctgtgcaaaccctggagtttacctgtgaatcacccgtcagcgcgcctgtgtctcccctggaacagccacctgcccaacccctggcatcctcaacaccactgtccctgtcaggcatgcctccagtttcttttccagccgtacacaaacccccatcatctacccctggctcttctctgcctacccctcctccgggattatctccgttgagcccccagcagcaggtgcagccctctggctctcctgcccgatcgctgcactcccaggctccaacaagcccccgtccgtcgctggggccatccacagtcggcgctcctcagaccctgcccaggtcctccttgagcgctttcccggcacagccaccagtggaagagctgggtcaggagcagcctcaggctgttgcactccttgtcagctccaagcctaaaagcgcagtacctctcgtacatgttaaggagaccgtgtcaaagccctacgtgaccgagtctccggcagaggactcaaattgggtgaacaaggtattcaagaaaaataaacaaaagacctccggcacacgtaagggtttccctagacactcagggtccaagaagccttctagcaaggtgcagtag

SEQ ID NO: 234133 - DNA, 1599 bp, Artificial Sequence
  Description of Artificial Sequence: Synthetic coding sequence
atggaggaacaggtattcaaaggcgacccagacacaccacactcgatttccttctcaggctccggtttcctgagtttttatcaggcaggcgcagttgatgctcttcgagacctggctcccaggatgctggaaaccgctcataggttcgccggtacatccgctggagccgttattgcggctctcgcaatatgcgggatcgagatggatgaatacttacgtgttcttaatgtcggcgtggccgaggtgaagaagagtttcctaggccctctgtcgccttcatgcaaaatggtccagatgatgagacagtttctttaccgagtgttacccgaggatagctacaaagtgacaactggcaagttgcacgtgtctctgacaagacttaccgatggcgaaaatgttgtggttagtgagttcacgagcaaagaagaattgattgaagctctttactgtagctgtttcgtcccagtgtattgcggtctgataccaccaacttatcgcggagtgcgatacatcgatgggggttttactgggatgcagccttgtgctttttggaccgacgctatcaccatttctacattctccggccagcaagacatttgcccaagggactgccctgccattttccacgacttccgcatgttcaactgttcctttcagtttagcctggagaatatcgccaggatgacccatgccctgttccccccagatctggtaatcctgcacgactactactaccgtggatacgaggatgcagtactctaccttcgaaggctgaacgctgtgtacctcaacagttcttctaagagagtgattttcccaagggttgaggtatattgccaaatcgaactagcccttggtaacgagtgtcccgagcggtctcagccgtcactacgagctagacaggcatcgctggagggggctacccaaccccataaggagtgggtgccaaaaggcgatggtcgtggtagccacgggccacccgtgtcccaaccagtccagacgctggaatttacatgcgaaagtccagtgtcagccccagtgtctccactagaacaacccccagcacagccattggcttcaagcacaccgttaagcttgtcgggcatgccccctgtgagctttcctgccgtgcacaagcctccatcgtctaccccgggatcaagcctgcccacccctcccccaggcctgtccccattatccccccaacaacaggttcagccttctgggtcccccgcacgatctctccactcccaggcgcctacttctcctcgcccatcgcttggtccatccaccgtaggcgcaccgcagacgctccctcgtagttccttgtcagcatttcctgcccagccccctgtagaagagctaggccaggagcagcctcaagcagtggccctcctcgtctcctcaaaaccgaagtccgcagtccctctggtgcatgttaaagaaaccgtctctaaaccatacgtcaccgagtccccggctgaggactcgaactgggtgaataaggtcttcaaaaaaaataagcagaaaacctctggcactaggaagggatttccgagacactctgggagcaaaaaacccagttcaaaagttcagtag

SEQ ID NO: 234134 - DNA, 1602 bp, Artificial Sequence
  Description of Artificial Sequence: Synthetic coding sequence
atggaggaacaagtgttcaagggcgatcctgatacacctcattccattagcttcagcggaagcggctttctgtctttttaccaggctggggcagtggacgcacttcgcgacctggccccaagaatgctcgagactgcccatagatttgccggaacatcagctggggctgtgattgctgcactcgccatttgtggcattgagatggatgaataccttagggtgttgaatgtcggagtggcagaggtgaaaaaatcattcttagggcctctctccccatcttgcaaaatggtccagatgatgcggcagtttctgtaccgcgtgcttccggaggacagctataaagtcactaccggaaaacttcatgtttccctgactcgcctgactgacggagaaaacgtggtagtatctgagtttacctccaaagaagagttgatcgaagcagccttatactgctcttgcttcgtgcctgtttattgcggcctcattcccccaacctataggggggtcaggtatatcgacgggggattcaccggcatgcagccctgcgcgttctggactgatgccatcacaatttctacattttcaggtcaacaggacatttgcccaagggactgtccagctatctttcacgatttccggatgtttaactgctcctttcagttcagcctggaaaacatcgcacgtatgacccacgctctctttcctcctgatctcgtgattctgcatgattactattatagaggctacgaggatgcggtattatatcttaggagattaaacgcggtgtatctgaattcttcctcaaagagagtcatcttcccccgtgttgaggtgtattgccagattgaactcgctcttggtaacgagtgtcctgagcgcagtcaacctagcctccgagcgcgtcaggcgtctttagaaggagccactcagccccacaaagaatgggtgcccaaaggagacggcaggggcagccacggaccccctgtgagtcagcctgtgcagaccctggagtttacttgcgagtctcctgtctcagccccagtctccccgctggagcagcctcctgcccagcccctggcttccagcacccccctgtcactgagtggaatgccaccggtgagcttccccgcagtacataagccaccatcatcaacgcctggaagttctttacctacccctccaccaggcctgtcccctctctctccacaacaacaagtacagcctagcggttctcctgcccgatccctgcatagccaggcccctacatctcccaggccatccctgggacctagcactgtgggagctccgcagacacttcctcggtcatcactcagtgctttccccgctcagccacccgtagaggaactcggacaggaacaaccccaggccgtggccttgctggtcagctccaaaccaaaaagcgctgtgcctctcgttcacgtcaaagaaaccgtgagcaaaccatatgtgactgaaagccccgcagaggatagtaattgggtgaacaaggtgttcaaaaagaataaacagaaaacaagcggcacaagaaagggtttcccacgccattccgggagtaagaagccatcctcaaaagtgcagtag

SEQ ID NO: 234135 - DNA, 1341 bp, Artificial Sequence
  Description of Artificial Sequence: Synthetic coding sequence
atggttcaaatgatgaggcagtttttgtatcgtgtgcttcctgaagatagctacaaggtgactaccggcaaactgcatgttagcctaacccggctcaccgatggcgagaacgttgtggtgtctgagttcacaagtaaggaagaactgattgaggcgttatattgctcttgctttgtgcctgtctactgcgggctcattccccctacatataggggtgtctgggcattcctgaccctgcccccacagcgctacattgacggtgggtttactgggatgcagccatgtgccttctggacggacgctatcactatctcaacattctccggtcagcaggacatctgcccacgcgactgccctgccatcttccacgacttccgaatgttcaactgctcatttcagttttccctggaaaatatcgccaggatgactcatgctctgttcccacctgacctggtgatccttcacgattactactacagggggtatgaggacgccgtgctgtatctgaggagactgaacgcagtatatctgaattccagttcgaaacgtgttatctttccacgggtggaggtatactgtcagattgaactcgcactggggaacgagtgtcctgagcggagccagcctagcttaagagctcgccaagcttccctggagggggcaactcaaccacacaaggaatgggtgccaaaaggagacggcagagggtctcatggacctcccgtgtctcaaccagtgcagacacttgaatttacctgcgagtcccccgtctccgctccagtatcaccactggaacaacctcccgctcaaccactggcatcctcgacacctttgagcttgtccggaatgcctcctgtgtcatttcctgccgtacacaaaccaccatcatctaccccgggttcttctctgccaacaccgccacctggtttgtcacctctcagtccccagcaacaggttcaaccaagcggctcaccggctcgatccctgcacagtcaggcaccgacgtcaccgagaccctcccttggcccatccacagttggggcaccccagactttgcctcgctcatctctgtccgcctttcccgctcagcctccagtcgaagagttaggccaggaacagccccaggctgtcgccctgctggtctcctcaaaacccaagtccgctgttccactcgtccatgtcaaagaaacagttagcaagccatatgtgacagagagccctgccgaagattctaattgggtcaacaaagtgttcaagaagaacaaacagaagacttccggaaccagaaaaggatttcccaggcacagcggaagtaaaaaaccgtcaagcaaggtccagtag

SEQ ID NO: 234136 - DNA, 1515 bp, Artificial Sequence
  Description of Artificial Sequence: Synthetic coding sequence
atgttccccagagagaaaacctggaatatcagcttcgctggctgcgggtttctgggagtctactacgttggagtcgcctcatgcctccgggagcatgcccctttcctcgtagcgaacgcaactcacatctacggagcgtctgcaggcgctctgacagcaaccgcactagtgactggggtgtgtctgggcgaggcaggggcaaaattcattgaagttagtaaagaagctcgaaaacgctttctgggacctctccacccctctttcaacctggtcaagattatcagatcttttcttttgaaggtcctgcctgccgactctcacgaacatgctagcggacggttgggcatctcccttactcgggtgagcgatggcgagaatgtgattatttcccacttcaacagtaaggacgaactcatccaggctaatgtctgctcaggttttatacccgtttactgcggtcttataccccctagtttgcagggagtacgctatgtcgacggcggaatcagcgataatctgccattatatgagttgaaaaatactattacagtgtcaccattctctggcgagagcgacatatgccctcaggacagctctacaaacatacatgagttgcgagtgaccaacacgtctatccaattcaatttgcgcaatttgtaccgtctctctaaggctttgttccccccagagcccctcgttctgagggagatgtgtaagcaagggtatcgagatggacttcgcttccttcagcggaacggactcctaaatcgcccaaacccgctgttagccctcccgccagcaaggccccatggaccggaagataaagatcaggctgtagaatctgcccaagctgaggattacagtcagctgcctggggaggatcatatcctggaacatctgcccgcacgactaaatgaggcattgttggaggcctgtgtggagccaacagacttattgacaaccttatcaaacatgctgcctgtccgcttggcgaccgctatgatggtaccttacactctgcctttggagagtgctctgtcctttacaatacgtttactagaatggcttcctgacgtaccagaggatatcaggtggatgaaggagcaaactgggagcatatgtcagtacctggttatgcgggctaaacggaagttgggtcgccacttgccgtcgcggctcccagaacaggtagagttaagaagggtccagagcctgccctcagtcccactgagttgcgcagcttatcgggaggccctgcccggttggatgcggaacaatctgtcactaggcgacgccttggccaagtgggaggaatgtcagcgacagcttctgctcgggctattctgcacaaatgtggctttcccgccagaggcgctacgaatgagagccccagcagatcctgctccagcacctgccgatccagcctcaccacagcaccagctggcaggtcccgctcccctgctttcgacccctgcacccgaggctcgaccggttattggggcactcggtctctag

SEQ ID NO: 234137 - DNA, 1290 bp, Artificial Sequence
  Description of Artificial Sequence: Synthetic coding sequence
atgggcttcctcgaagaagaagggaggtggaatctttccttcagtggagctgggtacctgggcgctcatcacgtgggagcaacagaatgtctccgtcagagagcgcctcgcctgcttcagggcgctcggagaatttatggaagttcgagcggggctctgaatgccgtgtctatcgtttgtggcaagtccgtggacttctgttgttcgcacctcctcggcatggttggccaactcgagcggctgtcgctgtccattctacacccagcttacgcgccaattgagcacgtgaagcagcagctgcaggacgctctgccaccggatgctcatgttcttgcatcgcaaaggctgggaattagcttgacacgctggcccgacgggagaaattttctagtgaccgactttgccacttgtgatgaattgatccaggctctagtgtgcacgctttactttccattctactgtgggctcattccgccagaatttaggggtgaacgctacattgacggtgcactatcgaacaacctgccatttgctgattgtcctagcaccattacagtgtcccccttccacgggacggtggatatctgcccgcagtccacgtcaccaaatctgcacgagctgaacgttttcaacttttcatttcagatcagcactgagaatttttttctgggactgatttgtttaataccgccatctctggaggtggttgcggataattgtcgccagggctatctggacgctctgagatttttggaacgcagggggctgaccaaagagcctgtactctggactttggtgagcaaagaaccacccgctcccgcagatgggaattgggatgccggttgcgaccagcggtggaaaggagggctgtctctgaattggaaggttcctcacgtgcaggtaaaagacgtgcctaattttgaacaactctccccggagcttgaggccgcactcaaaaaggcctgtactagggatccctcaaggtgggctcggttttggcacagtgggccaggccaggtgctgacttatctgctgctgccctgcaccctgccatttgagtatatatacttccggtctaggaggcttgtggtgtggctgcctgacgtacccgctgatttatggtggatgcagggcttgttaagaaatatggcacttgaagtcttttctcgcacaaaggcacagctgctcggtccaatctctccacctgccaccagagttctggagacatcccctctccagccccagatcgccccacaccgggaagaactggggcctacacatcaggcatag

SEQ ID NO: 234138 - DNA, 1515 bp, Artificial Sequence
  Description of Artificial Sequence: Synthetic coding sequence
atggctgcccaacgcagaagtctcctgcagagcgagcaacaaccttcttggacagacgacctccctctctgccacctgtctggggttgggtcggccagcaatcgtagctactcagcagatgggaagggaaccgaatctcatcctcccgaggactcatggttaaaatttcggtcagagaacaactgcttcttgtatggagttttcaatggatatgacggtaaccgggtgactaacttcgtcgcacagaggctctctgctgaattgctgctaggccaactcaatgccgagcacgccgaagctgacgttaggagagttctcctgcaagcgttcgacgtggtggagaggagctttttagagtctatcgacgacgctttggccgagaaggccagtctgcaaagtcagctccccgagggagtgccacagcatcagctaccacctcaatatcaaaagattctggagcgattgaaaactcttgagcgggaaatttccggcggtgctatggccgtggtcgccgtgctgctcaataataagctgtatgtggctaacgtcggaacaaacagggccctactgtgcaagagtaccgtggatgggcttcaggttacccagctgaatgtggaccacacaactgagaacgaggacgaactgtttcgcctgtcacagctgggattggatgcgggtaaaataaagcaagtgggaataatttgcggacaggagagcacaaggcggatcggtgattacaaagtgaaatacgggtacactgacattgatctgttgagtgcagccaaaagtaaaccaatcattgccgagccggagatacacggggctcaacccctagatggcgtaacaggctttttagtgttaatgagtgaggggttgtacaaagctctggaagcggctcatggccctggtcaagcaaaccaggaaatcgcagccatgatagatacagagtttgcaaagcagacctcgctggatgccgttgcccaggccgtagtcgaccgagtcaagcgcattcacagtgacacatttgccagcggcggtgagcgcgcaaggttttgcccaaggcacgaagatatgaccctgttggtgaggaatttcgggtatcccctcggcgaaatgtcccagccgacaccttctccagcccctgcggctggagggagagtctatcccgtttctgtgccctactcaagtgcccagtctacatccaagacctctgttactctgtcactggttatgccaagtcagggccagatggttaatggagctcatagcgcctcaactctggatgaggccacccccaccctgaccaatcagtctcccacactgaccctgcagtccacaaatactcatacccaaagctcttctagtagctccgatggtggactgttcaggagtaggcctgcgcattctctgcctcctggtgaagacgggcgtgttgagccttatgtggatttcgcagaattttacaggctgtggtctgtggatcacggcgaacagagtgtggtgaccgccccttag

SEQ ID NO: 234139 - DNA, 948 bp, Artificial Sequence
  Description of Artificial Sequence: Synthetic coding sequence
atgggctttctcgaggaagagggtaggtggaacctgtcgttttcaggtgcgggatatttgggagcgcaccacgtgggggctaccgaatgcttgcggcaacgggcaccacgactgttgcagggggcaagacggatctacggcagctcgtctggagcattgaacgcagtgagcatcgtctgcggcaaatctgtggactgccccagtacaattaccgtctcacccttccacggcacagtcgatatctgtccccagagtacgtcacctaacctgcatgagctgaatgtgttcaatttttcatttcagatcagcaccgagaacttttttctgggactgatatgcctgatccccccttctctcgaggtcgtggccgacaattgccgccagggataccttgacgccctgagattcctcgagagacgcggtcttactaaagaacccgtcctctggactcttgtgagcaaggagcccccagcgcctgctgacgggaattgggacgcagggtgcgatcaaaggtggaaaggtggtctgtctcttaattggaaggtcccccatgtacaggttaaagacgtgcccaattttgagcagctcagtcctgagctcgaggcagcccttaagaaggcatgcacccgggatccctccagatgggccaggttctggcacagcggtccagggcaggtgctaacataccttcttttgccctgtaccctgccctttgaatacatatacttcagatctcgcagacttgtggtttggctgcccgacgttcctgctgatctttggtggatgcaaggtctgctgagaaatatggccctagaggtgttcagccgaacgaaagcacaactcttggggcctatatcaccgccagcgacaagagtgcttgaaactagcccacttcagcctcagattgctccccacagagaggaactggggccaacccaccaggcttag

SEQ ID NO: 234140 - DNA, 807 bp, Artificial Sequence
  Description of Artificial Sequence: Synthetic coding sequence
atgggcttcctggaggaagaggggcgttggaacctgagtttctcaggagccggttatttgggagcccaccatgtcggagcaaccgaatgtttaaggcagcgcgctccccgtctgttacagggtgcaaggcgaatctatgggtccagctcaggtgcccttaacgcagtaagtatcgtttgcggcaagagcgtcgatttctgctgttcccacctgttgggtatggtcggtcagttggagaggttgagcctgagcatactacatcccgcatacgcccctatcgagcacgtgaaacaacagctccaggatgcactgccacctgacgctcacgtactcgcatctcagaggcttggaatcagcttgactaggtggcccgacggaaggaactttctggtgaccgactttgcaacatgcgatgagttgatccaggtggtggcagataactgtcggcaaggctacctcgatgctctgcggtttctggagaggaggggactcaccaaggaacccgtgttgtggactctagtgtctaaggaaccacccgcacccgcagatggtaattgggatgctgggtgtgatcaacgctggaagggaggcctctctttgaactggaaagtgccccacgtccaggtgaaagacgtcccgaactttgaacagttgtcgcctgaactagaggccgctctgaaaaaggcctgtacgcgggatccctcaaggtgggccagattttggcattccggtcccggacaggtgctcacttaccttctcctaccttgcacattacccttcgagtacatttacttccgctcccgttag

SEQ ID NO: 234141 - DNA, 948 bp, Artificial Sequence
  Description of Artificial Sequence: Synthetic coding sequence
atggggtttcttgaagaggagggcaggtggaacctatccttctctggtgctgggtacttgggagcacaccacgtgggagccacagagtgtcttaggcagagagcaccccgactgctccagggcgctagaagaatctatggcagctctagcggcgcactaaacgccgtgtctatagtttgcgggaaatcagttgattgcccgtccacaattacagtgtctcccttccatggaaccgtggatatctgtcctcaaagtacaagtcctaatttacatgagttgaacgtctttaatttttcctttcagataagcaccgaaaatttttttttaggcttgatctgcctgattcctccctccctggaggtggtagctgataattgtaggcaagggtacctcgacgctctgcggttcctggaaaggcgtggactgaccaaagaacccgttctctggacccttgtgtccaaggagcctcctgccccagctgatgggaactgggatgccggttgcgaccagcgctggaaaggcggtttgagcctcaattggaaagtcccacacgtgcaggtcaaggatgtgcctaactttgaacagctgagccctgagctggaggcagccttgaagaaggcgtgcaccagggaccccagcagatgggcacgcttttggcatagcggccctggacaggtactgacgtacctcctgcttccttgtacactgccattcgagtatatctatttccgatccaggcgcttggttgtctggctccccgacgtgcccgcagatctctggtggatgcagggactgctgcggaatatggccctggaagtattttcgcgcactaaggcccagctgcttggaccaataagcccaccagctacccgcgttttagagacatctccactccagcctcagatagccccacaccgggaggagctgggacccacccatcaggcctag

SEQ ID NO: 234142 - DNA, 708 bp, Artificial Sequence
  Description of Artificial Sequence: Synthetic coding sequence
atggaggaggagacccatactgacgccaaaatcagagccgagaacgggaccggatctagcccaagagggccaggctgctcacttcgacatttcgcctgtgaacagaatctcctcagtcgacccgatgggagcgcctcctttctgcaaggtgacacaagcgtcctggccggagtctacgggcctgcggaggtgaaggtctctaaggagattttcaacaaagccaccctggaagtcattctgcggccaaaaatcggtcttcccggagtagccgaaaaaagcagagagaggttaatccgtaacacttgtgaagccgtggtcttagggaccctacatccccgaacatctattaccgtggtgcttcaggtggtgagtgacgccggttccctgctggcctgctgtcttaatgctgcctgtatggccctcgtggatgccggagtgcctatgcgcgctctgttttgcggggttgcgtgcgcattggactctgatggcaccttggtgctcgaccctacctcaaaacaagagaaggaagctagagccgtgctgactttcgccctggactccgtcgagcgaaagctattgatgtcgtctactaaggggctctatagcgacacagagttgcagcagtgcttggcggctgcccaggctgcgagccaacatgtgtttcgattttaccgagaatcactccagaggcgatatagcaaaagctag

SEQ ID NO: 234143 - DNA, 4128 bp, Artificial Sequence
  Description of Artificial Sequence: Synthetic coding sequence
atggaggcacccctccagactggcatgatgggcacatctagccacggactggccacaaattcatcaggagctaaagtagcggagcgggatggcttccaggacgtgctggcacccggtgagggatccgcagggagaatatgtggagcccagcctgtaccattcgtgcctcaggttctcggggtgatgattggagcaggagtggctgtagtcgtgaccgctgtactcatactcctggtggtaagacggctgcgagtgccgaagacccctgcccctgacgggccaagatatcgctttcgcaaaagagataaagtcctgttttatggcagaaagattatgcgtaaagtctcgcagtctacctcaagtctcgtggacaccagcgtatcagcaaccagccgcccaagaatgcgtaagaagctcaagatgctgaatatagccaagaaaatcctgagaatccaaaaggagacaccgactctgcaaaggaaagaaccaccgccagctgtactggaagccgatctgacagagggcgacctggccaatagtcaccttccaagcgaagttctgtatatgctgaaaaacgtgagagtccttggacactttgagaagcccctttttttagagctgtgtaggcatatggttttccagagactgggacaaggagattacgtttttaggccaggacagcccgacgcttcgatttacgtggtccaggatggcctgctggaactatgcttgccaggtcctgacggtaaagagtgcgtggtgaaagaagtagtgccaggggactcagttaacagcctcctaagcatcctggacgtaatcactggacaccagcatcctcagcggacagtgtccgcgagggccgcacgggatagcactgtccttcgtttgccggttgaggcattctcggccgtcttcaccaagtaccctgagtccttggtccgcgtcgtacagataattatggtcagactccagcgagtgacttttttagccctacacaactacctggggttgaccaacgagctgtttagtcacgaaatccagccactgcgcttgtttccctcacctggtttgcctacccgaacctcacccgtaagaggtagtaagcggatggtgtctacatcggctactgatgagccacgggagactcccggacgccctcctgaccctacaggagctcctcttcctggaccaacaggagatccagtcaaaccaacgtctttggagacaccaagtgctccccttctttcccggtgcgtgtccatgccaggggacatctcaggcctacagggtggacctcgttccgatttcgatatggcctatgagcgtgggaggatttccgtgtcactgcaggaggaagcctccggcggttcattagccgctcctgcacggactcccacacaggaaccgagggagcaaccagctggagcctgcgaatacagctattgcgaagacgagagcgctaccggcggttgccccttcggtccttaccaaggcaggcagacttccagcattttcgaagccgcaaagcaggaactggccaagttgatgcgtattgaagatccttcactgctgaattcacgcgtgttactacatcacgctaaggccggaactataattgcgcgtcaaggagaccaggacgtttctctgcactttgtactgtggggatgcctacacgtctaccagcgaatgattgacaaagcagaagacgtgtgtctgtttgtggcccaaccaggggagctcgttggccagctggcagtcctgacgggcgagcccttgatttttaccctcagagctcagagggactgcacattcctccgcataagtaaatccgacttttatgaaatcatgagagcgcaacccagcgtggtactttcagccgcacacaccgtggcggctagaatgtcacccttcgttagacagatggacttcgccattgactggactgctgtggaggccggacgcgctctgtacaggcaaggggatagaagcgattgcacatatatcgtgctgaacggccgtctgaggagtgtgattcagcggggttctggaaaaaaggagctagtgggtgagtacggcagaggagatctgatcggtgtagtggaagcactcacccggcagccaagggcaaccacagtgcatgcagtgcgcgacaccgagctcgcaaaacttccagaagggactcttggccacatcaagcggagatacccacaagtggttacccgtcttatccacctgttgtcccagaagattctggggaacctgcagcagctgcagggcccattccctgctgggtcaggtctgggcgtgccaccccattccgaactcacaaaccccgcttccaacctagctacagtggctattttgcctgtctgtgccgaggtacccatggtggctttcactcttgaactccaacatgcccttcaggctattggccctactctgctgctcaattctgatataatccgggctcggttaggtgctagtgccctggattccatacaggagttccggttgtcaggctggctggcccaacaagaggacgcacaccgcattgtgttgtatcagactgacgcatctctcaccccttggaccgtacgctgcctaaggcaggctgactgtattctgatcgtagggctcggcgatcaggagcccacactggggcagctggaacaaatgctggagaacactgccgtcagggcactgaaacagctggttttactccacagagaggagggggctgggccaactcgaaccgtggagtggttgaatatgaggagctggtgttcgggccacctccacctacgatgcccacgacgactttttagtagacgtagccctgcaaaactgcacgagctgtacgagaaagttttctctaggcgggctgataggcactccgactttagccgactcgcccgagtcctgacagggaacacaatagcactggtgttgggtggaggtggcgctcgaggctgcagtcacattggagtcctgaaagcccttgaggaggctggtgtgcccgttgatctggtgggcggtacgagcattgggtctttcatcggagcactctacgcggaggagagatccgcttcacgtacgaagcagagggcgagagagtgggctaagagtatgaccagcgtcctggaacctgtgctggacctaacctatcccgtcacttccatgttcacaggcagcgcgtttaaccgctccatccatagggtttttcaggataagcaaatcgaggacttgtggttgccgtatttcaatgtgactaccgacatcaccgcctccgccatgagagtccacaaagacggttctctgtggagatacgtcagggcctcaatgacactgtccggatatcttcctccactctgcgaccccaaagatggccacctgctgatggacgggggatatataaacaacctgcccgcagatattgcccgatcaatgggagcaaaaaccgtcattgccatcgacgtggggtctcaggacgagacagacctctcaacatacggcgatagcctgtcgggctggtggctgctatggaagcgcctcaatccatgggctgataaggtcaaggtgccggacatggccgagattcaaagtcggttggcctacgtgagctgtgtgcggcagctggaggtcgtcaaaagtagctcatattgcgagtacctgcgacctcccatcgactgtttcaagaccatggactttggcaaattcgaccaaatctatgacgtcggctatcaatatggcaaagctgttttcggcggttggagtcgaggcaacgttatagagaagatgctaactgacaggaggtccaccgaccttaacgaaagtagaagggccgatgttcttgcttttccttcaagcggatttaccgatctcgcagagatcgtttctcgaattgaaccccctactagctatgtctcggatgggtgtgcggatggagaggaatccgattgcctgacggagtacgaagaggatgctgggccagactgctcacgggacgaaggcggtagccccgagggagcctctccgtcaacagcctcagaaatggaagaggaaaaaagcattctgagacagcggagatgtttaccccaagaaccgcctggatctgccaccgatgcctag

SEQ ID NO: 234144 - DNA, 3984 bp, Artificial Sequence
  Description of Artificial Sequence: Synthetic coding sequence
atggaagctcccctgcaaactggtatggtcctgggagtcatgatcggcgctggggttgcagtggtggtgaccgctgtgctgattcttcttgtcgtgcgacggctaagagtcccgaaaactccagccccagacggccctcgttatcgtttccgcaagcgcgacaaggttctcttctatggcagaaagatcatgcgaaaggttagccagtccacttccagcctggttgacactagcgtatccgccacgtcgcggcctcgaatgagaaaaaagctgaagatgctgaatatagctaagaaaattttgcgcatacaaaaggaaacccccacgttacagaggaaagagccccctcctgctgtgcttgaggcagatctgacggaaggggatttggcaaactcccacctgccatctgaggtgttatacatgctgaagaacgtgcgagtactggggcattttgagaagccgctttttcttgagttatgtcggcatatggtgttccaaagattgggtcagggagattatgtgttcaggcccggtcagccagatgcttccatctatgtagttcaagacggccttctcgagctgtgtttgccaggccctgatggcaaggaatgtgtagtgaaggaggtggtccctggcgacagcgttaattcccttctctctattctcgatgtgattacaggccatcagcatcctcagagaacagtctccgccagagccgctcgtgactcaactgtacttcgtctccctgttgaagctttctcagccgtctttaccaagtatcctgaatcccttgttagggtggtccagattataatggtacgtctccagcgggttacttttttggccctgcacaactacctgggcctgaccaatgagcttttcagccatgagatccagccactccggcttttcccaagcccgggactgcctactaggacttcacccgtccgcggatcaaaaaggatggtgagcacttccgcgacagacgagcctcgagagacaccgggaagaccccctgatcccacaggagcgccattgccaggcccaactggagaccctgtgaaaccaacttccttggagaccccctccgcgccactcctaagcagatgcgtctccatgcccggtgatatatccggactccagggcggaccgcgaagtgattttgacatggcttacgaaagaggtcgcataagcgttagtctgcaggaagaagccagcggcggaagcctggccgcacctgccaggacaccaacacaagaacctagagagcaacccgcaggagcgtgcgaatactcctactgtgaggatgagtctgctacggggggttgtcccttcggcccatatcaaggaagacagacatcgtccattttcgaagccgctaagcaggagcttgccaagctgatgcgtatagaagacccctctctgctaaacagccgcgtgttgttgcaccacgccaaagcaggcactataatagctcggcagggcgaccaggacgtttctttgcatttcgtactttggggctgcctgcacgtgtatcagcggatgatagacaaagccgaggacgtgtgcctgtttgttgcccaaccaggagagttggtgggacagctggctgtgctgaccggcgaaccattaatttttaccttgcgtgcgcagcgggactgtacatttctacgcatttccaaatccgatttctatgaaatcatgcgcgcacagcccagcgtggtgctaagcgcagcccacacagttgctgctagaatgtctccctttgttaggcaaatggattttgcgattgattggactgctgtggaggctggccgtgccctgtataggcagggcgataggtctgattgtacttatattgtgctgaacggacggctgcgttcagtgatccagagaggcagcggcaaaaaggaactggtcggagagtatggacggggtgatttgatcggtgtcgtggaagcgctgactcgtcaaccacgagccaccactgttcatgcggtgcgagacactgaacttgcaaaattgcccgagggcaccctggggcacataaagcggagatatccccaggtggtgacgagactcatccatcttttgagccaaaagattttaggcaacctgcagcagctgcaaggtcctttcccagcagggtcaggacttggagtcccacctcactccgagctgaccaacccagcgtctaacctggcaaccgttgccatcctgccggtatgtgcagaagtacctatggttgcatttaccttggagctccaacacgcacttcaggccatcggcccaacgctgctcctcaatagcgacatcatcagggctaggttaggggcttccgcccttgattccatccaggagtttcggctttccgggtggttagcacaacaagaagacgcacataggatcgttttgtaccaaaccgatgcctccttgaccccttggactgtcaggtgcctgcgacaggcggattgtattcttattgtgggcttaggggaccaagagcccactctgggccaactggagcagatgcttgagaatacggctgtgagagccttgaagcaactggtactgctgcatcgcgaggagggggctggccctacacgcacggtggaatggctgaacatgaggagctggtgtagtggtcacctgcaccttcgctgccctcggcgactattttctcggagatcccccgcaaaactgcacgagctctatgaaaaggtgttctccagacgcgctgatcgccattctgacttttccagactggctagagttctgaccgggaacacaatcgcgctggtcctcggtggtggaggcgcacgcggatgcagtcacattggtgtgcttaaggcattggaagaagccggagtgcccgtggacttggtcggagggaccagcataggtagttttattggggcattatacgcggaggagaggagcgcgagtcgaacgaagcaacgtgcgagggagtgggccaagtctatgacatcggtactggagcccgtgctggaccttacctatccggtgactagtatgttcacgggctcggcttttaaccgaagtatccatcgcgtgttccaggacaaacagattgaagacctgtggttaccctattttaacgtcacaaccgacattacagcatctgcaatgcgcgtccataaggatggaagcctctggcgctacgttcgggcaagtatgacattatccggctacctgccccctttatgtgacccaaaagacggccacctgttgatggacgggggttacattaacaacctccccgctgacattgccaggtctatgggggcaaaaacagtgatcgccattgacgtgggttcccaagacgaaactgacctatctacttacggggactcgctgtctggatggtggctgctatggaagcgcctaaacccttgggctgataaggtcaaggtgcctgacatggctgaaatccaatcccgcctggcttatgtctcctgcgtgagacagctggaagttgtcaaaagtagtagctattgcgagtaccttaggccgcctatagactgcttcaagacgatggactttggcaagttcgaccagatctatgatgttggttatcagtacgggaaggccgtgttcgggggttggtcccggggtaacgtgattgagaagatgcttacagatcgcagatcaaccgatctgaacgaaagtcgccgagctgatgttttagccttcccatcatctggctttacggacctggctgagattgtgtcacggattgaaccacccaccagttacgtgtcggacggttgcgccgacggggaagagtcagactgcttaactgaatacgaggaggacgcgggacccgactgctcccgagatgagggcggtagcccagaaggagcttctccatctactgccagtgagatggaagaagagaagagcatattacgacagcggcgatgcctgcctcaggagcccccagggtcagccaccgatgcttag

SEQ ID NO: 234145 - DNA, 1371 bp, Artificial Sequence
  Description of Artificial Sequence: Synthetic coding sequence
atgaggaaagtctcccagagcacatcttctctcgtagacacttcggtctccgccacctctcggccaagaatgaggaaaaagttgaagatgctcaatatcgccaaaaaaatactcaggatccagaaggagacacccaccctccaacgaaaagagccccctccggcagttctcgaggcagatctgactgaaggagacctggctaactcacacttgccaagcgaggtgctgtacatgctaaaaaacgtacgggtgctcggtcacttcgaaaagccactcttcctcgagctctgtcgccacatggtatttcaacgactggggcagggagactacgtcttccgtcctggccagcccgacgccagcatatacgtggtgcaagatggtctgttggagctgtgtctcccgggaccagatggaaaggagtgtgttgtcaaggaggtcgtgcccggagatagcgtcaactctctgctgtctatcctggacgttatcaccggacatcaacacccacagagaactgtgtccgcccgagccgctagagactctacagttctccgcctccctgtcgaagccttctcggccgtcttcacaaaataccctgaatcgctggtccgtgtggttcagatcataatggttcggttgcagcgagtcacgttcctcgctctgcacaactacctgggcctgaccaacgagcttttcagccacgaaatccaacctttgagactgtttccgtcacccggactgccaacacgaacctccccagtcagaggctctaagaggatggtctctacatcggctaccgacgagcccagagagacacctggtagaccccctgaccctaccggggctcccttgcccggtcccaccggcgatcctgtcaagccaacttcactcgaaaccccatctgcgccactgctcagccgatgcgtgagcatgcctggcgacatttctgggctgcaggggggtcctaggagtgacttcgatatggcgtacgagcggggaagaatttccgtttcattgcaggaagaggcaagtgggggttctttggcagctcctgctaggacgccaactcaggagccaagggaacagccggctggggcttgcgagtactcctactgcgaagatgaatcagccacgggtggatgtcctttcgggccataccaggggaggcagaccagctccatttttgaagcagctaagcaggaactggccaagctgatgcgaattgaggacccgagtctgcttaatagtagagttttactccaccatgccaaagccggaacgattatcgctagacaaggcgaccaggacgtgagcggtcctcacacggggcttacctgtcccgagagagggtgtagtgtcgcgttgatgacctag

SEQ ID NO: 234146 - DNA, 3903 bp, Artificial Sequence
  Description of Artificial Sequence: Synthetic coding sequence
atggaagcaccgttgcagacaggcatggtgctcggtgtgatgattggggctggggttgcagtggtggtgactgccgtactgatcctcttggtggttaggcggctgcgggtccctaaaactccagctccagacggccctcggtacagattcagaaaaagggataaggttctcttctatggccgtaagattatgagaaaggtatcgcaaagtaccagctctttggttgatacgagcgtttcagctaccagccgaccacggatgcgaaagaagttaaagatgctcaatatcgccaaaaagatacttagaattcagaaagagactcctaccctacagcgcaaggagcctccaccagcagtgcttgaggcagacctgacagagggtgaccttgccaattcgcatctgccatctgaggtgttgtacatgctgaagaacgtgcgcgtgctggggcattttgaaaagccccttttcctagagttatgtcggcatatggtgttccagcggttaggacagggagattacgtgtttaggcctggacagcccgatgccagtatatatgttgtacaagacgggctgctggaactgtgtctgcccggtcccgatggtaaggagtgcgtggtcaaagaagtggttcccggagatagcgtaaactcgctgctgtcgatactggatgtgatcacaggacatcaacaccctcagcgaaccgtgagcgcacgtgccgctagggattcgaccgttctgcgattgcccgtggaggcattcagcgctgttttcacaaaataccccgaatctctggttagggttgtccagattattatggttcgcctgcagagagttacctttctggccctccacaactacctggggctgactaacgaactgttcagccatgaaatacaacccttgaggcttttccccagccccggtctgcccacccgcacttctcccgtgaggggatcgaagcgcatggtgagtacctcagcgacagacgagccgcgtgaaactcctggtagaccgccagaccctacgggtgctcccttgccagggccaacaggggatccagtgaagccaacttcattagagacccccagtgcccctttgctgagcagatgtgtttctatgccgggagacattagtggactgcaaggaggcccacgctctgactttgatatggcctatgagagaggacggatctctgtgagcctgcaggaggaagcgtcaggcggttccctcgccgctccggcaaggaccccaactcaggaaccccgagaacagcctgcaggggcttgtgaatatagttactgtgaggacgaatctgccacaggaggatgcccctttggcccataccagggccgacaaacgtctagtatctttgaggctgcaaaacaggagctagccaaactgatgcgtattgaggatgtctctctccactttgtcctgtggggatgtctgcacgtgtaccaaagaatgatagacaaggccgaggatgtatgtctctttgttgcccagcccggtgaactggtggggcaacttgctgtccttactggagagcccctgatttttacactcagggcccagagagattgtacgtttctgaggataagcaaaagtgacttctatgaaatcatgcgcgctcagccatccgtcgtactgagcgccgcacacaccgtcgccgcacggatgagccccttcgtgagacagatggatttcgctatcgactggactgcagtggaggcaggaagagccctgtacagacaaggggaccgcagcgactgcacatacatcgtacttaacggaagattacggagcgtaattcagcgaggctccggaaaaaaggaattggttggcgagtacggcaggggcgacctcattggtgtcgtggaggccctgaccagacagcccagggcaactacagttcacgctgtgagggatactgagctggccaagttacccgaaggtactctcggccacattaagaggaggtacccccaagtcgttacccgattaattcatctgttatctcagaagattcttggaaatctgcagcaattgcagggcccttttccaggatccggactgggagtgcccccacattcagagctaacgaaccccgcttccaacttggccacggttgctatcctgccagtctgtgccgaggtcccaatggtggctttcactctcgaacttcaacatgctctacaggcgattggcccaacactgctgctaaactcagatataataagggctcgtctgggggcatcagctcttgatagcatccaggagttcaggctatcaggatggcttgcgcagcaggaagatgcccaccgaattgtgctgtaccaaactgacgcctccctgaccccctggacagtgcgttgcctgaggcaggccgattgcattctgattgtcggcttgggagatcaggagcccacacttggccagcttgaacagatgctggaaaatacggccgttagagctctcaagcagcttgtgctgctacacagggaggaaggggcaggcccaacacggactgtcgagtggctgaacatgaggtcatggtgctctggacacctgcacctgaggtgtccccgaaggttgttcagtcggaggtctccagccaaactccatgaactttatgaaaaagttttctccagaagagccgatcgccactccgatttctccagattggcaagggtgttgaccggaaacacaatagccttagtcctgggcggtgggggagcacgcggttgcagccacatcggagttcttaaggcgcttgaggaagccggagtgccggtcgacctggtaggcggtacaagtatcggaagtttcatcggcgcactctacgcagaagagcgatctgcgagtagaacaaagcagcgggcaagagaatgggcgaaaagcatgacaagcgtcctcgaacctgtcctggatttgacataccccgtgacctcaatgttcaccgggtcagcattcaataggtctatccaccgtgtttttcaggataaacagattgaggacctgtggttgccttactttaacgttaccaccgatattacggcctctgccatgcgagtgcataaagatggctcgctttggcggtatgtcagggccagcatgacactgagcgggtacctgccaccgctgtgcgatcccaaagacggccatctgctcatggatgggggatatatcaacaacctgccagccgatatcgcccgttccatgggagctaagactgtaattgcgatcgacgtcggtagccaagacgagactgatttgtcaacatacggggacagcctttcgggatggtggctcctctggaaacgcctgaatccttgggccgacaaggtcaaagtcccagacatggctgagatccagtcacgcctcgcttatgtgtcctgcgtgcgacagctggaagtggtaaagtccagttcatattgcgaatacctgaggcctccaatcgactgctttaaaaccatggactttgggaagttcgatcagatctatgacgtgggatatcagtatgggaaagctgtttttggcggttggtcaagaggcaacgtcatcgagaagatgctgactgatcggcgatctactgatctcaacgaaagcagaagggcagatgtgttagcctttccttcctctggattcactgatctggcagagatcgtatcccgcatagagcccccaacctcttatgttagcgatgggtgtgccgatggggaggagtcggattgccttaccgagtatgaagaggacgctggccctgattgtagccgagatgagggaggttccccggagggcgcaagtccatctacagcttctgagatggaagaggagaaaagtatcctccgacagcggaggtgcctcccccaggagccaccgggttcggcaacagacgcctag

SEQ ID NO: 234147 - DNA, 3954 bp, Artificial Sequence
  Description of Artificial Sequence: Synthetic coding sequence
atggaagaagaaaaggatgacagccctcagctgaccggcattgctgtgggcgcactgctggccctcgcactcgtgggagtgctcatcctattcatgttcaggcgactgcggcagttccgtcaggcgcaaccaaccccacagtaccgctttcgcaagagagataaggtcatgttctacggacggaaaatcatgcgaaaggtgaccactctccccaacacactggttgagaacactgccttaccgagacagcgcgcacggaagcggacaaaagtgctgtccctcgccaagcgcattcttcgattcaagaaagagtatccagctttacaacctaaggaacctcccccatccctacttgaggccgacttaacagaattcgatgtgaagaatagccacttgcctagcgaagtcttatatatgctcaagaacgtccgtgttctgggccacttcgaaaagcccctgtttctggagctctgtaaacacatcgtcttcgtgcagctacaggaaggcgagcacgtgttccagccacgtgagccagatccctcgatttgcgtagtgcaggatggtcgccttgaagtctgtattcaggatacagacgggaccgaggtggtggtgaaggaagtgctggcaggcgactccgtccacagtttgctgtcaattttggatatcattacagggcacgccgcaccatacaaaaccgttagcgttagggcggctattccttcgaccatcctccgcttacctgctgctgcttttcatggggtgttcgagaaataccctgagactctggtgcgcgtggtacagataattatggtccgactccaacgtgtgactttcctggcactgcacaattacttgggactgacaacggagctgttcaatgccgaatcgcaagctattccactggtgagcgtcgcttctgttgctgccggtaaagcaaagaagcaggtgttctacggggaagaggagaggttgaaaaagccccctcggctccaggaatcatgcgatagcgatcatggtggaggtaggcccgcagcagccggaccactcctgaaacggtcgcattcagtcccagcccctagcattcgtaagcagatacttgaggagctggagaagcctggcgctggcgatcccgacccctctgcaccccaggggggtcccggttccgcgaccagcgatctgggcatggcatgtgacagggcccgagttttcctccactctgacgaacatcccggaagcagcgtggcaagcaagtcaaggaagtccgtgatggtggctgagatcccgtccaccgtgagccagcattcagaatcacacaccgatgaaactctggcttccaggaagtcggacgctatcttcagagcagccaagaaggacctgcttactctgatgaagctcgaggactcctccctacttgacggtcgtgtggctttgttgcatgtcccagctggtactgtagtgagtagacagggggatcaagacgctagcattctgtttgtagtctcaggtctactccatgtataccagaggaagataggttctcaggaagatacttgcctgtttctaacgcgacctggagagatggtggggcagctggccgtattaactggcgagccactgattttcaccgttaaagctaaccgagactgttcattcctaagtatatccaaggcccacttctatgaaattatgcgaaaacaacctaccgtcgtactgggggtggcccacactgttgtaaagcggatgtcctcatttgtccggcaaattgacttcgctctcgattgggtcgaagtggaagccggacgtgccatttatcggcagggggacaagagcgactgtacttacattatgctctcagggagactgagatctgtcattagaaaggatgacggcaagaaacgtctggccggagaatatggcagaggcgatttagtcggggtggtggagaccctgacccaccaggcgcgtgctacaactgttcacgctgtgagggacagcgaactggctaaattacctgccggagccctgactagtattaagcgccgatatccccaagttgttacgaggctgattcatttgctgggggaaaagattctgggatctctgcagcagggccctgtaacaggccatcaactgggcctgccgacagagggaagcaagtgggatcttggcaatccggctgtgaacctttccacagtggctgtgatgcccgtttccgaagaggtaccccttaccgccttcgctctcgagttggaacatgctctctctgctattggaccaaccctgctgttgaccagtgacaatatcaagagacgcctagggagcgcagcgctggactcagttcacgaatacagacttagttcatggctgggccagcaagaagatacacacaggatcgtgctgtatcaggtggacggcacactcacgccgtggacccagagatgtgtgagacaggccgactgtattctgattgtcggtttgggggatcaggagcctacagttggcgaactggaaaggatgctggagtccaccgcagtgcgggctcagaaacaattaatcctactgcacagagaagagggccctgcacccgcacggacagtggagtggctgaacatgcggtcctggtgcagtgggcacctgcacctgtgctgcccacgcagagttttcagtaggcgctctctgccaaaactggtggagatgtataagcacgtgtttcagcggccaccagacagacactctgacttttctagactcgctcgtgtgctcaccgggaacgcgatagcgctagttctgggtgggggtggcgctcggggttgtgcgcaagtgggcgtcttaaaagctctggccgagtgtggcataccggtcgatatggtaggaggaacttcaataggtgcattcgtgggcgctttgtacagcgaagagaggaactatagtcagatgaggatcagggcaaaacagtgggctgaggggatgacctcactgatgaaggccgcattggacctgacctatccaattaccagcatgttttcaggggctggcttcaactcttcaatcttctccgtgtttaaggaccagcagattgaggacttgtggataccgtacttcgctattaccacagatattacagccagcgccatgagagtacataccgatggaagtctgtggtggtacgttcgggcaagcatgtcactgagcgggtacatgcctcccttgtgcgaccctaaggatggccacctgttaatggacggtggttacattaataatctgccagccgacgtggcaagatctatgggtgccaaagtagtcatcgcgattgatgtcggatctcgcgacgagacagatctaacgaactatggtgacgccctaagcggctggtggctgctatggaaacgctggaatcctttggcaaccaaggtgaaagtgctgaacatggctgaaatacagacccgattggcctacgtttgctgcgtgcggcaattagaggtggttaaatcttccgattattgcgaatatctgcgtcctccaattgacagctattcaacactggattttggtaaattcaatgaaatttgcgaggtgggttaccaacacgggcgaaccgtgttcgatatatggggcaggagcggagtcttagaaaaaatgctgcgagaccagcagggcccttctaaaaaaccagcttccgctgttctgacctgccccaatgcctcattcaccgacctggccgaaatcgtgtcgagaatcgagccagccaagcctgctatggtcgatgacgaatccgattatcagacagagtacgaagaagagctcctggatgtccccagggacgcttatgccgattttcagtccacctctgcccagcaaggctcagatctggaagacgagtcctccctcagacaccgccacccatcgttggcctttccaaagctgagcgaaggcagtagtgatcaggatgggtag

SEQ ID NO: 234148 - DNA, 2178 bp, Artificial Sequence
  Description of Artificial Sequence: Synthetic coding sequence
atggtgagactccagagagtaacttttcttgcccttcacaactacctgggcctgactacagaactttttaacgctgagtcacaagccatacctctggtctcggtggcgtccgtggccgctggaaaggccaagaaacaggttttctacggcgaggaggaaaggctgaagaagccaccacgcttacaggaaagttgcgattctgccgaccatggcggtggcaggcccgctgcagctggcccactgctgaaaaggtcacacagcgtaccggcaccatcgattcgcaaacagatactcgaagagctggagaaacccggtgccggagacccagatccgagcgcacctcagggccatcaattggggctgcctaccgaaggaagtaagtgggacctggggaatcccgctgttaacctgtccacagttgccgtgatgccagtgagcgaagaggtaccactaacggcatttgcactggaacttgagcacgccctctcagctatcggccctaccttgctgctgacatcagacaacatcaagcgcaggctcggatcagcagctttggactctgttcacgaatataggctaagcagttggttgggacagcaggaggacactcatcgtattgtgctgtatcaggtcgatggaactctcacaccctggacccagcgatgcgtgaggcaggcagactgcatcctcattgtgggcctgggcgaccaggaacccaccgtcggcgagctggaacgaatgctggaatcaactgccgtccgggcacaaaaacaattgatcctccttcaccgagaagaaggcccagcacccgcacggactgtggaatggctcaatatgaggagttggtgtagtggccacctgcatctatgttgccccaggagggtgttttcccgcaggagtctgccgaagctcgttgagatgtacaaacatgtgttccagcgaccacctgacaggcactccgacttcagcaggttagcccgtgttctgaccggtaatgcaatagctttagtcttgggcggaggcggagcgcgagggtgtgcccaagtgggtgttctgaaggctctcgcggagtgtggcatcccagtagatatggtgggcggaacctcaattggcgcatttgtgggagcactgtattctgaggagaggaattacagtcagatgagaatcagggctaagcagtgggccgaaggtatgacttcgctgatgaaagctgctttggatctgacgtatccgattacatccatgttctctggagcaggcttcaacagctccatattctctgtgtttaaggaccagcaaatcgaggacctgtggatcccctacttcgctattacgacggacatcactgcaagcgctatgcgggtgcatacggatggatccttatggtggtacgtgagggcaagcatgagtctgtcgggatatatgccaccgctctgtgacccaaaggatggccatctcctgatggatggaggttatatcaataacctccccgctgatgtagcgagatctatgggggctaaagttgtaatagctattgatgtggggtcccgtgacgaaaccgacctgacgaactacggcgatgccctcagtgggtggtggctcctatggaagaggtggaatcccttagcaacgaaggtcaaagtgctgaatatggcggagatccagaccaggctggcttacgtctgttgtgtcagacagttggaagtggtcaagtcgagcgattattgcgagtatttgagaccccctatcgactcctacagcacgctggacttcggaaaatttaatgagatctgcgaggtcggctaccagcatggtaggaccgtgtttgacatctggggcaggagcggtgttctcgaaaagatgctacgcgaccagcaaggcccatccaagaaacccgcatccgccgtgctcacttgtcctaacgccagctttactgacctggctgaaattgtttcgcgaatcgaaccagctaaacccgcaatggtggatgatgagagcgactaccagactgaatatgaggaagaactgctggatgttcctagggatgcttacgcagacttccagtctacttccgctcagcaggggtcagaccttgaggacgagtcgagcttacgtcaccggcatcccagtctggccttccccaaactctcggagggctcctcggatcaggatggatag

SEQ ID NO: 234149 - DNA, 1377 bp, Artificial Sequence
  Description of Artificial Sequence: Synthetic coding sequence
atggaggaagagaaggacgacagcccccaggcggatttctgtctggggactgctctgcattcctggggactctggtttacagaggagggttcaccttccactatgctgactggaattgcggttggggctctcctggccctagcactggtgggggtcctgatcctgttcatgtttcgaaggctgagacaattccggcaggcacagcctacaccacagtatagattcaggaaaagggataaggtgatgttttacgggagaaaaatcatgagaaaggtgaccaccctgcccaatactctggtcgaaaacaccgctctgcccaggcagcgggctagaaaacgcacaaaggtgctatctctggccaaacgtattcttcgctttaagaaagagtacccagccctccagccgaaagagccacctccaagtctgctcgaagccgacctgacagaattcgacgtgaaaaactcccatctcccgagcgaggtgctgtacatgctgaaaaacgtaagagttctgggccactttgaaaaacccctttttctggagttgtgcaagcatatcgtgttcgtgcaactgcaggagggagagcatgtcttccaaccacgcgagcccgatccaagtatatgcgttgttcaagatggccgtcttgaggtatgcatacaagatactgacggcacagaggtcgtcgtgaaggaggtcctcgctggagatagcgtacattcactactttcgattttggacataatcaccggacacgccgctccctacaaaacggtctctgtgcgtgccgctattccaagcaccattcttaggctccccgcagccgcattccacggagtatttgagaaatatccagaaaccttagtgagagtggttcaaattattatggtaagactgcagcgggtcacattcctcgccctccacaattacctgggactcaccacagagctgtttaatgcagaaagtcaagctataccccttgtcagcgtcgcaagcgtagctgcgggtaaagccaaaaagcaggtgttttacggcgaagaggagcggttgaaaaagcctcctcgtttgcaggagtcgtgtgattctgaccacggcggaggccgacctgcggcagctggacctctgttaaaacgatcacactctgtccctgcaccctcaatacggaaacagatcctggaagagcttgagaagcctggagcaggagatcctgatccctcagcccctcaggcaagagtcttgtgtcttctcccccagtgtcttgggggactcccgccaaccgacacctctgtgtactcatcagcatccagcgactgctgtggatgttcaatgccagtgttgtgtattatgggacataaaccacacgtgaccgtggacacatag

SEQ ID NO: 234150 - DNA, 3765 bp, Artificial Sequence
  Description of Artificial Sequence: Synthetic coding sequence
atggaggaagaaaaagatgatagcccacagttgacaggcatcgccgtgggtgcactactcgcactggccctggtgggggtactgatactattcatgtttagaagactgcgccagttccgccaggcccagccaactccacaataccggttccggaaacgcgacaaggtaatgttttatggaaggaagattatgcgcaaagtaactactctgccaaatactcttgttgagaatacggctttgccaagacagagggcacgaaaacggactaaagttttgagcctcgccaagcgcatactccggttcaagaaggagtaccctgctctccagccaaaggaaccgcctccgtctttgctagaagccgatctaaccgagttcgacgtcaaaaactcccacctcccaagtgaggtgttgtatatgctgaagaacgtccgcgtgctgggacacttcgagaaaccactcttcctcgaactatgtaagcacatcgtcttcgtccagctccaggagggcgagcatgtgttccagccacgagagccagatccaagcatttgcgtagtgcaggatgggcgattagaggtatgtatccaggacaccgatgggactgaagtagtggtgaaggaagtcctggctggggactcagtccattccctgctgagcattctggatatcatcacaggacacgccgctccctataaaacggtcagtgttcgcgcagccatcccctcgacgatcctgcgtttacccgcagcagcgtttcatggcgttttcgaaaaatatcctgagaccctggttagggtggtgcaaatcatcatggttcgtctacagagggttacctttctggccctgcacaactatttaggcctgaccacagaactgttcaacgcggaaagtcaggccatccctcttgtcagcgtcgccagcgtggccgcagggaaggccaagaaacaggtgttctatggcgaggaggaacggctgaagaagcctccacggttacaggaaagttgcgacagtgaccatgggggaggcagacccgctgcggctggccctttactgaaacggagccacagcgttcctgcgccatccatcagaaagcagattttggaggaactggaaaaacctggagccggagaccctgacccatctgctccgcaggggggtccaggttccgcaacatctgacttagggatggcctgtgacagagccagagtgttcctgcactccgacgaacatcccggatcatctgtggcatctaaatcacggaaaagcgtgatggtcgcagagatcccaagtactgtgtcccagcatagcgaaagtcataccgatgagaccctggcgtcccgtaagtccgacgcaatcttcagggccgctaagaaagatttactaactctcatgaagctcgaggatagttccttgctcgatgggcgagtcgcccttttgcatgtcccggctgggacagtcgtcagcaggcagggtgatcaggacgcgtcaattttgtttgtggtgagcggtttattacacgtctatcaacgcaaaattgggtcccaggaggatacatgcctgtttctgaccagacccggagaaatggtcggacaattagcagtgctcaccggcgagccactgatctttactgtgaaggcgaatagggattgcagcttcttgtcaattagcaaggctcacttttacgaaattatgcgcaagcagcccactgtggtgctgggagtggctcatactgtcgtcaagagaatgagctcatttgttcgacagattgattttgccctggattgggtggaagtggaggctggacgtgccatctaccgtcagggtgacaagtcagactgtacgtacatcatgctctctggcagactgcggtcagtaattcggaaagacgatggcaaaaaacggctcgccggagagtacggcaggggcgatctcgtcggcgttgtggagaccctgactcaccaggctagagccactacagtgcatgcagtgcgtgatagtgagctcgctaagcttcccgctggggcacttacgagcattaagcggcgatacccccaagttgtgacccgcttaattcatctgctgggagaaaagattttgggctccctgcagcagggcccagtgaccggacaccaattaggtctccccacagaggggtcaaagtgggatctagggaaccctgctgtcaacctatctacagtggccgtcatgcctgtctctgaggaagtacctctcactgccttcgccctcgaactggagcatgctcttagcgcaatcgggcctactcttttattgacgtcagacaatatcaaacgaagattgggctcagctgctctggattctgtccacgagtatcgcctaagctcttggctgggccagcaagaggacacacacagaatcgtgctctaccaagttgatggcactctcactccatggactcagcggtgtgtgcgtcaggcagattgtatcttaattgtgggcttaggcgaccaggaaccgactgtgggagagttagagaggatgttagaatcaacagctgtgagagcacagaaacagcttatactgcttcatcgtgaagaggggcctgccccagcgcgaaccgtggagtggttaaatatgagatcctggtgttcaggacacctccacctttgctgtcctagacgcgtattttctcgtcggtcccttccaaagctggttgagatgtataagcatgttttccaaaggccacctgatcggcatagtgacttcagcaggctagcccgtgtactgaccgggaacgcgatcgccctcgtgctgggtggaggcggagcacgcggatgcgctcaggtcggggtgctaaaggccttggcagagtgtgggataccagtggatatggtgggcggtacctccataggggctttcgttggcgctctgtactctgaagagcgcaattactcccaaatgagaatccgtgcaaaacaatgggcagaggggatgaccagcctgatgaaggctgccctggacttgacgtatcccattactagcatgttctcaggagccggatttaattcatctatctttagcgttttcaaggatcaacagattgaggatctctggattccttatttcgctattaccactgacatcactgctagtgccatgagggtccatactgacggatcactctggtggtacgtccgggcaagcatgagtctaagtgggtatatgcctccactgtgcgaccccaaggatggccacctcctcatggacggcggatatataaacaacctgcctgctgacgtggccaggtcgatgggggctaaagttgtgattgctattgatgttggttccagggatgaaactgatttgacaaattatggagacgctctttcagggtggtggctgctttggaagcgctggaaccccctggctaccaaggtgaaagtgctgaacatggccgagatacagacgcgactggcctatgtgtgctgtgtgaggcagctagaagtagtcaagagctcggactattgtgaataccttcgaccaccaatcgatagctatagtacccttgacttcggcaaatttaatgaaatttgcgtgcctgacgaatccgattaccagaccgagtacgaagaggaactacttgacgtgcccagagacgcctatgccgactttcagagcactagtgcacagcagggaagtgacttggaggacgagagctctctaagacatcgccatccaagtctggccttccccaagctatccgaaggatcctctgaccaagacggctag

SEQ ID NO: 234151 - DNA, 2772 bp, Artificial Sequence
  Description of Artificial Sequence: Synthetic coding sequence
atggcatgcgatcgcgctagagtctttttgcactcagatgagcatcccggatcctctgtggcctccaagtccaggaagtctgtgatggtcgccgagattccaagcaccgtgagtcagcattcggaaagtcatacagacgaaacactagccagcaggaagagcgatgccatcttcagagccgcaaaaaaggaccttttaacgctgatgaaacttgaagactcgtccctgttggacggtagggtggccttactgcacgtaccagcaggcaccgtcgtgtcgagacagggggaccaggacgcatcaattctcttcgtggtgagcggactgctacacgtgtaccagcgcaagattggcagccaggaagacacttgcctctttctaacacgaccaggggagatggtggggcagctggccgtccttaccggcgaacctcttatattcaccgtgaaggccaacagagattgcagctttctgagtatcagtaaggcacatttctatgaaatcatgcggaaacaacctaccgtagtcctaggggttgcccatactgtggtgaaacggatgtcctccttcgtccgccagattgattttgcccttgattgggtggaggtcgaggccggaagggcaatttacagacagggagacaaaagtgattgcacatacataatgctgtctgggaggcttcgctctgtgattaggaaggatgacggaaaaaagaggcttgccggagaatatggaagaggagacctggtgggtgtagtcgagactctcacacaccaggcaagggctacgactgtgcacgctgtccgcgacagcgagctggccaagcttccagcaggcgctcttacatccatcaagagacgatacccacaggtggtcacaagactgatccacctgctcggagaaaaaatccttggatctctccagcaaggccctgttaccggtcatcagctcgggcttccaactgagggctccaaatgggacttgggcaaccccgcagtgaatctgtccacggtggccgttatgccggtaagcgaggaagttcccctaaccgctttcgctctggaactggaacacgccctaagtgctatcgggccaacattacttctgacttccgacaacattaagcgaaggttgggaagcgctgcgctcgactcagtccacgagtatcgactcagctcgtggctaggacagcaggaggatacacacaggatcgtgctctaccaggtggacgggacgctgacaccatggacgcaaagatgcgtaaggcaagcggattgtatccttattgtgggcctaggggaccaagaaccaacagtcggggaactggagagaatgttggaatctactgcagtgagggctcagaaacaactgatactcctccatcgagaggagggacctgcccctgctagaaccgtggagtggttgaatatgcgttcctggtgctcaggccatctccacttgtgttgtccgagaagagttttttctcggagatcacttccgaagctggttgagatgtataagcacgtttttcagaggcctccggaccggcattcggatttcagtagactggccagagttcttaccggtaacgctatcgcattagtactgggaggcggaggcgctaggggctgtgcacaggtgggtgtgctcaaggcacttgctgagtgtggcattccggtcgatatggtgggtggtacttctataggagcgttcgtgggcgctttgtacagcgaggagcggaattattctcagatgcgaatcagagctaagcagtgggccgaaggtatgacttctctaatgaaggccgcacttgacctcacatacccaattaccagcatgttttctggcgctggtttcaacagttctatcttcagtgtctttaaagatcagcagatagaggacctgtggatcccctatttcgctatcacgaccgacatcacggcaagtgctatgagagttcacacggacggttccttgtggtggtacgttagggcctccatgtctctcagcggatatatgccaccactgtgcgaccctaaagatgggcacctactgatggacggtggatacattaataatttgccagcagatgtggcccgtagcatgggggcaaaagtcgtgatcgccatcgacgtggggtcacgggacgaaaccgacctcactaattacggcgacgctctgtccggctggtggttgctgtggaagcgctggaacccactcgcgactaaagtcaaggtcctgaacatggcggaaattcaaactcgcttagcctatgtgtgttgcgtgagacaactggaagttgtgaaaagttcagactattgtgaatacctccgtccccctatagatagctattcaactctcgacttcgggaagtttaacgaaatttgcgaggtgggatatcagcacggcagaactgtgtttgacatttgggggaggtccggagtgcttgagaagatgctgagagatcaacaggggccttccaagaagcccgcaagtgccgttctcacctgtcctaatgcaagcttcacagatctcgcggaaatcgtaagtaggattgagcccgctaagccagctatggttgacgacgaatccgattatcagacggagtatgaagaggagctgctagacgtgcctcgggacgcctacgccgacttccagtcaacatcagcccaacagggatcagatctggaggacgaaagtagcctccggcaccggcacccttccttggcatttcctaagctgagcgaaggtagctccgaccaagatgggtag

SEQ ID NO: 234152 - DNA, 4029 bp, Artificial Sequence
  Description of Artificial Sequence: Synthetic coding sequence
atggaagaagagaaagacgactcaccccaggctgatttctgtctggggaccgcactgcactcatggggactgtggtttacagaggaaggatctccatctactatgctcaccggtatcgccgtgggtgctctcctcgccctcgcgctcgttggggtgctgatcttgttcatgttcagacggcttcgccagttcagacaggcacaaccaactcctcagtataggttcaggaagcgagataaagtcatgttctatggcaggaagatcatgcgcaaggtgaccacactgccaaacaccctagtcgaaaatactgcgctgccaagacagcgggctcgaaagcggaccaaagtactgagcctcgcgaaaaggatcctgagattcaagaaagagtaccccgcactccagcccaaggagcctccaccaagcctgcttgaggctgatttaacagaattcgatgtgaagaacagtcatctcccatccgaagtgctgtacatgctcaaaaatgtccgggtgttggggcactttgagaagcccctcttcttagaactgtgtaaacacatcgtgtttgttcagctgcaggaaggggagcacgtgttccaacccagagaacctgatccaagcatttgtgtggtgcaggacgggcgacttgaggtgtgtatacaggacactgatggaaccgaggttgtggtgaaggaagtgctggctggcgactccgtgcacagcttattaagtattctcgacatcataacaggacacgcagcaccgtacaaaaccgtttcagttcgtgccgcaattccttctacaattttgaggctgcccgcagccgcattccatggagtctttgagaaataccctgaaaccctcgtgagagtggtgcagataatcatggtccggctgcagagggtgacatttctggccctgcataactatctgggtctcactactgagttgtttaatgctgagtcccaagcaatccccctggtttcagtagctagcgtggccgcaggtaaagcaaaaaaacaggtgttctatggagaggaagaacggctcaaaaagcctccacgccttcaggaaagctgcgactccgatcacgggggaggccgaccagcagcagcaggacctctgttgaagagatctcactcggtaccagccccatccatccgcaagcagattctcgaagaacttgagaaacctggcgcaggcgatcctgaccccagtgcgcctcaagggggtccgggtagtgccacatccgacctgggaatggcatgcgatagggcccgtgtgttcctgcactccgatgagcaccctggtagctcagtggctagcaagtctcggaaaagtgtgatggttgctgagatcccaagcacagttagccaacatagtgaatcccacacggacgagaccctcgcaagtcgcaagagcgatgccattttccgagctgccaaaaaggatctgctgactctcatgaagctcgaagactcatctttgctggatggccgtgtcgccctccttcacgtcccagccggaacagtggtgtctcgccagggggatcaggatgccagcatactttttgttgtgtcagggctgctgcacgtgtatcagagaaagattgggagccaggaggatacctgtcttttcctgacaaggcccggagaaatggtggggcagctggctgttctaacgggtgagccactcatctttaccgtcaaggctaacagggactgttcgttcctaagtattagcaaggctcatttttacgagattatgagaaaacagccaaccgtcgtcctgggtgtggcccatacagtagtgaagagaatgtcctcattcgtgcgccagattgattttgcactggactgggtggaagtcgaggctggcagagccatctaccggcagggggataagtcagactgcacctacataatgctgagtggcagattacggagcgtgatccgcaaagacgacggaaaaaaacgattggcgggtgagtacggtcgaggcgatctggtgggagtggtcgaaacgctgactcaccaagctagggcgactacagtgcacgccgtgcgggactctgaacttgccaaactcccagcaggagcattgaccagtatcaaacggaggtatcctcaagttgttacccgattgatacacttactgggagagaagatcctcggctcgctccagcaagggcctgtcactgggcatcaactagggctccccactgagggaagtaagtgggatctgggtaaccctgctgttaatctgagcacggttgccgttatgccggtatcggaagaggtccccctgacggcttttgcactcgaactggagcatgctctttctgccattgggccaaccttacttctgacatccgacaatattaagcgtcgcttgggatccgcagctctcgattccgttcacgagtaccgattgtctagctggctagggcagcaggaggacactcatagaattgtcctttaccaggtagacggaaccttgaccccatggacccaacgctgcgtgaggcaggccgattgtatcctgattgtgggactgggcgatcaggaaccaactgtgggcgaactcgagcgaatgttagaatctacagcggttagggcacagaaacagctgattctcttgcaccgagaggagggtccagctccggctcggacagtggagtggctaaacatgaggagctggtgttccggtcatcttcacctatgttgtcctcggcgagttttctctcggagaagccttcccaagctcgtagagatgtataagcatgtctttcaacgcccaccagaccgacatagtgacttctcccgcctggctcgggtgcttaccggcaatgccatagccctggtcctgggcggtggcggagcacgcggttgcgcacaggttggagtgctcaaggccctggccgagtgcgggattccagttgacatggttggcggaaccagtataggggcatttgtaggagctctctatagtgaggagcgtaattacagccaaatgagaatcagggcaaagcagtgggctgaaggaatgacatcactgatgaaagccgcactcgacctcacttatccaatcacctccatgtttagcggcgctggttttaactcttcaattttcagcgtattcaaggatcagcagatcgaagatttatggattccatatttcgctatcactaccgatattacagcttccgccatgcgggtacatactgatggcagtctgtggtggtatgtcagagctagcatgtctctgtcaggctacatgcctcctttgtgcgaccccaaggatggacacctgttaatggacggcggatatattaacaacttgccagctgacgtagccagaagtatgggggcaaaggttgtcatcgcaattgacgtcggatccagagatgagacggaccttactaattatggcgacgccctgtccggatggtggctactgtggaaacggtggaacccgttagccacaaaagtgaaggtgctgaatatggctgaaatacagacaagactggcatatgtgtgttgcgtgcggcagctggaggttgtgaagtccagtgattattgtgagtatctgcgcccaccaattgatagctacagcactttagatttcgggaaattcaatgaaatctgcgaggtgggatatcagcatggcagaacagtttttgacatttgggggagatccggagtcttagaaaagatgctgcgtgaccagcaaggaccctccaagaagcctgcctcagcagtgcttacctgtcccaacgcttcttttaccgatttggccgagatagtctcccgtatcgagcctgctaagcccgctatggttgacgatgagtctgactaccagacagagtacgaggaggagctgctcgacgtgcccagagatgcgtatgcagatttccagagcactagcgcacagcagggaagtgatttagaggatgagtccagcctacggcacaggcacccctcattggcgttccccaagctctccgagggatcttccgatcaggatggttag

SEQ ID NO: 234153 - DNA, 3846 bp, Artificial Sequence
  Description of Artificial Sequence: Synthetic coding sequence
atgctgaccggcatagccgtgggggctctccttgctctggccctcgttggcgttcttatcctttttatgttccgcagactccggcagttccgccaggcccagcccacaccacagtaccggttcagaaaaagagacaaagtgatgttctacggtaggaaaatcatgaggaaagtcactacactgccgaacaccctggtcgagaatacggctttgccacgtcaaagggcccgaaaaagaacaaaggtgctgtctctggccaagcgaatccttcgcttcaagaaagagtatcctgctctgcagcctaaagagccaccaccctctctgttagaagccgacctaactgagtttgacgtgaaaaactcacacctgccgagtgaggtgctatatatgttaaagaacgtgagggtcctggggcattttgagaaacctctctttctggagctctgcaagcacattgtcttcgtccaactgcaggaaggcgaacatgtgtttcaaccaagagaacctgacccctccatatgtgtggtccaggatggtcgcttggaagtatgtatccaagatacggacggcaccgaagttgtcgttaaagaggtccttgccggtgactccgttcattctctcctgtcaattctggacatcatcaccggccacgcggctccctataagacggtctctgtccgagccgcaattcccagcacaattttacgactccctgcagctgccttccatggagtcttcgaaaagtaccctgagaccctcgttcgagtcgttcagatcatcatggtccgtctgcagcgcgtgacctttttggctctgcacaactatctgggtttaactacggaactgtttaacgcagagagtcaagccatccccctcgtatccgtggcttcggtagcagcaggcaaagccaagaagcaagtattttacggtgaggaagaaaggctgaaaaaaccacccagacttcaggaatcgtgcgatagcgatcacggcggtggtcgtccagctgcagccggaccattgctgaagagatcccacagcgtcccagccccatcaattagaaaacagatactggaggagttagaaaaaccaggggcaggtgacccagatccttccgccccacaggggggtcccggaagcgccactagcgatttagggatggcttgtgaccgcgcacgcgttttccttcattccgatgagcatccaggttcctcggttgcttctaaaagccgtaaatccgtgatggtggccgagatcccaagcaccgtctcccagcattccgaatctcataccgatgaaacgctggcaagcagaaaatctgatgccattttccgggctgcgaaaaaagatctgctaactctaatgaagctcgaggatagttccctgctggatggcagagtggcactcctgcacgtccctgccggaacagtagtctcacgacagggcgatcaggacgctagcattctgtttgtggtgagcgggctgctacacgtataccaacgtaaaattggatctcaggaagatacgtgccttttccttaccagaccaggggaaatggtgggccagctggcggtcctgactggagagcctctgatatttacagtcaaggccaatcgcgactgctcatttctcagtattagcaaggcccacttctatgaaatcatgcgtaaacaacctaccgtggtgctgggcgtggcccacacggtagtgaaacgcatgagctccttcgtgaggcagatcgacttcgctctggattgggtggaagtggaggccggacgagctatttacaggcagggcgacaagtctgattgcacatacattatgctctcaggacggcttcgtagtgtcatcagaaaagacgacggcaagaagcgcctggcgggagagtatggaaggggcgacctcgtaggagtcgtcgaaacgctgacccatcaggcaagagccacgacggtacatgccgtccgcgattcagaattggcaaaattacctgctggagcactcactagcatcaaaagacggtatccccaagtggtaacaaggctcatacatttattgggggaaaagattctggggagtctacagcagggtccagtcactggacatcagctcgggctacccactgagggctccaagtgggaccttggcaaccccgctgttaatctcagtacagtggcagttatgcccgtttccgaggaagtgcccctgaccgcttttgcgctggagctagaacacgccctgtccgctatcggcccaacactgctgctaacatctgacaatataaagagacggttgggaagcgccgcattagactctgtgcatgagtatagactgagctcatggttaggccagcaagaagatacccacaggatcgtattgtatcaggtggacggcacgctgaccccgtggacccagcggtgtgtccggcaggctgattgcatcctgattgtcggattaggcgatcaggagccaactgtgggcgaactcgagagaatgctcgagtctaccgccgttcgagcccagaagcaattgattctgctgcaccgcgaggaggggcctgcaccagcacggactgtcgagtggttaaatatgcgatcatggtgctctggtcatttgcatctttgttgtcctcgacgcgtgtttagcaggagaagcctgccaaagctggtagagatgtacaagcacgttttccagaggccccctgaccggcatagtgacttcagtcggttggcccgagtgctcacagggaacgcaattgcgttggtcctgggcggaggaggagcgagggggtgcgcccaggttggcgtgctgaaagcactcgccgaatgcgggatcccagtcgacatggtcggaggaacctctatcggagcttttgtgggggctctctatagtgaggagcgcaactacagccagatgagaattcgcgctaagcaatgggcagaaggcatgacctcgttgatgaaggcagcgctcgacctgacatacccaattacatccatgttctcgggcgctggctttaattcttcaattttcagcgtttttaaggatcagcagatcgaggatttatggatcccctacttcgccatcaccactgatatcacagcaagcgctatgcgcgtccacaccgatggttcactttggtggtacgtgagagcctctatgagcctgagtgggtatatgcctcctctgtgtgaccctaaagacggccacctcctcatggatgggggttacattaacaaccttcccgctgacgtggcacgttcaatgggggctaaggtggtcattgcaattgacgtcggaagcagggacgagacagatctgacaaactacggtgatgcactctcggggtggtggctattatggaagcggtggaacccattggcgaccaaagtcaaggtgctgaacatggccgagattcaaactaggctcgcctacgtgtgttgtgtgcgacagctagaggtagtgaagagctcagactattgtgaatacctgcgaccccctattgacagctacagtaccctggactttggaaagttcaacgaaatctgcgaagtcggctaccagcatggacggactgttttcgacatctggggccgttctggggtgctggaaaagatgctcagagaccagcagggcccttcaaaaaagcctgcttcagcggttcttacgtgtcccaacgcctctttcacggatctcgccgagatcgtctctagaatcgagcccgctaaacctgccatggtggatgatgagtcagattatcaaactgagtatgaggaggagctgctggatgttcctagggacgcatacgctgacttccaatccacttccgctcaacagggcagtgacctttag

SEQ ID NO: 234154 - DNA, 2349 bp, Artificial Sequence
  Description of Artificial Sequence: Synthetic coding sequence
atgagcatcaaccttactgtggacatttatatttacctgctgtctaacgccagaagcgtgtgcgggaagcagcggtcgaagcagctgtattttctatttagtcccaaacattactggcgcattagccatataagcttgcaacggggtttccatacgaacatcattaggtgcaaatggaccaagtccgaggcccatagctgttctaaacactgttattcaccaagcaatcatggtctccatatagggatcctcaagctttctacctccgccccaaaggggctgactaaagtcaacatttgcatgtctaggatcaagagcaccctgaactccgttagtaaggctgtatttggaaatcaaaacgaaatgatatcgcgactggcccagttcaagccaagttcccagattttacgtaaagtctccgattccggctggctgaagcaaaagaacatcaaacaagcaataaagtccctgaaaaaatacagcgataagagcgccgagaaatctcccttcccagaggaaaagtcacatatcatcgataaagaggaagacatcggaaagcgcagcctgtttcattatactagttcaataacaacaaaatttggggactccttctacttcctctctaatcatattaacagctattttaagcgtaaggaaaagatgtcccagcagaaggagaacgaacactttagagataaatccgaactggaggacaaaaaggtggaggagggaaagctccgttccccagacccaggaattctggcatacaaaccgggtagtgaatccgtgcataccgtggacaagcccaccagcccttctgcaatacccgacgtccttcaggtatctaccaagcagagtattgctaacttcctcagtaggcctacagaaggagttcaggccttggttgggggatatattggagggctggtgccaaagctgaagtacgactccaaatctcaatcagaagaacaggaggagcctgccaagacagaccaagcagtgtccaaagacaggaatgccgaagaaaaaaagcggctgagtctccaacgcgagaaaattatcgccagagtttctatcgataatagaacccgagcattggtccaggccctgcggagaactactgaccctaagctgtgtattacaagggtcgaagaactgactttccacctcctcgagtttccagaaggaaagggtgtcgcggttaaagaaagaataataccttacttgcttcgcttgcgacagataaaagacgagaccttgcaggccgcagttcgggaaatattggcacttattggttatgttgatccagtgaagggacgcggtatccggattttgtcaatagacggcggagggaccagaggggttgtggccctacagacactacggaagctggttgagctcactcagaagcctgtgcaccagttgtttgactatatttgtggcgtgtcaaccggcgctatcttggcttttatgttaggacttttccatatgcctttggacgagtgtgaggagttatataggaagttaggcagtgacgtcttttcacagaacgtaatcgtggggaccgtgaagatgtcatggagccacgctttctatgattcccagacctgggagaatatcctcaaggatcgcatgggctccgctctcatgatcgaaacagcacgaaatcctacgtgtcctaaagtggcagccgttagcaccatcgtgaatagggggataacccccaaggctttcgtgttccgcaactatggtcactttcctggcattaactcacactacctgggcggatgccagtacaaaatgtggcaggccattagggcatctagcgcagctcccggttatttcgctgaatatgccctggggaacgatttgcatcaggacggaggtctgttgctcaacaaccctagtgccctagccatgcacgagtgtaagtgcctgtggcccgacgtaccgcttgaatgcattgtgtcactcggcacggggaggtacgaaagtgacgttagaaataccgtcacttatacctctctcaagaccaaactcagcaatgtcataaatagtgcaactgacaccgaagaagtgcacatcatgctcgatggactcctgccccctgatacatatttccgctttaacccagtgatgtgcgagaatatcccactggacgaatcccgtaatgaaaagctggatcagctgcaactagaaggcctgaagtatatagaacgcaacgaacagaagatgaagaaagtggccaagatattatcccaggagaagaccacactccagaaaatcaacgactggatcaaactgaaaacagatatgtacgaggggctgccgtttttttcaaagctgtag

SEQ ID NO: 234155 - DNA, 2163 bp, Artificial Sequence
  Description of Artificial Sequence: Synthetic coding sequence
atgtccataaatctgacggtggatatctacatctatctgctaagtaatgcgagatcagtgtgtggcaagcagcggagcaaacagctctactttctcttttccccgaaacactattggaggatcagccacatctccctgcaaagaggatttcatactaatattatccggtgtaagtggactaaatccgaagcgcatagctgcagtaagcattgttactcaccctctaaccacggcttgcatatcggtatcctgaagctgtccacctctgcgcctaaaggtcttaccaaagtcaacatctgcatgagcagaataaagtctacgcttaactcggtgtcaaaggccgtcttcggaaaccagaacgagatgatctctagactcgcgcaatttaagccaagcagccagattctccgcaaagtgagtgactcaggctggctcaagcagaaaaatattaagcaggccattaaatcactgaagaagtacagcgataagtcagcagagaagtccccatttcccgaggagaaaagccacattatagataaggaagaggatataggtaagagaagtctctttcactatactagtagtattaccaccaaatttggcgactcattctacttcctttctaatcacatcaactcatattttaaacggaaggaaaaaatgagccagcaaaaagagaacgaacatttcagggacaaatccgaactagaagacaagaaggtggaggaaggaaagctgcgctcccctgatcccggaatactggcctacaaacccggttcagagtcggttcatactgtggataagccgacctccccttctgcaatacccgacgtgctgcaggtgagcactaagcagagcattgctaatttcttgagcaggcccacggaaggtgtacaggcactagtcgggggatacattggcggacttgtacccaagctaaagtacgactcaaaaagtcagagtgaggaacaggaagagcccgctaaaactgatcaagctgtatcaaaagaccgcaatgcagaggagaagaaaaggctgtccctacagcgcgagaaaatcatcgctagggtttcaatcgataacaggacacgcgctctcgtgcaggctctccgacggaccaccgatcctaagctgtgtataactcgcgtcgaggagctgacatttcacctgctcgaatttccggaggggaagggagtcgctgtgaaagagaggatcatcccgtacctgctgagactcagacagataaaggacgaaacattacaggcagcggtgcgtgaaatcctggctctgattggatacgtggacccggtgaaggggagaggcattcgcatcctgtctatcgacggaggcggtacacgtggcgttgtcgcccttcagacactcaggaaacttgtggagctgacgcagaaacctgtccatcagttgtttgactacatctgtggtgtttcgaccggggctatcctcgcctttatgttaggcctcttccacatgccgcttgatgagtgtgaggaactttataggaaactgggaagtgacgttttttcccagaatgtgatcgtggggactgtgaagatgagctggagtcacgcgttctatgactctcaaacctgggagaatattctcaaggaccgaatgggctccgcactgatgatcgagacagcccgtaatccgacgtgtccaaaggtgcgaaaggacggcggactcctgttaaacaaccccagtgctctggccatgcatgagtgtaagtgtctgtggccagatgtcccactcgagtgcatcgttagcttaggcactggcaggtacgagtcagatgtgcggaacacagtgacttacacctcgctgaaaaccaagctgtctaatgtgatcaactcagccaccgacactgaggaagtgcatataatgcttgacggcctgctcccacccgatacttattttcgattcaatccagtgatgtgcgagaacattcccctggacgagagcaggaacgagaagttggatcagctccagctcgaagggctgaagtacatcgaacgtaacgagcagaaaatgaaaaaggtggccaagatcctgtctcaagagaaaaccactttacagaagatcaacgactggattaaactaaagaccgacatgtacgaaggcctaccgtttttctctaaactatag

SEQ ID NO: 234156 - DNA, 168 bp, Artificial Sequence
  Description of Artificial Sequence: Synthetic coding sequence
atgtccattaacttgaccgtcgacatatatatatatcttctgagcaatgcccgatccgtgtgtggtaaacaaaggtctaagcagctctatttcctgttttctcccaaacactactggcggatctcacatattagtctgcagcgaggcttccatacaaacataatatag

SEQ ID NO: 234157 - DNA, 2349 bp, Artificial Sequence
  Description of Artificial Sequence: Synthetic coding sequence
atgtcaatcaatctcacagtcgacatctacatctacctcctgagcaacgctagaagtgtgtgcggaaaacagcgctctaaacagctgtatttcctattctcgccaaaacactattggcgaattagccatattagcctccagcggggtttccacacgaacattatcagatgtaaatggacaaaatctgaagcacactcttgtagtaagcactgttatagcccttcaaaccatgggttgcacattggcattcttaagctctctaccagcgctcctaaggggctcaccaaggtcaacatctgtatgtcccggatcaagtctactcttaattccgtctccaaggccgtatttgggaaccagaacgagatgatttccaggctcgcccagtttaagccatcctcacagatactgcgtaaggtaagtgacagcggatggctgaaacagaaaaatatcaaacaggcaattaagagtctgaagaagtactccgacaaaagtgctgagaaaagtccttttcccgaggaaaaatcgcacattattgacaaggaagaggatattggaaagcgatcactctttcattatacttcaagtattaccaccaagtttggagactccttttactttctgagcaaccacatcaattcttactttaaacggaaggagaagatgtcacagcagaaagaaaatgagcatttccgtgataaatctgaactcgaggacaagaaggtagaggaaggaaagctacgctcccccgaccccggaattctggcttataagccaggtagcgagagcgtacacacagttgataagcctacctcgcctagcgcaattcccgacgtgctgcaagtctccacaaaacaatccatcgcaaatttcctgagccgacctacggagggagtgcaggctttggtgggtggttacatcggcggactggttccaaaactgaagtacgatagcaagtctcagtcggaagaacaggaggaaccagctaaaacagatcaggcagtatctaaggatcggaacgccgaggagaagaagaggctcagtctgcagcgagagaagatcatcgccagggtaagcatcgacaatagaactcgggctttagtgcaagcactgagacggaccaccgaccctaagctgtgcataaccagagtcgaggaattgacattccatctcctggagttccccgaaggcaaaggggtcgcagtgaaagaacgaattataccctacctgcttcgactaagacagatcaaggatgaaactcttcaggcagcagttcgagagatcctggcactgatcgggtacgttgacccagtcaagggaaggggtatacgcatattgagcattgacggcggaggaaccagaggtgtggtggctttgcagacactgagaaagttggtcgagcttactcagaaacctgtccaccagttgtttgactacatttgtggagtgtcaaccggcgctattcttgcatttatgctcggtttatttcacatgccactcgatgagtgtgaagaactttaccgtaagctagggagtgacgtctttagccaaaatgtgatagtggggaccgtcaagatgtcctggtcacacgcattttacgactcccagacttgggaaaatattcttaaggaccgcatgggatccgccttgatgattgagacggctcgcaaccccacctgtcccaaggtggctgctgtatcaacaattgtgaacagaggcataacacccaaagctttcgtgttccggaactacggtcacttcccgggaattaattcccattacctgggcggatgccagtacaagatgtggcaagcgatcagggccagcagtgctgccccagggtacttcgccgaatacgccctgggcaacgatcttcatcaggatgggggacttctcttgaacaacccctccgccctcgcgatgcatgagtgcaagtgtttatggccagatgtgcctctggaatgcattgtttcacttggtaccggtaggtacgaatccgacgtgcggaatacagtcacctacacatccctgaaaacgaaactgtcaaatgttatcaattccgcaaccgacactgaagaagtgcatattatgttggacgggctactgccaccggatacttatttccgattcaaccccgtaatgtgtgagaatatccccctcgacgagtccagaaatgaaaagctggaccagttgcaattagaaggactgaaatatatcgagagaaacgaacaaaaaatgaaaaaggtggccaaaattttgtcccaggaaaaaaccaccctgcagaagattaacgattggattaaactcaagacagatatgtacgagggcctgccgttctttagcaaactgtag

SEQ ID NO: 234158 - DNA, 582 bp, Artificial Sequence
  Description of Artificial Sequence: Synthetic coding sequence
atgagcatcaatctgaccgtggacatttatatttacctgctatcgaacgcccgatccgtctgcgggaaacagcgaagtaagcagctttacttcctctttagtccgaagcattactggcggatctcccatatctcattacagaggggcttccacacaaacataatcaggtgcaaatggactaaaagcgaagcgcattcttgctccaagcactgttactctccatcgaaccatggcttgcacataggcattctgaagttaagtacatcggcacctaaaggtcttactaaggtaaatatctgtatgagtcggattaagagtacgcttaacagtgtttccaaggcagtctttgggaatcagaacgagatgatcagcagactggcccagttcaaaccttcatcacagattctgcgaaaggtatcagattcaggctggctgaagcagaaaaacatcaaacaggctatcaaatctttgaagaagtattccgacaagtccgctgaaaagagcccattcccagaggagaagtcccacattatcgataaagaggaagatatcggcaagaggtcactgtttcactatacctag

SEQ ID NO: 234159 - DNA, 2349 bp, Artificial Sequence
  Description of Artificial Sequence: Synthetic coding sequence
atgtcaataaacctcactgtagatatttacatttaccttctgtctaatgccagatcagtgtgcggtaaacagaggtccaagcagttgtacttcttgtttagccctaaacactactggcggatctcccatatttctttgcagcgcggttttcatactaacataatccggtgtaaatggactaagtcagaggcgcactcatgctccaagcactgctatagtccgtcaaaccatggcctacatatcgggatactaaagctgagcacctctgcccctaaaggcctgaccaaggttaacatctgcatgtcccggatcaagagtactctgaattctgtttctaaagctgtttttggcaaccaaaacgaaatgatctctcgcctggctcagtttaagccttccagccagatcctgcgcaaggtgagtgactctggatggctgaaacagaaaaacatcaaacaagctatcaagagccttaaaaaatactcagacaaatctgccgaaaagagtcccttccctgaggagaagtcccatattattgataaggaggaggacatcggcaagcgatctctgttccactacacctcttctatcactactaaattcggcgatagtttttactttttatccaatcacattaactcatacttcaaacgcaaggagaagatgagccagcagaaggaaaacgagcacttcagggataaatcagagcttgaggataagaaggttgaggagggcaaacttcgctccccagaccccggtatacttgcatataaaccgggatccgagtcggtgcacactgtcgataagccaaccagcccatcagccattcccgatgtgctacaggtgagtacaaaacagtcaattgccaactttttgagccggcctactgagggggtacaggcacttgtaggcggttacataggcggactggtgcccaaattgaaatacgactcaaagtcccagtctgaagagcaggaagagccagcaaagaccgatcaggccgtctccaaggatcgtaacgctgaggagaagaaacgcctctccctgcagagggaaaaaatcattgcgagagtgtctatagacaaccgcactagagccctagtgcaagccttgaggcgtaccacggatcctaaactgtgcattactcgtgtggaagagctgacatttcacctgctcgagttccccgaggggaagggcgttgctgtcaaagaacgcatcatcccttacctcctcaggcttcgccagataaaagacgaaactctgcaagcagcggtccgagaaatcctggccctgatcggatatgtcgaccctgttaagggtcgcggaatcagaattttgtccatcgacggtggcggtactagaggcgtggtagcccttcaaaccttaaggaaattggtcgagctgacccagaaacccgtgcatcagttattcgactatatctgcggcgtcagcacgggggctatcctggcatttatgctcggtctcttccacatgccattagacgagtgcgaagagctttacaggaagcttgggtccgatgtattttcacagaatgttatcgtcggaacggtgaaaatgagttggtctcacgccttctatgacagccaaacttgggaaaatatcctgaaggacagaatggggtcggcattaatgattgagacagccaggaatcccacatgtcctaaagtggcagctgtcagcaccatcgtaaaccgaggaattactcctaaagccttcgtattcagaaattatggccactttcccggaatcaactcacactacctgggagggtgtcagtataagatgtggcaagcgatccgcgctagctccgccgctcccggatattttgcggagtatgcactcggcaatgacctgcatcaagacgggggtctccttctgaacaatccctccgccctcgccatgcatgaatgcaaatgcctttggcctgacgtaccccttgagtgcatcgtgagcctgggtacgggcagatatgagagcgacgtgcgcaacacagtgacctacacatccctgaaaacaaaactgagcaacgtgatcaactcagccacagacacggaagaggtgcatattatgctcgatggattgctgccccctgatacttacttccgtttcaatcctgtcatgtgcgaaaacatcccgcttgacgagagtcgaaacgagaagctcgaccaactgcaactggagggtttaaaatacattgaacgcaacgagcagaagatgaagaaggtcgccaaaatcttgtcccaggagaagactaccctgcagaaaattaatgactggatcaagttgaaaacagatatgtacgagggccttcctttcttctccaagctgtag

SEQ ID NO: 234160 - DNA, 2154 bp, Artificial Sequence
  Description of Artificial Sequence: Synthetic coding sequence
atgtccataaatttaaccgttgacatttatatttatctgctgtctaacgccagaagtgtatgtgggaaacagagaagcaaacagctctacttcctgtttagtcctaaacactactggaggatctcgcacataagccttcagcgcggattccacactaacattatccgctgcaagtggaccaagtcagaagcacactcatgctccaagcactgttactcacctagcaatcacggtctgcacattggcatcctcaagctttccaccagcgcgcctaagggcttgacgaaagtgaacatttgtatgagccgtatcaagtccacattaaacagtgtgtccaaggccgtgttcggtaatcagaacgagatgatcagcaggttagcccagttcaagccaagtagtcaaattctccggaaagtctccgactctggctggctgaaacaaaagaatattaaacaggccatcaagtccctcaagaagtactcagacaaaagcgctgaaaaatccccgtttccggaggaaaaaagtcatatcatcgataaggaagaagacatcggcaagaggtccctattccactatacctcttcaataacaaccaagtttggtgacagtttctacttcttgtcaaatcatatcaactcctatttcaagcgcaaggaaaaaatgagtcagcagaaggaaaacgagcattttcgggacaaaagcgaactcgaggataagaaggtcgaagaaggcaaacttcgatccccagacccaggcatcctggcgtacaagccgggtagtgaatccgtacacacagtggataaacccacaagtccctctgcaattcccgatgtcctccaggtgtcaactaaacagagcattgccaacttcctgtctcggccaaccgagggggtgcaagccctggtgggtggatacattggagggttagtgccaaagttgaagtacgactccaagagtcaatctgaagaacaggaggaacccgcaaaaaccgatcaagccgtttcaaaggatcgtaacgctgaagagaagaagcggctgtcgctgcaaagagagaagattattgcaagagtgtctatcgacaacaggacgagggcactggtgcaagctctaagacgtacgaccgacccaaagttatgcattaccagagtcgaagagttgactttccaccttttggagttccccgaagggaagggcgtggccgtcaaagaacgcatcataccatatctcctacgcctccgacaaattaaagatgagactttacaggccgcagtgagagagatcttagcgcttatagggtatgttgaccccgtgaagggaagaggaatcaggattctatcaatagatgggggtggcactcggggtgttgtggctctgcagacgttaagaaaactagttgaacttacgcaaaaacctgtgcaccaattgtttgactacatctgtggcgtctctacaggggctatccttgccttcatgctcggtctatttcacatgccccttgatgaatgtgaggagctctatcgaaaattgggaagcgacgtcttttcacagaatgtcatagtaggcaccgtgaaaatgtcttggagccatgcgttttacgactcccaaacgtgggagaacattttaaaagatcgtatgggatctgctctgatgatcgagacagcacgcaaccctacttgccccaaggatggcggactgttactcaacaatccgagtgctctagccatgcatgagtgcaaatgcctatggcctgatgtgcccctggaatgtatcgtgtcattagggacggggaggtacgagtctgatgtcagaaacacagtcacctacacatctcttaagacgaaactaagcaatgtcattaattctgcgaccgacacggaggaggtccacattatgcttgatgggctgctgcccccagacacttatttccgcttcaacccagttatgtgtgagaacatcccactcgatgaaagtagaaacgagaaactggaccagctccagctggaaggactgaagtatattgagcgcaatgagcagaagatgaaaaaggtcgcaaaaatactgtcccaggagaagactactcttcagaagataaatgactggataaagttgaaaaccgacatgtacgagggactgccctttttcagtaaactttag

SEQ ID NO: 234161 - DNA, 2049 bp, Artificial Sequence
  Description of Artificial Sequence: Synthetic coding sequence
atgtctagaataaagtccacattgaatagcgttagtaaagcggtgtttggaaaccaaaacgagatgatatccagactcgcccaattcaaaccaagtagccagatactcaggaaagtgtcagattcaggatggcttaagcagaagaatataaaacaagcaatcaaatcactgaagaagtacagtgataagagcgcagagaagtctccattccccgaggaaaagagccacataatcgacaaagaagaggacatcgggaagcgctctttgttccattatactagctccattacaacaaagttcggcgacagcttctactttctgtcaaaccacatcaattcatatttcaaacggaaggagaaaatgtcccagcagaaggagaacgaacacttccgggataagagtgaattggaagacaagaaagtggaggaggggaaactgaggtcccctgacccaggcatactcgcctacaagcctggatcagagagcgtccatacagtcgataagcctactagccccagtgctatccccgacgtactgcaagtcagcacaaagcagagtattgccaattttctttcccgtccaactgagggagtgcaagcccttgtcggcggatatatcgggggtttagtgccaaagctgaagtacgacagcaagagccagtctgaagaacaggaagaaccagccaagaccgaccaggctgtctccaaggatcgaaatgccgaggagaagaagcggctgtccctgcaacgtgaaaaaatcatagctcgcgttagtatcgataatcggactagagccctggtacaagctcttcgcaggaccacggaccccaagctgtgtattaccagagtcgaagagcttacgttccatctgctggaatttcccgagggcaagggtgtggcagtgaaggaaagaatcataccgtacctacttcgcctgagacagatcaaggacgagaccctccaggccgctgtccgtgagatcctggcattaattgggtatgtcgatcccgtaaaaggcagagggatacggatcctctccatcgacggtggagggacaaggggagtagtggccttgcagactttgcggaagctcgtagagctgacacagaagcctgttcatcagctcttcgactacatctgcggagtgtcaaccggcgcaattctcgccttcatgttaggactgtttcatatgccccttgacgagtgtgaggaactttatagaaagttggggagtgacgtgttctctcagaacgttattgtcggcaccgtgaaaatgtcctggtcccacgcgttctatgattcacagacctgggagaacatccttaaagacaggatgggctcagcccttatgatcgagacagcgaggaacccaacctgtcccaaagttgccgcagtgagcaccatcgtcaaccgcggaatcaccccaaaggctttcgtgttcaggaattacggacatttcccgggaattaattctcattatctcggcggatgccagtacaaaatgtggcaggcgattagggcctccagtgccgctcctggttatttcgcagagtacgccttgggcaacgatcttcatcaggatgggggactactgctcaataatccctccgcccttgcaatgcacgaatgtaagtgtctatggcccgatgttcctttggagtgcatcgtgagcctgggtacagggagatacgagagcgacgtgcggaacacggtgacatacacatccctcaaaacgaaactaagtaatgtgataaatagtgctactgacacagaagaagtgcacattatgcttgatggcctccttccacctgatacgtattttaggtttaatccggtcatgtgcgagaacatccctttagacgaaagccggaatgagaaactagaccagttgcagctggagggactgaaatacatcgaacggaacgagcagaagatgaagaaggttgccaagatcttaagtcaagagaagaccacactgcagaagatcaatgattggatcaagctcaagactgatatgtatgaggggctcccgttcttctccaaactatag

SEQ ID NO: 234162 - DNA, 3612 bp, Artificial Sequence
  Description of Artificial Sequence: Synthetic coding sequence
atgacccgctcaccccctctgcgtgaactaccaccatcttatactccaccagcccgaacagccgcaccacagatcctggccggttcactgaaggcccctctctggctgagagcctactttcagggcctgctgtttagcctgggctgcgggatacagcggcattgcggaaaggttctgtttcttggattgctcgccttcggggcacttgccctcggtttaaggatggccatcatcgagacaaacctggagcagttatgggttgaggtcgggagcagagtgagccaagaacttcattataccaaagaaaagctaggcgaggaggcggcttacacaagccagatgctgatccagacagctcggcaggagggtgaaaatattttgacacctgaggctctaggcctgcatcttcaagccgcactgaccgctagtaaagtccaagtctcattgtatggcaagagctgggatttgaataagatctgttacaagtctggggtcccgcttatcgagaacggaatgatagagaggatgattgagaagcttttcccatgtgtgatcctaactcccctggattgtttttgggaaggcgctaagctgcagggcggttccgcttatctgccagggagacccgatatccagtggaccaacctcgaccctgagcagcttttggaggaacttggcccatttgccagtctggaaggtttcagggagctgctggacaaggctcaggtcgggcaggcatacgtggggagaccttgtctgcatcccgatgacctgcattgtcccccatccgccccaaatcaccactccagacaagcgccaaatgtggcacacgaactatctggagggtgccatggattctcacataaatttatgcactggcaggaagaactgttgctaggaggcatggcccgtgacccacagggagaactgctacgggctgaggcactacagagtacgttcctgttaatgtcccccagacagttgtatgagcacttccgtggggattaccagacgcacgatattggatggtcagaggaacaagcctccacagtgctgcaggcatggcagaggagatttgtgcagctggcacaggaagccctccctgagaacgcctcacagcagatccatgcttttagtagcactacgttggatgatatcttgcacgccttttccgaagtgtcagccgctcgcgttgtggggggatatttattaatgctcgcctacgcatgcgtgaccatgctccgttgggactgcgcacagagtcaggggtccgtgggactggcaggggtcctgctggtggccttagctgtcgcgtcaggactgggactctgcgcgctgctcggaatcactttcaatgcggcaactacacaggtcctccccttcctggcactaggcatcggggtagacgatgtcttcctgctggcgcacgcgttcactgaagcgctgcctggaaccccacttcaggagagaatgggcgagtgcctccagcggacagggacctccgtggtgctcaccagcattaacaacatggctgccttcttgatggcagcattggttcctataccagcattacgggcattctctctccaggcagctatcgtggtgggatgcacatttgtggcagtgatgctggtgttccccgcaattctgtctctagacctgcgtagaaggcattgtcagcggctggatgtgttgtgctgcttttccagtccatgtagcgcacaggtcattcagattctgccccaggagctgggcgacggaaccgtccccgttggaatcgctcaccttacggcgaccgttcaggctttcactcactgcgaggcaagcagtcagcatgttgtcaccatcttgcctccgcaagcacacctggtaccgccacctagtgatcctctgggctcagagctctttagtccaggtggttccactagagacctgcttggacaggaggaggaaaccaggcagaaggccgcttgcaagagtctcccatgcgcccgatggaatttagcacattttgctcgctaccagttcgccccactcctgctacagtctcacgctaaagccatcgtgctggtgctgttcggcgctctattgggtttatccctgtacggggctaccctggtgcaagacggcctggcccttacagatgtggtgcctagagggaccaaagaacacgctttcctgagcgctcaattgagatatttttccctgtatgaagtggctctggtgactcagggcggatttgactatgcgcacagccagcgcgcacttttcgatcttcaccagagattcagctctctcaaagcagtgttgccgccaccagcaacacaggcccctcggacttggttacactattatcgcaactggcttcagggaatacaggctgcatttgaccaggattgggcctccggacggattacccgccactcctatagaaacggatccgaagacggtgccctcgcatataaactgttaatccaaactggcgatgcacaggagcctctggacttctctcagttgacgactcggaagctggtggatcgggagggactgataccaccagaactgttttacatgggcctgaccgtttgggtttcatccgacccactcggcctggccgcaagccaggccaacttctatccaccccctccagagtggctgcacgacaagtacgatactaccggagagaatctcagaatccctcccgcacagccgttggagttcgctcagttcccgtttctcctcaggggactgcagaaaacagccgactttgtggaagccatcgaaggagcgagggccgcttgtgcagaggccggacaggccggagttcatgcctatccgagcggctcgccgtttttgttttgggagcagtatctgggcctgcgcagatgcttcctcctcgccgtgtgtatcctgctggtttgcacattcctggtgtgcgccttgttgctgttaaatccctggacagctggattgatcgtcctggtattggcaatgatgactgtcgagcttttcgggatcatgggttttttgggcataaagctgagcgcaattcccgtggtgatactcgtggcatctgtgggaattggggttgaattcaccgtgcatgttgcattaggctttctgactacccagggcagccggaaccttagggcggctcatgctcttgagcacacttttgcaccagtgactgacggagcaatttctaccctcctcgggcttctcatgctggccggatcacattttgatttcatcgtcagatacttctttgcagctctaactgtactaacactgcttggcctgctgcatggactggtattattgcccgtcctgctttcgatcttgggacctccaccagaggtaatccaaatgtataaagagtcccccgagattctgagcccgcctgcccctcagggaggcggactgcgctggggtgcgtccagctctctgccgcagtctttcgcgagagtgactacctccatgaccgtggctatacaccccccacctttgccaggagcatacattcaccctgcaccagacgaaccgccttggagccccgcagccaccagctccggaaacctgtccagccggggacccggtccggcaaccggttag

SEQ ID NO: 234163 - DNA, 267 bp, Artificial Sequence
  Description of Artificial Sequence: Synthetic coding sequence
tagttcgattttatcgtgcgttactttttcgccgctctcactgttctcactctcctgggtctgctgcacggcttggtcctcctgcctgtgcttctatctatactcggacccccaccagaagtgattcagatgtataaggaaagcccagagatcttaagccctcccgctccccagggaggcggattgagggtgggatccttgcaggtgaatattagctattggaaagagctgctctggtgccaggatctgagacctgaggagatttag

SEQ ID NO: 234164 - DNA, 3441 bp, Artificial Sequence
  Description of Artificial Sequence: Synthetic coding sequence
atgaccaggagccctcccctcagggagttacctccaagttacacaccccctgcgaggactgcggctccccagatactggccggatctctaaaagcgcctctgtggctgagagcatactttcagggcctgctgttctccctgggatgcgggattcaacgacattgtggtaaggtcctttttctaggtctgctcgcttttggcgctttagccctggggttacggatggccatcatcgagactaacctcgagcaactctgggtggaggtggggagtagagtgtcacaagagctccattacactaaagaaaagctgggggaggaggccgcttacaccagccagatgctcattcagaccgcgaggcaggaaggtgagaatattttgacgccagaggccctgggcctgcaccttcaagccgctctaacggcctccaaggtccaggtttctctgtacgggaaatcttgggatctcaacaaaatatgttacaagtcgggtgttccgttgattgaaaacggcatgatagaacggatgatcgagaagttgtttccttgcgtgatactgacacccctggattgcttctgggaaggagccaagctccagggaggttccgcatatctaccagggagacccgatatacagtggaccaatctggatcccgaacaacttttggaagagctgggccctttcgcctccctggagggtttccgagagttgctggataaagcacaggtgggacaggcttacgtcggtagaccctgcctccaccctgatgacctacattgtcctccatccgcaccaaaccaccactccagacaagctcccaatgtggctcatgagctgtccggtgggtgtcatgggttctcgcacaagtttatgcactggcaggaggaactcctgttggggggtatggccagagatccacagggcgagctactaagagccgaggcgctgcagtctacgtttctcctcatgtcacctagacaactgtacgagcacttcagaggagactatcagacccacgacatcggatggtctgaggaacaggcttctaccgtcctccaggcttggcaacgtaggttcgtgcagctggctcaggaggctcttcccgagaacgcaagccagcagattcatgccttttcaagcaccaccctagatgatatcttgcatgcctttagcgaagttagcgcggctcgggtggtgggcggataccttctgatgctggcgtacgcttgtgtgacaatgttacgctgggactgcgctcagagccagggttcagttggacttgcaggcgtacttctcgtggcactggcggttgctagtggtctgggactctgtgcgctgctgggcatcacctttaatgccgcaacgacacaagtgctgcccttcttggcccttggaatcggcgttgacgatgtattcctgttagcacatgcattcactgaagcactgccaggcactcctctgcaggagcggatgggggaatgtctgcagcgaacagggacaagcgttgtgttgacgagcattaacaacatggccgcttttctaatggcagcgctggtgccaattccagctctccgcgcatttagcctccaagcagccatcgttgtgggctgtactttcgttgctgtgatgttagtgtttcccgcaatcctgtccctggatctaagaaggcggcattgtcagcgccttgacgtgctgtgctgcttcagttccccgtgtagcgcacaggtcatccagattctgccacaagagctgggtgatgggaccgtccccgtcggcatcgcacatctgacagcaactgttcaggccttcacccattgcgaagcatcttcacagcatgtcgtcacaatccttcctccccaagcccacctcgtgccaccaccttcagaccccttggggtctgagctcttctcccccggaggatctactcgggacctgttagggcaggaagaggagacccgacagaaggccgcttgtaagagtttgccgtgtgccaggtggaacctagcccacttcgccaggtaccagttcgcaccgttactgctccagtcgcatgccaaggctatcgtgctcgtgctgttcggcgcactcctgggcctctccctctatggggctacactggttcaggacggattggctttaactgatgtcgtgcctagaggcaccaaggagcacgcgttcctgagcgctcagctgaggtatttttccttgtacgaagtggcacttgtgacccagggagggtttgactatgcccactcccagagggccctttttgatctccatcagcggttctccagcctgaaagcggttctacccccacccgcaacacaggcacccagaacttggcttcattactacagaaattggctgcaggggattcaggctgcctttgaccaggactgggcttccggacgcattacccggcatagctacagaaacggtagtgaggatggtgctcttgcgtataagctgttgattcaaacaggcgatgcacaggaacccttagacttttcccagttgactacaagaaagctggtggatcgggagggtctgatcccgccagagcttttttacatgggacttactgtctgggtcagctctgatcccttgggcctggcagccagtcaggctaatttctacccccctcccccagaatggctgcacgataagtacgacactacgggggagaacctgagaatcccaccggcacagcctctcgaatttgcacagtttccatttctgctgcggggactgcagaagacggcagacttcgtcgaggctatcgaaggggctcgagctgcatgcgcggaagccggtcaggctggcgtgcatgcatacccctccggctccccttttctcttctgggaacagtacttaggcttaaggcggtgcttcctgctcgctgtgtgtattctactggtctgcacattcctggtgtgcgccctcttattactaaacccttggactgccggattgattgtcttggttctggctatgatgactgtggaactgtttgggatcatgggatttctggggataaagctgtccgcaatccccgtggttattctggttgcctccgtgggaataggagttgagtttacagttcacgtggcgctcggtttcctcaccactcaggggtccagaaaccttagggccgctcacgcgctggagcacaccttcgccccagttaccgacggcgctattagcactttactagggctgttaatgttagccggaagtcacttcgactttatagttcggtacttcttcgccgcactgactgttttgacactgctgggcctgctgcatggcctagtgctcttgcccgtgctgctttctatactcggtccacccccagaagtgatccagatgtataaagagagtcctgaaattctgtcccctcctgctcctcagggtggcggactccggcctgaggagatctag

SEQ ID NO: 234165 - DNA, 2667 bp, Artificial Sequence
  Description of Artificial Sequence: Synthetic coding sequence
atgctccggcaggtgctgcaccgcggacttagaacctgtttctcccgcttgggccacttcatcgcatcccatcctgtcttttttgcctccgcgccagttctgatctccatattgcttggtgcctctttctcccggtaccaggtcgaggagtcggtggagcatcttctcgctcctcagcactccctcgctaagattgagcgaaacctggtgaattccttgttccctgtcaatcggtccaaacatcggctgtattctgacttgcagaccccgggacgctatgggagagtgattgtcaccagttttcaaaaggctaacatgctggaccagcatcacacagacctaatcctcaagcttcacgcagctgtaactaaaattcaggttcccaggccagggtttaattacacctttgcgcatatctgcattctgaataatgacaaaacatgtattgtcgacgacattgttcacgttctggaggaactgaaaaacgcacgggctacaaacaggactaactttgctataacataccccatcacccacttgaaagatgggagggccgtgtacaacggccaccagctgggcggtgttactgtgcactcgaaggatagggttaagtccgcggaagctattcagctgacctattatttacagagcatcaactctctcaacgacatggtagctgaacggtgggagtcttcattttgcgacacagtacggctttttcaaaaatccaattccaaagtcaagatgtatccttacacaagttcaagtcttagagaggattttcagaagacctcccgtgtgtctgaaaggtacttagtgaccagcctaatcctggtggtgacaatggccatcctgtgttgctcaatgcaggactgcgttagaagcaagccctggctggggctgctgggtctagtgaccataagtctcgcaaccctcaccgccgctggcattataaacctgacgggcggaaaatataactctaccttcctgggtgtcccattcgttatgctcggccatggattgtatggcacatttgagatgctttccagttggcgtaaaactagagaggatcagcacgtcaaggaaaggacagcggcagtctatgctgattcaatgctgtcattctcgctgaccacggccatgtatctagtaacttttgggatcggggcttcgccgttcacgaatattgaggccgcaagaattttttgttgcaattcctgtatagccatttttttcaactacttgtacgtcctctcattttacggcagctctctagtatttacaggctacatcgagaataattaccaacattcgatcttctgcagaaaagttccgaagcctgaggcgctgcaagagaaacccgcatggtacagattcctactgacagcgagattttcagaggatacggccgaaggcgaagaagctaacacctatgagagccatttactcgtgtgcttcttaaaacgctattattgtgattggatcactaacacatacgtcaagccgttcgttgtgcttttttacttgatctacatcagctttgccctaatggggtaccttcaggtcagtgaaggtagcgatctctctaatatcgtagctactgcgacccagacgatcgaatatacaactgcacagcagaaatactttagcaattactcccctgtgatcgggttttatatctacgaaagcattgagtattggaacacatcagtacaggaggatgttttagaatacaccaaaggttttgtcaggattagctggtttgagagctatcttaattacctccggaagctgaatgtctctacaggtctccccaaaaaaaacttcaccgacatgttacgcaactccttccttaaagctccacagttctctcatttccaggaggacatcatttttagtaagaagtacaatgatgaggtagacgtggtggcatccaggatgtttctggtcgccaagaccatggagaccaatagggaagagctctacgatctcctggagacattgcggcgattatctgtgacctcgaaagtcaaattcattgtctttaacccatcttttgtttacatggatcgctacgcatcaagtctcggggcacctttgcacaatagctgcatttcggctctgttccttctgtttttcagcgcttttcttgtcgccgactcgcttataaacgtatggattaccctgactgtggtctcagttgagtttggagtaattggctttatgactctctggaaagtcgagctggactgtatctccgttctctgcctcatctatggcataaattacacaatcgacaattgtgcgccaatgctgtccacctttgtgctaggcaaggacttcacccgcaccaagtgggttaagaatgctctcgaagtgcatggcgtggccatcttacaatcctacctgtgctacatcgtggggctgatcccattagccgctgtgccctcaaaccttacatgtactctgttccgctgcctgttcttaatcgctttcgtgacattcttccattgttttgccattctgcccgtcattctgacattcctccccccatccaagaagaaacgcaaggagaaaaagaacccagagaacagagaggaaattgaatgcgtggaaatggtcgatattgatagcacgcgtgttgttgaccagatcactacggtgtag

SEQ ID NO: 234166 - DNA, 4179 bp, Artificial Sequence
  Description of Artificial Sequence: Synthetic coding sequence
atggacacagaggacgatccactcttacaggatgtttggttagaggaagagcaagaagaagaagaggcaacaggagaaactttcctgggcgcacaaaagcctggacctcagcctggggctgggggtcaatgctgctggaggcattggccattagcaagtagacctccagcgtccggtttctggtcgaccctgggctgggccttcacaaatccatgttgcgctggactggtgctgttcctgggctgctctattcctatggcgctgtcagcattcatgtttctgtattatcccccattggatatcgacatctcttacaacgcctttgagattagaaaccatgaggcatcccagaggtttgatgcgttaacccttgcccttaaaagccaatttggttcttggggacgtaacaggagagacctggcggattttacctccgagacactgcagcgcctgatcagtgagcagttgcagcagctccacttaggaaaccgatctcgacaggcttctcgggcacccagagttatcccagcggcatcactcgggggacctgggccttacagggacacatctgccgcacagaagccaaccgctaacagaagcggccgactgcgacgggagactcccccattagaagacctcgccgcaaaccagtcagaagaccctcgcaaccagaggctgtcaaaaaatggccgatatcagccatctattcctccccatgctgccgtggcagctaatcagagccgcgcacgtaggggagcttcccggtgggattatagccgagcttacgtgtccgccaatacccagacgcacgcccactggaggatcgaactgatatttttggcgcgtggcgatgcagagagaaatatctttaccagcgaacgccttgtgacaatacacgagattgaaaggaagattatggatcatcccggttttagagaattttgctggaaacctcacgaggtacttaaagacctgccgctaggaagctattcctattgcagtccacccagttccttaatgacatacttttttcccacagagcgaggcggaaaaatatattatgatgggatggggcaggatctggcagacattcggggaagtctggaattggcaatgacacaccctgaattctactggtacgtggacgaagggctttcagccgataaccttaagagcagtctactccggtctgaaattctgttcggagcccctcttcccaattattactccgtagacgataggtgggaagaacaacgcgctaagtttcagtccttcgttgtcacgtacgtcgctatgctggccaaacagagcacatccaaggttcaggtcctgtacggcggaaccgatctgttcgattacgaggttcgcagaaccttcaacaacgatatgctgctggcttttatttcctcatcatgtatcgctgcactggtgtacattctaacctcttgctctgtgttcctctcctttttcggaattgcatctatcggtctctcttgccttgtggccctgtttctctaccatgtggtatttgggatccagtatctcggcatccttaatggggtcgcggcttttgtcatcgtaggcattggcgttgacgacgtgttcgtgttcatcaatacatatagacaggccacgcacctggaggacccacagttgcgaatgattcatacagttcaaacagccggtaaagccaccttttttacctccctcacaacagccgcagcctatgcggcaaatgtgttctctcagatcccagcagtccatgacttcggactcttcatgtcattgattgttagctgctgttggctcgccgtactcgtaacaatgcctgccgcactaggactgtggtcactctatctggcacccctagagtcgagctgccagacttcttgtcaccagaattgcagtcgaaagacatcccttcattttcctggagatgtgtttgcggcacctgaacaggttgggggaagtcccgcacagggtcccattccttacttggatgacgatatacccctgctggaagtggaggaggagccagtgagcttggagctgggcgatgttagcttagtgtcggtgagccccgagggcctccaacctgccagcaatactgggtcaaggggtcacttaatagtccagctgcaggaactactccatcactgggtgctgtggtcagccgttaagagcaggtgggtgatcgttggcctgtttgtgagcatactgatactgagcctggtcttcgccagcagactcaggcctgcttcgagagcgcctctattgttcagacccgatactaatatccaggtgctgctggatctgaaatacaacctgtccgctgagggcattagctgtattacatgctccggcctgtttcaggaaaaacctcattccttgcagaataatatacggacttctcttgaaaagaagagacgcggttctggtgtcccttgggcctcccgcccagaagcgactctgcaggattttccgggtaccgtctacattagcaaggtcaagagtcaaggccaccctgctgtatataggctctccctgaacgcatctctgccagccccatggcaggccgttagccctggagacggcgaagtgccttcattccaggtctatcgagcaccctttggtaacttcacaaagaagctgacagcttgtatgagcacagtaggcctgttgcaggctgctagccccagccgaaaatggatgctcaccacactggcctgcgacgccaaacgcggttggaaatttgactttagcttttacgtcgccactaaggaacagcagcacactcggaagctatatttcgcgcaatcgcacaagccaccctttcatggtcgggtgtgtatggcacctccaggctgcttgctgagcagctcaccagacggccctaccaaaggcttcttttttgtcccttccgagaaggtccctaaggccaggctctctgctactttcggatttaacccatgtgtgaacaccggatgtgggaaacccgcagtcaggcctctagtagatacgggagccatggttttcgtggtctttggcataatcggagtgaatagaaccagacaggtggacaaccatgtgattggagatccaggtagcgtcgtctacgatagttccttcgatctgtttaaggagattggtcacctgtgtcatctctgcaaggctattgcggctaattccgagttggtcaaacccggaggggcacagtgtctaccctcgggctattcgatctcctcctttctgcagatgctgcatcctgaatgtaaagaattgcctgaacctaacctgctccccggacaactcagccacggcgcagtgggcgtcagagaggggagagtgcagtggattagcatggctttcgaaagcaccacctacaaagggaaatcctcctttcagacctactcggactatctacgctgggaatctttcctccagcaacagctgcaggctctgcctgaggggtctgtgttgaggcggggatttcagacgtgcgagcattggaagcagatatttatggagatcgtgggcgtgcaatctgctttgtgtggccttgtgctcagcctcctgatctgtgtcgctgctgtagcagtgttcactactcacattctgctccttctacccgttctgctttctattttggggattgtgtgtctcgtcgtgacgatcatgtactggtccgggtgggaaatgggagctgtggaggccatctctctgtccattcttgtgggatcctccgtcgactactgtgtgcaccttgtcgagggctatctcttggccggtgagaatctgccccctcatcaggcggaagatgctcggacccaacgccagtggaggaccctcgaggccgttagacatgtaggcgtagctattgtgtcctctgctctgactaccgtgattgcaaccgttcctctgtttttttgcatcattgcaccatttgcaaaattcggaaagattgtcgccttaaacactggtgtgtcaatactttacactttaactgtgtctacagctctgctcggaatcatggccccaagctccttcaccaggacccgcacatctttcctcaaggcactcggcgcagtcctactggctggagctttgggactcggcgcttgcctggtcctgcttcagtcaggctacaaaatccccctgcccgctggcgcatcgctgtag

SEQ ID NO: 234167 - DNA, 4179 bp, Artificial Sequence
  Description of Artificial Sequence: Synthetic coding sequence
atggacactgaagatgaccctctcctgcaggatgtgtggctggaggaagagcaggaggaggaggaggccacaggagagacctttcttggtgcccagaaaccgggacctcagcctggcgctggcggacagtgctgctggagacactggcccctcgcaagccgccctcctgcgtctgggttctggtcaacactgggatgggctttcactaacccctgctgcgctggtttggttttgtttctcggctgcagcatccctatggccctttccgcgttcatgtttttatattatcctccactcgatatcgatatcagctataatgcctttgagatcaggaatcatgaagctagtcagcggttcgacgccctgaccttggccctcaagtcccagttcggttcttggggacggaacagacgcgatctggcggattttacaagcgaaaccctgcagagactgatctctgagcagcttcagcaattacacctgggtaaccggtccaggcaggcctctagggccccaagagtaattccagcggcttccctgggaggtccaggcccttaccgggatacatctgcagcccagaagcccactgccaaccggtctggcaggttgcgcagggagactcctccactggaggacttggctgctaaccagtcagaggaccccagaaatcagagactgagcaagaacgggagataccagcctagcattccaccgcatgcagccgtggccgcaaaccagtccagggccaggagaggagctagtcgatgggattactctcgcgcatatgtctccgctaacacacaaacccacgcacactggagaattgagttgatttttcttgcaaggggcgacgccgagcggaacatcttcactagcgaaagactcgttacgatccacgaaattgagaggaagataatggaccatcctggattcagggaattttgttggaagccccatgaagtgttgaaagatttacccctaggaagttactcgtactgctcgccgccatcctctctgatgacatacttcttccctactgagaggggcggtaagatttactacgacggcatgggacaggacctcgcggatattagaggatccttagaattggccatgacccacccagaattttattggtacgtcgacgagggtctgtcagctgataacttgaagagctctttgttacgcagtgaaatcctgttcggagcacctctgccaaactactactcagtcgacgaccgttgggaagaacaaagagccaagtttcagtctttcgtggtcacctatgtggcaatgctggccaagcaaagtacatctaaagtacaggtgttgtacgggggaacagacctttttgactacgaagtgcgcaggacctttaataatgacatgctgctggcctttatcagcagctcctgcattgccgctctggtgtatatcctgacaagttgcagcgtcttcctctccttcttcggcattgcctctatcgggctgagttgtctagtcgctttgttcctgtaccacgtggtgttcggcattcagtacttgggtattcttaatggtgttgccgcattcgtgattgtgggtatcggcgtggacgacgtcttcgtgttcataaatacgtaccgacaggctactcacctggaagatccacagctcaggatgattcacactgtccaaacagctggaaaggcgacattcttcacatctttaactactgccgcagcttatgccgctaacgttttctcccagattcccgcagtacatgactttgggctctttatgtcactgatagtgtcctgctgttggctggctgtgttagtaactatgcctgcggcattgggcctttggtcgctctacctggcccctctagaatccagttgccaaacatcctgtcatcagaattgtagccgaaaaacgtcgctccacttccctggagacgtgtttgcagcccctgagcaggtgggaggttcaccagcccagggtccgatcccatacctggatgacgacataccattactggaggttgaggaggaacctgttagtctcgaactgggagatgtgtctctggtctcggtctctcccgaaggcctccagccagcatcgaacacaggttcccgcggacacctcattgtgcagctgcaagaactcctgcatcactgggtgttgtggtcagctgtgaagtccagatgggtgattgtaggtctttttgtgtcaatcctaatcttgtcgttggtgttcgcctctagactgcgcccagcctctcgggcacctcttttattccgacccgataccaacattcaggtgttgttggacctgaagtacaacctctccgcagagggcatcagctgcatcacctgctctggcttgtttcaggagaagcctcattctttgcagaacaacatccggacctccctggagaaaaaacgcagggggtctggcgtgccatgggcctcgagaccggaagcgacgctgcaggacttcccaggcactgtctacatcagtaaggttaagtcccagggacaccccgctgtttaccggctcagcctcaacgcctcactgcccgcaccctggcaggcagtgtctcctggagacggggaagtgcccagtttccaggtctaccgtgcaccctttggaaatttcaccaagaaattaaccgcctgcatgtcaaccgttgggctcctgcaggcggctagccccagccgcaaatggatgttgaccacacttgcctgcgatgccaagcgcggatggaagttcgacttcagcttttatgtcgcgaccaaggagcagcagcatactcgcaagctttacttcgctcagagtcataaaccccctttccacggcagagtgtgcatggctcctccaggctgcctgctgagcagcagcccggatggacctacaaaagggtttttcttcgtgccttctgagaaagtgcccaaggcgagactctctgccactttcgggtttaacccctgcgttaacaccggatgtggtaagcctgcagtcagacctcttgtagatactggagccatggttttcgtcgtcttcggaatcataggcgttaaccgaaccagacaagtcgacaatcacgtgattggggatcccggttcggtggtgtacgactcctcctttgacctcttcaaagaaataggccatctgtgccatttgtgcaaggcgattgccgcaaatagcgaactggttaagcctgggggtgctcagtgtctcccaagtggttattccattagtagctttttacagatgctccatcctgaatgcaaagagctgcctgaaccaaatctgctgccaggccaacttagccacggggctgtaggggtgcgggaggggagagtccagtggatatccatggcattcgaatctaccacatacaagggaaaaagttcctttcaaacctattctgactatttgagatgggaaagctttttgcagcagcagcttcaagccctcccagagggctccgtgctgcggagaggcttccagacctgcgaacattggaagcagatttttatggagatagcaggcgtgcaaagcgctctgtgtggacttgtgttgtcactcttgatctgtgtcgctgctgtggctgtcttcactacccatatactactgctgctcccagtgctgttgagcatcctgggcattgtgtgcctggtggtgacgatcatgtactggagcgggtgggagatgggagcagtagaagccatctcgcttagcatcctggttgggtccagcgttgattactgtgtacatctagttgaaggctatcttctggctggtgaaaacctccctccgcatcaggcagaggatgccagaacccagcggcagtggcgaacgcttgaagctgtgcggcacgtcggcgtggccatagtctcatccgctctcaccaccgtcatagccactgtgccacttttcttctgtatcattgcgccatttgctaagtttggcaaaatcgtagcactgaataccggagtttctatcttatacaccctgaccgtttccacagcactactgggcatcatggcacctagcagttttaccagaacccgcacttcctttttaaaagcgctgggagcagtgttgttggccggagctctgggattgggagcttgtctcgtgctcctgcagtcggggtacaaaatacctctgcccgctggcgcttccttgtag

SEQ ID NO: 234168 - DNA, 2304 bp, Artificial Sequence
  Description of Artificial Sequence: Synthetic coding sequence
atgccctgggtcgaacccaagcccagacctgggcctgagcagaaaccgaaactcacaaagccggactccgctacaggtcctcaatggtaccaggagagccaggagtcagagagtgaagggaagcagccccctcccggtcccctcgctcctccaaagtcccctgaaccgtctggcccactggcttcggagcaggacgcccctctccctgagggagacgacgctcccccacggcctagcatgctcgacgacgcgccaaggcttcctctcgagctggatgacgccccactgccagaggaggaaaccccagaacccactgcaatctgccggcacagacatagatgtcatacagactgcctagaaggactcctcagccggacatttcagtggctcggatggcaagttggtgctcatccctggattttcctgctcgcccctttgatgctcactgctgctctcggtaccgggtttctctatctgcctaaggatgaagaagaggatctcgaggagcattacactccagtcgggtcccccgcaaaggctgaaaggcgcttcgttcagggacacttcactacaaacgactcctataggttttcagcttcacggagatctaccgaggctaactttgtgtcccttctcgtggtatcttattccgacagtctgttagatccagcgactttcgcagaggtctccaagttggacggagcggtccaagatctcagagtggccagggagaagggatctcaaattcagtaccagcaggtttgtgccaggtaccgcgcactctgcgtgcctcccaaccccatcctgtacgcctggcaagtaaataaaacactgaatctgtccagcatttcttttcccgcttataaccacggaagacaccccctctacttaactgggttcttcggcggttatatcctcggcggttccctaggcatgggccagctcctgttgcgggctaaagccatgaggctactgtattaccttaagaccgaagatcctgaatacgatgtgcagtctaaacagtggctcactcacctgctggaccagtttactaatatcaagaatatactggcactgaagaagattgaggtggtgcacttcacttcactttccagacagttggagttcgaggccacatctgtaactgttattcccgtctttcatctggcttacatcctgatcatactgtttgccgtgactagttgcttccggttcgattgcattagaaataagatgtgtgtggctgcgttcggcgtcatctcagcctttcttgcagttgtaagcggctttggcctgctgttgcatatcggcgtgcctttcgtgatcattgtggcaaactccccattcctcatcttgggagtgggggtggacgacatgtttataatgatcagtgcttggcacaagacaaatttagccgatgacatccgcgagaggatgagcaacgtgtactctaaagctgccgtgtccattacaatcaccaccatcacaaacattctggcgctttacacaggcattatgagttccttccgcagtgtgcagtgtttctgcatctatacgggcatgactctccttttttgctatttctacaatatcacatgcttcggggcattcatggcgctagacggcaagcgggaagtcgtctgtctgtgctggcttaaaaaagccgatcccaagtggccctcctttaaaaagttttgttgctttccattcggctccgtcccggatgaacatgggaccgatatccatcccatcagtctgttttttcgggactactttggaccttttctgacccgctctgaatccaaatacttcgtggtgtttatttacgtcctgtatattattagctccatttacgggtgcttccatgtgcaggagggcttggatctccgaaacctagcatctgacgatagttatattacaccgtactttaatgtcgaggagaactacttcagtgactacgggccacgagtcatggttatcgtgacaaaaaaagttgattattgggacaaggatgtaagacagaaactcgagaactgtactaagattttcgagaagaatgtgtatgtggataaaaacctgaccgagttttggctcgacgcatatgtccagtatctgaagggcaattcccaggatcctaatgagaagaacacattcatgaacaacatccctgactttctgtcaaatttcccaaatttccaacacgatataaacatctctagcagtaatgaaataattagctccagaggcttcattcagaccactgacgtgagcagctccgccaagaagaaaatcctcttgttctag

SEQ ID NO: 234169 - DNA, 978 bp, Artificial Sequence
  Description of Artificial Sequence: Synthetic coding sequence
atgacagaacggagaagagacgaactcagtgaagaaattaacaatcttagggaaaaagtgatgaagcagagtgaagagaacaataatttgcagtctcaagtgcagaaattgacggaagaaaatactaccttgcgggaacaggtggagccaacacccgaagatgaggacgatgacatagagttgcgaggcgcagctgccgcagccgcaccccctcccccaatcgaggaggaatgtccagaagatctgccagagaagttcgatggcaaccctgacatgcttgcaccatttatggcacagtgccagatttttatggagaaaagcacacgagatttttccgttgacagagtgcgggtgtgctttgtgacctctatgatgacagggcgtgccgctcgctgggcatcggccaaactcgaaagaagccattaccttatgcacaattaccctgcatttatgatggaaatgaagcacgttttcgaggacccccagaggcgggaggtcgctaagagaaaaattcgtaggctgcggcagggtatgggctctgtgatcgactatagcaacgctttccagatgatcgcccaagacctggattggaatgaaccggcattgattgatcagtatcacgagggcctgtccgatcacatccaagaagagctttctcatctggaagtcgctaagtcactatctgcattgataggccagtgtatccacattgagaggagactcgccagagccgcagccgctaggaaacccagatctcctcccagagccctggtgctcccgcacatagccagccatcaccaagtcgaccctacggaaccagtgggaggagccaggatgaggctgactcaagaagaaaaagaaaggcggaggaagctaaacctctgcctctattgcggcacgggcggacattacgcagataactgtcccgcaaaggcctccaaatcctctccagcagggaactctccggctccactctag

SEQ ID NO: 234170 - DNA, 978 bp, Artificial Sequence
  Description of Artificial Sequence: Synthetic coding sequence
atgactgagaggcgacgggacgagctgtccgaggaaataaacaatctccgtgaaaaagtgatgaaacaatccgaagaaaataataatctgcagtcacaggtgcagaaattaacggaagaaaacacgacactcagggagcaggtcgagcccacacctgaagatgaagacgatgatattgaattacgcggtgcagcagcagccgcagcccctcctcccccaatcgaagaggaatgccctgaggatctgcccgagaagtttgacggtaatccagatatgctcgcacctttcatggctcagtgtcaaatcttcatggagaaatcaacccgtgacttctctgtggaccgtgtccgggtttgtttcgtaacctccatgatgacagggcgagctgcacgttgggcctcagccaagctggaacggtcacactacttaatgcacaattacccagcgtttatgatggagatgaaacatgtctttgaggaccctcagaggagggaagtggccaaacggaaaattaggcgcctgaggcaggggatgggaagtgtaatcgactacagcaatgcctttcaaatgatcgctcaggacctcgattggaatgaacctgcccttatcgaccagtatcacgaagggctctctgatcacatccaggaggagctgtctcacctggaagttgctaaatccctgagtgccctgattggccagtgtatacatattgaaaggagactggctcgtgcagccgctgcccgtaaaccaagaagccctcccagggctttagtgctcccacacattgcatcccaccaccaagtggatcccacagagcccgtaggtggagcaaggatgcgacttacccaggaagagaaagagagaagaagaaaacttaatttgtgcttgtactgtggtactggcggacactacgctgacaattgtcctgctaaagcgtccaaatcaagcccagcaggaaacagtcctgcccctctgtag

SEQ ID NO: 234171 - DNA, 1311 bp, Artificial Sequence
  Description of Artificial Sequence: Synthetic coding sequence
atgatggcaacccagaccctcagtatcgacagctaccaagacgggcagcagatgcaggtggtgaccgagctgaaaactgaacaagaccctaattgttctgagccagacgcggagggcgtcagtccgcctcctgtcgaatcacagacccccatggacgtcgataagcaggccatctacaggcaccctttattcccactgttagcccttctttttgagaaatgcgaacagtcaacccagggatccgagggcactaccagtgcatctttcgacgtcgatatcgaaaatttcgtgcgcaaacaggagaaggaaggtaaaccctttttctgtgaagatcccgaaaccgataatctgatggtcaaggcgatacaggtgctcaggatccacttattggaattagagaaggtgaacgagctgtgtaaggatttttgttctcgatatatcgcctgcttgaagactaaaatgaactccgagactctcctctccggtgagcccggatccccctactctcctgttcaatcccaacaaattcagtctgccatcacgggaacaatttcgcctcagggaattgtggttccagcctcggccttacagcagggcaacgtggccatggccaccgtcgctggcggaactgtctatcagcccgtgactgtagtcaccccacagggtcaggtggtgactcaaacactgagtcccggaactattcggattcaaaatagtcaactccagctacaacttaatcaggatctctctattctccaccaagatgacggcagctccaagaataaaagaggcgtgcttcccaagcacgccacaaatgtcatgcggtcctggcttttccagcacattgggcatccttatcctaccgaagatgaaaaaaagcagatagccgcacagaccaacctcacactgctccaggtcaataattggttcatcaatgcccgtcgcagaattctgcagcctatgttagattcttcatgttcagaaacacctaagacaaagaaaaagacagcacagaaccgcccagtccaacgcttctggcctgactcgatagcgtcgggtgtggctcagccacctccatctgagctgactatgagcgaaggcgcagtggtgactataaccactcccgtcaatatgaatgtcgacagcctgcagtccttaagctcagacggggctacgttggccgttcagcaggtgatgatggctggacagtccgaggatgagtccgtcgattcgaccgaggaggacgcaggtgccctagccccagctcacatatccggactcgtgctggagaattcggacagcttgcagtag

SEQ ID NO: 234172 - DNA, 960 bp, Artificial Sequence
  Description of Artificial Sequence: Synthetic coding sequence
atggtgaaagcgattcaggtgctacgcatccaccttttagagttggagaaggtaaatgagctgtgcaaagatttctgctctcggtatatagcttgtttgaagaccaagatgaattctgagaccctgttgtcaggcgaacctgggtcaccttattctccagtccagtctcagcagatccaatccgcaatcaccggcacaatatctccccaggggatcgtcgtgcctgccagtgccctgcagcagggtaacgtggccatggctaccgttgccggtggtacagtctaccaacccgtcacagtggtgacgccccaaggccaagttgtaacacaaaccctttctccgggaacaataaggatccagaacagccagctccagctacagctgaatcaggatctttccatcctccaccaggatgacggcagctctaaaaataaaaggggcgtgctcccaaagcacgcaaccaacgtgatgagaagctggctctttcagcatattggccacccttaccccaccgaggacgagaagaagcagattgccgcacagaccaatctgacactccttcaggttaacaactggtttatcaacgccaggcggaggatcctgcagcctatgctggattcctcttgctccgaaacgcccaagactaaaaagaaaaccgcacaaaatcgacctgtacaaaggttttggccggactctatagccagcggtgtcgcccagccccctccttctgagctgactatgagcgaaggggcagtggtcaccatcactaccccggtcaacatgaacgttgattccctgcaaagtctgagtagcgatggtgctaccctcgctgttcagcaagttatgatggcaggacagagcgaagatgagagcgtagattctacagaagaagatgccggtgctctagctccagctcacatttctggccttgtcctggagaacagtgactccctacaatag

SEQ ID NO: 234173 - DNA, 1260 bp, Artificial Sequence
  Description of Artificial Sequence: Synthetic coding sequence
atgatggcaacccagacactgtcgatcgactcatatcaggacggacagcagatgcaggttgtcactgagttgaaaacagaacaggaccccaactgttccgagcccgatgccgaaggcgtgtctccacctcccgtggaaagtcagacaccgatggatgtagacaagcaggctatctaccgccaccctcttttccctcttcttgctctccttttcgagaaatgtgaacagtccacccagggaagcgagggcaccaccagcgcctcctttgacgtggatatagaaaactttgtgcggaagcaagagaaggaaggcaaaccctttttctgtgaagatcctgaaactgacaacttgatggttaaggcaatccaggtactgaggatacatctcctcgagctggaaaaagtcaatgaactgtgtaaggacttctgctctcgctatatcgcctgtcttaagacgaaaatgaactcagagactttgctctcaggagaacctggaagtccctacagccccgtacagagccagcaaattcagtctgctattaccggcactatttctcctcagggaattgttgtcccagcatctgcgctccagcagggcaacgtggccatggccactgtagcgggagggacggtctatcagccagtgactgtggttacaccacaaggacaagtggtgacacagacactgtcaccaggaacaattagaatccagaactcccagctccagctccaattgaaccaggacctgagcatcttgcatcaggatgatgggtcctccaagaataaacgcggagtcctgccaaagcacgctactaacgtgatgcgcagctggcttttccaacacatcggccacccttatccaacagaggatgaaaagaagcagattgcagctcaaacgaatctgacactgctacaggtgaataactggttcatcaacgcccgacgaagaatactgcaacctatgctcgatagttcctgttccgagactcccaagaccaagaaaaaaaccgcacaaaaccgacctgtgcaacgtttttggcccgattccattgcttctggagtcgctcagcctcctccctctgagttgactatgtccgaggggaccggaggacgaccaagacctgacatggtcgatcatggagttggaatcatgaacaaaagacctggatctggcctcctggcacctccgaggccagctgagaacgatatactgaaaccacctctgcggagctcctttgtcaactgtctgctgatcttctag

SEQ ID NO: 234174 - DNA, 1419 bp, Artificial Sequence
  Description of Artificial Sequence: Synthetic coding sequence
atgatgcagcatgccagtcctgctcctgcgttgaccatgatggcgacgcagaatgttcccccacccccataccaggattctcctcagatgacagccaccgcccagccgccatcgaaggcccaggcagtacatatttccgcaccaagcgctgccgcttctacccctgtccccagcgccccaatcgacccgcaggcacagcttgaagccgacaaaagggccgtgtaccgccaccccctttttcccctcttgaccctgttgtttgagaagtgcgagcaggcaacccaaggaagtgaatgtatcacaagtgcctcctttgacgtagacatcgagaattttgttcaccagcaggagcaggagcataaaccctttttttccgacgaccctgaactagacaacctcatggttaaggcaatccaggtgcttagaatacacctgttggaactggagaaggttaacgaattgtgtaaggacttctgtaacaggtatattacatgcctcaagaccaagatgcacagtgataatttgctgaggaatgatctggggggaccgtactcccccaatcaaccatctatcaatctccattcacaggacctcctgcagaattcccctaactctatgtctggcgtgagcaataacccccagggtatcgttgttccggcttccgcccttcagcaaggcaatatcgccatgacaacggttaacagccaagtggtatccggaggtgccctttatcaaccggtgacaatggtgacatcccaaggtcaggtcgtgactcaggctatcccccagggcgctatccaaatccagaatacccaggtgaatctggacctgacctccctcctggataatgaggacaagaaaagcaaaaataagaggggcgtgttgcctaagcacgcaacaaacatcatgcgtagctggcttttccagcatctgatgcacccatacccaacggaagacgaaaaacgccaaattgccgctcagaccaatctgacacttctacaagtgaataattggtttatcaatgctcgaagacgcatccttcagcccatgctggacgcctccaatccggacccggcaccaaaggctaaaaaaattaaatcccagcatagacccacgcagcgattctggcccaattccatcgctgccggagtgctacagcagcaagggggagccccaggcacaaaccccgatggctccattaatttagacaacctgcagagcctgtcctcagattccgctaccatggctatgcagcaagccatgatggcagctcatgacgacagtctcgacggcaccgaggaagaggacgaggatgagatggaggaggaagaagaagaagaactggaggaggaagtggacgagcttcaaactaccaatgtatccgaccttgggctggagcactcagattcgcttgaatag

SEQ ID NO: 234175 - DNA, 120 bp, Artificial Sequence
  Description of Artificial Sequence: Synthetic coding sequence
atgatgcagcatgctagtcctgcccctgcactgactatgatggccacacagaatgtgccaccaccaccttatcaggacagccctcagatgacagcgactgctcagccaccttcaaaatag

SEQ ID NO: 234176 - DNA, 1332 bp, Artificial Sequence
  Description of Artificial Sequence: Synthetic coding sequence
atgaccgcaaccgctcagccgccatcaaaggcacaagcggtccatatcagtgctccctctgccgcagcctccactccagtgcccagtgcccctatagacccccaggcccagctagaagcagacaagagggccgtgtaccgccacccactctttcctctcctcacactgttatttgagaagtgtgaacaggctactcaggggagcgaatgcattacttcagccagttttgatgtcgatatagagaatttcgtgcaccagcaggaacaggagcacaagccctttttttccgatgatccagagctggataaccttatggtaaaggccattcaggtgttgcgaatccacttgctggagctggagaaagtcaacgaactttgcaaggatttttgcaaccgttatattacatgtctgaagactaaaatgcactcagataacctgttacgcaatgatctgggcggaccatattctccaaatcaaccctctataaaccttcactcgcaagacctgctccagaacagtcccaacagtatgtccggagtgagcaacaacccccagggtatcgtggtgccggcttcagcgctccaacaggggaacattgccatgaccaccgtaaacagccaggtagttagcgggggagctctctatcagcccgtgaccatggttacgagccaggggcaggtggtgacccaggcgatcccccagggagccatacagatccaaaatacccaggtcaacctcgatcttacatcacttctggacaacgaagacaaaaagtccaaaaataagaggggggtgctgccaaagcacgccaccaatataatgagatcatggctattccagcacctcatgcatccctatccgactgaggatgagaagcgacaaatagctgcccagaccaatctgacgctgttacaggtgaataactggttcatcaacgcccgacggaggattctgcagcctatgctggatgcttccaacccggacccagccccaaaagctaaaaagatcaaatctcagcaccggccaacgcagcgtttttggcccaattccattgctgcaggagtgctgcaacagcaggggggagcacccggtacaaacccagacgggtctatcaatctggacaacctccaaagtttgtcgtcagactcagccactatggcaatgcagcaggccatgatggccgcacacgatgacagtttggatggaacagaggaggaagacgaggatgagatggaagaggaagaagaggaagagctcgaagaagaggttgatgagttgcagaccactaatgtttctgacctcggcctcgagcactccgactcactagagtag

SEQ ID NO: 234177 - DNA, 1332 bp, Artificial Sequence
  Description of Artificial Sequence: Synthetic coding sequence
atgactgcgaccgcccaacccccatccaaagctcaggccgttcatatctctgcacctagtgccgctgcaagtacccccgtcccaagcgctcccatcgaccctcaggctcagctggaggccgataaaagggctgtgtacaggcatcccttatttccactactcacccttctcttcgaaaaatgcgaacaggctacacaaggttccgagtgcatcacctcagcatcattcgacgtggacattgaaaacttcgttcaccagcaagaacaggagcacaagccattttttagtgacgaccccgagctggacaaccttatggttaaggccattcaagtgctgagaatccacttactcgagctcgagaaagttaacgaattgtgcaaagacttttgtaacaggtatatcacttgtctgaaaaccaaaatgcactcagacaacctcctcaggaacgatctcggcggaccctattcacccaaccagccctctattaacctccattctcaggatctccttcagaattctcccaattctatgtcgggcgtgtccaataacccccaggggattgtcgtgcctgcatctgccctccaacagggtaacattgcaatgaccaccgtgaacagccaagtcgtctctggaggagccctctatcagcccgttactatggtcacatcccaggggcaagttgtgacccaagcaatcccgcagggcgcaatccagatccaaaacacacaagtcaatctagatctgactagcctgctggataatgaggataaaaagtcgaaaaacaagcggggtgtactaccaaagcacgccactaacatcatgagatcctggctgtttcagcatttgatgcacccctacccaaccgaggacgagaagcgtcagatcgccgcacagacaaacttgacccttctgcaggtcaacaactggtttattaacgcgcgacgacgtattctgcagccgatgcttgacgcttccaatccggatccagctccaaaggctaagaagatcaagtcacagcacaggcccacacaaaggttctggccaaatagtatcgccgcaggggttctgcaacagcaagggggagcccctgggactaaccccgatggatccataaatttggataatttacagtcgctcagctctgattccgctaccatggcaatgcagcaggccatgatggctgcccatgacgacagcttggacggcaccgaggaggaggacgaagacgagatggaagaagaggaggaggaggagctcgaggaggaagtcgatgagctccaaaccaccaacgtctcagatcttgggttggaacacagtgacagcctggagtag

SEQ ID NO: 234178 - DNA, 123 bp, Artificial Sequence
  Description of Artificial Sequence: Synthetic coding sequence
atgatgcaacacgcgtcccctgcccctgccctcacaatgatggcgactcagaacgtgccaccgcctccgtaccaagacagtccccagatgaccgctaccgcgcagccaccctccaaggcttag

SEQ ID NO: 234179 - DNA, 921 bp, Artificial Sequence
  Description of Artificial Sequence: Synthetic coding sequence
atgatggctacgcagaatgttcctcctccaccgtaccaggatagtccccaaatgacggcgacagcccagcccccatccaaagctcaggcggtccacatatcagcaccgagtgcagctgcgtccactccagtgccttcagctccaatagaccctcaggctcagctggaagctgacaaacgcgcagtgtaccgccatcccttgttcccgctgctgactctgttgtttgaaaagtgtgagcaggctactcaggggagcgaatgtatcacaagcgcatcattcgacgtggacatagagaattttgttcaccagcaggagcaggagcataagccatttttcagcgatgacccagaactggataatttgatggtcaaagcgatccaggtgctacggatccacctgctggagttggaaaaggtgaacgaactgtgcaaagacttctgtaaccgatacattacatgtctgaaaacgaaaatgcactcagataacctactgagaaatgacctgggcggaccctatagtcctaaccagccgtccatcaatctgcatagccaagatttgctccaaaattctccaaattccatgagcggggtgagcaacaacccacaaggaatagtagtacccgcttccgccctgcaacagggaaacattgctatgacaaccgtgaattctcaggttgtgtctggtggggctctgtaccagcccgtgacaatggtaacatcccagggacaggtggtgacccaggcaatccctcagggagctatccagattcagaacactcaagtaaacctggaccttacctccctgctggataatgaggacaagaagtctaaaaacaagagaggtgtccttccaaagcacgcgactaacatcatgaggtcatggttgttccagcatcatgccccactgcctcatgggggttag

SEQ ID NO: 234180 - DNA, 1227 bp, Artificial Sequence
  Description of Artificial Sequence: Synthetic coding sequence
atgtcacgccctcacccgacaagaacagcgcataggcaccccctttttccactcctgacactgctcttcgagaagtgcgagcaagccactcagggctcagaatgcattacttcagcctctttcgacgtggatattgaaaattttgtccatcaacaggagcaggaacataaacctttcttctctgatgatcccgaactggacaatctgatggtcaaggccattcaagtcctacgtattcatctcctggagttggaaaaagtgaatgagttatgcaaggacttttgcaatcgatacattacatgccttaaaacgaaaatgcactcagataatctgctacggaacgacctaggtggaccttacagccccaaccagccctcaattaatctccactcccaggatcttctacaaaactcaccaaattccatgagcggagtgtcaaataacccacaagggatcgtagtgccggcttctgctttgcagcaaggtaacatcgcaatgaccacagtcaattcacaggtcgtgtctggcggtgcattataccagccagttactatggttacaagccaagggcaggttgtcacacaagcaattccacagggtgcaatccagatccagaacacccaggttaacctcgacttaacctctctattggacaacgaagataaaaagtcgaaaaataaacggggagtactcccgaaacacgccaccaatatcatgagatcatggctgtttcaacacctgatgcacccttatcctaccgaggacgagaagcgccagatcgctgcgcagactaaccttaccctgcttcaggtgaataactggtttataaacgcgagaaggaggatcctgcagcctatgctggacgcatccaacccagaccccgctcccaaggccaaaaaaatcaagagtcaacacagacccacccagcgcttctggccaaactccatagccgctggcgtcctccaacagcaaggaggagctcccggaaccaatccagacgggagtattaacctggacaacctgcagagcctgtcaagcgattccgccaccatggcgatgcagcaagctatgatggccgctcatgacgacagtctggatgggactgaggaggaggacgaagacgagatggaggaggaggaagaggaggagttggaggaagaagtggacgaattgcagaccacaaacgtgagcgaccttggcttggagcatagcgactcattggaatag

SEQ ID NO: 234181 - DNA, 297 bp, Artificial Sequence
  Description of Artificial Sequence: Synthetic coding sequence
atgatgcagcacgcgtcacctgcgccagctttgactatgatggcaacccagaacgtgccccctcctccgtatcaggactcccctcagatgaccgccacggcacagcctccttcaaaggcacaggctgtgcacatctctgcaccgagcgctgccgcttcaacccctgtgccttcggcgcctattgaccctcaggcgcagttggaggccgacaagagagcagtgtatcgacacccgctttttccattgctcactcttctctttgagaagtgcgaacaggcgacacagggatctgaatag

SEQ ID NO: 234182 - DNA, 234 bp, Artificial Sequence
  Description of Artificial Sequence: Synthetic coding sequence
atgatgcaacacgcttccccggctccggcactgactatgatggccacacagaatgtacccccaccaccatatcaggactctcctcagatgacggcaaccgcccagcccccttcaaaggcccaagcagtacatatctcggccccaagtgctgccgctagcaccccagtgccaagcgctcctatcgacccccaagcccagctggaggccgacaagcgcgcagtttaccgctggtag

SEQ ID NO: 234183 - DNA, 990 bp, Artificial Sequence
  Description of Artificial Sequence: Synthetic coding sequence
atgacacgggattttaagcccggagacctgatctttgcgaaaatgaaaggatatccacactggcctgctagagtggacgaggtacccgatggtgcagtgaaaccacccaccaataagctcccgatcttttttttcggcacccacgaaaccgctttcctggggccaaaggatatattcccttacagcgagaacaaagagaaatatggaaagccaaataaacggaaggggttcaatgaggggctctgggagatcgataataatcctaaggtgaaattctcatctcagcaggcagctactaaacagtcaaacgcatcgagcgatgtagaagtggaagagaaggagacatcagtgtccaaggaggatactgaccacgaggagaaagcttccaacgaagacgtaaccaaggcggtggacatcactactcccaaagcagcaagaagagggaggaaaagaaaggctgagaagcaagtcgaaacagaggaggcgggagtggtgacaacagccactgcctccgtcaaccttaaggtgagccccaaacggggtcgcccagctgcaactgaagtgaaaattcctaagccaagaggccgtccaaaaatggttaagcaaccttgtcccagtgagagtgatattataaccgaggaggacaaatccaaaaaaaaaggtcaagaagaaaagcaacccaagaagcagcccaaaaaggacgaagagggacaaaaagaggaagacaaaccaagaaaggagcccgataaaaaggaggggaagaaagaggtggaaagcaagcgtaagaatctggcaaaaacaggcgtgacgagcacttcagactcggaggaggaaggggatgatcaggagggcgaaaagaagcgaaagggcggtaggaactttcagaccgcccacaggagaaatatgttaaagggccaacatgagaaagaggctgcggacaggaagagaaagcaggaggagcaaatggaaacggaacactttgcactatag

SEQ ID NO: 234184 - DNA, 1002 bp, Artificial Sequence
  Description of Artificial Sequence: Synthetic coding sequence
atgaccagggacttcaagcccggagatcttatcttcgctaagatgaaaggatacccccattggccagcaagggtagacgaagttccggacggcgctgtgaagccaccaactaacaaattgccaatcttcttctttggcactcacgaaacagcgtttctggggcctaaagacatttttccctactccgagaacaaagagaaatacgggaaaccaaacaagcgcaagggctttaatgaaggactgtgggagatcgacaacaatcccaaagtgaaattcagcagtcaacaagccgctacgaaacagtcaaacgcttcttcagacgtggaggtcgaggagaaggagacatcagtctcaaaggaggacaccgaccatgaggagaaggccagtaacgaggatgttaccaaggccgtagatatcaccacccctaaagctgctcgccgtggccgaaaacggaaggcagagaagcaggtggagactgaagaagcaggcgtcgtgacaacagcgactgcctcagtgaatctaaaggttagccccaaaagaggaaggccggcagccacggaggtgaaaatcccaaagcctagaggtcgacccaagatggtgaagcagccttgtccttctgagagcgacattatcaccgaagaagataagtccaagaagaaaggacaggaggagaaacagccgaagaagcagcccaaaaaggacgaagagggacagaaggaggaggacaaacccaggaaagagccagacaaaaaggaaggcaaaaaggaggtagaaagcaaaagaaagaatctggccaaaaccggggtgacctccacaagcgactctgaggaggagggggacgatcaggaaggagaaaagaagcgaaaagggggacgcaacttccagacggctcatcggaggaatatgctgaagggccagcatgagaaagaagccgctgaccgtaaaaggaaacaagaggaacagatggaaacagaacaccagaccacatgcaatctgcaatag

SEQ ID NO: 234185 - DNA, 1593 bp, Artificial Sequence
  Description of Artificial Sequence: Synthetic coding sequence
atgactcgggacttcaaaccaggcgacctcatcttcgcaaaaatgaagggctatccacactggcccgcacgggttgacgaggtccccgatggagccgttaagccgcctacaaataagctgcctattttcttcttcggtacccatgaaaccgctttcctgggcccaaaggacatcttcccctactctgaaaataaagagaagtacgggaagcccaacaaaaggaaaggctttaacgaaggtttgtgggagattgataacaatcctaaggtaaagttttcgtcccagcaggctgcaacaaagcagagtaatgcgagtagcgatgtggaggtcgaagaaaaagagacgtccgttagcaaggaggatacagatcacgaggaaaaggctagcaacgaggatgtcaccaaggctgtggacataactactcctaaagcagcccgaaggggacgtaaaagaaaagccgagaaacaggtggaaactgaggaggcaggcgtggtgaccacagctactgcttccgttaatcttaaggtgagccccaaacgaggcagaccagcagccacggaggtgaaaatccctaagccgagaggccgaccaaaaatggtgaaacagccttgtccgtcggagtctgacattataaccgaagaagataagagcaagaaaaagggtcaagaggaaaagcagcccaaaaagcagcccaagaaagacgaagaagggcaaaaggaggaggataaacccagaaaggagccggataaaaaggaaggaaagaaggaggtagaatcaaagcgcaagaatctggctaagactggagtcacaagcacgtccgactctgaggaggagggtgacgaccaggagggggaaaagaaacggaaggggggtcgcaactttcaaaccgctcatcggagaaacatgctcaagggacaacacgagaaagaggcagccgacagaaaacgcaaacaagaggaacagatggagaccgagcagcaaaataaggatgagggtaagaaacccgaagtcaagaaagtcgagaagaagcgtgaaacttcaatggattctaggctgcaaagaatacacgctgaaatcaaaaattcgctgaaaatcgacaacttggatgtcaatcgttgcatcgaggctctcgacgagctcgcctccctgcaggtgacaatgcagcaggcccagaagcacacggagatgatcactacattgaaaaagattcgaaggttcaaagtttcgcaggtaataatggagaagtctacaatgctatacaataagttcaaaaacatgttcttggttggcgaaggtgactcagtgattactcaagtgctgaataagagtctggcagaacaaaggcagcatgaagaggctaacaagaccaaagaccagggaaaaaagggccctaacaaaaaactggaaaaggaacagaccggcagcaaaaccctcaatggaggatccgatgcacaggacgggaatcaaccgcaacataacggcgaatccaatgaagatagtaaggataatcacgaggcttcgaccaagaaaaaaccttcctccgaggaacgcgagaccgaaatcagtctgaaggattcaacattggacaattag

SEQ ID NO: 234186 - DNA, 1593 bp, Artificial Sequence
  Description of Artificial Sequence: Synthetic coding sequence
atgacaagggatttcaagccgggagacctcatatttgctaagatgaaaggctacccccactggcccgctagagtagatgaggtgcccgacggagccgtgaagcctccaacaaacaaactccccattttcttcttcggcacccatgagacagccttcctgggtcccaaggacatcttcccatattccgagaataaagaaaaatatgggaagccaaacaaacgcaagggtttcaacgaaggcctgtgggagatcgacaacaatccaaaagtgaaattctcttcccaacaggcagcgacaaagcagagcaacgcgagcagcgatgttgaggtcgaggaaaaggagacatctgtgtccaaggaggataccgaccacgaagagaaagcttccaatgaggatgtcacgaaggcggtcgacataaccacgcctaaggctgcccgaagggggagaaaacgcaaagccgagaagcaggtagaaacggaggaggcaggggtggtcaccaccgcaaccgcctcagtgaatttaaaagtgagcccaaaaagggggagacctgccgcaaccgaggtaaagatacccaaaccgcgtggcagacccaaaatggttaaacagccatgtccttccgagagtgatatcatcactgaagaagacaagagcaaaaaaaaagggcaggaagagaagcagcccaaaaagcagccaaagaaagacgaagaaggccagaaggaagaggataagcccaggaaagagccagataaaaaggaaggaaaaaaagaagtggagtctaaaaggaaaaacctggccaagacaggagtgaccagcacttctgacagcgaggaagagggagatgatcaagaaggcgaaaagaagagaaaggggggacggaacttccagactgctcaccgtagaaacatgctgaaaggacagcatgagaaagaggctgccgacagaaagagaaagcaggaagaacagatggagaccgagcagcagaacaaagacgaggggaaaaagccagaagtcaagaaggtcgagaaaaaacgggagacgtccatggactctaggctgcaacggattcatgctgaaatcaaaaactccctgaagatagataatctcgatgtgaatagatgcatcgaagctttagatgaattggccagtctccaagttaccatgcagcaagcacagaagcacactgagatgatcaccactctgaaaaaaatcaggcggttcaaggtgtcccaggttatcatggagaagagcaccatgctttacaacaaatttaaaaatatgtttctcgtcggcgaaggcgacagcgtcataacacaggtgttaaacaaaagcctggcggagcagcgacagcacgaggaagcgaataaaacaaaagaccagggaaaaaagggccctaataaaaagctggagaaagagcagacaggctcaaagaccctgaatggcggatcggatgcccaagatggaaatcagcctcagcacaacggtgaatctaatgaagattctaaagacaaccacgaggctagcacaaagaagaagcctagcagcgaagagagggagactgagattagtctaaaagattcaactctggataactag

SEQ ID NO: 234187 - DNA, 1002 bp, Artificial Sequence
  Description of Artificial Sequence: Synthetic coding sequence
atgactcgagactttaagcctggtgacctcatatttgccaagatgaaaggttacccgcattggcccgcacgtgtcgatgaggtccctgatggagcagttaaaccccctaccaacaagctccctattttctttttcggtacccacgagaccgcattcctgggaccaaaggacatctttccctactcggaaaacaaagaaaagtatggtaaacctaacaagaggaaagggttcaatgaaggcctttgggagatcgataataatccaaaggtgaaattcagctcacagcaggccgcaaccaagcagtctaacgcgtcttccgacgtcgaggtcgaggaaaaagagacctcagtcagtaaggaagataccgaccatgaagaaaaagcttcaaatgaggacgtgacgaaagccgtggacattaccacaccgaaagccgcaagacgtggcagaaaacgaaaagccgagaaacaggtggaaacagaggaagccggtgtcgtcactacggccactgccagtgtcaatctgaaggttagcccaaagagaggacgtcctgccgctaccgaagtcaagataccaaaacccagaggcaggccaaaaatggtcaagcaaccttgtccctccgaatctgatattattacggaggaggacaaatccaagaaaaaaggccaggaagaaaagcagcctaagaaacagccaaagaaagatgaggagggtcagaaagaggaggacaagccaagaaaggagcccgataagaaagagggcaagaaggaggttgaaagtaaaaggaaaaacctggccaagacaggggtgacttctactagcgacagtgaagaagaaggcgatgaccaggaaggcgagaagaagcggaaaggcggtcgaaactttcagacagcacaccgcaggaacatgttgaagggacagcatgaaaaagaagccgctgaccgaaagagaaaacaggaggagcagatggaaaccgagcatcagactacctgtaacctccaatag

SEQ ID NO: 234188 - DNA, 1362 bp, Artificial Sequence
  Description of Artificial Sequence: Synthetic coding sequence
atggcccacattacaatcaaccaatatctccagcaagtttacgaggctatcgatagcagggatggcgctagctgcgcagagctggtttcatttaaacatcctcatgtcgctaacccacgtctgcagatggcgagtcccgaagaaaagtgtcagcaggtgctagagcccccttacgacgagatgtttgccgctcatttaagatgtacatacgctgtgggtaatcatgactttattgaagcctacaaatgtcagactgtgattgtgcagtatccgttgagtttcatggctgccgtcccccacagaactcacgcagtggactatcttgggttagaaactcgaaagcactgggcgtcctgtagctttctacagctggaacgcaacgatagcgtactcgagcagaaactcgtttctgctctctcgctcggaacctctttcttaagggcatttcaagctcacaaagaggagaactgggctctgccggtgatgtatgctgttgccctggacctgagggtgtttgctaacaacgcggaccagcagcttgttaaaaaagggaaatctaaagtgggcgatatgctagagaaggctgcagaacttctgatgtcctgcttcagggtgtgtgcgtccgacacaagggctgggatagaggattcgaaaaaatggggaatgctcttcctggtgaaccagctgttcaagatttatttcaaaatcaacaagctccacctgtgcaaacccttgatccgagccatcgattcgtccaacctgaaagatgactattcaacggcccagcgtgtgacctacaagtattacgtaggaaggaaagccatgttcgactcagattttaagcaggccgaagaatatctgtccttcgcgttcgagcattgtcatcggtcttcacagaaaaataagcgcatgattctgatttacctgctgcccgtcaaaatgctgttggggcatatgccaaccgtggagctgcttaaaaaatatcacctgatgcagtttgctgaagtgacaagggctgtctccgaaggtaacctgttgcttctgcacgaggcccttgcaaagcatgaagcatttttcataaggtgtggcatcttcctgatcttagagaaacttaaaataattacatacagaaacctttttaaaaaagtttacctgctgcttaaaacccaccagttgagcttagatgcattcttagttgctttgaagtttatgcaggttgaagacgtggatattgatgaggtgcagtgtattctggcgaacctcatctacatgggacacgtgaagggctacatctcacaccagcatcagaagctggtggtttccaaacaaaatcctttcccccctttgtcaactgtttgttag

SEQ ID NO: 234189 - DNA, 1200 bp, Artificial Sequence
  Description of Artificial Sequence: Synthetic coding sequence
atgcgcttaacagatgtagttcagcaattggtgtatgaagccattgacagtcgggacggggcaagttgcgcagaacttgtatcattcaagcaccctcacgtcgctaacccccgactgcagatggcttcgccagaagagaagtgccagcaggtgctcgaacccccttacgacgagatgtttgccgctcacctccggtgtacctatgccgtcgggaatcatgacttcattgaggcttacaagtgccagactgtgatcgtgcagtacaccagcttccttagggcatttcaagctcacaaggaagagaattgggcactaccggtcatgtacgctgtcgctctagaccttcgagtttttgcaaataacgctgatcagcagctcgttaagaaaggtaaaagcaaggtcggagatatgctggaaaaagccgctgaattgctgatgtcatgtttcagggtgtgcgccagcgatacaagggctggcattgaggatagtaagaagtggggcatgctttttctcgtgaatcagctgttcaaaatttattttaaaatcaacaagctgcatctatgcaagcccctcattagggctattgactcctcgaacctgaaggatgattacagcaccgcacagagggtgacatataagtattacgtaggccgaaaggcgatgttcgactccgactttaaacaggcagaagagtatctaagctttgcttttgaacattgccacaggagcagccagaagaacaaacgtatgattttgatttacttgttgcctgtcaagatgctgctggggcatatgcccacagttgaattactaaagaaataccatctgatgcaattcgcagaggtcaccagggctgtcagcgagggtaatctgttactgttgcatgaggccctggccaagcacgaggcattcttcatcagatgtggcatattcctgatcctcgaaaagctcaaaataattacttatcggaatctgtttaagaaggtttacctcttactcaaaacacaccagctgtcactggacgcatttctggtagccttaaagtttatgcaagtcgaggatgttgatatcgacgaggttcagtgtatcctcgctaatctcatctatatgggtcacgtgaaaggatacatatcccatcaacaccagaaactggtcgtatctaagcagaacccattccccccattgtctaccgtgtgctag

SEQ ID NO: 234190 - DNA, 1200 bp, Artificial Sequence
  Description of Artificial Sequence: Synthetic coding sequence
atggcacacatcacaatcaatcagtacctgcagcaggtatacgaagctatcgatagccgtgacggagcaagttgtgccgaactagtttcttttaaacatcctcacgttgcaaatcctcggctgcagatggcatccccagaagagaaatgtcagcaagtccttgagccaccctatgatgaaatgttcgccgctcatctgcggtgcacatacgcagtcgggaaccatgacttcatcgaggcatacaaatgtcaaaccgtaattgtgcaaagctttctccgggcatttcaggcccacaaagaagagaattgggctctgcctgtgatgtatgcagtagccctggacctaagggtgtttgccaacaatgccgatcagcagttagtgaagaaaggcaagagcaaggtgggcgacatgctcgagaaggcagcagagctcctcatgtcatgttttagagtatgtgctagtgacactcgggcaggcatcgaagacagcaaaaagtgggggatgctgttcctggttaatcaattattcaagatttatttcaagatcaataaactacacctatgtaagcccctcatccgagccatagatagttcaaacctgaaagacgactatagtaccgcacagcgagtgacctacaagtattacgtcggcagaaaggcaatgttcgatagcgattttaaacaggcagaggagtacctatccttcgcgttcgagcattgccatcgcagctcccagaagaataagcgtatgatcctaatttatctgctccccgtgaagatgctattgggccatatgcctacagtggagctgctcaagaagtatcatctgatgcagtttgctgaagtcacacgagcggtaagtgaaggcaacttactgcttcttcacgaagccttagctaagcacgaggccttcttcatacgctgcggtatcttcttaattcttgagaaattgaaaatcattacatataggaatctgttcaaaaaggtatacctgctcctgaagacgcatcagttgtcgctggacgcctttcttgtagccctcaagttcatgcaggttgaggacgtggacatcgatgaagttcaatgcatcctcgccaacctgatctatatggggcatgtcaagggctacattagtcatcaacaccaaaaacttgtcgtgagcaagcaaaatccattcccacccctatccacggtgtgttag

SEQ ID NO: 234191 - DNA, 1131 bp, Artificial Sequence
  Description of Artificial Sequence: Synthetic coding sequence
atggcccatatcacgattaaccagtacttacagcaggtgtatgaagccatagatagtcgagacggagcgtcttgtgccgagctcgtaagttttaaacatccccacgtggccaatcctagactacagatggcgtcacctgaggaaaagtgtcaacaggtactggagcccccttatgatgagatgtttgcggcacacctcaggtgtacctacgctgtaggcaaccacgactttatcgaagcctataagtgtcagaccgttattgtgcaatatcccttgagcttcatggctgccgtcgcagatcagcagttggtgaagaaggggaagagtaaggtgggcgatatgctcgaaaaggccgctgaactgctgatgtcctgcttcagggtatgtgcttcagacacaagggctggcattgaggactccaaaaagtgggggatgttgttcctagtcaatcaactcttcaaaatctattttaagattaacaaactccacctttgcaagccgctcatccgcgcaattgactcctctaacctgaaggatgattatagcactgctcagcgggtgacatacaagtactacgtcgggagaaaagcgatgtttgacagcgactttaagcaggccgaagaatacctgtccttcgcgtttgagcactgtcacaggtcttcccagaagaacaagaggatgattctgatctacttgctgcccgtgaagatgttgttaggtcacatgccaaccgtcgagctcctgaaaaaataccatctgatgcaatttgccgaggtgacacgtgcagtgtccgagggcaacctgttgctgctccacgaggcgctcgcaaaacacgaggcatttttcattcgttgtggcatcttcttaatcctggagaagctcaagattatcacatataggaatctgttcaaaaaagtatacttactcctgaagacacaccagttaagcctagacgcctttctggtcgcgctgaagttcatgcaggtcgaagacgttgacattgatgaggtgcaatgcatcctcgccaacctcatatatatgggccatgttaaaggatacatcagccaccagcaccagaagctcgtggtgtcaaaacaaaatccttttcccccactctccacagtctgctag

SEQ ID NO: 234192 - DNA, 1200 bp, Artificial Sequence
  Description of Artificial Sequence: Synthetic coding sequence
atggctcatatcactatcaatcagtatcttcagcaggtgtacgaagccatcgacagcagagatggtgcatcctgcgccgaattggtctccttcaagcaccctcacgtggcaaatccacggctgcaaatggctagccctgaggagaaatgtcaacaggttctcgagccaccttacgatgagatgtttgctgcccacttgcggtgcacttatgcagtgggcaaccatgacttcattgaggcatacaaatgtcagacagttatcgtgcagtcattcttgcgtgcatttcaagcgcataaagaggaaaactgggcattgcctgtcatgtatgccgtcgccctcgacctgcgggtttttgctaataacgccgatcaacaactagttaaaaagggcaagagcaaagtgggggatatgctcgagaaggctgctgaactgttaatgagctgctttagagtctgcgccagtgatacccgagcaggaattgaagattctaagaagtgggggatgctcttcttggtaaaccaactgttcaagatttatttcaagataaataaattacacctgtgtaagcccctgattagagctatcgactcttctaacctcaaagacgactactctacagcccaacgcgtcacctataaatattacgtagggaggaaggctatgttcgacagcgatttcaagcaagccgaggaatatctgtcgttcgcctttgaacactgccatcggtcatctcagaaaaataaacggatgattttgatatacctgcttcctgtgaaaatgctgctgggccacatgcccacagtcgagctgctcaaaaagtaccacttaatgcagttcgccgaagtgactagagcagtgtcggaaggaaaccttctattgctacatgaagcactggctaagcacgaggctttttttattcgatgcggaattttcttgatcctcgaaaaactcaaaataattacatatcggaatctctttaaaaaggtgtacctcctgttaaagacccaccagctctctttggatgcattcctggtagccctgaagttcatgcaggttgaggacgttgacattgacgaggtgcaatgtattctggctaatcttatttatatggggcatgtgaaaggctatattagtcatcagcaccagaaattagtggtatccaagcaaaacccattccccccactgagtaccgtgtgctag

SEQ ID NO: 234193 - DNA, 1200 bp, Artificial Sequence
  Description of Artificial Sequence: Synthetic coding sequence
atggcacatatcactattaaccagtacctgcagcaggtgtacgaagctattgatagcagagacggtgcaagttgtgcagagctcgtgtcctttaagcatcctcacgtggcaaacccccgtctgcagatggcatcccccgaagaaaagtgccaacaggtcctggagcctccctatgacgagatgtttgccgcacacttgagatgcacctatgctgtgggtaatcatgactttatcgaggcttataaatgccaaacggttatcgtgcagtcatttctgagagcttttcaggcgcacaaggaggaaaattgggctttacctgttatgtacgctgtggctctagatctgcgggtgttcgccaataatgctgatcagcagttggtcaaaaagggcaaaagcaaggttggagacatgctggaaaaggccgcagagctgctcatgagttgctttcgtgtgtgtgcatcagataccagagccggaatcgaggacagcaaaaaatgggggatgttattcctggtgaaccaactttttaagatttatttcaaaatcaacaagctgcacctatgcaagccactcattagggccatcgacagctctaacctgaaggacgactacagcaccgctcaaagagttacatataagtactatgtcggcaggaaggcaatgttcgattcagattttaagcaggctgaggagtacctctcattcgcttttgagcactgccacaggagttcacagaaaaacaagcgaatgattttaatatacctgttacctgtgaagatgttattgggccacatgcccacagtggagcttcttaagaagtatcatctgatgcaattcgccgaggttacccgggcagtctctgaaggaaatctgctactgctacatgaagcactcgcgaaacatgaggcgtttttcataagatgcggtatttttcttattttggaaaaattgaaaatcatcacctaccggaacctttttaagaaagtgtacctcctgctgaaaacgcaccagctcagtctggacgcctttttggtggcattgaaatttatgcaagtggaggacgtggatatcgacgaggtccaatgtatcctcgccaatcttatttatatgggccatgttaagggctatatttcacaccagcatcaaaaactcgtagtgagtaaacagaacccgtttccacctctatccactgtttgctag

SEQ ID NO: 234194 - DNA, 1194 bp, Artificial Sequence
  Description of Artificial Sequence: Synthetic coding sequence
atgagattaaccgacgttgtccaacagctggtctatgaggccattgactctcgcgatggggcttcttgcgctgaactcgtctccttcaaacatccccatgtggctaatccaaggttacagatggcctcaccagaggagaagtgccagcaagtcctggagcctccatacgacgaaatgttcgctgctcacctccgttgtacttacgctgtgggtaaccacgacttcattgaggcttacaagtgccaaaccgtcatagtccagtccttcttgcgcgctttccaggcccacaaagaggaaaattgggctctgcccgtgatgtacgcggtggccctcgacttgagagtgtttgcgaacaacgcggatcagcagttggtcaaaaaaggcaagtccaaagttggtgacatgctggagaaggctgcagagttattgatgtcgtgttttagagtctgtgcctctgacacccgggcaggcattgaggactcaaaaaagtggggcatgttgtttctggtgaatcagctgttcaaaatatatttcaagatcaacaaattgcacctgtgtaagcctctcattagagcgatcgattcgtccaacctgaaggacgattactccacggctcagagggtcacatacaagtattacgttggcagaaaagccatgttcgattctgattttaagcaggcggaagaatacttatcattcgcctttgagcactgccaccgcagctcccagaagaataaacgaatgatcctgatttatctactgccggtaaaaatgctcctagggcacatgccaacagtggagcttctcaagaagtaccaccttatgcagttcgccgaagtgacgagagcagtaagtgaagggaatctgcttcttctgcacgaggcccttgccaagcacgaggcattttttatccggtgcgggattttcctgattctggaaaagctgaaaatcatcacctaccgaaacctgtttaaaaaagtttatctcctgctgaagacccaccagctgtcactcgatgcctttctcgtggccttgaaatttatgcaggttgaggacgtggacatcgacgaggtgcagtgtatcttagccaatctcatatacatgggtcacgtgaaagggtatatcagccaccagcaccagaagttagtcgtttccaaacagaacccctttcctccactctccacggtgtgttag

SEQ ID NO: 234195 - DNA, 546 bp, Artificial Sequence
  Description of Artificial Sequence: Synthetic coding sequence
atgcctaagggcggtagaaaaggcggtcacaaggggagagctaggcagtacacctcaccggaagagatagatgctcaattacaagcagagaaacagaaggctcgcgaggaggaagaacagaaggaaggaggtgacggggcagcaggcgatccgaagaaagagaagaagagtttggactccgatgaatccgaggacgaggaagatgattaccagcagaaaagaaagggggtggaagggctcattgacattgagaacccaaacagggtggcccagaccactaaaaaggtcacgcagctcgacctggacgggcctaaggagctgagcagacgcgagagagaggaaatcgaaaaacagaaggcgaaggaaaggtatatgaaaatgcatctggcaggcaagacagagcaggctaaggcagatttggccaggttagcaattatcagaaagcaacgggaagaggccgcacgtaaaaaagaagaagagcgaaaggccaaagacgatgcaaccctgtcaggaaagcggatgcagtcactatccctgaacaaatag

SEQ ID NO: 234196 - DNA, 1026 bp, Artificial Sequence
  Description of Artificial Sequence: Synthetic coding sequence
atggtgtccagccagccgaagtacgatctaattcgagaggtgggtcgcggaagctacggcgtagtttacgaggccgtgattcgaaaaactagcgcacgcgtcgccgttaaaaagattcgctgccatgcgccagaaaacgtagaactggctctgcgagaattttgggcccttagctccatcaaatcccagcatcccaacgtgatccatctcgaggagtgcatactacagaaagatggcatggtgcagaaaatgtctcatggcagtaactcgagcttgtatctccagctggtggagactagcctgaagggtgaaatcgccttcgacccacgatccgcgtactatctgtggtttgtgatggacttctgtgacggaggggacatgaacgagtacttgctgtcaagaaaacccaatagaaagaccaatacaagcttcatgttgcagctatcttccgccttggctttcctgcataagaaccaaatcatacaccgcgatctgaagccggacaatatactgatctctcagacccgcctggatacctctgacttagagccgacccttaaggtggctgacttcggtctgagcaaagtctgctcagcctccggccaaaacccagaggagcctgttagcgtaaataagtgtttcctaagcactgcatgcgggaccgacttctacatggcacccgaagtgtgggagggccactatacagcaaaggcggacattttcgcactaggcatcattatctgggccatgttggaaagaataacatttattgacaccgaaacaaagaaagaactccttggctcctatgtgaaacaaggtactgagattgtcccggtgggtgaggccttgctagaaaaccccaagatggagctccttattccggtgaagaaaaaaagcatgaacggcaggatgaagcaactgattaaagaaatgcttgccgcaaacccacaggaccgacctgacgcatttgagctcgaattacgcctagtccagatcgctttcaaggactcctcctgggaaacatag

SEQ ID NO: 234197 - DNA, 1026 bp, Artificial Sequence
  Description of Artificial Sequence: Synthetic coding sequence
atggtgtccagtcagcccaagtacgatttgatcagagaagtgggcaggggttcgtacggtgtggtctacgaggccgtcattcgcaaaacctccgcacgagtggctgtgaagaagattcggtgtcacgctcctgagaatgtcgagttagccctcagagaattttgggccctttcttctatcaagtcccagcaccccaacgttatccacctggaggagtgcatcctgcagaaggacggaatggtgcaaaagatgagtcacggatccaactcatctctctatctccagctggtagaaaccagcttaaaaggagaaatagctttcgatcctcgctctgcctattatctttggtttgtgatggacttctgcgatggtggtgacatgaatgagtacttactttcacgtaaaccaaaccgcaagacaaatacctccttcatgcttcaattgtcatctgcacttgccttcctacataaaaaccagattattcatcgagatctcaagccagacaatattcttattagccagacccgactggatacgtcggatctagaaccaacattaaaagtcgctgattttggactatctaaagtgtgctctgcttctggtcagaatcctgaggaacctgtcagcgtcaacaaatgtttcctttctaccgcctgtggtacagacttctatatggcaccggaggtctgggagggtcactacaccgccaaagccgacatcttcgcgctgggcattattatttgggcaatgcttgagaggatcacctttattgacaccgagaccaagaaagagttgctgggtagctacgtgaagcaagggactgagatagtgcccgtcggagaggccttgctggaaaacccaaagatggaactcctgatacccgttaagaaaaaaagcatgaacggaagaatgaagcaacttatcaaggagatgcttgcagcaaatcctcaagaccggcctgatgcctttgagctggagctgagacttgtccagatagctttcaaagatagttcatgggaaacatag

SEQ ID NO: 234198 - DNA, 576 bp, Artificial Sequence
  Description of Artificial Sequence: Synthetic coding sequence
atggtctcttcgcagccaaagtacgacctaatccgagaggtaggacgcggttcctacggcgtggtgtacgaagctgtgattcgcaagacatcggctcgagtggccgtgaaaaaaattcggtgtcacgccccagaaaatgtggaactggccttaagggaattttgggccctgagctccatcaagagccaacaccccaatgtgatccatttggaggagtgcatactgcagaaagatggtatggtgcagaagatgtcgcatggctctaattcatccctatatctacagttggttgaaactagcctcaagggcgaaattgcgtttgaccctaggtccgcgtattacttgtggttcgtcatggatttctgcgacggaggagacatgaacgagtacctcctgtctagaaaaccaaatagaaagactaacacaagttttatgctccaactctcctccgctcttgccttcctgcacaagaatcagataattcaccgagacctcaagcctgacaacattttgatttcgcagacacgattggacactagtgatctggaacccaccctcaaagtggcggatttttag

SEQ ID NO: 234199 - DNA, 4014 bp, Artificial Sequence
  Description of Artificial Sequence: Synthetic coding sequence
atggattttaccgctcagcccaaaccagctacagcattgtgtggggtcgtcagcgccgacgggaagatcgcatatcctcccggagtcaaggagatcacagataagatcaccaccgatgagatgattaagagattaaaaatggtagtcaagacgttcatggacatggatcaagactctgaggacgagaaacagcagtacctgcctcttgcgctgcatctcgcaagcgaattcttcttgagaaacccaaataaggacgtccgattgctggttgcttgctgtctcgcggatatattccgtatctacgcccctgaagccccttacaccagtcacgacaaactcaaagacatattcttgttcatcaccaggcagctgaaagggttggaagatactaaaagcccccaattcaaccgatatttctatctcctagagaacctggcatgggtgaagtcctataacatttgcttcgagttggaggactgcaatgaaatcttcattcagctgttccgcactcttttcagtgtcatcaacaattctcataacaagaaggtgcagatgcacatgttggacctgatgagcagtatcatcatggagggcgatggcgtgacacaggagttgctggactcaatactgattaacctgattcctgcccacaaaaacctcaataaacagtctttcgacttggctaaggtgttgttaaaaagaaccgtacagactatcgaggcttgcattgccaattttttcaatcaggtactcgtcttaggccgatcaagtgtgagcgatctgagcgagcacgttttcgacttgatccaggaactgtttgcaattgacccccacctgctcctttccgttatgccacaattggagttcaaactcaaatcgaatgacggagaagagaggctggctgttgtgaggctcctagcaaaacttttcggtagcaaggactcggacctggcaacccagaatagaccactttggcagtgttttctgggaagattcaacgatattcacgtcccagtgcgactagaatcagtgaaattcgcgtcccattgccttatgaatcaccccgatctggccaaggatctaacagagtacctgaaggtgagatcccatgacccggaggaggctatccgacatgacgttatcgttactatcattacagcggctaagcgggacctcgccctggtgaatgaccaactgttaggattcgtccgtgagagaacactggataaacggtggagggtgcgtaaggaagccatgatgggcctcgctcagttgtacaagaagtactgcctgcatggagaagccggtaaggaggctgccgagaaggtgagctggattaaagacaagctgctgcacatttattatcagaatagcatcgatgacaagttgctggtggagaaaatcttcgctcagtacctggtgccccacaacctagaaacagaggagcgaatgaagtgtctgtactatttgtacgctagccttgacccaaacgcggtcaaagccctgaatgagatgtggaaatgccagaacatgcttagatcccacgtgagggagctcctggacctgcataaacaacccacatctgaggcaaactgctcagccatgtttggtaagctgatgacgatcgcaaagaatttgcccgatccgggtaaagctcaagactttgtgaagaagtttaatcaagtgttaggggatgacgagaagcttagatcccagctagaacttcttatcagccctacatgctcttgtaagcaggcagacatctgcgtgcgcgagatcgcaagaaaactggccaaccctaagcagcctaccaatcctttcctggagatggtcaaatttctgttagagcggatcgcccctgtgcatatcgattcagaggcgatctcagctctagttaagctcatgaacaagtccattgaaggcactgcagacgacgaggaggagggcgtcagtcctgacaccgccatcagaagtggcctcgaactgctcaaggtgcttagcttcactcacccgacaagttttcactcagctgaaacatacgagagcctcttacagtgtttgcgaatggaggacgataaagttgcagaagctgccatccagatatttcggaataccggacataaaatcgagaccgacctgccgcaaatccgatccactctcattccaattctacatcaaaaggcaaagagaggcacgcctcatcaggctaaacaagcagtccactgcatccacgcgatttttaccaacaaagaggttcagctcgcccagattttcgaacctctctcacgaagtcttaacgccgacgtacccgaacaactgattacccctctggtttcgttgggacatatctctatgctggcccctgatcagtttgcttctccaatgaaatccgtggtcgccaacttcatagtcaaggatcttttgatgaacgacagaagcacaggggaaaaaaacggcaaactgtggtcaccagacgaggaggtcagcccagaggtgctggccaaagtacaggctatcaagctgcttgtgcggtggcttcttgggatgaagaacaaccagtcaaaaagcgccaattcaacactgagacttctctcggcaatgctggtgtcagagggagacctcactgagcagaagcgaatctcgaaaagcgatatgtctcggctgcgccttgctgccggaagcgcgatcatgaagctggcacaagagccttgctatcatgaaatcattaccccagagcagttccagctgtgcgcgctggtgatcaacgacgaatgctatcaggtgaggcagatctttgctcagaaactgcacaaggctctcgtgaagctgctcttgccactggaatatatggcaattttcgctttgtgcgcaaaagaccccgtcaaagaaaggagggcccacgcgcgtcagtgcctgttgaaaaatatttctatacgaagggagtatattaagcagaaccctatggcaaccgagaagctattgtcacttctccctgagtacgtagtgccctacatgattcacctgctggcgcatgatccagacttcaccaggtctcaggacgtcgaccagcttcgggacattaaggagtgcctatggttcatgctggaggttttgatgaccaagaacgagaacaatagccatgcttttatgaagaaaatggctgaaaacattaaattgaccagagacgctcagtcccccgacgagagcaagacgaatgagaagctgtacacagtgtgcgacgttgctctgtgcgtgattaacagcaagagtgcactctgcaatgccgactccccaaaggatccggttctcccaatgaaattttttacccagccagagaaagacttctgtaacgacaagagctacatctccgaagagacgagggtgctcctcttgacgggcaagcctaagcccgctggagttctgggagctgttaacaagcccctctccgcgacaggcaggaagccgtacgtccggagcacaggaaccgagactggcagcaacatcaatgtcaattccgagctcaacccctctactggaaacaggtccagagagcagagtagtgaggccgctgaaactggggtgagcgaaaatgaggagaacccagtccggatcataagtgtgaccccagtgaaaaatattgatcccgttaaaaataaggagataaacagtgaccaggcaacacaggggaatatctcctctgaccgtgggaaaaaacgcacagttacagccgctggggcagagaatattcagcagaagactgacgaaaaagtggatgagagcgggccacccgctccctccaaaccacgcaggggaagaagacccaaatcggaaagccagggaaatgcgacaaaaaacgatgatctgaacaagcctataaacaaaggtcgtaagagagcagccgtggggcaagagtcacctgggggattggaagctggtaatgccaaagcccctaaacttcaggatctggccaagaaggccgctccagccgagcggcaaattgacctgcagaggtag

SEQ ID NO: 234200 - DNA, 1803 bp, Artificial Sequence
  Description of Artificial Sequence: Synthetic coding sequence
atggactttacagctcaacctaaacccgctaccgctttgtgcggagtcgtgagtgctgacggaaagatagcataccctcctggggtcaaggagattaccgacaaaataactacagacgagatgattaaacggcttaagatggtcgttaagacttttatggacatggaccaagactcagaggatgagaagcagcaatatctgcccctggcgcttcatctggcttcagagttttttctgcgcaacccaaacaaggacgtgcggctgttagtggcctgctgtcttgcagacatttttaggatctacgcccctgaggctccctacacttctcatgacaagctgaaggacatcttcctgttcatcacacggcagctgaaaggcctcgaggatactaaatctccccagttcaacagatatttctatttattggaaaacttagcctgggtgaaaagctataacatctgctttgaactggaggattgcaacgaaatattcattcagctattccggaccctctttagcgttatcaataattcacataataagaaggtacagatgcacatgttggacctgatgtccagtatcataatggagggtgacggggtaacccaggaactgctcgactccattttgattaacttgatcccggctcacaaaaacctaaataaacagagcttcgatctggctaaagtcttgctgaagagaaccgtacaaacaattgaagcctgtatagcaaactttttcaaccaagtgcttgtgctgggaaggagtagtgtgagcgacttaagtgaacacgtcttcgacctgatacaggagctgttcgccattgatcctcacctgcttctttccgtcatgccacagctggagtttaaactcaagagtaatgacggcgaggagcgcctagccgtggtcagactgctggctaagctatttggatccaaggactcagatctagccacacaaaatcgccctctgtggcagtgtttccttggcagattcaatgacattcatgtccccgtgagactcgaaagtgtcaaattcgctagtcactgcttgatgaaccatcctgatctcgctaaagatttgaccgagtatttgaaagttagaagccacgacccagaagaagctattcggcacgatgtgattgtgactattattaccgccgcaaagcgagacctggccctggtgaacgatcagctgctgggctttgtgcgagaacgtactctggacaaacggtggcgtgtgaggaaggaggctatgatgggtttggctcagctctataagaaatactgtctgcatggagaggctggaaaggaggctgcggaaaaggtgtcatggatcaaagataagctcctgcacatatattatcagaatagcattgacgataaactgttggtggagaaaattttcgcgcagtatcttgtccctcataatctcgaaacagaggaaagaatgaagtgtctgtattacctctacgcttcccttgacccgaatgcagtgaaagcactgaatgaaatgtggaagtgtcagaacatgctcagatctcatgttagggagctgctcgacttacataaacagcccacatccgaagctaattgttccgccatgtttgggaagctgatgactatcgccaaaaacctgcctgatccaggaaaggcccaggatttcgttaaaaagtttaatcaagtactcggagacgacgaaaaactccggtcacagctcgaactgctgatcagtccaacttgttcttgtaaacaggcagacatctgcgtagtgtcaaagagttactttactctgttcctgtag

SEQ ID NO: 234201 - DNA, 990 bp, Artificial Sequence
  Description of Artificial Sequence: Synthetic coding sequence
atgacaacacagcagattgatctccagggccctggcccatggggtttcagactggttgggggaaaggactttgagcagccactggctatttctcgcgtcacaccagggtccaaagctgcactcgccaacctctgcattggcgatgtcatcaccgccatagacggggagaatacatccaatatgacccatctggaagcgcaaaacaggattaaagggtgtactgataacctgaccttaacagtggcaaggagtgagcacaaggtgtggtctcctctggtgactgaggaggggaaaaggcatccttacaagatgaatcttgcctctgagcctcaggaagtgctacatatcgggtccgcgcataatagatcggctatgccttttacggccagtcccgcatccagcactacagccagagtaattacgaaccagtacaataatcctgccggactttatagctcagagaatatctcaaacttcaacaatgcactggaatcaaagactgctgcgtccggtgtcgaggccaatagtaggcccctggaccatgctcagcctccttcgtcactcgttatcgataaggagtcagaggtatacaagatgctgcaagagaagcaggaacttaacgagcctccaaagcaaagtaccagctttctggtactgcaggaaattctggaatctgaggagaagggggaccccaacaagccctccgggtttcgaagtgtcaaggcacccgtgacgaaggttgcagcttctatcgggaatgctcagaagctcccaatgtgcgacaagtgcgggacagggattgtgggtgtgtttgtgaagctgagagaccgccacagacacccggagtgctacgtgtgtacagattgcggcaccaatttgaagcaaaaaggccacttttttgtcgaggaccagatctactgtgaaaagcacgcgagagagagagtcacccctcccgagggctatgaggtcgtcaccgtatttccaaaatag

SEQ ID NO: 234202 - DNA, 1101 bp, Artificial Sequence
  Description of Artificial Sequence: Synthetic coding sequence
atggcactcactgtagacgtagccggtcctgcaccctgggggtttaggattacaggcggacgcgactttcatactccaatcatggtgactaaggtggcagagcgagggaaagccaaggacgcagacctgaggccaggcgacattatcgtggcgatcaacggcgagtcagccgagggcatgttgcacgcagaagcccagtctaagattcgccaatcacccagccctctcaggctgcagctcgataggagccaggccacctctcctggccagacaaacggcgactcaagtctggaggtcctggcgacccgctttcagggctctgttcgcacatacacagaaagtcagtctagcctccggagttcctactcctcacctacttccttgtcacccagggctggatctccattcagcccacccccaagcagttctagcctcacaggtgaagccgcaatctctcgatcttttcagagcttggcttgttcccctgggctgcctgcagcagatcggctctcttattctggtcgcccaggcagcaggcaggctggtctgggccgtgccggagattcagctgtgttggtgttgcctccctctcccggacctcggtctagccgcccttctatggatagtgaaggcggatcgttgctgttggacgaggactccgaggtgtttaagatgctccaagaaaaccgggagggacgcgcagcacccaggcagtcttcttcgttcagactgctgcaagaagccctggaagcagaagagagaggaggaactcctgcgttcctcccatcttcattatctcctcagtcctccctgccagcgtctcgcgcactcgccacaccgcctaaattacatacgtgtgagaagtgcagcacatccatcgctaatcaggccgtcaggattcaagaaggaaggtatcgtcacccgggatgttacacatgcgctgactgcggattgaatctcaaaatgcggggacacttttgggaggacgcttgcgctatggaaggcatgcggctgtcacttgaggcactggaaggcatggtagagggcgctaaacgccgagataggaggaaaacaagacgaccgatccagccttcatggtag

SEQ ID NO: 234203 - DNA, 1809 bp, Artificial Sequence
  Description of Artificial Sequence: Synthetic coding sequence
atgcgaggcggtcgggctcgccctgcttgggagagctttatgggcctgccccctcgctcatccgccaagtggggggctggccaatcgctagatcgcctatgttgtgcaccagggtcccgaggcttagcgggtgctccagggagaatgcgcgcaccacccgctggacgctcacagccggctgggggaccgggagattccttgcctcatccaccgggtgggctcgggccagggggaagtgcttgggccagacgggcagaagccgctgcgtccagggctagaggagggggtcggggtgggccaggtattacttgggcagaagcgggacctggcgcacccggaggtctgtcgccagagtccgggaggcgccaaagagaaaggtggcgcctgccagcttttcccccatctcgagcctgggctccaagcaggacgggagagcgccaaccgggtgagcgcgcacacctgagactgtctgcaagaccggctctgcccggagccggactgctcagcgccccattgtctgctcgtaatcccggactggtacggggacccgctccctggtccttggccagtgctggcgctccccctagagctgccctgtcccccgctggagcacttcttctccagcccccagcccgtcgtgtcttgtgccccaggagtgaaggagggtcgagaacaggccgagccggtccatcagggtgggctccgccacgaggagctcgctccgccgagtccactgatagactgaagggaatggccttaacagtggacgtggcagggccagctccttgggggttcaggattacaggcggacgcgactttcacaccccaatcatggtgaccaaggtggctgagcggggaaaagcaaaggatgctgacctgaggccaggagacatcatagtggcgataaatggtgagagcgccgaaggcatgctacatgcagaagcccagagtaagattcggcagtccccctcacctctgcggttgcagctggacagatcacaagccacttctcccggacagactaatggggattcgagcctagaagtacttgctaccaggttccaaggaagcgtccgaacttacaccgagtcccagagcagcttgcggagcagttacagctcccccacctccctgtctcctcgcgctggttcaccttttagtcctccacccagctccagttctttgaccggcgaggcggctattagtcggagctttcagtccctagcctgcagtccgggactgcccgcagccgaccggctctcttactctgggcgaccgggttccagacaagccggactcgggagagctggtgacagtgctgtgctcgtgctgccaccctctcccggacccaggtcctcccggccaagcatggactcagagggaggttctctcctgttggatgaggatagtgaagtctttaaaatgctgcaggagaaccgcgaaggcagggccgcacctcggcagagttcatctttcagattgctccaagaggcgctggaggccgaggagagggggggaaccccggcatttttgccttccagcctgtccccacagtcttccctgcctgctagcagagctctggccactccaccaaagctgcacacctgtgaaaaatgttctacttcaatcgccaatcaggcagttcggatccaggagggtaggtaccgacaccctggctgttatacatgtgctgactgcggcttgaacttgaaaatgagagggcatttctgggtgggggatgagctttactgcgaaaagcacgcaagacaacgctattctgcacccgctacactcagcagccgggcttag

SEQ ID NO: 234204 - DNA, 837 bp, Artificial Sequence
  Description of Artificial Sequence: Synthetic coding sequence
atggcactcactgtggatgtagctgggccagccccatggggcttccgtattaccggtggcagggatttccacaccccgatcatggtgaccaaagttgcagagagggggaaggcaaaagatgctgatttaagacccggagacatcatcgtggctattaacggtgaaagtgctgaagggatgcttcacgcagaagcgcaatcaaagattaggcaaagccctagcccactgcgcctccagctcgatagatcccaggcgaccagtccgggacagacaaacggtgacagcagcctcgaagtcttagccacaaggttccaaggcagcgtcagaacctacaccgaaagccagagctccctgcgttcaagttattccagccctacatctctgtcccccagagccggaagccccttctccccccctccttcaagtagctccttaacaggagaggccgctatttcgcggtccttccaaagtctcgcctgttcgcctggtctgcccgctgcggaccggctcagctacagcggccgacctggctcaagacaagccggacttggtcgagcaggggactccgctgtgctggtgttacccccaagtcccggacccagatctagtcgcccatccatggactctgaaggaggcagccttctgctggatgaggattcggaggtcttcaagatgctacaggagaatcgggagggtagggctgccccacggcagtcctcatcatttaggcttttacaggaagcattagaggcggaagagagagggaccagactttgtgcttccagacgagccggaacagctacccccgctgccacaccggttcccacagtggggtag

SEQ ID NO: 234205 - DNA, 675 bp, Artificial Sequence
  Description of Artificial Sequence: Synthetic coding sequence
atggcgctgacagtagacgtggctgggccagccccatggggatttagaataacagggggtagagactttcatacccctatcatggtgactaaggtcgctgagcgcggaaaggcaaaggatgctgatctgcgccctggcgacattatcgtagccattaacggggagagtgccgagggcatgctacatgcagaggcacagtccaagattcggcagtctcctagccctctgcgtctccagctcgaccggagccaggccaccagccctggacagaccaatggagactcctcactcgaagtcttagctacgagattccaaggatcggtccggacctatacagagtctcagagttcgttgcggagctcgtactctagccctactagcctgtcccccagagccggtagtccctttagcccaccaccctcctcatctagtcttaccggggaggccgctatttctaggtcgcgcccacgcccacgttggcgattgggcggagccggagccgctgccttccctggaccatcgtttcttcaagctcagcacgggcttggtagaggaaagcctccccctggacgaggtcttggtagcctccaagatgctgccggaaagtctcggggaactggtgggccacccaccgtgcagctgttaagcgccctggccggatcgcccggaggctag

SEQ ID NO: 234206 - DNA, 1059 bp, Artificial Sequence
  Description of Artificial Sequence: Synthetic coding sequence
atggctctcactgtagacgtagctgggcctgcaccatgggggtttcgaatcactgggggtcgcgattttcatactccaataatggtgaccaaagtggctgagagagggaaggccaaggatgcggacctgcggccaggagatatcatcgtggccatcaacggtgaatccgccgaaggcatgctccacgctgaggctcagtccaagattcgtcaatcacccagcccattaaggctccagctagatagatcgcaggctactagccccggacagactaatggagactcaagcttagaagtccttgcaacacgctttcaggggagcgtccgaacatacaccgaatcccagtcttcactgagatcctcttactccagccctacgagtctttcaccccgagccggttcccccttttcacctcctccatcttcctcttcccttactggtgaggcagctatcagtcgatcattccagtcgcttgcatgctcaccaggactccctgccgcagacagactgtcatactctggacggccaggatcaagacaggctgggctgggccgagcaggcgactccgccgtgttagtactcccccctagcccaggcccacgttcatctaggcccagcatggatagcgaagggggatctctgctgctagacgaagactcagaggtctttaaaatgctccaagaaaatcgagagggcagagcagccccacgacagagttcctcctttcgcctgctgcaggaagctctggaggcggaggaacgcggtggaacacccgcttttctcccctccagtctcagcccccagtccagccttccagcttctcgcgctctggccactccgccaaagctgcatacttgtgaaaagtgttctacgtcaattgcaaatcaggccgtaaggattcaggaggggaggtataggcatcccggatgctacacatgcgccgactgtggcctcaatctgaagatgaggggacacttctgggtgggagacgagctttactgtgagaagcacgctcgtcagcgatactccgcccctgcaaccctctcttcgagagcttag

SEQ ID NO: 234207 - DNA, 1059 bp, Artificial Sequence
  Description of Artificial Sequence: Synthetic coding sequence
atggccctgacagtcgatgtcgcgggaccagcaccgtggggcttccggattactggtggtagggactttcacacacccataatggtgactaaagtggccgagcggggaaaggctaaggacgctgatctgaggcccggagatatcatcgtggcaatcaacggggaaagcgctgagggaatgcttcatgccgaagcgcagtccaagatcagacaatcgccctcacccctcagactgcagctagatcgcagccaggcgaccagcccaggtcagacaaatggagacagttctctcgaagtgctggccactcggtttcaagggtcagtccgaacctacacagaaagccagtcctcattgcggagtagctactcttcccctacatccctttcacccagggcgggtagtccgttctctccccctcctagcagcagcagcttgactggtgaggctgccatctctaggagcttccagtcactggcttgttcacccggtctgcccgctgcagaccgcttgtcctattctggcaggccaggatcccgccaggccggtctgggtcgggctggcgacagcgctgtcttggtgttacctccatctcctggtccaaggagcagccggccatcaatggactcagaaggcggttcattacttctggacgaagatagcgaggtgttcaaaatgttgcaggagaacagagaaggcagggcagccccacggcagtcatcctccttcagattactccaggaagcgttggaggccgaggagcgcggtggtacgcccgcatttctcccaagctccctgagccctcaaagctccctccctgccagtagagcactggctacccctcccaagctgcacacctgcgaaaaatgtagtactagtatagccaaccaggccgtccggattcaggagggaagatatcgacatcccggatgctatacttgtgccgactgcgggctgaacctcaagatgaggggccacttttgggtaggcgatgagttgtactgtgagaaacatgccagacaacgatacagcgcacccgcaactctttccagccgcgcttag

SEQ ID NO: 234208 - DNA, 837 bp, Artificial Sequence
  Description of Artificial Sequence: Synthetic coding sequence
atggccctcaccgtggatgtagcaggacctgccccatggggatttagaataacaggcggacgggactttcatacaccaatcatggtgaccaaggtggcagaacggggtaaagcaaaagatgcagacctcagacctggagacatcatcgtggctatcaacggtgaatccgccgagggtatgttgcatgcagaggcccagtccaagattcgacagtcaccttcgcccctccgactgcagcttgatcgctcacaagccacctcgcccggtcagacaaacggagactcttcccttgaggtgctggccaccaggttccaggggtctgtaaggacctataccgagtcacagtcttcactgaggtcctcatattctagccccacttctttatcccctagagctggctcccccttctctccaccaccatcttcctcatcgctgactggggaggccgcaattagcaggtccttccaatctcttgcttgctctcctggcctgcctgctgcggaccgcctgtcctattctgggagacctggttctaggcaggccggtttgggtcgggctggcgacagcgctgtcctagttctgccaccttccccaggacctcgttcatcaaggccaagcatggatagcgagggaggaagcctgcttttggatgaagattccgaagtgttcaaaatgctccaggagaaccgagaaggccgagctgccccacgacagtctagtagcttcaggcttctacaggaggcactggaggccgaagagagaggcacccgcctttgcgctagtaggcgcgcagggactgccacacccgcagccacccccgtgccgacagtggggtag

SEQ ID NO: 234209 - DNA, 1059 bp, Artificial Sequence
  Description of Artificial Sequence: Synthetic coding sequence
atggctctgacggtcgacgtcgctggcccagctccttggggcttccgaattaccggcggtagggactttcacaccccaatcatggtgaccaaggtggccgagagagggaaggccaaggacgccgatctgcgcccaggggacatcattgtggctattaacggcgagtcagcagaaggcatgcttcatgcagaagctcagtccaagatccgccagtcaccatcaccacttcgcctgcagctggaccgatcccaggccactagtccagggcaaactaacggggatagctctctagaggttttggccacccgtttccagggtagtgtacgaacttacacagaaagtcagtcgtccctccgatcctcctatagctctccaacgtctctgagtcctcgcgctggatccccgttcagcccaccacccagcagttcttcacttacaggcgaagccgctatttcaaggtcctttcagagcttggcatgttcacccggactccccgctgcagatcggctctcctacagcggcagacctggaagccgacaggcaggccttgggagagctggagacagtgctgtgcttgtgctacccccatcccctggacctcgttccagcaggccatccatggattctgagggcggtagcctgcttctcgacgaggactccgaggtgttcaagatgctgcaagagaatagggaaggaagagccgcacccagacagtcctcctctttcagactgctccaggaggcgctggaggcagaggaaaggggaggcacaccagcttttctgccatcttcactgtctccccagtccagcctccccgcatcacgggctttggcgactccacctaagctccatacttgtgaaaaatgtagtacatcaatcgcaaaccaagcagttcggattcaagaggggaggtacaggcaccctggatgttatacctgcgcggactgtgggctgaatctgaaaatgagggggcacttctgggtgggtgatgagctgtactgcgagaaacacgcacgacagaggtactctgccccagctactctgagctcaagggcctag

SEQ ID NO: 234210 - DNA, 1560 bp, Artificial Sequence
  Description of Artificial Sequence: Synthetic coding sequence
atgacttccaccttcaaccctagagagtgcaagcttagcaaacaagaggggcagaactacggcttctttttaagaatcgagaaggatacggagggacacctggtccgggtggtcgagaaatgtagccctgccgagaaggcagggctgcaggacggggatcgcgtgctcagaattaacggcgtcttcgtggataaggaggagcacatgcaggtcgttgacctcgtcagaaagtctggaaattctgtcactttgctcgtcttggacggcgactcctacgagaaggccgtgaaaacacgcgtcgacctgaaagaactcggccaatctcaaaaagagcaggggctgagtgataatattctgagtcccgtgatgaacggcggagtgcagacttggacccagcccaggctgtgttacctcgtgaaggaggggggatcatacggctttagcttgaaaactgttcagggcaagaaaggagtttacatgactgatatcacccctcagggtgttgcaatgcgggctggggtgttggccgacgaccacctcattgaggtaaacggggagaatgtggaagatgcctctcacgaagaagtggtcgagaaggttaaaaaatccgggtcacgggtgatgttcctgctggtagacaaggaaaccgataaacgccatgttgagcagaagattcagtttaagcgggaaaccgcctcactcaagttactaccacaccagccacgcatcgttgagatgaaaaaggggtcgaatggatacggattctacctccgggctggctcagagcagaagggtcaaatcatcaaagacattgattcaggatcaccagcagaggaggcaggtctgaagaacaacgacttggtagtcgccgttaatggcgagtcagtcgagacactggaccatgattcagtagtcgaaatgatcagaaaaggaggagatcaaacttctcttctcgttgtggacaaagaaacagacaatatgtaccgactggcccactttagcccttttctgtattatcaaagccaggaactccctaacggcagcgtgaaggaggctcccgcaccaacccctacttcgctagaagtgtcatcaccccctgacacaaccgaagaggttgaccacaagccaaagctctgcagactcgctaaaggcgagaatggatatggctttcatctgaacgctattaggggcttgccaggaagttttattaaagaagtccagaaggggggtcctgccgacctggctggattggaggatgaggacgtcattatagaagtcaatggagttaacgttctcgacgagccctacgaaaaggtcgtcgacagaatccagagtagcgggaagaatgtgacgctgctggtttgcggaaagaaggcttacgactacttccaggccaagaaaatccctatagtgtcctctctggccgatccactggatacgcccccagattctaaagaggggatcgtggtcgagtcaaatcacgattcacacatggctaaggaaagggctcactctactgcaagtcactctagcagcaactctgaggacacagagatgtag

SEQ ID NO: 234211 - DNA, 1560 bp, Artificial Sequence
  Description of Artificial Sequence: Synthetic coding sequence
atgacttcaactttcaaccctagagaatgtaagctgtccaagcaggaaggtcaaaactacgggttctttctccgcatcgagaaagataccgagggccatcttgtgcgcgtcgtggaaaagtgttcccccgctgaaaaggccggacttcaagatggagaccgtgtgttgaggattaacggggtgttcgtggacaaggaagagcacatgcaggtcgtggatcttgtgcgaaaatccggcaactccgtcacactcctggtcctcgacggagattcctatgagaaggcagtgaaaacgagggtcgatcttaaagagctggggcagtctcagaaggaacagggtctaagtgacaacattctgagccccgtgatgaatggtggggtgcagacgtggactcaaccacggctttgctaccttgtaaaggaaggaggttcttatggctttagcctgaagaccgttcagggtaaaaagggcgtgtatatgacagacattacccctcagggagttgccatgagagccggtgtgctcgctgacgaccatctgatagaagtgaatggggaaaacgtggaggacgcttcccatgaggaagtggttgaaaaagtcaagaaatctgggagtagggtcatgttcctgttggtggacaaggaaaccgacaagagacatgtcgagcagaagattcagttcaaacgggagactgcctccctcaagctactgccgcatcagccacggatcgtggagatgaagaagggtagcaacggatacgggttctacttacgtgcaggcagcgagcagaaaggccagattattaaagatattgactcaggaagccccgctgaggaagctggcctcaagaataacgacctggtggtcgctgttaacggggagtccgtggagacattggaccacgattctgtagtcgagatgatcagaaagggtggtgatcagacctccctgttggtggtcgataaagagactgataatatgtaccgtctcgcccatttcagcccatttctgtactatcagagtcaggagctgccaaatgggagcgtgaaagaagcaccagcacctacaccaactagcctggaagtctcttctcctccagatacgacagaggaggtggatcataagcccaaactgtgtcggctggccaagggcgagaacgggtacggtttccatttgaacgccatcagggggcttcctgggtcatttatcaaagaagtccagaagggcggacccgcagatctggcaggacttgaggatgaagacgtaattattgaggttaacggagtcaacgttctggatgaaccctacgaaaaagtggtagacaggattcaaagctcggggaagaatgtcacacttctagtgtgcggaaagaaggcctacgattactttcaggccaaaaagataccaatcgtgtcatctctggccgacccattagacactccccctgactccaaggagggtatagtcgtagaatctaatcacgacagtcacatggccaaggagcgggctcactcaacagcaagccattcctcaagcaactccgaggatacagagatgtag

SEQ ID NO: 234212 - DNA, 795 bp, Artificial Sequence
  Description of Artificial Sequence: Synthetic coding sequence
atgacctcaacttttaacccaagggagtgtaagctcagcaaacaggagggccagaattatggcttctttctgcggatcgagaaagataccgagggccacctggtgcgtgtcgtcgagaaatgctcaccagctgagaaggccggactccaagacggcgatcgtgttttgcgcattaacggagtttttgttgacaaggaggaacacatgcaggttgtagacttagtgcgcaagtccggaaacagtgtcaccctgctcgttctggatggagactcttatgagaaagctgtcaagactcgtgtggatctgaaggagctgggccagtctcaaaaagaacagggtctctccgataatattctgagtccggtcatgaatggaggggttcaaacgtggacccaaccgcgtttgtgctacctagtaaaggagggaggttcatacggatttagtttaaaaaccgtgcaagggaagaaaggcgtttacatgactgacatcacgccccagggcgttgccatgcgcgctggcgttctcgccgatgaccatctcatcgaagtgaacggggaaaatgtcgaggacgcatctcacgaggaagtcgtggagaaggtgaaaaagtccggatcacgtgtaatgttcttgctcgttgataaagagaccgataagaggcacgttgaacagaaaatccagttcaagcgcgaaaccgcctccctcaaactccttccccatcagcctcggattgtggagatgaagaagggatcaaacggttatggcttttatctcagagccggaagtgagcagaaatag

SEQ ID NO: 234213 - DNA, 1227 bp, Artificial Sequence
  Description of Artificial Sequence: Synthetic coding sequence
atgacatcaaccttcaaccctagagaatgcaaactctcgaaacaggaagggcagaactacggatttttcctgaggattgaaaaggacacggaagggcacctggtgagagtggtagagaaatgctccccagccgagaaggcaggcctacaggacggcgatcgtgtgttgcgcattaacggagtgtttgtcgacaaagaggaacatatgcaggtggttgacttagttaggaagtccggcaattcagtgaccctcctggtcttggatggcgactcatacgagaaagcagtcaagaccagggtagacctgaaagagcttggacaaagccaaaaagaacagggactgtctgacaacattctgtcccccgtgatgaatggcggagtgcaaacttggactcaaccaagactttgctacctggttaaagagggagggtcttatggtttcagcctaaagacagtgcaggggcagattatcaaggacatcgacagtggttctcctgccgaggaggctggactcaagaataacgacctggttgttgctgtgaacggcgaaagtgtagaaacactggatcacgacagcgtggttgagatgattaggaaggggggagatcaaaccagtttgctcgtcgtggacaaagaaactgacaacatgtatagactcgctcatttcagtccctttttgtattatcagtctcaggaactccccaacggttcagttaaggaagcccctgctccaacccctacatctttagaggtcagctctcctcctgataccacagaagaggtcgaccataagcccaagctatgtcgcctggctaagggcgaaaacggttacggtttccacctgaacgccataagagggctgcctggtagtttcattaaggaggttcaaaaggggggacccgctgatttagccggattggaggatgaggacgtaataatcgaagtaaatggcgtcaatgtattggacgagccctatgagaaagtcgttgataggatccagtcaagcggaaagaacgtgaccctgctagtgtgcgggaaaaaggcctatgattatttccaggctaagaagatcccgatagtgtcatcactggccgaccccctcgatacgcctcctgatagcaaggaaggcatcgtggtggaaagcaaccatgattctcatatggctaaggagcgagctcactcaactgcttcgcatagttcctcaaactccgaggatacagagatgtag

SEQ ID NO: 234214 - DNA, 423 bp, Artificial Sequence
  Description of Artificial Sequence: Synthetic coding sequence
atggacagcagaattccttacgacgactatccagtggtgttcctcccagcctacgaaaatcctccagcatggatcccccctcatgaaagagtgcaccaccctgattataacaatgaattaacccagttccttccacgcacaattacattgaagaagcctcctggcgctcagctcggcttcaacattcggggtggaaaagcaagccagttaggcatcttcatcagcaaggttattccagacagcgacgcacatagggccggactgcaggagggcgatcaagtcttggccgttaatgatgtggacttccaggatattgagcactctaaggccgtggagattttgaagaccgccagagaaattagcatgcgggtgcggttttttccctataattatcaccgtcagaaggaaagaaccgtacactag

SEQ ID NO: 234215 - DNA, 423 bp, Artificial Sequence
  Description of Artificial Sequence: Synthetic coding sequence
atggatagcagaattccatacgacgactaccctgtcgttttccttcctgcatacgagaacccccctgcttggatacctcctcacgaacgagtccaccaccccgactataacaatgagttgacacagtttctccccagaaccattacactgaagaaaccacccggagcccaactgggctttaatattaggggcggaaaggcctcacaattgggcatcttcatatctaaggtgataccggactccgatgctcatcgggctggactgcaggaaggcgaccaggttctggcggtaaatgacgttgattttcaagatattgaacactccaaggctgttgagatactcaagacagcacgcgaaatctcaatgagagtccgatttttcccctataactatcataggcagaaggaacgcacggtgcattag

SEQ ID NO: 234216 - DNA, 8520 bp, Artificial Sequence
  Description of Artificial Sequence: Synthetic coding sequence
atgcctattacacaggacaatgctgttctgcaccttccacttctgtaccagtggctgcaaaatagcctgcaggaggggggagacggcccagagcagagactgtgtcaggcggctatccagaaactgcaggagtatatccagttaaatttcgccgttgacgagagcacagtgcctccagaccacagcccccctgagatggagatttgtaccgtctatctgacaaaggaacttggagatacggagaccgtggggctgtctttcgggaatatccccgtcttcggggattacggagaaaaaaggagagggggaaaaaagaggaaaacgcaccagggaccagtgctggacgtcggctgcatttgggtcacggagctgaggaagaattctccggctggtaagtcagggaaggttcgtctgagggacgaaatcctgtctttgaacggccaactgatggtgggggtggacgtgagtggggcaagttatctcgccgagcagtgctggaacggtggttttatttatcttataatgctgaggcggttcaagcacaaggcccacagtacttacaatggcaacagctccaacagctccgaacctggcgagactcctacactggagttaggagatagaactgctaagaagggtaaaagaacgaggaagtttggggtcatcagccgccctccagcaaacaaagcgccagaggagtccaagggcagcgctgggtgtgaggtgagctctgacccgtcaacggaactcgaaaatgggccagacccagagctgggtaatgggcacgtatttcagttggaaaacggaccagactcccttaaagaggttgccggtcctcatctggaaagatcggaggtggatcggggaactgaacaccggatccccaagaccgacgcaccactaactacttccaacgacaagcggaggtttagtaaaggcggaaaaaccgactttcagtccagtgattgtctggccagagaggaagtcggaaggatctggaagatggaactattgaaggaaagcgatgggttgggtatccaagtgagtggaggtaggggttcgaaaaggtctccacacgcaatcgttgtcacgcaggtgaaagaagggggtgccgctcatagagatggacgtctgtcactgggtgacgaactattagtcattaatggccatctgttagtaggactttctcacgaagaagccgtcgctattctgagaagtgcaactggcatggtccagctcgtcgtcgcatccaaagagaacagtgctgaagatctcttacgacttacctccaaatcactacccgacctcaccagtagcgttgaagacgtaagctcctggacggacaatgaggatcaggaggcggatggagaggaggatgagggtacctcctccagtgtgcagcgggcaatgcccggaacggatgaaccccaggatgtgtgcggcgcagaggagtccaagggaaacctggaaagccccaagcagggatcgaacaagataaaacttaaatcacgtctcagcggaggcgtccatagacttgagtctgtcgaagagtacaacgaactgatggtcaggaatggcgaccctcgaattcgtatgttagaagtatctagggatgggagaaaacattccctgccccagttgctggactctagctcagccagccaggagtaccacattgtcaagaaatctactaggtcgctatccaccacacaagttgaatctccatggcggcttatcagaccctcggtgattagcatcattggactctacaaagagaaaggaaaaggactgggattttctatcgctgggggaagagactgtatccgaggtcagatggggattttcgtgaaaaccatcttcccgaacgggagtgcagcagaggacggcagactaaaagagggcgacgagatactggatgtgaatgggataccaatcaaggggctgacgttccaggaagcaatccacaccttcaagcaaattcggtctggcttattcgttttgacagtgaggacaaaactagtgagcccctcccttacaccatgctcgacccccactcatatgtccaggagcgcctcacccaattttaacacaagcggtggggctagcgcgggagggagcgacgaagggtcgagtagctcactcggcagaaaaacacctggacctaaggataggatcgtcatggaggtgacgctgaacaaggagccacgcgtcggacttggaatcggggcttgctgccttgcactggaaaactcacccccagggatctacatacattccctcgcaccaggatccgttgcaaagatggagagcaacctgtctcgaggtgaccaaatcctagaggtgaactccgtgaacgtgcgccacgctgccctctctaaagtgcacgccattctgagtaagtgtccgccaggaccagtcaggctggttattgggaggcacccaaaccccaaggtctccgaacaggaaatggatgaagtaatcgctcgatcaacttaccaagagtcaaaggaagccaacagcagcccagggttaggcacccctctgaagagcccaagcctcgcgaaaaaggatagcctgatcagtgagtcggaactgtcacagtactttgctcacgatgttccaggaccactttccgattttatggtcgccggttccgaagacgaagatcaccccggaagcggatgtagtacaagtgaggaagggtcgctccctccctcgacctctactcacaaagagccagggaaacctcgcgctaactcgctggttactttggggtcccacagagcctcgggcctcttccacaagcaggtcactgtagctcggcaggctagcttacccggttcacctcaagccctcagaaatccattgctgaggcagcggaaggtgggctgctacgatgccaatgatgcatccgacgaagaagaatttgatagagagggagattgcatcagcctgcccggagccttgcctggtcctatcaggcccctgagcgaagatgaccctcgacgagtgtctatctccagttctaagggaatggacgtccacaaccaagaggagaggccacgcaagaccctggtgagcaaagcgataagtgccccactcctcggctcctctgttgatctggaagagtctatacccgaaggcatggttgacgccgcaagttacgctgcaaacctgaccgacagtgctgaagctccaaagggtagtcctgggtcatggtggaagaaagagctcagcgggtcgtccagcgcaccaaagctggagtataccgtaaggaccgacacacagagccctaccaacaccggctcaccctcatccccacagcagaaaagcgagggactgggatcccggcatcgtccggtcgctcgggtgagtcctcactgcaaacggtccgaagcggaggctaagccatctggaagtcagaccgtaaacctcactggcagggctaatgatccctgtgacttagattccagagtgcaggccacttccgttaaagtgacagtggccggatttcagcccggaggggctgtggagaaagaatctctgggcaaattaactaccggggacgcctgcgtgagcaccagttgtgaactggcttcagccctttcacacctagatgcctcacatctgacggaaaatcttcctaaagctgccagcgaactcggccagcaacctatgactgaactcgacagctctagtgatcttatcagctctccgggtaaaaagggggctgcccatccggatcctagcaagaccagcgtcgacacaggccaagtatcgcgtccggagaatccatcccaaccggcatcgcccagagtcacgaagtgcaaggcaaggagtcccgtaaggctaccccacgagggtagcccgagcccgggagaaaaggccgctgcccctccagattacagtaaaacaaggtctgcttcagagacaagcacacctcacaacacaaggcgcgttgcggctcttagaggtgcagggccaggcgctgaagggatgacccccgcaggcgctgtccttcccggtgatcccctgacaagtcaggagcagcgccagggagcccctggcaaccacagtaaagcgctcgaaatgacaggaatccacgcacccgagagctcgcaggagccaagcctcctggagggcgctgactctgtgtcatccagagcccctcaagctagtttgagcatgctgcctagcactgacaacaccaaagaagcttgtggtcatgtctctggtcactgctgtcctggtggctcaagggaaagccctgttactgatattgactcctttattaaagagttggacgcttcagctgcccgatctccgtccagccagaccggagactccggttcacaggaaggctccgctcaaggacacccacctgctggggctggaggcggatcgtcatgtagggccgagccagtcccagggggacagacgtcaagccccaggagggcgtgggccgcaggcgctcccgcttatcctcagtgggcctctcagccatccgtgctggacagtataaatcctgataagcattttacagtcaataagaatttcctcagcaattactcgagaaactttagcagtttccatgaggatagcacatctctctccgggttgggggactccacagagccttctctttcaagcatgtatggagacgcagaagatagctcatctgatcctgagtccctcacagaggcgccaagagcatcagccagagacggctggtctcctcccagaagccgcgtgtcgttacataaggaggatccatcagaaagtgaggaagagcagattgagatttgttccacccggggatgccccaatcctccaagctctccagcgcacctgccaacccaagccgctatctgtcccgcaagcgcaaaagtgctctcactgaaatactccactcctagagagagcgtagcctcgccccgagagaaggcagcatgtcttcccggtagttacaccagcggacctgattccagccagccttcatccctcctagagatgagctctcaggagcatgaaacacatgccgatatatctacatcccagaatcatcgtccctcatgcgccgaggaaaccacggaggtgacctccgccagcagcgcaatggagaattctccactctcaaaggtggctcgtcacttccactcacccccaatcatccttagtagtcctaacatggtaaatgggctggaacatgatcttcttgatgatgagacccttaaccagtacgagacatccattaacgctgcagcctctctgtcttctttctccgtggacgtgccaaagaacggcgaatcagttttagaaaatctgcacatttcagagtcccaagacctggatgatcttcttcagaaaccaaagatgatagcccgtagaccaattatggcctggtttaaagaaatcaacaaacacaaccagggcacacatctgcgttcaaaaactgaaaaggagcagccccttatgccggctcgcagccctgacagtaagatacaaatggtttcatctagccagaagaagggcgtgacggtgccacattcccctcctcaacctaaaacaaaccttgaaaataaggatctgagcaagaagtcaccggctgagatgctcctaaccaatggacagaaagccaagtgtggccctaagttgaagcgcctgagcctcaagggaaaagcaaaggtgaacagcgaggcccctgcggctaacgcagtgaaagcaggcggaactgatcacaggaaaccacttattagcccacagacgagtcataaaacactcagtaaagctgtaagtcagaggttgcacgtggcagatcacgaagatcctgacaggaatactaccgcggctccccgatccccacagtgcgttctggagtccaagccacctctcgctacatccggacccctcaaacctagcgtgagtgatacctccatccgcacctttgtgagccccttaacaagcccaaagcccgtccctgagcaggggatgtggtccagattccatatggctgtgctgagcgaacctgatcgaggatgtcctacaacaccaaagagcccaaagtgtcgagctgagggcagggctcccagagccgattcaggtcctgtgtctcctgcagcttctcgcaatggcatgagtgttgccggtaaccgccaaagcgagccacgtctggcgagtcacgtagctgcagataccgctcagcccagacccacgggagagaagggagggaacattatggcatcggacagactcgagcggactaaccagctgaagatagtggagatcagtgcagaggccgtcagcgagactgtgtgcgggaacaaacccgcagagagcgaccgtcggggaggctgtctagcgcagggcaactgtcaagagaagtccgaaattaggctgtatagacaggtcgcggaatcttccactagtcacccttccagtctgccctctcacgccagtcaagccgagcaagagatgtctcggtctttttcgatggccaagctggcatcctcaagttctagcttacagaccgctatccggaaagccgaatactctcaggggaagtcttccctcatgtcagacagccggggtgtccctcggaatagcatcccgggaggaccaagtggagaagaccacttgtacttcactccacggcctgctacccgcacatatagtatgcctgctcagttctcttctcactttggacgagagggtcatccgcctcactctctcggcaggtcccgggatagtcaggtgccagttacttcaagtgtcgtgcctgaggcaaaggcatctcgtggagggcttcctagcttagccaacggacaaggcatttatagcgtgaaacctttgctcgatactagcaggaacctaccagcaaccgatgaaggtgacatcatttcagtacaggagaccagctgccttgtgaccgataaaattaaggtgacaaggaggcattattgctacgaacagaactggcctcacgagtctacaagctttttttccgtgaagcaacgcatcaagtctttcgaaaatttagccaatgccgaccggcctgtggccaaatctggagctagtccttttttatctgtgagcagcaaacctcctatcggccgtaggtcaagtggcagcatcgtttctggaagtttaggacatcccggagatgctgcagctaggctgctccgcaggtccctgtccagttgttcagaaaaccaaagcgaggcagggacgttgttgcctcagatggccaagagcccctccattatgaccctgactatcagccggcaaaatcctccagagacgtcttctaaaggttccgactcagagttgaaaaaaagcctgggtcctctaggcatccctacaccaaccatgactctagcctcacccgtgaaaagaaataagtcctctgtgcgacacacacagcctagcccagtgtctcgctcgaaactacaggaactgagagcgctcagtatgccagatctagacaagctctgtagcgaggattacagcgccggaccaagcgccgtgttatttaagacggagctcgaaatcacacctcgtcgcagtccaggtccacctgcgggaggtgtatcttgccctgaaaaggggggaaaccgggcttgtcccggtggttctgggccaaagacctctgcagccgagaccccttcatcagcgtctgatactggagaagcagcccaggacctgccctttcgcagaagctggtcggtgaacctcgaccagctgctcgtgagcgcgggagaccaacaaagattgcagagcgtgctgtcttcagtggggtccaagtcaactatactgacccttatccaggaagccaaagcccagtcagaaaatgaggaggacgtgtgctttattgtgttaaaccggaaagaggggtcaggcctgggcttttctgttgctggcggaacggatgtcgaacccaagagtattaccgtccaccgcgtgttttcccagggtgccgcaagtcaggaaggaacaatgaacagaggcgacttcttactctcagtgaatggggcttcgttggccggactggcccatggtaatgtactgaaggttcttcaccaagcacagctgcacaaggacgccctggtggtcatcaagaagggaatggatcagcctcgcccatctgctcggcaagaacctccaacagcaaacgggaagggactgctcagtagaaaaactattccccttgagccgggaatcgggaggtccgtggcagttcacgacgcgctctgtgtcgaggtgttgaaaacgtcggccggtctcggcctcagcctcgacggcggaaaatcttcggttacaggagatggccctcttgtgattaagagggtctacaagggtggggcagctgaacaggccggtattatcgaggctggggacgagattctggccatcaacggaaagcccctggttggtctgatgcactttgatgcgtggaacatcatgaagtccgtgccagagggaccagttcagttgcttatccgaaaacatcgcaacagcagctac

SEQ ID NO: 234217 - DNA, 7922 bp, Artificial Sequence
  Description of Artificial Sequence: Synthetic coding sequence
atgcctattacacaggataatgcggtgctgcacttgcctctgctataccagtggctccagaattctctgcaggaaggaggggacggacccgagcagaggctgtgtcaggccgcaatacagaagctgcaggaatacatccagctgaacttcgcagtggacgagagtaccgttccacctgatcattctccacccgaaatggaaatttgtaccgtgtatctgacaaaggagctgggagacaccgaaacagtgggcttgagttttggaaacattccagtgtttggggattacggagagaaaagacggggaggcaagaagagaaagacccatcagggcccagtgcttgatgtgggatgtatctgggtgaccgaattacggaagaactcccctgccggtaagagcgggaaagtgcgactgagagatgagattctttccctgaacgggcagttgatggtaggagtggatgtatctggcgcttcttacctggccgaacagtgttggaatgggggatttatttacttgatcatgctcagaaggttcaaacataaggctcactccacatacaacggaaatagttctaactcaagcgagcccggtgagacaccgactctcgaactgggcgatcggactgctaaaaaaggtaaacggactaggaagtttggggtgatttctcgcccacctgctaataaagcgccagaagagtcgaagggctccgcaggatgtgaagtgagttccgatccttccaccgaactggagaacggcccagacccggaattaggcaatggccatgtcttccagctggagaacggcccagattcccttaaggaggtcgctggaccccacctggagcgttccgaggtggaccggggtacagagcatcggattccgaaaactgacgctcctctcacaacatcaaatgacaagagaagattttccaaaggtggcaaaaccgactttcagagctctgattgtcttgcacgggaggaagtgggcaggatctggaaaatggaactattaaaagaatccgatgggcttggtattcaggtttctggcggacgcggttcgaagcgatcaccgcatgccatagtagtaacgcaggttaaggagggtggagccgctcatagggagtatcacattgtgaagaagagcacaaggtctctctctaccactcaagtggagtccccgtggcgtttgatacgcccatcggtgatcagcattattgggctctataaggagaagggtaagggcctgggttttagcatagctggcggaagggattgcattagagggcagatggggatttttgtgaagaccatcttcccaaatggctctgcagccgaagacggaagattgaaagagggtgatgagatcttggatgtcaatggcattcctatcaaagggttaacttttcaagaagcgatccacacattcaagcagataaggtcaggcctatttgttctaacagtccgaacaaaacttgtaagcccaagcctcactccttgttcaacacctactcatatgagtagatctgcatctcccaattttaatacctccgggggagccagcgctggtggttcggatgagggctccagcagctcccttggacggaaaacaccaggacccaaggaccggatcgtcatggaggtgacactgaataaggagcccagggtagggctggggataggggcatgctgtttggctctcgaaaattcccccccagggatctatattcacagcctagcacctggatccgttgccaagatggagtccaatctgtctaggggagaccaaatactggaagtcaatagcgttaacgtacgccacgccgctctctcaaaggttcatgcaatcctgtcaaaatgtccagtctctgagcaggagatggatgaagtcattgcgcgatcaacgtatcaggagtccaaggaggcaaacagcagccctgggctgggcacacccctcaagtcacccagtctggccaaaaaagatagtctgatctctgaatcagagctcagccaatatttcgctcatgatgtgcccggaccattgagcgactttatggtggcaggatctgaggacgaagaccaccccggatctggctgtagtactagcgaagagggcagtctccctccgtccacctctaaagagcccggaaaacctagggctaacagtttagtaacactgggctcgcaccgcgcatccggattgtttcataagcaggtaacggtggccagacaggccagccttccaggctccccccaggctctgaggaatcctcttctcagacagagaaaagtgggctgttacgatgcaaatgacgctagcgatgaggaggagttcgatcgtgagggggactgcatcagtctgcccggagctctgccaggcccaatcagaccactgtctgaagatgacccccgacgggtcagcatttcaagcagcaagggaatggatgtccataatcaggaggaacgccctcgaaaaaccctggtcagcaaagccatctccgcacctctcctaggcagcagcgtggatctggaggaatcaattcccgaaggcatggtggacgccgctagttatgcagcaaacctgaccgatagcgccgaagcgcctaagggctctcccggaagctggtggaagaaagaactaagtggatcctcctcagcgcctaaacttgagtataccgtgcgtaccgatacacagtctccaacgaatactgggtcgccctcctctccccagcagaaatccgagggccttggctcaagacaccgccctgttgctagggtatctccccactgcaagaggagcgaggcggaagctaagcctagcgggtcacaaacagtcaatttgacaggacgagcgaacgatccatgtgacctcgatagccgcgtgcaagcaacttccgtcaaggttactgtcgccggttttcaacccggtggcgcagtcgagaagctctgtcaggagtcacttggaaaacttaccacaggagacgcctgcgtctctactagctgtgagttggcctccgccctgtctcacttggatgctagtcacctgactgagaaccttcctaaagcagctagcgaattagggcagcaacccatgaccgctagtgaccttataagctctcccggaaagaaaggcgctgctcacccagaccctagtaaaacctccgttgacactggacaggtgtcccggcctgagaatcccagccagccggcatcgccaagagtcaccaagtgtaaggcaaggtctccggtgcggctgcctcacgagggtagtccctcacccggtgaaaaggcagcagcccctcccgactactctaagacacggagtgcgtccgagacctcaacccctcacaatacaagaagggtcgctgcgcttagaggagcaggccctggcgctgaaggcatgacacctgccggagccgtcttacctggcgatcctctgacctcacaagagcaaagacagggtgctcctggaaaccattctaaagccctggaaatgacaggcattcacgctcctgaatcttcacaggaaccatcgctccttgagggggctgactcggtctccagccgcgctccacaggctagcctgtcaatgctccccagcactgataacacaaaagaggcttgcggccacgtgagcggccattgttgccccggtggctctcgggagtccccagtgacagatattgactcattcatcaaggaattggacgcttctgctgccagatcaccatccagccaaacgggagattctggaagtcaggaaggctccgctcagggtcacccacctgcgggtgccggtggcggttctagctgcagagccgaacccgtccctggaggccagacatcgtccccacgtcgggcttgggctgccggagcgccagcctatccgcagtgggcctcacagccttccgtgctggactctatcaatccggataagcatttcactgttaataagaatttcttatccaactacagccgcaacttctcgagttttcatgaagactccacttccctgagcggactgggagacagtaccgagccaagcttgtcttccatgtacggcgatgctgaagactctagctctgaccccgaatccctcacagaggcacccagagcaagcgccagagacggctggagccctcccaggtcacgggtgagtttgcataaggaggacccgagcgaatctgaggaggagcagattgagatctgttcgacgcggggttgtcctaacccaccatcttcccccgctcacttgcctacccaagccgctatctgtcctgccagcgctaaggttcttagccttaaatattccactcctcgcgaatcagtcgcttcaccgagggaaaaggccgcatgtctgcccggttcttacacctccggtccggattcaagccagccttcttccctgcttgagatgagtagtcaagaacacgagactcatgccgacatcagtactagccagaaccataggccctcttgtgctgaggaaactacagaagtgactagtgccagttctgccatggaaaacagccctctcagcaaggtcgcccgtcactttcactccccgccaattatcttgagttctccaaacatggtcaacggactggagcacgatctgcttgatgacgagacattaaatcagtatgaaaccagcatcaatgccgctgcctctctctcctcgttctccgtcgacgtccccaaaaacggagagtccgtcctagagaatttgcacatatcagagtctcaggacctggacgatctgctgcagaaacctaagatgatcgcccgacgccctattatggcatggtttaaggaaataaacaaacacaaccaagggacccacctgaggtcgaaaaccgaaaaggagcagcctctgatgcccgcaagatctccagattcaaaaatccaaatggtcagttcctcccaaaaaaaaggagtaaccgtccctcattctccgcctcagcccaaaacgaatctggaaaataaggacttgagcaaaaaatctcctgccgaaatgctgcttacaaacgggcaaaaagcaaagtgcggccctaaattgaaacgcttgagcctgaaaggaaaggccaaagttaatagtgaagcacccgctgccaatgccgtgaaggcaggtgggaccgaccatcgtaagccgctgataagcccccagacgtcgcacaagacacttagcaaggcagtatcacaacgactacatgtcgccgaccatgaggaccccgataggaatacgacagccgctcctcgtagcccacagtgtgtgctggaatctaagcctcccctagccacttccgggccactcaaaccaagtgtttcagatacaagtataagaacattcgtttcacccttgacatcaccaaagcccgtgcccgagcagggaatgtggtccaggttccatatggccgtactgagcgaacccgaccgcggatgcccaaccactcctaagagcccgaaatgtcgtgcagaaggaagagccccaagggccgactcaggtccagtctcacctgctgcctccagaaacggcatgagcgtagctggcaaccgccaatctgagcccagactggcctcgcacgtggctgctgatactgcccagccacggcctactggggagaaaggaggtaatattatggcctccgaccgtctggagagaaccaatcagctcaaaattgtcgagatttcggcggaggcggtcagcgaaaccgtttgcgggaacaaaccggcagagagcgataggaggggcggatgtctggctcagggcaactgccaggagaagagcgaaattcgcctctacagacaggtggctgagtcttccacgtctcatccaagctccttacccagccatgcgtcgcaggccgaacaggagatgtcccggagtttttctatggctaagctggctagctcttcctctagtcttcaaaccgctattagaaaagccgagtattcacagggcaaatcaagtctgatgtcagattcacgaggcgttcctaggaacagcataccgggaggcccatcaggggaagaccacctctactttaccccgcgtcccgcaactcgtacctatagcatgccagcgcagttctcgtcccatttcggacgcgagggacacccccctcacagcctcggccgtagcagggactcacaggtgcctgtcaccagcagtgtcgtgccagaggcaaaggcctccaggggtgggctacccagtctggctaatgggcagggaatttactccgtgaagccactgctggatacctctcgaaatctgcctgccaccgatgaaggggacattataagcgtgcaggaaaccagctgtttggtgaccgacaagattaaggtgacgcgccgtcactactgctacgaacaaaactggccacatgagtcaacctccttcttttctgtgaaacaaaggatcaagtctttcgaaaatctggccaacgccgaccgaccagtggccaaaagcggcgcttcccctttcctatcagtaagctccaagcccccaatcggaagacgaagcagtggctccatcgtcagcggctccctgggccatcccggagacgctgcagcgcgactgctgaggaggtctctgtcctcctgctcggagaaccagtctgaagcaggtaccctgttgcctcagatggccaagtccccatccatcatgacgctgaccatttctaggcagaacccacctgaaacttccagcaagggaagtgattccgagttgaagaaaagcctcggccctctcggaatcccaactccaaccatgacccttgcctctcccgtaaagcggaacaaatccagtgttcgccatacccaaccatcccccgtcagccggtccaagctgcaggaattaagggcactctccatgcctgaccttgacaagttgtgctctgaggactatagtgcagggccatcggccgtgttgttcaagactgagcttgagatcaccccaaggcggagcccaggtcctcctgctgggggagtgtcttgtcctgagaaggggggtaatcgcgcttgtcccggtggctcaggcccaaagactagcgccgcagagactccgtcgagcgcttcagatacaggggaagccgctcaagatctgccctttcgtcggtcctggtctgtgaacctggatcagctgcttgtgtctgccggagaccagcagcgccttcagagtgtgctaagcagcgtggggtctaaatccactattctgaccctcattcaagaggctaaagcccagtcagaaaatgaagaagatgtgtgcttcatcgttcttaacagaaaagaagggagcgggctcggattcagcgtcgccggtggcaccgacgtagagcccaagtctatcaccgttcaccgcgtgttttctcaaggcgctgcctcacaggaaggcaccatgaacagaggtgactttctattatccgtcaatggtgcttccctcgctggactggctcacgggaatgtgctgaaggtcctgcaccaggcacagctgcataaagatgctctggtcgttatcaaaaaaggcatggaccagcctcgcccttctgccagacaggagcccccaaccgctaatgggaaaggcctgctttctaggaagacgatcccactcgagccaggcataggtcgcagcgtggccgtccacgatgccctgtgtgtcgaagtactgaaaacctcagcaggtctgggactctccctggacggcggaaaatccagtgttactggggatggtccgctggttataaagcgcgtgtataaaggaggcgcagccgaacaggccggtataatagaggccggtgatgagattcttgctattaacggaaagccactcgtagggcttatgcactttgatgcctggaacataatgaagtccgtccccgagggaccagtacagctgctgatccgcaaacataggaattctagtta

SEQ ID NO: 234218 - DNA, 8519 bp, Artificial Sequence
  Description of Artificial Sequence: Synthetic coding sequence
atgcccattacgcaagataatgcggtactgcatcttccacttctctatcagtggctgcagaactctttacaagagggcggagatgggcctgagcaaaggctttgccaggccgctattcagaaactgcaggagtacatccagctgaactttgcagtggatgaatcaacagtgccgcctgatcattctccaccagaaatggagatttgtacagtgtacctgaccaaagagctgggggacaccgagacagttgggctgagttttggcaatatacctgtgtttggtgattacggcgagaaacggagagggggaaaaaagaggaagacccatcaggggccagtgctcgacgtgggatgtatctgggtcactgagttgcggaagaattctcccgctgggaaaagtggaaaggttcgcctgagagacgagattctgtccctgaatggtcagctcatggtgggagtcgacgtctccggcgcttcctacttggctgagcaatgctggaacggcggttttatttaccttattatgctccgcaggttcaagcataaagcccatagtacctacaatggcaactcatccaactccagtgagcccggagagactccaacgctcgagctcggtgaccgcaccgctaaaaaaggcaagaggactcgcaaattcggagtgatctctagaccacccgctaacaaagccccagaggaatccaaaggaagcgctgggtgcgaggttagttccgacccttccaccgagctagagaacggcccagacccagagctgggtaatggccatgtgttccagttggagaacggccctgacagtctgaaagaggtcgccggaccacacctggagcggtccgaagtggaccgcggtacggagcaccgcatccctaaaaccgatgccccacttacgacttctaacgacaagagaaggttcagcaaggggggaaaaacagacttccagtcgagtgattgtctggctcgggaagaggtgggcagaatttggaagatggagctgcttaaggaatctgatggtctgggcatccaggtatctggaggtaggggttctaagcggagcccgcacgcaatcgttgtcacccaggttaaggaaggaggagctgctcatcgggatggccgactgagcttgggcgatgagctgttagtgataaatgggcacctattagtggggctgtctcacgaggaggctgtggcaatactgagatcagccacaggtatggtccagcttgtggtcgcatctaaagaaaattccgctgaggatttgttacgactcacgagcaagtccctcccagatctgacctcatcagtcgaagacgtcagcagctggactgataacgaagatcaggaagccgacggtgaggaagacgagggcacatcctcttctgtccagcgagccatgcccggtacagatgaaccccaggatgtttgtggggcagaggaaagcaagggaaatctcgaatctcccaagcagggatcaaacaagatcaagctgaagagccggctgtctggcggagtgcaccggctagaatcagtggaggaatacaacgagctgatggtgagaaacggagaccccaggattagaatgctggaggtcagtcgtgacggacgcaagcacagcctcccacaactgctggatagctcttctgcctctcaagaataccacatcgtgaagaagagcactcgttcactgtctaccacgcaggtggagagcccttggcgactgattcggccatcagtaatcagcatcattggtctgtacaaggaaaaggggaaggggcttggctttagcatcgcgggaggcagggactgcatcagaggccaaatgggaatattcgtgaaaactatctttcccaacggctccgccgctgaagacggccgtttaaaagaaggtgacgagatactcgacgtgaatggcatccccattaagggactcacctttcaagaagcgatccacaccttcaagcagatccggagcggcttatttgtgctgaccgtgcgaacaaagctggtgagcccttcattgacgccatgttcaacccccacacacatgtctcgctcagcttccccgaactttaacacttcaggcggtgcgtcggccggagggagcgatgaaggcagtagttcaagccttggacggaaaactccgggtcccaaggataggattgtgatggaggtcacactgaacaaggagccccgtgtcgggctaggtattggcgcttgttgcctcgcgctcgagaatagtcccccagggatttatattcacagtcttgcacccggttctgtggctaaaatggagagcaatctgtcccgtggggaccagatcctggaggttaattctgtgaatgttaggcatgccgctctgagcaaggtgcacgccatcctgtcaaaatgtccgccaggtcccgtgcgcctggtgataggccgtcacccaaaccccaaggtctccgagcaggaaatggacgaagtcatcgcaaggagcacctatcaggagtccaaggaggcaaactcttcacccggtctggggacccccctcaagtccccttctctggctaagaaggatagcctgatctccgaaagtgaattgtctcagtattttgcacacgatgtccctggccctctgagtgatttcatggtcgccggttccgaggatgaagaccaccccggaagcgggtgctccacatctgaagagggcagcttacccccatcgacaagcacacacaaagagcccggtaaacctcgcgctaactccctcgtgaccctcggcagccaccgagcatccggtctctttcataagcaggtcacagtggccagacaggccagcctgccgggatctccgcaagccctgcggaacccactgcttagacagcgcaaggtgggttgctatgatgccaacgacgcttccgatgaagaagaattcgatcgtgagggcgactgtatcagtctccctggggctctgcccggacccatcaggcctctttcagaggatgacccgaggagagtgagcatctccagcagtaaaggaatggatgtgcacaaccaagaggaacgtcccagaaagacgttggtttccaaagccatttccgcaccactgctcggcagtagtgtcgatctggaggagtctatcccagaaggcatggtggacgccgctagctacgctgcaaatttaaccgattctgctgaagcacctaagggaagcccgggttcttggtggaagaaagagctgtctggttccagttccgcacccaaattagagtatacggtgaggacagacacacagtctccaacaaatactggctcaccttctagtccccagcagaaaagcgaggggctggggtctcgccatcggccagtagctcgtgtgtctcctcattgcaaacggtccgaggccgaggccaagcccagcgggagtcagacagtgaacctgactgggagagctaatgacccttgcgatttggatagtcgggttcaagcaacatcagttaaagttacagtggccggtttccagccaggcggtgcggtagaaaaagagagccttgggaaactcacgacaggggatgcttgtgtgtccacttcttgcgagttggcctcagctctgagtcacctggacgcctctcatctaaccgaaaatctgcctaaggctgcatccgagctcggtcagcagcccatgacggagcttgattccagcagcgaccttatctcctctcccggtaagaagggcgctgcccaccctgacccttctaaaacctccgtggatactgggcaggtgtcccggccagagaatccctcccagcccgcatctccacgagtgactaagtgcaaagcgcgttcgccagtccggctgcctcacgagggaagtccctccccaggtgagaaggctgcagcccctcctgattattccaaaacgaggtctgcatctgagactagcactccgcacaacaccagaagagtggcagctttaagaggagctggcccaggggctgaaggcatgaccccagctggcgcagtgcttccaggggatccccttacgtcacaggaacagcgacaaggtgcccctggtaatcactccaaggcacttgagatgaccggaattcatgccccagagagttcacaagagccgtctctcttggaaggtgcagactccgtctcatcgagagctcctcaagcctccttgagtatgctgcccagcactgataatacaaaagaggcctgtggtcatgtctcgggacactgctgccccggaggatcacgcgaatctcccgtcaccgacattgacagtttcatcaaagaattggacgcctccgcagccaggtctcccagctctcagaccggagactcaggaagtcaggagggaagcgcccaggggcacccaccggcaggcgctgggggaggaagcagctgcagagccgagcccgtccccggagggcagacaagctctcctaggcgcgcttgggccgcaggcgctcctgcttatccccagtgggcctctcagccatctgtgctggacagcattaacccagataaacactttaccgtgaataaaaatttcctttcgaattacagccgcaactttagcagttttcatgaggattctacaagtctgtcaggcctcggagactctactgagcccagcctctctagcatgtatggtgacgctgaagactcttcttcggacccagaaagtcttaccgaggcaccgagggcttcagcgagagatgggtggagccctccgcgtagtagggtttctttgcacaaggaagatcctagtgagtcagaagaagagcagattgagatctgctcaactagaggttgtccgaaccccccaagctcccccgcacatttaccaacgcaagccgcaatttgtcctgcttctgcaaaggttcttagtcttaagtatagcacgcctagggagtccgtggcaagtccccgtgagaaagccgcatgtctccctggtagctacacttctggccctgattcaagtcagcctagcagcctgctagaaatgtcatcccaggaacacgagacacacgctgacatttccacttctcaaaaccaccgcccatcatgcgctgaggagacgaccgaggtcacaagtgcctcatctgcaatggagaattcacctctaagcaaagtggctcgtcacttccactctcctcccattattttatcaagccccaacatggtcaatggcctcgaacacgatctgctggatgatgaaaccctgaatcagtacgaaacgtcgataaatgctgccgctagcctaagtagcttcagcgtagatgttcccaagaatggcgagtctgtcctcgagaacctgcacataagtgaatcacaggatcttgatgatctgctacaaaaacctaagatgatcgcgagaagacctatcatggcctggttcaaagagattaataaacacaatcaaggcacccacttacgtagcaagacggagaaggagcaacctttaatgcctgcacgctcgcccgactcaaagattcaaatggtcagttcctcccagaaaaagggagtcaccgttccccattctccgcctcagccaaagacaaacctcgagaataaagacctgtctaagaagagccccgcagagatgctcctcaccaacgggcagaaagccaagtgcggccctaagctcaagaggctaagtctcaagggcaaggcgaaagtcaactcagaggcaccagcggctaatgctgtgaaagctggtggaacagatcacagaaagccgctgatcagcccacagacgagccataaaaccctgtccaaggcagtgagtcaacgcctgcatgttgccgatcacgaggatcctgataggaataccacagcggcacccaggtcccctcaatgcgttttggaatccaaacctcccctcgccaccagtggtccccttaaaccaagcgtgagcgacacctccatacggaccttcgtcagtccgctcacttcccccaagcctgtcccggagcagggtatgtggtctaggtttcatatggccgtactgtccgagcccgaccgaggatgtccaactactccaaagtctccgaaatgtcgcgctgaaggacgcgcacctagagccgacagcggacctgtaagcccggcagcatcacgtaacggaatgtccgtcgccggaaaccgtcaatctgaacccagactcgcgtcacatgtggctgcagacactgctcagcctcgtcccaccggagagaaggggggaaatataatggccagcgacaggctggagaggaccaaccagctaaaaattgtggagatctccgctgaagcagtctcagagacggtgtgtgggaataaaccagcagaatccgatcggcgaggcggttgcctagcacagggcaattgccaggaaaagagcgaaattcgattgtataggcaggtggctgaaagctccacctcacatccatcaagcctgccaagccacgcttctcaagcagagcaggagatgagccggtccttcagcatggctaagctggcatccagctcaagctcgttacagacagccattcggaaagcggagtacagccaggggaagtctagcctcatgtccgatagcaggggagtgcctcgtaactccatcccaggcggtccgtccggagaagaccacctgtacttcactcctaggccagcaacaagaacgtattcgatgcctgctcagtttagcagccacttcggcagagaaggccaccctccacacagtctggggcgaagtcgggacagccaggtgcccgtcacaagctccgtggtacccgaggcgaaagcatctcggggaggcctgccctcacttgcaaatggtcaggggatctactcagtcaagccactactggacacgtccagaaacctccccgcaaccgacgaaggagacataatttccgtgcaggaaacaagctgcctggttaccgataagatcaaagtgacgcgtagacactattgctacgagcaaaactggccgcatgaaagcaccagtttctttagcgtcaaacagcgaatcaaatcatttgaaaacttagctaacgccgacagaccagtcgcaaagagcggcgctagcccttttctttccgtgtcatctaagccaccaatcgggagaagaagttcaggatctatagtgtccggctctcttggccatcccggtgatgccgctgccaggctgctgcgcagaagtctttcttcttgcagcgaaaatcaaagcgaggcgggaactctgcttccccagatggctaaatccccctctatcatgacgctgactatctcccgccaaaaccctcctgaaacatcaagtaaaggatccgactcggagcttaaaaaatcgctcgggccactgggcattcccacacccaccatgaccctggccagtcctgtcaagagaaacaagagcagtgtgcggcatacacagccctcccccgtaagtcgctccaaactccaggagctccgcgcactgtctatgccagatctggacaagctgtgttccgaggattattccgcaggcccttctgctgtcttgtttaaaacagaattggagatcactccaagaagatctccaggccctccggcagggggtgtctcatgtccagaaaaaggagggaaccgtgcttgtcccggaggatctggcccaaagacatctgctgcagagactccctcctccgcttctgatacgggggaggccgctcaagatctgccattcagacggagctggtcggtgaatctggaccagctcctggtaagtgcaggggaccaacagagactccaatccgtgctatcgtctgttggaagcaaaagtacaatcctcacccttatacaggaagctaaagcccaatctgaaaatgaggaggatgtgtgctttatagtgctcaaccggaaagagggtagtggcctgggcttctctgtggccggtggcaccgatgtggagcccaagtcgatcaccgtccatcgagtgttttcacaaggagcagctagtcaggagggaaccatgaacagaggcgattttctgctttcagtaaatggggcttccctggctggactggcgcatggcaacgtcctaaaggtactgcaccaggcacagcttcacaaagatgcattggtggtgatcaagaaggggatggatcagccaaggcccagcgctagacaggagccacctacggctaatggaaaaggcctactctccagaaagacaattcctctcgagcctggcatcggacgcagcgttgccgtccacgatgccctctgcgttgaagtcttgaaaacctcggccggactgggcctgtctttggatggcggaaaatcctccgtcacaggggacggcccacttgtcattaagagagtttacaaggggggtgctgctgagcaggcagggatcatcgaggccggagacgagatcctcgcaataaatggcaaaccactcgttggactgatgcactttgacgcgtggaacatcatgaaaagcgtgccagagggtccagttcagttgctcattcgtaaacatcggaatagttctta

SEQ ID NO: 234219 - DNA, 45 bp, Artificial Sequence
  Description of Artificial Sequence: Synthetic coding sequence
atgccaatcacccaagacaacgccgttctgcacttgccactgtag

SEQ ID NO: 234220 - DNA, 1476 bp, Artificial Sequence
  Description of Artificial Sequence: Synthetic coding sequence
atggaaaaagccgctgatttacaggacacagccagtcttactttaaagttcaagtttaatccaaagctcggtattgataaccccgttttaagcctcgctgaagatcacgatccctatgatccatggtctctggagcgcccacggttttgtttgctttcaaaggaggagggcaagtccttcggattccacctgcaacaggaacttggacgcgcaggccacgtggtgtgcagagtggaccctgggacgtccgcacagagacaaggactgcaagagggagataggattcttgccgtgaataatgacgtggtggagcacgaagactatgctgtggtcgtgcgcaggatccgagcaagtagtccacgagtgttgcttacagtgctggctcgacacgctcatgacgtggcgagagctcaattgggggaagacgcccatctttgtcccaccttggggccaggggtgcgcccacgcctgtgccatatagttaaggacgaaggaggattcggattcagcgtgacacacggaaaccagggccctttctggctggtcctttcaaccggcggagcggctgaacgcgcaggtgtgccgccaggagcccgtctgctcgaggtgaacgggttgtggcagagtggccagcaggtgacgctgctcgtcgccggaccagaagtcgaggaacaatgcaggcagctgggcctgccgttagctgccccactagcagaaggctgggcgttgccaactaaacctaggtgtttacacttagaaaagggtccacaggggtttggattcctcctcagagaggaaaaaggccttgacggtcgacccggacaattcctttgggaggtcgatcccggactccccgctaagaaggcagggatgcaggcaggcgacagactggttgccgttgccggagaaagtgttgagggtctcggccacgaagagaccgtgagccggatccagggacagggtagctgcgtgtccttaacggtggtcgatcctgaagcagaccggtttttcagtatggtccgactgagccccctgctgttcctggagaatactgaggcccctgcatctccgcgtggctcttcgtccgccagtctggttgaaaccgaggaccctagcctcgaggatacaagtgtgcctagcgttccgctgggcagtcgccagtgcttcctgtatcccggtcctggtgggtcatatggcttccgcctcagctgtgttgcgtcaggacctcggctgtttattagccaagtgactccaggaggcagcgccgctagggcaggcctacaagtgggcgatgttatccttgaggtgaatgggtaccctgtgggtgggcaaaacgacctggagcgactccagcaactccccgaagcagaacctccgctttgtctgaagctggccgctagatccttgcgtggactcgaggcgtggattccaccaggagccgctgaggactgggcactggcctccgatctcttgtag

SEQ ID NO: 234221 - DNA, 1518 bp, Artificial Sequence
  Description of Artificial Sequence: Synthetic coding sequence
atggaaaaagctgctgatctgcaagacaccgctagtttaaccttaaagttcaaatttaatccgaagctggggatcgataatcctgtgctgagtcttgccgaagaccacgacccctacgatccttggtcattggaaagaccaagattttgccttttatcaaaggaggaagggaagtccttcggattccatctgcaacaggaacttgggcgtgccggacatgtagtgtgtagagttgatcctggaacctcggcccagcggcagggtctgcaggaaggagataggatactggctgtaaataacgatgtggttgagcacgaggactatgcagtcgtcgttcgcagaattcgtgcttcgtcacctcgggttctgctcacagttttggctagacacgcacacgacgtggctcgagctcagctgggagaggatgcacatctgtgtcccacccttggacccggagtacggcctaggttgtgccatatagttaaagacgagggagggtttgggttctcagtaacacacggtaaccaaggtccgttctggcttgtgctgtccaccggcggagccgctgaacgagccggagtgccacctggcgcacggcttctggaagtgaacggcgtttccgtcgaaaagtttacacataatcagctgacccggaagctttggcaaagcggccagcaggtgacacttctcgtcgccggtccagaggtggaggagcaatgtaggcagctaggactccccctcgctgcacccctcgcggagggatgggccctcccgactaagccccgatgtcttcatttagaaaaggggcctcagggtttcggctttcttctgcgggaggaaaagggactggatggcaggcccggacagttcctgtgggaggtagaccctggcctgccagccaaaaaggccggaatgcaggcaggtgaccggctcgtggccgtggctggggagtcggtcgagggactcgggcatgaagagacagtgagccgcatccaaggccagggatcttgtgtatccttaaccgtggtggatcccgaagccgaccggttcttctccatggtcaggttatcaccgctgttgttccttgagaatacagaggctccagctagccccagaggaagcagcagcgccagtttggtggagacggaggatcctagcttggaagacacatcggtgccaagcgtcccactggggtcacggcagtgtttcctatacccgggaccagggggatcttatggcttcagactatcctgcgtcgcttccggacccaggctgtttatcagccaggttacccccggtggtagcgctgcgagagccggtttacaggttggcgatgtgattttggaggtgaatggctaccccgtcgggggacaaaacgaccttgagaggttgcaacaattgcccgaagctgaacctccactctgtctcaagttggctgctaggtccctccggggactggaggcatggattcccccaggggcagctgaggattgggctttagcatccgatctgttatag

SEQ ID NO: 234222 - DNA, 1716 bp, Artificial Sequence
  Description of Artificial Sequence: Synthetic coding sequence
atggttacgccatctcctcctggcaatcatagcctttccctcgaagcgcctcgtcttcatacagcaagcgacctgctagggaaccactctctggggctgcctctcattactgccttagtcggatccagagaccgccgaggcagagtcttcagccccgtaccagttcccttaccaacaaacccaacaacccagcaccccactcgccaaaaactgccctcaaccctttccggtcacagggtttgccaggctcacggagaacccgtgctaggactgtgtcccctcctccccttattctgctgtccaccgcatcctcctgacccctggtccctcgaacgccctagattttgcctgctgtctaaggaagagggaaagtccttcggtttccacttacagcaggagctagggagggctggacacgtggtgtgtcgagttgaccccggtacctccgcacagcgacaaggactgcaggagggcgataggattctcgctgtgaacaacgatgtcgtggagcacgaagactacgcagttgtcgtcagaaggattagagcttcaagcccaagggtactcttgacagtgctggctcggcacgcccatgatgtcgcacgtgcccagctcggtgaggacgcccatctgtgcccaacccttgggcctggcgtcagaccacgcttgtgccacatcgtaaaagatgaggggggatttggatttagcgtgactcacggtaatcagggacctttttggctggtgctgagtaccggcggtgcggctgagcgagcaggcgtcccccctggtgctcgccttctggaggttaatggcgtgtctgtcgaaaagttcactcacaaccagctgacccgcaaactgtggcagtctgggcagcaggtaaccctgctcgtcgcgggaccagaagtggaggaacagtgcagacagctgggcctgccgctggcagctccactggccgaagggtgggctctgcccactaaacccaggtgtttgcacttggaaaagggcccacagggattcggttttctcttgagggaggagaagggcctggacgggagaccgggacagttcctttgggaggtagatcccggactgcccgctaaaaaggcgggtatgcaggcaggagacaggcttgtcgcggttgcaggagaatccgtggaaggtcttgggcatgaagagaccgtgtcacgcattcaaggacagggcagctgtgtctcgctcaccgtggtagacccggaagcagacaggttcttttccatggtgaggttatctcccctactttttttggaaaacacggaggctcccgcatctccgagagggtcatctagcgcatccctggttgaaaccgaagacccttccctcgaggatacaagtgtcccatctgtaccactgggatctcgacagtgctttctatacccaggccctggtggcagctacggtttccgcctgagctgcgtagcatccggacctcggctgtttattagccaggtgacccctgggggaagtgcagcacgcgcaggcctgcaggtgggggacgtgatcctggaagtgaacgggtaccccgtcgggggacagaacgatctggagagactccaacagctgcccgaggccgagccgccactctgcctcaagctggctgcgagatcgctgcggggactagaggcctggatccctcccggagccgctgaagactgggccttggcatccgatcttctgtag

SEQ ID NO: 234223 - DNA, 1518 bp, Artificial Sequence
  Description of Artificial Sequence: Synthetic coding sequence
atggaggaggccctagatcttcaagataccgctagcctcaccctcaaattcaaattcaaccctaagcttggcatagataaccctgttctgtcactggccgaagatcacgacccctacgatccctggtctctggagcggccacgcttttgcctgctgtccaaggaggagggtaagtctttcggattccaccttcagcaggaattaggtcgcgcaggacacgtggtttgtcgggtggacccaggcacgtctgcacagcggcagggattacaagaaggcgacagaattctcgccgtaaacaatgatgtcgttgaacatgaagactatgccgtagttgtgcgcagaatcagggccagctcgccaagagtgcttctcactgtgctcgcccgacatgcccatgacgtagcacgtgcacagcttggtgaggacgcgcacctgtgtcccactttgggcccaggcgtcaggccgagactgtgccatatagttaaagatgaagggggtttcggtttctctgtaacgcacgggaatcagggtccattttggctcgtcctgagcactggaggagcggcagaaagagctggagtgccacccggagccagactcctcgaagtgaatggcgtttcagtggagaaatttacccacaatcaattaactcgaaagctgtggcagagtggccagcaggtgacactcctggtggccggtcccgaggtggaggaacagtgccggcagttaggcctgcccctcgcggcacccttggcggagggatgggcactgcccactaagccaagatgtttacacctagaaaagggccctcaggggttcggttttctcctccgcgaagaaaaaggcctggatggccgacccggacagtttttgtgggaggtggaccccggtctgcccgcaaagaaggcaggcatgcaggccggtgaccgccttgtcgcagtggccggagagtcagtggagggtctaggtcacgaggagaccgtttctagaattcagggtcaaggctcctgtgttagcctgacggtggtggacccagaagcggaccgcttcttcagcatggttcgcctctccccactactgtttctggagaacacggaagcccctgcgtcgccgcgagggagttcctccgcatcgctggtagagacggaggaccccagcctggaggacacctcagtgcctagtgtcccactgggcagtcgtcagtgtttcctatacccaggaccaggaggatcatacggtttcagactaagctgtgtggcaagcgggcctcggttgttcatctcacaggttactcccggagggtctgctgcccgagccggattgcaggtgggcgatgtcatccttgaagtcaatgggtaccccgttggaggccagaacgacctggaaaggttacagcagctgccggaggcagagccccctttgtgcctgaagctcgcggctcgctccttgagagggctggaggcttggatcccccctggagccgcagaagattgggcgttggcgtcggacctcttgtag

SEQ ID NO: 234224 - DNA, 1716 bp, Artificial Sequence
  Description of Artificial Sequence: Synthetic coding sequence
atggtgacaccatcaccccctggcaatcatagtctaagcctcgaggcacccaggctccacactgcaagcgaccttttgggcaaccactctctcggtcttcccctgattactgcgctggtcggatcgcgtgacaggaggggccgagtgtttagcccggtcccagtacccctccccactaaccccactacccagcatccgacacggcagaagttaccctctacgctgtctgggcaccgggtgtgccaggcccatggagaaccggtgttaggtctgtgcccattgctgcctctgttttgctgcccccctcaccctcctgacccttggagtttggaaagacctcgcttttgcttgctatcgaaggaagagggcaaatcttttggctttcacctgcaacaggagctgggtcgggctggccatgtggtgtgccgcgtggatcctggtacatccgctcagcgacagggcctgcaggagggagaccgcatccttgctgtgaacaacgatgtcgtggagcacgaagattacgcggttgtagttcggaggataagggcgtcctctcccagggtgctgctaactgtgttagccaggcatgctcacgacgttgcccgagcccaattgggagaggatgcccatctctgcccaaccctagggcctggcgtgcgaccccgtttatgtcatatagtgaaggacgagggcggatttggtttctcagtcacccacggtaatcagggcccattctggttggtcctgtctactggtggagctgcggagagggcaggtgtgcccccaggtgccagactcttagaggtaaacggggtcagtgtagagaaatttacccataatcagctgacccgaaagctctggcagtccggtcagcaggttaccctcctggtggccggaccggaagtagaggagcaatgtcgccagctcggcctcccgcttgccgctccgttggctgagggatgggcattacccactaagcctcgctgtctacacttggaaaaggggcctcagggcttcgggttcctcctaagggaagagaagggactcgatgggagaccgggacaattcctctgggaggttgatcccggtctgcccgctaaaaaagcaggtatgcaagccggtgatcgtttagtggcggttgcgggtgaatccgtcgaggggttgggtcatgaggagaccgtgtcgcggatccagggacaggggtcctgcgtgtccctcacagttgttgaccctgaagcagatagattttttagtatggtacgcctctctcccttgttatttctggagaacaccgaggcacccgcttctcccaggggatcttctagcgcctccctggtcgagactgaagatccttctctggaggatactagcgttccatcagtcccactcggcagcagacagtgctttctctacccaggtcccggagggagttatggcttccggctgagctgcgtcgcttccgggcctcgcctctttatctcacaagtgacccccggaggtagcgcggcacgtgccggacttcaagtgggggatgtgattctggaggtcaatggctaccccgtagggggacagaacgacttagaaaggctgcagcagttgcctgaggccgaaccccctctttgcctgaaattagctgctcgttcactgcgcggactggaggcttggatcccgccaggcgctgccgaggattgggccctggctagtgatctgctgtag

SEQ ID NO: 234225 - DNA, 2310 bp, Artificial Sequence
  Description of Artificial Sequence: Synthetic coding sequence
atgggctgcaacatgtgtgtggttcaaaaacctgaggagcaatacaaagttatgctacaggttaatggaaaagaactaagcaagttgagccaggaacagacgctacaggcattgaggtcctctaaggagccactggttattcaggtgctgcgcaggagcccccgacttcggggagacagcagctgccatgatctgcagttggtggatagcggtacgcagaccgacatcactttcgagcacatcatggcgctggggaagcttaggccacccacccctccaatggtgatactcgaaccccctcccatcagtcacgagtactacgatcctgcagaatttatggagggagggccacaagaggccgaccggcttgacgagctggagtacgaggaggtcgaactgtacaagtcttctcacagggataaactgggcctgatggtgtgctacaggactgacgacgaagaagacctgggcatttatgtgggggaggtcaatccaaactccatagcggctaaggatggcagaatcagagagggagaccggatcattcagatcaacggtgtcgacgtccaaaacagagaggaggcagtcgccatcttaagccaggaggagaataccaatatcagcctcctggttgcacgcccagagagccagctcgcaaaaagatggaaggactcagatcgcgatgacttcctggatgactttgggtccgaaaacgagggggaactgagggcgcgtaaacttaaaagtccccctgcccagcaaccgggaaatgaagaggaaaaaggagcccctgacgcagggcctggcctttcaaacagccaggagttggactctggggtgggcaggaccgatgagagcactcgaaatgaggaatcgtccgaacacgacctcctgggagacgagcctccatcctccaccaacaccccaggcagtttgcggaagtttggcctgcaaggcgatgccctgcaatctcgtgatttccacttttcaatggacagcctgctggccgagggcgctggcctgggaggaggtgatgtacctggactcactgacgaagagtatgagcgctaccgtgagctcctggaaataaaatgtcatcttgagaatggcaaccaattaggactcctatttcctcgtgcaagcggcggtaacagtgcactagatgtgaaccgaaatgaatcactgggacacgagatggccatgctggaggaggagctgcggcatttagaatttaaatgccggaatatcctccgggctcagaagatgcagcagctgcgggagcgctgcatgaaagcgtggctgttagaggaggagtccctgtacgacctcgccgcttcagagcctaaaaagcatgaactatcagatatatctgaactccctgaaaaaagtgataaagattccacgtcggcctataacactggagagtcatgtcgcagtactcccctcctcgtggagccgttgcccgaaagccccctgcggcgtgctatggccggaaactccaatctcaatcgcacccccccaggtcctgccgtggcgaccccagccaaggccgctcctccacccggttcccctgccaagttccgttcccttagcagagaccccgaagccggacggagacagcatgcagaggagagaggccgaagaaacccaaaaacaggactgacactggaacgcgttgggcctgaaagcagtccttatctgagccgcagacaccgcggacaagggcaggaaggggagcattaccacagctgcgtgcagttggctcccacgagaggactcgaagagctggggcacggacccctgagcctggccggaggtccgagggtggggggtgtcgcggctgccgctaccgaagccccacggatggaatggaaggtgaaagtgcggagtgatgggacacggtatgtggccaagagacctgtaagggatagactgctgaaggcacgcgctctcaaaatcagagaagagagatcaggcatgaccaccgacgatgacgccgtttctgagatgaagatggggagatactggtcaaaggaagagcgtaagcagcacctgatccgtgccagggagcagagaaaaaggagggaattcatgatgcagtcaagattagaatgcctgcgtgaacagcagaacggcgattccaagccagaacttaatattatcgccttgtctcatagaaagacaatgaaaaagcgcaataagaagattctggacaattggatcacaattcaggagatgctcgcccacggcgcacggagcgcagatgggaagcgggtctacaacccactcctcagtgttactaccgtgtag

SEQ ID NO: 234226 - DNA, 2085 bp, Artificial Sequence
  Description of Artificial Sequence: Synthetic coding sequence
atggctcttggtaagcttaggccccctacacctccgatggttatcctcgagccctatgtcctgtctgaactgccaccaattagtcacgagtactacgaccccgctgaattcatggaaggaggcccacaggaggcagacagactcgacgaactggaatacgaggaagtggaactctataagtcttcccaccgggataaactgggcctcatggtatgctacagaacagacgacgaagaagatctcgggatttacgtcggagaagtgaatccgaactctatcgctgctaaggatggcaggatccgagaaggagatcgcatcattcagattaacggcgtggacgtccagaatcgggaagaggccgtggccatcctcagccaagaggagaacacaaatatttctctactggtggccagacctgagagtcagcttgccaagaggtggaaggacagtgatcgagatgattttctcgacgacttcgggagcgagaacgagggagaactaagagctcgtaaacttaaatctccccctgcccagcagcccggtaacgaggaagaaaagggggcaccagacgccggaccaggtctgagtaacagccaagagctagatagcggcgtgggcaggacagatgagtcaacccgcaatgaagagtcctcagagcatgacctgctaggcgacgagcctccttctagtacgaacacgccgggttctctgcgaaagttcggtctgcagggagatgccctgcagagcagagacttccatttttctatggattctctgctagctgaaggggcaggattgggcggaggggacgtcccagggctgaccgatgaggagtacgagaggtatcgagaattgctcgaaattaagtgtcatctggagaatggaaaccagctggggctgctcttcccgagggcttccggtggtaattccgcccttgatgtgaaccggaacgagagtttagggcatgagatggctatgctggaggaggaattgcgtcatttagaatttaagtgtcggaacatcctgagggcccaaaaaatgcagcagctgagggaaaggtgtatgaaagcttggctgctcgaagaagagtctctgtacgatctcgctgctagtgagccaaagaaacacgagttatccgacatcagtgaattgcctgaaaagtcggataaggattcaacatctgcttataacaccggtgaaagctgccggtctacaccgctgctcgtagagcctttgccggaaagccccctcaggcgcgctatggccggaaattccaacctcaaccgaacacctcccggaccagcggtagccacccccgctaaggctgcacctcctccaggcagccccgctaaattccgctcacttagtcgtgatccagaagcagggaggagacagcacgcagaggagcgaggtcgtcgcaacccaaaaaccgggctcactttagagcgggtgggacctgaatcctcaccctacctatcgagacgtcatcgcggacagggacaagagggagaacactatcacagctgtgtccaattagcacctacacggggtttagaggaactggggcatggccctctgtctttggccggtggccctagggttgggggtgtggccgcagccgcaacagaggctccccgaatggagtggaaggtgaaggtcaggtcagacggcacacgctacgtcgctaagcggcctgtccgggatcggttgctcaaggccagggctctgaaaatccgagaagagcggagcggcatgacaaccgacgacgatgccgtgtcggagatgaaaatgggacggtattggtccaaagaggagcgaaagcagcatctgatccgggcacgcgaacagcgcaagaggagggagttcatgatgcagtctcgcctggaatgtcttcgggagcagcaaaacggagattccaaaccagagctgaacatcatcgcactaagccatcgtaaaacgatgaagaagcgtaacaaaaagattttagataactggattaccatacaggagatgctcgcccacggagccaggtccgctgatggcaaacgggtgtacaaccctctgctctccgttacaacagtgtag

SEQ ID NO: 234227 - DNA, 2022 bp, Artificial Sequence
  Description of Artificial Sequence: Synthetic coding sequence
atgactgcgccacctatcagtcacgagtactatgatccagccgaattcatggagggaggtccccaggaagcggacagactcgatgagctggaatacgaggaagttgaattatataagtcaagtcatcgtgacaaactaggcctcatggtatgttacaggaccgatgatgaagaggacctgggcatatatgtcggcgaagtgaatccaaactcaatcgccgctaaagacggcaggatccgggagggagacaggattatccaaattaacggggtggatgtgcagaatcgcgaagaagcagtcgcaattctgagtcaggaagaaaataccaatatctcattgttggtggcacgccctgagagtcaattggcgaaacggtggaaagactccgacagggacgactttctggacgattttggcagcgagaatgagggcgaactgagggccaggaagctgaagagcccacccgcacagcagcccggtaatgaagaagagaaaggcgcacccgatgccggaccgggactctcgaattctcaggagcttgactccggggtgggcagaactgatgagtcgacacggaatgaggagtcctctgagcacgatctgttgggtgatgagcctcctagcagtacaaatacacccggttcattaagaaagtttggactgcagggggacgcactccagagtcgggattttcactttagtatggattcactgctcgcagagggtgccggacttggcggaggtgatgttcctggcctgactgacgaggaatacgaaagatacagggagctgctggagatcaagtgccatttggagaatggaaatcagcttggtcttttgttcccccgagcctccgggggtaacagcgctctggacgtcaatcggaatgaaagcctgggacacgagatggccatgttagaggaggagctcagacacctggaattcaagtgccgaaacatcctccgggctcaaaagatgcaacaactcagagagcgctgtatgaaggcatggctcttggaggaagaaagcctttacgaccttgcagcctctgagcctaagaaacatgaactcagcgatataagcgaacttcccgaaaagtcggacaaggattcaacctctgcctataacacgggggaatcctgcaggtcaacacctttgcttgtggaacctctgcctgaaagccccctccggagggcgatggccggtaacagtaatttgaacagaacgccacctggtccagcagtggctacgcctgccaaggcagcaccaccacccggttcccctgctaaattccgatctctaagcagagatcccgaggccggtcgaagacagcacgcagaggagagaggcagacgcaatcctaagacgggactgaccctggagagggtcggtcccgaatcctccccctatctgtcaaggcgccatcgcggacagggacaggagggcgaacattatcacagttgtgtccaactggcaccaacaaggggactggaggagcttggccatggccctctgtctcttgccggaggcccacgggtaggcggtgtcgcagctgccgctactgaagcacctagaatggagtggaaggtgaaggttcggtcagatggtacccgctacgtggctaagagaccagtgagagacaggttactgaaagccagagccctcaaaattcgtgaggagcgcagcggaatgacaacagatgatgatgccgtgagcgaaatgaagatgggtagatactggagcaaggaggaaaggaaacagcatctgattagggctcgtgagcagagaaagcggagagaatttatgatgcaaagccgtctagagtgtctgcgcgaacagcagaacggcgattctaagccagagcttaatattatcgctctctcacacagaaagacgatgaagaagcgaaataaaaagatattagacaattggatcactatccaggagatgctcgctcacggggcaagatccgctgacggcaagagagtgtataaccctttactgtcagtcaccactgtctag

SEQ ID NO: 234228 - DNA, 1983 bp, Artificial Sequence
  Description of Artificial Sequence: Synthetic coding sequence
atgggctgcaatatgtgcgtagtgcaaaagccagaggagcaatataaagtaatgctgcaggaagtggagctctataagagctcccacagggataaactcgggctcatggtgtgctacaggacggacgacgaagaggatctcggtatctacgtgggagaagtgaatcctaactcaatcgccgctaaagacggtcgtatcagagagggtgaccggattatccagatcaacggagttgatgtgcagaatcgcgaggaagcagtggctatcctgtcccaggaagaaaacactaatatttctctgctcgtggcccgaccggaatcccagctggcaaagagatggaaggacagcgatagggatgacttccttgatgatttcggaagtgagaatgagggagaactgcgcgctcggaagctgaagagccctcctgctcagcaacccggaaacgaggaggaaaaaggggcacccgatgcaggacccggactttccaactcacaggagcttgactcaggagtgggacggactgacgagtcaactcgcaacgaggagtcaagcgagcacgatctcttgggcgacgaaccaccttctagcacaaacactccaggaagtctgcgcaagttcggccttcagggcgacgctctccagtctcgcgacttccatttttctatggattccttgctggccgagggcgctggcctgggcggaggagatgtacccggtctgacggacgaggaatacgagaggtaccgggaactgcttgaaataaagtgccatctggaaaatggaaaccagctgggtctccttttccccagggcttcaggtggcaattccgctctagatgtcaatcgaaacgagtctctggggcacgagatggcgatgcttgaggaggagctgcgtcacttagagttcaaatgcagaaacatcctgcgcgctcagaaaatgcagcagctgagagagaggtgtatgaaggcctggctgctggaggaggaaagtctgtatgacttggctgccagtgaacctaagaaacacgaactttccgatatcagcgaactgccagaaaagagtgacaaggactctacgtccgcatacaataccggtgaatcctgtaggtcaacacccctgcttgttgaacccctccctgaatcacccctgaggagagcaatggcgggaaactccaatctgaatcggacacctcccggaccagcagtggcaacccccgctaaggctgcgcctcctccgggaagccccgcaaaatttcggtccctctcgcgggaccccgaggcagggagaagacagcacgcagaggagcggggtagaagaaatcccaagactgggctgacattggaacgggtgggccctgaaagttcgccatacctctctcgacgtcaccgcggtcagggacaggaaggagagcattatcattcctgtgtccagctggccccaaccagaggtctcgaggagttaggtcacggaccgttgtccctggcgggagggcctcgcgtcggaggggtagcagcagcagctaccgaagcacctcgtatggagtggaaagttaaggtgcgctctgacgggactagatacgtagcgaagcgccctgtgcgcgaccgactgctaaaagctcgcgcactgaagatcagggaggagcgaagcggtatgaccaccgatgacgacgcagtctccgaaatgaagatgggccgatattggtctaaagaggagcgtaagcagcatcttatcagggcaagagagcagcggaaaaggagggaattcatgatgcaatcccgtctggaatgtctccgggaacaacagaacggagattcgaaacccgagctgaacattattgctctcagccacaggaagacaatgaagaagcggaacaaaaaaatccttgacaactggattacaattcaggagatgctagctcatggagcgcgatctgcagatggtaaacgcgtgtacaatccactcctttccgttaccactgtctag

SEQ ID NO: 234229 - DNA, 1554 bp, Artificial Sequence
  Description of Artificial Sequence: Synthetic coding sequence
atggcccagggcttcgccgtcggctttgatcctctgggactaggagacctctccagtggctctctgtccagcctgagtagtcgagggcatcttgggtctgactcaggaagcactgccacacgctatttgttacggaaacagcagaggctgctcaatggacctcctcgaggcatccgggcatcgagccccatgggtcgtgttatactgataaattcccctatcgaagccaactcagatgaatcagatatcattcattctgtgcgtgtggagaaatccccagccggtcgtctgggcttctccgttcgcggagggtctgagcacggcctaggtattttcgtgagtaaggtcgaggagggctccagcgcagaacgggctggcttgtgcgttggagataagataacagaagtgaatgggctcagtctggagtcaactacgatgggtagcgccgtcaaagtcctgacctcttcaagtcgcttgcatatgatggttaggaggatgggaagggttcccggaattaaattctccaaggagaagaccacctgggttgatgtggtcaatcgcagacttgtggtggagaagtgtgggtcaactccctctgatacgagctctgaagacggcgttcgtcgcatcgtgcacctgtacaccacgagcgacgatttttgtctgggattcaacattcggggtggcaaagaatttgggctcgggatctacgtgagtaaagtggatcacgggggactcgcagaggagaacggcattaaggtgggcgatcaggtgctggctgctaatggcgtgcggttcgacgacatatcccacagtcaagcagtggaggtcttgaaaggccaaactcacatcatgctgacaattaaggagaccggccgatacccagcttacaaagaaatggtgtctgagtattgctggctggatcgactgtctaatggcgtgcttcagcagctgtcgccagcttccgagagttctagctctgtcagctcttgtgccagcagcgccccatactcttctggctcgctaccatcagatcggatggacatttgcttgggtcaggaagagcccggaagtagaggacctggttgggggagggcagatacggcaatgcaaacggaaccagatgccggtggcagggtagaaacttggtgttctgtccgcccaaccgtaattctgagggacactgctatcaggtctgacggtcctcaccccggtcggagactggatagcgcgctgagcgagtccccgaaaacagcactgctgctagccctgtcccgtcctcgccctcccattacaagaagccaatcttatttgacactttgggaggagaagcaacagagaaagaaagaaaagtccggctctcctggcgagaaaggcgcattacagagaagcaagaccctgatgaacctcttcttcaagggtgggaggcagggcagactggcccgtgatggacggcgagaagcctggactcttgattctggatcacttgccaaaacctacccacgcctggatattgagaaggagatgggagttagcccctgctgtccaggctag

SEQ ID NO: 234230 - DNA, 3102 bp, Artificial Sequence
  Description of Artificial Sequence: Synthetic coding sequence
atggctcaaggcttcgccgttggattcgatcccttaggcctgggagatctaagctctggcagcctgtcttctctgtcctcccgaggccacctgggttctgactcagggagcaccgcaacccgttatctgctccggaagcaacaacgcttgctgaacggacctccccgaggcataagagccagcagtcccatgggacgtgtaatcctgattaacagccctattgaggccaactcagatgagtccgacataattcattccgtacgcgtggaaaagagccccgctggacgacttggattttctgtccggggtggatcggaacacggccttggcattttcgtgtctaaggtggaggaaggcagctccgcagaacgcgctgggctgtgtgtgggggacaaaatcacggaggtaaatgggctgagtcttgaatcaaccaccatgggatctgcagtgaaagtgctcacgtcttcttctcgcctgcacatgatggtgaggagaatgggtcgggtgcctggtattaagttttctaaggaaaagacaacctgggtcgacgtggtaaatcggcgtttagtggttgaaaaatgcggatccacaccaagcgatacaagctccgaagacggagtacgacgcatagtccatttatacaccacaagcgacgacttttgtttggggttcaacattagaggagggaaggaattcggactgggaatctatgttagcaaggtcgatcacgggggactagccgaagaaaacggaatcaaggtcggagaccaagtgttagcggcaaatggtgtccggtttgacgatatttctcactcccaagcagtagaggtgctcaagggccagacccacattatgctgaccataaaggagaccggcaggtatccagcctacaaggaaatggtatcggagtactgctggctggaccgactgtccaatggagtgctccagcagctgagccccgcttcagagtcttcctccagcgtctcaagttgtgctagcagcgccccttattcttctgggtccctgcctagtgacaggatggacatctgcctgggacaggaagaaccagggtcaagaggccctggttggggtcgggctgacaccgcaatgcaaaccgagccagatgctggaggtagagtcgagacctggtgcagcgtgcgtcctacagtcattttgagggatacggcgatacggtccgatggcccacacccaggtagaaggctagacagtgccctgtccgaatctcccaagaccgcccttttgttggctttgagccggccacgcccacccatcacacgatcccagagttatctgaccttatgggaagagaagcagcaaaggaaaaaagagaagtctggaagccccggtgaaaagggggctctccagaggagcaagactcttatgaatttgttctttaaaggagggcgacaggggagactggcccgtgacggacggagagaagcctggactctcgactcaggttcgctggcgaaaacgtaccctcgattggatatcgaaaaagcaggaggcgtgggccctgtgcagaaatttgtgacatggcgattgcgtagggatcaggagcgcggacgcgctcttctctcagccaggagcgggtctccatcttcacaattacccaacgtcgatgaacaagttcaggcatgggagtctcgacgacccctgattcaggatctggctcaacggctcctgaccgacgatgaggtgctggccgtgacccgacattgttccaggtacgtgcatgagggagggatagaagacctggtacggccactcctcgcaattttagatcgtcccgagaagctccttctccttcaggacataaggtccgtcgtggcccctacagacctcggtagattcgattcaatggtcatgctagtggagcttgaggctttcgaggctctaaagagcagggcagtgaggcctccggcattgcggcctgcacggcaggacacgccacccaagcgtcacctcatcactcccgtgcctgactctcgtggaggattctacttgctccccgtcaacggttttcccgaagaagaggataatggcgaactgcgagaacggctgggcgctctaaaagttagtcccagcgcttcggccccacggcaccctcacaaaggcattccgcctctgcaggacgtaccagtcgacgcctttacccctcttaggatagcctgcaccccaccccctcaactaccccctgtcgcaccgagaccactccggccaaattggcttttgacagaacccttgtctcgagagcaccctccgcagtctcagatccgcggtcgcgctcaatccaggtcacggtctcgaagccgatcccgatccaggagttctaggggacagggaaagtcccccggtcggagaagtcccagtcccgttccgacccctgctccctctatgacgaacggaagataccacaaaccgaggaaagctaggccacccttgcctcgccctctggacggagaggcagccaaggtaggtgctaaacagggtccaagcgaatctggcaccgagggcaccgccaaagaagccgcaatgaagaatccatcgggtgaattgaagacggtgaccttgtccaagatgaagcagtcgctcggcatctccataagcggaggtatagaaagcaaagttcaaccgatggtgaagattgagaagatcttccctggcggagcagcctttctttccggggcactacaggctggctttgagctggttgctgtggacggggagaacctggaacaggtgactcaccagcgagccgtagataccattagacgtgcgtataggaataaagccagggaacccatggagctggtggtccgggttcccggtccctccccacggccatcaccaagtgacagcagtgctttaaccgacggcggtctgccagcagaccatctgcctgcccaccagcctttagatgcggctccagttccagcgcactggctgccggaaccaccaacaaatccacagactccccctaccgacgctcgcctgttacagcctactcccagcccggctccaagtcccgctcttcagacccctgactccaagccagcgcctagccctcgaataccttag

SEQ ID NO: 234231 - DNA, 627 bp, Artificial Sequence
  Description of Artificial Sequence: Synthetic coding sequence
tgaccacgaccacctatcacaaggagccagagctacctcaccctgtgggaagagaaacagcagagaaagaaagaaaagagtggatcccccggtgagaaaggagccctacagcggtcaaagaccttgatgaacctgtttttcaaggggggtagacagggcagattggcaagagacggcagaagggaggcctggaccttggatagtggctccctggcaaagacctacccaagacttgatatcgaaaaagctggtggagtgggcccagtacagaaattcgttacttggcgtctgcggagggaccaggagagaggtagggccttgctgagcgcaaggtctggatcaccctcttcccagcttcctaacgtggacgagcaggtgcaagcctgggagtccaggcggcctctgattcaggatctggcacaaaggctgcttacagatgatgaggtgctggctgtcaccaggcactgctcacgctatgttcacgagggtggtatcgaagacctcgtgcgacctctgctcgccatcttggacaggcctgaaaaactcctgctgctgcaggacatccgctcggtagtggcccctacagatcttggacgcttcgatagcatggtgatgctggtcgagtag

SEQ ID NO: 234232 - DNA, 3465 bp, Artificial Sequence
  Description of Artificial Sequence: Synthetic coding sequence
atgggactgctcttgatgatcctagcctcagccgtgttggggtcattcctgactctgctggctcagttttttttattatataggcggcagccggagccacctgcagatgaagctgctagggccggagagggattccggtacatcaaacctgtgcccggactgcttttgcgggagtatctgtacggaggcggtcgggatgaggagcccagcggtgccgctccagaaggtggggctacccccaccgccgctcccgagacaccagctccccctactcgcgaaacctgttacttcctgaatgcaaccattctcttcctgtttagagaacttagagacactgctcttactagacggtgggtcactaaaaagattaaggtggagttcgaggaacttctgcagaccaagacggcaggaagacttctcgagggactgagcctccgggacgtgtttttaggggagaccgtgccctttatcaagactatcaggttggtgcggcctgtagtccctagtgcaacgggcgagccggatggaccagagggtgaggccttacccgcagcttgccccgaggagctagcttttgaggccgaggtagagtacaatgggggtttccatctggcaatcgatgttgacttggtgttcggaaagtccgcctacttgttcgtaaaactgtctcgcgtcgtaggacgtttgaggctcgtctttaccagggtcccctttacacactggttcttctcatttgtagaagaccctctgattgacttcgaggtgaggtcacagttcgagggcagaccgatgccacaactgacaagcatcatcgtgaaccagttaaaaaaaattattaagaggaagcacacgctgccgaactataaaatcagatttaagcctttcttcccatatcagaccctgcagggattcgaggaagacgaggagcatattcacatccaacagtgggcgctgacagagggacgattaaaggtaacgctcctggagtgcagtcggctgttaatatttggtagctacgatcgtgaggcaaacgtgcactgcacacttgagctgtcatctagcgtttgggaggagaagcagcgcagcagtatcaaaacagtcgaacttatcaagggcaatttacagtccgtaggtcttaccctacgactggtccagtccactgatggatatgccggtcacgtgattatagaaaccgtcgccccaaactctccggctgccatcgcagatctccagcgaggggataggcttatcgctattggcggtgtgaagattacatccaccttacaagtgctgaagctgataaaacaggcgggtgacagggttctggtgtactatgaaaggccggtggggcagtctaaccagggcgctgtcctgcaggacaattttggccagctcgaggagaatttcctctcatcctcctgccagtccggctacgaggaggaggctgcgggtctgaccgtcgacacagaaagtagagagttggacagtgaatttgaagacctggctagtgatgtgcgcgctcagaatgaatttaaggatgaggctcaaagcctgtctcactcccccaagcgcgtgcctaccacactgagtatcaagcctctgggggctattagtcctgttctgaacagaaaacttgctgtgggcagtcaccccctgccgccaaaaatccagtctaaagacgggaataaaccacctcccctcaaaacatctgagattactgatcccgctcaagtgagcaaacccacacagggttcagccttcaagccccctgtaccgcctcgaccccaagcgaaagtacccctaccatccgccgatgcccctaaccaggcggagcccgacgtcttagtagagaaacccgagaaagttgtgcctccacctctcgtcgataagagcgctgagaagcaggccaaaaacgttgacgccatcgacgacgccgcagctcccaaacaatttctggctaaacaggaagttgcgaaggacgtgacgtcagaaaccagctgccccaccaaagatagctccgacgacaggcaaacatgggaaagcagcgagatcctgtatcgcaataaactaggaaaatggactcggaccagagccagctgtttatttgacatcgaggcttgccaccgctacctgaacatcgcattgtggtgtcgagatccatttaaacttggtgggcttatatgcttgggccacgtgtctttgaagctggaggatgtagctttggggtgtctggcaacttccaacaccgagtatctgtcaaagttaagactggaggcgccatctccaaaagccatagttacaagaacggctctgcgtaatttatctatgcaaaagggcttcaacgacaaattttgttacggcgatatcacaatccattttaagtacctcaaagagggagagtcagatcaccacgtcgttactaatgtggagaaggagaaggaaccacatctggtggaagaggtgtcggtgctcccaaaggaggaacaattcgtgggccagatgggactaactgaaaataagcattcgtttcaggacacccagtttcaaaatcctacctggtgcgactattgtaaaaaaaaagtttggaccaaagcagcctcacagtgtatgttctgtgcctatgtttgccataagaaatgtcaagagaagtgccttgctgagacgagcgtctgcggcgctaccgacagaaggattgacaggaccctgaaaaatctccgcttggagggacaggagacccttctgggtttacctcccagagtggatgccgaagcgtcaaaaagtgtgaacaagaccaccggcctgacccgtcacatcataaacacctcctctcgactgctgaacctcagacaagtttccaaaacccggctaagtgagccaggaactgatctggttgagccctcccctaagcatacacccaatacttcagataacgaaggcagcgatacagaagtgtgcggccctaactctccctccaagcggggaaatagcacgggcattaagctggttcgtaaggaggggggactcgatgactctgtgtttatagctgtgaaggaaatcgggagggacttataccgaggactccctaccgaggagagaatccagaaacttgagttcatgttggacaagttgcaaaacgagatcgatcaagaactcgaacacaataatagcctggtgcgagaagagaaggaaaccaccgacacccgaaagaagagcctcttaagtgcagctctggctaaatcaggcgagaggctgcaggctttaacactgctgatgatccattatagggctggcatcgaggacatcgagaccttagaaagcctttctctggaccagcatagtaagaagattagcaaatatactgacgacaccgaggaggacctggacaatgagatttcccaattgatcgattcccagcccttctcaagtatttctgacgacctttttggcccttcagagtccgtctag

SEQ ID NO: 234233 - DNA, 3201 bp, Artificial Sequence
  Description of Artificial Sequence: Synthetic coding sequence
atgggtttcgagctggacaggttcgatggtgatgtggatcccgatttgaagtgtgccctatgccacaaggtgttagaggaccctctgaccaccccgtgcggccacgtgttctgtgccggatgtgtattgccctgggtggtccaggaggggtcatgtccggctagatgccggggtagactgagcgccaaagagctcaaccacgttctgcccctcaagcggttgatattgaagctcgatataaagtgcgcatacgccactcggggatgcggacgggtggttaagttgcagcaacttcccgagcatctggaacggtgcgacttcgcgccagccaggtgcagacatgctggatgcgggcaggtcctgcttcggcgagatgtggaagcccacatgcgcgacgcctgcgacgccagaccagtcggaaggtgccaggagggctgcggtttacccctaactcatggcgaacagcgagcgggaggacattgctgtgctcgcgcactgagagcccacaacggcgctctccaagcaagactaggcgcacttcataaggcactcaaaaaggaagctctgagagccggaaagcgcgaaaagagcctagtcgctcagcttgccgctgctcagcttgaactgcagatgacagcactgaggtatcaaaagaagttcacagagtatagcgccagattagacagcttaagcaggtgcgtcgcagcccctcccggagggaaaggagaagagacgaaaagcctaaccctggtgctgcaccgggactccgggtcactcggattcaacatcattggcggtcgcccaagcgttgataaccacgatggttcctcgagcgaaggaatcttcgtgtctaagatcgtagattctggccctgccgctaaagagggcggactgcagatccacgaccggattattgaggtcaacgggcgagacttgtctcgcgctactcatgatcaggctgttgaggcatttaaaaccgccaaggagccgattgtggtgcaagttcttaggcgcacaccccgaaccaaaatgtttaccccccctagcgagtcacagttggtggatacaggaactcagaccgacatcacttttgaacatatcatggccctcactaagatgtcttcaccgagcccaccagtcttggacccatacctgttgcccgaagagcacccctctgctcatgaatactatgacccaaatgattatatcggagacattcaccaggagatggatcgagaggagttggagcttgaggaggttgatctgtatcggatgaactctcaggataaactcggactgaccgtgtgttatagaacagacgacgaggacgacatagggatttacatctccgagatcgatcctaatagcatcgccgcaaaggatggcagaatcagagagggtgacagaattatccaaataaacggcattgaagtgcagaaccgggaggaagcggtggctttgctcactagtgaggaaaataaaaatttttcccttctgatcgctagaccggaattgcagctggatgagggatggatggacgatgacaggaacgacttcctcgacgacttacatatggacatgttagaagaacagcaccaccaggctatgcagttcacagcctcagtcctgcagcagaaaaaacatgacgaagacgggggtaccacagatacagcaacaatcctctccaatcagcacgagaaggacagtggcgtagggagaaccgacgaaagtactcgtaacgacgaaagtagtgaacaggagaacaacggagacgacgcaaccgcctcctcgaatcccctggccggtcagaggaaattgacctgcagccaagacaccctgggctccggcgacctgccatttagtaatgagtcgttcataagcgccgattgtaccgacgccgactacctgggcatccccgtagacgaatgtgaacgattccgggagcttctggaactcaagtgccaagttaagtctgctacaccgtacgggctgtattacccaagcggcccactggatgcaggcaaatccgatcccgagtctgtcgacaaggaattggagttgctcaacgaagagctgcgctcaatcgaactggagtgtctctcaattgtcagagcccacaaaatgcagcaacttaaggagcaataccgagagtcttggatgctccataactcgggtttccgaaattataacacctcgatcgacgtgcgccgtcacgagctctcagacatcaccgaattgcctgaaaaaagtgacaaagattcatcctctgcatacaacaccggtgagtcttgccggtcgacaccgctgaccctggagatcagtcccgataattccctgaggcgcgcagccgaggggattagttgtccttcttccgagggggctgtgggtacaacggaggcctacggccctgcctccaagaatctgctgtctatcaccgaggatcccgaggtcggaactcccacctacagtcctagcctgaaagagctcgaccctaatcagccccttgaatcaaaagaaaggagagcgagcgatggatctcgcagtccaacaccatcgcagaagctgggatccgcctatctgcccagctatcatcacagcccgtacaaacatgcccacatacctgcccacgctcaacattaccagtcctatatgcaattgattcagcaaaaatcggccgttgaatacgcccagtcgcagatgagcttggtaagtatgtgtaaagacctgtcatcccctactccctccgaacccagaatggaatggaaggtaaaaatccggtcagacggcaccagatatattacaaaacgacccgttcgggatagattactccgtgagcgcgcactgaaaatccgcgaggaaagatcgggcatgactaccgatgacgatgctgtcagcgagatgaagatgggcaggtattggtccaaggaagaaaggaagcaacatcttgtgaaggccaaggagcagcgcaggagacgcgagtttatgatgcagtcacgcttagactgcttaaaagaacaacaggctgcagatgaccgtaaggagatgaacattctggagctctcacacaagaaaatgatgaagaaaagaaataaaaaaatctttgataattggatgaccatacaggaactcttgactcacggaactaagtcacccgacggaacccgcgtgtataattcctttctcagcgttaccacagtgtag

SEQ ID NO: 234234 - DNA, 2190 bp, Artificial Sequence
  Description of Artificial Sequence: Synthetic coding sequence
atgggatttgagctggacagatttgatggggatgtggatcccgacttgaagtgtgccctatgtcacaaggtgcttgaagaccctctgactaccccctgtggacatgtgttctgcgctggctgcgtcctaccttgggtcgttcaggaaggttcttgtcctgccagatgccgcggtcggctgtctgctaaggagctgaatcacgtactccccctgaagaggctgatcttgaaattggacatcaagtgtgcatacgctactcgaggctgcggaagggtggtgaaactgcaacagctacctgagcatttggaaaggtgcgacttcgcccctgcgaggtgcagacatgccggatgtggccaggtcttactgagacgcgatgttgaagctcacatgcgcgatgcatgtgatgccaggccggtcggtcggtgccaggagggatgtggccttcctctcacccacggcgagcaaagggctggtggacattgctgcgccagggcactacgcgcacacaacggtgccttacaggctcgcctgggcgcactgcacaaagccctcaagaaagaggctctgagagcgggtaagcgggagaagtccctggtggcacaattagccgcagctcagcttgagctccagatgacagccctgcgctatcaaaaaaaattcacggaatacagcgccagactggactccttatctaggtgtgttgcagcgccaccagggggtaaaggcgaggaaactaagtctctgacactcgtcctacatagggattcggggtcgcttggattcaacatcattggcggaagaccctcggtggacaatcatgacggatcaagtagtgaaggaatttttgtctccaaaatcgtagattccggtccagcagcaaaagaaggtggcctgcagattcatgatagaatcatcgaggtgaatggccgagacctctcgcgagctacccacgaccaggctgtcgaagcatttaagacagccaaagagccgattgtcgttcaggtgttaagaaggacacctcgaactaagatgtttacccctccctccgagagtcagctagtggatactggcacacagactgatattacctttgagcatatcatggcgctgaccaagatgagctctccttcacctccggtgctggacccttatttgctgcctgaggaacatccatctgctcacgagtattatgaccctaacgattacattggcgacatccaccaggaaatggatcgcgaggaactcgagttggaagaggttgacctgtacagaatgaattcccaggataaactgggcctcacggtctgctatcgaaccgacgacgaagatgatattgggatatacatcagtgagattgatccaaattctatcgccgctaaggatgggagaatacgggagggagacagaataatacagatcaacggaatagaagtccaaaaccgggaagaggccgtggccttattaaccagtgaagaaaataaaaatttcagccttctcatcgctaggcccgaactacagctcgatgaaggatggatggacgatgaccgcaatgattttttggatgatttacacatggacatgctcgaggaacagcaccaccaggcgatgcagttcactgcttccgtcctgcaacagaagaagcacgacgaggacggtgggaccaccgacacagccacaatcctgagcaaccagcacgagaaggatagcggcgttggaagaactgacgaaagcacccgtaacgatgaaagcagtgaacaggagaataacggcgatgatgctactgcttccagcaatccacttgctggacaacgtaaactaacatgctctcaggatacactgggctctggagatctgccattttcaaacgaatccttcattagcgcggactgtacggacgccgattacttggggatccccgtggagggcgaagatcctcagcgcagagacgcacttcatcaccaggaggcacgtgcgggaccccctgcagccggagcaaggccagaagatcccggaagagcacagcggcatgatcaccggagaagacgcggagaacgggatgaagatggagcactgctcgagcaaggaggagaggaagccgctcccggagaaggacagggcgctgccgctgccgcacgcgtccatgatgcagagcaagtgggcctgtctcagggtgccgctagcagtcgctag

SEQ ID NO: 234235 - DNA, 2352 bp, Artificial Sequence
  Description of Artificial Sequence: Synthetic coding sequence
atgggttgttcactttgctctcttcagaagcaggaggagcaatacaagcttttgtatgaagtctgccaagtaaatggaagagacctgtcaagggcaacccacgaccaagccgtggaggcctttaaaactgctaaggagcctattgtagtgcaggtgctcagaagaaccccgagaaccaaaatgtttacaccgccatccgaaagtcaactggtcgacaccggcacccagactgatataacattcgaacatatcatggccctgaccaaaatgtcatccccttcccccccagtcctggatccatatctgctgcctgaagagcatccttcggctcacgaatattacgacccgaatgattacattggggacattcatcaggagatggaccgggaggaactcgaactagaggaggtagacctgtaccgaatgaactcccaggataagctgggtctcacggtgtgttatagaactgacgacgaagacgatatcggaatttatatatcggagattgaccctaattctatcgcagctaaagacggacgcatcagggagggtgatcgtatcatccagatcaatggtatcgaagttcaaaacagagaggaggcggtggccctactgacttctgaggagaataagaactttagcctgttgattgcacgaccggagctacagcttgatgagggatggatggatgatgatagaaatgacttcttagacgacctacatatggacatgctggaagagcagcatcatcaggcaatgcaatttaccgccagtgtcctgcagcagaagaaacatgacgaagacgggggtaccacagacactgccaccatactcagcaaccaacacgaaaaggactccggagtgggcagaactgatgagtctacgagaaatgacgaatcttcagagcaggagaacaacggtgacgacgcgacagcttcctccaaccctctggccggtcagagaaagctcacatgcagccaggacaccctgggctccggcgatttgcccttctcaaacgagtccttcatctctgccgattgtactgatgccgattatctgggcattccagtggatgagtgcgagagattccgggagctgctagaactgaaatgtcaggtgaaaagcgctactccttacggcctttattacccttctgggccactcgacgccggtaaatctgacccagaaagcgttgacaaagaactggagctgctgaatgaggaacttcgatctattgaactggagtgtctttctattgtgagagcgcacaaaatgcagcaattaaaagagcagtatagggagtcctggatgctgcacaattccgggtttagaaactataacacttctattgacgtaaggaggcacgaattgtctgacattacagagttacccgaaaaaagcgacaaggattctagcagtgcctataacaccggcgaaagttgtcgcagcacccctcttaccttggagatttcacctgataattctctgcgccgagctgcagaaggtatctcctgcccttcaagcgagggggcagttggcaccaccgaagcatatgggcctgcaagcaaaaacctactgagtataaccgaggatccggaggtgggtacgcctacttactcaccatccctgaaagagctcgaccctaaccagccgctggaaagtaaggagaggcgggctagcgatggctcacgctcccctactccaagccagaaattgggctccgcgtacctgcccagctaccaccacagcccttataaacacgcccatatcccggcacacgcgcaacactatcagtcttatatgcagctgatccagcaaaaatccgccgttgaatacgcccaatctcagatgtcactggtgagcatgtgtaaggacttgtcttctcctacaccatctgagcctagaatggagtggaaagtgaagatccgcagtgacggaactcgctacatcaccaagcgccctgttcgcgataggctactgcgcgagcgcgcacttaaaattagagaggaacgctcaggaatgacaacggatgacgatgcagtatctgagatgaaaatgggcaggtactggagtaaggaagagcggaagcagcatttggtcaaggcgaaggagcagcgacggcgtagggagtttatgatgcagtcgagactggattgcctgaaggaacagcaagctgctgacgaccggaaagaaatgaacatcctcgaactaagccacaaaaagatgatgaagaagcgaaacaagaaaatttttgacaactggatgactattcaggaactactgacccacggtacaaaatcccctgatgggacccgggtgtataattctttcctcagcgtgaccaccgtgtag

SEQ ID NO: 234236 - DNA, 2367 bp, Artificial Sequence
  Description of Artificial Sequence: Synthetic coding sequence
atgaaaatggagcataagaggatgatccttctgttttccaaattcaccttgatacacaaaccgcacggtgggagatggtatttggtgaatggacgggacctatcccgcgcaactcatgatcaggcggtagaggcctttaaaactgccaaggagccgatagttgtccaggtgctgagacgcacacctcggaccaaaatgttcacccctccaagcgaatcccagctagtggataccgggactcaaacagatattacttttgagcatattatggctcttaccaaaatgagttccccctccccccctgtactggatccctatctgttgccagaggagcacccctccgcccacgagtactacgatcctaacgactatatcggggatatacaccaagagatggacagggaagaactcgaactggaagaggttgatctttatcggatgaatagccaggacaaactggggctgaccgtctgctatagaactgatgacgaggatgatataggtatttacatctcggaaattgatcccaatagtatcgcggcaaaggacggcaggatcagagagggggacaggatcattcagataaatgggatcgaggtacagaaccgcgaggaggctgtcgccctgctcacctccgaagaaaacaaaaatttctctctgctcatagcccgtcccgagctccagcttgatgagggttggatggacgatgacaggaacgacttcctggatgacttgcacatggacatgttagaagagcaacatcatcaggctatgcagtttaccgcctccgtcctgcagcagaagaaacacgatgaggacggtggtactacagacaccgctactatactgagcaatcaacacgaaaaggattctggggtcggccgaactgatgaaagtacccgaaacgatgagtcatcagagcaggaaaacaatggggacgacgcgacagcctcatccaatccgcttgcgggacagcgtaagctgacatgctcacaagataccctcggctcaggagatttaccattcagcaatgagtcctttatcagcgcagactgcactgatgctgactacctcggcatcccggtggatgaatgcgagaggtttagggaattactcgaacttaagtgccaagtcaaatccgcgactccatacggattatactatccgtctggaccattggacgcagggaagagcgatccagagtctgtcgataaagagctggagctgctcaatgaagagttaaggtccattgaacttgagtgcctctccatcgtcagagcccacaaaatgcagcagcttaaagagcagtaccgcgaaagctggatgttacacaattcgggctttcgcaactacaacacatccattgacgtcagaagacacgagctaagcgacataaccgagttgccagaaaaaagcgacaaggactccagttctgcttataataccggggaatcttgccggtccaccccattgaccctggagatctcccccgataactcactacggagagctgctgaaggaattagctgtccctcctccgagggcgcagtgggcaccacagaggcttacggacctgcctcaaaaaatcttctgagtattacagaggatccagaggtaggtactcccacatacagccctagtttaaaggaattggatcctaaccaacccctagagagcaaagaacgcagagctagcgatgggagtcggtcgcccactccatcccagaagctggggagcgcctacttgccgtcctatcatcactcaccctacaagcacgctcacattcccgctcatgcccagcattatcagtcatatatgcagttgattcagcaaaagagtgcagtggaatacgcgcagtcccagatgagcttggtgagtatgtgcaaagatctctcctcaccaacaccgagcgaaccacgcatggaatggaaggtcaaaatcagatctgacggcaccaggtacatcacaaaaagacctgtacgagatagactactgagggagagagccctcaagatcagggaggagcgttcgggcatgaccactgatgatgacgccgtaagcgagatgaagatgggaagatattggagtaaagaagagcgaaagcagcatttggtcaaagcaaaggagcagcgtcgcagaagagagtttatgatgcagtctaggctcgattgcttgaaagagcagcaggctgctgacgaccgaaaagaaatgaacatactcgagctgagccacaagaagatgatgaagaaacgaaataagaaaatctttgataactggatgactatccaggaacttctgacacatggcacaaagtcacctgacgggacgcgcgtctacaattcctttttaagcgtaaccaccgtttag

SEQ ID NO: 234237 - DNA, 2331 bp, Artificial Sequence
  Description of Artificial Sequence: Synthetic coding sequence
atgtccggaaagagacagttttttctcaagcctctcgctctgctcacttgttggccttccaccgtgaatggcaaagacctgtcgaaggccacacacgaagaggccgtcgaggcattcaggaatgctaaagagccaattgtggtccaggttctccggagaacccccttgtccaggccggcttatggaatggcatctgaagtgcaactcatgaatgcctccacacagacggacattacctttgagcatatcatggcgcttgccaagttacgccctccaactccccctgttcccgatatttgtccatttctgctcagcgatagctgccactcccttcaccctatggaacacgagttctatgaagataatgagtacatttcctctcttccagccgacgcagaccggaccgaggatttcgagtatgaggaagtcgagctctgccgggtgagctctcaggaaaagctcggtcttaccgtttgctaccgaaccgacgatgaagaagacaccgggatatacgttagtgaagtcgaccccaactcaatcgctgccaaagacggtaggatccgggagggagaccgtattctgcaaatcaatggggaagatgtgcagaatagagaggaggctgtcgcactgctgagcaacgacgaatgcaagaggattgtcctgctggtcgctcgcccagaaatccagctggatgaagggtggcttgaggatgagagaaacgaatttctcgaagagctgaatctggagatgctggaggaagagcacaacgaagccatgcagcctaccgcgaacgaagtcgagcagccaaagaagcaggaagaagaggagggcacaaccgatacagcaaccagcagcagtaataaccacgagaaggactccggggtgggccgtactgatgaatcgctgcgtaatgacgaatctagtgagcaggagaatgcggcagaggatcccaatagcaccagcttgaagagcaagcgggacctgggccagtcgcaggacactctggggtctgtggagctgcagtataacgaatctcttgttagcggagagtacatcgactccgattgcattgggaatcctgacgaggattgtgaaagattccgccaactgctggaacttaagtgcaagattcgcaatcacggagagtatgacctgtactactcatccagcacaatagagtgcaatcagggtgaacaggaaggtgttgagcacgagctgcagttgctgaatgaggagttaagaaatatagagctagaatgtcagaacattatgcaggcccataggctccagaaggtgactgatcagtatggagacatatggacattgcacgacgggggtttccgcaattataatacttctatagacatgcagcgtggaaaactggacgacattatggagcaccccgaaaagagtgataaggatagttcaagcgcctataacactgcagaatcttgccgttcaacgccactgaccgtggataggagcccggattcttcgctccctagagttattaatctcaccaataaaaaaaacctgaggtctacaatggctgcgacccagtcctcgtccgggcaatcctccaaggagtcaacaagtaccaaggctaagactacggagcaaggatgcagtgctgaatcgaaggagaaggtgctggagggtagtaaattgcctgaccaggaaaaggccgtgagcgagcacattccctacctgtccccctatcactcatccagttatcgttacgccaacattcctgcccatgcgaggcattaccagtcttacatgcaactaatccaacaaaaatcagctgtggaatacgctcaatcccagctgtccctagttagcatgtgcaaagaaagtcagaaatgcagcgaacccaaaatggagtggaaagtcaaaatccgctccgacggaacccggtacatcaccaagcgacctgttcgtgataggattcttaaggagagggcgcttaaaataaaagaggagaggtccggcatgacaacagacgacgatactatgtctgagatgaagatgggtcgatattggagtaaagaggaaaggaagcagcatctggtcagggccaaggagcagcggcgaagacgtgaattcatgatgagatcaagactggaatgtctaaaagaatcgccccagagcgggagcgaagggaagaaggagattaacattatcgaattgagtcataagaaaatgatgaagaagcgaaataaaaagatcttggataactggatgacaatacaagagctgatgactcatggcgctaagtcccccgacgggactcgagttcacaacgctttcctttcagtgactaccgtgtag

SEQ ID NO: 234238 - DNA, 3111 bp, Artificial Sequence
  Description of Artificial Sequence: Synthetic coding sequence
atgggctttgcccttgaaagattcgccgaggccgttgaccctgcactggaatgcaagctctgcggccaggttctggaggagcccttatgtacaccgtgtggtcacgtgttctgtgcctcatgcttgctcccatgggccgtgcgcagaaggcggtgcccactgcagtgtcaaccactggccccaggcgagctctatagggtgctgccacttaggtctctgatccaaaagctgagagtacaatgtgactatcgcgctcggggttgtgggcactcggtgcgtctgcatgaactagaggcccatgtagagcattgcgacttcggccctgccaggcggctaagatcccgaggtggatgtgctagcgggctaggaggcggtgaagttccagctcggggagggtgtggacccacccctcgtgcgggaagaggtggtggcgctagggggggaccaccgggagggagatggggcagagggagggggcctggcccacgggtcctggcctggcgccgtcgggagaaagcactgcttgcacaactttgggccctgcagggggaggtgcagctgacggccagaagatatcaagaaaagtttacacagtatatggcccatgtccgcaatttcgtcggtgacctcggcggaggtcatcgcagagatggggaacataaaccctttaccattgtgctggagagggaaaatgataccttaggctttaatataatcggcggaaggccaaaccagaacaaccaggagggcacgtctaccgaagggatttacgtctctaaaatcctggagaacgggccagctgatcgtgctgatgggctggagattcatgacaagattatggaagtcaatggtaaagatctgtccaaggctactcacgaagaggccgttgaagctttcagaaatgccaaagagcccattgtggtgcaggttttgcgcaggaccccgctgtcacggccagcctacggaatggcatctgaagtgcaactgatgaatgcttctacccagacggacattacttttgaacatattatggcccttgccaagttgaggccacccacaccccctgttccagacatatgtccattcttgcttagcgatagctgtcactcattacacccaatggagcatgaattttatgaggataacgagtatatttcttctctccctgctgacgcagacagaactgaagatttcgagtatgaggaggtggagctctgtagggtgtcttctcaggagaaactggggttgactgtttgctatcgcaccgacgacgaggaggacactggcatctatgtatctgaggtggatcccaattcaatcgccgcaaaagacggccgaatcagggagggggaccgaatcctgcaaattaatggcgaggatgtccagaaccgagaagaagcagtagcactgcttagtaatgatgagtgtaagagaattgtgctgctggtcgcccgaccagaaatccagctggacgagggatggctcgaagatgaaaggaatgaatttctagaggagttgaatctcgagatgctggaggaagagcacaacgaagccatgcagccaactgcgaatgaggttgagcaacccaaaaagcaggaagaggaggaaggtactacagacacagcgacctctagctcgaacaatcacgagaaagattcgggcgtgggacgaaccgacgaaagtctacgcaatgacgagagttctgaacaggaaaacgctgccgaagaccccaactcaacatcactgaagtcaaaacgcgacctggggcaatctcaagacactcttgggagtgtagaattgcaatataatgagagcctggtgagcggggagtacatcgacagtgattgcataggcaatccagacgaggattgtgaacggtttaggcagctgctcgagcttaaatgtaagatacggaaccacggagagtacgacctctattactcgagttcaacgatagagtgcaatcagggggagcaggagggagtcgagcatgagcttcagctcctaaacgaggagttgagaaacatcgaactcgaatgtcagaatattatgcaggctcaccgactccagaaagttactgaccagtatggtgatatctggaccctgcatgacggcggattcaggaactacaacactagtatcgacatgcaaagaggcaagcttgatgacatcatggaacatccagaaaagtcagacaaagatagctcctctgcctataacaccgccgaatcgtgtagatccacccccctcactgtcgatcgcagtccagattcgagcctacccagggtgatcaacctcacaaacaagaagaaccttcggtccacgatggctgccacccaatctagtagcggacagagcagcaaggagagtacatcaactaaggcaaagaccacagagcagggctgcagcgctgaatcaaaagaaaaggtgctcgagggctccaaattgccagatcaggagaaggctgtgtctgagcatattccttatctgtctccctatcatagcagcagttatagatacgccaatattcctgctcacgccagacattaccagagctatatgcaactgatccagcaaaagtcagctgtggaatatgctcaaagccaactcagtttggtgtcgatgtgcaaggagagccagaagtgttcagagcccaagatggagtggaaggtaaaaatcaggtctgatggaacccggtacatcaccaaacgacctgtgagagatagaatccttaaagaaagagccctcaaaattaaagaagaacgaagcgggatgacaacggacgacgacacaatgtccgaaatgaaaatgggacggtattggagcaaagaggaaagaaaacaacatttggttcgtgcgaaggagcagagaaggaggcgggaatttatgatgagaagccgtctagaatgcctgaaagagagcccccaaagcggttccgaaggcaagaaagaaatcaacatcattgagctgtcccacaagaagatgatgaaaaagcgtaataagaagattctggacaactggatgactattcaggagttaatgacacatggagccaagtcaccggatggaacaagggtccacaacgcgttcctatcagtaacgactgtgtag

SEQ ID NO: 234239 - DNA, 2337 bp, Artificial Sequence
  Description of Artificial Sequence: Synthetic coding sequence
atgggatgcaatctgtgtacttttcagaaacgcgaggagcactacaagctgctttatgaggtctctcaggtgaatgggaaagatctcagcaaggccacccatgaggaggccgtcgaggcattcaggaacgccaaggaacctatagtggtgcaggtgctgcgccgtacacccctgagtaggcctgcttacgggatggccagcgaggtgcagttgatgaacgcgtcgacccagactgacattaccttcgagcatatcatggctcttgccaaactgaggcctcctactcccccagtgcccgacatttgtccattcctgttatcagatagctgtcactccctccatccgatggaacatgagttctacgaggataatgagtacatttcaagtctacccgcagatgcagaccgaaccgaggacttcgagtacgaagaagtcgaattgtgccgcgtgtcttcacaggagaaactggggctgaccgtgtgctacagaactgacgacgaggaggacacaggaatatacgtgtctgaggtcgacccaaattccattgcggctaaggacggcaggattagggagggtgatcggatactgcagatcaatggagaagatgtgcagaaccgggaggaggccgtcgcactcctgtcaaatgatgaatgtaaaaggatcgtgctactcgtagctcggccagaaatacaactcgacgagggctggctagaagacgaaaggaatgagttcctggaagaactgaacctggaaatgttagaggaggaacacaatgaggcaatgcagccgaccgctaatgaagtggagcagcctaaaaaacaagaggaagaggagggcactactgacacggccacctctagctcaaacaaccatgaaaaagatagcggggtgggcaggaccgacgaaagtcttcggaacgacgaatcctccgaacaggaaaatgccgctgaggaccccaacagcacgtccctcaagagtaaaagggacctcgggcagagccaggatacgctcggatcagtggagctgcaatataatgaaagcctggtgagtggcgagtacatcgacagtgattgtattgggaatcccgacgaggattgtgagagattcaggcagttactagagttgaagtgtaaaatccggaaccatggcgagtacgatctgtattatagcagttcaactatcgagtgcaatcagggtgagcaggaaggcgtggagcacgagcttcagctgctcaacgaggaactgcgcaacatcgaactcgagtgtcagaacatcatgcaggcccacagattgcaaaaagtgaccgatcagtatggtgacatttggactctccacgacggcggattcagaaactacaatacaagcatcgacatgcagcgtgggaagttggacgatattatggagcatccagaaaagtctgataaagactcctcgagtgcttataatactgcggagtcgtgtcgttcgacaccgctaaccgtggatcggagtcccgactctagtctgcccagggtaataaacctcaccaacaaaaaaaatctgcggagcacgatggcagcaacccaaagttccagtggacaatctagtaaagagtctactagtaccaaagcaaaaactacagagcaaggctgctctgccgagagcaaggagaaagtcttagagggcagtaaactgcccgaccaggaaaaagcagtcagcgagcacatcccttacctctccccttaccatagcagctcctaccgctatgctaacatcccagctcacgcccgtcattaccagagctacatgcagttaattcagcaaaagagcgcagtagaatatgcacagtctcagctgtctttggtgtcaatgtgcaaggaatcacagaagtgcagcgaaccaaaaatggaatggaaggtcaaaatcagaagtgacggaactaggtatataaccaagcgacccgttcgggataggatcctgaaggagcgagcacttaaaattaaggaagaaagatccggcatgactactgacgatgataccatgtcagagatgaaaatgggtcgatattggtctaaggaagaaaggaagcagcacctcgtccgagcaaaggagcagcgcagaagacgtgaatttatgatgagatcccgactggagtgcctgaaggagagcccgcagtcaggctccgagggcaagaaagagatcaatattatagagctgagccataaaaaaatgatgaaaaagcgaaataaaaagattctggacaattggatgacgatccaggagttgatgacgcatggggctaagtcccccgacggcacaagggtacacaacgccttcctgagcgttacaacagtatag

SEQ ID NO: 234240 - DNA, 1158 bp, Artificial Sequence
  Description of Artificial Sequence: Synthetic coding sequence
atgaaattagtcagaaaaaacatcgagaaggacaacgcaggacaagtgactctcgtacctgaggaacctgaagacatgtggcatacctacaacctcgtccaggtgggtgatagcctgcgggctagtactatccgcaaggtgcagaccgaaagcagtacaggttccgtgggctctaaccgcgtccgcaccacactgaccctatgtgtggaggctatcgactttgactcccaggcttgtcagctgagagtgaaaggcacgaacatacaggagaacgagtacgtgaagatgggggcttaccatactatagaactagagccaaatcgccaattcaccttagccaagaaacagtgggattccgtcgtgctcgaaagaatcgagcaagcttgcgatccagcatggtcggctgatgtggccgctgtcgtaatgcaggaaggattggctcacatttgtctggtgactccgtccatgaccctgacacgggcaaaagtggaggtgaacatcccgagaaaaagaaaggggaactgttcccagcatgatagagccctcgaaaggttctacgaacaggtggttcaagccatccaaagacacattcacttcgacgtcgtcaagtgtattctcgtcgcttcaccgggttttgtgcgcgaacaattctgtgactacctattccagcaggccgtcaagacagataacaagttgcttctggagaataggtccaagtttctgcaagtgcatgctagttccgggcataagtacagtctgaaagaagcgctctgtgacccaacagttgccagccgactgagcgatacgaaggctgcaggtgaagtgaaagctctggatgatttctacaagatgctccagcatgagccagacagggcgttctacggtttaaaacaggtagagaaagctaatgaggccatggctattgatactctgctcatcagcgatgaactatttcgacaccaggacgtggctaccaggtcacgatatgtgcggctggtggacagtgtgaaggagaatgcgggtaccgttaggatcttctcaagtctacacgtgtccggggagcaattatcacagctcacgggggtggctgcaatcctgagattccctgtgccagaactaagcgaccaggagggagatagtagctccgaagaggattag

SEQ ID NO: 234241 - DNA, 855 bp, Artificial Sequence
  Description of Artificial Sequence: Synthetic coding sequence
atggcaagctacccatacagacaaggatgtccgggagctgccggacaggcgccaggagctccccctggcagttactatcccggtccccctaatagcggtggacagtacggatcagggctccccccaggaggcggatacgggggtcccgcacccggtggtccttacggccctcctgctggcggtggcccttatggccacccgaaccctgggatgtttccttcagggacacccggaggcccttacgggggagctgcccctgggggtccgtatggacagcccccacctagtagttacggcgctcagcagcctggattgtatgggcaaggaggagctcccccaaatgtagaccccgaggcatacagttggtttcaatccgtcgatagcgaccactctggatacatttcaatgaaggagttaaagcaggcgctcgttaactgtaactggtcttcattcaacgatgagacctgcctgatgatgattaacatgtttgataagacaaagagtggcagaattgatgtatacgggtttagtgctctgtggaagttcattcaacagtggaagaatctgttccaacagtatgaccgcgatcggtccgggtctatcagctatactgagttacagcaggccctctcccagatgggatacaacctgtccccccagttcacccagctgctggtgtccagatattgcccaagaagtgcaaacccagccatgcagttagaccgattcatacaagtgtgtactcagcttcaagtgctaacagaagcattcagggagaaagataccgccgtacaaggtaacatacggctttccttcgaggattttgttacaatgaccgcatctcggatgctgtag

SEQ ID NO: 234242 - DNA, 423 bp, Artificial Sequence
  Description of Artificial Sequence: Synthetic coding sequence
atggcttcttacccttatcgccagggatgcccaggagctgcaggtcaagcgccaggggctcccccaggttcttactaccccggacctccaaattccggcggtcagtacggctccgggttacctcccggtggaggatatggaggtcctgccccaggaggcccttacggacctccagcaggaggcggaccctatgggcaccctaatcctggaatgtttccatcgggcacccctgggggaccatacggaggtgccgctcctggtgggccttacggtcagcctccaccttcctcctatggcgcacaacagcccggactttacggccaggggatccacgctgagggagccgctcctgtctgggacatgctgagtctctggcaacgcgagggcgctggcgagcttgcccgtatgcataacgcatcctag

SEQ ID NO: 234243 - DNA, 1146 bp, Artificial Sequence
  Description of Artificial Sequence: Synthetic coding sequence
atgcatctcttagccatactgttttgcgcgctctggagtgccgtcctcgctgaaaattccgatgattatgatttaatgtatgtcaatctggataacgagatcgacaacggtctccaccccacggaggacccaactccttgcgcgtgtgggcaagagcacagtgagtgggataagctgttcatcatgcttgagaactcccagatgcgggaaagaatgttgctgcaagcgaccgacgatgtgcttaggggagagctgcagcgactgcgggaggaattggggaggctagctgaaagcttagcccgtccctgcgcgccaggcgcaccagccgaggctaggctaacctctgcacttgacgagcttttacaggctacaagagatgccggtcggcgactggcacggatggagggggcagaggcgcaaaggcctgaggaagctggtcgggctctggcagctgtactggaggagctgcggcagacgagagcagacctccacgctgtccagggatgggccgctaggtcctggctccccgcaggctgcgagaccgctatcctcttccctatgcggtctaagaagatcttcgggtccgtgcaccccgttcggcctatgcgcttagagagtttcagcgcatgcatttgggtaaaggccactgacgtgctcaataagaccatcctgttttcatacggcacgaagcgcaatccatacgaaattcagctgtatctgtcctaccaatcaatcgtctttgtcgtcggaggtgaggagaacaaattggttgcggaggcaatggtgagtctcggcaggtggactcacctgtgtggcacatggaatagcgaagaaggcctgacctccctctgggtcaacggagagctggccgctacaacagtggaaatggccacagggcacattgtaccggagggcggtatcctgcagatcgggcaggaaaagaatggctgctgcgttggtggtggctttgacgagacacttgccttctctggcaggctgactggttttaacatttgggattccgtcctgagcaacgaggaaatcagagaaactgggggagcggagtcctgtcacatcagagggaacattgtgggctggggcgtgaccgagatccagcctcatggtggcgctcaatatgtgtcgtag

SEQ ID NO: 234244 - DNA, 1422 bp, Artificial Sequence
  Description of Artificial Sequence: Synthetic coding sequence
atgggttcaggcaattgggaggtcactggcccaccgtgtggatcgcgctgcgagcgtccacccggtcttcctcgcggagtgcacggccaattccggtcagccgtcggcctgtcggggttgcggtggtttagacgcttccaggaagtgacctggacacacctgcagaacatcgccagcaattacaacgtcagctacaatgtggacgtgcggtttaggtccttagctgaagaatcacaggcggtggcccaggcagtgaaccgttcccaagcatccgttcagggagagcttgctcaactaaaggcctgggttcggaagctgcaacggagaggaagaaaagtggacactcgactgagagcgctggatctcactcttggcgaacgctctcagcagcgcgctagggaaaggaaagcacataaagcgcagcgggatgcattacaagactcactcgccaggctggagggcctggtccactctcaaggggcaagattggctgcattagaagggaggctccctgtggctcaccctgggactgcggctctgggcccagccctagtgcccacacctacacaacctgaggaactcggtccaacgagcctaaagctacagagagatcgtcaggagttaagggccgcttcagaacatagaggcccacctcaggattcttctgcgcctctacagggcaggcgcgagcctcccgctagtgggtctcacagggtgttgagtggaactgcccctaaggacccacgacaacaggcttggtcaccacaggtgcccggagagatttgcggtgtggggcctacgctcgtatttccgaacgcctccactaggaacgtcgtattcttaagtcctgggttcgtgactgcactgagggcactctcattttgcagttgggtgcgaacggcttccggacgtttaggcacactgttatcttacgccactgaggataatgacaacaagctggtgttacacggtcgtgatagcctgctacccggatcgatacactttgtgataggggatccggcatttagagaactgcctctgcagctgctgcttgacgggcaatggcaccatatttgcgtgatctggacttccactcaagggaggtattggctgcacgtcgatcggaggctggtcgccaccgggagccgctttagagagggctacgagattccacccggtggatcgttagtgttgggccaggaacaggacagcgttggagggggattcgactctagcgaggccttcgtcggctctatgtccggcctggccatctgggatcgggcattagtccccggagaagtggccaacctggccatcggcaaagaatttccaaccggagccatactgacgctagccaacgctgccctggcgggaggatttgtgcagggcgcaaactgtacttgtcttgaaagatgcccttag

SEQ ID NO: 234245 - DNA, 1437 bp, Artificial Sequence
  Description of Artificial Sequence: Synthetic coding sequence
atgggttgcagttggaggaagacactcagtttcttcctcgtgttcgttcctatttatctccacggggcttcaagccaagaagcggctcccgtgggcccacgtaagccattcttcgaacgcctgcgccgtctagaggagcagttcaggcggttccaggaagtcacatggactcacttacagaacattgctagtaattacaacgttagctacaacgtggacgtcaggtttcgcagcctagcagaagagagccaggccgtggcacaagctgtaaatcggagccaggcctcggtgcagggtgagcttgcacagctgaaagcttgggtgcgtaagctgcagcggaggggacgcaaggtagatactaggctgcgggctctcgatttaacccttggggagaggagtcagcaaagggcccgtgagaggaaggctcacaaggcacagcgcgacgcgctccaggactctcttgccagactggaaggattggttcactctcaaggggctcgccttgccgcattggagggtcgtctgcccgtggcacaccctgggacagctgcactcggaccagcattggtaccgacacccactcagcccgaggagctggggcctacctcactgaagctccagcgtgatcgccaggagctgagagctgcaagcgagcatcgcggacccccacaggactcctcggctccactgcagggtcgaagggagcctccagccagtgggtcccatagggtgctgagcgggaccgcccctaaggatcctaggcagcaggcttggagtcctcaagtacctggcgaaatttgcggggtcggacccaccctggtttttcccaacgcatctaccaggaatgtggtgttcttaagcccagggttcgtgaccgctttaagagccctctcattttgcagctgggtacgaaccgcctccggaaggttgggaacactgttgtcttatgccacagaagacaacgacaataaactggttctccacggcagagattctctgcttccaggctccattcactttgtcattggagatccagcgtttcgggaactcccgctccaacttctgctcgacgggcaatggcatcacatatgtgtcatctggacatctacccagggacgttactggttgcatgtggaccggcgactcgtagcaacgggaagtaggttccgggaagggtatgaaattccaccagggggttccctggtactgggccaggaacaagacagcgtgggagggggatttgattcttcagaagctttcgtgggatccatgtcagggctagccatttgggatagagcccttgttcccggagaagttgctaacctggcaatcggtaaggagtttccgaccggcgcaatattaacactcgccaacgctgcattggcaggcggttttgtgcagggtgccaactgcacatgtcttgaaaggtgcccttag

SEQ ID NO: 234246 - DNA, 1167 bp, Artificial Sequence
  Description of Artificial Sequence: Synthetic coding sequence
atgaaatggctacttctcctgggtctcgtggccttgagcgaatgtataatgtataaggtgcctctgatacgcaagaaatctctaagacgcaccctgagtgaacgcggtttgcttaaagactttctgaaaaaacacaacctcaatccagccagaaaatatttcccccaatggaaggctccaacactagtggatgagcaaccactagagaattaccttgatatggaatactttggcaccatcgggattggtaccccagcccaagacttcaccgtcgtttttgacaccggctctagcaatttatgggtcccgtctgtttactgttcgtccttagcttgcaccaaccacaatcggttcaatcctgaagattcctctacctatcagagcacaagcgagacagtaagcataacctacggcacagggtccatgacaggaatcctcgggtatgatacagtgcaggtaggaggtataagtgatacaaatcagatcttcgggttatccgagaccgagcccggttcctttctgtactatgcaccatttgatgggatattgggcctggcgtatccctctatctcatcctcgggggcaacacccgtgttcgataatatatggaaccaagggctggtgagccaggatctgttttccgtctacctctctgcagatgaccagtctggatccgtcgtgatattcgggggaatcgacagctcctattacacaggatctctcaattgggtcccggtgactgtggagggttattggcaaattaccgtggatagcattacaatgaacggtgaagccatcgcttgtgcggaaggttgccaagcgattgtcgacacagggacaagtctgctgaccgggccaacatcccctatagccaatattcaatccgacattggggcaagcgagaattctgacggcgatatggttgtgtcatgcagtgccataagctccctgccagatattgtgtttaccatcaacggtgtgcagtacccagtaccaccctctgcctacattctgcaaagcgagggcagctgcatctcggggttccaaggaatgaaccttccgactgaatccggcgaactgtggattctgggagatgtgttcatcagacagtattttaccgtgttcgatagagctaataatcaggtgggactcgcgcctgttgcctag

SEQ ID NO: 234247 - DNA, 849 bp, Artificial Sequence
  Description of Artificial Sequence: Synthetic coding sequence
atgaagtggctacttctgttgggtctggtggcgctgtctgaatgtataatgtacaaagtccctctgataagaaaaaagagcctgagaaggactctctctgaaagagggctgctgaaagacttcttaaagaagcataacctgaatcctgcccgtaaatattttcctcaatggaaagctcccactctcgtggacgagcagcctttggaaaattacttggacatggagtatttcggcactatcggaatcggcacaccagcacaagatttcactgtggtgttcgatacaggaagttccaatttatgggtgccctccgtttactgctccagcctggcatgcacaaatcataaccgctttaaccctgaagactcaagcacttatcagtcaacgtccgagacagtgtctataacctacggcacgggatccatgacaggcatcctcgggtacgatacagtccagacagtggccatctggcgctctgctgctatgggactggtgagccaagacctgttctctgtgtatctgtcagcagatgatcagagtggaagtgtcgttatcttcggaggtatagatagctcttactacacgggatcactcaactgggtgcccgtaacagtggagggctactggcagataaccgtcgattcgataacaatgaacggagaagccattgcgtgtgccgaaggctgccaggcaattgtggatacgggcactagcctgctgactggacctactagtcctatagcaaacattcagtctgacataggcgcaagcgaaaactccgatggcgatatggtcgtgtcctgttctgctatttctagtctgcccgatatcgtgttcactatcaattag

SEQ ID NO: 234248 - DNA, 750 bp, Artificial Sequence
  Description of Artificial Sequence: Synthetic coding sequence
atgaccggcatcctgggatacgatacagttcaggtcggtggtatcagcgacacgaaccagattttcggactctccgaaactgagcctggcagttttctgtattacgcaccattcgacggcattctcggcttagcgtaccccagtatcagctcttctggagcaacaccggtatttgacaatatttggaaccagggactggtgagccaggatctcttctctgtttatctgtccgccgacgatcaatcaggcagtgtggtgatattcggcggtatagattcatcatattacacaggctccctgaactgggtgccagttactgtggagggctactggcagattaccgttgactccataaccatgaatggcgaagcgatagcttgtgccgagggctgccaggccatcgtcgacacggggactagcttgctcactggacccacttcacccatagccaatatccaatctgatattggcgcttctgagaactctgacggcgacatggtcgtgtcttgcagtgccatctcctccctaccggacatcgtctttaccatcaatggggtgcagtatcctgttcctccgtctgcctacatcctgcaattgccttctgagggctcctgcatttcaggctttcagggaatgaacttacccacagaatctggcgagctatggatactcggtgacgtgtttattaggcagtactttacggtcttcgatcgcgcaaacaaccaggttggactcgctcctgtggcctag

SEQ ID NO: 234249 - DNA, 1167 bp, Artificial Sequence
  Description of Artificial Sequence: Synthetic coding sequence
atgaagtggctgctgctattgggcctcgtggccctatcagagtgcatcatgtacaaggtgccgctgattagaaagaaatcactgcgtcgcacacttagtgaacggggacttctgaaggacttcctgaagaaacataatttaaatccagctcgcaagtactttcctcagtgggaggccccaacactggtagatgaacaacctttagaaaattacctcgacatggagtatttcgggacaatcggtattggcacacctgcacaggatttcaccgtcgtgttcgacaccggctcttcgaatctatgggtcccctctgtgtattgctcctccctggcctgtactaaccacaatcgctttaatcccgaggactcttctacttaccagagcacctctgagacagtaagcattacctatggaaccggcagcatgaccggcattctcggatacgataccgtgcaggttggcggaatttcagatactaatcaaatttttgggctgtcagaaacagaacctggctcattcctgtattacgcgccttttgatggcatactgggcttggcttatccgagcatttcgtcctctggtgctactccagtctttgataacatctggaaccagggtctggtgtctcaagatctgttcagtgtttatttgtctgctgacgaccagagcgggtctgtggttattttcggcggaatcgactcttcgtactatacaggtagcttaaactgggtacccgtgacagttgaaggatattggcagattaccgtcgattccataacgatgaacggcgaagcaatagcctgcgcagagggttgtcaggccatcgttgacacagggacaagtcttttgacagggcctacctcacctattgctaatatacagtctgatattggcgcttcagaaaatagcgatggggacatggtagtgtcctgctccgccatatcctcactgcccgatatagtgtttactatcaacggggtgcagtaccctgtgcccccttccgcctacatcctgcagagcgagggcagctgcatctccggatttcagggcatgaacttacccaccgagtcgggtgagctgtggattctcggagatgtgtttattaggcaatacttcaccgtgtttgaccgggctaataaccaggtcggactggcgcctgtggcgtag

SEQ ID NO: 234250 - DNA, 1167 bp, Artificial Sequence
  Description of Artificial Sequence: Synthetic coding sequence
atgaagtggctgctgctgcttggcttagtggctctcagcgagtgtattatgtacaaagttcccctgatacggaagaagtccctgaggcgaacactgagcgaacgcggtctattaaaagacttcctgaaaaagcacaacttgaatcccgcacgaaagtatttcccgcaatgggaggcaccaacactggtggatgagcagcccctagagaactatctggacatggagtactttggcacaatcggcatcggcacaccagcgcaagatttcaccgtggtgttcgataccggttcctcaaacctctgggttcccagtgtgtactgttcttccctggcctgtactaatcacaaccgcttcaaccccgaggacagttccacctatcagtccacctctgagaccgtttcaattacttacgggaccggatccatgaccggtatcctcggttacgatacggtgcaagtgggcggaatctctgatacaaaccagatctttggtttgagtgagacggagccagggagcttcctgtactacgcacccttcgacggaatcctaggtttagcctacccctcaattagctctagcggtgccactcctgtgttcgataatatctggaaccagggcctggtcagtcaggacctgttctctgtgtacctgagcgcggacgacaagagtgggtccgtggtcatttttgggggaatcgacagctcttattacactggcagtctaaattgggtgcccgtcaccgtcgagggctattggcaaatcaccgtagacagtattaccatgaatggggagaccattgcgtgtgctgaggggtgccaggcaatagtagatactgggaccagcctcttaactggcccaacgagccccattgctaacatccagagcgatattggtgcatctgagaacagcgacggcgatatggtggtgtcatgttccgctattagttccctacccgatattgtcttcacaattaacggggtgcagtacccggtgccaccctcggcttacatcctccagagcgagggcagttgtatctcaggctttcaaggtatgaatgttccaacagaaagtggggagctgtggatcctgggggatgtcttcattagacagtacttcactgtgttcgaccgggcaaacaaccaagtgggtctggctccggtcgcttag

SEQ ID NO: 234251 - DNA, 849 bp, Artificial Sequence
  Description of Artificial Sequence: Synthetic coding sequence
atgaagtggctgctccttttaggccttgtcgccctgagtgaatgtattatgtataaggtgcctctgatccggaaaaagagtctaaggagaaccttgtctgaacggggactgctcaaagatttcctgaaaaagcataacctgaatcctgctcgcaagtactttccacagtgggaagctccaaccttggtagacgagcaaccactggagaattatctggatatggaatattttgggaccataggtattggtactcccgcacaggattttactgtagtctttgacaccggtagcagcaatttgtgggtgccatctgtttactgttcaagccttgcttgtacaaaccacaacagatttaacccagaagactcatccacctaccagagcacctccgagacggtatccatcacctatggaaccggatcaatgacggggatcctcggatacgacaccgtgcagacagtggccatttggcgctctgccgcaatgggccttgtgtcccaggacctgttctccgtttatctaagtgcagatgatcaatctggatctgtggtgatttttgggggaatcgacagcagctactatacaggaagcctcaattgggtgcccgttacagtggagggatattggcagatcacggtcgatagtatcaccatgaatggagaagccattgcctgtgccgaggggtgtcaggctatcgtggatactgggacaagtctgcttacaggcccaacctccccaatagccaacattcagtcagacataggagcatctgagaactccgacggcgacatggtggtttcctgttccgcgattagcagtctgcctgatattgtcttcacaatcaattag

SEQ ID NO: 234252 - DNA, 750 bp, Artificial Sequence
  Description of Artificial Sequence: Synthetic coding sequence
atgaccggaatccttggttatgacacagtgcaggtgggcggaatttctgatacaaaccagatttttgggctgtcagagacagagcccggatcctttctgtattatgctccattcgatggcatcctcggcctggcttaccctagcataagctcgtccggagcaactccagtgttcgacaacatctggaatcagggcctggtttcccaggatcttttcagtgtatacttaagcgccgacgatcagtctggtagcgtggtgatcttcgggggtatagattcatcctattatacagggtccctaaattgggtgccggtgacagtggagggctactggcaaattacggtcgacagtatcacaatgaacggcgaagccatcgcttgcgctgaaggctgccaagcgatcgtcgacacaggtacctctttgcttaccggcccaacatcgcccatcgctaacattcagtctgacattggtgccagcgagaattcagatggggacatggtcgtgagttgctcagccatttcatcacttccggatattgttttcacaattaacggcgtacagtatccagtccccccttctgcttacattttgcagttgccctccgaagggagctgtatctcaggtttccaaggtatgaatttaccaaccgagtcgggcgagctgtggatcctgggagacgtgttcatcaggcagtacttcaccgtgttcgatcgcgctaacaaccaggtgggcttggcccctgttgcatag

SEQ ID NO: 234253 - DNA, 1167 bp, Artificial Sequence
  Description of Artificial Sequence: Synthetic coding sequence
atgaaatggctactactgcttgggctcgtggccctctccgagtgtatcatgtacaaggtccccctgatacgaaagaaatctcttagaagaactctttctgaaaggggcttgcttaaggatttcttaaaaaagcacaacctgaaccctgctcgcaaatatttcccccagtgggaggcacctactctggttgacgagcagccactggaaaactacctggacatggaatacttcgggacgattggcattggtactccggctcaagactttacagtggttttcgatacaggtagtagcaatctctgggtgccctccgtgtattgtagctctcttgcatgcaccaaccacaacaggtttaatcccgaagacagctccacctaccagtctacatcagaaacagtgtcaattacatatggcacaggatccatgacagggatactgggatacgacacagtccaggtaggcggtatatccgacaccaaccagatatttggactcagtgagaccgaaccaggtagcttcctttattatgcaccttttgatggcattctaggcctggcctacccatccattagttccagcggggcaacacctgtgttcgataatatttggaaccagggattggtctcacaggacctgttttccgtctacttgagcgccgacgacaaaagcggctcggtcgtgatctttggagggattgactcaagttattacaccggatctctgaactgggtgcctgtgacagtcgaaggatattggcagatcactgtggatagcattaccatgaacggcgaaacaattgcatgcgccgaaggctgccaggccatcgtagacacaggtacctcacttctgaccggccctacctcccctatagccaacatccaaagtgacataggagccagcgagaatagtgatggcgacatggtggtctcatgctctgcaatttctagtctacctgacattgtgttcacgatcaacggagttcagtatcccgtgccccctagcgcctacattctgcaatccgagggatcctgcatcagtggttttcaaggtatgaatgtccctaccgagtctggagagctgtggatactgggcgacgtctttattcggcagtacttcacagtgtttgacagggccaataatcaagtcggactcgctcctgtggcttag

SEQ ID NO: 234254 - DNA, 849 bp, Artificial Sequence
  Description of Artificial Sequence: Synthetic coding sequence
atgaaatggctactgctgctggggctggtggcattgagtgaatgtattatgtacaaagtacccttaatcaggaagaagagcctccgtagaacactatctgagcgcggactgttaaaggatttcctgaagaagcacaatctaaatcctgctcgcaagtattttccgcaatgggaggcacctactctagtcgatgaacagccactggagaactatctcgacatggagtactttgggaccataggcattggaacacccgctcaggatttcacagtagtgtttgataccggttccagcaatctgtgggttccatctgtttactgttccagtcttgcgtgtaccaatcacaaccgctttaacccagaggattcatcaacgtaccagtccacctcagaaactgtgtccatcacatacggcaccggatccatgactggtatactagggtacgacactgtgcagacggttgcaatatggcgttccgctgctatgggactagtcagccaggatttattcagcgtatacttgagcgccgacgataagagtgggagtgttgtcatcttcggaggtatcgactccagttattataccggctctcttaattgggtgcctgtaacggtggaagggtattggcagattactgtcgatagtatcacgatgaacggggagacaatcgcttgcgccgaagggtgccaagctatcgtggatactggaacttctctgctcactggccctacttctccaatagcaaacatccaatcagatatcggcgctagtgagaactcagacggagacatggtagtcagttgcagcgccatttcctctcttccagatatcgtgttcaccatcaattag

SEQ ID NO: 234255 - DNA, 750 bp, Artificial Sequence
  Description of Artificial Sequence: Synthetic coding sequence
atgacaggcattttaggctatgacactgtgcaggtgggagggatttccgatacgaatcaaatcttcggtctctcggaaacagagcctggcagcttcctgtattatgctcccttcgacggcatcctgggccttgcctacccgtcaatatcttccagcggcgctacccccgtgttcgataacatctggaaccagggtctcgtgtctcaggacctgttttctgtctacctgtcagctgatgacaaaagtggcagtgtggttattttcgggggaatagatagttcctattacaccggctctctgaattgggtgccggtcacagtggaggggtactggcagattactgtcgacagcatcactatgaacggagagactatcgcctgtgccgaggggtgtcaggccatcgttgataccggaacatctcttctgacgggacccacaagcccaatagcaaatattcagtcggatattggggcatcagagaatagcgacggcgatatggtggtaagctgttccgccatcagctctttaccggatattgtgtttacaattaacggggttcagtaccccgttcccccatcagcttatatcctgcaattaccaagtgagggcagttgcatcagtggcttccagggtatgaatgtccccacggaatccggcgaactttggatcctgggggacgtctttattcggcagtattttacagtcttcgatagagcaaataaccaagttggcttagctcccgtggcgtag

SEQ ID NO: 234256 - DNA, 1578 bp, Artificial Sequence
  Description of Artificial Sequence: Synthetic coding sequence
atggccgcagtggtgttagcagctaccagactcctgagaggatccgggtcctggggatgtagtcggctgcgcttcggtcctccggcatatcggcgtttcagctctggaggcgcttatccgaacatcccgttgtcaagcccgctccccggagtaccaaaacctgtctttgccacagtggatggtcaggaaaagttcgagaccaaagtaacaacgctggacaatggcctgcgggttgcgtcacagaacaaattcggccaattttgcaccgtgggtattttgatcaactccgggagcagatacgaagcaaaatatctaagcggcatcgctcattttcttgagaaactggcattcagctccacagctcggttcgattccaaagacgaaatcctgctgacgcttgaaaaacacggaggaatatgcgactgtcagacaagcagagacactactatgtatgccgtgtccgccgacagtaagggcctcgataccgtcgtggctttgctagcagacgttgtgctgcagcccaggttaacggacgaggaggtggagatgaccaggatggcagtacagtttgaacttgaggatctgaacctcagacctgacccggagcccctgctcaccgaaatgatacatgaggctgcgtatcgcgaaaacacagtgggtctccaccggttctgcccaactgagaacgtggcaaagatcaatagggaagtcttacattcttatctgcgcaactactacacccctgaccggatggtgcttgcaggcgtgggagtagagcacgaacatctggttgattgtgccaggaagtatctgctgggggtccagcctgcttggggatccgccgaggctgtggacatcgacagatctgtcgcacagtacactggagggattgctaaactcgagagggacatgtccaatgttagtctcggccctactcctatccccgagttgacccacatcatggtgggcctggaaagctgcagctttcttgaagaagatttcatccccttcgccgtgctgaacatgatgatggggggaggcggatcctttagcgccggtgggccaggaaagggtatgttcagccggctgtatcttaacgtgctcaatcgccatcattggatgtacaacgcaacctcataccaccattcttacgaggacaccggcttgctgtgtatccacgctagtgcagatccacgccaggtccgagagatggtggaaattattactaaggagtttattctcatgggaggtaccgtagacaccgtagagctggaacgcgcaaaaactcaactcactagcatgctcatgatgaatctggagtcacgcccagtgatcttcgaggacgtgggtcgccaagtcttggcgaccagatcccggaagctgcctcacgagctgtgtaccctcatcaggaatgtgaagcctgaagacgtgaagcgggtagcatctaagatgctgagaggaaaacccgctgtggcagctctgggcgatctgaccgaccttccgacctacgagcacattcagaccgccctgagttccaaggatggccgtctgcctaggacctacagactgtttcggtag

SEQ ID NO: 234257 - DNA, 441 bp, Artificial Sequence
  Description of Artificial Sequence: Synthetic coding sequence
atggctgctgtcgttttggctgcaaccaggctcttacggggtagcggatcatgggggtgctcccggttgagatttggacccccagcatatcgtagattctcatcggggggtgcataccccaatatcccgctgtcaagccccttgccgggagtccctaagccggtcttcgcaacggttgacggacaggaaaagttcgaaaccaaggtgacaacattggacaatggattaagagtcgcatcccaaaataaatttgggcaattctgcacagtgggaatcctcatcaacagtgggagtaggtacgaggcaaagtatctgtccgggattgctcacttcctggaaaaacttgctttctcatcaaccgctcgattcgactccaaggacgaaatcctactgaccctggaaaaacatgggggaatctgcgactgccagaccagcaggtag

SEQ ID NO: 234258 - DNA, 1185 bp, Artificial Sequence
  Description of Artificial Sequence: Synthetic coding sequence
atgaaacgaaacactttagtggaacttcttaccttttggaaaaattggcactttcggctgcttctggacctcacagctaaaatgaagttctgcttgcggtggaaaagcatgggcgtttcggtgaccgcccgacaccaggatgaggaagttgaaatgacccgcatggcagtgcagttcgaactggaagaccttaaccttcgtcctgaccccgagcctctgttgactgagatgatacacgaggccgcatatagagagaacacggtcggattgcaccgtttctgccccactgagaacgtagccaaaataaacagagaagttctccattcttatctgcggaactactacacacccgataggatggtgctggccggtgttggagtcgagcatgaacaccttgtcgactgcgccagaaaatacctgctgggcgttcagcctgcttgggggtctgccgaggcagttgacattgaccgcagtgtcgctcagtacaccggtggcatcgcaaaattggagagggacatgtcaaatgtcagtctgggcccaactccaataccggaactgactcatatcatggtgggtctcgagagctgtagttttctcgaagaggatttcatacccttcgctgtattgaacatgatgatgggtggcggaggctcttttagcgcagggggaccaggaaaaggcatgttctctaggttgtacctgaatgttctgaatcgccaccattggatgtataatgctacatcttaccatcattcttacgaagatactggacttctgtgtattcacgcctctgcagacccacgccaggtgcgagaaatggtcgagattatcactaaagagttcattctcatgggaggaactgtggacacagttgagctggagagagcaaagactcagctgactagtatgttgatgatgaacctcgagagcaggcccgttatctttgaggacgtgggacgccaggtactcgctacaaggtctaggaagttgccccacgaattatgtacccttatccggaatgtcaaacccgaggatgtgaagagagtggccagtaaaatgttacgaggcaagccggctgtggccgctctgggcgatctcacagacttgccaacctacgaacatatacagactgccctctcttcgaaagatgggcgtcttcccaggacgtacagacttttccggtag

SEQ ID NO: 234259 - DNA, 816 bp, Artificial Sequence
  Description of Artificial Sequence: Synthetic coding sequence
tacaccggcggaatcgcgaaactggaaagagacatgagtaacgtgagcctaggcccaacgcccatccctgaactgacccacattatggtcgggctcgagagctgcagcttccttgaggaagatttcatcccttttgcagtcctgaatatgatgatgggcggaggtggctcctttagcgcagggggaccaggtaaaggtatgttctcccggttgtatctaaatgtgctgaataggcatcactggatgtacaacgccacttcctaccaccattcttatgaggacacgggcctgctctgtatacatgcctctgcagacccaagacaagttagagaaatggttgagattataacgaaggagttcattctaatgggagggacagtggacactgtggaactcgaaagagctaagacccagctaacttccatgctgatgatgaacctggaatctaggcctgtgattttcgaagacgttggcagacaggtattggcaactcgatcacgcaaattgccacatgagttatgcactctcatccgcgaatatagacggggtagtgagggtctgccacaggcaagtgcccgactgcgcggagggagactggccctgccgcaggccgtggtaggactgtggtatgtgcaccacactcagaacctggggcctagcccagtggtgctttcgaggggtgggcagggacagggccgaggggtcgcagatctcgtgtctttgcccggacccaccatgcacctattgccaccttggcaggtaaccccgccaagcgcaccccttggtggggcagtcacgacagcccagtcatgttag

SEQ ID NO: 234260 - DNA, 1482 bp, Artificial Sequence
  Description of Artificial Sequence: Synthetic coding sequence
atggccgctgcaaccgggccatctttttggctcgggaatgagacactgaaggtgccgctcgctttgttcgctcttaaccggcagagactgtgtgagaggctgcgtaaaaaccctgccgtacaggccggttctattgtcgtcctgcagggcggtgaagagacgcaacggtactgtacggatacaggggtactgtttcgacaggagtcctttttccactgggcctttggtgtgacagagcccggatgttacggagtgatagatgttgacaccggtaaaagtacactgttcgtgccgagactacctgctagccacgccacctggatgggaaagatccactctaaagagcatttcaaagagaagtacgctgtggatgatgttcagtatgtggatgaaatcgctagcgtgctgacgtcgcaaaaaccatccgtgctgctaaccctacggggagtaaataccgactccggatcagtctgcagagaagcctcctttgacgggatcagtaagtttgaggtcaataatacaattctgcatcctgaaattgtggagtgtcgcgttttcaagactgatatggaattggaggtattgcgttataccaacaaaatctccagcgaggcacaccgcgaggtcatgaaagccgtcaaagtgggcatgaaagagtacgagctggagtccctatttgaacactactgttacagccgaggcggaatgaggcatagctcttatacttgcatatgcggctccggagaaaattctgccgtactccactacggacacgctggcgcacctaacgataggactatccagaacggggatatgtgcctgtttgatatgggcggtgaatattactgcttcgcttccgatatcacttgttcatttcctgccaacgggaagttcaccgccgaccagaaagccgtgtatgaggccgtgctgagatccagcagggctgtgatgggggctatgaagcccggagtgtggtggcctgatatgcaccggctcgcagaccgcattcacctggaggagcttgcccacatgggcattctctccggcagcgtcgacgccatggtgcaggcacatctcggcgctgtgttcatgccccatggccttggacactttttaggtatcgatgtgcacgatgtgggtgggtaccctgagggcgtggaacgaatcgacgaaccgggactgagaagtttgagaacggcaagacatcttcagcctgggatggtgttgaccgtcgagccgggtatttactttatcgatcacctgctcgatgaggccctggctgatcccgcacgggcttcgttcttgaacagggaggtcctacagagattcagaggttttggcggtgttaggatcgaagaagacgtcgttgtaaccgattccggcatcgagctccttacatgtgtgcccagaactgtcgaagagatcgaagcttgtatggctggctgcgacaaggcctttactcccttttccggtcctaaatag

SEQ ID NO: 234261 - DNA, 1359 bp, Artificial Sequence
  Description of Artificial Sequence: Synthetic coding sequence
atggcagctgctacaggaccaagtttttggctcgggaatgaaactcttaaggttcccttggccctgttcgccctgaatcgccagagactgtgcgaacggctccgcaagaaccccgctgttcaggcagggtcaattgttgtgcttcagggtggggaagaaactcagcgctactgcacagatacaggagtcctctttcgtcaagagtccttttttcactgggcctttggcgtcacagaacctggatgctacggagtgattgacgtagatacgggcaagagtactcttttcgtccccagacttcccgcttctcatgccacctggatgggaaagattcactcaaaagagcactttaaggagaagtatgctgtcgatgatgtacagtacgtggacgagattgccagtgtgctcacgagccagaaaccctctgtcctgttgactttgcgaggtgtgaacacagattctggatccgtgtgccgagaagcttccttcgacgggatcagcaagttcgaagtgaacaacactatcctgcacccggagattgtggaatgcttgtttgaacattactgttactcaagaggtggaatgcgtcactcctcatacacctgcatctgcgggagcggcgaaaattcagcggtactgcactacggacacgcaggggctccaaatgatcgcactattcagaatggggacatgtgtctgtttgatatgggcggagagtattactgtttcgccagtgatatcacgtgcagttttcccgctaatggaaaattcacagccgatcagaaagctgtgtacgaagccgtcttgcgcagctcgcgcgcagtcatgggagctatgaagccaggggtctggtggcctgacatgcacagacttgccgatagaatacacctggaggagctggcacatatgggcatcttaagcggatctgtggatgccatggtgcaggcacacttaggtgccgtatttatgccccatggtctaggccacttcctggggatagacgttcacgatgtgggaggctacccagaaggcgtagaaagaatcgacgaacccggactgaggtctcttcgcacagccagacacctacagcctgggatggttctgaccgtagaaccaggaatatactttatagaccacctgctggatgaagccctcgctgatcccgctcgggcttcgttcctgaatagagaagtgttacaacggttccggggattcggaggggtacgaatcgaggaagacgtggtagtcacggattccggaatcgaattgctgacctgcgtgccacggactgttgaagaaattgaggcctgtatggctggctgcgacaaggcattcacccccttttccggacccaagtag

SEQ ID NO: 234262 - DNA, 1290 bp, Artificial Sequence
  Description of Artificial Sequence: Synthetic coding sequence
atggccgctgcgacaggtccttcgttttggttgggcaatgaaaccctgaaagtccccttagcactcttcgccttgaaccgccagcgactgtgcgagagacttagaaaaaatcctgcggtgcaggcagggtccatagtggtccttcaaggaggagaggagacgcagaggtactgtactgataccggcgtgttgttccgccagatagcttcagttctcacttctcagaagcctagtgtcctgttgactctgcggggtgttaatacagattcgggatccgtgtgtcgtgaagcctcctttgacggcatcagcaagttcgaggtcaacaacacaattctccaccctgaaatcgttgaatgccgagtgtttaaaacggatatggagctcgaggtcttaagatacactaataagattagctccgaggcacaccgagaagtcatgaaggccgttaaagtggggatgaaggagtatgagctggaatcactgttcgaacattactgctactcacggggaggaatgcgacatagctcatacacgtgtatttgtggcagcggagagaattcggcggtgctgcactatggccatgctggcgcaccaaatgacagaacaatacagaatggggatatgtgcttgttcgacatgggcggagagtactactgttttgccagcgatatcacttgttcattccctgcgaacgggaagtttactgccgatcaaaaagctgtgtacgaagccgtcctgcggtctagcagggccgttatgggcgcaatgaagcctggcgtctggtggcctgacatgcataggctggccgacaggattcatctcgaggagttagctcacatgggtattttatctggctccgtagacgccatggtccaagctcacctcggggcagtgttcatgccacatggtttagggcactttctggggattgatgtgcacgatgtcgggggttacccagagggagtcgagcgtattgatgaacctgggctcaggtcgttgcgcacagcacgacacctgcagcctggaatggtgctgaccgttgagcctggtatatacttcattgaccatctgttagacgaggcgttggccgatccagccagagcttccttccttaacagagaagttctgcagcgattcagaggcttcgggggtgttagaatcgaggaagatgtggtggtgacagattctgggatagagctgcttacctgcgtgcctagaaccgttgaggagatcgaggcatgcatggcgggttgcgataaggcttttactccgttcagcgggccaaaatag

SEQ ID NO: 234263 - DNA, 354 bp, Artificial Sequence
  Description of Artificial Sequence: Synthetic coding sequence
atgcgagccagctccttcctgattgtagttgtatttttgattgctggaacccttgtgctcgaagcggctgtgactggagtccccgtgaaaggacaggataccgttaaaggccgtgtaccattcaatggacaggaccccgtcaagggtcaagtgtctgtgaaaggtcaggataaggtgaaggcgcaggaacccgtcaagggtcccgtgagcaccaagccgggatcatgtcccataattttgattagatgcgctatgcttaaccctcccaataggtgcctcaaagacaccgactgtccaggaatcaaaaaatgttgtgaaggcagttgcgggatggcttgcttcgtccctcagtag

SEQ ID NO: 234264 - DNA, 732 bp, Artificial Sequence
  Description of Artificial Sequence: Synthetic coding sequence
atggcacgcctgtggggtgcgctgtcactatggcccttgtgggctgcagtcccttggggtggtgccgcagccgtgggagtccgtgcctgttccagtacggcagctcccgacggagtcgaagggccagctctgcgacggagctattggcgccatctcaggaggctggttctgggcccacccgagccacccttttcacatgtgtgccaggtcggagatcccgtcctgcgcggagtcgccgcaccagtggagcgtgcccagctgggaggtccagagctgcaaagacttacccaacgccttgttcaggttatgcgcagaaggagatgtgtaggactgtctgctccgcagctaggtgtgccccgtcaggttttagctcttgaactgccagaggccctgtgccgtgaatgcccacccagacaacgggctcttcggcaaatggagccctttcctctgcgggtctttgtcaatccatcactgcgagtgctcgatagccgactcgtcaccttcccggagggatgcgagtccgttgccggatttcttgcttgtgtccctcgctttcaggccgtgcagatttctggactcgatccaaatggagagcaggttgtgtggcaggcgtcaggttgggctgcaagaataatccagcatgaaatggaccacctccaaggttgtctatttattgacaaaatggacagccgaacattcacaaatgtgtattggatgaaggtcaacgattag

SEQ ID NO: 234265 - DNA, 294 bp, Artificial Sequence
  Description of Artificial Sequence: Synthetic coding sequence
atggttttcgtccgacgcccttggccagctctgaccaccgtgcttctcgccctcttggtgtgcttaggggctcttgtggatgcatatcctattaaaccagaagcacccagggaggacgcgagcccagaggagctcaatagatattatgcgagtttgagacactacttaaatctggttacacggcagcgctatgggaagcgcgacggacctgataccctgctgagtaagacgttttttccagacggggaagatcgccctgtcaggagccgcagcgaaggcccagatctatggtag

SEQ ID NO: 234266 - DNA, 1992 bp, Artificial Sequence
  Description of Artificial Sequence: Synthetic coding sequence
atggcccctaaaagagtagtccagctgtctctgaagatgcctactcacgctgtgtgtgtggttggagtggaggcgcatgtggacatccactccgatgttcctaaaggtgcaaactctttccgcgttagtggctctagcggagtagaggtgtttatggtgtacaaccgcacacgcgttaaggagccaatcggtaaagctaggtggcccctcgataccgacgctgatatggtggtctccgtggggacagcctctaaggaactcaaggacttcaaggtcagggtgagttatttcggcgagcaggaggaccaggctctgggacggtctgtcctctatctcactggcgtggacatctctctggaggtcgatactggacgcacaggcaaagtgaagcgatctcaaggagataagaaaacatggcgctggggtcccgagggttacggggcaatcctcctggtgaactgcgatcgggataaccatcgcagtgcagagcctgatcttactcactcatggctgatgtcactggccgatctccaggatatgagcccgatgctcctgagctgcaatggtcccgataagctctttgactcacataagctggtcctaaacgtgcccttctctgactctaagcgggtccgtgtgttctgcgcccgaggcggaaattcactgtctgactacaaacaggtcctaggcccacagtgcctctcctacgaagtggaacgccagcctggtgagcaggaaataaagttttatgtcgaaggcctcactttcccagatgcagacttcttggggcttgtttcactgagtgtgtccttggttgacccaggaacgcttcctgaggttacgttgttcaccgatacagtgggattccggatggcgccttggatcatgactccaaacactcagccgccagaggaactgtatgtttgccgcgtcatggacacccacgggtcaaacgaaaaatttctggaagatatgagctaccttacactaaaggcaaactgtaagctgactatttgcccacaggtggaaaatcgaaacgataggtggatccaggacgaaatggagttcgggtatattgaagcccctcacaagtccttcccagtcgtctttgatagccccagaaaccggggactaaaagatttcccctataagcggatcctgggcccagactttggctatgtcaccagagagatccctttgccaggacctagctctttagacagttttggcaatctcgacgtcagtcctcctgttacggtgggcggaaccgagtacccgctggggaggattcttattgggtcgagcttccctaagagcggtggccgacagatggccagggccgttaggaattttttaaaggctcagcaggttcaggcacctgtggaactctatagcgactggctttccgtgggccacgtggatgagttccttacctttgtgcccacgtcagatcagaaaggatttagactgctgctggcctctccctccgcctgccttaaactgttccaagaaaagaaagaagaaggatacggcgaagctgctcagtttgacggtctgaagcatcaggctaagagatcaataaacgaaatgttagctgacaggcacctacaacgagacaaccttcacgcccagaagtgtattgactggaaccggaacgtgctgaagagagagcttggactggctgagagcgatatcgttgacatcccccagctctttttcctgaaaaatttctatgccgaggcttttttccctgatatggttaacatggtggtccttgggaagtacttaggcatccccaaaccatacggccctatcatcaatggcaggtgttgtttggaggagaaagtgcagagcctccttgaacccctaggccttcactgcattttcattgacgattatctctcctaccacgagcttcaaggggagatccattgtggcacaaacgtacggaggaaacccttccccttcaagtggtggaatatggtcccctag

SEQ ID NO: 234267 - DNA, 537 bp, Artificial Sequence
  Description of Artificial Sequence: Synthetic coding sequence
atggccagggctgtgaggaactttctcaaagcccaacaggtgcaggcacccgtcgaactgtatagcgactggttgtcagtgggccacgtggacgagtttctgacgttcgtaccaacgagcgatcagaagggctttagattgctcttggccagcccctcagcttgcctcaagctgttccaggagaagaaggaggagggatacggtgaggcagcccagtttgacggtttaaagcaccaagctaagagatccattaacgagatgttggcagacaggcacttgcagcgcgataatctccacgcccaagttaacatggtggtcctgggtaagtatttgggcatacctaagccgtacggccctatcattaatggaagatgttgcctggaggaaaaagtccagagcttgcttgaaccactggggctgcattgtatattcatcgatgattatctcagttaccatgaactgcaaggtgaaatccattgcggcacgaacgtgcggcgaaagccgttcccttttaagtggtggaatatggtaccatag

SEQ ID NO: 234268 - DNA, 405 bp, Artificial Sequence
  Description of Artificial Sequence: Synthetic coding sequence
atgctggcagatcgacatctccagcgcgacaacttgcatgcccagaaatgtattgattggaaccgcaacgtactaaagcgcgaattaggcctggctgaatcagacattgtggatatcccacagctattcttcctgaaaaacttctatgccgaggcctttttccctgacatggtcaatatggtggttcttggaaagtacctcgggattcccaagccgtacggcccaatcatcaacgggcgatgttgcctcgaggagaaggttcagagcctgctggaaccacttggactgcattgcattttcattgatgattacttgtcctatcacgaactgcagggggaaatccactgcgggaccaatgttaggcggaagccatttcccttcaagtggtggaacatggtgccctag

SEQ ID NO: 234269 - DNA, 663 bp, Artificial Sequence
  Description of Artificial Sequence: Synthetic coding sequence
atggcccgtgccgttcggaacttcctgaaagctcaacaagtgcaggcacccgtggagctctacagcgattggcttagcgttggtcacgtcgacgagtttcttacttttgtccccacatcagatcagaagggcttcaggctgttactggcttcccctagcgcatgtcttaagctgtttcaagagaagaaagaagaaggatatggtgaagccgctcagtttgatggtctaaagcatcaagctaaacgcagtataaatgaaatgctggcggacagacacctccagcgagacaatttgcacgcccaaaaatgtatagactggaaccgaaatgtgctgaagcgcgagttagggctagctgagagtgacattgtggacatcccacagctgttcttcctgaaaaatttctatgccgaggctttcttccctgacatggtaaacatggttgttcttggcaagtatttgggtatccccaaaccttatggtcctatcattaatggcagatgctgtcttgaagaaaaagttcagtcgctgttggagcccctagggctccactgcatcttcatcgatgattatctgtcttaccacgaacttcagggagagatacactgcgggacaaatgtccgcagaaagccatttccgttcaaatggtggaacatggtgccttag

SEQ ID NO: 234270 - DNA, 1314 bp, Artificial Sequence
  Description of Artificial Sequence: Synthetic coding sequence
atgttgagggagcggaccgtacgccttcagtatggctcacgggtggaagctgtctacgtcctggggacctatctgtggaccgacgtttactccgcagcccctgctggcgctcagaccttcagtctgaagcattccgaacacgtctgggtggaggtcgtgcgagacggagaggctgaagaagtggcaacaaacggcaagcagaggtggctgttgtccccgtcaaccacactaagagttacaatgtcccaggcctcaaccgaggcgagttccgataaagtcactgttaactactatgatgaggaggggtccatccccatcgaccaagcaggcttgttcctcacagccattgagatttcccttgacgtggacgccgaccgtgacggcgtggtcgagaagaacaaccccaagaaagctagctggacatggggtcctgaagggcagggagccattctactggttaactgcgatcgggagaccccctggttgcccaaggaagactgccgtgatgagaaagtttatagcaaggaggaccttaaagacatgtcacagatgatcttgagaacgaaaggccctgatcgcctgccagcgggttacgaaattgtgctctatataagtatgagcgatagcgacaaggtgggcgtgttttatgtcgagaatccgttttttggacagcgctatatccacatcctcggccgtcggaaattatatcacgtggtaaaatacacaggaggatccgctgagctcctcttctttgtggagggcttgtgtttccccgacgaagggttttctgggctcgtgtcaatccacgtgtcccttctcgaatatatggctcaggacatcccactcacccctatcttcaccgacacagttatcttcagaattgccccttggattatgacgcccaacattctaccccctgtctctgtttttgtttgttgtatgaaagataattacctgttcctcaaagaagtcaaaaacctcgttgagaagacaaattgcgagctcaaggtatgtttccagtatctgaatagaggggaccggtggatccaagacgagatcgagttcgggtacatcgaagctcctcacaagggtttccctgtggtgctggactccccaagggatggcaacctgaaggattttcctgttaaggaattgttgggccctgactttgggtatgtgactcgagaacctctctttgagagcgttacgtctctggacagtttcggcaatttggaggtctctcccccagttacagtgaatggcaaaacataccccctgggaagaatcctgatcgggagcagctttcccctatag

SEQ ID NO: 234271 - DNA, 1998 bp, Artificial Sequence
  Description of Artificial Sequence: Synthetic coding sequence
atgcttcgtgagagaactgtcaggttacagtatgggtctcgggtcgaagccgtctacgttctgggcacctacttgtggacagacgtttatagcgctgctccagccggagcccaaacatttagcctgaaacacagcgaacatgtgtgggttgaagtggtgagggacggggaggctgaagaggtggccaccaacggtaagcaacgctggctactgtctcctagcacgacgcttcgtgtaacaatgagccaagccagcactgaggcatcctccgacaaggtaacagtgaattattatgacgaggagggcagcatcccgattgatcaggctggccttttcctcacggcgattgagatctctttggatgtggatgccgatagagatggcgtggtggagaagaacaatccgaaaaaggcctcttggacctggggccctgagggacagggtgccatcctgctcgtgaattgcgaccgagagacaccctggctgcccaaggaagactgtagggatgagaaagtttactccaaggaggacttgaaggacatgtcccagatgatccttcgtactaaggggcctgatcgcctgccagcaggatatgagatcgtgctgtatatcagtatgagtgacagcgataaggtcggagtcttttacgtcgagaatccatttttcggccagcgatacattcacatcttgggacgacggaaactgtaccatgtggtgaaatatacgggcggaagtgcagagctgttgttttttgtagagggcctctgctttcccgacgagggtttcagtggccttgtgtccatccatgtcagtctgcttgagtacatggcacaggatataccactgaccccgatatttacagacaccgtcatcttccggatagccccttggatcatgaccccaaacatactgccccctgtaagtgtgttcgtttgttgcatgaaggataactatttattcctgaaggaggtcaaaaatttagtggaaaaaaccaactgtgagctcaaggtgtgcttccagtacctgaatcggggtgatcgatggatacaggacgaaattgagttcggctacattgaagcaccgcacaagggattccccgttgtccttgatagcccgagggacggcaatctgaaagattttcccgtcaaggagctgctggggcctgacttcggatacgttacgcgagagccgctttttgaatctgtcacttcacttgacagctttggcaacctagaagtgtccccacccgttacagtcaatggcaaaacatacccgcttggtagaatcctgatcggttcgtcctttccactgtccgggggtaggagaatgacgaaagtggtaagagactttctgaaggcccaacaagtgcaagccccagtggaattgtattctgattggctgactgtcgggcatgtggacgagtttatgagctttgtgccgattcccggaacaaagaagttcttgctgctgatggctagcacttccgcctgctacaaactgttccgagagaaacagaaagatggtcatggtgaggctatcatgtttaagggcttgggtgggatgtccagcaagcggataactattaacaagattttaagtaacgaaagtttggtgcaggagaacctttacttccagcgttgtcttgattggaaccgggacatactgaagaaggaactgggtctcacagagcaggacattatcgatctgccggcactcttcaaaatggacgaggatcaccgtgcgagggctttttttcctaatatggtgaacatgatagtgcttgacaaggacttgggtatacccaagccctttggaccacaagtggaagaagagtgttgtcttgagatgcatgtccggggactactggagccactggggctggagtgtacgtttatcgacgatatcagcgcttaccacaagttcctaggggaagtccactgtggtacgaacgtacggcgaaaaccctttaccttcaaatggtggcacatggtaccttag

SEQ ID NO: 234272 - DNA, 1650 bp, Artificial Sequence
  Description of Artificial Sequence: Synthetic coding sequence
atgctgcgcgagagaacagtccgactgcagtatggcagtcgggtagaggccgtatatgttcttggcacctacctctggacagacgtttattctgctgccccagcaggggctcagacattctctctgaaacactcagaacatgtgtgggttgaggtggtacgggacggggaagctgaggaagttgccaccaacggcaagcagcgttggctgctgtctccatctaccaccttacgagttactatgtcccaggcctctacggaagcgtccagcgataaggtaacagtgaactattatgacgaggaagggtcgatccccatcgaccaagcaggtctgtttcttaccgccattgaaattagcctggatgtagatgccgatcgcgacggtgtggtggagaagaacaacccaaagaagacacgcagctccgcaaacgccatttctactagctgggctggcggaagcagcaccatgtggtcatcaaccagagtggccccacgatcttgctgctcatcctggaaggcctccgtgtcacccacacgggctagccaagcatggtccccctctatgtccgcctgttggagtacatggccttccatgaaggacaattacctttttttaaaagaggtgaagaacctggttgagaagacaaattgcgagctcaaagtttgttttcagtatctcaatagaggagacagatggatccaggacgaaatcgaatttggatacattgaagcacctcataaaggctttccggtcgttctggacagcccgagagatggtaacctcaaggattttcctgtgaaggaattactggggcctgacttcggttacgtgaccagagaacctctgtttgagagtgtcacttctctggattcctttggaaacctcgaagtctctcctccggtgactgtgaacggcaagacataccccctaggcagaatcctaatcgggagctcttttccactctcagggggtagaaggatgactaaagttgttagagacttcctgaaagcacagcaggtgcaggcccctgtcgagctgtatagtgattggctcactgtgggccacgtggacgagttcatgagttttgtgccaataccaggaactaaaaagttcttactccttatggcttccacctccgcctgttataagttgtttcgagaaaagcaaaaagacggccatggagaggcgatcatgttcaaaggtctgggcggaatgtcttctaagcgtatcacaatcaacaagattctgtccaatgagtctctggttcaagagaatctgtattttcaacgatgcctggactggaaccgcgacatcctcaagaaagagttaggtctcacagagcaggacatcatagatctgccagcacttttcaaaatggacgaggatcacagagctagagccttcttccctaacatggtcaacatgattgtcttggataaggaccttgggataccaaaaccattcgggcctcaagtcgaagaagagtgctgtctggagatgcatgtgcgagggctcctcgaacccctgggacttgagtgcaccttcatcgacgacatatctgcttaccacaagttcctgggggaggtgcattgtggaacaaatgtacggagaaagccatttacatttaaatggtggcacatggtgccttag

SEQ ID NO: 234273 - DNA, 1995 bp, Artificial Sequence
  Description of Artificial Sequence: Synthetic coding sequence
atgtccttacagaggatcgtgcgagtcagtctcgagcatcccaccagcgcggtttgcgtcgcaggggtggaaacactggtggatatttatggcagtgtgccagagggtacggaaatgtttgaggtgtacgggacacctggcgttgatatctacatctctcctaacatggaacgaggaagagagagagcagacactcggaggtggcgctttgatgctaccttagagatcatcgttgttatgaatagtccctctaatgatctcaatgattcccacgttcagatatcatatcattcctctcatgagcccttacccctcgcctatgctgtattgtatctgacctgtgttgatatttcactggactgtgatctgaactgtgaaggcagacaggatagaaactttgtcgacaaacggcaatgggtctgggggcctagcggatacggcggaatcctgttagtcaactgcgaccgtgatgatccatcctgtgatgtccaggataattgcgaccaacatgtccattgtctgcaggatctggaagacatgtctgttatggtactcagaactcaaggcccagccgctttattcgatgaccacaaactcgtcctacacacctcaagctacgacgcaaaacgggcacaggtatttcacatatgcggacccgaagatgtttgtgaagcctatcggcatgtgttggggcaggacaaggtttcatacgaagtgccacgtcttcatggtgatgaggaacgcttttttgtggaagggttgagcttccccgacgctgggttcaccggactgataagtttccatgtgaccctgttagacgactccaacgaagattttagtgctagccccatcttcactgacaccgtggtttttcgagtggctccctggatcatgactcctagcacactgccaccgttggaggtgtacgtttgtcgtgtgcggaataatacctgctttgtcgatgcagtcgccgagctggccaggaaggctgggtgcaaactgactatatgcccccaggccgagaatagaaatgatagatggattcaggatgagatggagctgggctatgtacaggcacctcataaaacactccccgtagtctttgatagcccacgcaacggcgagctccaggacttcccctataaaaggattctaggacctgattttgggtacgttaccagagagcccagagatcgaagcgtcagcggcttggactcattcgggaatcttgaggtgtcgcccccagtcgtggcgaatggtaaagagtatccgctggggcgtattctaattggaggcaacctaccaggttccagcggcaggcgtgtaacacaggtggtacgcgattttctgcacgctcagaaagtgcagccacccgtggaattgttcgtggactggctggcagtgggacatgtggacgagtttttatcttttgtgcccgcacccgacggcaagggattccgcatgctgctggcgtcacctggtgcatgttttaagttgttccaagaaaagcagaagtgtggtcacggacgggctctgctgtttcaaggagttgtggacgatgagcaggtgaagacaatcagtataaaccaagtcttgtctaacaaggacctaatcaattacaataaattcgttcagtcttgcatcgactggaacagagaggtgctgaagcgtgagctgggacttgcggagtgcgatataatcgacatccctcagctgttcaagaccgagcggaagaaggcaacagcttttttccctgacctggtaaacatgttggtcctcggaaaacacctgggcatcccgaaaccattcggtcctattattaatgggtgctgctgtctggaggaaaaggttcgtagcctacttgagccactagggctgcattgtaccttcatagatgatttcacaccctatcatatgcttcacggtgaagtgcactgcggcacaaacgtgtgccggaaacccttctcatttaagtggtggaatatggtgccatag

SEQ ID NO: 234274 - DNA, 645 bp, Artificial Sequence
  Description of Artificial Sequence: Synthetic coding sequence
atggctcagggcacattaatcagggtgactccagagcagcccacgcacgctgtgtgtgtgttagggacactgacacagctggatatttgttcttcggcccctgaggactgcacaagttttagtattaacgcttcaccaggcgttgtggtcgacattgctcatgggcctccagccaagaaaaaatctacaggttcctccacctggccacttgatccaggtgtcgaagtgaccctgactatgaaagtggcttccggttctactggggaccagaaggttcagatatcctattacgggcctaaaacacccccagtgaaggcgctgctctatcttactggcgttgacggcgtatcaccgtgtcaccccggttggtccgcaatgcacgatctggctcactgtaatctgcgcctgcaggttcaggcaatactgtgcttttccgttcctagttcttggactaccggagcatgccaccatgcgtggttaattttcgtcttccttgtagagatggaattccaccacgtgggccaggcagggcttgagctcttgacgagcggagacctgcctgcgagcggctctcaatctgccaggattaccggtatgaaccattgcgctagaccttcaatcttccttatattgaaatacttatag

SEQ ID NO: 234275 - DNA, 1992 bp, Artificial Sequence
  Description of Artificial Sequence: Synthetic coding sequence
atggcacaagggaccttgatccgagtcacacccgagcagcccacacatgctgtgtgcgtgctcggtaccctgacccagctcgatatttgcagctctgctccagaggattgcaccagtttctcaataaatgccagtcctggggttgtggttgacattgctcacggcccacccgctaaaaagaagtcaactggatcttccacctggccacttgatccaggtgtcgaggtaaccctcaccatgaaggtggcttccggtagtaccggggaccaaaaggttcaaattagttattatggaccaaaaaccccacctgtgaaagccttgttgtacctgacaggggtggaaatcagcctgtgcgctgacattaccagaaccggaaaagtgaagccaacccgcgcagtgaaagatcagcgaacctggacatggggcccatgtgggcagggcgctatcctactggtgaactgcgaccgggataatctggagtccagcgccatggattgcgaggacgacgaagttctggactctgaggacctccaggatatgtccctcatgaccctttctactaagactcccaaagacttcttcaccaaccacactttggtcctgcatgtggcccgttctgaaatggataaagttagggtctttcaggcgacccggggaaagctttccagcaagtgctcagttgtgctgggacccaaatggccttcccactacctcatggtgcctggcggtaaacacaatatggatttctacgtagaagctctggcttttcctgacaccgactttcctggactaataacgctgacaatctcccttttggatacttccaacctagagctacccgaggccgtggtgttccaggacagcgtggtttttcgagttgcgccatggattatgaccccaaatacacagccgcctcaggaggtatatgcgtgctctatcttcgagaatgaggattttctgaaaagcgtcaccacccttgcaatgaaggcgaaatgcaagttgactatctgccctgaagaggaaaatatggacgaccagtggatgcaagacgaaatggaaatcgggtacatccaggcaccccacaagacccttcccgtcgtcttcgactcaccgcgaaacagagggctgaaggagttccctatcaaacgggtcatggggccagattttggctacgtgaccagaggtccacagacaggcggtatctccggactggacagctttgggaatctggaggtgtctccccctgtgactgtcagaggaaaggaatatccgcttggcaggatcttgttcggggattcatgctacccaagcaacgattcccggcagatgcaccaagccttacaggatttcctgagcgcccaacaggtccaggccccagtgaaactgtacagtgattggctgtccgtggggcacgttgatgaattcctttcctttgtacctgcccctgacaggaagggctttcggctgctcctcgcgtcaccaaggtcctgctataaactgttccaagagcagcaaaatgaaggtcacggagaagcattgctgtttgaaggcatcaaaaagaaaaaacagcagaaaattaaaaacatcctcagtaataagaccctgcgtgaacacaattcatttgttgagagatgcattgactggaatagggaactgctgaaaagagagcttgggctcgctgaatctgatatcatcgacattccgcagctgttcaagttgaaagaattctctaaagccgaggcgttttttcctaatatggtgaacatgttggtcctgggaaagcatctgggaatccctaagccattcggacctgtcattaatggcaggtgctgtttggaggaaaaggtctgctccttgctcgagcccctcgggctgcagtgcactttcataaatgatttttttacataccatatccgccacggagaagtccattgcgggacgaacgtgcgacgcaaaccattctctttcaaatggtggaacatggtcccctag

SEQ ID NO: 234276 - DNA, 384 bp, Artificial Sequence
  Description of Artificial Sequence: Synthetic coding sequence
atggcacaagggaccctcataagggtaacacctgaacaaccgacccatgctgtgtgtgtacttggtacgcttacgcagctagacatttgttcctctgctcccgaagattgcaccagttttagcataaatgcgagccccggagttgtggtggatattgctcacgggccacccgcaaagaaaaagtccactgggtcgagcacatggccgctggacccaggcgttgaagttaccctcacaatgaaagtagccagcggctccactggagaccagaaagttcaaattagctactacggtcccaaaactccccctgtcaaagcccttttgtatctgaccggggtcgatggggtgtctccctgccatcctggctggtccgccatggcatag

SEQ ID NO: 234277 - DNA, 2628 bp, Artificial Sequence
  Description of Artificial Sequence: Synthetic coding sequence
atggacacagtccatcacatgctgttgtttggctgcaacatgccaagcagcactggatcatactggttctgtgacgagggcacttgcaccgataaggctaatatattgtacgcgtgggcgaggaacgctcctcccaccagactgcctaagggcgtgggttttagggtgggcggagagaccggctccaagtacttcgtgctacaggtgcattacggagatatatcagcctttagggacaacaacaaggactgtagcggtgtgtctcttcacctgacccggctcccccaacctcttattgccggaatgtaccttatgatgtcagtggacaccgtgattcctgcaggggagaaagtggtgaattcggacataagctgtcattacaaaaattatcctatgcatgtgttcgcttatagggtccacacacaccacctgggaaaagtcgtgtcagggtatagggttcgcaacggacagtggaccctgatcggccgacagagccctcagctaccccaggcgttctaccctgtcggacaccctgtggatgtgtcgttcggagacctgctcgctgcaaggtgtgtgtttaccggagaagggagaactgaagccacacatattggcggaacatcctccgacgaaatgtgcaatctgtatatcatgtactatatggaggccaagcatgccgtgtcgttcatgacctgcactcagaacgtagctcccgatatgttcagaacgattccaccagaggcaaacattccgattcccgtgaaatctgacatggtgatgatgcacgaacaccacaaagagactgagtacaaggacaaaatccctctgttgcagcaaccaaagcgcgaggaagaggaagtgctggaccagggcgacttctacagcctcctgtctaagctgctgggagagagagaggatgtggtgcacgtccacaaatataatcccacggaaaaagctgaaagcgaatccgatctggtggctgaaattgctaatgttgtccagaaaaaggacttaggacgatctgacgcaagagagggggctgagcatgagcggggaaatgctatcttggttcgagaccggatacacaagtttcatcgcctggtgagcaccctgagacccccagaatctagagtgtttagcctgcaacagcccccacccggagagggtacttgggaacccgagcacactggcgacttccatatggaagaagctttagattggccaggcgtctacctgttgcccggacaggtatctggcgtggccttagaccctaaaaataatctggtgattttccacaggggggaccatgtatgggacggcaacagtttcgattctaagtttgtgtatcaacagataggtctggggccaatagaagaggataccatcctggtgatagaccccaacaatgcagcggtgctccagagtagcgggaaaaacttgttttacctgccccatgggctatcaatagacaaggacggaaactactgggtgactgatgtcgcactccaccaagtgttcaagctcgaccccaataataaagagggtccagtgctcattttgggcaggtctatgcagcctgggagcgatcaaaatcacttttgtcagcccacagacgtcgccgttgatcctgggaccggcgctatttacgtttccgatggttattgtaattccaggatcgtacagtttagcccgtccgggaaattcatcacccagtggggcgaggaaagttccggatcctcccccctgccagggcaattcacggtgccccattcgcttgccctagtgcccctcctggggcagctttgtgtagctgacagggagaacggcaggattcagtgctttaagacggacacaaaagagttcgtgagagagattaaacattcttcctttgggagaaatgtctttgctatctcctacattccagggctcttgttcgccgttaacggcaagccccatttcggcgatcaggagcctgtccaaggtttcgtgatgaacttctccaacggagaaatcattgacattttcaaacccgtccgtaaacactttgatatgcctcatgacattgtagcatctgaggacggcacagtctatattggtgatgcgcacacaaacactgtttggaaattcacattgacagagaagctcgagcacagaagcgtaaaaaaggccggaattgaagtacaggaaattaaagccgaagcagtcgtggagacgaagatggagaacaagcccacttcctctgaactgcagaaaatgcaggaaaagcaaaagctgatcaaggaacctggatctggcgtgccagtggtgctgatcaccacactcttggttatcccagtggttgttctcctggccattgccatcttcattcggtggaagaagtctcgagcatttggcgactccgaacacaagctggagacctcctccggcagagtactgggtcggttccgcggaaaaggaagcggcggactgaaccttggtaatttctttgcttcccggaagggctactcccgcaagggcttcgatcgcctgtccacggagggcagcgaccaggagaaagaagatgacggaagtgaaagcgaggaggaatattctgctcccttgcctgccctcgcacctagcagctcgtag

SEQ ID NO: 234278 - DNA, 2925 bp, Artificial Sequence
  Description of Artificial Sequence: Synthetic coding sequence
atggctggtcgggtgcccagcttgttggtgttgttggtgttcccctcttcctgcctcgcatttaggagccctctgtctgtattcaagcgattcaaagaaactactagaccattctctaacgaatgtctcgggactacccggccagtggtgccaattgatagtagcgatttcgctctcgacatacgcatgcctggggtcacccccaaacagagcgatacatatttttgcatgagtatgcggatacccgtcgacgaggaggctttcgtgattgattttaaacccagagcctctatggatacagtgcatcatatgctgctgttcgggtgcaacatgccctcatcaacgggttcatattggttctgtgatgaagggacgtgcaccgacaaggccaatattctctacgcatgggcacgaaatgccccacccacccgtctgcctaagggcgtgggtttccgcgttgggggagagactgggtcaaagtatttcgtgctccaggtccattatggcgacattagcgcgtttagggacaataataaggattgttctggggtatccctccatctcacgcgtctcccacaacccctaatcgccggaatgtaccttatgatgtcagtggacaccgtgattcccgcaggggagaaggttgtgaattcagatatctcatgtcactacaaaaattatccgatgcacgtctttgcctacagagtacatactcaccacctgggaaaagtcgtgtctggataccgtgtcagaaacgggcagtggaccctcattggacgccaaagcccccagctgccacaggcattctaccctgtgggacaccccgttgatgtatcctttggggatctgttggctgccagatgcgtgttcacaggcgagggcaggactgaagccacccacatcgggggtacctcctccgatgaaatgtgtaacctctatatcatgtattatatggaggccaaacatgccgtatctttcatgacttgcacccagaacgtggcaccagatatgttcaggactatcccccctgaagccaatatcccaattcctgttaaatctgacatggttatgatgcatgaacaccacaaagagacggagtacaaggacaagattccactgttgcagcagcctaagagagaggaagaggaagtccttgatcaaggagacttctactccttgctctctaagctgctcggagagcgggaggacgttgtgcatgttcacaagtacaatcctacggaaaaggcagagtccgaaagtgatctggtggcagaaatcgcaaatgtggtccagaagaaagatctaggtagaagcgatgccagagaaggggctgagcatgagcgagggaacgcaatacttgtgagagatcgtattcacaagtttcataggctggtgagcaccttgcggcctccagagagcagggtcttctcacttcagcagccaccgccaggggagggaacctgggaacctgagcacacaggagactttcacatggaggaagctctggactggccgggagtgtatttattaccaggccaggtgagcggcgtcgccctggaccctaagaacaacttagtgatttttcacagaggagatcatgtctgggatggcaactcttttgattcaaaatttgtataccagcaaattgggctcggcccaatcgaagaagacacaattctggttattgaccccaacaatgcagcggtcctccagtctagtggcaaaaatctgttttacctgccgcacggcctcagtattgacaaggatgggaattattgggtgactgacgtcgcattgcaccaggtattcaagcttgaccctaacaacaaggagggccctgtgctgatcctgggtagatccatgcagcctggaagcgatcaaaatcatttttgccagcctaccgacgtggcggtcgaccctggaacaggcgctatatatgtttccgacggatattgcaactcacggattgtgcagttcagcccttccggaaagtttattactcagtggggagaggaaagctctggctcctctccattgccagggcagtttaccgtgcctcactcacttgcgcttgtgcccctgctcggacaattatgcgtggccgacagagaaaacgggaggatccagtgcttcaagacagacactaaggaattcgtgcgggagatcaagcactcctcattcggcaggaacgtgtttgcaatttcttacatcccaggtctactgtttgccgtgaacggaaagccgcactttggtgaccaggagccagttcaaggctttgtcatgaacttctccaacggcgagattatagatatctttaaacctgttcggaagcatttcgatatgcctcacgatatcgtggcctcagaagacggaacagtgtatatcggcgatgcacacaccaacacggtttggaagttcacccttaccgaaaaactcgaacatcgcagtgtaaaaaaagctggaattgaggtccaggagattaaagaggcagaggcggtcgttgaaacaaaaatggagaacaaacccacatcctctgaactccagaagatgcaagaaaagcaaaagttaatcaaagaacccggatcgggcgttcctgtggtactcatcactacacttctggtgattcctgtggtcgtattactcgctatagccattttcatccgttggaagaaaagccgtgcctttggggctgacagtgagcacaaactggagacctcaagcggccgtgttcttggcaggttcagaggtaagggatccgggggtctgaatctgggaaacttttttgctagtcgtaaggggtattcgcgaaagggctttgaccggttgagtaccgaaggaagcgaccaggagaaggaggacgatggcagcgagagcgaagaggagtatagtgcgccattacctgcactcgctcccagcagtagctag

SEQ ID NO: 234279 - DNA, 2664 bp, Artificial Sequence
  Description of Artificial Sequence: Synthetic coding sequence
atggcaggccgtgtcccatctctgctggtgctcctggtcttccctagctcttgcttagcctttcggtctcccctgagtgttttcaagaggttcaaagagacaacccgtccattctctaacgaatgcctcggcaccactcggccagtggttcctatcgatagctccgatttcgcgctagatatccgaatgccaggggtgactcccaaacaaagcgatacatatttctgcatgtctatgcggattccggtcgatgaagaggcctttgtaattgacttcaagccacgcgcttctatggacacagtgcatcatatgctgctgttcggctgcaatatgccatctagcacgggttcttactggttctgtgatgagggcacgtgcaccgataaggctaacattctgtacgcctgggctcgcaacgcccctcccacacgcctcccaaagggagtcggctttcgcgtcggcggagagactggttctaaatatttcgtgttacaggttcattacggcgacattagtgcattcagggataacaataaggactgttccggcgtgagcttgcatctcacgcgactcccacaaccgctgatagccggtatgtacttgatgatgagcgttgataccgtcattcccgcaggggagaaggttgtaaatagtgacatttcgtgtcattataagaattatccaatgcacgttttcgcctatcgggtgcatacccaccacttaggcaaggtggtgagcggctaccgcgtgcgaaacggccagtggactttgatcggcagacagagcccccaactgccgcaggccttttatcctgtcggacacccagtcgatgtttcgttcggggatctgttagccgcacggtgtgttttcacaggcgaggggagaaccgaggccactcacattggagggacttcgtcggatgaaatgtgcaacctctacatcatgtactatatggaggctaagcacgccgtgtcttttatgacatgcacacagaacgtggctcctgatatgttcagaactataccacctgaagccaacattcctattccagtaaagagtgatatggtgatgatgcacgagcatcacaaggagacagaatacaaggacaagatcccccttctgcagcagccaaaacgggaagaagaggaggttctagatcaaggggacttctactccttactgtccaaactgctgggagaaagggaggacgtagtgcacgtgcacaagtacaatccaacagaaaaggctgagtcagagtcggatctcgttgccgaaattgcaaatgttgttcagaagaaagacctcggcagaagcgacgcccgagagggagccgagcatgaaagaggaaacgccatcctggtccgggaccgtatccacaaatttcatcggctggtgagcaccctacgacctcccgagtcccgagtcttcagcctccagcagcccccacccggagagggcacttgggagccagaacatactggtgacttccacatggaggaagctctagactggccaggcgtttacctcctgcctggacaggtgtctggagtcgcgctggatccgaaaaataatctagtgatcttccaccgtggggaccacgtgtgggatgggaattccttcgactctaagtttgtctatcagcagattgggcttggaccaattgaggaggacacaatacttgtgatcgaccctaacaatgctgcggttttacaatcgtctgggaagaacctcttttatttgccacacggcctgagtatcgacaaggatgggaattactgggtgaccgatgtcgcccttcaccaagtcttcaaactggaccccaataacaaggaaggacccgtgctgatactcgggaggtctatgcagcccggttctgatcagaaccacttttgtcagcccaccgatgtggccgtcgatcccggtactggagccatttatgtatcagacgggtactgcaattcaagaattgttcaattctctccgagtggaaaatttattacccagtggggagaggagtcgagcggaagcagcccattgcccggtcagtttacagtcccccatagcctggcactggttcctcttctggggcaattgtgcgtggcagacagggaaaatggcagaattcagtgtttcaagacagacacaaaagagttcgttcgagaaatcaagcatagtagctttggtaggaacgtgttcgccatttcttacattcctggactcctgtttgctgtgaacggtaagccccatttcggagaccaggagcccgtccaggggtttgtcatgaactttagcaatggcgagatcatcgacatcttcaagcctgtccgtaagcatttcgatatgccccacgacatcgttgcgagcgaagatggaaccgtgtacatcggagacgcccacacgaacacagtgtggaaatttaccttaacagaaaagctagagcataggtctgtaaagaaggcaggaatagaggtccaggaaataaagggcaagggatctggcggtctgaacctgggaaacttctttgcgagcagaaaggggtactcccgcaaaggatttgatcgtttgtccaccgaaggatccgaccaggagaaggaggatgatggctcagagagcgaagaagagtatagtgctccgctccctgcgctggctcccagctctagttag

SEQ ID NO: 234280 - DNA, 2601 bp, Artificial Sequence
  Description of Artificial Sequence: Synthetic coding sequence
atggccggtcgagtcccttccctgcttgtgttgctggtcttcccatcatcatgcctggcattccggtctcccttaagcgtgttcaagcggttcaaggagactaccaggccgtttagcaatgaatgtctggggacaacaaggcccgtggtccctatcgacagttcggacttcgccctggacatccggatgcctggggtcactccgaagcagagtgacacctacttctgtatgtctatgcgcatccctgtagacgaggaggctttcgtgatcgacttcaaacccagagcttcgatggacaccgtccatcacatgctgctgttcgggtgtaatatgccctcatcaacaggcagctattggttctgtgacgaaggcacgtgcactgacaaggctaatatcctttacgcttgggctcgcaacgcaccacctaccaggctccccaagggggttggcttcagagtgggaggtgagactgggagtaagtatttcgttttgcaggtgcactacggtgatattagcgccttccgagataacaataaggactgctccggggtctctctgcaccttactcggctcccacaacccttgattgcagggatgtatctcatgatgtcggtcgataccgtgatccccgcaggagagaaggtagtcaactcggacatatcgtgccattataaaaactaccctatgcacgttttcgcttaccgtgtccacacacaccatctaggcaaggtggtatccggttaccgggttcggaacggccagtggaccttgattggacggcagtctccgcagcttcctcaggctttttaccccgtcggccatcccgttgacgtttcttttggggatctgcttgctgcacgttgtgtgtttaccggggaggggaggactgaagctacacacataggaggcacatcatccgatgagatgtgtaacctgtacattatgtactacatggaggctaaacatgccgtgagttttatgacttgtacccaaaatgtcgccccagacatgttccgaacgataccaccggaagcaaatataccaatcccagtcaagtctgatatggtcatgatgcatgagcaccacaaggaaacagaatacaaagacaaaattcccctgttacagcagcctaagagggaggaggaagaagttttggatcaagattttcacatggaggaggccctggactggcctggagtctatctcctcccagggcaggtgtccggagtggcactcgaccccaaaaacaatctggtcatctttcacaggggcgatcatgtgtgggatggcaatagttttgatagtaagtttgtatatcagcagatcggtttaggacctatcgaggaagatacaatcctggtcattgaccccaataatgccgctgtattacagtcttccggcaagaacctcttttacctgccccacggactgagcatcgacaaagacggcaattattgggtgaccgacgtcgccctgcaccaagtgttcaaactggaccccaacaacaaggagggacccgtgctgatcctgggcaggagcatgcagccaggcagcgatcaaaatcatttttgtcaacctactgatgtagccgtcgaccctggcactggggcaatttacgtgtctgacggttattgtaactctagaattgtgcaattttcccctagtggtaaattcataacccagtggggtgaagagtcaagcggtagctctccattgccgggacagttcacagtgccccactcactagcactggtgcctctcctggggcagttgtgcgttgcagaccgtgaaaatggccgtattcagtgctttaaaacggataccaaggagtttgtcagggagatcaagcactcgtcttttggccgtaacgttttcgcgatttcctatatcccgggtcttttgttcgctgtcaatgggaagccacacttcggggaccaagaaccagtgcagggctttgtcatgaatttctccaatggagaaataatcgacatctttaaacccgttcggaaacactttgatatgccgcacgacatagtggctagtgaggatgggacggtttacatcggcgatgcgcacacgaataccgtgtggaagtttaccctcacagagaagctcgaacacagatctgtcaaaaaggcaggaatcgaggtccaagaaatcaaggaagcagaagctgtagtcgagaccaagatggagaacaagccgacatcctctgaactgcagaagatgcaggagaaacagaagctaattaaggagcccggtagcggagtccctgtagttctgataaccaccctattagttattcctgtcgtcgttctgctggccatcgcgatctttattcggtggaaaaagtcaagggctttcggcgactctgaacacaagctagaaaccagcagtggcagagttcttggaagattccggggaaaaggaagcggaggtctgaatctgggcaatttcttcgcttcaaggaaggggtactcgaggaagggctttgatcggcttagtacggagggaagcgaccaagagaaggaagatgatggatcagagagcgaggaggagtactcagcccctctccccgcactggctccatcatcaagctag

SEQ ID NO: 234281 - DNA, 1008 bp, Artificial Sequence
  Description of Artificial Sequence: Synthetic coding sequence
atgcagccaggaagtgaccagaatcacttttgccagccgaccgacgtggctgtggatcctggaactggagctatctacgtctcagatggttactgcaactctcgtattgttcagttcagcccatctggaaagttcattacccagtggggtgaagagtcatcggggtcgtcccctcttcctggtcagtttacagtgcctcatagtctggctttggtgcccttgctaggtcaattgtgtgtggcagatcgagagaacggtcgtatccaatgtttcaaaactgacactaaagagtttgttcgcgaaatcaaacattcatcctttggccgaaatgtgtttgccatttcgtacattccgggattgctttttgctgtgaacgggaagccccactttggcgatcaggagccagtgcagggtttcgtgatgaactttagcaatggtgagatcatcgacatcttcaaacccgtcaggaaacacttcgacatgcctcacgacattgtggcgtctgaagatggcaccgtgtatatcggcgatgctcacaccaataccgtgtggaaattcacactcacagagaaactagaacaccgctccgtgaaaaaggccggaatcgaggtacaggagattaaggaagcagaagctgtggttgagaccaagatggaaaataaaccaaccagtagcgagttgcaaaaaatgcaggagaaacaaaaactcatcaaagagcccggatctggggttcccgtggtacttattacaaccctgttagtgattccagtggtggttctcttagcaatcgctatttttatacggtggaagaagtcgcgagcgtttggcggtaaaggcagtggaggactgaacttggggaatttctttgcctctcgcaagggatactctaggaaggggtttgaccggttgagcaccgaggggagcgaccaagagaaggaggacgacggttcagaaagcgaagaggaatactccgcccctctcccagccctcgccccttccagcagctag

SEQ ID NO: 234282 - DNA, 468 bp, Artificial Sequence
  Description of Artificial Sequence: Synthetic coding sequence
atgcacgagcatcataaggagactgagtataaggataaaatcccactcctccagcagcccaaacgggaggaggaggaagtccttgaccaaggagacttctactccctgcttagcaagctcctgggagaacgagaggatgtggtgcacgtgcacaagtataaccctactgagaaagcagagagcgaatctgacctggtagccgaaatagcaaatgtggtgcaaaagaaggacttggggagatccgacgccagagagggcgcagagcatgagcgcggaaatgccatcctggtgagagatcgaatccacaaatttcatcggctcgtcagtactctgagaccgcctgaatcccgggttttcagcctgcagcagccaccacccggtgaggggacctgggagcccgagcataccggcgcaaggagagaagatatgaagtgttttcagtgtaaggaaatgatttcggttcaatag

SEQ ID NO: 234283 - DNA, 2922 bp, Artificial Sequence
  Description of Artificial Sequence: Synthetic coding sequence
atggcaggcagggtaccctcgcttctggttttgctagtctttccatcttcctgtctggctttcaggtcaccgctgtcagtttttaagaggtttaaggaaaccactcgccctttctctaatgaatgcctcggtacaacccgtccagtggttcccattgactcgtccgacttcgctctcgacattagaatgcccggagtaactccaaaacagtctgacacatacttctgtatgtccatgagaatcccagttgatgaggaggctttcgtaattgactttaagccgcgagctagcatggataccgtgcatcatatgttgctgttcggttgcaatatgccttcttctacaggctcatactggttctgcgatgaagggacgtgcaccgataaagctaacatactgtacgcatgggcgcgaaatgcccctcccacaagactgccaaagggcgtggggttcagagtgggcggagagacaggtagcaagtactttgtgctgcaggtccattatggagatattagtgccttccgtgataacaataaggactgctctggagtgtccctgcacttaactagactcccgcagcctctcatcgcaggcatgtatctcatgatgtccgtcgacactgtgatccctgccggagagaaggttgtgaattcggacatatcttgccactacaagaactatcctatgcacgtgttcgcctatcgagtccatactcatcatctgggcaaggtggtaagcggatatagagtgaggaatggccagtggaccctcatcggccgacaatcaccacagctaccgcaggccttctatcctgtgggtcatcctgtagatgtctctttcggagatctattggccgcacgttgcgtatttacgggcgagggcagaaccgaagccacacacatcggagggacctccagtgatgagatgtgtaacctgtacattatgtattatatggaggcaaagcatgcagtgagcttcatgacttgcacgcagaatgttgcaccagatatgttcaggactatccccccagaagcaaatatacctattccagtcaagtccgatatggtaatgatgcatgaacaccacaaggagaccgagtataaggataaaatccctcttcttcagcagcctaagcgcgaagaagaggaagttttagaccagggggatttctattccctactgtcaaaactgctcggcgaacgcgaggacgtggttcacgttcataagtacaatcctacagaaaaggctgagagtgagtcggaccttgtggcagaaattgcaaacgtagtgcagaaaaaggatttaggcaggagcgatgcacgggagggcgcagagcacgaacggggaaacgctatactagtgagagacaggattcacaagttccatcgtttggtatcaacattgaggccccctgagagtagagttttcagcttgcagcaaccccctcccggtgaaggtacttgggaacctgaacacaccggggatttccatatggaggaggcactagactggccaggagtctatctgctacccggacaagttagcggggtggcattagatccgaagaataatttagtgatctttcatcgcggtgatcacgtttgggatgggaactccttcgattctaagtttgtgtatcaacaaatcgggctggggccaattgaggaagataccattcttgttatcgatccaaacaacgccgcagtgttacagtcatcaggcaaaaacctgttttaccttcctcacggcctgagcattgacaaggatggcaactactgggtgacggacgttgctcttcatcaggtgttcaaactggatccgaataataaagaaggccctgtgctgatcttgggacgtagtatgcagccaggcagcgatcaaaaccacttttgtcaacccacagatgtcgcagtggatcccggaaccggtgcgatctacgttagcgacggatattgcaattcacgcattgtccagttcagtccgtcagggaaatttataacacagtggggtgaagaatccagcggatcgtcaccgcttccaggtcagttcactgtgcctcattcactggctctcgtgccattgctaggacaactgtgcgtggccgaccgggaaaatgggaggattcagtgcttcaaaacggataccaaagagttcgtgcgggagataaaacattctagctttggcaggaacgtcttcgcaatcagctacatcccgggtctgctgtttgccgtcaacggtaagccccacttcggtgaccaagagcctgtgcagggttttgttatgaacttctctaacggagaaataatagacatttttaagccagtgcgaaaacactttgatatgccacacgatatcgtagcctccgaagatggcacagtttacataggcgacgctcacacaaacaccgtgtggaagttcactctcactgaaaagttagaacatcgctctgtcaagaaagctggcatcgaggtgcaagaaatcaaagaagccgaggcagttgtcgagaccaagatggagaacaagcccacttcatccgaactacagaagatgcaggagaagcagaagcttatcaaagagccaggttccggggttccagtcgtccttataactacgctgctggtgatcccagtggtggtgctcctggcaatcgctatctttattagatggaaaaaaagtagagcattcggcgattccgaacataaactcgaaacatcgagcggacgtgtcctgggacggtttcggggaaagggctcaggaggcctgaacctggggaatttttttgccagcaggaagggatatagtcggaagggatttgataggctgtctactgaaggctcagatcaggagaaagaagacgacggctccgagtcagaggaggaatacagcgcacccttacctgcactcgcgccatcaagttcatag

SEQ ID NO: 234284 - DNA, 2718 bp, Artificial Sequence
  Description of Artificial Sequence: Synthetic coding sequence
atggccggaagagttccatccctgttggtgttgctggttttcccatcctcttgtctggcgtttcgctcaccactgagtgtgtttaaacgttttaaggagacgactagaccattctcgaacgagtgtctgggtactacaaggcctgtggtgccaatcgattcctctgacttcgctctcgacattagaatgcccggtgtgacacctaaacagagtgacacctacttctgcatgtcaatgaggattcccgttgatgaagaggcatttgttatcgattttaagccacgcgctagtatggataccgtccatcatatgctgttgttcggctgcaacatgcccagcagtactggcagctactggttctgtgacgagggtacttgcaccgacaaagcaaatattctgtacgcctgggctaggaacgcgccaccgacacgtcttccgaagggggttgggtttcgggtaggtggcgaaactggatccaagtatttcgttctgcaggtgcattatggtgacatttcagccttcagggacaataataaggactgcagtggcgtctctcttcatctcactcggctacctcagccattgatcgccggaatgtatttgatgatgtctgtggacaccgttatccctgcaggcgaaaaagtggttaattcggacataagttgtcactataagaactatccaatgcacgtgttcgcgtatcgcgttcacacacatcacctgggcaaggtagtgtctggctaccgggttcgcaatggacagtggacgctgataggaaggcagagtccacagctgccacaggccttttatcccgtgggccatccagtggacgtctcatttggcgacctcttggccgctaggtgcgtcttcactggagagggtcgcacagaggcgacccacattggcggaacctctagtgacgaaatgtgtaatttatatatcatgtattatatggaagctaagcacgcagtgtctttcatgacctgcacccaaaacgttgctcctgatatgtttcgaacaatccctccggaggctaacattccaatccccgtcaaaagcgacatggttatgatgcacgagcatcataaagagaccgaatacaaggacaaaattcctctgctgcagcagcctaaacgtgaagaggaggaggtgctcgaccagggagacttctacagcctgcttagcaagctgcttggggagcgggaagacgtggtccacgtccacaaatacaaccccaccgaaaaggcagaaagtgagagtgacctggtcgcggagattgccaacgtggtgcagaagaaggacctgggtcgttccgacgctagggaaggcgctgaacatgaaaggggaaacgccatcctcgtcagagatagaattcataagttccataggttggtgagtacattacgtcctcctgaatcccgcgtgttctctctgcagcagccacctccaggagagggaacctgggagcctgagcacacaggcgattttcacatggaggaggcactggactggcccggtgtctatctccttcctggacaagtctcaggggttgctctggacccaaagaataacctcgttattttccaccgcggagaccatgtctgggacggaaattcctttgatagcaagtttgtatatcaacagatcggcctcggtcccatcgaagaggacacaattcttgtgatcgatcccaacaacgctgcagtgctgcagtcctctggaaaaaacttattctacctcccacatggcctaagcatcgataaagatgggaactattgggtgacagatgtggccctacatcaggtcttcaaactggatcctaataacaaagagggaccagtgctgattctaggcagatcaatgcagcctgggtccgatcagaaccacttctgtcagccaaccgatgtcgccgttgaccccggaaccggagccatatatgtgtccgacggttattgcaacagtcgaatcgtccaattttccccatccggaaagttcattacccaatggggggaggagagctcaggtagcagcccgctccctggccagtttacagtcccacactcccttgcgctagtccccctgctgggacagctgtgtgtagccgatcgggagaacggcagaatccaatgtttcaaaacagacactaaggagttcgtcagagagattaagcattcgtcattcggccgaaacgtttttgccatctcatatatccccggactgctgtttgccgtgaatggtaagccgcacttcggggatcaggaaccagtgcaaggcttcgtaatgaatttctccaatggcgagatcatcgacatcttcaaaccagtccggaagcacttcgatatgcctcatgatattgtggctagcgaagatggaactgtatatattggcgacgcgcatacaaataccgtgtggaaattcacactaacagaaaaactggaacaccgctctgtgaaaaaggcaggaattgaggtgcaagaaattaaggattccgagcataagctcgaaaccagtagcggacgcgtgctgggcagattcaggggcaagggtagtggaggattaaacctgggaaacttcttcgctagtagaaaagggtacagccgcaagggcttcgatcgtctgtcgacagagggcagcgaccaggaaaaggaggacgacggaagtgagagcgaggaggagtactctgccccactgcccgcattggccccatccagctcctag

SEQ ID NO: 234285 - DNA, 90 bp, Artificial Sequence
  Description of Artificial Sequence: Synthetic coding sequence
atggctggacgggtcccatccttacttgtgctgctagtcttcccctcatcatgtttagctttccgatccccgcttagcgtatttaaatag

SEQ ID NO: 234286 - DNA, 87 bp, Artificial Sequence
  Description of Artificial Sequence: Synthetic coding sequence
atggccggacgagtgccatctctcttggtgcttctggttttcccctcctcatgcctggcctttcggtctcccctgtctgtgttctag

SEQ ID NO: 234287 - DNA, 162 bp, Artificial Sequence
  Description of Artificial Sequence: Synthetic coding sequence
atggccggacgcgttcccagtttgttggtgctgctggtatttcccagctcttgcctggcattcagatctccgttatccgtcttcaagcgctttaaggagactaccaggcccttctccaacgaatgtctaggaaccacaaggcccgtggtgcccatcgactag

SEQ ID NO: 234288 - DNA, 129 bp, Artificial Sequence
  Description of Artificial Sequence: Synthetic coding sequence
atggccggtcgggtgcctagtttgctggtcctgttggtgttcccatcaagttgtttggcttttcggtctcccctgagcgtattcaagcggtttaaagaaaccacgcggccttttagtaacgagtgttag

SEQ ID NO: 234289 - DNA, 207 bp, Artificial Sequence
  Description of Artificial Sequence: Synthetic coding sequence
atggccggacgggtgccctccctgctcgtactgttggtcttccccagcagctgcctggcgttcagatcccccctgtctgtgtttaagaggttcaaagagacgacacgccctttcagtaacgagtgtctgggcacgactcggccagtggtgcccattgactcctcggattttgccctcgatatccgcatgcccggagtgacaccttag

SEQ ID NO: 234290 - DNA, 78 bp, Artificial Sequence
  Description of Artificial Sequence: Synthetic coding sequence
atggctggaagggttccgtctctgctcgtcttgctggtattcccctctagctgcctggcatttcggtccccactctag

SEQ ID NO: 234291 - DNA, 501 bp, Artificial Sequence
  Description of Artificial Sequence: Synthetic coding sequence
atggcagccatcccaccagattcatggcagcctcccaatgtttacctggaaaccagcatgggcatcatcgtgttagagctgtactggaaacatgcccctaagacatgcaagaacttcgcggagttggcaagaagaggctattataatggcaccaagtttcacaggattatcaaggactttatgatccagggcggtgatcccaccggcaccggacggggaggggcttccatctacgggaagcagtttgaagacgaactccatcccgaccttaagttcaccggagcgggtatacttgccatggccaacgcagggccagatacaaatgggtctcagtttttcgttactctggcccctacacagtggttggacggcaagcacaccatcttcgggagagtgtgtcaagggatcgggatggttaatagggtgggtatggtagagacaaactcacaggataggcccgttgatgatgtcaaaatcataaaagcctatccttccggttag

SEQ ID NO: 234292 - DNA, 1563 bp, Artificial Sequence
  Description of Artificial Sequence: Synthetic coding sequence
atggggaaacggcagcatcaaaaagataaaatgtatatcacttgcgccgaatacactcacttttacggaggtaaaaaacctgacctgcctcagacgaacttccgaaggctcccctttgaccactgttcactgtcactccagccttttgtctaccccgtttgtacccccgatggaatagtgttcgatctgctaaatatagtgccctggctgaagaaatatggaactaacccttccaacggcgaaaagcttgatggccgatctttaatcaagttgaattttagtaagaattcggagggcaagtaccactgtccagtactgtttacagttttcactaacaacacccacattgttgccgtccgcactacggggaatgtgtacgcgtatgaggccgtggagcaattgaacattaaggcaaagaacttccgggatctcctgacagatgagccgttctccaggcaggacattatcaccctccaggatccgactaacctggacaagtttaatgtgagcaatttttaccatgttaaaaacaacatgaaaattattgatcccgacgaagaaaaagctaagcaagatccatcttattatctgaagaatacaaacgctgagactcgggagacactccaggagttgtacaaggaattcaagggagacgagattctggcagcgaccatgaaggccccagagaaaaagaaggttgacaagttaaacgcagctcattatagcacaggaaaggtcagtgcgtctttcacatcaactgccatggttcctgaaacgacccacgaggctgcggctatagatgaagacgttcttagatatcaatttgtgaagaagaaaggatacgttcgcctccataccaacaagggcgacttgaatttagagctacactgtgacctgaccccaaagacatgtgagaactttattcgcttgtgcaaaaaacactattacgacgggactatctttcaccggagcatccgtaattttgtgatccaaggaggcgatccaacaggaactgggaccgggggagaaagctattgggggaaaccatttaaagatgaatttagacccaatcttagccacaccgggaggggaatcctgagtatggccaatagtggacccaacagcaatcgtagtcagttttttattaccttccggtcgtgcgcataccttgataagaagcacaccattttcggcagagtcgtgggcggtttcgacgtgctcacagccatggaaaatgtcgagtcagacccgaagacggaccgacctaaagaggaaatacgcatcgacgccacaacagtgttcgtggatccgtatgaggaagctgacgctcagatcgcacaagagagaaagacgcagctcaaggtggcacctgagacaaaagtcaaatcatcacagccacaggctggctcacagggcccacagacatttagacagggcgtgggcaaatacattaacccagccgctactaaacgcgcagccgaggaagaaccgtctacttctgccacagtcccaatgtcaaaaaaaaaacccagtcggggattcggcgactttagttcctggtag

SEQ ID NO: 234293 - DNA, 1563 bp, Artificial Sequence
  Description of Artificial Sequence: Synthetic coding sequence
atgggtaagaggcagcatcagaaggacaagatgtatattacatgtgcagaatatactcacttctacggtggaaaaaagccagaccttcctcaaactaacttcagacgtcttccctttgatcactgtagcctcagcctacagccattcgtgtatcctgtctgcactccggatggaattgtctttgacctgctgaacatcgtgccttggttaaaaaaatatggcaccaacccttctaacggggagaaattagatgggagaagtctgattaagttgaacttcagtaagaactccgaagggaaataccactgtcccgttctgtttaccgtgttcacgaataacacccacattgtggcagtgcgtactactgggaacgtctacgcttatgaggctgtggagcagctcaacatcaaggccaaaaatttcagagacctgctcactgatgaacccttcagcaggcaggatatcatcaccttacaggatccaaccaacctcgacaagtttaatgtcagcaacttctatcacgtgaagaacaacatgaagattatcgaccctgatgaagagaaggccaagcaggacccatcctactatctgaaaaatacaaacgccgagaccagagagaccctccaggagttatacaaggagttcaagggcgacgaaatattagccgcaaccatgaaggctcctgagaaaaaaaaggtcgataaattaaatgccgctcactactccaccggaaaggtctctgcgtctttcacctcaactgctatggttcctgagacaacccacgaggccgctgctattgatgaagacgttctgcgatatcagtttgtcaaaaagaaagggtacgttagactgcacacaaacaagggagacctgaatttggagctacactgcgacttgacgcctaagacttgcgaaaattttatccgcctgtgcaagaagcactactacgatggaaccattttccacaggtctatcagaaattttgtgatccagggtggcgatccaacaggcaccggtacgggcggtgaaagctattggggaaagccatttaaggatgagtttagaccaaatctgagccacaccgggcgaggtattctctctatggctaacagtgggcctaacagtaaccgtagccaattctttatcaccttccggtcttgcgcttacctcgacaagaagcatacaattttcggtagagttgtgggcggatttgacgtccttaccgccatggaaaacgtggaaagtgatccaaagactgacaggccgaaggaagagattcgcatcgacgccaccactgtgttcgttgatccttacgaagaggcggatgctcagatagcacaggagagaaaaacccagcttaaagtcgcccctgagacaaaggttaagagctcacagcctcaagccggatcccagggacctcaaacgtttcggcaaggtgtcggtaagtatattaatccagctgctacaaagcgtgcggctgaagaggagccgtcaactagcgcaaccgttcctatgagcaaaaaaaagccctcacgtggttttggggatttttccagctggtag

SEQ ID NO: 234294 - DNA, 1563 bp, Artificial Sequence
  Description of Artificial Sequence: Synthetic coding sequence
atgggaaagcggcaacatcagaaggataagatgtatatcacctgtgcagagtacactcacttttacggcggaaagaaacctgacttgcctcagactaatttcagaaggctccctttcgaccactgtagtctgtctctccagccgtttgtgtaccccgtgtgcactcctgatggaattgttttcgacttactgaacatcgttccctggctcaagaaatacgggactaaccctagcaatggggagaagctcgatggacggtccttgattaaactgaatttcagcaagaacagtgagggcaagtaccactgccccgtcctattcaccgtctttacaaacaatacgcacatcgttgcggtacggacgactggaaacgtgtatgcctacgaagccgtggagcagctaaacatcaaggcaaagaacttccgagatctgttaactgacgaacctttctctagacaagatataatcacgctgcaggatccaacgaaccttgataagtttaatgtctcaaacttctaccatgtgaagaacaatatgaaaattatcgaccccgacgaagagaaggccaaacaagatcctagttactatctcaaaaatacaaatgctgagactcgagagacacttcaggaactttataaggaattcaaaggagatgagattcttgctgctacgatgaaagctcctgagaagaaaaaagtcgataaactgaacgctgcacattattcgacagggaaagtaagtgcaagctttacatcaacagctatggtgccagagacaacccacgaggcagcagcaatagacgaggatgtcttgaggtaccagttcgtaaagaaaaaagggtatgtaaggctccacacgaataagggggacctgaacctggagctccactgtgatctcactcctaaaacatgtgagaacttcatccgactgtgcaagaaacattactacgacgggacaatcttccaccggtcgatcaggaatttcgtaatacagggcggagacccaacaggcacagggaccggcggtgagtcatactggggcaagcctttcaaggacgagttccgcccaaatctgtcccacaccggtcgtggtatactttccatggccaactccgggccaaactcaaacaggtcccagtttttcatcaccttccgctcctgtgcttacctggataagaaacacacaatattcggtcgggtggtcggcggattcgacgtgttaacagcaatggaaaatgtggagtccgatcccaaaaccgaccgacctaaagaagagattaggatcgatgccactactgtgttcgtggacccgtatgaagaagccgatgcacagattgctcaggaacgcaagacgcagctgaaggttgctccagaaaccaaggtgaaatccagtcaacctcaggcagggtcccagggaccacagactttccggcaaggtgtgggtaagtatattaacccagccgcaaccaaacgtgccgctgaagaggagccaagtactagcgccaccgtgccaatgtccaaaaagaagccatcaaggggctttggagacttttctagttggtag

SEQ ID NO: 234295 - DNA, 1584 bp, Artificial Sequence
  Description of Artificial Sequence: Synthetic coding sequence
atggggaaacggcagcaccagaaggataagatgtacatcacctgcgcagagtacactcacttctatgggggtaagaagccggatttgccccagactaattttagacgtctcccattcgatcactgctctttgagtctgcagccctttgtctaccctgtctgtacaccggatgggatcgtgtttgatctcctgaacattgtgccctggctgaaaaagtacggcacaaatccctcaaatggtgagaagcttgacggccgttcccttattaagttaaactttagtaagaactccgaaggtaagtaccactgccccgtcctattcacagttttcaccaataacactcacatagtggccgtcagaaccaccggcaacgtgtatgcgtacgaggccgtggagcagttaaatattaaggctaaaaactttcgagacctcttgaccgatgaacctttctctaggcaggatattattacactgcaggatcctactaacctggacaaattcaatgtttcaaacttctatcacgtcaaaaataatatgaaaatcatcgacccagacgaagagaaagcgaagcaggatcctagctactacctgaagaatactaatgcggagacccgcgagactctgcaggagctgtacaaagaatttaagggcgatgaaattctggccgctaccatgaaagctccagaaaaaaaaaaggtggataaactgaatgcagcccactactctacaggaaaggtgtcggcaagctttacctccaccgccatggtaccagagaccacacacgaagcggcagccatcgatgaggacgtgctgcggtaccagttcgtaaagaaaaaaggctatgtacgccttcacaccaataaaggggatctcaacttggagctgcattgcgatctgacccctaagacctgtgaaaatttcatccgtctctgcaaaaaacattactatgacgggactatctttcacaggtctattagaaacttcgtaatccaggggggtgatccgaccggcactggtaccgggggtgaatcatactgggggaaaccatttaaggacgagtttagaccaaatctgtcccataccggcagggggatcttgtccatggccaattctggcccaaatagcaaccgatcgcaatttttcattacatttcggtcctgcgcctacctcgacaaaaaacataccatatttggacgcgtggttggaggattcgatgttttgacagcaatggaaaacgtcgaaagcgatccgaaaaccgatcggcctaaagaagaaatccgcattgacgctactactgtgttcgtggatccctacgaagaagcagacgctcaaatcgcgcaggaacgaaagacccagctgaaagtggccccagagacgaaagtgaaatcctctcagcctcaggctggctcccagggtcctcagaccttccggcagggtgtcggtaaatacattaacccagcagcaacggagcagcaaaggaagtcaccgcaacctgttccactctctccttgtccaagacggtcacccgtgggggttctcgggaccagcgcgccaggcagcagccgactccctgatgatcattag

SEQ ID NO: 234296 - DNA, 1470 bp, Artificial Sequence
  Description of Artificial Sequence: Synthetic coding sequence
atgggcaagaggcagcatcagaaagataagatgtacattacttgcgcagagtacacccacttctacgggggaaagaaacccgatctcccgcaaacaaactttagaagactccctttcgaccactgtagaaatattgtaccctggctaaaaaagtatggcactaatccgtccaatggtgaaaaactggatggacggagcctcattaagctcaatttcagcaaaaattccgagggcaagtaccactgtcccgtgctgtttaccgtgttcactaataatacccacattgtggccgtccgcacaactggtaacgtatatgcctacgaagctgttgagcaactcaacattaaagccaaaaactttagagatctgttgactgacgagccattcagccggcaggatatcataactctccaagaccctacaaacctcgacaaattcaatgtcagcaacttctatcatgttaaaaataatatgaaaattatcgaccccgatgaagaaaaggcaaaacaagatccatcatattatctcaaaaacacaaatgccgaaacgcgcgaaaccctgcaggaactctacaaagaattcaagggcgatgaaattttggctgccaccatgaaggcacctgagaagaagaaggttgacaagctcaacgccgcacattactccaccggcaaggtgagcgctagctttacgtcgaccgcgatggtgcccgaaactacccacgaggcagctgccattgatgaagatgttcttcggtatcaatttgtgaagaaaaaggggtacgttcgactgcatacgaacaaaggagatctgaacctggagctgcactgtgatctcaccccaaagacgtgcgagaactttatccgcctctgtaaaaaacattactacgacggcaccatctttcaccggagtattagaaatttcgtgattcaagggggagaccccacaggaacagggactgggggtgagtcatactggggcaagcccttcaaggacgaatttcggcctaatttaagccacaccgggcgagggatcttgtctatggctaacagtgggccaaactcaaataggtcccagttctttatcacatttcgaagttgcgcctacctggataagaaacacacaatcttcggccgtgtagtcggtgggttcgacgttctgacagcaatggagaatgtagaatccgatccgaagaccgataggcctaaagaggagatcaggatcgatgcaaccactgtgttcgttgatccatatgaggaagccgatgcccaaatagcccaagaaagaaagactcagttgaaggaagccagtagtcgcggtagggccttaaaccagtgtcattgtcctcacgtgcaggaggaggcccagtccgggttctgggggctccaactgctagtcgctgcagctacttgtaggctgtacctgtgccctagtttttcccaccaaagcctgatgctcaaactgcaggcctag

SEQ ID NO: 234297 - DNA, 1563 bp, Artificial Sequence
  Description of Artificial Sequence: Synthetic coding sequence
atgggcaagaggcagcaccagaaggacaagatgtacattacctgcgcggaatacacacacttttatggcggtaagaagccggacctgccgcagacaaattttaggcggttaccgtttgaccattgttcactgagcctgcaaccctttgtttatccagtgtgtacccccgatggtattgtctttgacctcctcaacatcgttccatggctgaagaaatacggtacaaatcctagcaatggtgagaagcttgacggtaggagcctcattaagctgaatttctccaagaatagcgaaggtaagtaccattgtcccgtgctgttcaccgtgttcacaaataatacccacatcgttgcagttcggactactggcaacgtgtatgcatacgaggccgtcgagcagctgaacatcaaggctaagaacttcagagacttactgaccgatgaaccattttccagacaagatatcattaccctgcaggatcctacaaatctcgacaaatttaacgtgagtaacttttaccatgttaaaaacaacatgaaaattatcgacccggacgaagaaaaggctaagcaagatccgtcttactaccttaaaaatacgaacgccgagacacgcgaaaccctccaggaactgtacaaggagtttaaaggcgacgagattctcgctgccacaatgaaagcgccagagaagaagaaggtcgacaaactgaacgcagcccactattcaaccgggaaggtttcagccagttttacgtcaactgccatggtacctgaaaccacacatgaagctgccgcaatagacgaagacgttctgcgttaccagttcgtgaagaaaaaaggctatgttcggctgcatacaaataagggagacctgaatctggaactgcattgcgacttgacaccaaagacatgcgaaaacttcatcagattatgcaagaagcactattacgatggtaccatctttcacagaagcattcgtaattttgtgatccagggaggcgatcccacaggaaccggaactggcggagaaagctattggggcaagcctttcaaagatgagttccgccctaacctctcacatacaggcaggggaattctttctatggcaaatagcgggccaaactcaaaccggtctcaatttttcattacatttcggagctgtgcatatctcgacaagaaacacaccatcttcgggcgagtcgtgggcggattcgacgtcttgactgcaatggagaatgtggagagcgacccaaaaacagaccggccaaaagaagaaattagaattgatgccacaaccgtgttcgtcgatccgtacgaagaagcagatgcccagatagcccaggaacgcaaaacacagctcaaagtcgctcccgaaaccaaggtgaagtcttcccaaccacaggccggttcacagggtcctcaaacgtttagacagggagtgggtaagtacattaaccccgctgcaacaaagcgcgctgcagaagaagaaccgtcaacgagcgccaccgtacccatgagtaaaaaaaagccctcccgcggatttggcgacttctcaagttggtag

SEQ ID NO: 234298 - DNA, 1479 bp, Artificial Sequence
  Description of Artificial Sequence: Synthetic coding sequence
atggctgtgttattggaaactacgctgggggacgttgtgatcgacctgtacaccgaggagagacccagggcctgcttaaactttcttaagttgtgcaaaatcaagtactataattactgccttattcataatgtgcagcgtgacttcatcatacagactggagaccctaccgggactgggaggggaggagagagcattttcgggcagctatacggcgaccaggcatcctttttcgaggccgaaaaagtccccaggataaagcacaagaagaaggggacagtgtcgatggttaacaacgggtctgaccaacacgggtctcagtttctgattacgactggagaaaatttggattacttagatggggtccacacggtgtttggcgaggttaccgaaggtatggacatcattaaaaaaataaatgaaaccttcgtcgataaggatttcgtcccttatcaagacattcggatcaaccacaccgtgatcctagatgaccctttcgacgacccccctgatctcctgataccagacaggtcgccagaacccacccgtgaacagctggattctggaagaattggagcagacgaagagatcgacgacttcaaagggagatctgctgaagaggtcgaggaaatcaaggcggaaaaagaggccaagacccaagctatccttctggaaatggtaggcgatctccccgacgctgatatcaagcctccagagaatgtactattcgtctgcaaactgaaccctgtaaccaccgacgaggacctggagattatattctcaagatttggtcctatcaggtcttgcgaggtaattagggactggaaaacaggcgagagcttatgctatgccttcatcgagttcgagaaggaagaagattgtgaaaaggccttttttaagatggacaacgttctaatagatgatagaaggatccatgttgatttttctcaatctgttgcgaaggtaaagtggaaagggaaaggagggaaatacaccaagagcgactttaaggagtacgaaaaagagcaggacaaacctcccaaccttgtactgaaggacaaagtgaaaccgaaacaggataccaagtacgacttgatacttgacgagcaggccgaagactctaagtccagccactcacacacttctaagaagcacaagaagaagactcatcattgctccgaagaaaaggaggacgaggactacatgccaataaaaaatactaaccaagatatttaccgcgaaatgggatttggccattacgaggaggaggagagttgttgggagaagcaaaagtcagagaaacgtgaccggacccagaatcgatccaggtcacgatctcgtgaacgggatggccattatagcaattctcacaagagtaaatatcagacggatctgtacgagagggagcgatccaagaaacgcgatagatccagaagtcctaagaaatctaaggacaaggagaagtccaagtacaggtag

SEQ ID NO: 234299 - DNA, 384 bp, Artificial Sequence
  Description of Artificial Sequence: Synthetic coding sequence
atgtcaagacctaagacccaaaatcaagtcacccatacccaagttaagaatacgagacggaagcccatcactgttcttaaaagaaaaaaaatgcgtactacttgtcagtccaaaatcctgattagaattagcattgagaagtgggggctcgttaccatgaagaagaaaaaggccgtcggacgcaataagcgtgtcaaacgagagacggagcttcggaccgaggtggtggctgacctcgagcggggtatggccataatcgtcatagtgatcaatcaaaacacaaagcagattttcatgaaggagaagggagtgaaacgcgaaaccgaagccgaagtgcagcggagcccgaagattaagaaaaacctgagtatagacgaacggtag

SEQ ID NO: 234300 - DNA, 318 bp, Artificial Sequence
  Description of Artificial Sequence: Synthetic coding sequence
atgtgccagggcggagattttacacgtcataatggaacaggagggaagtctatttacggcgagaagtttgaggacgaaaatttcattctgaagcacactggtcccggtatcctgtcaatggccaatgccggaccaaacaccaatgggtcccagttcttcatttgtacggcaaaaactgagtggcttgatggaaagcatgtggtctttggtaaggtgaaggagggcatgaatatagtggaggctatggagagattcgggtccagaaacggcaagacatcgaagaagatcaccattgccgactgcggtcagctcgagtag

SEQ ID NO: 234301 - DNA, 390 bp, Artificial Sequence
  Description of Artificial Sequence: Synthetic coding sequence
atggtcaaccctaccgtatttttcgacatcgcggttgacggcgagcccctggggagggtgtccttcgagctgtttgccgataaagtgccgaagacggcggagaactttagagccctctccactggagagaagggattcgggtacaaggggtcatgtttccataggatcatccccggtttcatgtgccagggaggggacttcacacgccacaatggaactgggggaaaaagcatatgtactgcgaagacggaatggctggatggcaaacatgtggtttttgggaaggttaaggaaggcatgaatatcgtggaggccatggagcggtttgggtcacggaacggcaaaacctccaagaaaataacgatcgctgattgtggccagctggagtag

SEQ ID NO: 234302 - DNA, 498 bp, Artificial Sequence
  Description of Artificial Sequence: Synthetic coding sequence
atggtgaaccctacggttttttttgacatcgccgttgacggagaaccccttgggcgagtatcctttgagctgtttgcggacaaggtccccaaaacggctgagaatttccgcgcattatctacgggtgagaaaggattcggctacaagggatcctgtttccatagaattatccccggtttcatgtgtcaggggggtgactttactagacataacggcaccggagggaaatccatctacggggagaaattcgaagacgagaatttcattcttaagcacaccggaccaggcatactgagcatggccaatgccggacccaacactaatggttcacagttctttatttgcaccgctaagaccgaatggctcgacgggaaacacgtggtcttcggtaaagtcaaggagggcatgaacatagtcgaggcaatggagcgtttcggaagcaggaatggcaagacctcaaagaaaattactatcgccgactgcgggcagttagagtag

SEQ ID NO: 234303 - DNA, 495 bp, Artificial Sequence
  Description of Artificial Sequence: Synthetic coding sequence
atggtgaactccgtggtttttttcgatatcacggtggatgggaaaccccttggcaggatttccattaaactatttgccgataagattctcaagaccgccgagaattttagggctctgagcaccggcgaaaaaggatttagatacaagggaagttgctttcacaggatcatacccggatttatgtgtcaagggggtgacttcacgaggcacaacggaactggtgacaagagcatttatggtgagaagtttgatgacgaaaatctgatccggaagcacaccggcagtggcatcttatcgatggctaatgcaggaccgaatacgaacggatcccagtttttcatctgtgcagcgaaaaccgaatggctcgatggcaaacatgtggcattcgggaaggtgaaggaacgggtgaatatagtggaagccatggagcactttggataccgtaactctaagacctccaaaaagattactattgctgattgtggccaattctag

SEQ ID NO: 234304 - DNA, 651 bp, Artificial Sequence
  Description of Artificial Sequence: Synthetic coding sequence
atgctacgactgagcgagcgcaacatgaaggtgcttctagcggcagctctcattgccggttcggtgttctttctcctgctgccaggaccttcagctgctgatgagaaaaagaagggcccaaaagtcacagtgaaggtctatttcgacctgcgcattggcgacgaagacgtgggcagggtaatcttcgggctatttgggaagaccgtgcccaagaccgtggataactttgtcgcgctggccaccggcgagaaggggtttggctacaagaacagcaaattccaccgggtgataaaggactttatgattcaaggcggtgacttcacacgaggagatggtacaggtgggaaatccatctacggtgaacggttccccgacgagaattttaaactgaaacactacggcccaggctgggtctccatggcaaacgctggcaaggataccaacggctcccaattctttatcaccaccgttaaaactgcgtggctggacggtaaacatgtcgtgtttggaaaggtcctcgagggaatggaagtcgttcggaaagtcgaatctaccaagacagattctcgcgataaacctctgaaagacgttatcattgctgactgcggcaaaattgaagtcgagaaacccttcgctattgctaaggagtag

SEQ ID NO: 234305 - DNA, 639 bp, Artificial Sequence
  Description of Artificial Sequence: Synthetic coding sequence
atggggccagggccaagactcctcctgccactggtactgtgtgtcggattgggtgctctggtcttttcgtcaggagctgaggggttccggaaacggggacctagcgtcaccgcaaaggtctttttcgacgtgcggataggggacaaggatgtcggccgtatcgtgataggcctgttcggaaaagttgtgcctaagactgtagagaacttcgtcgccctcgccactggagagaaaggatacgggtacaagggctcaaaattccaccgagtaataaaagattttatgatccaagggggagatatcacaacaggggacggcaccggcggagtctccatctacggggagacttttccagatgaaaactttaagctgaagcactacggcataggctgggtgtccatggctaatgccggaccagatacaaacggctctcaattttttattaccctaacaaagcccacttggcttgacgggaaacatgtggtgttcggcaaggtcattgatggcatgactgtagtccatagcatcgagctgcaggcaacagacggccacgacaggcctctaactaactgctcaattattaactccggcaagattgatgttaagactcctttcgtcgttgaaatcgccgactggtag

SEQ ID NO: 234306 - DNA, 1113 bp, Artificial Sequence
  Description of Artificial Sequence: Synthetic coding sequence
atgagccatcctagcccgcaagccaaaccatcaaatccttcgaacccccgagtgttctttgatgtcgacatcgggggtgaaagagtggggcgaatcgtgctagagctctttgcagacatagtgcccaaaaccgccgagaattttcgggctctgtgcaccggtgaaaagggcataggccacaccaccgggaaacccctacacttcaagggctgtccatttcacaggattataaagaaattcatgatccagggcggtgactttagcaatcaaaatgggacagggggagagagcatttatggcgagaagtttgaggatgaaaacttccactacaaacacgaccgtgaagggctgctgtctatggctaatgccggacgcaacacgaatgggtcccagttcttcatcaccacagtcccgacccctcacctcgatggtaagcatgtggtgtttggacaagtgatcaagggtatcggcgtcgcgagaatcctggaaaacgtggaagtgaaaggcgaaaagccagccaaactgtgtgtgattgccgagtgcggggaactgaaggaaggtgatgacggtggcatttttccgaaagacgggtctggcgatagccacccagacttcccagaggacgctgacatcgacttgaaagatgtcgacaagatactgctcataacagaagatctgaaaaacatcgggaacaccttcttcaagagccagaactgggagatggctattaagaaatatgcagaagtcctccgttatgtggattcgtctaaggctgttatcgagacagccgatagagctaaactgcagccaatagctctgagctgcgtcctgaacattggcgcatgcaaactgaaaatgagcaactggcagggagccatcgactcttgcctggaggctctggagctggacccttcaaataccaaggccctgtacaggcgcgcacaggggtggcagggcctgaaagagtacgaccaggctctcgcggacctgaagaaagcccaaggcattgcgcctgaggacaaggccatacaggctgagctgttgaaggtgaaacagaaaattaaggctcaaaaagacaaggaaaaagccgtctacgcgaaaatgttcgcttag

SEQ ID NO: 234307 - DNA, 597 bp, Artificial Sequence
  Description of Artificial Sequence: Synthetic coding sequence
atggacgctattctgaactacagatcagaggacacagaagactactacactcttttgggctgcgacgaactttcctctgtagaacagatcctggccgaattcaaagttagagcattggaatgccaccccgacaagcatcccgagaatcctaaggctgtggaaacgttccagaagcttcaaaaagcaaaggagatcttgacaaatgaggaaagccgagcacggtacgaccattggaggcggagccagatgagcatgcctttccagcagtgggaggcgctcaacgattccgtcaagacctcaatgcactgggtggtgcgtggcaagaaggacctgatgctggaggaatctgataagacccacacgactaaaatggagaacgaggagtgcaatgagcaaagagagagaaaaaaagaggaactcgcctccactgcagagaaaactgagcagaaggaaccaaaaccactggaaaagagcgtgagcccacaaaatagcgactcatcaggtttcgccgatgtcaacgggtggcacttgcgctttcggtggagcaaagacgctccctccgaactcctacgaaagttccgaaattacgagatttag

SEQ ID NO: 234308 - DNA, 468 bp, Artificial Sequence
  Description of Artificial Sequence: Synthetic coding sequence
atgctcgctttgagatgcggttctaggtggctcggcctattaagtgtaccgaggagcgtccccctgaggctccccgctgccagagcatgttccaaaggctccggcgatccctcttccagctctagtagcggaaacccattggtgtatctcgacgtggacgctaatggcaagccattgggaagggtggttctcgagctgaaggcagacgtggttcccaagacggcagaaaacttccgcgcattgtgtacaggggaaaaggggttcggctacaaagggtctacttttcatagagtcatcccctcatttatgtgtcaggctggagactttactaatcacaatgggacaggcggaaagagtatttacggtagcaggtttcctgatgaaaattttactctgaagcacgttggacccggatggatggctagtatgctgtgcagcgtaacctccaagagggcttggacctcctag

SEQ ID NO: 234309 - DNA, 498 bp, Artificial Sequence
  Description of Artificial Sequence: Synthetic coding sequence
tgatcctcctcatcaagctctggtaatcccctggtgtacctcgacgtcgacgcaaatggaaaaccattgggtcgggtcgtgctggagctgaaagccgacgtggtcccaaaaaccgccgagaacttcagggcactgtgtactggagagaaggggtttggctataaaggatcgacctttcaccgggtgatcccgagctttatgtgccaagccggtgacttcacaaaccataatgggaccggcggaaaaagcatttacgggtccagatttcccgacgaaaattttacgttgaagcatgttggtccaggcgtgctaagcatggctaacgccggacccaataccaacggcagccagttttttatttgtaccattaagacagattggtctatggcgttggatgacatcgcattgcactgttgttctcccggatctcctgtgctgacggggtggatggcaagtatgctgtgctcagtgacctctaagagagcatggacatcttag

SEQ ID NO: 234310 - DNA, 2265 bp, Artificial Sequence
  Description of Artificial Sequence: Synthetic coding sequence
atgggaatcaaggttcagcgcccaaggtgtttcttcgatattgctatcaacaatcagcctgccggaagagtggtgtttgaactcttctccgatgtgtgccccaagacctgtgaaaatttcaggtgtctgtgcactggtgagaagggaaccggcaaatcaacccagaaaccactacactataaaagttgtttatttcaccgggttgttaaagattttatggtacaggggggtgatttctcggaagggaatggtagaggcggtgaatcaatttatgggggattcttcgaggatgaatcttttgccgtaaaacacaataaggaatttttattgagcatggccaacagagggaaagatacgaatggctcacagttttttataacgacgaagccaactccacacctagacgggcaccatgtggttttcgggcaagtgatctcaggccaggaggtggtccgtgaaatcgagaatcagaaaaccgacgccgcaagcaagcctttcgcagaagtcagaatcctgtcttgtggagagctcatccctaagtctaaggtcaagaaggaggagaagaagcggcacaaatcttcttcctcatcatctagcagctcttccgattccgacagcagtagcgattctcaatcttcgtccgatagtagtgacagcgagagtgcaacagaggagaagtccaagaaacgaaaaaagaagcatagaaagaattcgcgcaagcataagaaagaaaagaagaagaggaagaagagcaaaaagagtgcgagtagcgagtcggaagctgaaaacctggaggcccagcctcagtctacggtcagaccggaagaaatacccccaattcccgagaataggtttcttatgcgtaagtcacctcccaaggcagatgaaaaggagcgtaaaaatagggaaagagagagggagcgcgaatgcaacccacccaactctcagccagcgagctatcagaggagactcctagttacacgctcgggtagaaaaatcaaagggaggggccctcgcagatatagaacgcctagccggtcacggtcaagagacagattcaggcgcagtgagactcctccccactggagacaggagatgcagcgggctcagaggatgcgcgtaagttctggagagaggtggattaaaggggacaaaagcgagcttaacgaaatcaaggagaatcaacgcagcccagtacgcgttaaggaacgaaagattaccgatcatagaaacgtcagcgaaagcccaaaccggaagaatgaaaaggaaaagaaagtcaaagaccacaagtctaacagcaaagagcgcgacatccgaaggaattccgagaaggatgataagtacaaaaacaaggtaaaaaagcgagccaagtcgaagtcacggtccaagagtaaagaaaagagcaagtctaaggagagagacagtaagcataataggaacgaagagaaacgaatgagatctagaagcaagggtagagaccatgaaaatgtcaaagagaaagagaaacagagtgatagcaagggaaaggatcaagaaagatctagatcaaaggagaagtccaagcaactcgagtcaaagtccaacgaacatgatcacagcaagtcgaaagagaaggacaggagggcccaaagcagaagccgggagtgcgatattacaaaaggaaagcactcctataacagtaggacccgggagaggtctcgctccagagatcggagccgcagagtgcgttctaggacccatgatcgggaccgcagccggtccaaggagtaccatcgctacagagagcaggaatatcgacgaagaggcagatcaaggtcccgtgagaggcggacaccccctgggagaagcaggtctaaggatcggcgtcggaggcgacgggatagcagatcaagcgagcgcgaggagtcccagtctcgaaacaaggacaagtacaggaatcaggagtctaagtccagtcataggaaggagaactccgaatccgagaaaagaatgtattctaaatcccgcgatcacaacagctccaacaattccagggagaagaaggcagatcgagatcaaagccccttcagtaagattaagcagagttcccaggataatgagttgaaatcaagtatgttgaaaaataaagaagatgaaaagatccgatcttccgtcgagaaagaaaaccaaaaatccaagggacaagagaatgatcacgtgcatgaaaagaacaaaaaattcgaccacgaaagcagccccggaaccgatgaggataagtctggctag

SEQ ID NO: 234311 - DNA, 741 bp, Artificial Sequence
  Description of Artificial Sequence: Synthetic coding sequence
atgggaattaaagttcagcggccacgatgtttcttcgacattgccataaacaaccagcctgccggtcgggtcgtatttgaacttttttcagacgtgtgtcccaagacctgtgaaaacttcaggtgcttatgcaccggagaaaagggaactgggaagagtacccaaaagcctctgcactacaaaagctgcctgttccaccgcgttgtgaaggacttcatggtgcagggcggagactttagcgaaggaaacggccgtggcggtgaatcaatttatgggggatttttcgaggatgagagtttcgctgtcaagcataacaaggagtttctcctatcaatggcaaaccgaggaaaggacaccaatggaagtcagtttttcatcaccactaagccaacccctcacttggatggccaccacgtcgtgttcggacaggtgatttccggccaggaggttgtgcgcgagattgaaaatcagaagacagacgccgcttccaaaccatttgcagaagtgagaattctgtcttgtggagaattgatcccaaagagtaaagtgaaaaaagaagagaaaaagcgccataaatcctcaagcagctcatcaagttcatctagcgacagcgatagttcctccgattcccaatctagctcggacagctccgattcagagtctgccacggaggagaaatccaagaaaagaaagaagaagcatcgcaagaatagtcggaaacacaagaaagagaagaagtag

SEQ ID NO: 234312 - DNA, 180 bp, Artificial Sequence
  Description of Artificial Sequence: Synthetic coding sequence
atgggcattaaggttcagcggccacgctgcttctttgacattgctataaacaatcagcctgcaggccgtgttgtgtttgagttgttctcagatgtctgcccaaaaacctgcgagaattttaggtgcctctgcactggcgagaaggggactggcaagtctacacaaaagcctctccactag

SEQ ID NO: 234313 - DNA, 2265 bp, Artificial Sequence
  Description of Artificial Sequence: Synthetic coding sequence
atgggaatcaaggtgcaacggcctcgctgttttttcgacatagccattaacaatcagcctgcaggaagagtagtttttgaactgttttccgacgtatgtcccaagacatgtgagaactttcgatgtctctgcacaggtgaaaaaggcactgggaagtccactcagaagcctctgcactacaaaagctgtctatttcatcgggtagtgaaagatttcatggtgcaaggtggcgacttttccgaaggcaacggacgcggaggtgaaagtatctatgggggattctttgaggacgagtcttttgcagtgaagcacaacaaggagttcctgttgtcaatggcgaatcgcggaaaagacacaaacggttctcagttctttattacaaccaaacccactccgcaccttgacggacaccacgtagtgttcgggcaggtgatttccggacaggaggttgtgcgcgaaatcgagaatcagaaaacggatgccgctagcaaacctttcgctgaggtccgcatcttatcatgcggtgagctcatccctaagagcaaagtaaagaaggaagagaagaaacgacacaagtcaagctcttcttcaagttcctccagctcagatagtgactcttcgtctgacagtcagtcttctagcgactcctccgatagcgaaagtgctacggaagaaaaaagcaagaagcgcaagaagaagcaccgcaagaatagtcggaaacataaaaaagaaaagaagaagcgaaaaaaaagcaagaagagcgcctccagcgagtcagaagccgaaaatctagaggcccagccacagtcgaccgtgagaccagaggaaatcccgccaattcccgagaacagatttttgatgcggaagagtccccctaaggccgatgagaaagaaaggaaaaaccgggaaagagagcgcgagcgagagtgtaaccccccaaacagccagcccgcatcttaccagagaagattgttggtgactcgatctggtagaaaaataaaaggcaggggtccaagacgttatcgaactccttctaggagccgtagtcgagatcggttcagaagatcagagacgcccccacattggcggcaggaaatgcaaagggcacaaagaatgagagttagctcaggcgagagatggatcaaaggtgacaaaagtgaactgaacgagattaaggaaaaccaaagatcaccagtaagagttaaagaaagaaaaattaccgatcatcggaacgtctccgagagtccaaaccggaagaatgagaaagaaaaaaaggtgaaggatcataagtcaaacagcaaagagcgcgacatacggagaaattcggagaaggacgataaatataaaaacaaagttaagaagcgcgctaagtcaaaatcacgctccaagtccaaagagaagtccaaaagtaaagaaagagactccaaacacaaccggaatgaagagaagaggatgaggtctcgtagtaaaggaagagaccacgagaacgtgaaggagaaagagaagcaatctgactcgaaaggaaaagaccaggaaaggagccgaagcaaagaaaaaagcaaacagcttgagtctaaatccaacgaacacgatcattccaagagcaaggaaaaggaccgccgagcccaatctaggagtcgggaatgtgacataactaagggcaagcattcttacaacagtagaacaagggagcggagtcgtagcagagatcgatcacggagagtaagaagtcggacacatgaccgggatcgcagtaggtctaaagagtatcatcgctatcgagagcaggaatatcgcaggcggggtcggagcagatccagagagagacgcacgccccctggccgatccaggagcaaggacaggcgcaggaggagaagggactcccgctcatccgaacgggaggaatctcagtctcgtaataaagataagtaccgcaatcaagaatccaaatcctcccacaggaaggagaacagtgagagcgaaaaacgaatgtactctaagagtagagaccataattcatccaataacagtcgagagaagaaagcagatcgggaccagagccccttcagcaagatcaagcagtcctcccaggacaatgagctaaaaagctccatgcttaagaataaagaggatgagaagattagatcctcagtcgaaaaagaaaatcagaaatccaagggtcaagagaacgaccacgtgcatgagaagaataaaaaatttgaccatgagagcagcccaggtaccgacgaggacaagtccggatag

SEQ ID NO: 234314 - DNA, 1347 bp, Artificial Sequence
  Description of Artificial Sequence: Synthetic coding sequence
atgggaatcaaggttcaacggcctagatgttttttcgacatagccataaacaaccaaccagccggacgggtggtttttgagttattcagcgacgtatgccccaaaacttgcgaaaatttccgatgtctgtgtactggagagaaggggaccgggaaatctacccagaagccgttacattacaagagctgcttatttcatcgggtggtcaaggacttcatggtgcagggtggggacttctccgaagggaacgggcgtgggggagaatctatctacggcggtttcttcgaagatgaaagctttgccgtgaaacataacaaagaattccttctgtcaatggctaatcgtggaaaagacaccaatggaagtcagttcttcatcactacgaaacctacacctcacttggatggtcatcacgtcgtgtttggacaggttatctcaggccaggaggttgttagagaaattgagaatcagaaaactgatgccgcttcgaagccttttgctgaggtgcgtatcctgtcttgtggagagctgattcctaaatctaaggtgaagaaggaagagaagaaaagacataagtcttcaagctcttctagctcatcctctagtgattctgacagctcctctgactcccagtcaagcagtgattcgtccgattctgaaagtgccacggaagaaaagtcaaagaagagaaagaaaaaacacaggaaaaactcgaggaaacataaaaaggaaaagaagaagcgcaagaagtccaaaaagtctgcgtcaagtgaatcagaggccgaaaacctggaggcccaaccacagtctacagttcgccctgaggagatcccaccaattccagagaataggtttctcatgcggaagtctccccctaaggccgacgagaaggaacgtaaaaacagggagagagagagggaacgcgagtgcaacccacctaactctcagcccgcaagctaccaacgcagactactggtaacccgatccggtcgtaagatcaagggacgcggaccgaggcggtatagaacaccaagtcgatcccgttctcgtgaccgatttagaaggtctgagaccccgccacactggcggcaggagatgcagcgcgctcagaggatgcgcgtgagcagcggagagcgctggattaagggcgacaagtcagagctcaacgagatcaaagagaatcagcgatcacccgttcgcgtgaaggagcgtaaaattacagaccaccggaatgtctccgaatcccccaaccgtaaaaacgagaaggagaaaaaagtgaaagatcacaaaagcaattctaaggagcgagacattagaagaaaaaagaagaagaagaagaaaaagtag

SEQ ID NO: 234315 - DNA, 534 bp, Artificial Sequence
  Description of Artificial Sequence: Synthetic coding sequence
atggccgtcgccaatagtagtcctgtgaaccctgtggtattttttgatgtgtctatagggggacaggaggtcgggagaatgaagatagagctttttgcagatgtcgttccgaagactgccgaaaattttcggcaattctgcaccggggaatttagaaaagatggcgtgcccattggctacaaaggaagcacattccatcgagttatcaaagacttcatgattcagggtggggatttcgtcaatggagatgggacgggtgtggccagtatataccgagggccatttgccgatgagaatttcaagctccggcattctgcacccggactacttagtatggctaacagcggaccctcgacaaacggctgtcaattcttcattacctgctcaaagtgtgattggctagatggaaaacatgtggttttcgggaagattattgatggactgctggttatgcgcaagatagagaatgtgcccaccgggcctaataacaagcccaagctgccggtggtgatttcccagtgcggagaaatgtag

SEQ ID NO: 234316 - DNA, 174 bp, Artificial Sequence
  Description of Artificial Sequence: Synthetic coding sequence
atgaaaatcgagctatttgccgatgttgtcccaaaaaccgccgagaactttcgacagttctgcaccggcgagttcaggtctgtgtcagatgtgtttgatttcttcgcctgctccagaggggtgttctgggggtgcagtgaaggcattggcgagccgccagccggactcgaatag

SEQ ID NO: 234317 - DNA, 405 bp, Artificial Sequence
  Description of Artificial Sequence: Synthetic coding sequence
atgatcgcaggcgactcagaccgccgaaaggatggagtcccaattggctataaaggcagtacctttcaccgagtcatcaaggactttatgattcagggcggagattttgtgaatggagatgggactggcgttgctagcatatataggggcccattcgctgacgagaactttaagttgcgacattccgcccctggactcctgtctatggcaaattccggtccaagcaccaacgggtgccagttctttattacctgcagtaagtgtgattggctcgatggaaagcatgttgtatttggcaagataatcgatggcctattagtaatgaggaagattgagaatgtccctaccgggcctaataataaacccaaattaccggtcgtgatctcccagtgcggtgagatgtag

SEQ ID NO: 234318 - DNA, 207 bp, Artificial Sequence
  Description of Artificial Sequence: Synthetic coding sequence
atggtcaattggaagggtttggtcctgccagccgtgacccctagtttgttcctctttgggtacaggaaggatggagtcccaatcggttacaaaggctccacttttcatcgggtgataaaggattttatgatccagggcggagactttgtgaacgtgagtactattcctttcctgtccaaaacaagatcgttctctttctgttgttag

SEQ ID NO: 234319 - DNA, 435 bp, Artificial Sequence
  Description of Artificial Sequence: Synthetic coding sequence
atgaagattgagctgtttgccgacgtggtgccaaagacagctgagaactttagacagttctgcacgggagaattcagaaaggacggtgtaccaattggctacaaagggtccacattccaccgcgtcatcaaagactttatgatccagggcggtgactttgtcaacggagacggaactggagtggccagcatatatcggggaccctttgctgacgagaattttaagctgcgtcattcagcccctggactgctgtccatggcaaattcagggccaagcactaacggatgtcaattcttcatcacatgttcaaaatgcgactggttggacgggaagcacgtggtcttcgggaagattatcgacggactccttgtgatgagaaagattgaaaacgtgccaacgggcccaaataataaacctaaactgcccgtggtgtag

SEQ ID NO: 234320 - DNA, 405 bp, Artificial Sequence
  Description of Artificial Sequence: Synthetic coding sequence
atgattgccggtgattccgaccgccgaaaagacggggtgccgatcgggtacaaaggctccacattccacagggttatcaaagactttatgatccagggcggagacttcgtaaatggtgatggaaccggcgtggcctccatttaccggggtccgtttgcagacgagaacttcaagcttagacatagtgccccaggactgttatcaatggccaattccggcccaagcactaacggctgccagtttttcatcacttgcagcaagtgcgattggttggacggcaagcacgtggttttcggaaaaattatcgatggcctattagtgatgagaaagatcgagaacgttcccactggccctaataacaaaccaaaactgccagtggtgataagtcagtgcggcgagatgtag

SEQ ID NO: 234321 - DNA, 540 bp, Artificial Sequence
  Description of Artificial Sequence: Synthetic coding sequence
atgccttcgaaatcactggtgatggaatacctcgcacatccctcaactctcggtctggccgttggcgttgcgtgcggaatgtgtctgggctggtctcttcgggtgtgttttggcatgcttccaaaaagcaagacatccaagacgcacaccgacacagaatctgaggcgtctattcttggcgacagcggtgaatataaaatgattcttgtggttaggaatgatcttaaaatgggcaaaggcaaggtggccgctcagtgtagccatgccgctgtgagtgcctataagcagatacaacgcagaaatcccgagatgctgaaacagtgggaatattgcggtcagccaaaggtggtcgtgaaggctccagatgaggagactctgattgccctcctggcccatgcaaaaatgctcgggctgacagtttcactgatacaggacgccggaaggactcaaatcgcccctggctcccagacggttctgggaattggacccggacccgctgatctgatcgacaaggttaccgggcacctgaaactctactag

SEQ ID NO: 234322 - DNA, 543 bp, Artificial Sequence
  Description of Artificial Sequence: Synthetic coding sequence
atgatgccctctaaatctttggtgatggagtatctcgcacacccttcaacccttggcctggctgttggcgtcgcatgtgggatgtgcctgggatggtctttacgggtctgttttggtatgcttcccaagagcaaaacatcaaagactcatacagatacagagagtgaagcaagtatcttgggcgactcaggggagtacaagatgatccttgtagtccgaaacgatcttaagatggggaaggggaaggttgccgctcagtgtagtcacgcagccgttagtgcgtacaaacagatacagcggcgaaaccccgaaatgctgaagcagtgggaatactgtggacagcccaaggtggtagttaaggcccctgatgaggaaaccttaatcgctttgctcgcccacgcaaaaatgttgggtctgactgtgtctcttatccaggatgccggtcggacgcagatcgcgccaggcagtcagacagtcttaggtatcggacctggaccagccgacctcatcgacaaggtcactggccatctgaagctgtactag

SEQ ID NO: 234323 - DNA, 540 bp, Artificial Sequence
  Description of Artificial Sequence: Synthetic coding sequence
atgcccagtaaatcgctcgtcatggagtatttggcccacccctccaccctcggattggcggtgggcgttgcttgcggcatgtgtcttggttggagcttgagagtgtgttttggtatgttaccgaaatctaagacctcgaagactcatacagacacagagtccgaggcctctatcctgggggacagcggtgagtacaaaatgatattagtcgtgaggaatgatctaaaaatgggcaaggggaaggttgctgcccagtgctctcacgcagccgtgagcgcatacaagcaaatccagagaagaaaccccgaaatgttaaaacagtgggagtattgtggccagccaaaagtggtcgttaaagcacctgacgaagagacccttatcgccttattggcgcatgccaagatgctcggactgactgtgtccctgatccaagacgccggtcgcactcaaattgccccaggcagccaaacagttttaggaatcggacccggtccggctgatctgatcgataaggtcactgggcacctaaagctgtattag

SEQ ID NO: 234324 - DNA, 1668 bp, Artificial Sequence
  Description of Artificial Sequence: Synthetic coding sequence
atggctgctagactgctgctactgggtatattactcttactgcttcctctgcctgtgccggctccctgccacacagcggcaagatccgaatgtaaacgatcccataagttcgttccaggggcttggctggctggcgagggcgtggatgttacaagcttgcgcagatcgggcagcttccccgttgacactcagcgctttctgcgccctgacgggacatgcactctgtgcgaaaatgctctgcaggaaggaacactgcagcgcctcccgctagcgttgactaactggcgggctcagggatctggctgtcagagacatgtgacaagggccaaggtgtccagtactgaggcagtggccagagacgcggctagaagtatccggaacgactggaaagtgggcctcgatgtgactcctaaacccaccagcaatgtgcacgtttctgtagccggaagccattctcaagctgccaacttcgcagcgcaaaagactcatcaggaccagtactctttcagtacagacaccgtggaatgcagattttacagctttcatgtcgtccacaccccgccactgcacccagactttaagagagctctaggcgacctcccacaccacttcaatgcctctactcaacccgcatacctgcgcttgatctcaaactacggcacccactttatccgtgcggttgaactggggggaagaatttccgcccttaccgcccttcggacctgcgagcttgcactcgagggcctcactgataatgaggtcgaagactgcctgacagtggaggcacaggttaacatcgggattcacggcagcatcagtgccgaggccaaagcgtgtgaggagaagaaaaaaaaacataaaatgaccgctagtttccatcaaacttatcgcgaaagacactctgaggtggtaggtggacaccacacaagcataaatgacttactctttggaatacaagccggacccgagcagtactccgcctgggtcaattcccttcctggatcccccggtctcgtagactacacgctggagcctctgcacgtactcctggattcccaagatcccaggcgcgaggccctgagaagagctctctcccagtatctgaccgatcgagccaggtggagggattgctcccggccttgtccccctggtaggcagaagtctccgagggatccctgccagtgtgtctgccatggctccgcagtcactacacaggactgttgcccgagacagcgagggttggcccagcttgaagttacatttatacaggcatgggggctctggggggactggttcaccgccactgatgcttatgtcaagcttttcttcggcggacaggagttgcggacaagcactgtgtgggataacaataatcccatttggagcgtcagactggatttcggagacgtcctgctggctacaggcggtcccctgaggctgcaagtgtgggatcaggactcaggcagggatgatgatcttctcggcacctgcgatcaggcacctaaaagtgggtcccatgaagttcgctgtaatctgaaccatggacatctcaaatttcgataccacgcacgttgcctgccccacctcggtggaggaacgtgtctcgattacgtgcctcaaatgctgctcggggagccccctggcaacagatccggagccgtgtggtag

SEQ ID NO: 234325 - DNA, 1668 bp, Artificial Sequence
  Description of Artificial Sequence: Synthetic coding sequence
atggctgctaggttgctcctgcttgggatcctcctgttactcctgcctctgccagtccccgcaccttgtcacaccgctgctagatccgagtgtaagagatcccataaattcgtgccaggcgcatggttggcgggagagggcgtcgacgtaacatcccttcgtcgatctgggagcttccctgtcgatacccagcgcttcctgcgcccagacggcacctgcactttgtgcgagaatgctctgcaagagggcaccctgcagcgacttcccctcgcgttgactaactggcgcgcacagggcagcgggtgccagaggcacgttacaagggccaaagtttcctctactgaggctgtggcacgagatgctgcgagaagcattcggaacgattggaaggtgggattagacgtcacccccaaacctacctcaaatgttcacgtttcagtcgccggatcgcactctcaagccgcaaattttgctgcccagaaaacccaccaggaccagtattccttttcaaccgatacagtggagtgtcgtttttattcctttcacgtcgtgcatactcctcccctccaccctgattttaagagagctctaggtgacctgccacaccatttcaatgcgtctacgcaaccagcctatcttcggctgataagcaactacggaactcactttataagagccgtagagttgggtgggagaattagcgccctgaccgccctcaggacgtgcgagctcgcactggagggccttacagacaacgaggtagaggattgcttaaccgttgaggcccaggtgaatatcggcattcatggaagcattagtgccgaggccaaggcctgtgaggagaaaaagaaaaagcataaaatgactgccagttttcaccagacttaccgagaacgccactcggaggtagtgggtggacaccacacatccattaatgatctgctctttggcattcaggcgggtccagagcagtactcggcctgggtgaacagcttaccaggctcccccggactcgtggactatacactcgagcctctccatgtgctccttgacagtcaggatcctaggcgggaagcacttcgtagagccttgtcccaatacctgactgacagggcccgatggcgcgactgcagtcgcccttgccccccaggtcggcagaagtctcctagggacccttgtcaatgcgtgtgtcatggttccgcagttacgacccaggattgttgcccaaggcagagaggtttggcacagcttgaagtgacgtttatccaggcgtgggggctgtggggggactggttcaccgccacggatgcatatgttaaactgttctttggcggtcaggagctaagaacctcaacagtatgggataataacaacccgatctggtctgtgcgcttggactttggggatgtgttactcgccaccggcggtccactccggttgcaggtgtgggaccaggactctggaagagatgatgacctgttgggtacttgcgaccaggcacccaagtcaggatcccatgaggtgaggtgtaaccttaaccacggccacttaaagttcagatatcacgctcggtgtttaccgcacctggggggaggaacgtgcctggattacgtacctcagatgctgctaggagaaccgccaggaaatagatccggcgctgtttggtag

SEQ ID NO: 234326 - DNA, 1668 bp, Artificial Sequence
  Description of Artificial Sequence: Synthetic coding sequence
atggccgctcggctactgctgctgggtatcttgctgctcttattaccgctcccagttcccgctccatgccataccgcagcaagaagtgaatgcaagcgctctcataaatttgtccctggtgcctggctagctggagaaggagtggacgtaacatcccttagacgaagcggaagctttccagtcgacactcaacggtttctgcggcctgatggaacgtgtacgctgtgcgaaaatgcgctgcaggagggtaccctgcagcgcctgccactggctctcacgaactggagagcccagggctcggggtgccaacgtcatgtgacgcgcgctaaagtgagttctactgaagctgtcgcgcgtgatgctgctcggtctatcagaaacgactggaaagtcgggctcgacgtaactcctaaacctacctctaatgtacacgtgtccgttgccggatctcacagtcaagctgccaacttcgctgctcagaaaactcaccaagatcaatacagtttcagtaccgatacagtcgaatgccggttctacagctttcacgtggtgcatactccccctttgcatcctgacttcaaaagggcgctgggcgatcttccccatcacttcaatgcttctacacagcctgcttacctgcgcctcatctcgaattacggcacccactttataagggccgtcgagttgggtggtaggatatctgctctgactgcacttagaacatgtgaactggcgcttgagggcctaacggacaacgaggtcgaggactgcttaacggtcgaggctcaggttaacatcgggatccacggcagcatctcagcggaggccaaagcatgtgaagagaagaagaagaagcataagatgacagccagctttcaccagacttatagagagaggcacagcgaagtggtgggagggcaccatacttctatcaacgacctactcttcggcatccaggccggaccggaacagtatagcgcctgggtgaatagtctgccagggtcgccaggacttgtggactatacactcgagccactgcacgtattgctggattcacaggatccgaggcgcgaggcccttcggagggccctgtctcagtatttaaccgacagagccaggtggagggattgctctcggccttgtccgcctgggcgacagaaaagtccgcgtgatccttgtcagtgtgtgtgtcacggatccgcggttaccacccaagattgctgccccaggcaacgcggtctcgctcagctggaagtgacattcattcaggcatggggtctttggggtgattggtttacagccaccgatgcctacgtgaagctcttcttcgggggacaggaactgcgtacatctacggtgtgggataataacaaccccatctggagcgtgcgcctggactttggcgacgttctcctagccaccggaggcccactgagacttcaagtctgggaccaggactctgggagggatgacgatctgctcgggacatgtgatcaggcacccaagtcagggtctcacgaagttaggtgcaacctgaatcacggacacttaaagtttcgttatcatgcgagatgtctgccacacttgggcggtggaacctgtctcgattacgtcccccagatgctcctgggagagcctcctggtaaccggtccggggctgtgtggtag

SEQ ID NO: 234327 - DNA, 444 bp, Artificial Sequence
  Description of Artificial Sequence: Synthetic coding sequence
atggaggctagatcacgtagcgccgaagaactgcgtcgcgctgaactggtagagattattgtggagacagaagcacagaccggagtgagcggaattaatgtggccggagggggaaaagagggtattttcgtccgggaactcagagaagacagccccgcagcacgttcactgagcctgcaggaaggagatcaactcctgtctgcaagggtgttctttgaaaattttaaatacgaagatgccctgaggctgcttcagtgcgctgagccttataaggtgtctttctgtctgaaaagaaccgtgccaacaggcgatctggctctcagacccggaaccgtttccggatatgaaatcaaagggccaagggctaaggttgccaagctggtgcgcgtcctctcacctgcccctgccctcgactgcccaagcgatcctgtttctgcaccttag

SEQ ID NO: 234328 - DNA, 4386 bp, Artificial Sequence
  Description of Artificial Sequence: Synthetic coding sequence
atggaggccagatccaggagcgccgaggaattaaggcgcgcagaactcgttgaaataatcgtagagacggaagcccagactggcgtgtcaggcatcaatgtcgcaggcggaggaaaggaggggattttcgtcagagaactcagggaagattcgccggcagctaggagtctgagcttacaggagggcgaccagctccttagcgcccgagtcttcttcgagaatttcaagtatgaagatgcactgcggctcttacagtgtgctgaaccatacaaggtgtccttctgcctgaagcggaccgtgcctacaggtgatttagcccttcggccaggcacggtgtccgggtatgaaatcaaggggcctcgggctaaggttgctaagcttaacatacaaagcctgagccccgtgaagaagaagaagatggtgccaggcgctttaggggtacctgccgacctggcgcctgtcgacgtggaattttccttccccaaattctcgcgtctgcggcgaggcctgaaagccgaagctgtcaaaggccctgtgccggctgctcccgctaggaggcgcctccagctgcctaggctcagagttcgcgaagtggccgaagaagcccaggccgctagactcgccgcagcagcccctccgcctaggaaagccaaagtggaggcagaggtggcagccggtgcaaggtttaccgcgcctcaggtcgaactggtaggccctaggttgccaggcgctgaggtgggtgtgccccaggtgtctgctcccaaggcagccccatcggccgaagccgcaggcggatttgcgctccatctacctactctgggtctcggcgcacctgccccacctgcggtggaggcccctgctgtaggcatccaggtaccgcaggtcgaactgcctgccttaccatccctgccaactcttccaacacttccatgcctggaaacacgtgagggcgcagtaagtgtcgtggtgccaaccctcgatgtggctgcacccacagtaggagtggacctagctctaccaggcgctgaggtggaggcccgaggcgaggctccagaagtagccttaaaaatgccccgtctctcctttcccaggtttggggcacgggcaaaagaggtggccgaggccaaagttgccaaggtttcacctgaagcccgtgttaaaggcccacgactacggatgcctacattcgggctgtcactgctggaacctcgccctgccgcaccagaggtggtggagtccaagcttaagctgccaaccatcaaaatgccgtcacttgggatcggagtctcgggtcccgaagtgaaagtaccgaagggcccagaggttaagctccctaaggctcccgaggtaaagcttcctaaagtgccggaggccgctcttcctgaagttaggttgcccgaagtcgagctgccgaaggtgtctgagatgaagctgcctaaagtcccagagatggctgttcctgaagttcgtctcccagaagtagagctcccgaaagtatcagagatgaaattacccaaagtgcccgaaatggccgtgccggaggtgaggctgcccgaagtccagctcctgaaggtctccgagatgaagctgcccaaagtgccggagatggccgtgccagaggtcagactccccgaggtccagcttccaaaggtctccgaaatgaagctccctgaagtgagcgaagttgctgtgccagaggtgaggttacctgaagtccaactaccaaaggtccctgagatgaaagtgcccgagatgaagctacccaaagttcctgaaatgaagctgcctgaaatgaaactgccagaggtgcaattacctaaggtacctgaaatggccgtgccagatgtgcaccttccggaggtgcagctgccaaaggtacccgagatgaaattacccgagatgaagctgcccgaagtgaagttgcctaaagtgcctgaaatggctgtccccgatgtgcatcttccagaagtgcaactccctaaagtgccggagatgaagctgccaaagatgcccgagatggccgttcctgaggttcggctccctgaagttcagctgcccaaggttagcgaaatgaaactccccaaggtgccagagatggcagtgcccgatgtccacctcccagaagtacaactacccaaggtgtgcgagatgaaagtgccagacatgaagctccctgagataaaactccctaaagtcccggaaatggcagtccccgacgtgcatcttcccgaagtgcaactgccaaaagtgtcagagatccggttaccagagatgcaggttcctaaagtacccgacgtgcacttacccaaggctccggaggtgaaacttcctagggctcccgaggtccaactgaaggcaacaaaggccgaacaggccgagggaatggagtttggttttaaaatgccaaagatgacaatgccaaaactcggtagggccgaaagtccctccagaggaaagcccggtgaggctggagctgaggtcagcggtaaactcgtgaccctgccttgtctccagcccgaagttgatggggaagcccatgtgggggttccttcccttaccctcccatcagtggaactggacctgccaggagcgttgggactgcaggggcaagttcccgctgccaaaatggggaagggggagcgagtagaagggcctgaagtggcagctggggtgagggaggttggcttcagggttccctccgttgaaatcgttacaccacagctgcctgcggttgagatcgaagagggaaggttagagatgatagagactaaagtgaaaccaagtagcaaattttctttgccgaagtttgggctttccggtcccaaggtggctaaagcagaggcagagggggctggtcgcgcaaccaagctgaaggtcagtaaatttgctatctcactgcccaaggcccgtgtgggggcagaggcggaggccaaaggtgcaggggaagccggactgctgcccgcactggacctgtctattccgcaactgagcttggatgcccatctcccgtccggaaaggttgaggtggcaggcgcagacctgaagttcaaaggaccaaggtttgccctgcctaaattcggcgtcaggggccgagacaccgaggccgcagaattggtccctggcgttgctgaactcgaggggaagggctggggatgggacggcagggtgaaaatgccaaaactcaaaatgccgtcctttggtctggcgaggggaaaagaggccgaggtgcaaggcgacagggccagtcctggtgagaaggctgagtcgactgccgttcagctcaagatcccggaagtggagcttgttacccttggggctcaggaggagggcagagctgaaggggctgtggcggtctcaggaatgcaactgtctgggctgaaggtgtcgacagctggccaggtcgtgacagagggacatgacgctggactcagaatgcctccacttggtattagtcttcctcaggttgaactcacggggttcggcgaagctgggacaccagggcagcaggcacagagcacagtccctagcgccgagggcaccgccggatatcgagttcaggtaccccaggttaccctttccctccccggagcacaggtggctggaggcgagctgctggtcggtgagggtgtctttaagatgcctacggtgacggtgccccaactcgagcttgacgtaggcctgtctagagaggcccaggcgggagaggcagccactggcgagggcggactgcgactgaaattaccgaccctcggggctcgcgcacgagttggaggcgaaggagctgaggagcagccacctggggctgagcgtaccttctgcttatctcttccagacgtggagttatccccctctggcggtaatcacgctgaataccaggttgccgaaggcgagggtgaggccggacacaagcttaaagtcagattaccgcgatttggcctggttagagctaaagagggtgcagaagaaggcgagaaagccaagtctcctaagctgcgtctgccacgcgtggggttcagccagagtgagatggtcacgggcgagggctccccttctccagaggaggaggaagaggaggaagaggaggggagcggcgaaggcgcaagtggccgacgaggtcgcgtacgggtgcgactacccagagtaggattggctgcccctagtaaggcttcccgcggtcaagagggtgacgcagcccctaaatcacccgttagggaaaaatccccaaagttcagattcccgagagttagcctgagtcctaaggcgcgatctggcagtggcgaccaggaagagggcggactccgagtccgacttccttctgtcgggttcagtgaaacgggcgcacctggcccagcgcgaatggagggagctcaggccgcagccgtgtag

SEQ ID NO: 234329 - DNA, 4191 bp, Artificial Sequence
  Description of Artificial Sequence: Synthetic coding sequence
atggaagccaggagcagaagtgcagaagaactccggcgtgccgagctggtggaaatcatcgtcgagaccgaggcacagaccggcgtgagcggtataaacgtggccggtggcggaaaagaagggatatttgtgagagaacttcgcgaggattcgcctgcggctagatctctgagtctccaggaaggagatcagctgcttagcgccagggtgttcttcgagaacttcaaatacgaagacgctctgagactgctgcagtgtgctgagccctacaaagtgagcttttgtcttaaacgaacggtgcccacaggcgatttagctctccgacctggaacagtgagtggctatgagatcaaaggtcctagggccaaggtcgccaaactcaatatccagtccctcagtccggtaaagaagaagaagatggtgcctggggctctaggagtacccgcagaccttgctccagtcgatgtcgaattctcttttccaaagttcagcaggctccgcagaggtctcaaagctgaagcagtcaagggacccgtgcccgctgctcccgcacggagaaggctccagttgcccagactccgagtcagagaggttgccgaagaagcccaggccgctaggctcgccgctgccgctcctccaccgagaaaggctaaggtggaagccgaggtggccgcaggcgcacgctttacagcaccccaggtggagttggtgggcccaaggctgcccggagcagaagtaggggtcccccaagtgagcgcccctaaggccgctccgtctgcggaggcagccggaggatttgcactgcacctgcctacactgggactgggggcacccgctcctcccgctgtggaagcaccggcagtgggtatccaggtcccccaggtcgaactccccgcactgccatcattgccaacactgcccaccctcccgtgtctggagacacgtgaaggggctgtctccgtcgtcgtgcctacactcgacgtggcggctcccactgtaggagtggatcttgccctgcctggtgctgaggtggaagctcggggtgaggcacctgaggtggctttgaagatgcctcgactctcctttcctcggttcggggctcgggcaaaggaagtcgctgaggccaaagtggcgaaggtctctcccgaggcaagggtgaagggaccgcgtctgagaatgccgacatttgggctgagtcttctcgagcctcgacccgctgcccctgaggtggtcgagtccaagttaaagctgcccaccattaagatgccctccctcgggatcggcgtctcaggccctgaggtcaaggtaccgaagggtccagaagtcaaacttccgaaagctcccgaggtgaagctgcctaaggtgccggaggcagctctccccgaggtccgcctgcccgaagttgagctacctaaggtttcagaaatgaaacttcctaaggtgcccgaaatggccgttcccgaagtgcgcctgcccgaagtggagctccctaaggtctccgaaatgaaactgccaaaggtccccgagatggctgtgccggaagtgaggttgccagaagtgcagctgctgaaagtctccgagatgaaattgcccaaagtgccagagatggcggttcccgaagtcaggctcccagaagtccaactgcccaaggtctcagagatgaaattgccagaggtctctgaagtggccgtacccgaggtgagactccctgaagtgcagctgcctaaggtgcctgaaatgaaagtgccagagatgaagctgccaaaagtgcctgagatgaagctccctgaaatgaaactaccagaggtacagcttcctaaggtgccagaaatggcagtccctgacgtccaccttcccgaagtccagctgcctaaggtgccagaaatgaagctgccagagatgaaactaccggaggtgaagctgccaaaagtgcccgagatggccgtgcctgacgtgcacctgcctgaggtgcagctgccaaaggtaccagaaatgaagctgcccaagatgccagaaatggcagtgccggaagtccggcttccagaggtgcagctccccaaagtgagcgagatgaaactgccgaaggtcccagaaatggctgttcccgacgtccacctgcctgaggttcaactgcccaaagtgtgcgaaatgaaggtgccagacatgaaactgccagagattaagctgccaaaggttcccgagatggcagtcccagacgttcatctgcctgaagtgcagctgccaaaagtcagcgaaattcgcctcccagaaatgcaggttccgaaagtccctgacgttcacctgccgaaagctcctgaggtgaagctgcccagggcacccgaagtacaactaaaggctacaaaggcggagcaggccgaagggatggagttcggtttcaagatgccgaagatgacaatgccaaagctgggcagagcagagtcgccttccagaggaaagccaggagaagccggagctgaggtgagtggcaagctagttaccctgccgtgcctgcagcccgaggtggacggagaagcccatgttggggtgccctctctgactcttccctccgtcgagcttgacctgcctggagcattgggacttcaaggtcaggtccctgccgctaaaatgggcaagggagaaagggtggagggacccgaagtggcagctggcgtcagggaagtgggttttcgggtgccatcagttgaaatagttacacctcagctgccggctgtcgaaatcgaagaaggcaggctggaaatgatcgaaactaaggttaagcccagctccaaattctcacttcccaagtttgggctcagtggccctaaggtggccaaagcagaggccgagggcgcaggtagagcaactaaactgaaggtgtccaagttcgccatctccctgcccaaggcacgcgttggcgctgaagcagaggccaagggagccggagaggcaggtcttctccctgccttagacctaagcatcccccagttgagtcttgacgcccatttgccgtccggcaaggtggaggtggccggagctgacctgaaattcaaaggacctcggtttgcactacccaaattcggggtcagaggcagagataccgaggcggcagaacttgtcccaggagttgcggaactggagggcaaagggtggggatgggacgggagagtcaagatgccgaagctcaaggtctccaccgccggacaagtagtgacagagggccatgatgcgggtctcaggatgcctccccttgggatctctttgccccaggtagaactcacgggtttcggtgaagcaggaacccctggccagcaggcgcagagcacggtgccgagtgctgagggcaccgccggatatagagtacaggtcccccaagtgacactcagcttgccaggcgcacaggtcgcaggcggagagctgctggtcggagaaggcgtgttcaaaatgccaactgtcaccgtaccccagttggagctggacgtggggctatctcgggaagcccaagctggcgaggctgctaccggtgagggcggactccggttgaaactgcccaccctgggggcaagagccagggttggcggtgagggggctgaggagcagcctccaggggcagaaagaaccttctgcctgtcgcttcctgatgttgagctctccccatctggcggaaaccatgcagagtatcaggtggctgaaggagagggcgaagctgggcacaaactcaaagtccgactaccccgatttgggctggttcgcgcaaaagaaggcgctgaagagggcgaaaaagcaaaatcccctaagcttcgactaccaagggtcggcttcagtcagtcggagatggtgactggcgagggttccccaagcccagaggaggaagaggaggaagaagaagaaggttcaggtgaaggagcctctggcaggcggggaagggttcgggtgcggctgcctcgagtggggttggcggctccaagtaaagccagccgcggtcaggaaggggatgcggctcccaaatccccagtccgagaaaagtcaccaaaattccgtttcccacgagtgtccctttctcccaaagcccgttccggcagcggcgaccaagaggagggcggactccgggttcgcctaccatctgtgggtttctccgagaccggagcgcctggtccggctcgcatggagggagcacaagctgcagccgtatag

SEQ ID NO: 234330 - DNA, 2214 bp, Artificial Sequence
  Description of Artificial Sequence: Synthetic coding sequence
atggaagttgagcaagagcagaggagacgtaaggtggaagccggtcgaaccaagttagcccactttcggcagcgcaagaccaagggagattctagccacagtgaaaaaaaaacagctaagcgaaaaggtagcgccgtcgatgcttccgtacaggaagagagccccgttaccaaggaagactccgcgctgtgtggagggggtgacatatgcaagtcaaccagttgcgatgacacacccgacggcgcaggtggcgcattcgctgctcagccagaagactgtgacggcgagaagagagaggatctggagcagctgcagcaaaaacaggttaatgatcaccctccggagcagtgtggcatgttcacagtctcagatcacccaccggaacagcacgggatgtttaccgtcggcgatcacccccctgaacagagaggtatgttcaccgtcagcgatcatccacctgaacagcgaggtatgtttaccattagtgaccaccaacctgagcagcggggaatgttcaccgtttctgaccatacaccggaacagcgcggtatttttaccatcagcgatcacccagctgaacagcgaggcatgtttacgaaagagtgcgagcaggagtgtgagctggcaattaccgacttagagagcggacgcgaagacgaagccggtcttcatcagagtcaggccgtgcacgggctggagctggaagcgctccggctgtccctgtccaacatgcacacagcacagctggagctgacacaggctaatctacagaaagagaaagagacagctctcaccgaactgagagagatgctgaattccagacgggcacaggagctcgctttactgcagagtaggcagcagcacgagctggaactactgcgcgaacagcacgcacgggagaaggaagaggtcgtactaagatgtgggcaggaagccgctgaactgaaggaaaagttgcagagcgaaatggagaaaaacgctcagatagtcaaaaccctgaaggaggactgggagagtgagaaagatctgtgtctcgaaaatcttaggaaagagctgtcagcaaagcatcagagtgaaatggaggacctgcaaaaccagttccagaaggagctggcagagcagagggctgagctggaaaagattttccaggataagaatcaggctgagagagcactccgaaacctggagagccatcaccaggccgctatcgagaaattgcgcgaagaccttcagtctgagcatgggagatgcctggaagacttggagttcaagttcaaggagagcgagaaagaaaagcagctggaactggagaacttgcaggcctcttacgaagatctcaaagcccagagtcaagaggagattaggcgtctatggagtcagctagacagcgcccgaacctcaagacaagaactctccgagctccacgagcagctcctggctagaaccagccgtgtggaggacctagaacagctcaagcaacgggaaaagacccaacatgagtccgaactggagcagctgagaatttactttgaaaaaaaactgcgcgacgcggagaagacatatcaggaggatctgaccctgctgcagcagcggctccagggcgctcgcgaggatgccttactggactcagttgaagtcggcctttcatgcgtgggcctcgaggaaaaaccagagaaaggtaggaaagaccacgtcgacgagctggaacccgagagacataaagaaagcttgcctagattccaggccgaacttgaggagtcccatcgacaccaacttgaagcactggaatcacctttatgtattcagcatgaaggccacgttagcgacagatgttgcgtcgagacgagcgcgttgggccacgaatggagacttgagccctctgaggggcactctcaagaacttccctgggtccatctgcagggcgtgcaggacggcgatctggaggccgacactgagcgggctgccagagtgctgggactggaaaccgaacacaaggtacagctttcactgctgcaaaccgagttgaaagaggagatcgagctgcttaagatcgaaaaccggaacctatacggaaagttgcagcatgagacaaggcttaaagatgaccttgaaaaggtaaaacataatttgatcgaagaccatcagaaagaacttaacaatgcaaagcagaaaaccgagctgatgaagcaggagtttcaacgcaaagagacatag

SEQ ID NO: 234331 - DNA, 10010 bp, Artificial Sequence
  Description of Artificial Sequence: Synthetic coding sequence
atggaggtggaacaggagcagcgaaggcggaaggtagaggcagggaggactaaactggcccacttcaggcagcgaaaaaccaagggcgactcctcccactcggagaaaaagaccgctaagagaaaaggctccgcagtggatgctagcgtgcaggaagagtctccggtgactaaggaggactcagctctatgtggaggtggcgatatatgtaaatcaacttcttgtgacgacactcctgatggtgcagggggtgcattcgccgcacagccagaggactgcgatggcgaaaagcgggaagacctggaacaactccagcagaagcaggtgaatgaccatcctccagagcagtgtggaatgttcacggttagcgaccatccgccagagcagcacggcatgtttaccgtcggagatcacccaccggagcagaggggaatgtttaccgtgtcagaccacccgccagaacagcatggcatgtttacggtttccgatcaccccccagagcagcgagggatgttcactataagcgatcatcagcccgagcagaggggtatgtttactgtgagcgatcacaccccagaacagagaggcatcttcacaatctccgaccacccagccgaacaacggggtatgtttacaaaagaatgtgaacaggagtgtgaactggctatcacagatttggagagtggacgtgaggatgaagcgggactgcaccagtcacaggccgtgcacggtctggaactcgaggctcttcgtctgagcttgtctaacatgcatacagcccagctggaactgacacaggcaaacctccaaaaagagaaggaaacagcactgaccgagctgcgggagatgctcaacagccgacgggcacaagagctggccctcctgcagagccgccagcagcacgaactggaactgctgagagagcaacatgctcgcgaaaaagaggaagttgtgttacgatgcgggcaggaagctgcggagctgaaggaaaaactgcaatcagagatggaaaaaaacgcccagatcgttaagaccctgaaggaggattgggaaagcgagaaggacctgtgcctggagaacctgcgaaaagagctgagcgccaagcatcagagcgagatggaagatttgcaaaaccagttccaaaaagaattggctgaacagcgagccgagctggagaagatctttcaggataaaaaccaggcagagagagccttaagaaatctcgaatctcaccatcaggcagccattgaaaaactgagggaagatttgcaaagtgagcacgggagatgtctggaagatctagagtttaagttcaaggaatctgagaaagaaaagcaactggaactggaaaatttgcaggcttcctatgaggacctgaaagctcagagtcaggaggagattaggcgcctatggtcccagttggattctgcccgaacatctcgtcaggaactaagtgagcttcacgagcaactgctggccagaacatctagagtcgaggaccttgagcagttgaagcaacgtgaaaagacacagcacgaatccgaattagagcagctgaggatctactttgaaaaaaaactgcgggacgccgaaaagacctatcaagaggacttaactctcttacaacaaaggctgcagggcgcaagagaagacgcccttctggactcagttgaagtaggactgagctgcgtcggtctagaggaaaaaccagagaaggggaggaaggaccatgtagatgaattggagcccgagcgccacaaggagtctctgcccagatttcaggcagagcttgaagaaagccacaggcaccaattggaggccctcgagagcccactatgcattcaacacgaagggcatgtgtcagacaggtgttgtgtcgagacgtcagctctgggccacgagtggcgtctggaaccctcagagggacacagtcaggaattgccatgggtgcatcttcagggcgtacaagacggcgacctagaggcggatacagagcgcgctgccagggtactcggtctcgaaaccgagcacaaggtccaactctcccttcttcagacggagttgaaggaggaaatagagctcctgaaaattgagaaccgcaatttgtacggtaagttgcagcacgaaacccgcctcaaagacgacctggagaaggtgaagcacaacctgatagaagaccaccagaaagaactcaacaacgcgaaacagaagaccgaactgatgaaacaagaattccagcgaaaggagaccgactggaaagtgatgaaggaagagctgcaaagagaagctgaggagaagctcacattgatgctgctggagctgcgggaaaaggccgagtcagagaagcaaactatcattaataaatttgagctccgcgaggccgaaatgagacagctgcaagatcagcaggccgctcaaattctggacttagaaaggagtctgaccgaacagcagggaaggcttcagcagctggagcaggatctaacttcagacgatgcgttgcactgttctcaatgtggacgtgaacctcctaccgcccaagacggtgaactcgccgcactgcatgtgaaggaggactgtgccttgcagctgatgctggctcgatcccgctttctcgaagaacgcaaagagatcaccgagaagttcagcgctgagcaggatgcctttctgcaggaggcccaggaacaacatgcaagagaattacagctgctccaggagaggcaccagcagcagctcctttccgtgacagcagagctggaagccagacatcaggccgctcttggcgagctgaccgctagtctggagtcaaaacagggtgctctgctggctgcgagggtcgccgaattgcagaccaagcacgccgcagacctgggcgctctcgaaactcggcacctgtcatcccttgactctctcgaatcgtgttatttgtcagagtttcagacaattagggaggagcatcgacaggctttagagctcctgcgggctgacttcgaggagcagctttggaaaaaggatagcttgcaccagacaatcctgacgcaggagttagagaagttgaaaagaaagcatgagggagagctgcagtccgtgcgggaccatcttcgtacggaagtcagtacagagttagcaggcactgtggcacacgagctgcagggggtccatcagggcgagttcggttccgagaagaaaacagctctgcatgagaaggaggaaacacttcgcttgcagtcagctcaggcgcagccttttcaccaggaggaaaaggagtctctgtccctgcagctccagaaaaagaatcaccaggtccagcagctaaaagaccaggtgctcagcttaagtcatgagattgaagagtgtcgaagcgagctagaagtgttacagcagcggagagaaagagagaacagggaaggggcaaatttgctcagcatgctcaaggccgacgtgaatctctctcactcggagcgcggagccctacaagatgcacttcgacggctgctcgggctgttcggagaaacccttcgggcagccgtgaccctccggagtcgcataggcgagagggtggggctgtgtctcgatgatgcaggggcaggtctggccttgagcacggctcctgccctcgaagaaacgtggtccgacgtggccctgccagaattggatcgaacgctttccgaatgcgccgagatgtcctccgtcgcagaaatttcatcacacatgagagagagctttctaatgtcacctgaatcggttcgggagtgcgaacagcccatcagacgggtttttcagtcactgagcctggccgtggatggtttgatggaaatggcgctggactcctctcgccagctggaagaagccagacagatccactcacgctttgaaaaggagttttctttcaaaaatgaggagaccgctcaggtggtgcgcaaacaccaggaactgctggagtgtttgaaggaggaaagcgcagctaaggccgaactggcgttggaacttcataagactcagggaacgctagaagggttcaaagtggagactgccgacctcaaggaagtgctggctggcaaggaggacagtgagcatcgactggttctggagctggagtcattaaggcgtcagcttcagcaggctgctcaagagcaagctgctctgagagaggagtgtactcggctctggtctaggggagaggccaccgcaaccgatgccgaagctcgtgaagccgcactcagaaaggaggtggaggacctgacgaaagagcaatcagagacccggaagcaggcagagaaagacaggtctgccctcctttcgcagatgaaaatcctagaatccgagctcgaagaacaactgagtcagcacagaggctgcgccaaacaggccgaagccgtgactgcattggagcaacaagtcgcttctcttgacaagcacttgcggaaccagcggcagttcatggacgaacaggccgcagagcgagaacacgaacgtgaggagtttcagcaggaaattcaaaggctggaagggcagctgcgacaggctgccaaaccacagccgtggggcccacgggacagtcaacaggcaccgcttgacggcgaggtagagcttttacagcagaagcttagggaaaagctggatgaattcaatgagctcgcaatccagaaggagtctgccgaccggcaggtgctgatgcaggaagaggagatcaaaaggctggaggagatgaatatcaatatcaggaagaaggttgcccagctgcaggaagaggtggagaagcagaagaatattgtgaaagggcttgagcaggacaaagaggtattgaagaagcaacagatgtcaagcctgttattggcaagtactctgcagtctaccctcgacgcagggagatgtcccgaacctcccagcggaagtccgccagaagggcctgaaattcagctcgaggtgacccaacgggcactcctaaggagggaaagcgaagtgcttgacctgaaagaacaactagagaaaatgaagggcgacctcgagtctaagaatgaggaaattttgcacctgaatctcaaactcgacatgcagaactctcagacggccgtctcactgcgcgagctggaagaggagaacaccagcctgaaagtaatctacactcgaagcagtgagatcgaggagctcaaggcaacaatcgagaatctccaggagaatcagaagaggctgcagaaggagaaagctgaggaaattgaacagctgcacgaggtcatagagaaattacagcacgagctgagcttgatgggacccgttgtccacgaggtgtcagacagccaggcaggatcgctgcagagcgaattactgtgtagccaggcaggcggaccccgtgggcaggcactgcaaggcgagctggaagctgcccttgaggcaaaggaggcactgtccagattacttgcggaccaagaacgtagacacagtcaggcactggaggctctacagcagaggctccagggcgcagaggaagccgctgagctacagctcgcggaacttgagaggaacgtggcgttaagagaagctgaggtggaagatatggcatcacgtatccaggagttcgaagcggctttgaaagcaaaggaggccaccatcgcggagcggaacttggagatagatgcactgaatcagcgcaaggctgcccattccgcagagctcgaagccgtcctcctggctctggcacggattagacgggcactggaacagcagcctctggctgccggtgctgctcctccagaactgcagtggctgagggcccagtgtgccagactctcccggcagctgcaggttcttcaccaaaggtttttgcgatgccaggtggaactggacagacggcaggccaggcgggctactgcccatacacgcgtgccaggagctcacccacagcctcggatggatggaggcgctaaggcccaggtgacaggagatgtagaggcctcccatgacgcagccctggagcctgtggtgccagacccacagggagacctccagcccgtgctggtgacactaaaagatgctccattgtgcaagcaggaaggcgtgatgtccgtcctgaccgtgtgtcaaaggcagctgcaatcagagctgttactggttaaaaacgagatgagattgtcattagaagacgggggaaaaggcaaggaaaaggtacttgaggactgtcagttgcccaaagtggacctcgtcgcccaggtcaagcaattgcaggagaaattaaaccgccttttgtactccatgactttccaaaatgtagatgctgctgatactaaaagcttgtggcctatggcaagcgctcatctgctcgaatcaagctggtccgacgactcttgcgatggcgaggaacccgatatatcgcctcatatcgacacatgcgatgctaatacagctaccggaggagtgaccgacgtgatcaagaaccaggcgattgacgcatgtgatgccaacaccacgcccggaggcgttacggacgttatcaagaattgggattccctgattcctgatgagatgccagacagccccatccaagagaagtccgagtgtcaggatatgtcgctgtcatcgcctaccagtgtactgggcggttcacgccaccagtcacatactgcagaagcgggtcccaggaagtccccggtgggcatgctcgatctttcaagctggtcgagccctgaggtgctgaggaaggactggactctcgagccctggcccagtttgcccgtgacaccccactccggcgctttgagcctgtgtagcgctgataccagccttggtgatagagcagatacaagtctgccacagactcaagggcctggacttttgtgtagtccgggagtgagtgctgctgccctcgctctgcaatgggccgaatctccacccgctgatgaccatcacgtacagcggacagcagtcgagaaggacgtcgaggatttcatcaccacatctttcgattcgcaggagactttatccagcccccctcccggtctcgaaggcaaggccgaccgttccgaaaagagcgatggaagtggattcggggctagactcagccctggttcagggggtccagaggcccaaactgctggaccagtcactcctgctagcatttcagggagatttcagccattgcctgaggctatgaaagaaaaggaagtgaggccaaaacatgtgaaggccctactccagatggtgagggacgagtcccatcaaatcctcgcactctccgagggactggctcccccttcgggagaaccacatcctccccgtaaggaggacgagatacaggacatttcactgcacgggggaaagacccaggaagtacccactgcatgtcccgactggagaggggacttgctgcaggtggtccaggaggccttcgagaaggaacaggagatgcagggcgttgaactgcagccgcgtctcagtggaagcgacctcggtggacactcctcgttgctggaacgacttgaaaaaattatcagagaacaaggagacctccaggagaaaagccttgagcatctgcgtttgccggatcgcagctcgcttctgtctgagatccaggccctcagagcccagctgaggatgacacatctacagaaccaggaaaaactgcagcatttacggacggcattaaccagcgcagaggctcggggttcacagcaggagcatcaattacggcgacaagtcgagctgttggcatacaaagtcgaacaagagaaatgcatagctggagacctgcagaaaacactgtctgaagaacaagagaaagcaaactctgtgcagaagcttctggccgcagagcagacagtcgtccgcgacctgaagtccgatttatgcgaaagtcggcagaaatccgagcagctgtcaagatcactttgcgaagtgcagcaggaggtattgcagctcaggtcaatgttgtcgtccaaggagaatgagttgaaggctgctctccaggagctggagagtgagcaagggaaaggcagagcactccagtctcagttggaagaggaacagctgagacaccttcagcgggaatctcagagtgcaaaagctcttgaggaactgagggcatccctcgagactcaacgggcacaaagttcccgactgtgtgtcgcgctaaagcatgagcagacagccaaggacaacctgcagaaggaactgcggatcgaacattcacgctgtgaggcactcctcgctcaagaacgatcacagctgtcagaactgcagaaggaccttgccgcagagaagtcccggaccctcgagctgagtgaggctctgaggcacgagcgcctattgacagaacaactttcacagcgaacgcaagaggcttgcgtgcatcaagacacgcaggcacatcatgctctacttcagaaactcaaggaggagaaaagcagagtggtcgatctgcaggccatgctggagaaagttcagcaacaggcgctgcatagtcaacagcaactcgaagccgaggcccagaagcattgtgaagctctgagaagagagaaggaggtgagcgccaccctgaagtccactgtggaggctctccacacccagaagcgggagttgagatgcagtctcgaacgagagcgggaaaagccagcctggctccaggccgagctggaacaaagtcatccacggttaaaagagcaagagggcaggaaagccgctaggcgctcagctgaggcgcgtcagagccccgcagcggctgagcagtggagaaagtggcagagagacaaggagaagttacgggaactcgaactgcagagacagagggacttacataaaattaaacagctgcagcagacagtcagggatctggagagtaaggatgaggtgccaggaagtcggttgcatctgggctccgcaaggagggctgctggatccgacgcggaccatctccgagagcagcagcgcgagctggaagcgatgaggcagcggttactgtctgctgctaggctgctaacctccttcacctctcaggccgtcgatcgcacagtcaatgactggaccagcagcaatgagaaagctgtcatgagtttgctccacacactggaggagctgaagagcgaccttagtagacccacatcgtcacaaaagaagatggccgctgagcttcaattccagtttgtggacgtccttctgaaggacaacgtcagtctgacgaaggcactgagcacggtcacacaggagaaactagagctgtcccgggctgtgtctaagctcgaaaagttgcttaagcaccaccttcagaagggttgtagtccttctcgcagcgagcgctcagcatggaaacctgatgagacggccccacagagtagcctccgccgtcctgaccccggaagactcccaccagctgcaagcgaggaagcccacactagtaatgtcaagatggagaaactttatctgcactatctccgggctgaatcctttaggaaggccctgatttatcagaagaaatatctgcttttattaatcgggggatttcaagacagtgagcaggagaccctgtcaatgatagcacacctgggtgttttccccagcaaagcagagcgcaagattaccagccgccctttcaccaggtttaggacagccgtccgcgtggtgatcgctatattgcgactcagatttctagttaaaaaatggcaagaagtggacaggaagggcgcactcgcccaggggaaggcgcctcgccctggccctcgggctcgccagccacagagcccgcctaggacccgcgagtctccgcctactcgagacgtgccatctgggcacacacgggatcctgcccgtggacggcgactggcagcagccgcatcgccacactccggaggacgggctactcctagccccaatagccgattggagcggtctcttacagcaagtcaggaccccgagcactccctgacagagtatatccaccatttggaggtaatccagcagaggctagggggtgttctgcccgactcgacctccaagaagtcgtgtcatccaatgataaaacaata

SEQ ID NO: 234332 - DNA, 6074 bp, Artificial Sequence
  Description of Artificial Sequence: Synthetic coding sequence
atggcgaccggcggtgggccatttgaagatggaatgaacgatcaggatctgcctaattggagcaatgagaatgttgacgaccggctgaataacatggattggggtgcccagcagaaaaaggcaaaccgatcgtcggagaaaaacaagaagaaatttggagtcgagtccgacaaaagggtaacaaacgacatttccccagagtcgagtccaggagtagggagaaggcggacaaagacaccacacacctttcctcattctcggtacatgtcacagatgtccgtgcctgaacaggctgagttagaaaagctgaagcagcgcatcaactttagcgacttagaccagcggtcaatcggatcggattctcaggggagggctaccgccgcaaacaacaaacgccagctgtccgaaaacagaaagccctttaattttcttccgatgcagatcaacactaacaaatccaaggatgcctccacaaacccccctaacagggaaaccattggctctgcccagtgtaaggagttgtttgcttctgccctctctaatgacctgctgcagaattgccaggtatccgaagaggatgggcgaggagaacctgcaatggaatcctctcaaattgtgtcccgattggtccagattagagactacatcactaaggcctcctccatgcgggaagacctggtggaaaagaacgagcgcagcgctaacgtagaaaggctcacccatctcatcgatcaccttaaggagcaggagaagtcatacatgaaatttttgaagaaaatcctcgcacgtgacccgcagcaggaacccatggaagaaatcgagaatctgaaaaaacagcacgacctcctgaagaggatgctgcagcagcaggaacagctcagggccctccagggaaggcaggccgcacttctagccctccaacataaggcggagcaggccattgctgtcatggatgattctgtcgttgccgaaaccgccggttccctttccggtgtgtcaataacctctgagctaaatgaagagctgaatgacctaattcagcgttttcacaaccagctccgggactctcaacctcccgctgtcccagacaaccggaggcaagcggagtctctgagtctgacccgcgaagtgtctcagtctcgaaagccgtctgcaagtgagagactccctgatgaaaaagtggagctgttcagtaaaatgcgggttcttcaagagaaaaaacagaaaatggacaaattactgggagaactgcacaccctccgcgatcagcaccttaataatagcagttcttcacctcagcgtagtgtcgatcagagatctaccagtgcaccttccgcgtcagtcgggctagctcccgtggtaaacggagaatctaactctctgacaagtagcgtgccctatccaaccgccagcctcgtttcccagaacgagagtgagaatgaagggcatttgaatccctcagagaaactgcagaaactgaatgaagtgcgtaagaggctgaacgagctgagggaactggtgcattattacgagcagacctcggacatgatgacagatgccgtgaacgaaaacaggaaggacgaggagacggaggagtctgagtacgacagcgagcatgagaattcagaaccagtgaccaatattaggaatccccaggtggcgtccacatggaacgaagtcaactcgcattccaatgcgcaatgcgtttccaacaacagagacggtcggactgtgaattcaaactgtgaaatcaataatcgctcggcggcaaacatccgggctctgaacatgcctccttcgctggactgccgatacaatagggagggggaacaggagatccacgtcgcacagggcgaagacgatgaagaggaagaagaggaggcggaagaggaaggggtctctggggcatcacttagtagccaccggtcttccctcgtagacgagcatccagaggatgcagagttcgaacagaaaatcaatagactgatggccgcaaagcagaaactacgacagctgcaggacctggttgcaatggtccaggatgatgatgcggctcagggggtgatctctgcgtccgccagtaacctcgacgatttttatcccgctgaggaagacaccaagcagaactccaataatacacggggaaacgcaaacaaaacccagaaagacacaggagtgaatgagaaagccagagagaagttttacgaagccaagctgcaacagcagcaaagagagctgaaacaactccaagaggagcgcaaaaaattgatagatatccaagagaagatccaagcacttcagaccgcttgtcccgatctacaactctccgccgcttccgtcggcaactgccctacgaagaagtatatgcctgctgtcaccagcaccccaacggttaaccagcacgaaacatctacgagcaaaagcgtctttgagcccgaggattcaagcatcgtggacaacgaactttggtccgagatgaggagacacgaaatgctgcgagaggagctacgccaacgaagaaagcaactggaggctcttatggcagagcaccaacgtcgtcaaggcttagctgagacggccagcccagtcgctgtgtccctcagatcagatgggtccgaaaatctgtgtactccccagcagagtaggactgagaaaaccatggcaacctggggcggatcaacacagtgcgccctggacgaggaaggtgacgaagatgggtatctctctgaggggatagtgaggacagacgaggaggaggaagaggagcaggatgccagctcaaatgataacttttcagtgtgtccctccaactccgtgaaccataacagttataacggtaaggaaacaaaaaatcgatggaaaaataactgtccgttctccgctgacgagaactaccggcctctggccaagacccgacagcagaacatcagcatgcagcggcaggagaatctccgttgggtgtccgaactgtcatacgtagaggaaaaagagcaatggcaagaacagataaatcagctgaagaaacagttggatttcagcgtctccatatgtcagacactcatgcaggatcagcagaccttgagctgtctccttcaaaccctcttaacagggccatattctgtcatgccctcaaatgttgcaagcccgcaagtacatttcataatgcatcagctgaatcagtgttatacccagctcacctggcagcagaataacgtgcagagattgaagcagatgctgaacgaactcatgagacagcagaaccagcatcccgaaaaaccaggaggcaaagagagaggcagctccgcaagccatcctccctcacctagcctcttctgcccttttagcttcccaacacaacctgtgaacctattcaacattcccggattcaccaatttttcctctttcgcgcctgggatgaacttctcgcccctcttcccaagcaattttggtgatttctctcaaaacatttctacaccctctgagcaacagcaacccttagcccaaaacagttccggtaagacagaatacatggcgtttccaaagcctttcgagtcctccagctctataggcgcagagaagcccagaaataaaaaactgccggaggaggaagtcgaatcttctcggaccccctggctgtacgagcaagaaggcgaagttgaaaagcccttcatcaaaactggattttccgtgtctgttgaaaaatctactagctccaacagaaagaaccagctggacaccaatggcagaagacgtcagttcgacgaagaatccttggagagcttcagctcgatgcctgaccctgtggatcccactactgtcacaaaaacgttcaagacacgaaaggcttctgcccaggcatcacttgcttcgaaagataagaccccaaagtccaagagcaaaaagcgaaattccacacagctcaagtccagggtgaaaaatattcggtacgagagtgcttcaatgtcctccacgtgcgagccttgtaaatcccggaatcgtcacagtgctcagactgaagaaccagtccaggccaaggtgttctcaaggaagaaccacgagcagcttgaaaagatcataaaatgcaatcgctcaacagagatttcaagcgagaccgggagcgacttcagcatgttcgaagcgctccgcgacaccatctactcagaggtggctacccttataagccagaatgagtctagaccccacttcctgatcgagctgttccacgaactccagctgctgaatacagattacttgcgtcagcgggcactatacgccctgcaggacattgtatccagacacatttctgagagccacgagaaaggcgagaacgtgaaatctgtaaattctggcacgtggattgcatccaattccgaattgacaccatccgaaagccttgccaccacggatgatgagacatttgaaaaaaatttcgagcgtgagacccacaaaatttcagaacagaatgacgctgataacgccagcgtgctgtcagtttcttccaacttcgaacccttcgctactgacgatctgggtaacaccgtgatacatctcgaccaggccctcgcaaggatgcgcgaatatgagcgaatgaagaccgaagcagaaagcaattcgaatatgcggtgtacctgtcgtatcatagaagacggcgacggcgcaggcgctggaaccacagtgaataacttggaggaaacgcctgtgatcgaaaacaggagcagccaacagcccgtgtctgaagtgtccactatcccgtgcccgcgaattgatactcagcagcttgatagacagatcaaggcaattatgaaagaggtaattcctttcctgaaagaacatatggatgaggtgtgcagttcccaactcctgacatctgtcaggaggatggtgctgacgttgacccagcagaatgatgaaagcaaggagtttgttaagttcttccataaacagctagggagtattctacaggattccctggcaaagtttgccggtcgtaagttgaaagactgcggagaagaccttcttgtagaaataagcgaggtgctgttcaacgagctcgcctttttcaagttgatgcaagatctcgacaacaattctattacagtcaaacagagatgcaagagaaagatcgaagccaccggcgttatccaatcctgtgcaaaagaagccaagagaattctagaagatcacggatcccctgctggggaaatcgatgatgaagataaagacaaagacgagacagagacggttaaacagacacagacttcagaagtgtatgatgggcctaaaaatgtgagatccgacatctctgaccaggaagaggatgaagagagcgaaggatgtcccgtcagcataaaccttagcaaagccgaaacccaggcactgacaaattacggaagcggcgaggatgagaacgaggacgaagagatggaggaattcgaggagggccctgtagacgtgcagaccagcctgcaagcaaacaccgaggctacagaagagaatgagcatgacgagcaggtgctgcagagggactttaagaagactgctgaatcgaaaaatgtgcccctggagcgcgaagccacctccaagaacgaccaaaacaattgtccggtgaaaccctgttatctgaatattttagaagatgaacagcccttaaattccgctgcacataaggagtcccctccgaccgtcgattccactcagcagcctaaccccctcccattacggcttcccgaaatggagccattggtgccccgagttaaagaggtgaagtcagcacaagaaaccccagaaagttctctggccggatccccggacacggagtcaccagttctggtgaatgattatgaagctgaatctgggaacattagccaaaagtctgatgaagaggattttgtcaaagtcgaggatcttcccttgaaactgactatctatagtgaagccgacctgcgtaagaagatggtggaggaggaacaaaagaaccatctctccggggaaatctgtgagatgcaaactgaggaactggctgggaatagcgaaacactgaaggagccggagactgtcggtgcccagagtatcta

SEQ ID NO: 234333 - DNA, 1590 bp, Artificial Sequence
  Description of Artificial Sequence: Synthetic coding sequence
atggccacagggggtggccctttcgaagatggaatgaatgaccaggatctccctaactggtcgaatgaaaacgtagatgatcgtctaaataacatggactggggcgcacaacagaaaaaggcaaataggagcagtgagaagaataaaaaaaaattcggcgtggaaagtgacaaaagagtcactaatgatatcagccctgagagctctcctggagttggtagacgacgaactaagactccacacacatttccacatagcagatatatgagccagatgtctgtcccggagcaggctgagctcgagaagttaaagcagcgcatcaacttctcagacttagaccagagatcgatcggttctgacagccagggcagggccacagctgcaaataataagcggcaactttcagaaaatcgcaagccatttaattttctccccatgcagataaatacaaacaaaagcaaagacgcaagcactaacccccctaatagagagactattggctccgctcagtgtaaggagctgtttgcctctgcactgtcgaacgatctactccagaattgccaggtttcagaggaagacgggagaggggaaccagccatggaatcctcccaaatcgtctcccgcctcgtgcaaatcagggactacattaccaaggcaagtagtatgagagaagatctggtcgagaagaatgagcggagtgcaaacgtcgagaggctgacacacctgatcgaccacctgaaggagcaggaaaaaagctatatgaaattcttaaaaaagatcttggctagggaaaacgaagaagaggacgtcagaactatagattccgcggtcggctctggctccgtggccgaaagtacgtctttaaatatcgatgtgcagagtgaggcaagcgacacaacagcgagagacccccagcaggagccgatggaagagattgagaatctaaaaaagcagcacgacctcttaaagcgcatgctgcagcagcaggagcagcttagggctctgcaggggcgacaggccgctttgctcgcacttcagcacaaggctgagcaggccattgccgtgatggatgacagtgtggtggcagaaacagccggatctcttagcggagtctctatcacctccgagctgaacgaggaacttaacgacctgattcagcgttttcataatcagctacgcgacagccagcccccagccgttccggataataggagacaagccgaatccctgagtttgacccgagaggtatctcagagccgtaaaccatctgcgagtgagagactacctgacgagaaggtggaactctttagcaaaatgagagtactacaggagaaaaagcagaagatggacaagcttttgggcgagctacacactctccgagatcagcacctgaacaattctagctcatccccccagaggtcggtggaccaaagaagcacaagtgctcctagcgcctcagtggggctggcaccagtggttaatggggagagcaattccctgacgtcctctgtaccatacccaactgcttcgttagtaagccagaatgaatcagagaacgaaggccatttaaaccccagcgaaaagttgtag

SEQ ID NO: 234334 - DNA, 2172 bp, Artificial Sequence
  Description of Artificial Sequence: Synthetic coding sequence
atgagctctacatgtgaaccctgtaagagtagaaatagacatagtgcccagactgaggaaccagttcaagcgaaagtcttcagcagaaaaaatcatgaacaattggaaaagatcatcaaatgtaaccggtcaacggagatcagtagcgctcacgccaggagaatcctgcaacagagtaaccgcaacgcctgtaatgaagcccctgagacaggaagtgacttttctatgtttgaagcacttcgcgatactatctactcggaagtagccaccctcattagtcagaacgagagccgtccccattttttgatagaactgtttcatgagctgcaactcttaaatacagactacctgagacagagagccctttacgccctgcaggacatcgtgtcaagacacatttcggagtcccatgagaagggcgagaacgtgaaatcagtcaattcaggtacctggattgcctcaaattccgaactgactccatcagaatctctggcgaccacagatgacgaaacattcgagaaaaatttcgaaagggaaacacacaaaattagcgaacagaacgacgccgacaatgccagcgtgttgagcgtatcttccaattttgaaccgtttgctactgatgatctggggaatacagtcattcacttagaccaggccctcgcacggatgcgagaatacgagagaatgaaaacggaagcagaaagcaactctaatatgagatgtacctgccgcattatcgaggatggtgacggggctggggcaggcaccacagtgaacaacctagaggaaacccccgtgatagagaataggagctctcagcagcccgtgtctgaggtcagcactatcccctgtccacgcatagacacacaacaactggacagacagatcaaagccatcatgaaagaggtgatcccttttctgaaagagcatatggatgaagtctgttcttctcagttgctgacctctgtgcggagaatggtcctgactcttacgcagcaaaatgacgagtctaaagaatttgtgaaattcttccacaagcagctcggatcaatcctgcaagactccctggccaaattcgcgggacgcaagttgaaggactgtggagaagacctcctggtggaaattagcgaggtcctcttcaacgaactagcttttttcaagctgatgcaggatctcgacaacaatagcatcactgtgaaacagaggtgcaaacggaaaatagaggcgaccggagtgatccaatcatgtgctaaggaagctaaacggatcctcgaagaccacggcagtcctgcaggggaaattgacgatgaggacaaagataaggacgagaccgagaccgtcaagcagacacagacaagcgaggtatatgacggccctaagaacgtgaggtctgatatctccgatcaagaggaagacgaagaatctgagggttgccccgtgtctattaatctgtccaaggctgagacccaggccctgaccaattacgggagtggtgaggacgaaaacgaggatgaagagatggaagaattcgaagagggcccagtggacgtccagacatccctacaggcaaataccgaagctactgaggaaaacgaacatgacgaacaggtacttcagcgtgatttcaagaaaaccgccgaatccaagaacgttcctctcgagcgtgaggcaacctctaaaaacgaccagaacaattgtcctgtgaaaccctgttatctcaatatccttgaagatgaacaacctctgaacagtgccgcacataaggagtcccctcctacagtggacagcacacagcagcccaatcccctacccctcagactgccagaaatggagcctctcgtgcctagagtgaaagaggtgaagagtgcccaggagaccccagagtcatcactggccggtagccctgacacagagagccctgtgctggtgaacgactatgaagccgaatctggcaatatctcccaaaaatcagatgaggaagactttgtgaaagtggaggacctgcccctaaaactcacgatctatagcgaagctgatctccggaagaagatggttgaggaggaacagaagaaccatttatccggcgagatttgtgagatgcagactgaggaactggcagggaactccgaaaccctgaaggagcctgagacagtcggggctcagtccatctag

SEQ ID NO: 234335 - DNA, 2295 bp, Artificial Sequence
  Description of Artificial Sequence: Synthetic coding sequence
taaaaggctagtgcacaggcaagtctcgcatctaaggacaagacgcccaagagcaagagcaagaaaaggaattctacgcagcttaaatcgcgcgtgaagaatatacgatatgagagtgcctccatgtctagcacctgcgaaccctgtaaatctagaaataggcacagcgcccagactgaggaacctgtgcaggccaaggtgtttagcaggaagaaccatgaacaactagaaaagattatcaagtgtaacagatcaactgagatttcatcagcacacgccagaaggattctccagcagtctaaccggaacgcatgtaacgaagcccctgagactgggagcgatttctctatgtttgaggccttgcgagataccatttactctgaggtggcaaccctcatctcccagaacgaatctcggccacacttcctgatagagctgtttcacgagcttcagctgctcaacactgactatctcagacaacgagcgctgtacgcgttgcaagacatcgtgtctaggcatatcagtgaatcccatgagaagggggagaacgtgaaatccgtcaactcaggcacttggatagcgtccaactctgagttaaccccctctgagtccctggccaccacggatgacgagactttcgaaaaaaacttcgaacgcgagacccacaagatatcagaacagaatgacgcggacaacgcaagcgttctgtccgtttctagcaacttcgaacctttcgcgactgatgacctcggcaatacagttatacacctggatcaagcacttgcacggatgcgggagtatgaacggatgaagaccgaagccgagagtaactctaatatgcgctgcacttgcaggatcattgaagacggggatggggctggggcaggcaccacagtaaacaacctggaggaaacacccgtgatcgagaaccggtcgagccagcagcctgtatccgaagtgtctactattccgtgtcctagaattgatacccagcagttggacagacagattaaggctatcatgaaagaagttattccttttctcaaagaacacatggacgaggtatgctcctcacagttactgacctctgtgaggaggatggttcttacactgacccagcagaatgacgagtccaaggaattcgtgaagtttttccataaacagctgggctccattttgcaagactcccttgcgaagttcgcaggaagaaagctgaaagattgtggagaagatttattggttgagatatccgaagtcttgtttaacgagctcgcattcttcaagctgatgcaggatctggataataactcaataacagttaaacagagatgtaaaagaaaaattgaggctacaggagtgattcagtcctgtgctaaggaagccaagaggattctggaggatcacggctctccagctggagagatcgatgacgaggacaaggataaagacgagaccgaaacggtgaaacagacgcagacctccgaagtctacgatgggccaaagaacgtccggagcgatattagcgatcaggaagaagatgaggagtcagaaggctgtcctgtcagcattaacctcagcaaggctgagactcaggctcttactaactatggtagcggcgaggacgaaaatgaggatgaagaaatggaggagttcgaggagggccctgtcgatgtccagactagcttgcaggcaaacacggaagccacagaagaaaacgaacatgacgaacaagtcctgcagagagacttcaagaaaacagcagagagtaaaaatgtgccactggagagggaggctaccagtaaaaacgaccagaataactgtcccgttaagccctgttacctgaatatccttgaagacgagcagcctttgaacagcgctgcccacaaagaaagccctcctactgtggacagtacgcagcaaccgaacccactcccactccgcttgcctgagatggaacctctagtgcccagggttaaagaggtcaagtccgcccaagagactcctgagtcatccctggccggttcacccgacacggagtctcccgtgctcgtcaatgattacgaagccgaatcaggaaatatctcgcaaaagagcgatgaagaggattttgtcaaggttgaggacctgcctctgaagctgaccatctacagtgaagccgatttacgtaaaaaaatggtggaagaagaacaaaaaaatcacctgtctggcgaaatctgtgagatgcaaaccgaggaattggccggaaatagcgaaacacttaaggagcccgaaacggtgggagctcagagtatctag

SEQ ID NO: 234336 - DNA, 1227 bp, Artificial Sequence
  Description of Artificial Sequence: Synthetic coding sequence
atggccacagggggaggtccattcgaggatggaatgaacgaccaggacttgccaaactggtctaatgagaacgtcgatgatcggctcaataatatggactggggcgctcaacagaaaaaggccaatcggagtagcgagaaaaataaaaagaaattcggcgtggagtctgacaagcgagtgacaaacgacatcagtcccgaatcctccccaggtgtgggccgacgacggaccaaaacaccccacaccttcccccattccaggtacatgtcacagatgagcgtgccagaacaggccgagttggaaaaattgaaacaacgcatcaacttctccgacctggatcagagatccattggatcagacagccagggaagggctaccgctgccaataacaaaaggcagctgtccgagaacaggaagcctttcaatttcctgcccatgcagattaataccaacaaaagtaaagacgccagcacaaaccctccgaatagggagaccatcgggtccgcccagtgtaaagagctcttcgcttctgctttgtctaacgatctcctgcagaactgtcaggtgagtgaggaagatggaagaggagaacccgcaatggaatctagccaaatagtctcgcggctggtgcagatcagggactacatcactaaggcaagttccatgcgagaggacctggttgaaaagaacgaaagaagcgctaacgtcgagaggctgacacatctgatcgatcaccttaaagagcaagagaaaagttacatgaaatttctgaagaagattctagccagagatccccagcaggaaccgatggaggaaatcgagaatctgaaaaagcaacacgacctcctgaaacggatgctccagcagcaggagcagcttcgagcactccaaggtaggcaagcagcactgttggccctgcaacacaaggcagagcaggcaatcgccgtgatggatgattctgttgtcgctgagaccgcaggatccttgagtggagtcagtattacgagcgagcttaatgaagaactgaatgatttaatccaaagatttcacaaccagctccgagacagccagcccccagccgttcccgacaatagacgccaggccgaatcactgtccctcacgcgcgaagttagccagagcagaaaaccgtccgccagtgaacgtctgccagacgagaaggtggagcttttcagtaaaatgcgagtgctgcaggagaagaaacaatag

SEQ ID NO: 234337 - DNA, 1569 bp, Artificial Sequence
  Description of Artificial Sequence: Synthetic coding sequence
atggccgtgaacaagggcttgactctccttgatggtgacctccctgagcaagagaatgttctacagagggttctccagctgcctgttgtgtcaggcacgtgtgagtgttttcaaaaaacctatacctcaaccaaagaagcccacccactggttgcaagcgtttgcaatgcctacgagaagggagtccaaagtgctagctcccttgcggcttggagtatggagccggtggtccggcgtctgagcactcaatttaccgcagctaacgaactggcttgtaggggtctggatcacctcgaggagaagatcccggctctacagtatccccctgagaagattgcatctgagcttaaggacacaatcagcactcggctgaggagcgccagaaactccatttcggttcctatcgccagtacaagcgataaagttctgggcgcagctctagcgggatgcgagttagcctggggggtggccagagacaccgcggagttcgccgcaaacacccgtgcagggcgtctcgctagtggaggggctgacctggcgctgggctccattgaaaaggtcgtggagtacttattgccacctgacaaagaagagtcggctccggcacccggtcatcagcaagcccagaagtccccaaaagctaaaccttcactgctatcaagagtgggtgccctgacgaacacactctcaaggtacactgtccaaacgatggcccgtgccctagagcaggggcacacagtggcaatgtggatccctggcgtggtgccattgagttctcttgcacagtggggcgcatctgtagcaatgcaggcagtgtctcggagaagatcagaggtgcgcgtcccctggctacacagcttggccgcagcccaggaagaggatcacgaggatcagaccgatactgagggagaagataccgaagaggaggaggaactagaaaccgaagaaaataaatttagtgaggtggcagcacttcctggacccagggggttgctcgggggtgtcgcccacaccttacagaaaacactgcagacgactatctctgctgttacttgggcacccgctgcagtgctcggaatggcaggcagagtgcttcacctgactccagcaccagccgtgtcatccaccaagggacgcgctatgtccctgtccgatgccctgaagggtgtcaccgacaatgtcgtcgatactgtggtgcactacgtacctctccctcgactgtcactcatggaacccgaaagcgaattccgggacattgacaatccccctgccgaagtggaacgcagggaggcggaacggagagctagtggggctccctcagccggacccgaaccagctcccaggttagcacagccacgacgaagtctcagatccgcccaatctcccggagcgccaccgggacccggactggaggacgaagtggcaacccccgcagccccaaggcctggctttccagcggtgcctagggaaaaaccaaagagaagggtgtccgacagctttttcaggccgtctgtgatggagcctattcttggcaggactcattacagtcagctgagaaaaaaatcatag

SEQ ID NO: 234338 - DNA, 1569 bp, Artificial Sequence
  Description of Artificial Sequence: Synthetic coding sequence
atggcagtgaataaagggcttacactcctagacggcgatctccccgagcaggaaaatgttttgcagcgggttctgcagcttccagtggtgagcggaacgtgtgagtgttttcagaaaacctatacttctactaaggaggctcaccccctcgttgcgtctgtttgtaatgcctacgaaaaaggcgttcagagcgcctcaagtctggctgcttggtcaatggagcctgtcgtgagacgcctgagtacccagttcaccgctgccaatgaactcgcctgtcgtgggctggatcacctagaggaaaaaattcctgcacttcaataccccccagaaaagattgcaagcgaacttaaagacacaatcagcaccagactgcgcagtgctcggaatagcatttccgtccctatcgcaagcactagcgacaaggtccttggtgcggcactggccggatgtgaactcgcatggggagtcgctcgggatacagccgaattcgccgcaaacaccagagcaggcaggttagcttcgggcggtgctgacctcgctctgggcagtattgaaaaagtggtcgaatatcttctgccccctgataaggaggagtcggccccagccccaggacaccagcaggcacagaaatcacccaaggccaagcccagcttgctgagtcgtgtgggggcactaacaaacaccttgtcacgatataccgtgcagaccatggctagagctttggaacaggggcacaccgtcgccatgtggatacctggggtggtgcctctcagctctctggcccagtggggtgcttcggtggccatgcaggccgtgtctcgcaggcgaagtgaagttcgtgtcccttggctgcacagcctggcagccgctcaggaggaggaccatgaggaccagactgacacagagggagaggacacggaggaggaggaggaacttgagacggaggagaacaaattctcagaagtggccgcattaccaggacctagggggctgcttgggggagtcgcccacacactccaaaagactctccaaaccacgatctccgccgttacttgggccccagccgctgtgctaggcatggccggtcgtgttcttcaccttacccctgctcctgccgtatcatcaacaaaaggaagagcaatgtccctcagcgatgccctaaagggtgtaaccgacaatgtggtagacaccgtggtgcactacgtgcccctgccccgactgtctctcatggaacccgagtcagagtttcgggacatcgacaatcctcctgcagaagtggaaagaagagaagccgagcggcgtgctagcggcgctccatctgccggaccggagcccgctccgaggttagcacagcccaggcgctcccttaggtccgcacaatctcctggagccccacctgggcctggcctggaagacgaggtcgccaccccggctgctcctcgtccaggcttccctgcagtgccgagggaaaaacctaaacggagagtttcagacagtttttttcggccatctgtcatggaaccaattctgggcaggactcattactcacagctccggaagaaatcctag

SEQ ID NO: 234339 - DNA, 1314 bp, Artificial Sequence
  Description of Artificial Sequence: Synthetic coding sequence
atggcctccgttgcagtagatccacagccaagtgtggtcacacgagttgtgaatctgcctcttgtgagctccacctatgacctgatgtcctcagcctatctgagtaccaaggaccagtacccctatctgaaatcagtgtgtgagatggcggagaatggcgtaaaaaccatcacgtcagtggccatgaccagcgcgctgcccatcatccagaaactggaaccgcagatcgccgtggctaatacctacgcatgtaaagggctggatagaatcgaagagcgactgcctatcctcaatcagccatctacccagatcgtggctaatgccaagggggcagtgacgggcgctaaagacgctgtgaccacaaccgttaccggggcaaaggattccgtagcttccacaattaccggggttatggataaaaccaaaggagccgtgaccggctctgttgaaaaaacaaaaagcgtcgtttctggcagcattaatacagtgcttggatctaggatgatgcagctcgtttcttccggcgtggaaaatgcgttgacaaaaagtgaacttctggtcgaacagtatctgccactcacagaagaagagctggaaaaggaagccaagaaggtggaaggatttgatctcgtgcaaaaacccagctactatgtgcggctgggctcattatctaccaagctgcactcaagagcgtatcagcaggccctcagccgtgttaaagaggcgaagcagaagagccagcagacgatttctcaactgcattctaccgtgcacctgattgaatttgccagaaagaacgtgtactccgccaatcaaaaaattcaggacgcacaggacaagttgtatctgtcttgggtggaatggaagaggagtataggttatgacgatacggatgaaagccattgtgcagaacacatcgaatccaggacccttgctattgcacgcaaccttactcagcagctccagaccacgtgtcataccttgctgtcaaacattcagggagtacctcagaatatccaggatcaggccaaacatatgggggttatggctggagatatttactcagtcttcagaaatgcggctagttttaaagaagtgtctgacagtttgttgacgtcaagcaagggccaactccagaagatgaaggagtcccttgatgatgttatggattatctggtgaacaatactcccctaaactggttggtagggcctttttaccctcagctgacagagagccagaacgcccaggatcaaggagccgaaatggataagtctagccaggaaacccaacggtcggagcataagacacattag

SEQ ID NO: 234340 - DNA, 333 bp, Artificial Sequence
  Description of Artificial Sequence: Synthetic coding sequence
atggcctccgttgctgtggatcctcagccttcagtagtgacacgcgttgtgaatcttccccttgtttccagcacctacgacctgatgtctagcgcctatctgtccacaaaagatcagtatccatatctgaaatccgtatgtgaaatggctgagaatggcgtcaaaaccattacctcggttgcgatgacttctgcgctgccgatcatccaaaagctggagccccagatagccgttgcgaatacgtacgcatgtaagggtctggatcgcatcgaagagcgcctccctatcctgaaccaaccatcaacccaagtttccctgggacagaagtgttag

SEQ ID NO: 234341 - DNA, 381 bp, Artificial Sequence
  Description of Artificial Sequence: Synthetic coding sequence
atggcaagtgtcgccgttgacccccagccctccgtcgttacccgcgtggtgaatcttcccttggtgtctagcacgtatgaccttatgtcttccgcgtatttgagcactaaggatcaatatccatatctgaaatcagtctgtgaaatggctgaaaatggagtgaaaacgattacctccgtcgccatgaccagtgccttgcctataatccaaaagctggagcctcagatcgccgtggcaaacacatatgcctgcaagggactggatcgaatcgaggaaaggcttccaatccttaatcagccaagcactcaggccaacacttgttttccaaatttggatctggacgtctgcctcaagaacaatggacacttcctgacaagttag

SEQ ID NO: 234342 - DNA, 1071 bp, Artificial Sequence
  Description of Artificial Sequence: Synthetic coding sequence
atggctagtgttgcggtggatcctcagccaagcgtggttacacgcgtggtgaatctccctttagtgtccagcacctacgatctaatgtcttctgcctacttgagcactaaggaccagtacccttatctaaaatcagtgtgtgaaatggccgagaatggtgttaaaacgattaccagcgtggctatgaccagcgctctgcccatcatccagaaactggagccccagatagcagtggccaatacgtacgcttgtaagggcctggaccgcattgaggaacgtcttcctatcttgaaccagccaagtacccagatcgtggcaaacgcgaaaggcgctgtcacaggtgcaaaggacgctgtgactacaacggtgacaggcgctaaggacagtgtcgcttcaacaataaccggtgtgatggataagaccaaaggcgctgtcaccggaagcgtcgaaaagacaaagagcgtcaagaaaaagcagaaaaagctgaaggacctgatctggttccggtcccaactgcactccacggtgcacctaattgagtttgcaagaaagaacgtgtattcagctaaccagaagattcaggatgcacaagacaaattatacttatcttgggtcgagtggaaaagaagcatcggttacgatgatacagatgagagccactgtgccgaacatattgaaagccggacattggccattgcacgtaatctcactcagcagcttcagaccacatgccacacgttactgagcaatatccagggcgtcccgcaaaacattcaggaccaagctaaacatatgggagtaatggccggagacatatactctgtcttcaggaacgctgctagcttcaaggaggtgtcggattcccttctaacctcatccaaaggccagcttcagaagatgaaggagtccctcgatgacgttatggattacctcgttaataatacgcccctaaactggctggtggggcctttctatccacaactcacagaatcccagaacgcccaggaccaaggcgcagagatggacaagtctagtcaggagacgcagcgcagcgagcataagacccattag

SEQ ID NO: 234343 - DNA, 378 bp, Artificial Sequence
  Description of Artificial Sequence: Synthetic coding sequence
atggcttcggtcgcagtggatccccagccctcagtggtaactagggtagtgaatctcccactcgtgagctccacctatgacctaatgtctagcgcatatctgtccaccaaggaccagtacccatacctgaagagcgtttgcgaaatggccgaaaacggcgtcaaaaccattacgtcggtggctatgacctccgccttgcctatcatacagaaactcgagcctcagatcgctgtcgccaatacatatgcctgtaagggtctggacagaatcgaagaacggctcccaattctaaatcaacccagcacacagatagttgctaatgctaagggtgccgtcaccggcgctaaagacgccgttaccacaactgtgaccgggtag

SEQ ID NO: 234344 - DNA, 735 bp, Artificial Sequence
  Description of Artificial Sequence: Synthetic coding sequence
atgggtccaccttcggcggctccgagaggtggccaccgtccgtggcagggactgctgatcaccgcttcattactgaccttttggcaccctcccaccaccgtccagttcacgattgaagcccttccttcaagcgccgctgagggcaaagatgtattgctgctggcgtgtaacatttctgagacgattcaggcgtactattggcacaagggaaagacagctgagggcagccctctcatcgcaggctacatcacagacatccaagccaatataccgggagcagcttacagtggcagggaaaccgtataccccaatgggtcactcctgttccaaaatatcacactggaggatgctgggtcatacacacttcggactataaatgcctcatacgactctgaccaggcgacaggacagctgcatgtgcaccagaataatgtgcccggtcttcccgttggcgcagtggcaggaatcgtgactggagtgctggtgggagtggccctggtggcagcgctggtctgcttcctgttgctgtcgagaaccggacgcgctagcatccagagagatctgagagaacaaccaccccctgccagtacacccggtcacggaccatcccaccggtctacattctccgctccactgccgagtccacggaccgccacacctatctacgaagagctgctgtattctgatgcaaacatttactgccagattgaccacaaagctgacgttgtgtcatag

SEQ ID NO: 234345 - DNA, 1269 bp, Artificial Sequence
  Description of Artificial Sequence: Synthetic coding sequence
atgagcgccgatggagctgaggcggatggatcaacccaggtgactgtggaggaacccgtacagcagccttcagtagtcgaccgggtggccagtatgccgctgatttcatctacctgtgatatggtgtcggctgcctacgccagcacaaaggaaagttaccctcatataaaaactgtgtgcgacgctgccgagaagggggtgaggacccttactgctgctgctgtgtccggtgcccagcctatcctatctaaattggagccccaaatcgctagtgcctctgaatatgcacaccgtggacttgacaagttagaagagaacttacccatattgcagcagcctaccgagaaagtgtcaggcgcacaggagatggtgtctagtgcgaaggacactgtcgccacacagctcagtgaagcagtcgacgccactcggggtgctgtgcagtccggagtcgataaaaccaaaagtgtggtcactggaggagtccagtccgtgatggggagcagactgggccagatggtgctgtcaggggtggacaccgtgctgggtaaatccgaagaatgggctgataatcaccttcctctgaccgacgcagagttggctaggatcgccacctctctcgacggtttcgacgtggcaagtgtccagcagcaacggcaggaacaaagttactttgtcaggctgggcagtctgagcgagcggttgagacagcatgcatatgagcattcactcggaaagctgagagcaaccaagcagcgagcccaggaagctcttctgcagctgagtcaggtcctttccctgatggagactgtgaaacaaggggtcgaccagaagctcgtcgaggggcaggagaagctgcaccaaatgtggctgagttggaaccagaaacaactgcagggcccagagaaggaaccacctaagccagaacaagtagagtcgagagctctgaccatgttccgagatatcgctcagcagctgcaggcgacgtgcacgtctctggggtctagcatccaaggccttcctacgaatgtaaaggaccaggtccaacaggccagaagacaggtggaggatctacaggcaacgttctctagtatccattccttccaggacctgagctcttctattctggcgcagagccgagagcgtgttgcctccgctcgagaagctctggaccacatggttgagtatgttgcgcagaatacgcctgttacatggctggtcggcccttttgcccctggaatcaccgagaaagcccctgaggaaaagaagtag

SEQ ID NO: 234346 - DNA, 1392 bp, Artificial Sequence
  Description of Artificial Sequence: Synthetic coding sequence
atgagcgaggaagaagccgctcagatcccacggtcatcagtgtgggagcaggaccagcagaacgttgtgcagcgagtcgtcgccctccctctggttcgagccacttgcaccgcagtgtgtgacgtgtatagcgccgctaaggaccgccaccccttgcttggatcagcctgccgcctcgcagagaactgcgtatgtggactgacaaccagagctctggatcatgctcagcccttgctcgagcacctccagccacagctggctacgatgaactcactggcctgtcggggactggacaaacttgaggaaaagctgccctttttacagcagccgtcagagactgtggttacctccgccaaggatgtggtggcatcttctgtaactggcgtggtggatttggctcgcagagggcgtcggtggtctgtggagctcaaacgttccgtctcacacgctgtagacgtcgttttggagaagagtgaggagctggttgatcactttctacctatgacagaggaggagctcgccgctctggcagctgaagctgagggccctgaagtaggcagcgtggaagaccagagaagacagcagggctactttgtgaggcttggctccctcagtgccagaataaggcatctagcttacgagcactcagttggaaagctgagacagtccaagcacagagcacaagatacgttggcacaactacaggaaacactcgagttaattgatcacatgcagtgcggcgtaacccccacggctcccgcttgccccggaaaggtgcacgaactgtggggggaatggggtcagaggccacctgaatctcggaggcgcagtcaggcagaactggaaactctggtgctgtccaggagcttgacccaggagctccagggcacagtggaagcactggagtctagcgttcgcggactgccagccggagcccaggagaaggtcgccgaggtaagacgcagtgtggatgccctccagactgcctttgccgacgcaagatgctttagggacgtgcctgctgctgcactggccgagggcagaggaagagtcgctcacgctcacgcttgcgtggatgagttgctcgagcttgtcgttcaggccgtcccccttccttggctggttggccctttcgcaccaatactggtggaacgaccggagcctctgccagatcttgcagatctggtcgacgaggtgatcgggggtcccgatcctcgttgggcccacctcgactggcctgcccagcagagggcatgggaagcagaacatagggatggaagcggcaacggcgacggagatagaatgggcgtagccggagacatttgcgagcaggagcctgagacaccctcctgccctgtaaaacatactctcatgcctgagctcgatttctag

SEQ ID NO: 234347 - DNA, 3768 bp, Artificial Sequence
  Description of Artificial Sequence: Synthetic coding sequence
atgaatgggtacgctgaattccccccaagcccaagtaaccccacaaaggagccagtggagccacagccctctcaggttcccttacaggaagatgtcgacatgtcaagcggatcttcaggacacgagaccaatgaaaattgttccactggaagagactcccaaggcagcgactgtgatgactccggaaaggagttgggaatgttggtggaaccaccagatgccaggcagagtcccgacacatttagtctgatgatggccaaatcggaacacaaccccagtacatccggctgtagcagcgaccaatctagtaaagtagacactcacaaggagctcattaagactcttaaagaactcaaggtgcatctgccagccgacaagaaggcaaaaggaaaggctagcaccctggcgactctgaaatacgctctccgctccgttaaacaggtcaaggcaaatgaagagtactatcagcttctgatgtcctccgagggacatccttgcggggctgacgtgccctcgtataccgttgaggaaatggagagtgtgacaagtgaacacattgtgaaaaatgcagacatgtttgcagtggctgtttcactggtatcaggaaaaatcctgtatatatccgaccaagtggcctctatcttccattgcaagcgcgacgccttttctgacgccaagtttgtggagtttctggcaccacatgacgtgggagtcttccacagttttacttctccctacaaactgcccctctggtctatgtgctctggggcagactcttttactcaggagtgcatggaggagaaaagctttttctgtagggtgtccgtgcgaaagagccacgaaaacgagattagataccatcctttccgaatgaccccctatttagtcaaagtgcgtgatcagcaaggcgcagaaagccagctctgttgtttgctactcgcagagcgcgtgcactccgggtatgaggcacccaggattcccccagagaagagaatttttactacgacacatactcccaactgcttattccaggatgttgacgagcgcgctgtgcctctgctaggctacctgccccaggatctaatcgagactcccgtcctcgttcagctccatccatcagacagaccactgatgctggccattcacaagaagattttgcaaagtggcggtcagccgtttgactactccccaattagattcagggccagaaatggagaatatatcactttggacacatcttggtcatcctttattaatccatggtctcggaaaatctccttcatcatcggtcggcataaggtccgcgtggggccactcaatgaggatgtttttgcagcccatccctgtaccgaggagaaagcacttcaccctagtatccaggagcttactgagcagattcacagacttcttctccagcctgtgccccactccggctcctcaggctacgggagcctgggctctaacggctcccacgagcacctcatgtcgcagacttccagctctgacagcaatggtcacgaggattcgcggcgtcggcgagctgagatctgcaagaacggcaacaaaaccaaaaatagaagccattacagccatgaatccggggagcaaaagaaaaagtctgtgacagaaatgcagacgaatccgcctgccgaaaagaaggctgtccctgccatggaaaaagattctctcggggtgtcattccctgaggaattggcttgcaagaaccagcctacgtgctcatatcagcaaatctcttgtttggatagtgtgatacggtacttggagtcatgtaacgaggccgcaaccttaaaaaggaaatgcgaattccccgctaatgtccccgcactgagatcctcagataagcggaaggccaccgtgagcccaggtcctcatgcaggagaagccgaaccaccctcccgagtgaattcaagaacaggcgtcgggacacatttgactagccttgcactccccggtaaagcggagtcagtggctagcctgacctcccagtgctcttacagttctaccatcgtacatgtcggcgataaaaaaccccaacccgaattagagatggtcgaggatgccgcttccggccctgagtcattggactgcctggccggacctgcccttgcctgcggtttatcgcaggagaaggagccattcaagaaactggggctcacaaaagaggtgctggctgcccacactcagaaagaagaacagagttttctgcagaaatttaaggagatccggaagctctccattttccagtcccattgtcattactacttacaagagagatcaaaaggccagccgtctgagaggaccgcccctgggctgcgcaacacgagtggtatcgacagcccctggaagaaaaccgggaagaacagaaaactcaaatcaaagcgggtgaagcccagggacagctcagaatcgaccggatccggtggcccagtgagcgcacggccaccccttgtggggctgaatgctaccgcttggtctccatccgatacttcacagtctagctgccctgccgtcccgttccccgcacccgttcccgcagcttactcccttcccgttttcccagcaccaggcacggttgcggctccaccagctcctcctcacgcttctttcactgtgcctgccgtgcctgtagatttgcagcaccaattcgctgtccagcccccaccttttccagctccactggctcctgtcatggcattcatgcttccctcctactcatttccgagcggcaccccaaacctgccacaagctttcttcccttctcaacctcagttccccagtcatcccactctcacgtcagagatggctagcgcgtctcagcccgagtttccaagcagaacttcaatcccccgtcagccctgtgcttgcccggcaaccagagccacaccaccttctgccatggggagagcgtcccccccactctttcaatctaggagtagtagccccttacagcttaacctgctccagttggaagaggctcccgaaggcggtaccggcgctatgggcaccacaggtgcaacggagactgccgcagtcggggctgactgcaagcctggaacgtctagggatcagcagcctaaagcaccactaaccagagatgaaccatcagacacccagaactcagacgccctgagcacgtcgtcaggccttttgaatttgctgctgaacgaggacctctgcagcgcttccggctcagcagctagcgaatcgctgggcagcggctccctgggatgcgatgcttctccatctggggcagggtcttcagataccagccatacctccaaatatttcggctccatcgattcctcagaaaacaaccataaggcaaagatgaatacgggtatggaggaatcggaacacttcataaaatgtgtcctacaggacccaatctggctcctgatggccgatgctgactcgagtgtaatgatgacatatcaattgccatctcgtaatttggaggctgtccttaaggaggaccgcgaaaaacttaagcttcttcaaaaacttcagccgaggttcacggagtcccagaagcaggagctccgggaggtgcatcaatggatgcagacaggtggactcccagcagcaatcgatgtcgccgaatgtgtctactgcgaaaacaaggaaaaagggaatatttgcattccttatgaggaggatattccgtccttgggcctgtctgaggtcagcgataccaaggaagatgagaatggttcaccacttaatcacagaatcgaagagcaaacatag

SEQ ID NO: 234348 - DNA, 1215 bp, Artificial Sequence
  Description of Artificial Sequence: Synthetic coding sequence
atgaacggctacgcagaattcccgccatcccccagtaatccaaccaaagagccagtggagccccagcctagccaggtgcctctgcaggaagacgtcgatatgtccagtggctcctccggacacgagacaaacgaaaactgctcaaccggcagggattctcagggcagtgactgcgacgactccggtaaggaactgggaatgttagttgagcctccagatgcaagacagagtcctgacacattcagcctgatgatggccaaatctgaacataacccatcaacctcgggctgcagcagcgaccaatcgtccaaggtggacacgcataaggaactcattaagaccctgaaggaattgaaggtgcatctacctgctgacaaaaaagctaaaggaaaggcctctactctggccacactgaagtatgcccttcgctctgtgaaacaagttaaggctaatgaggagtattaccagcttctgatgtcgagcgaaggacatccctgtggcgcagatgtcccctcttacaccgtggaggaaatggagagtgtcacaagtgagcatattgtcaaaaacgcagacatgttcgccgtggccgtttctctggtgtccgggaaaatcttatacatctccgaccaggtggccagcatatttcactgtaagcgcgatgctttctcagacgctaaattcgttgagttcctggctcctcacgacgttggtgtcttccatagtttcacgagcccttataagctgcccttgtggtccatgtgctctggagccgactctttcacacaggaatgtatggaagagaaatcatttttctgtcgcgtgtccgtgcgcaagtcgcatgagaacgaaattcgctaccacccatttcggatgacaccgtatctggtcaaggtgagagaccaacagggcgctgaatctcaactgtgctgcctgctgttggcggagcgggtccactccggatatgaagcacccagaattccccctgagaagcgaatctttaccacaactcatacccccaattgtttatttcaggacgtcgatgagtcgcctgctgtgcgcagggctgcctttcggttgttttcacattctgtatcccgaccggagcgcagggttcatcacgtgggccaccagctcgtccagttgcaccaaccaatggagcaagagaacttgctccatcactgggaggcccagtcccagggcggaccgttcgaatag

SEQ ID NO: 234349 - DNA, 1215 bp, Artificial Sequence
  Description of Artificial Sequence: Synthetic coding sequence
atgaatggatatgccgagttcccacctagtcccagcaatccaaccaaggagcccgtggaaccgcagccatcgcaggtgccccttcaggaagatgtggatatgtcatctggatcttctgggcatgaaacaaatgagaattgcagtacgggacgtgactctcagggatctgactgtgatgattctggtaaggaattaggtatgttagtggagcccccagacgcccgtcaatccccagacacatttagcttgatgatggccaaaagcgaacacaacccttccacctcgggatgcagttccgaccagagctctaaggtagacactcacaaggaacttattaaaaccctcaaggagctcaaggtccatctgcctgcagacaagaaggctaaaggaaaggcaagcacactcgccacactgaaatatgcactgaggagtgtgaagcaggtcaaggcaaatgaggaatactaccagctgcttatgtctagcgaaggccatccctgtggagcagacgtacctagctacacagtggaggagatggaaagcgtcacaagtgaacatattgtgaagaacgcagatatgtttgctgtggctgtgtcactggtgtcagggaaaattctgtacatctccgaccaggttgcgtctatatttcattgcaaacgcgacgcattcagcgacgccaaatttgtggagttcctggcaccacatgatgtgggcgttttccactcattcacctccccatacaagttacccctttggagtatgtgttctggtgcagatagtttcacacaggaatgcatggaagaaaaatcattcttctgtcgggtgagcgttaggaaatcccatgagaacgaaatccgataccatccttttcgcatgacaccctatctcgtgaaggtacgagaccagcaaggggctgaatcccagctctgctgtcttctgttagccgagcgcgtccactccggttatgaggcacctcggatccccccagagaagaggatcttcacgacaacccacacacctaattgtctgtttcaggatgtggatgagagccccgctgtgagaagagctgcctttcggctgtttagccactcggtgtcacgacccgagcgccgtgtccaccacgtgggacaccagctcgtacagttgcaccaaccaatggagcaagaaaacctgctgcatcactgggaggctcagtcccagggcggacccttcgagtag

SEQ ID NO: 234350 - DNA, 330 bp, Artificial Sequence
  Description of Artificial Sequence: Synthetic coding sequence
atgaatggctatgccgaatttccccctagtccaagcaaccccaccaaagagcctgtcgagccccagccctctcaggtccctctgcaggaggacgttgacatgagcagcggtagcagtgggcatgaaacgaacgaaaactgttcaactggacgggactcacaggggtctgattgcgatgattcaggcaaagaactgggaatgctcgttgagccccctgatgctcggcaatcccctgataccttttccttaatgatggccaagtcagagcacaatccgtctacaagtggatgtagttccgaccagtccagcaaagtagatacccacaaatag

SEQ ID NO: 234351 - DNA, 1452 bp, Artificial Sequence
  Description of Artificial Sequence: Synthetic coding sequence
atgaatggctatgccgagttcccacctagcccaagtaaccctactaaggagcctgtcgagccccagcccagccaagtccccctacaggaggatgtggatatgtcttctggttcctcaggccatgagaccaatgagaactgttccacaggccgtgattctcaaggtagtgattgtgacgatagcggtaaggagttagggatgctagtggaaccacctgatgctcggcagagtccagacaccttttcgttgatgatggccaaaagcgagcacaatccttccacgtctggctgctcaagtgaccaaagctctaaagtcgacacacacaaagaactgattaaaaccctgaaagaacttaaggtgcacctgccggcagataagaaagccaaaggaaaagcctctacactcgctacacttaaatatgctttgcggagtgtgaagcaggtcaaggcgaatgaggagtattatcagcttctcatgagcagcgaagggcacccatgtggggctgacgtgcctagctataccgttgaggagatggaatccgtaacttcggaacacatcgttaaaaacgccgatatgttcgctgttgcagtttcgttagtatccggaaagatcctgtatatcagcgatcaggtagcctcaattttccactgcaaaagggatgctttctccgacgctaagttcgtggagttcctggcaccccacgatgtcggggtgtttcactcattcaccagtccctataagctgcccctttggtcgatgtgctccggagccgactcctttacacaggagtgcatggaggagaaatcattcttctgtagggtgtctgtgaggaagagccatgaaaacgagatcagatatcatcccttcagaatgacaccgtaccttgtcaaggtccgcgaccagcagggagccgagtcccagctgtgttgtctcttattggctgagagagttcattctgggtatgaggctccacgaatcccacccgaaaagcgtatttttacaacaacacacactccgaattgtctgttccaggatgtggacgagcgggcagtgccattactgggctatctgccacaggatctgatcgagaccccagtgctagtacagctgcatccttcagaccgcccacttatgcttgccattcacaagaagatccttcagtccggaggacagccgttcgactatagccccatacgatttcgagcaaggaacggagagtatattaccttggatacaagttggagctctttcattaatccgtggtcccgcaagatctcatttataattggccgtcacaaggtccgcgtgggccctctgaacgaggacgtgtttgctgcgcatccttgtactgaggagaaggcccttcacccttctatacaggagttaactgaacagatccacagactgttactgcaggtgggagtcgtgcccgcttgccctcctcccagatag

SEQ ID NO: 234352 - DNA, 2340 bp, Artificial Sequence
  Description of Artificial Sequence: Synthetic coding sequence
atgattcccttcttgcctatgttctccctcttacttctactcatcgtgaatccaattaatgccaacaaccattatgataagatcctggctcattcccgaatccgcggtcgcgatcagggccctaacgtatgcgcgctgcaacagattttgggcactaagaaaaagtatttctcaacatgtaagaactggtataagaagtctatttgcggtcagaaaaccaccgttctgtacgagtgctgtcccggttacatgagaatggaggggatgaagggatgtcccgctgttctgcccattgatcatgtttatggcactcttggaattgtgggggcaaccacaactcaacggtattctgatgcctccaagctcagagaggaaatcgagggtaaggggagcttcacttacttcgctcccagcaacgaggcttgggacaacctggactctgatatccgccgtgggttagaatccaacgtgaatgtcgaactcctgaacgcactccattctcacatgatcaacaagaggatgctgactaaggatcttaagaacgggatgattatccctagcatgtacaacaatctggggttgttcataaatcactatcctaacggagtggtcaccgtcaactgtgctcggataatccatggaaatcagatcgcgacgaatggcgttgttcacgtgatcgatagagtgttgacccaaattggcacctccattcaggattttatcgaagcggaggacgatctctcttccttccgggcagcagccatcacatccgatatacttgaagcccttgggagagatggccactttacacttttcgcacccacaaatgaagcctttgagaaacttccaaggggtgtcctggaaagaatcatgggtgataaagtggccagcgaggccctgatgaagtatcatattctaaacactttacagtgttcagagtccatcatgggtggcgctgtgtttgagacactagaaggtaacactatcgagattggctgcgacggcgactctattaccgtgaacggcatcaaaatggttaacaaaaaggatatcgtgacaaataacggagttatacatctcatagatcaggtactgatccccgacagcgccaagcaggtcatcgaattggccggaaagcagcaaaccacatttacagatcttgtggcccaactgggccttgccagcgccctgagacccgatggggaatatacccttcttgcccctgtaaataatgctttttcagatgacactctttccatggatcaaagactcctgaagttgatcctgcagaatcatatccttaaagtgaaggttggactcaatgagctatacaacggacaaatactggaaacgatcgggggaaaacagctgagggtatttgtttatagaaccgctgtgtgtatcgagaattcgtgcatggaaaaaggctcaaaacaaggaagaaatggcgctatccatatttttagggaaataattaaaccggctgaaaagtctctgcacgagaagctcaaacaagacaagcgcttcagtaccttcctgtcactgctggaggctgccgatctcaaagagctgctgacgcagcctggcgattggaccctgtttgtgcccacaaacgacgccttcaaagggatgacttcagaagagaaagagatccttatccgagataaaaacgctctccagaacatcatcttataccacttaaccccaggggtgttcattgggaaagggttcgagcctggagtgacaaacatactgaagaccactcagggttccaaaattttcctgaaggaagtgaatgatactctgttggtgaatgagctgaaaagtaaggagagtgacatcatgacgactaacggcgtaatccatgtggtggacaagctcctgtacccagcggacacgccagttggcaacgatcagctgctggaaattctgaacaaactcatcaaatatatccagatcaaatttgtacgcggaagcacattcaaagagatcccagtgaccgtttataaaccaatcattaagaaatacaccaaaattatcgacggggtcccggtggagatcacagagaaggagactagggaagagaggattatcacgggcccagaaataaagtacactcgtatatctacaggcggtggggaaacagaagagactctcaagaaattattacaggaggaggttactaaagtgactaagtttatcgagggaggagacggacacctattcgaagatgaagagataaagcggctgttacagggcgatactcccgtgcggaagctgcaggccaacaagaaggtgcagggttcacggcgacggctccgcgaaggccgtagccaatag

SEQ ID NO: 234353 - DNA, 2430 bp, Artificial Sequence
  Description of Artificial Sequence: Synthetic coding sequence
atgatcccctttctacccatgttcagccttctattgctgctgatcgtgaatccgatcaatgccaataatcactatgataaaatcctcgcccattccagaattcgagggcgtgaccagggtcccaatgtgtgcgccctccagcagatcctaggaacaaagaagaaatacttctctacttgtaagaactggtataaaaagagcatctgcggccaaaagaccactgtcctatatgaatgctgccccggatatatgagaatggaggggatgaagggttgccctgccgttttacctatcgatcatgtgtacggcaccttaggcatcgtgggggctacaaccacccagagatattcagacgcatccaaactacgtgaggagatcgagggaaagggtagcttcacgtactttgcaccaagtaacgaggcttgggataatctggatagtgatattagacgcggactggaaagcaatgtaaatgtggagctactgaacgcactgcactctcacatgatcaacaagaggatgctgaccaaggacctcaagaatggcatgattataccctccatgtataacaacctggggctgttcataaatcactatccaaacggggttgtcaccgtgaactgtgcacgaattattcacggcaaccagatagccacgaatggggttgttcacgttattgatcgcgtgctgacacagatcggtacctctatccaggatttcattgaggccgaggacgatcttagcagcttcagggccgctgctataacatccgatatccttgaggccctagggagagacggtcatttcactcttttcgcaccaactaatgaggcctttgagaaattgccacggggagtgctggagaggataatgggtgacaaggttgcatcggaagctctcatgaaataccatattcttaatacccttcagtgtagcgagtccatcatgggtggcgctgtgtttgaaacccttgaggggaacactatcgaaatcggctgcgatggagactctattacagtgaatggaatcaaaatggtgaacaagaaggacatcgtcaccaacaacggcgtgatacaccttattgaccaagttttgattcccgactccgctaagcaggttatagaactggctggaaaacagcagaccactttcactgatctggttgctcaactggggttggcctcggccctcaggcccgatggtgagtacacactgctggcccctgtcaataacgctttctccgacgatacactgtccatggaccagaggctcttgaagttgatcttgcagaaccacatactaaaagtcaaggtgggcctgaacgaactgtacaatggccagattctggagacaatcggaggaaagcaactcagggtctttgtgtaccgcacagcagtctgtattgaaaacagctgtatggagaaagggagcaagcagggcaggaacggggcaattcatatcttccgcgaaatcataaagcctgcagagaagtctttacacgagaaactcaagcaggacaaaagattctctacatttctatcactcctagaagcagccgacctgaaggagcttttgactcaacctggagattggactttatttgtccctaccaatgacgcattcaaaggtatgacttccgaggaaaaggagatcctgataagggataagaatgcgctgcaaaacattatcctgtatcatctgaccccaggcgtctttattgggaaaggcttcgaacccggtgtcacaaatatcctcaaaactacccagggctcgaagatcttcctcaaagaagtcaacgacaccctgctcgtgaatgaactaaagtcaaaagagtccgacattatgacaacaaatggggtgatccacgtggtagacaagctcctgtacccggcagatactcccgtgggcaatgaccagctgctggagatcctgaacaagctcatcaaatacatccagattaagtttgtaagaggctcaacgttcaaagagatccccgtaactgtgtatcgccctacattaaccaaagtaaaaatagaaggagagccagaatttcgcttaataaaagagggcgagacaataactgaagtgatacacggagaacctatcatcaaaaagtacactaagatcattgatggtgtccctgttgagattaccgaaaaggaaacgcgtgaagagagaattataacagggccagagatcaagtacactcgtatcagtaccggagggggtgaaactgaagagacactaaaaaagctgctccaggaggaagtgacaaaagtgaccaagtttattgaaggcggagacgggcacctgttcgaagacgaagagatcaaacggctcctgcagggggacacccccgttagaaaactccaagctaacaagaaagtgcagggcagccgcaggcggttgcgggagggcagatcgcagtag

SEQ ID NO: 234354 - DNA, 2511 bp, Artificial Sequence
  Description of Artificial Sequence: Synthetic coding sequence
atgattccatttctgcccatgttctctttgctcctgctgctgatcgtgaatcccatcaacgccaataaccattacgacaaaatactcgctcactcccgcattagaggcagagaccaaggcccaaacgtgtgcgctctgcagcaaatcctgggcaccaaaaaaaaatacttttccacatgcaaaaactggtacaagaaatcaatctgtggccaaaagacaactgtcctgtacgagtgttgccctggatacatgcggatggaagggatgaaaggctgccccgcagtcctgcccatcgaccatgtctatggcacgcttggtatcgtaggtgccaccacgacgcagcgatacagcgacgccagtaagctccgtgaggagattgaggggaagggctcgtttacctacttcgcaccttctaatgaggcttgggacaacctcgatagcgacatccgcaggggactcgaatccaacgtgaacgtggaactcctgaatgccctgcattcccacatgataaacaagagaatgctcactaaagacctcaaaaatggcatgatcatccctagcatgtacaacaatttgggcctattcataaatcattatcctaatggggtggtcaccgtgaactgtgctaggatcatccacgggaatcagatcgccaccaacggggtcgtacatgtgattgacagagtgctcacccaaatcggcactagcatccaagacttcattgaagcagaggacgatctcagcagcttccgcgcagctgcgatcacttccgacatcctggaggcgcttggaagagacgggcattttaccttgttcgctcccaccaatgaagctttcgaaaagctgccacgtggcgtgcttgagcgaataatgggcgataaagtggcttccgaagccctgatgaagtaccatatcctgaatactctccaatgctctgaatctatcatgggcggagcagtgtttgaaacgctggagggtaacaccattgagattggctgcgacggcgactcaataaccgtcaatggtatcaagatggtgaacaagaaagacatcgttacaaacaacggcgtgatccatttgatcgatcaagtgctgatccccgacagcgcgaagcaggtcattgagttggccggaaagcagcagaccacattcacagacctggtcgctcagttgggacttgctagcgcacttaggcccgatggagaatatacgttgcttgcaccagtgaacaatgctttctccgatgatacgctatctatggaccagcgactgcttaaactgattctccaaaaccacatactgaaggtgaaggtgggcctcaacgaactgtacaatggacaaattcttgaaaccattgggggaaagcagttgcgagtgttcgtgtaccgtacagccgtgtgcatcgaaaattcatgtatggagaagggatctaaacaggggcgaaatggtgccatccacatcttcagagagatcatcaagcccgcagagaagagccttcatgaaaaacttaaacaggataagcgcttctcgaccttcctgagcctattggaggcagctgaccttaaggagctattgacccagcctggagactggactcttttcgttcctacaaatgacgcctttaagggcatgactagcgaagagaaggaaatcctaatccgtgataaaaatgctctgcagaatatcattctgtaccacctcacaccaggagtgtttattgggaaagggttcgagcccggagtgaccaatattcttaagaccacacaaggaagcaaaatctttctaaaggaagtgaacgatactcttcttgtgaatgagctgaaaagtaaggagagtgacatcatgacgactaatggggtgattcatgtcgtcgacaaactactctatccagctgatacccccgtaggaaacgatcagttactcgaaatactcaacaagctgataaagtatattcagatcaagtttgtgcgtggcagtacatttaaagaaattccagtgacggtttacacgacgaaaataatcaccaaagtggtggaacccaagatcaaggtaatagaaggttccctgcagccaattattaaaacagaggggccaacgctgacaaaagttaaaattgaaggggaacctgaattccgcctaattaaggagggagaaaccatcaccgaggtgattcacggcgaacccatcatcaagaagtatactaaaataatcgatggagtgccagtggagataacggagaaggagacccgggaagagcggattataacaggacctgaaataaaatacacgcgtatctctacgggcggtggggagaccgaagagaccctaaaaaaactgttgcaggaggaggtcacaaaggtcacaaagtttattgaaggcggtgacgggcatctgtttgaggatgaggagatcaagaggttactacagggcgacacacccgtgaggaaacttcaagccaataagaaagtgcaaggatccagaaggcgactccgagagggtcgatcccaatag

SEQ ID NO: 234355 - DNA, 2427 bp, Artificial Sequence
  Description of Artificial Sequence: Synthetic coding sequence
atgattccctttctgccaatgtttagcctcctcctgctgcttatcgtgaacccaattaacgccaacaaccactatgacaaaatccttgctcactccagaattagggggagggatcaagggccaaacgtgtgtgccttacagcagattttaggtacaaagaagaagtacttttctacatgcaaaaattggtataaaaagtccatctgcggccagaaaactaccgtgctttacgagtgttgccctgggtacatgaggatggaaggcatgaaggggtgtcccgctgtcctacctatcgaccacgtgtacggcaccctcggaatcgtgggtgcaactaccacccagcggtattcggacgctagcaaactaagagaagaaatcgagggaaagggaagtttcacttatttcgcaccatccaacgaggcatgggacaatttggatagcgatatccgacgcggtttagaaagcaacgtaaatgtggaattactgaacgcccttcatagccatatgatcaacaagcgtatgctgaccaaggatctcaaaaatggcatgatcattcccagcatgtataataacctagggctgttcatcaaccactatccgaatggggtggtgaccgtgaactgtgccaggataatccacgggaaccagatcgcaactaatggagtggttcacgttatcgatagagtcttaacccagatcggcacaagcatccaagattttatagaggccgaagacgatttgtcctccttcagggccgctgctatcacatccgatatcctcgaggctttaggccgtgacggccattttaccctgttcgcccctaccaacgaggcctttgaaaaactccctaggggcgttctggagcggatcatgggcgataaggtggctagcgaagcactcatgaaatatcacatcttaaatacccttcagtgttccgagtctattatggggggtgccgtgttcgaaacattagaaggcaacacaatcgaaatcgggtgtgacggtgatagtataaccgttaacggaattaagatggtaaacaagaaagacattgtgacgaacaacggcgtgatccatttgatcgaccaggtccttattccagattcagctaagcaggtgattgaactcgccggaaaacaacagaccacttttacagaccttgtggctcagctgggtttagcctccgcgcttagaccagacggcgaatacactctgctggctccagttaacaacgctttctcagatgacaccctgagcatggaccagagactgctgaaacttatcctgcagaatcacatcttgaaggtgaaagtgggcttaaacgaactatataacgggcagatcttagagacaatcggtggcaaacaactacgtgtctttgtctataggactgccgtctgtattgagaatagctgcatggagaagggttccaaacagggcaggaatggggctatacatatctttagggagatcattaagcctgcggagaaatcactccatgaaaaactgaagcaagacaaacgatttagcaccttcctgtctctgctcgaagcggctgacctcaaggagctgctaacccagccgggtgattggacactattcgtcccgacgaatgacgcgttcaaaggaatgaccagcgaagagaaagagattctgatcagagacaagaatgccctgcagaatattatcctgtatcatctgacccctggggtcttcataggcaaaggtttcgaacccggtgtgactaatatcctcaaaaccactcaagggtctaagatctttttgaaggaggtgaacgatactcttctggtgaacgaactcaaatccaaagaatcagacatcatgaccactaatggagtgattcacgttgtggataagctactgtatcctgcagacaccccagtgggaaatgaccagctgttagaaatactgaacaagctgattaaatacattcagatcaagtttgtgcgcggtagcacctttaaggaaatcccggtcactgtatacacaactaagattatcaccaaagtggttgagcctaaaattaaagtgattgagggcagcttgcaaccgatcataaaaaccgagggaccaactttgaccaaagtcaaaatcgagggtgagcctgagtttcggctgatcaaagagggggagacaatcactgaagtgatccacggcgagcccatcatcaaaaagtatactaagattatcgatggcgttccagtggaaatcacggagaaggaaactagagaagagcggataattacggggcctgagattaagtacacacggataagcactgggggtggcgaaacagaggagaccctaaagaaactccttcaggaagatacacccgtcaggaaactacaggctaacaagaaggtccaaggcagcagaaggaggctaagggaggggagatcacaatag

SEQ ID NO: 234356 - DNA, 834 bp, Artificial Sequence
  Description of Artificial Sequence: Synthetic coding sequence
atgcggatggaagggatgaaaggctgcccagcggtgcttccaatagaccacgtatacggtaccctgggtatcgtcggcgctacaaccacccagcgatactccgacgcatcaaaacttcgggaagaaatcgagggaaaagggtccttcacctacttcgctccttccaacgaggcctgggacaacctggactcagatatcagaagaggcctggagagtaatgttaacgttgagctcctgaacgctctgcactcccatatgattaacaagcgcatgctgacgaaagatcttaagaatggcatgattattccctcaatgtataacaatctcggtcttttcataaaccattatccaaatggggtggttacagtcaactgtgcgagaattatccatggaaaccagattgccacaaatggtgtggtccatgtgatcgacagagtactcacacagataggtaccagcatccaggattttatcgaggcagaagacgacttaagctctttcagggccgcagccatcacatccgatatcctggaggctctagggagagacggacacttcactctgtttgcgccaactaatgaagcatttgagaagctgcccaggggggtgttagaaaggatcatgggagataaagtcgcgtcagaggccctgatgaaataccacatcctgaatacgctgcagtgcagtgaaagcattatgggcggagcagtgttcgaaactctggaaggtaataccatagagataggttgcgatggagactccatcacggtgaatggcattaaaatggtcaacaagaaggacatagtgactaattggtgtgacccatttgactag

SEQ ID NO: 234357 - DNA, 2346 bp, Artificial Sequence
  Description of Artificial Sequence: Synthetic coding sequence
atgatccccttcctaccgatgtttagtctgctgctccttttgatcgtgaacccaatcaacgccaacaaccattacgataaaatcctcgcccacagcaggatcagaggtagggaccagggacctaatgtttgcgccctccagcaaatcttaggcaccaagaaaaagtatttcagtacatgcaaaaattggtataagaaaagcatttgcggacaaaagaccacagttctctacgaatgctgtcccggatacatgcggatggaagggatgaaggggtgtcctgcggtgcttccaatagaccacgtgtacggaacactcgggattgtcggggctactacaacacagaggtattctgacgcctcgaaactacgggaggagatcgaagggaaaggcagttttacgtatttcgccccttctaacgaagcatgggataatctcgactcagacatcagacgcggtctggaatcaaatgtgaacgtcgagctgctgaacgccctacattctcacatgattaacaagaggatgcttaccaaagacttgaagaatggaatgataattccctctatgtacaataatctcgggctcttcatcaatcactaccctaacggtgtagtgaccgtaaattgtgcacgcataatacacggtaatcagattgctacaaatggggtggtgcatgtgattgaccgagtgttgacccaaatagggacctccattcaagatttcatcgaagccgaagacgacttatcctcatttagagccgctgccataaccagcgacatcctggaggcattgggccgagatgggcatttcactctgtttgcgcctaccaatgaagccttcgagaaactgccacgcggagtgttggagcgaatcatgggcgataaagtggccagcgaagcactgatgaaatatcatatccttaacacccttcagtgctccgaaagtatcatgggaggagcagtgtttgagaccctagaaggcaatacaattgagattgggtgtgacggggactctatcacggtgaatggtatcaaaatggtaaataaaaaggatattgtgaccaacaatggcgttattcacctgatcgaccaggtgcttataccagatagtgcaaaacaagttatagagcttgcgggaaaacagcagactacatttaccgatttggtggcccagctcggtttggcatctgcattgaggcctgacggggaatatactctgctggccccagtgaacaacgctttctctgatgatactctgtccatggaccagcgcctgcttaaattaattctgcagaatcatatcttaaaagtcaaagtgggcctaaacgagctttacaacggccagattctagagaccatcggaggcaagcaactccgggtcttcgtctatcgcaccgccgtctgtattgagaactcctgcatggaaaaagggagtaaacaagggcgtaatggggcaatccacatcttcagagagattatcaaaccggctgagaaatctttgcatgaaaagttgaaacaagacaagcggttttcaacctttctttccctcctggaagccgctgacctgaaggaacttttgacacagcctggggactggacactatttgtgcccacaaacgatgcgtttaaaggtatgacttccgaagaaaaagagatcttaatcagggacaaaaacgcccttcagaacattatcctttaccacctgacccccggtgtgttcataggaaaaggcttcgaacctggagtcaccaatattttaaagactactcaggggtctaagatcttcttgaaggaggtaaatgatacccttcttgtgaacgagttgaaatccaaagagagtgatatcatgacaactaacggtgtgatccacgtggttgacaagctgctctaccccgctgacactcctgtcggaaacgaccagctgcttgagatcctcaacaaacttattaaatacattcaaatcaagtttgtgcggggatcgacctttaaggagatcccagttacagtctaccgacccactctgacaaaggttaaaattgaaggagaacccgagttcagattaattaaagaaggagagacaataacggaggtcatccatggagaacctatcattaagaagtacaccaaaatcatcgatggagtaccggtggagataacagagaaggagaccagggaagaaagaatcatcactggtcctgagatcaaatatacgcgaatatcaaccgggggaggggagacggaagaaacattgaagaagctactgcaggaagacacgcctgtcaggaaattgcaggctaacaaaaaggttcaaggttctcgcagacggctgagagaagggcgaagccagtag

SEQ ID NO: 234358 - DNA, 2250 bp, Artificial Sequence
  Description of Artificial Sequence: Synthetic coding sequence
atgattccctttctccccatgttctcattgctgctgctccttatcgtgaacccaattaacgctaacaaccactacgataagatactcgctcatagtcgaatccgcggtagggaccagggtccaaatgtgtgcgcgctgcagcaaatcttgggcactaagaagaagtacttttccacttgtaaaaattggtataaaaagtcaatctgcggacagaaaaccaccgtcctgtacgaatgctgtcccggatacatgaggatggaagggatgaaggggtgccccgcagttttgccgattgatcatgtttacgggactctcggcattgtgggtgccacgacgacccagaggtacagcgatgcatccaagttgcgggaagagatagagggcaagggcagctttacctactttgcacccagtaatgaggcctgggataatctcgactctgatatcagacgagggctagaaagtaatgtaaatgttgaactactcaatgcactccacagccatatgatcaacaagaggatgctcactaaagatttaaaaaacggcatgatcatcccatctatgtataataatctcgggctgttcattaatcattaccctaacggggtagtaaccgtaaattgcgctcggataatacatggaaaccagatcgccaccaatggagtggtgcacgttatcgatagggtgctgacacagatcggtacttccattcaagacttcatcgaagccgaggatgatctttctagttttcgtgcggcagcaatcaccagtgacatattggaagcactgggccgtgatgggcactttaccctttttgctcctacgaacgaagctttcgaaaaactccccaggggcgtgttggaacggatcatgggagacaaagtcgcatccgaagcattgatgaagtaccacatccttaacacattgcaatgcagtgagagcataatgggtggagccgtatttgaaaccctcgagggaaatactatcgaaataggctgcgacggggacagcattactgtcaacggcataaagatggtgaacaagaaggatatagtcactaacaatggagtgatccatctaattgaccaggtgttgattcctgactccgccaaacaagtgattgaactcgcaggcaaacagcaaactacattcactgatctggtagctcaactcggcctcgcatcagctctgagacctgatggtgaatatacactactcgctccagtgaacaacgctttttccgatgatactcttagtatggatcagcgattactgaaactgattcttcaaaaccacatcctgaaagtgaaggtgggcctcaatgagttgtacaatggccagatcttagagaccattggtggaaagcaactacgtgtttttgtgtatcgaactgcagtgtgcattgaaaattcttgcatggaaaagggttctaaacagggccgtaacggggctatacatatctttcgggagataattaaacctgcagaaaagtcgctccacgagaaactcaagcaggataagcgattctccacttttttgtcattgttggaggctgcagatcttaaggagctgctcacacagccaggagactggacgcttttcgtccctacaaatgatgctttcaaggggatgacttcagaagagaaagagatcctcatccgagacaagaacgcactccaaaacattatattgtatcatctcacacctggcgtcttcattgggaaaggctttgaacctggggtaacaaatatactaaagacaactcaagggtccaagatcttcctcaaagaagtaaatgacactctgctggtgaatgagctcaagtcaaaagagtctgatatcatgactacgaatggggtcatccacgtggttgataagcttctatatcctgccgatacaccggtgggcaatgatcagttactcgaaattctgaacaagcttattaaatatattcagattaagtttgtaagagggagcacgttcaaagaaatccccgtgaccgtttatagccctgaaatcaaatacacccgtatctcgacagggggtggagaaaccgaggaaactctgaagaagctcctccaagaggaagtgacaaaggtaacgaaattcatcgagggaggcgatggccatctgttcgaggacgaagagataaaaaggctcctccagggcgacactcctgtgagaaagttgcaagcgaataaaaaggtacagggaagcaggcgcagactgcgagagggacgatcacaatag

SEQ ID NO: 234359 - DNA, 399 bp, Artificial Sequence
  Description of Artificial Sequence: Synthetic coding sequence
atgtctaacaagttcctcggaacctggaaattggtgagctctgagaactttgacgattacatgaaggctctgggagtgggcctagccacacggaagctcgggaaccttgcaaagcccacggtgatcatctccaagaagggtgacatcatcacgatcaggactgaatctacgtttaagaacaccgagatctcctttaaactcggccaagagttcgaagaaaccaccgctgataatcgcaaaacgaaatccattgtgacactacagcggggaagtctcaaccaggtgcagaggtgggacgggaaggagactaccattaagcggaaattggtcaacgggaagatggttgccgaatgcaagatgaaaggagttgtgtgcacccgtatctatgaaaaagtttag

SEQ ID NO: 234360 - DNA, 483 bp, Artificial Sequence
  Description of Artificial Sequence: Synthetic coding sequence
atgctccttctgctcctcagcattatcgtgctgcacgtcgcagtgctggtgcttctgtttgtgtcaaccatagtgtcccagtggatcgttggaaatggccacgccaccgatctgtggcagaactgcagcacgagctcttccgggaatgtgcaccactgcttctcctcgagccctaatgagtggcttcagtcagtgcaggcaacgatgatccttagtattatcttttctatcttgagcctgttcttgtttttttgtcagttgtttacgctcaccaagggaggcaggttctacataaccggcatctttcagatcctggccggactttgtgttatgagcgccgctgccatttacacagttagacaccccgagtggcatctgaattcagattatagctacgggttcgcatacattttggcgtgggttgcttttcccttagcgctgctgagcggagtcatctatgttattcttagaaagagggagtag

SEQ ID NO: 234361 - DNA, 357 bp, Artificial Sequence
  Description of Artificial Sequence: Synthetic coding sequence
atgctattgctgttgctgtccattatcgttcttcacgtcgccgtgttggtcctgctctttgtttccaccatagtctctcagtggatcgtcggaaatggccacgcaacggacttgtggcaaaattgctctacaagttcgtcaggcaatgtgcatcactgcttctcatcctctcccaacgaatggctgcaatccgtgcaggcaaccatgatattgtccataatctttagtatcctgtctttattcctgttcttctgtcagctctttacgctcacaaagggtgggagattctatataacaggaatcttccaaatccttgctgaaagtaatagtagccagatgtgcgggtaccgggattag

SEQ ID NO: 234362 - DNA, 483 bp, Artificial Sequence
  Description of Artificial Sequence: Synthetic coding sequence
atgcttctcctgctactcagtatcattgtcctgcacgtagctgtgttggtgttgttgttcgtgtctacaatcgttagccagtggattgtgggcaacggtcatgctacagacctgtggcagaattgcagtacatcaagtagcggaaatgtgcaccactgttttagctccagcccgaacgaatggttacagtccgtgcaggccactatgatcctgtcaattatctttagcatccttagcctgtttttgttcttctgccagctgtttactctgacaaaggggggtcgcttctatatcacaggtattttccagatcctcgctgggctgtgcgtgatgagcgccgctgcaatctacactgttagacacccagagtggcatctgaactctgactactcatacggcttcgcctacatcctggcctgggtcgcgttccctctggctctgctgtctggggtgatttatgttattcttaggaaaagggaatag

SEQ ID NO: 234363 - DNA, 450 bp, Artificial Sequence
  Description of Artificial Sequence: Synthetic coding sequence
atgctgctactgctcctgagcattatagttcttcatgttgccgttctagtccttctgtttgtatctacaatcgtatcacagtggatcgtgggcaatggccacgcaactgatctgtggcagaattgttccacctcctcctccggtaatgttcatcactgttttagttcatcgccgaacgaatggctgcagagtgtgcaggccaccatgatactgtccattatcttcagcatcttaagcctcttcctatttttctgtcagttgttcaccctgactaaggggggacggttttacatcactggaattttccaaattttagccggactgtgcgtgatgtctgccgctgccatttacaccgtccgacaccccgaatggcatctgaattccgattacagttttccactggcgcttctttccggggttatctacgttattctccgaaaaagggaatag

SEQ ID NO: 234364 - DNA, 1413 bp, Artificial Sequence
  Description of Artificial Sequence: Synthetic coding sequence
atgagccatcatccttccggcctccgagcgggattttcctccacctcctatcgaagaactttcggccctcccccttccctgagtcccggagccttctcatacagctccagttcccggtttagtagtagtaggctgctgggtagcgccagtccctcctcctctgtgagattaggcagtttccggagcccacgggctggcgcaggggcattattgcgcctgcctagcgagcgactcgacttctccatggccgaagctctgaatcaggagtttcttgcaacacggtctaacgagaagcaggagttacaagaactcaatgaccgttttgcaaatttcattgagaaggtgcggtttctggagcagcaaaacgcagcccttcgtggcgagctgtcacaggcccgtggccaggagccagcccgtgccgatcagctgtgtcagcaggaactgcgcgaactgcggagagaattagaactgcttggaagggagcgagaccgtgtacaagtcgagagggacggcttagcggaagatctggctgctctcaaacagcgcctcgaagaagagactcggaaaagagaagatgctgaacataatcttgtgctcttcagaaaggacgtggatgacgctacgcttagtcgcctggagctagagaggaaaattgaaagccttatggatgaaattgagtttctgaaaaaacttcacgaggaagagctgcgtgatctgcaggtgtctgtggaaagtcagcaggtgcagcaggttgaagttgaagctaccgtgaagcccgaactgaccgccgctctgagggacattagagcccaatatgagagcatcgcggctaaaaacttacaagaggccgaagaatggtataaatctaaatacgccgatttatctgatgcagcaaaccgcaaccatgaagcactgcggcaggccaaacaggagatgaacgaatctcgcaggcagatccagtctttgacatgcgaggtggatggcctgaggggcaccaacgaggctctcctccgtcagctgagggaacttgaggaacagtttgccctcgaggctggtgggtatcaagccggtgctgctcggctcgaggaggagctgcgccagcttaaagaagaaatggcccgacacctgcgcgagtaccaggagctcctgaacgtcaagatggccttggatattgagatcgccacgtatagaaaattactggaaggagaggagagccgaatcagtgttcccgttcactcctttgcctctcttaatataaagaccactgtacctgaggtggagccccctcaggacagccattcacgcaagaccgttctgataaagaccattgagacacgcaatggggaggtagtgacggagtctcagaaagagcagagaagcgagcttgacaagtccagcgctcattcctactag

SEQ ID NO: 234365 - DNA, 603 bp, Artificial Sequence
  Description of Artificial Sequence: Synthetic coding sequence
atgggtcaagagttctcatgggaggaagctgaagcagccggagaaatcgatgtcgcagaactgcaggaatggtacaaaaagtttgtcatggagtgcccatctggcacactgttcatgcacgaatttaaacgtttctttaaggtgaccgacgatgaggaagctagccaatatgtagaggggatgttcagagcatttgacaagaacggggataacaccatcgactttctggagtacgtcgcagccctcaatcttgtgctcagggggaccctggagcacaagctgaaatggacatttaagatttacgataaggacggaaatggttgtatcgaccgactggagctgcttaacattgtcgagggaatttaccagctgaagaaagcctgcaggcgggagctgcagactgaacaggggcagctgctgaccccagaagaagtggttgatcggatattcttactggtggatgaaaacggagatggccaactctccctcaacgaatttgtggagggtgccagacgcgataagtgggtgatgaagatgctccagatggatatgaacccttccagctggctcgctcaacagcgacgaaaatcggccatgttttag

SEQ ID NO: 234366 - DNA, 1104 bp, Artificial Sequence
  Description of Artificial Sequence: Synthetic coding sequence
atgtggtcagagggtagatatgagtatgagcggatcccacgggaaagagcaccgccaaggtctcacccaagtgatggctacaaccgtttggtgaatatagttccaaagaaaccacctctcctggatagacccggagagggctcttacaatcggtactactcccacgtggactaccgcgactacgatgaaggcagaagcttttctcatgataggaggtccggccctccccaccggggagatgagtctggatacaggtggacccgggatgatcatagtgcatcccgccagccggagtacagggatatgcgcgacggctttcgtcgcaagtccttctattcttcccattacgcgcgtgaaagatccccctataagagagacaatacattcttccgagaatcgccggttgggcgtaaggactctccccatagtaggtccggatcatccgtgtcctcccgcagctatagccccgagagatccaagagttattcatttcatcagtcacaacaccgaaagtccgtgcgtccaggggcaagttacaagagacagaacgaaggaaatcctgagagggacaaggaaaggcccgtgcaaagcttgaagacctctcgcgacacatcacccagctccggttcagccgtttcaagcagtaaggtgctagataaaccctcgaggctcacagagaaagaactggccgaggcagcaagtaagtgggccgcagagaagctggaaaagagcgatgagtccaatctccccgaaattagtgagtatgaggctgggtccaccgccccactctttaccgatcagcctgaggagcctgagtcaaatacaacccacgggatcgagctttttgaggattcccaactgaccacaagatccaaagcgattgcttcaaagacaaaggagattgagcaagtttaccgacaggactgtgagacttttgggatggtagttaagatgttgattgaaaaggacccgtccttagaaaagagtatccaatttgctctgcgacagaacctccacgaaatcggagagcgctgtgtcgaagaactgaagcatttcattgcagaatacgacacctctacccaggactttggcgaaccattctag

SEQ ID NO: 234367 - DNA, 1377 bp, Artificial Sequence
  Description of Artificial Sequence: Synthetic coding sequence
atgtggagcgaaggccgatatgagtacgagcgtatccctagggagagggccccacccagatctcacccttccgatggctataatcgcctggttaacatcgtgcctaaaaagcctccattgcttgataggcccggagagggatcttacaatcggtactattcccatgtggattacagggattatgatgagggcagatcgttttctcacgataggaggagcggacctccccacagaggagacgagtccggctatcggtggactcgcgacgatcattctgcctcccgacaacccgagtatagggacatgcgtgatggctttcggcgtaagtccttttattcctctcattatgccagggaacgctcaccttataagcgggacaacactttttttcgagaatcacctgtcggaaggaaggatagtcctcattctcgcagcggctcaagtgtaagcagcaggtcatacagccccgagaggtcgaaaagctacagtttccaccagtcccagcaccgaaagtccgtccgaccaggggcttcgtataagaggcagaatgaaggaaaccctgagcgtgataaggaacggcctgtccaatctctgaagacatctagggacacttcaccgtcaagtggctccgccgttagttcttcaaaagtgttagacaagccttcaagactgactgagaaggagctggcagaggccgcaagcaagtgggccgcagagaaactcgaaaagagcgacgaaagcaatctgccagagattagcgaatacgaggcagggagcacagcaccgcttttcaccgatcagcccgaggaacccgagtctaataccactcacggcattgagctatttgaggacagccagttgacgaccagatcaaaagctattgccagcaaaactaaagaaattgaacaggtttacagacaggattgtgaaactttcggtatggttgttaagatgttgatagagaaagatccatctcttgagaaatcaatacagtttgcacttcggcagaatctgcacgagatcgagagcgctggccagacgtggcagcaggtcccgcctgtcagaaataccgagatggatcatgacggcactcccgagaatgaaggagaggaaactgcacaatcagcgcctcagccgcctcaggctccacagcccctccagccacgcaaaaagagggtgagacgaactacccagctgcggcgaaccaccggggctcccgatattacttggggcatgctgaaaaaaacaacgcaggaggcagaaaggatcctgttgcgtacccagactccgttcacccccgagaacttgttcctcgcaatgctctctgttgttcattgcaactctaggaaagacgttaaaccagaaaataagcagtag

SEQ ID NO: 234368 - DNA, 1125 bp, Artificial Sequence
  Description of Artificial Sequence: Synthetic coding sequence
atggcataccggagggacgagatgtggagcgaggggcgatacgagtatgagagaatcccacgggaacgcgctcccccaaggtctcatcctagcgacggctacaatcgtctggtcaatattgtgcccaagaagcctcctctcctcgacaggccaggtgagggaagctacaacaggtattattcccacgtcgattaccgcgattacgatgagggcaggtcctttagtcatgatcggaggagtgggccaccgcatcgaggagatgaaagtgggtatagatggacccgggatgaccacagcgcctctcgccagcctgaatatagggacatgagagatggatttcggcgtaaatcattttatagctcccactacgcacgcgaaaggtctccttacaaacgcgacaacacattctttagggaaagcccagtgggcagaaaagattccccccatagtagatcaggaagcagtgtgtctagccgaagttactctcccgagaggagcaagtcctattcttttcatcagtctcaacaccggaagagcgttaggccaggcgcaagctataaaaggcagaatgaaggcaaccctgaacgcgataaagagcgtcccgtgcagagtctgaagacctccagggacacatcgccatctagcggcagtgccgtctcatctagcaaggtgctggacaagccaagcagacttaccgagaaggagctggcggaggctgccagtaagtgggctgcggagaaattggagaagtccgacgaatcaaacttgccagagatcagcgaatatgaggcgggatccaccgccccactgttcacggatcagccagaagaacctgagtccaatacaactcacgggatcgaactatttgaggactcacagctgaccacacgctcgaaggctattgcaagtaaaacgaaagagattgaacaggtctatcgccaggactgcgagactttcggcatggttgtgaagatgttaatagagaaagacccgtctctggaaaagagtatacagtttgctcttcgccagaacttgcacgagataggggagaggtgcgtggaagagctcaaacatttcattgcggaatatgacacctctactcaggattttggagaacctttttag

SEQ ID NO: 234369 - DNA, 1305 bp, Artificial Sequence
  Description of Artificial Sequence: Synthetic coding sequence
atgtggagtgaaggacgctatgagtacgagaggattccgagggaaagagcacctccccgttctcacccctccgatgagagcggatacaggtggacccgcgatgatcacagcgcctcccgacagccggagtaccgggacatgcgcgacgggttccggaggaaaagtttctattccagccattatgctcgggagagaagcccctataagcgagataatacctttttccgcgagagccctgttgggagaaaggatagtcctcacagtagaagcggctcgtcagtgagctctagatcttactctcctgaaagaagcaagtcttacagctttcatcaaagccagcatcggaagagcgtacgaccaggagccagttacaagcgccagaacgagggcaacccagaaagagacaaagaacggccagtgcagagtctcaagacgtccagggacaccagccccagttccggatccgccgtatcttcaagcaaagtgctcgacaaacccagccgtctgactgaaaaggaactggccgaggccgctagtaaatgggctgccgagaaactcgaaaaatcggatgagtcaaacctacctgagattagcgagtacgaagccggaagcaccgccccacttttcacagatcaaccagaagagcctgagagcaataccacccatggtatagagctctttgaagatagtcagcttactacgcggtccaaggctatcgccagtaagaccaaggagattgaacaggtttaccgtcaggactgtgagacattcgggatggtggttaaaatgctcattgagaaggatccctctctggaaaagagtatccagttcgccctgaggcagaacctgcatgaaatcgagagtgcagggcagacctggcagcaagtgccccctgttcggaataccgagatggatcacgatgggacgccagagaatgaaggcgaggagactgctcagagtgccttatttggctttcagcacgatgctagcaatcatactattgtggggcttggtcctaaccaggtgcctgagatgaaggagaccactcttcaagcaccacagcccccacaagcacctcagcctttgcagcctcggaaaaagagggtacgcaggactacccagcttcgtcggaccacgggagcaccggacattacctggggaatgctcaagaagactacacaggaggcagagcgcatcctgctgcgaactcagacacccttcacccccgagaacctattcctagcaatgcttagcgtggttcactgcaattctcggaaggacgttaaaccagagaataagcagtag

SEQ ID NO: 234370 - DNA, 1047 bp, Artificial Sequence
  Description of Artificial Sequence: Synthetic coding sequence
atgtggagcgagggcaggtacgagtacgaacgaattcctcgcgagagggcccctccccgatctcaccccagcgacggatacaacagactcgtgaatattgtacctaaaaagccgcctttgctggaccgcccaggcgagggtagctacaacaggtactactcgcatgtagattaccgcgactacgacgaaggacgtagcttcagccatgaccggcgttctggaccaccgcaccgaggggatgagagcggctataggtggacgcgggacgatcactccgctagtcgtcaacctgagtacagggacatgagggacggcttcagacgcaaaagcttttactcttctcattatgctcgcgagaggtccccttacaaaagagacaacacctttttccgcgagtcccctgtggggcgaaaggacagtccccatagcagatccgggagtagcgtgtcgagtcggagctacagccctgaacggtcaaaaagttattcattccatcagagtcaacatcggaacaaagagcgccctgtgcagtcactcaagacatcccgtgacacgtcaccttcttccgggagcgccgtgagcagcagcaaagtgctggataagccatccaggctgaccgagaaagagctggccgaagctgcctccaaatgggctgccgagaagctcgaaaagtctgatgagtccaacttgcctgaaatctctgagtacgaggccggtagtaccgccccactgttcacagaccagccggaggagccggagtctaacactacacacggcattgaattattcgaggattcgcagttaactacgcgctccaaggcaatcgctagcaaaaccaaagaaattgaacaagtgtaccggcaggactgtgagacatttggcatggtggttaaaatgctcattgaaaaagatccttcactggaaaaatcaatacagtttgctctaagacaaaatctgcacgaaatcggcgagcgttgtgttgaagagctgaaacactttatcgccgagtatgatacctccacgcaggactttggggagcctttctag

SEQ ID NO: 234371 - DNA, 486 bp, Artificial Sequence
  Description of Artificial Sequence: Synthetic coding sequence
atggcctacagaagggatgaaatgtggtctgagggacggtatgagtacgaacgcatcccgagagagcgggctccccctaggtctcacccaagcgatggatacaacagattggtcaacattgtacccaaaaaaccaccgctgctggaccgccctggcgagggctcctataataggtattatagccacgtcgactaccgtgattacgatgaaggtcgttcattctcacatgaccgacgaagcggccctccccatcgcggtgatgaaagtggctatagatggacccgcgatgatcactccgcttcccggcagcccgagtaccgagatatgcgcgatgggttcaggcgaaagagcttctacagtagccattatgcacgggaacgcagcccgtacaagcgggacaataccttcttcagggagtcaccagtgggacgtaaggacagcccccatagtcggtctggatcaagcgtgtcctctcgcagctattag

SEQ ID NO: 234372 - DNA, 507 bp, Artificial Sequence
  Description of Artificial Sequence: Synthetic coding sequence
atgtggtccgagggaagatatgaatacgagagaatcccgcgagagagggcgcctccgcgatcccacccttcggatggctataatagactggtgaacatcgtgccaaaaaagcccccactgcttgaccgacccggtgagggctcttataatagatattacagtcatgtcgattacagagactacgatgaaggccgaagtttttctcacgacaggaggagcggaccacctcaccgcggtgacgaaagcggatacaggtggacccgcgacgaccactcggcttccaggcagcccgaatacagggatatgagagatgggtttcgtcgcaaaagtttctacagcagccattacgcaagggagcggtcgccttacaaacgcgataataccttctttagggaatcacctgtgggcagaaaggacagccctcacagccggtcagggagtagtgtctcatctagatcttacagccccgagcggtctaagtcttattctttccatcagtctcagtag

SEQ ID NO: 234373 - DNA, 960 bp, Artificial Sequence
  Description of Artificial Sequence: Synthetic coding sequence
atggcgtaccggcgagacgaaatgtggagcgaaggtcgatacgagtacgagagaattcctcgagagagggctcccccacgctcgcatccatctgacgagagcggataccggtggactcgggatgatcattcggccagccgccagcctgagtatagagatatgcgagacggtttccgtcgaaagagtttctattcttctcattatgctcgcgagagatctccttacaagagagacaacacttttttcagggaaagccctgtggggaggaaggatagtcctcactcacggagtggaagcagtgtctcatcacgttcttactcgcccgagcggagcaagtcctattcattccatcagtcccaacatcgtaagtccgtgaggccaggggcttcatacaaaaggcagaacgagggaaatccggagagggataaagagagacccgttcagtctctgaagacttcaagagacacatcccccagcagcgggtcagcagtgtcctcgagcaaggtgctcgacaaacccagccggttgactgaaaaagagttggcggaggccgcttctaaatgggcggctgaaaagctggaaaaatctgacgaaagtaacctgccagaaattagtgagtacgaggcgggaagcactgcccctttattcacagatcaaccagaagaacccgagtccaacactacgcacggcatcgagctgttcgaggactcacagcttacaacacgctctaaagccatcgcctccaaaactaaggagattgagcaggtctatcgccaggactgcgaaacgttcgggatggttgttaagatgctgattgaaaaagatccaagcctggagaagagcatccagttcgcactcaggcagaacctgcacgaaataggagaacgctgtgtggaggagctgaagcacttcattgctgagtacgacacaagcacgcaggattttggcgaacctttttag

SEQ ID NO: 234374 - DNA, 5270 bp, Artificial Sequence
  Description of Artificial Sequence: Synthetic coding sequence
atgaacagcctgtttagaaaaagaaataagggtaagtactccccaaccgtgcagacacggtcaatttctaacaaggaactatccgagctcattgaacagctgcaaaagaacgcagatcaggtcgagaagaatatagtggacacagaagctaagatgcaatccgaccttgccaggcttcaggagggacggcagcctgagcatcgggacgtgaccctgcagaaagtgctggactccgaaaaactcttgtatgttctcgaggccgacgcagccattgctaaacatatgaagcacccacagggtgatatgattgccgaagacattaggcagctgaaggagagggtgacaaacctccgcggtaagcacaaacagatctacagacttgcagtaaaagaggtggatccccaggtcaattgggccgcactcgtggaggaaaagctggataaactcaacaaccaaagctttgggacagacctgcccctggtggaccatcaggtagaagaacacaacatcttccacaacgaagtgaaggcaataggtccccaccttgcgaaggacggggacaaagaacaaaactctgagctaagggccaagtatcagaagctcttagccgcttcacaggctcggcagcagcacctgtcttcactgcaggactacatgcagcgctgcaccaacgaactctattggctggaccaacaagccaagggacgcatgcagtatgattggtcagatcggaacctggactacccttctcggcgaagacagtacgaaaacttcattaaccgcaatctggaggccaaagaagagcgtattaataagttacattccgaaggggaccaactgctcgctgctgaacaccctggccgaaactcaatagaagcacacatggaggcggtgcatgcagactggaaagaatatctgaaccttcttatatgtgaagagtcccacttaaagtatatggaagattaccatcagttccacgaggacgtgaaggatgcacaagagctcctgcggaaggtggactccgatctcaatcaaaagtacggcccagacttcaaggacaggtatcagattgaattactcctgcgggaacttgatgaccaagaaaaagtgcttgacaaatatgaggatgtggtgcaggggctgcagaaaagagggcagcaggtcgttcccctcaaatatcgtcgtgaaacacctttaaagccaattccggtggaggcactgtgtgatttcgaaggagaacagggccttatttcaagagggtatagttacactctgcagaagaacaacggagagtcatgggaactgatggactccgctgggaataagctgatagcccctgctgtgtgctttgtgatcccacctactgatcccgaggccctggccctggctgactcattgggttcacagtaccgcagtgtgcgacagaaggcagccggttcaaagcgtaccctccagcagcgctacgaggtgctaaaaacggagaacccaggcgacgcttccgaccttcagggaagacagctcctggctgggctggacaaagtggcgagcgatctggatagacaggaaaaagccatcactggaattctccgccctcccttggagcagggtcgtgctgtgcaagatagcgcagagcgcgctaaagacctaaagaatatcactaatgagctactgcggattgagccggaaaagactaggtctacggctgagggggaagcatttatccaggccctgccaggctctgggactacacctctgctgcggacccgcgtggaggacacaaacaggaaatacgagcacctgcttcagctgctcgacctggcacaagagaaggtggatgtggctaaccgcttggagaaaagcctccagcagtcttgggagctcttggcaacacatgagaatcacttgaaccaggacgacacagtccctgaatccagccgagtcttggactcaaaaggacaggaattggcagcgatggcctgtgagctccaagcacagaagagcctcctgggtgaagtggaacaaaatctgcaggcggcaaagcaatgtagctctacacttgccagccgtttccaggaacactgcccagacctcgagagacaggaggccgaagtccacaagcttggccagcgcttcaacaatttaaggcagcaggtcgaaagacgtgcccagtcgctgcaatctgcaaaggctgcttacgaacactttcatcgcggacacgaccacgttctacagttcttggtgagtattccctcctacgaaccccaggagaccgacagcctatcccagatggaaacgaaactcaagaaccaaaaaaacctgctggacgagattgcctcgagagaacaggaggttcaaaagatttgtgccaattcacagcagtaccagcaggcagtgaaggattacgaactcgaggccgaaaagcttcgttctttgctcgatctggagaacggccgaagatcccacgtttctaagcgggctagattgcaatctccagctactaaggtcaaggaggaagaggccgctcttgccgcaaaatttaccgaagtttatgcgatcaacagacaacggctgcaaaacctcgaattcgccttgaatcttcttaggcagcagccagaggtagaagtgacacacgagaccttgcagcgaaacaggcccgatagcggcgtggaagaggcttggaaaatccggaaggagctggatgaggaaaccgagcgcagaaggcagctcgagaacgaggtgaagtctacccaagaggagatctggaccctgagaaaccagggacctcaagagtcagtggtgagaaaagaagttctaaaaaaggttccagaccctgtgttggaggagtctttccagcagctgcagagaaccctggctgaggaacagcacaaaaatcaattgctacaggaagagctggaggcacttcaattgcagctgcgagcgttggagcaggagacccgagacgggggtcaggaatatgttgtgaaagaggtcttaaggatcgagccggatcgggctcaggcagacgaagtcctgcagttgcgggaggagctagaggctctgaggagacaaaagggggcaagggaagctgaggtgcttctcctgcaacagcgagtagcagccctcgcagaggagaagagcagagcccaggagaaagtgaccgagaaagaagtggtgaagttgcagaatgatccgcaattagaggccgagtaccagcagctccaggaagaccaccaaaggcaggaccagcttagggagaagcaggaggaagagctgtcgttcttgcaggataaacttaagcggctggaaaaagagcgggcaatggctgaaggtaaaatcacagtaaaagaggtgctgaaggttgaaaaggatgcagcgaccgaaagagaggtgagcgatctgactagacagtacgaggacgaggccgctaaggcgagagccagtcagagggagaagacggagttactacggaagatctgggccctggaggaggagaacgcaaaggtggtcgtccaggaaaaggtacgcgagatagtgaggccagatccaaaggcagagagtgaagtggccaacctgcgtctggagcttgtggaacaggaacgtaaatatcgcggtgctgaagaacagttacgaagttatcaaagcgaacttgaggcgctgagacggcgaggccctcaagtggaagtaaaagaggtgactaaagaggttatcaagtataagacagatccagagatggaaaaagagttgcaacggctacgcgaagaaatcgtggacaaaacacgcctcattgagcggtgtgatctggagatctatcagttgaagaaggaaatccaagcattaaaggataccaaaccacaggtgcaaactaaggaagtggtgcaagagatcctgcaatttcaagaagacccccagacaaaggaggaggttgctagcctaagagctaagctgtctgaggaacagaagaaacaggtagatttggagcgagagcgtgcgtcccaagaagagcagatcgccagaaaggaagaagagctgtccagagtcaaggaacgggtcgtgcaacaggaggttgttagatacgaggaggaacccggacttagggctgaagcaagcgcctttgccgagtcaattgatgtcgaactgcgccagatcgacaaactgagggccgagctcaggcggcttcagcgtagacggaccgagcttgagagacagctggaggagttagagagggagcgccaggcccgacgagaagctgaacgtgaagtccaaaggctccaacagagacttgctgcgctggaacaggaggaagcagaggcccgtgaaaaagtgacgcatacgcagaaagtcgttttgcagcaggacccacagcaagccagagagcacgccctgttgcggctgcagctcgaggaggagcaacatcggcgacagttacttgagggcgagttagagacgctgcggcgtaaactggccgctcttgagaaagctgaggtgaaggagaaggtggttctcagtgaatcagtgcaggtggaaaagggcgacacagaacaggaaatacagcggttaaaatcgtcactggaggaggagtcacgctcgaagagagaactagacgtggaagtgtctcgtctcgaggccagattgtccgaattggagttccacaattcaaagtcttcgaaagagctggacttcctgagagaggagaaccataagctccagctcgagagacagaatctccagttggagactcgccgactccagtccgagattaacatggcggcaacagaaaccagagacctacggaacatgacggtggcagattcggggaccaaccatgacagcaggctgtggtctcttgaacgagagttggacgaccttaagcgcctctctaaggacaaggacctagagatagatgaactgcagaagagacttggaagcgtcgctgtcaagcgcgagcaacgtgagaaccatttgaggcggagtatcgtagtgatacatccagatactggaagggaattgtcacctgaggaggcgcacagggcaggcctcattgattggaatatgttcgttaaactccgcagccaagaatgcgattgggaggaaatctcagtcaagggccctaatggcgaatcaagcgtgatacacgataggaagtctgggaagaaatttagcattgaagaagcgcttcagtcagggcgattgactcccgcacagtatgatagatacgtgaacaaagatatgtcgatccaagaacttgccgtgctcgtttcagggcagaaata

SEQ ID NO: 234375 - DNA, 4440 bp, Artificial Sequence
  Description of Artificial Sequence: Synthetic coding sequence
atggctaagcggtctaggggacctggtcgtagatgtctgcttgctctcgtccttttttgcgcttggggcactctcgcggtggtggcccagaaacctggcgctgggtgtccctcaaggtgtctgtgctttcgcaccactgtccggtgtatgcacctcctgctggaagcagttcccgctgtagcccctcagacatccatcctcgatctcagattcaaccgtatacgcgagattcagcctggcgcttttcgaaggcttcgtaacttgaatactctcctcctgaacaacaatcagattaaacggattccaagcggcgcttttgaagatctggagaatttgaagtatctctatttgtacaagaatgagattcaaagcatcgaccgacaggccttcaagggcctcgctagcctcgagcagctctatcttcatttcaaccagatcgagaccctcgaccctgattcgttccaacacctgcctaaactcgagagactgttcctccacaacaatagaataacacaccttgttcctgggaccttcaatcacttggagagtatgaagcggctaaggctggatagtaacaccctgcattgtgactgcgagatcttgtggctagcggatctgctcaagacctacgccgaatcaggaaacgcacaggctgccgctatctgcgagtatccacgcagaattcagggcaggtcagttgcgacgatcacccccgaggagctaaactgcgaaagaccaaggattacatctgagcctcaagatgcagacgttacatccggcaacacggtgtacttcacctgcagagcagaaggcaaccccaagccggagattatatggctgagaaacaacaacgaactctccatgaaaacagactcaagactgaacctacttgatgatggcactcttatgatccagaatacccaagagactgaccagggcatctatcagtgcatggcaaaaaacgtcgcaggtgaggtgaagactcaagaggtcactttacgctattttggcagtcctgccagacctacatttgtgatacaacctcaaaacaccgaggtgctggtgggagagtccgttaccctggagtgtagcgcaactggacaccctccccctcggatcagctggacgagaggtgaccgcactccacttcccgtggaccccagagtcaatattacaccgtcaggaggcctgtatatccagaatgtggttcagggcgattctggagaatatgcttgctctgctactaataatattgatagcgtgcatgcaaccgctttcattatcgttcaggctttaccacagtttacagtcaccccacaagatagggttgtcatagaaggccagacagttgacttccagtgcgaggcgaaaggtaatccaccccctgtcatagcgtggactaagggtggctctcagctgtccgtggaccgtcgtcacctggtcttgtcgtcagggacactgcgcatatcaggggtggcccttcatgaccagggtcagtacgagtgtcaggcagtgaatataattggcagtcagaaggtggttgctcatctcactgttcaaccaagggtgactcccgtgtttgcctccattcccagcgataccaccgtcgaggtaggagcgaacgtccagttgccatgctccagtcagggcgaaccagagcctgcaattacttggaataaagatggggttcaggtcactgagagcggtaaatttcacatttcaccagagggattcctgacgattaacgatgtgggtcccgctgatgctggtaggtacgagtgcgtggcgagaaataccattgggtcggcgtctgtgtccatggtgctatcagtgaacgtgccagatgtatcccgaaacggagatccattcgtcgcgacctccattgtcgaggccatagctacagtggatagagccattaactcgacgcgaacacatctgttcgactctcgcccaagatcccctaacgacctactggctctgtttcgctatccacgtgatccctacacagtcgaacaagccagggcaggggaaattttcgagcggactctgcagctgatccaagaacacgttcagcacggactaatggtggacctgaacggaacctcctaccattataacgacctcgtcagtccacagtaccttaatttgattgcaaatctgagtggttgtacagcccacaggcgagttaacaattgtagcgacatgtgcttccaccaaaagtataggacccatgacggcacatgcaacaatctgcaacatccaatgtggggggcatcattaactgcattcgagagactcctgaagtcagtctatgaaaacggattcaatactcctcggggtataaacccacacagattgtataacggacatgccttgccaatgccccgtctcgtcagcacaaccctgatcggcactgagacagtgacacccgatgaacagtttacccacatgctgatgcagtgggggcaatttttagaccatgatctcgatagcactgtagttgctctgtcacaggcccgattctcagacggtcagcactgcagcaacgtgtgttctaacgaccctccatgttttagtgtgatgatcccccctaacgactccagggcgagaagcggagctagatgcatgtttttcgttagaagctcccctgtctgcggatctggaatgacgtcccttctgatgaatagtgtgtacccgagagagcagatcaaccagctgacctcatacattgacgctagtaatgtgtacgggtccactgagcacgaagccaggagcattcgcgacctggcaagtcatcggggattgctccgccagggaattgtgcagagatccgggaagcccctgctgcccttcgctaccggaccacctacagagtgcatgagagacgagaacgagagtccgatcccatgtttcctcgctggagaccatcgagcgaacgagcagctcgggctgacaagtatgcacaccctttggtttagagaacacaacagaatcgccactgagttgttaaagctgaatccccattgggatggcgataccatctattacgagacacgtaagatagtgggagccgagatccagcacatcacgtatcaacattggctcccgaaaatcctgggggaagtaggcatgcgaactctcggagagtatcacgggtatgaccctggaattaatgccggtatatttaacgcttttgccacagcagccttccgcttcggtcatacactggttaacccactgctgtacagattggatgagaattttcagccaatcgcgcaagaccaccttcctctgcacaaggcctttttctccccttttaggatcgtgaacgagggtggcatcgatcctctgttgagggggctctttggcgtagccggtaagatgagagttcccagccaactccttaatacagagctaacagaaagattgtttagcatggcacacacggttgcgctggatttggcagcgatcaacattcagagaggaagggaccacggcatcccaccctaccatgattaccgggtgtactgcaacctttccgctgcacacacgttcgaggacctcaagaatgagattaaaaatccagaaattcgagagaagcttaagcggctctacggaagtacgctgaatattgatttgtttccagctctcgtggtggaggatttggtccccggatcaaggctgggacctacccttatgtgcctgctgtccactcagttcaaacgactccgcgatggggatcgactgtggtacgaaaatcctggtgtgttctccccagcccaactgactcagattaaacagacctccttggcccgtatcttatgtgacaatgcggataacataacaagggtccagagtgacgtcttcagggtcgcggagtttccccacggatacgggagctgtgatgagattcccagagtggatctacgggtttggcaagattgctgcgaggactgcagaactagaggacagttcaatgccttttcgtaccatttccgaggtcggaggagcttggaattttcataccaagaggacaagcccactaaaaagacccggccacgcaaaattccctccgtgggcaggcagggcgaacatctatcaaacagtacatcggccttctccacacgcagcgacgctagcgggactaatgacttccgtgaattcgtgctggaaatgcagaagacaatcaccgacctgaggacgcagattaaaaagctcgaaagccgtcttagtaccaccgaatgcgtggatgcagggggagagagtcatgcaaacaatacaaaatggaagaaagatgcttgcactatttgcgagtgcaaagatggacaggttacctgtttcgtggaagcttgccctcctgcaacatgcgccgtgcctgtcaacatccctggggcatgctgccccgtatgtttgcagaagcgcgctgaggaaaaaccctag

SEQ ID NO: 234376 - DNA, 2172 bp, Artificial Sequence
  Description of Artificial Sequence: Synthetic coding sequence
tgacgaggtcccggaaggcgctgcctcttggctctcgttctcttttgcgcctggggaacactggcagtggtggcccagaagccaggagctggttgtccctcacgctgcttgtgtttcaggacaacagtgcgctgcatgcaccttctactggaggcggttcccgctgtggcccctcagacctcaatcctggacctgcgcttcaaccggattagggaaattcaacccggagccttcagacggctcaggaacctgaacaccctgttactcaataataatcagataaaaaggatcccaagcggagcctttgaggatctagaaaacctgaagtacctctacctgtacaagaacgaaattcagagtatcgaccggcaggcattcaaaggtctggcgtccttagaacaactgtatcttcatttcaaccagatcgagacactcgatcctgacagcttccagcacttgcctaagctggagcgtctctttctgcacaataaccgcataacacatctagttccagggacctttaaccacttagaatctatgaagcggcttcgtctcgattccaacactttacattgtgactgtgaaattctgtggttagctgacctcttaaagacctacgctgaaagtggcaatgcccaagctgccgctatctgtgagtacccacggcgaatccaagggaggtcagtcgcaactattacccctgaggagttaaattgcgagcgaccacgcattacctctgagcctcaggatgcagacgtcacttctggaaataccgtatacttcacctgtagggctgagggcaatcccaaaccggagatcatctggctgcgcaataataatgagctgagtatgaagaccgattcccgcctgaaccttttggacgacgggacacttatgatccagaacactcaggagaccgatcagggaatctaccaatgtatggcaaagaacgtggccggagaagttaaaacacaggaggtgacactgcggtacttcggatcacccgctcgcccaacttttgtcatacagccccagaacacagaggttctggttggtgaatctgtgactctggaatgctccgccactggacatccgccaccaaggattagttggacacggggagacagaacgccactgcccgtggatccacgtgtgaatataacaccctctgggggtctgtatatccagaatgtcgtgcagggtgacagtggcgagtatgcctgctccgccacaaacaacatcgatagcgtgcacgcaaccgcattcatcatcgtacaggctctgccacagtttactgtcactccgcaggacagggtagtgatcgaggggcagaccgtggatttccagtgtgaagcaaagggaaacccgcctcctgtgatagcatggacaaaagggggaagtcagcttagcgtagaccgcagacacttagtcctctcaagtggcacattgaggattagtggcgtagccctacacgatcagggccagtacgaatgccaagctgtaaacataatcggctcacagaaggtggttgcgcacctcacggtgcagccacgggttacgccagttttcgcttccattcctagcgatactaccgtagaggtaggagcgaacgtacagctgccctgctcaagccagggcgagcccgagcctgcgattacttggaataaagacggggtccaggtgacggagtctggaaaattccatatttctcctgaaggatttcttaccatcaatgacgttgggcctgcagacgcaggacgatacgaatgcgtcgcccgaaacaccattggctccgcctcagtgtcaatggtcctcagtgttaatgttccagacgtttctagaaacggcgatccattcgtcgctacttccattgttgaagccatcgctactgtcgatcgcgcaatcaatagcacccgcacccacctttttgattctcgcccacggtcacccaacgacctgctggccctgttcagataccctcgggacccctataccgtcgaacaggcgagggctggagagattttcgaacggacactgcaacttatccaggagcacgttcagcatggtctgatggtggacctaaatggaacttcccaatgccaatccctgttcttcctgctccatggcctttccaatggggtcgagcatgcctctgtcaaaagccactcctag

SEQ ID NO: 234377 - DNA, 771 bp, Artificial Sequence
  Description of Artificial Sequence: Synthetic coding sequence
atggctgccgcagtcgggagattgttacgcgcttccgtggccaggcacgttagcgccattccctggggcatatctgcaaccgcagccctcaggccagctgcctgtggtcgtacatcactcaccaacctactgtgcagtggcagcagtcaggccaagctcttttcaacctcctcaagctgccacgcacctgccgtgacgcagcacgccccatacttcaaaggaacagccgtggtaaatggcgagttcaaggatcttagcttagatgacttcaaaggcaaatacctggtgctattcttctaccctctcgattttacttttgtgtgtccaaccgaaatcgtggcttttagcgacaaagcgaacgagttccacgacgttaattgtgaggtagtcgctgtctctgtggatagtcacttcagccacctggcttggataaatacacctaggaagaacggtgggttggggcacatgaacatcgccttactatcggacctcacaaagcagatatcaagggattatggtgtactcttagagggtagcggtctggccctcagaggcctttttatcattgatcctaacggagtgattaagcacctgtcggttaacgacctgcccgttggcagatccgttgaagagaccctccggctcgtgaaggctttccaatacgtcgaaacgcacggtgaggtatgcccggctaactggacccccgatagtcctacaatcaaaccttcaccagccgcttccaaagagtactttcaaaaagtgaatcaatag

SEQ ID NO: 234378 - DNA, 717 bp, Artificial Sequence
  Description of Artificial Sequence: Synthetic coding sequence
atggccgctgctgtcggccgtctattaagagccagtgtggcgcgacacgtctccgctattccgtggggtattagcgcaaccgctgccctacggccagccgcatgcggacgtacatccttgacgaacctgctatgtagtgggtcaagccaggcgccatacttcaaaggaactgccgtagtgaatggtgaattcaaggatctttcccttgatgatttcaaaggcaagtacctcgtgttgtttttttaccctctagatttcacattcgtgtgccctactgagattgtggcattctctgacaaggcgaacgagtttcacgatgtgaattgcgaggtagttgctgttagcgttgatagccacttttcccacctggcgtggatcaacactccgaggaaaaatggcggtctagggcacatgaatattgccttgctatcagatttaaccaagcaaatttcgcgtgattacggagtgctgttggaaggatcagggctggccctgaggggcttattcattatcgatcccaatggggtcattaaacatttgagcgtcaacgatttgcctgtcggcaggtccgtggaagagaccttaagactggttaaggccttccaatacgtcgagacccacggggaggtgtgcccagcaaactggactccagacagcccaaccatcaagccatcacctgccgcaagtaaggagtactttcagaaggtgaatcagtag

SEQ ID NO: 234379 - DNA, 645 bp, Artificial Sequence
  Description of Artificial Sequence: Synthetic coding sequence
atgggactcgccggagtttgtgccctcaggcgaagcgctggctatattctggtcggaggtgccggtggacagtccgctgcagcggcagcgcgtcgatactcagagggggaatgggcaagtggtggcgtgcggagtttctcccgcgctgcggctgcaatggctcccattaaggtgggggacgctattcctgcggtcgaagtgtttgagggggaaccagggaacaaggtgaatttggcagaactgttcaagggtaaaaagggtgttttgttcggagtccctggagctttcacacccggatgttccaagactcatctgccaggctttgtcgaacaagcagaagctctaaaggccaaaggcgtgcaggtcgtggcgtgtttgtctgtcaacgacgctttcgtcactggcgagtgggggagggctcacaaggctgagggcaaagtgagactcctcgctgacccaaccggggcttttggcaaggaaaccgatctgctgctggacgactccttggttagcattttcggcaacaggaggctcaaaagattctcgatggtggtccaagatgggatcgtcaaggccttgaacgtggaaccagacggtacagggttaacctgcagcctagctccgaacatcatcagtcaactctag

SEQ ID NO: 234380 - DNA, 378 bp, Artificial Sequence
  Description of Artificial Sequence: Synthetic coding sequence
atgggtctggcaggcgtctgcgccctgagacgttccgctgggtacattctcgtgggtggcgcaggcggacagtctgcagccgcagcggcacgtcggtactcagagggagagtgggccagcggcggagtgagatctttctcccgagccgcagccgcaatggctccaataaaggtgcggttgctggccgacccaacgggggcttttgggaaagagacggaccttttacttgacgattccctggtgtccattttcggcaaccggagattgaagagattttcaatggtggtacaggatggaatcgtcaaagccctcaatgtcgagcctgacggaacagggttgacgtgctcactcgctccaaacatcatttcacagctctag

SEQ ID NO: 234381 - DNA, 513 bp, Artificial Sequence
  Description of Artificial Sequence: Synthetic coding sequence
atgggactggccggagtttgcgctcttcggaggagcgcagggtacattctcgtcggcggagctgggggtcaatccgctgcagccgcagcaaggcgctactcggagggtgagtgggcgagtggaggtgtgagaagttttagccgtgccgcagcggcaatggctcctatcaaagtgggtgacgccatccccgcagttgaggtcttcgagggggaacccggaaacaaagttaacctagccgagctgtttaagggtaagaagggggtgctctttggagtccccggagccttcacccccggttgctctaaagtgcgcttactggcagatccaaccggcgcattcgggaaggagactgatcttctactggacgattccctggtatccattttcgggaataggagattgaaaagatttagtatggttgttcaggacggtattgtgaaggccctcaacgtcgagccagatgggaccggattgacatgttctttagccccaaacattataagccaactgtag

SEQ ID NO: 234382 - DNA, 675 bp, Artificial Sequence
  Description of Artificial Sequence: Synthetic coding sequence
atgcctgggggtctcctcctaggcgacgttgcacctaatttcgaggcaaatactacagtgggcaggattagatttcatgactttctgggagattcttgggggattctcttcagccacccaagagacttcacccccgtctgtactactgaactcggcagagccgcaaagttggctcccgaatttgccaaaaggaacgtgaaattgatcgcactcagtatcgatagtgtagaggaccatctggcctggagcaaagacatcaacgcctacaactgcgaagaacccactgaaaaactgccatttcccataatcgacgaccgcaacagggagctagcaattctgctggggatgttagatcctgctgagaaggatgagaagggaatgcccgttacggccagggtcgtgttcgtttttgggccagacaagaagctgaaactcagcatcctgtaccccgctactactggcaggaattttgacgagatcctgagagtagtcatttcactgcaactcacagctgaaaaaagagtcgctacccctgttgactggaaagatggcgatagtgtcatggttctgcccactatcccagaagaggaggcaaaaaaattattccctaagggcgtttttacaaaggagctgccctcaggaaaaaagtacctgcgctacactccccaaccatag

SEQ ID NO: 234383 - DNA, 3852 bp, Artificial Sequence
  Description of Artificial Sequence: Synthetic coding sequence
atgtggggctctgacaggctggctggagcgggaggtggcggtgcagctgtgaccgtggcctttacaaacgccagggattgctttttgcacctgccccgtaggctggtcgcgcaactgcatctcctgcagaatcaagccattgaagtcgtctggtctcaccagccagccttcctctcctgggtggagggtcggcacttctctgaccagggtgagaacgtcgccgagattaacaggcaagtgggccaaaagctgggcctgagcaacggcggacaagtatttctgaagccctgcagtcacgttgtgtcttgccagcaggtggaggtggaacctttgagcgccgacgattgggagatcttggaattgcatgccgtttcattagaacaacatttactcgatcagatacgaattgtgtttcctaaagcaatctttcccgtctgggtggaccagcagacatacatcttcattcagattgtggccctgatccccgctgctagctacggtcgccttgagactgacaccaaactgctgatacaaccaaaaactcggagggccaaggagaacaccttttcaaaggcagatgctgagtacaaaaaactccactcatacggacgtgaccaaaagggtatgatgaaggaactccagactaaacagctgcagtctaacacagtagggatcaccgagtccaacgaaaacgagagtgaaatccccgtcgactcttcttctgtggctagcctgtggaccatgattggaagcatcttcagcttccagagtgagaagaagcaagagacgagttggggcttgaccgaaattaacgccttcaaaaacatgcagtccaaggtggttccactggacaatatcttcagagtgtgtaagtcccaaccaccgagcatttacaacgcttcagcaaccagcgtattccacaagcactgtgctatacatgtgtttccttgggatcaggaatactttgacgtcgagccctccttcacagtcacatacggcaaactcgtgaagcttctgagcccaaagcaacagcagagtaaaacgaaacagaacgtcctgtcacccgagaaagagaagcagatgtccgaaccgctggaccagaagaagatacgatcagaccacaacgaggaggacgaaaaggcttgtgtcctgcaggtggtgtggaacgggctggaggagctcaacaacgccattaaatacaccaagaatgtggaggtgttgcatctgggtaaggtatggatccccgacgatctcaggaaacgcttgaacatcgaaatgcacgccgtcgttagaatcacacctgtagaggttacccccaaaattcccagatctctgaagctgcagcctcgcgagaacttaccgaaggatatcagcgaggaagatattaaaactgtcttctattcctggctgcaacagtctacaacaacaatgctaccactggtgatcagcgaggaggaattcattaaactggagaccaaagacgggcttaaagaattcagcttgtccatcgtccacagctgggaaaaagagaaagacaagaatatcttcctcctgagccccaacctcctccagaaaactaccattcaagttctccttgatcctatggtgaaagaggagaatagcgaagagattgatttcatcttacctttcctgaagctctcttctttggggggtgttaactcgctcggggtctccagccttgagcacattactcacagtctcctaggcagacctcttagccggcagctgatgtcactggtggccggtcttcggaacggtgccttacttctgaccggcggaaaagggtctggtaagtccacgcttgccaaggctatatgtaaggaggccttcgacaaattagacgctcacgtggaacgggtggactgtaaggccttgcggggaaaacgcctcgaaaacatccagaaaactctggaggtggccttttccgaggctgtgtggatgcaaccaagtgtcgtgctgttggatgatctcgatctcatcgctggcctgcccgcagtgccagagcacgagcacagtccagacgctgtgcagagtcaacggctggctcatgccctgaatgacatgatcaaagagttcatctccatggggtccctcgtcgcactgattgccacgtcccagtcccagcagtccctccacccactccttgtatcagctcaaggcgtgcatatatttcagtgcgtgcagcacattcagcctccgaaccaagagcagcgttgcgaaatcctttgcaacgtcataaagaacaaactggattgcgatattaataaattcacagacctcgatttgcagcacgttgctaaagaaacaggcggtttcgtcgcaagagacttcaccgtgctggtggaccgtgctattcatagcagactgtcccgccagtccatcagtacaagggagaagctcgtcctgaccacactggatttccagaaggccctgagaggctttctcccagcatctttgcgctctgtgaacctgcacaaacctcgggacctgggatgggacaaaatcgggggtttgcatgaagtgagacagattctaatggacacaatccagctgcctgctaaataccccgagctattcgccaatctgccaataaggcagcgcactggcattcttctttatggtccaccaggcacagggaaaaccctgctcgcaggggtgatcgcaagagagagtcgaatgaacttcataagtgtaaaaggtcctgagctcctgagcaagtacataggagcttctgaacaggcagtccgcgatatttttataagggcccaagccgctaaaccttgtattctgttcttcgacgagttcgagtctatagcgccaaggcggggtcacgataatacgggagtgactgatagggttgtgaatcaacttctaacccaactcgacggcgtggagggcctccaaggggtttacgtgctcgctgccacttcaagacccgatctgatcgatccagccctcctcaggcctggaagactcgacaagtgtgtttactgccctcctcccgatcaggtgagccgactggaaattctgaacgtgctcagtgattcactgcctcttgcagacgacgtggatctccaacacgtcgcctcagtcacagactcattcaccggagctgacctaaaggccctgttatacaatgcacagctcgaagctctgcatggcatgcttctgtctagcggcctgcaggatggatcctcatcctctgacagcgatctgagcctctctagcatggtgtttctcaatcattcttccggtagtgatgattcagcgggagatggtgagtgcgggttggaccagtcgctggtctccctggaaatgagcgaaatcttaccagacgaatcaaagttcaacatgtacaggctgtatttcggatccagctacgaatcggagctcgggaacggaaccagctcagatttgtcaagtcagtgtctatctgccccttcatccatgacccaggatttacctggggtccctggcaaagaccagttgtttagccagcctcctgtcctgagaacagcgtcccaagagggctgccaagaactcacccaggaacaaagagatcagctcagagccgacatttccatcattaaggggaggtatagatcccaatctggagaggacgagagtatgaatcagccagggccaattaagaccagactggcaattagtcaaagccatctgatgactgcactgggtcacactcggccatccattagtgaggatgactggaaaaactttgccgagctatatgagagcttccaaaatcctaaacgccgaaaaaaccaatccgggaccatgtttcgccctgggcaaaaggttactctggcatag

SEQ ID NO: 234384 - DNA, 3681 bp, Artificial Sequence
  Description of Artificial Sequence: Synthetic coding sequence
atgtggggatccgacaggctggctggcgcaggtgggggtggcgcagcagtcaccgtagctttcaccaacgcacgcgattgttttttgcacctgcctaggcgactcgtggctcaactgcatctacttcagaatcaggccatcgaggtggtgtggtcccatcagccagcctttctgtcctgggttgaaggcagacactttagcgaccaaggggaaaacgtggccgagataaatcggcaagtcggtcagaagctgggattgagtaacggcggacaagtctttttaaagccctgcagccatgtggtgagctgtcagcaggtcgaggtggagccgctgtctgctgacgactgggagattctggaactacatgccgtgtctctcgaacagcacttactggaccagatccggatcgtgttcccaaaggctatctttccagtttgggttgatcagcagacctacatatttatacagatagtagcgttgatccctgccgctagctacggacgcttagagaccgacaccaagctcttgatccagccaaaaacccgccgagcgaaggagaatactttctccaaagccgatgcagaatacaaaaaactccactcatatggtagggaccaaaaggggatgatgaaggagctccagaccaaacagcttcaatctaatactgtgggcatcaccgagtccaatgaaaatgaaagtgaaataccagtggacagtagctccgttgcttcactctggactatgatcggcagcatattctcgttccagtccgaaaaaaaacaagagacctcttggggcctgaccgaaataaatgcgttcaagaacatgcaaagcaaggtggtgcctcttgacaacatctttagggtgtgcaagtcccagccaccttcgatttacaacgcctctgccacctctgtgttccacaaacattgcgccatccatgtgtttccatgggatcaggagtactttgacgtggaaccttcttttaccgtaacttacggaaagttagttaagctgttatctcctaagcagcaacagagtaagactaagcaaaacgtgctctcgcccgagaaggagaagcaaatgtcagagcccttggaccagaaaaaaatcaggtccgaccataacgaggaggacgagaaagcatgcgtcctccaggttgtgtggaacggcctggaagagctcaacaatgcaatcaagtacaccaagaacgtggaagtactccacctcgggaaggtttggatcccagacgatttaagaaagagactcaacattgagatgcacgcagtggtgcgaatcacccctgttgaggtcacgccaaagatccctagatcacttaaacttcaaccaagagagaacctgcctaaggatatctctgaggaagatattaaaacggtcttctactcctggctgcagcaaagcaccaccactatgctgcccctggtgataagcgaggaggaatttatcaaactggagactaaggatgggctgaaggaatttagcctttccattgtgcattcatgggagaaggagaaagacaaaaatatcttccttctcagtccgaatttattgcagaagaccactatccaggtgctcctggacccaatggtgaaggaggagaattccgaggagatcgactttatcctcccatttttaaagttgtccagtttaggaggcgtaaattcactgggggtgtcgtcactcgaacacataacccattccttactgggcaggcctttatcacgacagctaatgagtctcgttgcgggattaaggaatggcgcactgctcctcacagggggaaagggaagcggcaagtctactttggccaaggcaatctgcaaagaggcctttgacaaattagacgcccacgtagagcgtgtagattgtaaggccctgcgtgcccttaacgacatgatcaaggaatttatctcgatgggctccctcgtagccctgatcgccacctcccagagccaacagtcactccacccacttttagtctccgcccaaggtgtccacatatttcagtgcgtccaacatatccagcctcccaatcaagagcagcggtgcgaaatcctttgtaatgtgattaaaaacaagctcgattgcgatattaacaagttcaccgacctggatctccagcacgtggcgaaagagaccggaggtttcgtcgctcgtgattttacagtgctggttgacagagctatccacagcaggctgtccagacagagtatatctaccagagaaaagctggttctgactacccttgatttccaaaaggcactgagggggttcctgcctgcctccctgcgctccgtgaacctgcataaacctcgagacctgggctgggataaaattgggggtctccacgaagtaaggcaaatattgatggacactatacaactgcctgccaaatacccagagttgttcgccaacctccctatcagacagcgcacaggtattctactgtacggcccacccggtactgggaaaaccttactggcaggagtcattgcccgtgaatcccgcatgaattttatctccgtgaaaggcccagaattgctcagtaagtacatcggcgcatccgagcaggctgtgcgggacatcttcatccgcgcacaggccgctaaaccctgcatcctgttcttcgatgagtttgaatccattgcccctcggaggggccatgataacacgggcgtcaccgatcgagttgtgaaccaactgctgacccagctggacggtgtggagggtcttcagggagtgtacgtgctcgctgcaacttcacgcccagacctgatcgatccagcccttctgaggccgggtagactggataaatgtgtgtactgtcctccacccgatcaggtgtcaagactggaaattctcaatgtcctcagtgattccctgcccctcgctgacgatgttgacctccaacacgtcgccagtgtgactgactccttcactggagccgatctgaaggcactgctgtacaatgctcagctggaagcgttacacgggatgctgctgtcgtcaggtctgcaggatggatccagttcatcagatagtgatctgtccttgtcttccatggtattcctgaaccatagtagtgggtctgacgatagcgcaggagacggggagtgcggattggaccagtccctcgtgtcgctcgagatgagtgaaatactgccagatgaaagtaagtttaatatgtatcgcctgtactttgggtcctcttacgaatctgaactgggaaacggtacgtcctcagacctgtcttcacagtgccttagcgctccctctagcatgacccaggatcttcccggagttcccggaaaggatcaactgttttcccaaccccctgtgttgcgtactgcgtcccaggagggctgtcaggagttgactcaagaacaacgcgaccagcttcgagccgatattagcattattaagggcaggtacagatcccagtcaggcgaggatgagtctatgaaccagccaggacctatcaagacacgtcttgcaatctctcagagccacctcatgaccgccctcggtcacacccggccatctatcagtgaagacgactggaagaatttcgcagagctgtatgagtccttccagaatccaaagaggaggaagaatcagagcggcacaatgttcagaccaggacaaaaggtgaccctcgcatag

SEQ ID NO: 234385 - DNA, 483 bp, Artificial Sequence
  Description of Artificial Sequence: Synthetic coding sequence
atgtctctggtggcagggctgaggaatggggcattgctcttgactggaggcaaaggcagtggaaaaagcactcttgcaaaggccatctgtaaggaagcatttgataaactcgacgctcacgttgagagggttgactgcaaagcgctgagaggaaagcggctggagaatattcagaaaactcttgaagtcgccttctctgaggcggtatggatgcagccatctgttgtgttgctggacgatttagacctcatcgcgggactgccagccgtgcccgagcacgaacactcacctgacgctgtccagtcccagcgactcgctcatgcactgaacgacatgataaaagaatttatctctatgggttctcttgtggccctcatcgccacctctcagtcccagcagtcactccatccactgcttgtatctgcacagggcgtacatattttccagtgcgtgcaacacattcagccccctaatcagaattag

SEQ ID NO: 234386 - DNA, 1899 bp, Artificial Sequence
  Description of Artificial Sequence: Synthetic coding sequence
atgtggggatcggaccggctggctggcgctggagggggaggcgcagcagtcactgtggccttcactaatgctcgcgattgcttccttcatcttcctaggcgcctggttgcacagctgcacctcttgcagaaccaggctatcgaggtagtctggtctcatcaaccagcattcctgtcatgggtggagggtcgccacttcagcgaccagggagaaaatgtggccgaaatcaatcggcaggtcgggcagaagttgggactcagtaatggcggtcaggtgttcctcaaaccctgtagccacgtggtctcgtgccagcaggtggaggttgagcccctgtccgccgacgactgggaaattctggaactccatgccgtgtcactcgaacagcatctcctagaccagatccggattgtgttccccaaggccatattcccagtctgggtggatcaacagacttatatcttcatccagattgtcgccctcattccagctgcgtcatacggaaggctggagaccgacaccaagctgctcattcagccaaagactaggcgggcaaaggaaaacacgttttcgaaggctgacgctgaatataaaaagctgcactcctatgggcgtgatcagaagggtatgatgaaagaactgcagaccaagcagctgcagtccaacacagtgggaattaccgaaagtaatgagaatgagtcagaaatcccagtggacagctcgtcagttgcaagcttgtggactatgatcggaagcatcttctctttccaaagcgagaaaaagcaggagaccagctggggactcactgaaatcaacgcatttaagaacatgcaatctaaggtggtgcctttagacaacatctttcgcgtctgcaagtcccaaccccctagtatctataacgcgtcggcaacaagcgtgttccataagcactgcgccattcacgttttcccttgggatcaggagtattttgacgtggagcccagcttcactgtcacgtacgggaagctggtcaagcttctcagtccaaagcaacagcagtcaaagaccaagcagaatgtgctgtcacctgaaaaggagaaacaaatgtcggagcccttggatcagaaaaagatcaggagcgaccataatgaggaggatgagaaggcctgtgttctgcaggtggtatggaacggcctggaagagctgaataacgcaattaaatataccaaaaacgtggaagtcttacatctgggaaaggtgtggatccccgacgacttgaggaagagactcaatatagagatgcacgctgtagtgcgaattacccccgtcgaagttacaccaaagatacctcgtagcctgaaactccagcctcgggaaaacctgccaaaggacatctccgaggaggacattaagacagtcttttattcttggctgcagcagagtaccaccacaatgctccctctagtcatttccgaggaggagttcattaagctcgaaacaaaagacgggcttaaggagttcagcttgagtattgttcacagctgggaaaaggaaaaggacaaaaacattttcctactgagtcctaatctgctccagaaaacgaccattcaggtactgctggatcccatggtcaaagaagaaaacagcgaggagattgacttcattcttccattcctcaaactgtcctcccttggtggggttaactccctgggggtgagcagcctggaacatatcacacactccctgctgggtaggcctctgtcaaggcagctcatgtctctggtggcgggactccgcaatggcgctcttttgctcacagggggaaaggggtccggcaagagtactctggcaaaggccatctgtaaggaagctttcgataaattggatgcccatgtcgagcgtgtggactgcaaggccctttag

SEQ ID NO: 234387 - DNA, 1041 bp, Artificial Sequence
  Description of Artificial Sequence: Synthetic coding sequence
atggcacccgctgcagcatcccctcccgaagtgataagggccgctcagaaggacgagtactaccgaggcggacttcgttccgcagcgggtggagctctgcatagcctcgcaggcgctcggaagtggctggaatggcgaaaggaggtcgagttgctgagcgacgtcgcctatttcggactcacaacactggccggataccagactctgggtgaggaatacgtttctatcatccaggtggatccctcacgtatccacgttccttcaagtctaagaaggggggtgctcgtgacactacacgcggtgctgccatacttgctagacaaggccttattgcctctcgagcaagagctccaagcagacccggattctgggaggcctttgcaggggagtttaggacctggcggacgcggatgcagcggggcaagacgctggatgagacaccacactgctaccttgactgaacagcaaagacgtgcactgctgagagccgtgttcgtgttgaggcagggactcgcctgtttgcaacggctgcacgtggcctggttttatattcacggggtgttttatcacctggcaaagaggctgactgggatcacttaccaggcacttcggccagaccccttgagggtgcttatgtcagtggcaccatccgccctgcagctgcgagtgaggagtctccctggcgaggacttgcgggcacgggttagttaccgcctgttaggagtgattagcctgctgcacctggtcctgtcaatgggcctgcagctatacgggtttcggcagagacagagggctcgtaaggagtggcgactccatcggggattgagtcacaggcgggcttctcttgaggagcgcgcagtgagtcgcaacccactttgcacactttgcctggaggagaggcgccatccaacagccacaccgtgcggacatctgttttgttgggagtgtattaccgcgtggtgctcgtccaaggccgaatgtcctttatgtagagaaaaattcccccctcagaaactaatatacctgcgccactatcgatag

SEQ ID NO: 234388 - DNA, 981 bp, Artificial Sequence
  Description of Artificial Sequence: Synthetic coding sequence
atggccccagccgctgcctctcctccagaggtcatcagggccgctcagaaggacgagtattataggggcggactacgcagcgctgctgggggagcactacatagcctggccggagcgcgaaagtggctggagtggcgcaaggaagtcgagctcttgagtgacgtggcttattttgggctcactaccctggcagggtaccagactctgggcgaagaatatgtatctatcatccaggtggatcccagccggattcatgtgccctcctccctgcgtagaggggtgctagtcacactccatgcagtgctgccgtatctgttagataaggctcttctcccactcgagcaggaactccaggccgaccccgacagcggtcgacctctgcaaggctcactagggcctgggggaaggggctgctcaggagctcggcgttggatgagacatcacaccgccaccctgacggagcagcaaaggcgggctttgctcagggcagtgtttgtccttaggcagggactagcatgcttgcagcggcttcatgttgcttggttttacatccacggcgtattctatcacttagccaagcggctgactggtatcacatacctgagagttcggagtttgcccggtgaggaccttcgggctagagtgtcgtatagactcctcggcgtgattagcctcctccatctagtgctgagcatgggcttacaactgtacggcttccgtcagaggcagcgagcccgaaaggagtggcgcttacaccgtgggctgtcgcatagacgtgcctccctggaagaaagagcagtgtctcggaatcccctgtgcacactctgtctggaggaaagacgccaccccactgctacgccttgcggtcacctgttttgctgggagtgtatcacggcttggtgctcgagcaaggctgaatgcccgctgtgccgtgaaaaattcccaccccagaagttgatttacctacgccattaccgctag

SEQ ID NO: 234389 - DNA, 744 bp, Artificial Sequence
  Description of Artificial Sequence: Synthetic coding sequence
atggacgcgttcacccgatttactaatcagacacagggtcgggatcgactgttcagagccactcagtatacctgcatgttactgcggtacctgctcgagcccaaagctggaaaagaaaaggtagttatgaaactgaagaaactagagtcctctgtgagcacaggcaggaagtggttcagacttggcaatgtcgtgcatgccattcaagccacggagcagagcatccatgccaccgacctcgtccctcggctctgcttaactttggccaatctgaacagggtgatttatttcatatgcgacaccatcctgtgggtgcggtctgtgggactcacctccggaatcaataaggagaagtggcggacacgagccgctcaccattattactacagtcttctgttgagcttggtgcgcgatctgtatgagatcagtctgcaaatgaaacgggtcacctgcgatcgcgctaaaaaggaaaagagtgcctcacaggaccctctttggttcagtgtggccgaggaagagaccgaatggctacagagttttctccttctacttttccgctcgctgaaacagcaccctccgctgctcttagataccgtgaagaatctatgtgacattcttaatccccttgaccaactgggcatttacaagagcaatcctggtattattggcttgggtggtctggtttcaagcatagccggaatgattacagttgcctaccctcagatgaagctcaaaacccgttag

SEQ ID NO: 234390 - DNA, 1209 bp, Artificial Sequence
  Description of Artificial Sequence: Synthetic coding sequence
atgccttggaagttatggcgaggaagtgttggctgcccaggagacctgagctctgacggcttactcttcagactcgggccacccaaaccacccaccgaactggaacccgagcccgagattgagggactgttaacacccgtcctggaggctggggacgtggatgaaggccctgtggcccgaccgctatcgcctacaagattgcagcccgcactaccgccagaggctcagtctgtccccgaactcgaagaggtggccagagttttagctgagatcccgaggcccttaaaaaggaggggctccatggagcaagccccagcggtggcgttacctcctacccacaagaagcaatatcaacagattatcagccggctgttccacagacacgggggtcccggtccgggtggtcccgagccagagctgtccccaatcactgaaggctctgaggccagggccggacctcccgctccagctcctccagcccctatccctccacctgccccttcacagtcctcaccccctgaacagcctcagtccatggaaatgcgctccgtcctccgtaaagccggttccccgaggaaagcaaggcgggcacgcctgaatccacttgtcctcttgctggatgccgcactcactggagaacttgaggttgtccagcaggcagtgaaggagatgaatgacccatcccagccaaacgaagaagggataaccgccctgcataatgccatctgtggcgctaactacagcatcgtcgactttctgataaccgctggtgccaatgtcaactcacccgactcacacggatggacccccctgcattgcgcagcatcctgcaacgacacggtcatttgcatggcgctggttcagcatggcgctgctatatttgctacaaccctttcggacggagccacggcctttgagaagtgcgatccttatcgagaaggctacgccgactgtgcaacgtacctggccgatgtcgagcaaagcatgggacttatgaattcaggtgctgtgtacgccctgtgggattactccgccgagtttggggacgaactgagttttagggaaggcgagtcagttactgtactgaggcgggatggccctgaggagacagactggtggtgggccgctctacacgggcaggagggttacgtaccccgaaactactttggccttttcccgagggtcaaacctcaaagatccaaggtctag

SEQ ID NO: 234391 - DNA, 507 bp, Artificial Sequence
  Description of Artificial Sequence: Synthetic coding sequence
tgataccgaggacgggaccgactgatacgggtgctgggttattgttgccagcttgtgggtggggtgcttgtcgagcagtgccccgcaagaagtgaagtaggtacaagactgcttgtggttagcactcagttgtcccattgtcgaactattctgagactgtttgatgacttggccatgttcgtgtacacaaaacagtatggactgggcgcacaggaagaggatgctttcgtgcgctgcgtgtccgtgctagggaacttagctgaccagctctactacccttgcgaacatgtggcctgggcagccgatgcgagagtgctgcatgtggatagttctcgctggtggaccctgagcaccaccctgtgggcactttccctgcttttgggcgttgcgcgatcactgtggatgctgttgaagctccggcagcgactcagaagccccaccgctccctttactagtatgtaccaggctgcccgagccggtggacaggcagaggccaccaccccgtag

SEQ ID NO: 234392 - DNA, 1212 bp, Artificial Sequence
  Description of Artificial Sequence: Synthetic coding sequence
atggctagccagcctcctcccccaccgaagccctgggaaacacggaggattcctggtgccggtcctggcccagggccaggcccaacattccaatccgctgacctcggacccacgcttatgacgcggccaggacagccggctttgactcgggtcccccctccgatcctgcctaggccgagccagcaaactggctcctcttctgttaacactttcaggccggcttactccagcttcagttcaggctacggtgcgtacgggaactcattttatggcggatatagtccctattcttacggctataacggactcgggtacaacagactgcgcgtggacgatctgcccccatcgcgattcgtccagcaggccgaggagtcctcccgcggagccttccagtcaattgaatcaattgtacatgcattcgctagcgtgtccatgatgatggacgctactttctccgccgtgtataactccttccgcgctgtactggatgtggcaaaccactttagccgactgaaaattcacttcaccaaggtgttctctgcattcgccttggtccggactatcaggtacctttatcgacgcttacagcgaatgctcggcctgcgcaggggctctgaaaatgaagacctgtgggctgagtcggagggcacagtcgcttgccttggcgctgaggatcgcgcagccacctcagcaaagtcctggcctatcttccttttcttcgccgttattctggggggaccctacctgatctggaaactgctgagcacacacagtgacgaggtgaccgattcaataaactgggcctccggagaggacgaccatgtggtcgcacgagcagaatacgatttcgctgccgtctcagaggaggaaatctcattccgcgctggtgatatgctgaatttggctttgaaagagcagcagccaaaagtgaggggttggctgttggcctctctggacggacaaaccaccggactaattccggcaaattatgtgaaaatcttaggaaagcgtaagggaagaaaaaccgttgagtctagtaaagtgagtaaacagcagcagtcgtttaccaacccaactctgacaaagggggctacggtggctgacagcctcgacgaacaggaggccgcttttgagtccgtctttgttgagaccaataaggtccccgtcgcacccgattctatcggcaaagacggggaaaaacaggatctatag

SEQ ID NO: 234393 - DNA, 1134 bp, Artificial Sequence
  Description of Artificial Sequence: Synthetic coding sequence
atggcttctagcgagcaagctgagcaaccaagccagcccagctccacaccaggctctgagaacgtgctccctcgagaaccgctgattgcaactgctgttaagttcttgcagaattcacgcgtgagacaaagcccgttagctacacgtagggcattccttaagaagaagggactcacggacgaagaaatcgatatggcttttcagcagagcggcacagcggctgatgaacccagttccctcggccctgccacacaggtagttccggttcaaccccctcatctcatctcccagccatactccccagctggctcgcggtggcgcgattacggagctctggccatcatcatggccggaatcgccttcggtttccaccagctgtacaagaagtatctgcttccattgattctgggaggcagagaggaccggaaacagctggaaagaatggaagcaggcctcagcgagctttcaggaagcgtcgcacaaacagtaacacagctccaaacaactctcgcctcagtacaggagctccttatccagcagcagcaaaagatccaggagcttgcacacgagttagcagctgcgaaagctaccacgagtacgaattggattctggaatcacaaaacataaatgagctcaaatccgaaatcaactctctgaaaggattactgttgaacaggcgccagttccccccatcccctagcgcacctaaaatcccgagctggcaaattcctgtcaaaagcccttctccttcctccccagctgccgtgaatcaccactctagcagtgacatcagtcccgtgtctaatgaatctacctcttctagccctggcaaggaaggacattcacccgagggctccaccgtgacctaccacttgctgggtccccaagaggaaggcgagggagtagtcgacgtcaaagggcaggttcgtatggaagtgcagggggaagaggagaagagagaggataaggaggatgaagaggacgaggaggacgacgatgtcagccacgttgatgaggaggattgcttgggagttcaacgcgaagacagaagaggaggcgatgggcagataaacgagcaagtagaaaagctgcgcaggccagaaggcgctagcaacgaatcagagcgcgattag

SEQ ID NO: 234394 - DNA, 942 bp, Artificial Sequence
  Description of Artificial Sequence: Synthetic coding sequence
atggcctttcagcagagcggaacagcagccgacgaaccatccagcctggggcctgcgacccaggtggtgcctgtccaacctccccacctcatttcacagccttatagccccgcaggctcacggtggcgggattacggggcacttgcaataatcatggcagggatcgcctttggatttcaccagctctacaagaagtacctcctgcctctgattctgggaggcagggaggacagaaaacagctagagcggatggaagcgggtctctccgagctgtcgggttcggtggctcagaccgttactcaacttcagacaacactggcaagcgtgcaggagctactgatccagcaacagcagaagatacaagagctcgctcacgagctggccgctgccaaggctacaacctctacaaattggattctcgaatcgcagaacataaatgaacttaagtccgaaatcaattctctgaaaggcctccttctgaatcgccgacagttccccccttccccatccgctcccaagattccaagttggcagatacctgttaaatctcccagcccctctagtcctgccgctgttaaccaccactccagtagcgacatcagcccagttagtaacgaaagcacatccagcagtcccggtaaggaagggcattcccccgaggggtctaccgtgacataccatctgctgggtcctcaggaggagggcgaaggcgtcgtcgacgtgaaggggcaggtcagaatggaagtccagggggaggaagagaagcgagaggataaggaagacgaggaggatgaggaggacgacgatgtgtcacacgtcgatgaagaggattgtctaggcgtgcagcgagaagatagaagaggcggtgacggccagattaatgagcaggtcgagaagctccggagacccgaaggcgcatctaacgagtccgaaagggattag

SEQ ID NO: 234395 - DNA, 1041 bp, Artificial Sequence
  Description of Artificial Sequence: Synthetic coding sequence
atggaaaaactgaggctgctcggcctgagatatcaggaatatgtgacacgccatcccgcagcaaccgcccagctagaaacagccgttcgcggatttagctacctgctggccggaagatttgccgattcgcatgaactgtcagagctcgtctactcagcctccaaccttcttgtgctgctgaatgacggcatactgcgcaaagagttgaggaaaaaattacccgtaagtttgagtcaacagaaattactcacttggctatcagtgctggaatgtgtggaagtctttatggagatgggtgctgcaaaggtttggggggaagtgggcaggtggttggtcatcgccctcgttcagctcgccaaagctgtccttcgtatgttgctgctgttatggtttaaggctgggttgcagacctctccacccatagtgcccttggaccgcgaaactcaagcacagccaccggatggagatcactctcctggcaatcacgagcaatcatacgtcggaaagcggtctaaccgggttgtgaggactctgcagaatactccatcccttcactctagacactggggggctcctcagcagcgcgaaggaaggcagcagcagcatcatgaggagctctccgcaactcctactccattagggctgcaggaaaccatagcagagtttttgtatattgctaggcccctgctgcatctgctgagcttgggactctggggccagaggagctggaaaccctggcttctggccggagtggtggacgtgactagtctctccctgctcagtgatcggaaggggttaacccggcgagagcgccgagaactgagacgccgtacgattctcctgctatactacctcctgcggtctcccttctacgatcggtttagtgaggccaggatcttgttcctgttgcaattgttagcggaccatgtccctggggtgggcctcgtcacaacatcccagagagctgcatccccatgtctccctgctcggccacatacccagccgtggagtcctccagcgtttctccccggtcacccctag

SEQ ID NO: 234396 - DNA, 1011 bp, Artificial Sequence
  Description of Artificial Sequence: Synthetic coding sequence
atggaaaaactgcggttactgggcctgcggtatcaggagtatgtgacacggcaccccgctgctacagcccagctcgaaactgccgtgcggggattctcctacttattggccggacgcttcgctgattcccacgagctgagtgaattagtctattcggctagtaacctgcttgtcctgctcaacgatggaatcctaagaaaagaactgcggaagaaactgcccgtttcactcagccagcagaaattacttacctggctgagtgttctcgagtgtgttgaagtgtttatggagatgggggcagccaaagtttggggtgaggtgggcaggtggttggtgatcgctttagtccaactggccaaggcagtgctaagaatgctccttctgctttggtttaaggctgggctccagaccagccccccaattgtccccctggacagggagacacaggcacagccacctgatggagatcattcccctgggaatcatgaacaatcatatgtaggcaaaaggagtaatagagtggttagaaccctgcagaatacccctagccttcatagcagacactggggggcaccccaacaacgcgagggcagacagcagcagcatcatgaggaattgagcgctacgccaacgcccctcggacttcaagagacaatcgcagagtttctttatatagccagaccactgttgcacctcctgagccttggtctctggggtcaaaggagctggaaaccttggttgctggccggtgtggtggacgtgacatccctgagtttgctttcagataggaaagggctgacacggagggagcggagagaattgcgaagacgcacaatcctgctactctactacctgttgagatcccccttctatgacaggttctccgaggcacgtatccttttcctgctccaactcctggctgatcatgtgcccggagttggcctggtcacacgacccctgatggactatctaccaacatggcaaaaaatctatttttattcctgggggtag

SEQ ID NO: 234397 - DNA, 900 bp, Artificial Sequence
  Description of Artificial Sequence: Synthetic coding sequence
atggctgccgctgaggaaggttgctccgtcggggctgaggcagacagggagctcgaagagctgttagagtcagcccttgacgatttcgataaggcgaagccttcaccagctcctccaagcaccacaacagctcctgatgcatcaggcccacagaaaagatcccccggtgacaccgccaaggatgcccttttcgccagccaggagaagtttttccaagaactatttgattcagagttagccagtcaggccaccgctgagtttgagaaggccatgaaagagctcgcggaagaggagccccatcttgttgaacagttccagaagctgtcggaagccgcaggtagagtaggctccgatatgacctcacaacaggagtttacttcctgcctgaaggagactctgtccggcttagcaaaaaatgcaaccgatctgcagaattcatcgatgtccgaggaagaactgacaaaggccatggaaggacttggaatggatgaaggagacggcgaggggaacattttacctattatgcagtccatcatgcagaatctgctgtctaaggacgtgctctacccttcgttgaaagagatcacagaaaagtacccagaatggctgcaatcccatcgagagagtctgcctccggagcaattcgagaagtaccaagaacagcattctgtcatgtgcaagatttgcgaacagttcgaagcggagactcctactgacagcgaaactacccagaaggctaggttcgagatggtactggacttgatgcagcaactccaggatctgggtcacccacctaaagagctcgccggagagatgcctccgggtctgaattttgatctagatgccctgaacctaagtgggccacccggagcctccggagaacagtgtctcattatgtag

SEQ ID NO: 234398 - DNA, 708 bp, Artificial Sequence
  Description of Artificial Sequence: Synthetic coding sequence
atggagagcggagctctcgatgactttgacaaggcgaaaccaagtcccgcaccaccgtctacaaccacagcccctgatgcatccggaccccagaagcgatcccctggagatactgcaaaagacgccctctttgctagtcaggagaagtttttccaggaattgtttgactccgaactggcttcacaggccactgcagaatttgaaaaggcaatgaaagagctggctgaggaggagccccacttggtcgaacagttccagaagcttagcgaggccgctggcagggttggctccgacatgacctcccagcaggagttcacttcttgtctgaaggaaaccctcagcggactagctaagaacgctacagacctgcaaaactccagcatgagcgaagaagagcttacgaaagcgatggaggggttgggaatggatgagggcgacggtgaaggcaacattctaccaatcatgcagtccattatgcagaatctgttgtcaaaggatgttctttacccaagcttaaaggaaataacagagaagtaccccgagtggcttcagagccatagagagagcctgccacctgagcagttcgaaaaataccaggagcagcattccgtcatgtgcaaaatttgcgagcagttcgaagctgagactcctacggatagtgaaacgacccagaaagcgcgattcgagatggttctcgacttgatgtag

SEQ ID NO: 234399 - DNA, 840 bp, Artificial Sequence
  Description of Artificial Sequence: Synthetic coding sequence
atggagtctggcgcactggatgactttgataaagctaagccctcccccgcaccgccatctaccacaactgccccagacgcctcggggccacagaaaaggtcccccggagacactgcaaaggacgccctattcgcctctcaggaaaagttcttccaagagctgttcgatagtgagttagcctctcaggccaccgccgagtttgagaaagccatgaaggaattggcggaagaggagcctcatcttgttgagcagttccagaaactctcagaagccgctggccgagtgggctccgacatgacttcccagcaggagtttactagctgtctgaaagagacactgagcgggcttgccaaaaacgctactgacctgcagaacagctccatgtcagaggaagagcttacgaaagcgatggaaggcctgggcatggatgaaggagacggcgaagggaacatcctccctatcatgcaaagcattatgcagaaccttttgagtaaggatgtgctctacccctcactgaaggagataacggagaaataccccgaatggcttcagtcgcatagggagtcccttccaccagagcagtttgaaaagtatcaagaacagcattccgttatgtgcaagatttgcgaacagtttgaggccgagactcctacagattccgagactacccagaaggcccgattcgagatggtgctggatctaatgcagcagcttcaagatctgggacatccacccaaagaactagcaggcgaaatgccccctgggctcaacttcgacctggacgcactcaacctttccggcccacccggagcatctggtgaacaatgcctcattatgtag

SEQ ID NO: 234400 - DNA, 630 bp, Artificial Sequence
  Description of Artificial Sequence: Synthetic coding sequence
atgaaggaactggccgaagaagaacctcacctggtggaacagttccagaaattaagcgaggctgccggtagggttggcagcgacatgactagccagcaggaatttaccagttgtctgaaagaaaccctgtccggtctggctaaaaacgcaactgacttgcagaactcctccatgtctgaagaggaactgaccaaggccatggaaggcctgggcatggacgagggcgacggggaaggcaatattcttcccatcatgcagtctattatgcagaatttgctgagtaaggacgtgctgtacccctctctgaaggagatcactgaaaagtatcctgagtggctgcaaagtcacagagagtccttgcccccagagcagttcgaaaagtatcaagagcagcacagcgtgatgtgcaagatctgtgagcagtttgaggccgaaaccccaaccgactccgagacaactcaaaaggcacgatttgaaatggtgctggatctgatgcagcagctccaggatctgggtcaccctccaaaggagttagctggggaaatgccacccggattgaacttcgatctggacgctctcaatctgagtgggcctcctggggcatctggcgagcagtgcttgatcatgtag

SEQ ID NO: 234401 - DNA, 561 bp, Artificial Sequence
  Description of Artificial Sequence: Synthetic coding sequence
atggccgcagccgaagagggctgctctgttggggctgaagccgaccgcgagttggaagaactgctggaatccgctcttgacgactttgacaaagctaaacccagccccgcacccccttccactacgaccgccccagacgcatccggtcctcagaaaagatcacccggagataccgccaaggatgcattgttcgcttctcaggaaaaattcttccaggagctgtttgacagcgagctcgccagccaggctacagcggagttcgagaaagcaatgaaggagttggccgaggaagagccccatcttgtcgagcagttccagaaactatctgaagccgcagggagagtcgaactccagcacgtgggtagacgggcagatcaggggcacgggggagcccgacatggcagaagaggatggggacgcgaacatccacctcatcacgcagaatattatgccgaaccaacacttcaggggtgtgctgtgcccatcactgagggtgatcatagaaaggtttcaagaatggtggccgaatcgagtgggatctcgacatccagagccgtgtag

SEQ ID NO: 234402 - DNA, 918 bp, Artificial Sequence
  Description of Artificial Sequence: Synthetic coding sequence
atggcctctcggaaggagaatgcaaagtccgcaaatcgagtgctgaggattagccagcttgacgcattggagctcaacaaggcactcgaacagttagtgtggagccagtttacgcagtgctttcatgggttcaagcctggattactggctagatttgagcccgaggtaaaggcttgcctctgggtgtttctctggaggttcactatctactctaaaaatgcaaccgtcgggcagtccgtcctaaatataaagtataagaatgacttcagccctaatttgcgctaccaaccaccatctaagaatcagaagatttggtacgccgtatgtacgatcgggggacgttggctggaggagagatgttatgacctgttccgtaaccatcacctggcttcatttggaaaggtgaagcagtgtgtgaactttgtgatcggactgcttaagctcgggggtttaataaatttcttgatatttctgcaaagaggcaaatttgctaccctcaccgagaggcttctggggatccactccgtcttttgtaagcctcagaatatttgtgaggtcggtttcgaatacatgaacagggaactgctttggcatgggtttgctgagttcctaatctttctcctgcccttgattaacgtacagaaattgaaggctaaattatcctcatggtgtatccccctgactggcgcaccaaacagcgataatacgctggcgacatccggaaaggagtgtgcactgtgcggcgaatggccaaccatgccgcacactatcggttgtgagcacattttctgttacttctgcgccaagtcctcgttcctgttcgacgtctactttacctgtcccaagtgcggcacagaagtgcactcactacagcctctgaaatccggtatcgagatgtcggaggttaatgcgctgtag

SEQ ID NO: 234403 - DNA, 918 bp, Artificial Sequence
  Description of Artificial Sequence: Synthetic coding sequence
atggcttctaggaaagaaaacgctaagagtgctaacagggtactcaggatctcgcagctcgatgcactcgagttgaacaaggcccttgagcagctggtgtggagtcagtttacacagtgcttccatggattcaagcccggacttctggcgaggtttgaaccagaggtaaaagcgtgcttatgggtcttcctgtggagattcactatttattctaaaaacgctactgtcggacagtctgttcttaatataaagtacaagaatgacttttcccctaacctgcgctaccagccaccttctaagaaccaaaaaatctggtacgccgtttgcacaatcggcggacgttggctggaggagcgttgttacgatctcttcagaaatcatcatctcgcatcttttgggaaggttaagcagtgtgtaaacttcgtgataggccttcttaaactgggaggcctgattaacttcctgatatttctacagcggggtaagtttgccactctaaccgaaaggttgctcggcatccatagcgtgttctgcaagccgcagaacatctgcgaagtgggatttgagtatatgaaccgcgagctactttggcacggcttcgcagagtttctgatttttttactgccgcttataaatgtgcaaaaactcaaggccaagctctcttcttggtgcattcctctgaccggcgcaccgaattccgacaacacactggcgaccagcgggaaagagtgtgcactgtgtggcgaatggccgacaatgcctcataccatcgggtgtgagcatattttctgttatttttgcgccaagtcttcgttcctttttgacgtctactttacctgcccaaagtgcgggactgaagtccatagccttcaacccttgaaaagtggaattgagatgtcagaagtgaatgcgctctag

SEQ ID NO: 234404 - DNA, 543 bp, Artificial Sequence
  Description of Artificial Sequence: Synthetic coding sequence
atggcatccaggaaggagaacgcaaaaagtgccaaccgggtgctgaggatcagccaactcgatgcactcgaactgaacaaagcgctggaacagcttgtatggagccaatttacccagtgcttccacgggttcaagccaggcctgctggcacgcttcgaacccgaagtgaaggcttgtctctgggtttttctgtggcggttcactatatacagcaaaaacgctactgtgggccaaagcgtgctgaacattaaatacaaaaatgacttctcacccaacctccgatatcagccgccttccaagaatcagaaaatatggtatgctgtgtgcactatcggcggtagatggctagaggaacggtgctatgacttgtttcggaatcatcacttggccagttttgggaaggttaagcagtgcgttaacttcgttattggcctgttaaaactgggaggcctcatcaactttctgatatttttgcagcgtggaaagttcgccaccctcaccgaaagactcctggggatccattctgtgttctgcaaaccatag

SEQ ID NO: 234405 - DNA, 12 bp, Artificial Sequence
  Description of Artificial Sequence: Synthetic coding sequence
atggcttcctag

SEQ ID NO: 234406 - DNA, 918 bp, Artificial Sequence
  Description of Artificial Sequence: Synthetic coding sequence
atggcctcacggaaggagaatgccaagtcagccaaccgagtgctgcgtataagccagctggacgctctggaactgaacaaggcactggagcagcttgtatggtcccagttcacgcaatgcttccacggctttaaacccggactcttggctcggttcgaaccggaggttaaggcgtgtttgtgggtgttcctctggcgattcaccatctactctaaaaatgctaccgtcgggcagagcgtcctgaatattaagtataaaaacgattttagtcccaatttgaggtaccagcccccttcaaagaaccagaaaatctggtacgccgtgtgtacaattggaggtcgctggctggaagagagatgttacgatctattcaggaatcatcaccttgcctcattcgggaaggtgaagcagtgtgtgaatttcgtgattggcctgctgaagctgggaggtttgattaattttctgatctttttgcagagggggaagtttgccaccttgacagagcggttgctcggtattcacagcgttttctgtaaaccacagaacatctgcgaggttggattcgaatatatgaatcgcgagctactatggcacggattcgccgagtttctcatttttctcctcccgcttataaacgtgcagaaactgaaggccaagctgtctagctggtgtattccgttaaccggggcacctaattccgacaacacattggcaacctctgggaaggaatgcgctctttgcggcgagtggccaaccatgccacacacaatcggctgcgagcatattttttgttacttctgcgctaaaagcagcttcctgttcgatgtgtactttacctgtcctaaatgtggcaccgaagtacactccctccaacccctgaaatctggaattgagatgagcgaagtaaacgcattatag

SEQ ID NO: 234407 - DNA, 918 bp, Artificial Sequence
  Description of Artificial Sequence: Synthetic coding sequence
atggcctctagaaaagagaatgcaaaatctgcgaatagagttctaaggatatcacaactggacgctctcgaacttaacaaggcactggaacagcttgtttggtctcagttcacgcaatgttttcatggatttaagccgggacttctggcaagatttgaacctgaggtgaaggcttgtctgtgggtcttcctgtggagattcaccatctactccaagaacgcaaccgttggccagtccgtgctgaatatcaaatacaaaaacgatttctcacctaacctgcggtaccaacctcctagtaagaatcagaagatctggtatgccgtatgtaccatcggcggacggtggctcgaagagcgttgctatgatttattcagaaatcatcacctagccagctttggtaaggtgaaacagtgcgtgaattttgtgatcggtttgttgaagctgggcggtctgatcaacttcttaattttccttcagaggggtaaatttgccactctcacagagagacttttaggaatccattcagttttttgtaagcctcagaacatctgcgaggtcggtttcgagtacatgaaccgcgagctgctgtggcacggattcgccgagtttctcatatttctattgcctttgataaacgtccagaaactcaaggcaaaactttcttcatggtgcattccactgaccggagcgcctaactcagacaacaccttagcaacctcaggcaaagagtgtgctctgtgcggcgagtggccgaccatgccacacacaattggttgtgagcacattttttgttacttttgtgcaaaatccagcttcctgtttgacgtatattttacgtgtccaaaatgcggaaccgaagtgcattccttgcagcctctcaaaagcggaattgaaatgtctgaggttaatgcactgtag

SEQ ID NO: 234408 - DNA, 918 bp, Artificial Sequence
  Description of Artificial Sequence: Synthetic coding sequence
atgaaaagcgacagtagcaccagcgccgctcccctaaggggcctgggcggaccactcagaagtagcgaaccggtccgagctgtgcccgctcgagctccagccgttgatttgctggaggaagctgccgatttgcttgtagtccacctggatttcagagccgctttggagacttgcgagcgcgcatggcagtctcttgctaaccatgccgttgcggaggaaccagccggaacctccctggaggttaaatgcagcctgtgcgttgttgggatccaagccctcgcggaaatggataggtggcaggaagtgctgtcatgggtgctgcagtactaccaggtgcccgaaaagctacccccaaaagtactcgagctgtgtatattgctgtattcaaaaatgcaggagcctggggctgtcttggacgttgtaggggcatggctgcaggatcccgctaatcagaatctgccagagtacggggcactggctgaatttcacgtccagcgggtgttgctgccgcttggatgcctaagtgaggccgaagagcttgtcgtggggtcagctgcctttggagaagagcggagactggatgtgcttcaagcgatccacaccgcaagacagcagcagaagcaggagcattcggggagtgaagaggcacaaaagcccaacctagagggctccgtctctcataaattcttatcactacccatgctcgtgaggcagctctgggacagtgcggtctctcacttcttttctctgcctttcaagaagagcctcctcgctgccctcatcctctgcctgctggtcgtgcggtttgaccctgcttctcctagctcattacactttctttacaagcttgcccagctcttcagatggattaggaaggccgcttttagccgactttaccagctgcgcatccgggactag

SEQ ID NO: 234409 - DNA, 918 bp, Artificial Sequence
  Description of Artificial Sequence: Synthetic coding sequence
atgaaaagcgactcctccacatccgcagcccctctacgcggactagggggtcctctgcgcagcagcgagcccgtccgcgcagttccagcccgagccccagcagtggatctgctggaagaagctgctgacttgctggtggtccatctcgatttcagggcagctctggaaacctgtgaacgcgcatggcaaagtctcgccaatcatgctgttgcagaagagcctgctggtacctctcttgaagtgaagtgcagcttatgcgtggtcgggattcaggccctggcggaaatggacaggtggcaggaggtgctctcttgggttcttcaatattatcaggtgccggagaagcttccacctaaagtgttagaactgtgtatcttactttattcaaagatgcaggagccaggtgcagtgctggacgttgtaggggcttggctacaagaccccgcaaaccagaatctgcccgaatatggagctttagccgagtttcacgtacagcgcgtgttgctgccactgggatgtctgtccgaggcagaggagctggtggtggggtccgccgcatttggcgaggagcgacgtctggacgtgctgcaggcaatccatacagctagacaacagcaaaaacaggaacatagcggctcagaggaagcacagaagccaaacctcgagggctcagtctcccacaagttcttgagcctgcctatgctggtgagacagctctgggattccgcggtctcacactttttcagcctgccattcaaaaaaagcttgctcgccgcactgatattgtgcttactggtcgtgagatttgatccagccagtcccagcagccttcatttcctctacaagttagcgcagctgttccggtggatccggaaggcagcctttagccgcttatatcagctacgaattcgggactag

SEQ ID NO: 234410 - DNA, 1098 bp, Artificial Sequence
  Description of Artificial Sequence: Synthetic coding sequence
atgaagagtgatagtagtacctcggccgcacctctgagaggacttggaggcccactgcgaagctctgagccggtcagagctgtccctgcacgtgccccagctgtcgacttactggaggaggcagctgatctcctggtcgtgcatctggattttagggctgccctcgagacctgcgaacgggcttggcaatctctcgccaaccatgctgttgcggaggaacctgcgggtacttcactggaagtcaaatgttctctgtgcgtcgttggcatacaagctctggccgagatggatcgctggcaggaggtgctgtcatgggtgctgcagtactaccaagtaccagagaaactcccacctaaagttctggagttgtgtatacttctatacagcaaaatgcaagagcctggcgctgtgcttgacgtcgtgggggcttggctgcaagaccccgctaatcagaacctacccgagtacggggctctggctgagtttcatgtgcagagagttttgctgcctctgggatgcctgagcgaagctgaggaactggttgtagggtctgcggcatttggagaggagcggaggctcgacgttctgcaggctatccacacagcacgacagcagcagaaacaggagcattctgggtctgaggaagctcagaagccgaacctggaggggagtgtgtcccacaaattcctgagtctgcctatgctggtgcggcaactctgggactctgccgtgagtcattttttcagcctgccttttaaaaagtccctgctcgccgcactcatcctgtgcctcctagtcgtaagattcgatcccgcatctcctagcagcctacacttcctgtacaagctggcccaactgttcgccggatcgggcaggctccatttcttagccagcacatctagtgctagtgtcaccgaaggaccatgcgcacctcaaccactttgttcttctcgcccttggccccagaagcagagtgatcgggcaacacatcctcaagctccactgggcaagtgggaccaaccaaatctcgccgagtgtaccgtatcttgctgccttggcgctctatcctttgccccttacttcggctggtctcgctag

SEQ ID NO: 234411 - DNA, 771 bp, Artificial Sequence
  Description of Artificial Sequence: Synthetic coding sequence
atgaagtcagattcttccacctctgcagcccctctgcggggattgggtggcccactgaggtctagcgaacctgttagggccgtgcccgcaagggcccctgccgttgacctgctagaggaggccgctgacctgttagtggtacatcttgatttccgtgccgctctggagacttgtgaacgcgcttggcagtcgctggccaaccatgccgtcgccgaagaaccggcaggaactagtctggaggttaagtgttctctctgcgtagtaggcattcaggcccttgccgagatggaccgttggcaagaagtgttgagctgggtgctgcagtactatcaggtcccagagaaactccctcctaaggttctggagctgtgcatccttctgtactccaagatgcaggagccaggagcagtcctagatgtcgtgggagcatggctccaggaccctgctaatcagaacctccctgagtatggcgctctggccgagttccacgtccagagggtgctgctcccccttggttgtttatccgaagccgaggagttggtcgttggatctgctgcttttggagaagagaggaggctcgatgttttgcaggcgatccacaccgcacgacagcaacagaagcaggaacactctggatccgaagaagcccagaaacctaaccttgaggcttctccctcctctttgcactttctgtataaactcgcacaattatttcgctggataagaaaagcagccttctcacgtctgtatcaactacgcatccgcgattag

SEQ ID NO: 234412 - DNA, 549 bp, Artificial Sequence
  Description of Artificial Sequence: Synthetic coding sequence
atgctcagatcggtctggaatttcctgaagcgccacaagaaaaagtgtatcttcctgggcaccgtactgggagtgctctccatgcttccaacactgagagaggccctgatgcagcagctgaactcagaatccctaaccgccctattaaaaaacaggccaagcaacaaattagaaatctgggaagacctgaaaattatcagttttacacgcagcaccgttgctgtttatagcacctgcatgctcgtcgtcctgctccgcgtccaactcaatatcatcggaggctacatttacctggataacgcagctgtcgggaagaacggaacgactatacttgctccaccagatgtccagcagcagtacctctctagcatccagcacttactgggtgacggtctgacagaactcatcaccgtgataaagcaggccgtgcagaaggtgctgggctcagtgtctctcaagcatagcctttccctcttggacctggagcagaagctgaaagaaattaggaaccttgtcgagcaacacaaatccagctcatggattaattag

SEQ ID NO: 234413 - DNA, 1122 bp, Artificial Sequence
  Description of Artificial Sequence: Synthetic coding sequence
atgctccggagcgtgtggaacttcctcaagcgacacaagaagaagtgtatattcctgggaactgtcctcggcggagtctatattctcgggaaatacggccagaagaaaatccgcgaaatccaggaacgcgaagcggcagagtacatagctcaggccaggcgccagtatcactttgagagcaatcagcgcacgtgcaacatgaccgtgctctcaatgttgccaaccctcagagaagcgctgatgcagcagcttaactcagaaagcctgactgctctgttgaagaaccgtccgagcaataaactggagatttgggaagatctcaagataatcagcttcactcggtctaccgttgcagtatactccacatgtatgcttgttgtgctgctgagagtgcagctcaacataattggagggtatatctatttagataacgctgccgtaggcaagaacggcactaccatcctggctcctccagatgtacagcaacagtatctctcttccatccagcacttactgggtgacggcttgaccgaactgataacggtgatcaagcaggcggtccagaaggtgctgggatctgtaagcctcaagcactcactgtcactccttgatctggagcaaaagctgaaggaaattcgcaatctggtggagcagcacaagtcaagctcatggatcaataaggatgggtccaaaccccttctgtgtcactacatgatgcccgatgaggaaaccccacttgccgtacaagcttgtggcctgtctccacgcgacattactacaataaaactgctaaacgaaacacgggatatgctggagtcgcctgatttctccaccgtgctgaatacatgtttgaatcgcggattttctaggttgctggataacatggcagaattttttaggccaaccgagcaagacctccagcacggtaatagcatgaattctttgtcctcagtgagtctgcctctggccaaaatcatccctatagtcaacggtcagattcactctgtctgcagcgagacaccctcccattttgtacaggatctgctcacaatggaacaggtaaaggacttcgcagccaatgtctatgaagcctttagtacgccccaacaactcgagaagtag

SEQ ID NO: 234414 - DNA, 549 bp, Artificial Sequence
  Description of Artificial Sequence: Synthetic coding sequence
atgctgcggagcgtctggaacttcctgaaaagacacaagaaaaaatgcatctttctgggaacggtgctgggagtactcagcatgctgcctactttacgcgaagccctgatgcaacagttaaatagcgagtccctcactgctctactgaaaaatagaccctccaataagctggaaatttgggaggatctgaagattatttccttcacacgcagtaccgtagccgtgtattctacttgcatgctcgtcgtgctcctccgagtccagctcaatatcatcggtggttatatctacttagacaatgctgcagttgggaagaacgggacaaccattctggcccctcctgacgtgcagcaacaatatctgtcaagcatccagcacctccttggggatggactgactgagctgatcacagttatcaaacaggccgtccagaaagttctggggtctgtgagcctcaagcactctctgagtctcttagacctggagcagaagctcaaggagatccgcaacctggtggagcaacacaaatcaagttcatggatcaactag

SEQ ID NO: 234415 - DNA, 1809 bp, Artificial Sequence
  Description of Artificial Sequence: Synthetic coding sequence
atggccatgcgagagctggtcgaagccgaatgtggcggtgcaaatccactaatgaagctggctggacattttactcaggataaagctctgaggcaggagggcttgagaccaggaccatggccccctggagcgccagctagcgaggccgcatcaaagcccttaggggtcgcctcagaggatgaattggtagccgagttcctccaagaccagaacgctccgctggtatctcgagctccacagacatttaagatggacgatctgttggccgaaatgcagcagatcgagcagagcaattttagacaggcaccacagcgcgctccaggagtggcggatctcgcactgtcggaaaactgggctcaggagtttctcgccgcaggcgatgctgtcgacgtcactcaagattacaacgaaactgactggtctcaggaattcattagcgaagtgacagatccactaagcgtatccccagccaggtgggccgaagagtacctggagcaatccgaagaaaagttgtggctgggcgaacctgagggcacagcaaccgacagatggtacgatgagtatcaccctgaagaagacctccagcacacggctagtgacttcgttgctaaggtcgatgatcctaagctggccaattccgagggcacatccgatgcttgggtggaccagttcactcgaccagtgaacacgtccgctttagacatggaatttgagcgagctaaaagtgccatcgagagcgacgttgatttctgggataaactacaggcagaacttgaggaaatggctaagagggatgccgaagcccatccctggctatctgactatgacgatcttacttcagcgacatacgacaaggggtatcaattcgaagaagagaatccgctgcgcgaccacccgcagccttttgaagaagggctaaggcggttacaggagggtgatctgccaaacgcagtcctgctgtttgaagcggctgtacaacaggatcctaagcacatggaagcatggcaatatctcgggaccacacaggctgagaatgagcaggagttgctggccatcagcgcattacgccgttgtctggagcttaaacccgataaccagaccgcccttatggccctggctgtgtcctttaccaatgagagcctccagaggcaagcctgtgagacactgagggattggctgaggtacaccccagcctatgcccatttggtgacccccgctgaggagggagccggaggggctggactcgggcctagtaagcggatcctgggatcactcctctctgatagtttatttttggaggtgaaagagctgttcctagccgcagtgcgactggatccaacatcaattgaccctgatgtgcagtgcggtttaggggtgctgtttaacctgtcaggtgagtacgacaaggccgtggactgttttaccgccgctttaagcgtgaggcctaatgattacctcctctggaataaattgggtgccactctcgccaacggcaatcagagtgaggaagccgtcgccgcatacaggagggcgctcgagctccagcccggatatatccgcagccgctataatctgggcatcagttgtattaacttgggtgctcaccgtgaagcggtggagcacttcctggaggctctgaacatgcagcgcaagtcccggggaccaaggggggaggggggagccatgagtgaaaatatctggtctaccttgaggctggccttgagcatgctgggccagtccgacgcatatggagctgctgacgcccgagaccttagcacgctcttgacaatgttcggcctgccccagtag

SEQ ID NO: 234416 - DNA, 1896 bp, Artificial Sequence
  Description of Artificial Sequence: Synthetic coding sequence
atggccatgcgcgagcttgtagaggccgaatgcggcggtgccaatcccctcatgaagttagccggacatttcacacaggacaaggccctgcgacaagagggactcaggccaggcccatggcccccaggagctccggcatcagaggccgcttccaagcccctgggtgttgcttccgaggatgaactggtggccgaattcctgcaggatcagaacgctcctctggtctctcgcgctccacaaacatttaaaatggacgatctgctggcagagatgcagcagatagagcagtccaacttccggcaggcccctcagagggcccctggagtagccgatctagccctgtctgagaattgggcccaggaattcctggcagcaggagatgccgtggacgttacccaggactataatgagacagattggagccaagaatttataagcgaggtgactgatcccttgtcggtgtccccagccagatgggcagaagaatacctggagcagtcagaagagaaactgtggcttggcgaaccggagggcactgctaccgacagatggtacgatgagtatcaccccgaggaggatttacaacataccgcttcggatttcgtcgccaaggttgatgaccctaaactggccaattccgaatttctaaagtttgttcggcagatcggtgaagggcaagttagcctggagtctggtgcaggctccgggagagcccaggcggagcagtgggctgctgaattcattcagcaacaggggacctccgacgcatgggttgaccagtttacaagaccggttaatactagtgcgcttgacatggagtttgagcgtgccaaaagtgccatagagctccaggctgagctcgaagaaatggccaagagggatgcagaggcccatccatggctttcagactacgacgatctaacatccgcaacctacgacaaaggttaccagtttgaggaggagaatccactaagggatcacccgcagcctttcgaagaggggcttcgtcgactgcaagagggcgacctgcccaacgccgtcctcctgttcgaagccgcagtccaacaggatcctaaacatatggaagcgtggcagtacctgggtacgacgcaggcagagaatgagcaggaactgcttgccatctctgccctgaggcgttgtctagagctgaaaccagataatcaaaccgccttgatggccctggctgttagcttcactaacgaaagcctacaaaggcaagcctgtgagactttgcgcgactggctcagatacacacccgcatacgcccatttagtgacccctgctgaggagggggcaggcggtgccggactggggccttcaaaacgcatactcggtagtctgctgagcgactcgctctttctggaagttaaagagctttttcttgctgcagtcaggctggatccaacgtctatcgacccagacgtgcaatgcggcttaggagtgttgtttaacctctccggggagtacgataaggccgtggattgttttacagccgctctaagtgtgagaccaaacgattacctcttatggaacaaacttggcgctaccctggctaacgggaaccagagcgaggaagccgtggccgcataccggagggctctagaactgcagccagggtacataaggtcacgttacaatctgggaatttcctgtatcaacctgggagcgcacagagaagcagtcgaacatttcttggaggcactgaacatgcaacgaaaatccagagggccaagaggtgagggcggagccatgtccgaaaacatctggagcaccctccgactcgccctaagcatgctgggccagagcgacgcatacggagctgctgacgcccgagatctgtccacgttgttgacaatgttcgggctccctcaatag

SEQ ID NO: 234417 - DNA, 1233 bp, Artificial Sequence
  Description of Artificial Sequence: Synthetic coding sequence
atggccatgagagagctggtcgaggcggaatgtggtggcgcaaatccattgatgaagctggccggacacttcacccaggacaaagctcttcgccaggaaggtcttcgcccaggtccgtggccgccaggcgctccggctagtgaggcagtgtcagtattggaggtcgaatcccccggtgccgcttccgaagccgcatcaaagcccctgggtgtggctagtgaggatgaactcgtggctgagttcctgcaggaccaaaacgcacctctggtgtcccgcgcaccacagaccttcaagatggacgatctgctggcggagatgcagcagatagagcagtctaactttagacaggcacctcaacgcgctcccggagtcgccgacctagcattgtccgaaaactgggcacaggagtttctggcggcaggagatgctgtggatgttacccaggattataacgagaccgattggtcccaggagtttatttcagaagtcacagatcccttgtcagtatccccggcacgatgggcagaggagtaccttgagcagtctgaggagaaattgtggctaggtgagcccgagggcactgctacggacaggtggtacgatgaataccaccctgaggaggatctgcagcacaccgccagtgactttgtggcgaaagtggatgacccaaagctggcaaattctgaaggcaccagtgacgcgtgggtggaccaatttactcgcccagtgaacacaagcgccctcgacatggaattcgaaagggccaagtcagcgattgaactgcaggcggagctcgaggagatggcaaagcgcgacgcagaagcacacccctggctctctgactacgacgatttaacaagtgccacatacgacaaagggtatcagtttgaggaagagaatcctcttcgggaccacccgcaaccgtttgaggagggcctaaggcgtctgcaggagggagacttgcctaatgcagtgctgctgttcgaggcagccgtccagcaagacccgaaacacatggaagcctggcagtatctggggacgacccaggccgagaacgaacaggagctactggccatctccgctcttaggcgctgccttgagcttaaaccagataatcaaacggcattgatggctctggctgtgagctttacgaatgaatctctccaaaggcaggcctgcgagaccctgagggactggctgcgctataccccagcatatgctcacctggtgtag

SEQ ID NO: 234418 - DNA, 1983 bp, Artificial Sequence
  Description of Artificial Sequence: Synthetic coding sequence
atgctactgtgcagagctcatcgagtgcttggcctcagaggcgctcgagagttggccgtgaccatggctatgagggagctggtggaggctgagtgcggcggagccaaccccctgatgaagctggcaggccacttcactcaagacaaggcgctgcggcaagaaggccttagacccggaccatggccgccaggcgcaccagcctccgaggcagcttcaaaacctttaggcgtagccagtgaagatgagttggttgccgaattcctccaggatcaaaacgcacccctcgtgagcagggcccctcagaccttcaaaatggacgatcttctcgcagagatgcagcagattgagcagtctaattttcggcaggccccacagagggctccgggagtggctgatctcgcgttaagcgagaactgggcacaagaatttctcgccgctggcgatgccgtggacgtgactcaggattacaatgagactgattggagtcaggagtttatctccgaggttaccgaccccctatccgtctctccagcgaggtgggctgaggagtacctagaacagagcgaggaaaaactgtggttgggagagcccgaagggacagctactgatcggtggtatgatgaataccatccagaagaagatctgcagcatactgcctctgactttgtggcgaaggtggacgatcccaaactggctaacagtgaattccttaaatttgtgagacagattggagaagggcaagtgagtctggaaagcggagcagggtctggcagagcacaagcagagcagtgggccgctgagtttattcaacaacaaggtacgtcagacgcgtgggtcgaccagtttacccgcccagtgaataccagcgccctggacatggagtttgaacgcgctaagtcagccattgagtccgacgtggatttctgggacaagctgcaggctgagctagaagagatggccaagagagatgccgaggcacacccatggctcagcgactacgacgacctaacaagcgccacctatgataaggggtatcagtttgaagaagagaatcctctgcgtgaccatccacagccatttgaagagggcctccggcgactgcaagaaggcgacctccctaatgcggtgctgctgttcgaggcagccgtgcagcaggatcctaagcacatggaagcatggcagtacctcggaactacccaggcagaaaacgagcaggaattattggccataagcgccctgcgaaggtgcctggagttaaaacccgataatcagacagccctgatggccctcgctgtgagcttcacaaatgagagtttacaacgacaggcatgcgagaccctgagggattggttgcgctatactcctgcttatgctcacttagtcacccctgcagaagagggtgccggaggggctgggttgggcccttctaagcggattttgggctctctgctctcggactctctcttcctcgaggtcaaagagctttttctggccgctgtgcgactcgaccccacatcaatcgatcccgatgtacaatgtggacttggggtgttatttaatttgtcgggagagtacgataaagcagttgattgcttcacagccgctctcagtgtccggcctaacgactatttactctggaacaagttgggcgcaacattggccaacggcaaccaaagcgaagaagcggtagccgcataccgaagggctttggagctgcagccagggtacatccgttcccgatacaatcttggtatttcttgtatcaatctgggggctcacagagaagctgttgaacactttttagaggcactgaacatgcagcgcaagagccgaggacctcgcggtgagggaggagctatgagtgagaatatctggtccacactccggttggctctttcgatgctcgggcagagcgacgcctatggcgctgcggatgcacgcgatctctctacactactgacgatgttcggtctgccacaatag

SEQ ID NO: 234419 - DNA, 1920 bp, Artificial Sequence
  Description of Artificial Sequence: Synthetic coding sequence
atggccatgcgggaactggtcgaggcggagtgtggcggtgccaaccccctgatgaaactggcaggacacttcactcaggacaaagcactgaggcaggaaggtttgagacccggaccctggccacccggtgcccctgccagcgaagctgccagcaagccgctcggcgtcgcttcagaggacgagctagtggccgaattcttacaggatcagaatgcacccctcgtatcccgggctcctcaaacttttaagatggacgacctcctggctgagatgcagcagatcgaacaaagcaatttccggcaggccccacagagggcccctggggttgcagacttggccctcagtgaaaattgggcacaggaattccttgcggcaggtgacgcggtggacgtgacccaggactataatgaaactgattggtcacaggagttcatatcagaggtgacagatcccctcagcgtgagtcccgctagatgggccgaggaatatctggagcagtccgaggaaaaactgtggctgggagagccagaagggacagccacggaccgatggtacgatgagtatcatcccgaggaagacctgcagcacactgcctctgactttgttgccaaggtcgatgatcccaaactggctaactccgaattcctcaagtttgtccgccaaatcggcgagggccaggtcagcctcgaaagtggagcaggaagcgggagggcccaggccgagcagtgggctgcggagtttattcagcaacaggggaccagcgatgcttgggtggatcaatttaccaggcctgtgaacacatcggctcttgacatggagttcgagagagccaaaagcgcaatcgaaagtgatgtcgatttctgggataagctgcaggcagagctggaagagatggccaagagggatgccgaagcccatccttggctgagcgactacgacgacctcacatctgctacatacgataagggctaccagtttgaagaggagaatccactgcgtgatcacccacagccgtttgaggagggccttagacgcctgcaggagggcgacctgccaaacgccgtgctcttgtttgaagctgcagtgcagcaggatccgaagcacatggaagcctggcagtacttgggcaccacccaggctgaaaacgagcaggagctgctcgccattagcgctctacgaagatgtctggagctgaagcctgataatcagaccgctctcatggcgttagcggtgtcttttacgaatgagtcattgcagcgccaggcttgtgagaccttacgcgactggctgaggtacacgccagcctacgctcacctggtcacacccgcagaggaaggagccggaggcgctgggttgggcccttctaagcgcatccttggttctttattgagtgactccctgttcctggaggtgaaggagcttttcctcgccgctgttcgcctcgatcctaccagcatcgaccccgatgtgcagtgcgggttaggggtgctattcaacttaagtggtgagtacgataaagctgtagactgctttacagccgctctgtccgtgcggccaaatgattacctcctctggaataagctcggggctacgctggccaatgggaaccagtccgaggaagccgtagcagcataccggagagcgctggaactccaacctggatacatccgcagcagatacaatcttggcatttcttgcatcaaccttggggctcatagagaggcggtcgagcactttctggaggctcttaatatgcagagaaaaagccgagggcctaggggggagggcggagcaatgagcgagaatatctggagcacattgagattggcgctgtctatgttaggtcagtcagacgcttatggcgctgctgacgccagagacctatccactctgctcaccatgttcggtttgccccagtag

SEQ ID NO: 234420 - DNA, 1965 bp, Artificial Sequence
  Description of Artificial Sequence: Synthetic coding sequence
atggcgatgagggaactcgtggaagctgagtgcgggggagccaacccactcatgaagctcgctggccacttcacacaagataaagccctgcgacaggaggggctgcgcccaggtccctggcctccaggagcacctgcatctgaagcagtgagtgtgcttgaagtcgagagccccggagctgctagcgaggccgcaagtaaacccttaggcgtggcctcagaagacgagctggtggccgaattcctgcaggatcaaaatgcacccctcgtaagccgggcaccgcagactttcaagatggacgatctccttgcggaaatgcagcagatagagcagtcgaatttcaggcaggcaccacagagagcccctggggtcgccgatctggccctgtcagagaactgggctcaggagtttctggcggcaggtgacgcggttgacgttactcaagactataacgaaaccgattggagccaggagttcatcagcgaggtaactgatccactctcagtgtcacccgctcgatgggccgaggagtatctggagcaaagtgaggaaaaactttggctgggtgaaccagagggtaccgcgaccgataggtggtatgacgagtaccacccagaggaggacttacagcatactgcgagcgattttgttgccaaggtggacgaccccaagctggccaattccgaattcctgaagttcgtgcgccagatcggggagggccaagttagcctcgagagtggagccggaagtggacgtgctcaagccgagcaatgggctgccgaattcatccagcagcagggcacttcggacgcttgggtcgatcaattcaccaggccagtgaatacctccgctctagacatggaatttgagcgggcaaagagcgccattgaatcagatgtggacttttgggacaagctgcaagcagaattggaggagatggcgaaaagggacgcagaggcccatccctggcttagcgattacgatgacctgacctctgctacctacgacaagggctaccagttcgaagaagagaaccccttgagggaccaccctcaacccttcgaggaagggctgagaaggctccaggaaggtgatctgccaaatgctgttctcctgtttgaggccgcagtgcagcaggatcctaagcatatggaggcgtggcagtacctaggaaccacccaggccgaaaacgaacaggagttgctcgccataagcgctttgcggagatgtttggagctcaaacctgataaccagacagcacttatggcgctggctgtctcgtttaccaacgagtctctacaacgacaagcttgtgagaccctgcgtgactggctcaggtatacgcctgcctatgcccacttagtgacacccgcagaggagggagcagggggtgccggacttggcccttccaagcgcatcctaggatccttgctctccgatagcctgtttctggaggttaaggagctgtttcttgccgctgtcaggttagaccccacaagcatcgatccagacgttcagtgtggactgggcgtgttgtttaatttgtctggggagtatgataaggccgtagactgcttcaccgccgctttatccgttagaccgaacgactatctgctttggaataagctaggtgcgaccctggctaatgggaatcagtccgaggaagccgttgccgcatacaggcgcgcactggagctccagcccggatacatcagaagcaggtacaacctagggatttcttgtattaatctaggcgcacacagggaggctgtggagcattttctggaggccttaaacatgcagaggaagagtagggggcctagaggagagggcggtgccatgtctgagaatatctggtcgacccttagacttgcactgtctatgctcggtcagtccgacgcttacggggctgccgacgctagggacctgtccactctgcttaccatgtttggcctgccccagtag

SEQ ID NO: 234421 - DNA, 1920 bp, Artificial Sequence
  Description of Artificial Sequence: Synthetic coding sequence
atggctatgcgagaattagtagaagccgaatgcggaggcgcaaacccactaatgaaattggcaggccacttcacccaggacaaagccctgcgacaggagggtctccgacccggaccatggccccctggcgcacccgctagcgaggcagcttcaaaaccactcggtgtcgcttcggaggacgagttagtggctgagttcctgcaggaccaaaacgctccactcgtgagccgcgctcctcagaccttcaaaatggacgatttgctggctgaaatgcaacagatcgaacagagcaatttccgccaggcacctcagcgggcaccaggagttgcggatctcgccctgtccgaaaattgggcccaggaattcctggctgcgggagatgcggtggatgtcactcaggattacaatgagactgactggtcccaggagtttatctcagaagtcaccgatccgttgagtgtatcccccgcaaggtgggccgaggagtacctggagcaatcagaggaaaaactctggcttggtgaaccagagggaaccgccaccgataggtggtacgacgaatatcatcccgaagaagaccttcagcatactgcctcagatttcgtggcaaaagtggacgaccctaaattggcaaatagcgagttcctgaaatttgtacgccagattggtgagggtcaggtgtctcttgaaagcggggcaggcagcggcagggctcaggcagagcagtgggctgccgagttcatacagcagcaagggaccagcgatgcatgggtggaccaattcactaggcccgtcaatacaagtgctttggacatggagtttgaacgtgccaagtcagcgatcgaatccgacgtcgacttctgggataagctgcaagctgaactcgaggagatggccaaaagagacgcagaagcccacccctggctcagcgattacgacgatcttacttctgccacgtatgataaagggtaccaattcgaggaagagaaccccctccgggatcatcctcagccctttgaggagggcctgcggcgtctgcaggagggtgacctgccaaacgctgtactgctttttgaggccgcagtacagcaggacccaaagcatatggaggcgtggcagtacttaggcacaacacaggccgaaaacgagcaggaactgttagctatcagcgcactccggcgatgccttgaattgaagcccgacaaccagaccgccctgatggctctcgcagtgtctttcacaaacgagtccctacagcggcaggcctgcgagaccttgagagactggttgagatacaccccagcttatgcccatctcgttacaccggctgaggagggtgccggaggtgccggattggggcctagcaagcgcatacttggaagtctgctttccgactccctgtttttggaggtgaaagaacttttcctcgcagcagttaggctcgaccctaccagcattgatccagatgtccagtgtggcttaggagtcctcttcaacctgtctggcgaatatgacaaggccgtagattgcttcacagctgccctgtccgtgcggccaaatgactatctgctgtggaataagttgggagccaccctggcaaacggcaatcagtctgaggaagctgtcgccgcatacaggcgggcacttgaactgcagccgggttacatccgatcacgatataatttgggcatttcatgtattaacttaggagctcaccgagaggctgtggaacacttcctcgaggctctgaacatgcaacgcaagagcaggggacccaggggagagggcggagcgatgagtgagaacatctggagtacattacgcctagccttatccatgttggggcagagcgacgcatacggcgcagctgacgctcgggatctctcaaccctcctaactatgttcgggctgccccagtag

SEQ ID NO: 234422 - DNA, 345 bp, Artificial Sequence
  Description of Artificial Sequence: Synthetic coding sequence
atggctatgagggaattggtcgaggccgagtgcggcggagccaaccctctcatgaagctcgcaggccatttcacacaggacaaggccctgagacaagagggcctcaggcctgggccatggcctcctggcgcacccgcaagtgaggcagctagcaaacccctgggagtcgctagtgaggatgagctggtggccgagtttttgcaggaccaaaatgcgccactggtctcccgggctccccaaacctttaaaatggatgatctgctggctgaaatgcagcagattgaacagtctaatttcaggcaggcgccacaaagagccccaggcgttgcagacttagcgctctag

SEQ ID NO: 234423 - DNA, 309 bp, Artificial Sequence
  Description of Artificial Sequence: Synthetic coding sequence
atggccatgagggagctggtggaagcagagtgcggcggtgctaatccgctgatgaagttggccggacattttacccaggacaaggccctcaggcaagaaggattaagacctggcccatggcctcctggggctcctgccagtgaagccgcttcgaagcccttgggcgtggcatctgaagacgaactcgtagcggaatttcttcaggatcagaacgccccactggtgtctagagcacctcagacctttaaaatggacgacctgctagctgagatgcagcaaatagagcagtcgaactttagacaggcctag

SEQ ID NO: 234424 - DNA, 747 bp, Artificial Sequence
  Description of Artificial Sequence: Synthetic coding sequence
atggcaatgcgcgagctcgtcgaggcagagtgtgggggagcaaaccctctcatgaaactggctgggcacttcactcaagacaaagctctgaggcaggagggattacgccctggtccatggccaccaggagcccctgctagcgaggctgcctccaagcctctgggcgtggcctcggaggacgaactcgtggctgaatttctgcaagatcagaacgctccactggtttccagggccccacaaacatttaagatggatgacctcttggcagaaatgcagcagattgaacagtccaactttagacaggctccccagcgcgctcccggtgtggctgacttggcactgtctgaaaattgggctcaggaatttttagccgctggcgacgctgtcgacgtgacacaagattacaacgaaaccgactggtcacaggaattcatttctgaggtgacagacccgctctccgtcagcccggcacggtgggccgaagagtatttagaacagtcggaagaaaagctgtggctcggggaacccgagggcaccgccacggaccgatggtacgatgaataccatcccgaagaggatctgcagcataccgcgagcgacttcgtcgccaaggtggatgatccaaagttggccaatagtgaatttctgaagtttgtgcggcagattggggaaggacaggtgtccctcgagagtggcgctgggtcaggaagggcgcaggctgagcagtgggctgccgagttcatctag

SEQ ID NO: 234425 - DNA, 315 bp, Artificial Sequence
  Description of Artificial Sequence: Synthetic coding sequence
atggcgatgagggaattagtggaagctgaatgcgggggtgccaaccccctgatgaagcttgcgggtcacttcacccaggacaaggccctgagacaggagggactgcgtcctggtccttggccccctggtgccccagctagtgaggcagcttctaagccattgggagtggcttcagaggacgagctggtcgccgagtttctgcaggaccagaatgcacccttagttagccgcgcaccgcaaacctttaaaatggatgacctgctggccgagatgcagcagattgagcagtccaactttagacaggctccccaatag

SEQ ID NO: 234426 - DNA, 1875 bp, Artificial Sequence
  Description of Artificial Sequence: Synthetic coding sequence
atgtaccagggccatatgcaagttgttggggttacattgaagaagaagtggcattgtttgcagaagtccgatctgactctcgctctgggaaagggatcccgggcagcagacaaagccgtggctatggtgatgaaagagatccccagggaagagtcggcggaggagaaacccttgctgacaatgacaagtcagcttgtgaacgaacagcaggagtccaggcccctactgtcccctagcatagacgacttcttgtgtgagacaaaatccgaagccatcgcccgtcccgtcacaagcaatactgcagtgctgaccaccgggttggacttgttagatctgagtgagcccgtgagccagactcagacaaaggcgaagaagtctgaaccaagctcaaaaactagctccttgaagaaaaaagcagatggatccgatctgatctctactgatgccgagcagagggggcaacccctgcgggttcctgaaacctccagcctagatctcgacatccaaacacagctggagaaatgggacgatgtaaaatttcacggggaccgcaacactaaaggtcaccctatggccgaaaggaagagttcatcttctcgtactggctcaaaagaactcctctggagcagtgagcatcgctcccagccagagctatctgggggtaaaagcgccctgaactcagagagcgctagcgaactggaactcgtggcacctacccaggccaggcttacaaaggagcatagatggggctctgccctgctttctaggaaccactccctggaggaagagttcgagcgtgccaaagccgctgtcgaatccgatacagaattttgggacaagatgcaggctgaatgggaggaaatggcaagacggaattggatatcggaaaatcaggaagcacaaaatcaagtgaccatctcagcgtcggaaaagggttattatttccacaccgaaaatccttttaaagactggcccggagcattcgaagagggactcaagagactgaaggagggcgatctgccggtcactattctgtttatggaagcagccattttgcaggacccgggtgacgcggaggcatggcagtttctgggcatcacccaggcagagaatgagaacgaacaggcggctatcgttgccctccagcgatgccttgagttacaacctaataatcttaaagccctgatggccttagccgtgtcatacactaatacaggccaccagcaggacgcctgcgacgccctgaaaaactggatcaaacaaaaccccaagtacaagtatctcgtgaaatccaaaaaaggaagccctggcctcactcggcgtatgtccaagtctcccgttgattccagcgttttagagggagtgaaggaattatatctggaggctgctcatcagaacggagacatgatagaccccgaccttcaaactggcttgggggtgctgttccacctgtccggtgagttcaacagggcgatagacgcattcaatgctgccctgaccgtgcggcctgaggactactcgctgtggaaccggctcggagcaacacttgccaacggcgataggagtgaagaggcagtcgaagcttatactcgtgccctggagatacagcctggctttatcaggagccgctacaatctaggcatctcctgtattaacctaggcgcatacagggaggctgttagcaattttctcacagccctctccctgcagcggaagagtagaaatcagcagcaagtcccccacccagctatcagcggaaatatttgggctgctcttcggatcgctctgtctctgatggatcaaccagaactgtttcaagccgctaacctaggcgacctcgacgtactgctcagagccttcaatttagatccctag

SEQ ID NO: 234427 - DNA, 1875 bp, Artificial Sequence
  Description of Artificial Sequence: Synthetic coding sequence
atgcaccagaacgggtcgcaagtcgttggcgtcactctgaagaagaagtggcattgcctgcagaaaagcgacctgacacttgctctgggcaagggttctcgggctgcagataaagccgttgccatggtgatgaaagaaatccctcgcgaagagtccgcagaagagaagccactgctcacaatgacatcgcagttggtgaatgaacagcaggagagcaggcctctgctgtccccatccattgatgattttctgtgcgaaacgaaaagcgaagccattgcacggccagtgacctccaatacagccgtcctgacgactggcctagaccttcttgatctgtcagaacctgtgagccagacacaaacaaaggccaaaaagtctgagcccagctctaagacatcatcactgaaaaagaaagccgatggatccgatttaataagtaccgacgccgaacagagaggccaacccttaagggtcccagagacatcatctctggacctcgatattcagacccagcttgaaaagtgggacgatgttaaattccatggggaccggaatactaaaggacaccctatggccgaaagaaagagtagttccagcagaacaggcagcaaggaactgctgtggtccagcgaacatagatctcaacccgaactcagcggcggaaagagtgctctgaatagtgagtctgcttccgagctggagctggtggcacccactcaggctcgcctgactaaagaacataggtgggggtccgcattgctatcaagaaaccacagtctggaagaggaattcgaacgagccaaagcagccgtggagtccgacaccgagttctgggacaagatgcaggcagagtgggaggaaatggccagacgtaattggatcagtgagaaccaagaggctcagaatcaggtgaccattagtgccagcgagaaagggtattacttccatactgaaaacccatttaaggattggcctggcgcattcgaggagggactaaaaaggctgaaggagggagacctgcccgttactattctgtttatggaagcggctattctgcaagaccctggcgatgccgaggcttggcagttcctcggcattacccaggccgagaacgaaaatgagcaggctgcaatcgtggcactccaacggtgcctggaattacaaccaaacaacctgaaggcactgatggccctggccgtatcctatacaaataccggacaccagcaggatgcatgtgacgctttgaagaattggatcaaacagaatccaaaatataagtatcttgtaaaaagtaagaaggggagccctggcctgacacgaagaatgtctaagtctcctgtggactcctcagtgctagaaggtgtaaaagaactgtatctggaggctgcccatcagaacggtgacatgatcgatcccgacctgcagacaggtctgggagtcctcttccatctgtctggggagtttaaccgggcaatcgacgcttttaacgccgcattgacggtgaggcccgaggattactccctgtggaataggctgggcgcaaccctggcaaatggcgacagaagtgaggaagctgtagaggcttacacgcgagctctcgaaatccaacccggtttcatcagatccaggtataacctgggtatcagctgtatcaatcttggcgcatatcgcgaggccgttagcaactttcttactgccttgagcctgcaacgaaaatctcgaaaccagcagcaggtcccgcatcccgcaatatcaggcaatatctgggctgctcttagaattgctctgtctctgatggatcagcccgagttgttccaggccgctaatctgggtgatctggacgtgctgctgcgcgctttcaaccttgacccgtag

SEQ ID NO: 234428 - DNA, 1557 bp, Artificial Sequence
  Description of Artificial Sequence: Synthetic coding sequence
atggtcatgaaagagatcccccgtgaggagtctgctgaagagaagccgctgcttacaatgactagtcagttggtgaatgaacagcaggaatcacggcctctccttagcccctccattgatgactttctttgtgaaaccaaatctgaggctatagctaggcccgtgacctcgaacaccgcagacattcagactcagctagagaagtgggatgacgttaagtttcacggcgaccgtaatactaaaggtcaccctatggctgagcggaagtcatcgagtagcagaaccgggagcaaggaactcctctggtcctccgagcaccgatcacagcccgagttatccgggggaaaaagtgccctgaacagtgaaagtgcctcagaactagagctggtcgctcctacccaagctagactgacgaaggagcacaggtgggggtccgcactccttagtagaaatcactcccttgaggaagaatttgaacgtgcaaaggccgcagtggaatccgacactgaattctgggacaagatgcaggctgaatgggaagaaatggccagaagaaactggatctctgagaatcaggaagcccaaaaccaagtgaccatctcagcttcagagaaaggatattacttccataccgaaaatccatttaaggattggccgggagcgttcgaggaaggcttgaagagactgaaggagggagacttgcctgttaccatcttgttcatggaggcagctatcctgcaggatccaggagatgccgaggcatggcaattcctaggaattactcaggctgaaaacgaaaatgagcaggctgcaatcgtggccctgcagcggtgtctggagctgcagcccaacaatctgaaagcactgatggcgctggcggtgtcatatactaataccggccaccagcaggatgcctgtgacgcattgaagaattggataaaacagaatccaaagtataagtatttagtgaagtctaaaaaggggtcccccggactcaccaggcggatgtctaagagcccagtggatagcagcgtcctcgaaggcgttaaggagctgtacctagaggctgcccaccagaacggcgacatgattgatcccgatctccagaccggcctgggcgtgctgttccatctgtctggcgaatttaacagagcaatcgacgccttcaacgctgcactgaccgtgcgaccggaggactacagtctatggaacagattgggcgctactttggcaaatggcgatcggtcggaggaggctgtcgaggcttacacaagggctctcgagatacagcccggttttattcgttctaggtacaatttggggatttcttgtattaacctgggcgcatatagggaagccgtgtctaacttccttactgccttgtcattgcagaggaagtctagaaaccagcagcaagtgccccatccagctatcagcggaaatatctgggccgctctgcgaattgcgctctctttaatggaccagccagaactctttcaggcagccaacctgggcgatctggacgtgctgttgcgtgcattcaacctggacccctag

SEQ ID NO: 234429 - DNA, 1809 bp, Artificial Sequence
  Description of Artificial Sequence: Synthetic coding sequence
atgtatcagggtcatatgcaggggaagggaagcagagcagcagataaagcggtggcaatggtgatgaaagagattccaagggaagaaagcgccgaggaaaaacctctgctaaccatgacgtctcagttggtcaatgagcagcaggagtcccgccctttgctctccccatcaatcgacgactttctctgcgaaactaaaagtgaggcgatagctcgcccagtgacatcaaacactgcagtattgacaacagggttagatttgctcgatctctctgagcccgtgagccagacgcagacaaaggctaaaaagtcagagcctagctcaaagacaagttccctgaaaaagaaagcagatgggagcgatctcatcagcacagatgcagagcagcgcggacagcctctgcgagtgccagagacttcatcactggacctcgatatccagacacagctcgagaagtgggatgatgttaagtttcatggagaccgcaacactaagggccacccaatggcagaaaggaagagctcttctagccgcaccgggagcaaggagctgttgtggagctctgagcaccggtcacagcccgagctgtccggcggtaagagtgccctgaatagtgagtctgcctcagagctggagctcgtggctcccacacaggccagattaactaaggagcacaggtgggggtccgccttgctgtcacgaaatcacagtcttgaagaggagttcgagcgggcaaaggccgctgtagaatcagatacagaattttgggataaaatgcaagccgaatgggaggagatggccagacgaaattggatctccgaaaatcaggaggcacagaatcaggtgacaatctccgcctcagaaaagggatactactttcatacggaaaacccattcaaagactggcccggagccttcgaagagggcttaaagaggctgaaagaaggggatctgccagtcactatcctatttatggaagctgccatcctgcaggacccgggagatgcagaggcctggcagttcttgggaattacccaagcggagaacgagaacgagcaggccgcaatcgtcgcccttcagcgatgcctggagctgcaacctaataaccttaaggcactgatggccctggcagtgtcctacacaaacaccggacatcaacaagatgcctgcgatgcgttaaaaaactggatcaaacagaatccgaaatacaaatacctcgtcaaaagcaaaaagggatctcccggtttgacccgtcggatgtccaaatctccggtggattcttctgtactggaaggagtgaaggaactgtacctggaggctgcccatcagaacggggatatgatcgacccggatctgcagactggtttaggggtgctgttccatctctcgggcgaattcaatagagcgattgacgccttcaacgccgcacttactgtgcgccctgaagattattcgctgtggaaccgcctgggagcaaccctggcgaatggggatcgcagcgaggaagctgttgaagcatacactcgagccctggagatccagcccggattcatcaggtcacgttataatctcggtatatcctgcattaatctgggagcttacagagaggcagtatcaaacttcctgactgcactaagccttcagcgcaagtcccgaaaccagcagcaggtaccacaccctgcgatttcgggcaacatctgggccgctcttcggatcgcactctctcttatggatcaacccgaattgtttcaggccgctaacttgggggaccttgacgtccttcttcgggcttttaatctggacccctag

SEQ ID NO: 234430 - DNA, 1545 bp, Artificial Sequence
  Description of Artificial Sequence: Synthetic coding sequence
atgtccagcctgagcctcaagcccctcgtgcaggtgtctgtaggggcatttgtacagctcgtgaatgagcagcaggagtccaggccactcctgtcacctagtatcgatgactttctttgtgaaactaagtcagaggcgatcgcgaggcccgttaccagcaacactgctgatatccagacacaactcgagaaatgggatgacgttaagtttcacggagaccggaacactaaaggccatccgatggccgagcgtaaatcatctagcagtcgcacgggaagcaaggagttgctctggtcaagcgaacaccgcagtcagcccgagctgagcggtgggaagtccgcgctcaacagtgagtcagctagtgagctagaactggtggctccaacccaggctcggctcacgaaagaacacaggtggggatccgcactgctatcacggaaccatagcctcgaggaagaattcgagcgagctaaggcagccgttgaaagtgatacggagttttgggataagatgcaggctgaatgggaggagatggccaggagaaattggatatcggagaatcaggaggcgcagaaccaggtcacaatctcagcgtcagaaaaaggttattattttcataccgagaatcctttcaaagattggccaggggcattcgaggaagggctcaaacgactgaaggagggagacctgcctgttacgattctgttcatggaggcagccatcctgcaagaccccggtgatgccgaggcctggcaatttttgggaatcacccaagctgaaaacgagaacgagcaggctgccattgttgccttgcaacgctgtttggaactgcaaccgaacaacctaaaggccttgatggcgctcgccgtgagttatacaaataccggtcaccagcaagatgcctgcgacgctctgaaaaactggattaagcagaaccctaaatacaaatacttggtgaaatcgaagaagggctcccctggcctaactaggcgaatgtcaaagagcccagtggacagctcagtcttagaaggcgtcaaggagttatacttggaggctgcgcaccaaaacggagacatgatcgacccagacctgcaaactggactgggcgtactgtttcaccttagtggagaattcaatcgagctatagatgcattcaatgccgctctgaccgtccgacccgaagactattctctctggaacagactcggtgcaacactcgccaatggcgatcggtcggaagaagccgtcgaagcgtataccagggctttggagatacagccaggctttatccggtctagatacaatctggggatctcttgtataaatctgggtgcctatcgcgaggccgtctccaactttctgaccgcattaagtctccaacgaaagagccgaaaccagcaacaagtgccccatccggctatctccgggaacatatgggccgctctgaggattgcactcagcttgatggaccagcccgaattgtttcaggccgctaacctcggggatctggacgtgctcttgcgcgcttttaacttggacccttag

SEQ ID NO: 234431 - DNA, 1881 bp, Artificial Sequence
  Description of Artificial Sequence: Synthetic coding sequence
atgtaccaggggcacatgcagaagtctaaggagcaaggctatgggaaacttagttctgacgaagacctagaaatcatcgtcgaccagaaacaaggtaaggggagccgcgctgccgataaggctgtagccatggtgatgaaagagatcccgcgtgaggagtcagccgaagagaaacctctattaaccatgacttcccagcttgttaatgaacagcaggagtcccggcctctcctctctccttcaatagacgatttcttatgcgagacgaaatccgaagccattgcgaggcccgtgacctctaacactgcagtcctgactacagggcttgatctgcttgacttgagtgaacctgtgtcccagacgcagaccaaggccaaaaaaagcgagccctccagtaaaaccagctccctgaagaaaaaagcagatggcagcgacctgatcagtaccgatgcggagcaaaggggtcaaccactacgagtgccagaaacctccagcctggacctggacatacaaacacagctcgaaaagtgggacgacgtgaaattccatggggaccgcaacactaaggggcacccaatggccgagcggaagtcttccagctcgcgcaccggttccaaagagctcctgtggtcctccgagcatagatcgcagcctgaactgtccgggggtaaatccgcccttaacagcgaatccgctagtgagctcgagctggtcgcccctacgcaggccaggctgaccaaggagcatcggtggggctctgccctgctgtctcgaaatcactcccttgaggaagagtttgaacgcgcaaaggctgcagtggagagcgatacggaattctgggataagatgcaggctgaatgggaggagatggctcgcagaaactggattagcgagaaccaagaagcccagaatcaggttacgatttcagcttccgagaaggggtattattttcacacagaaaatccattcaaagactggccaggtgccttcgaggagggattgaaacgcctgaaagaaggagatctaccagtgacgatcctgtttatggaggccgcaatcctgcaggaccctggagatgccgaagcatggcagttcctcggtattacacaagctgagaacgaaaacgagcaggcggcaatcgtggccctgcagcgctgcctggaactccagccaaataacctgaaggctcttatggctctggccgtaagctacacaaacacaggccatcagcaggacgcatgcgacgcactcaaaaactggatcaagcagaaccccaagtacaagtatctagtcaaaagcaagaaagggagcccgggtttgactcgtaggatgtcaaaatctcccgtggatagcagtgttctagaaggcgtcaaagaactttacctggaagccgcacaccaaaacggtgatatgatcgatcccgacctgcagacgggcctaggcgtgttatttcacctcagcggggagttcaatagggccatcgacgccttcaatgctgctctgactgtaaggccggaagattactccttatggaacagactcggcgctactttggcgaacggcgataggtccgaggaagcagttgaggcttacacaagagccttggagatccagcccggattcatccgttcccggtacaacctgggcatttcctgcattaacctcggcgcttaccgcgaggccgttagtaattttttgaccgccttaagtcttcagcgcaagagtcgaaatcagcagcaggtgccacaccccgcaatcagtggcaacatttgggcagccctaagaatcgccctcagcctaatggaccaaccagagttgttccaagccgctaatctgggcgacctagacgtgctgcttagggcttttaacctggatccttag

SEQ ID NO: 234432 - DNA, 1752 bp, Artificial Sequence
  Description of Artificial Sequence: Synthetic coding sequence
atggttatgaaagagatcccacgggaagaaagcgcagaggagaagccgctcctgacaatgacatcacaactggtcaatgagcagcaggaaagccggccactcctgtctccctccattgacgacttcttatgtgagactaaatcagaggcaatcgcaaggcctgtaacttccaataccgcagtgctgacaaccggattagatctgctggatttgagtgaacctgtgtctcagacccagactaaggctaaaaaatccgaaccttctagcaaaacatctagcctgaagaaaaaagctgatggcagtgatcttatttctactgacgccgaacaacgcggacagcccctcagagttcctgaaacatcctccctagaccttgatatacagactcaattggagaaatgggatgacgtgaaatttcatggcgaccgaaacacaaaaggtcaccctatggctgaacgaaagagctcctcatcaagaacaggaagcaaagaactgttgtggagctctgaacacaggtctcaacctgagctgtcaggtgggaaatcagccctcaacagtgaaagcgcctcagagctggagctggtcgcccctacccaggctaggctgaccaaggaacaccgatgggggagtgcactgctctcccgtaatcattcgcttgaagaagagttcgaacgagctaaagccgcagttgagtcagacaccgagttttgggacaaaatgcaggccgagtgggaggaaatggctagaaggaattggatttctgaaaaccaagaggcccagaaccaagtcacaatctctgcctcggaaaagggctattatttccatacggagaatcctttcaaggactggccaggggcttttgaagaagggctgaaacgcctcaaggaaggtgatctgcccgtaacaatactgttcatggaagcggctatcctccaggacccaggcgacgcggaagcttggcagtttctgggaataacacaggcagagaacgaaaatgagcaggccgctatcgtggctctgcagcgctgtttagaactgcaacccaacaacttaaaggctctgatggcactggccgtttcctacactaacaccggccaccagcaggatgcttgtgacgcactaaagaattggatcaaacaaaatcccaagtacaagtacctggtcaaatccaagaaagggtcgccaggactgacgagacggatgtccaagagtcccgtggactcatcagtcttggagggcgtcaaggagttgtatctggaagctgcacatcagaatggggatatgatcgatccagacctgcaaaccggcctcggagttctatttcatctgtccggcgagtttaaccgggctattgacgcctttaatgctgcactgacagttagaccagaggattatagtctgtggaacagattgggggcaactctggcaaacggagaccggtcggaggaggccgtggaggcctacacacgggctctggagattcaacctggctttattagaagtcgatataatctgggtatttcttgcattaatctgggcgcataccgagaagccgtttctaattttctgaccgctctgtcattacaaagaaaatcgaggaatcagcagcaagtaccccaccccgcaatcagtggcaacatctgggctgcacttagaatcgctctctccctgatggaccaacctgaactgttccaggcagccaatctcggcgacctggacgtgcttctccgtgcgttcaatctggacccatag

SEQ ID NO: 234433 - DNA, 1776 bp, Artificial Sequence
  Description of Artificial Sequence: Synthetic coding sequence
atgtaccagggccatatgcaaaaatccaaggaacagggttacggtaagttatcatccgatgaggatctcgagattattgtggatcaaaagcagctggtgaatgaacagcaggagagcaggccactactgtccccatcaattgacgacttcctgtgtgagacgaaatccgaggcaatcgctcgacctgtaaccagtaatactgccgtgctgactacaggattggacctcctggacctctctgagcccgtctcccaaacccagaccaaggccaaaaagtccgaaccctcttccaagaccagcagtctcaagaagaaggcggatggctctgatttaatctcgaccgacgccgagcaacggggacagccactcagggtgcccgaaacgtcaagcctggatctggatatacaaacccagttagagaagtgggatgatgtgaaattccatggagaccggaatactaaagggcacccaatggccgagcggaaatcttcctcatctagaaccggaagtaaagaacttttgtggtcctccgagcacagaagtcagcctgaactgtctggaggtaagtccgctctgaattccgaatcggctagcgagctcgaactggttgctcctactcaggcaaggcttaccaaagagcatcggtggggttcagcgctgctgtctcggaaccactctctggaggaggagttcgagagagccaaggcggctgtcgagagtgacactgagttctgggacaagatgcaagcagagtgggaagaaatggcaaggcgcaactggatcagtgaaaaccaagaggctcagaatcaggtgacaatatcagcctcagaaaagggttactactttcatacagagaatccgttcaaggattggcctggcgcttttgaggaggggctcaagagactgaaggagggcgacctgcctgtgactatattgtttatggaggcggctatcttgcaggatcccggtgatgctgaggcctggcaatttctgggcattacacaggccgagaatgagaatgaacaagccgctatcgtggcacttcaaagatgtcttgagctacagcccaacaatttgaaggctctcatggccctggcagtctcatatacaaatactggtcatcaacaggacgcttgtgatgcccttaaaaattggataaagcaaaacccaaaatataaatacctggtaaagagcaaaaaagggagtcccggactgacccgcagaatgtccaaaagcccggtggattcttctgtattagagggggttaaggaactgtacctggaggccgcacaccagaatggtgatatgatcgacccagacctgcagacgggcctaggcgtgctgtttcacctcagcggagagtttaatcgggctattgatgcctttaatgctgctctcaccgtgagacccgaggactactctctgtggaacaggttgggggcaacgctggctaatggggatagatcagaggaggcggttgaggcatacacaagagctcttgagattcagcctgggtttataagatcaaggtataatctgggcatctcttgtatcaacctgggcgcttatagagaggccgtgtcaaatttcctgaccgcgctgagcctacaacgcaagagtcgcaatcaacagcaggtgccccaccctgctatttcaggcaatatatgggccgctttacgtatagccctgtctttgatggaccagcctgagctcttccaggccgcaaatctgggggacctggatgtcctgctcagagccttcaatttagatccttag

SEQ ID NO: 234434 - DNA, 2217 bp, Artificial Sequence
  Description of Artificial Sequence: Synthetic coding sequence
atggccttagctgtgcttagggtgcttgagccatttcctactgaaacacctcctcttgcggtattgttaccacctggcggaccctggcctgccgctgaattaggcctcgtgctggctctgagacccgctggagaatcgccagccggaccagcccttctcgtggccgcactcgagggccctgatgctgggaccgaggaacaaggacccggtcctccccagcttttagtttcaagggcattgctcagacttcttgcacttgggtccggtgcctgggtccgagctcgggcagtgaggcggcctcctgctctggggtgggccctgttgggcacttcgttgggccctggtctgggtcctagggtgggcccactcctcgttcgtaggggagaaactctgccagtgcccggaccacgagtactagagacccgccctgccctccagggtctgttggggcctgggactagactggcagtcacggaactgcggggtcgggctcggctctgtcccgagtctggagacagttctagaccccctcccccaccagtggtgagctcttttgctgtcagtggcacagtgaggagacttcaaggcgttctggggggtacaggtgattccttaggtgtgtcacgctcttgtttgcggggtctaggtctgttccagggcgagtgggtttgggttgcccaggcaagagagtcatccaacacctcccagccccacttggcccgagtgcaggtgctggagccgagatgggatctgtcagaccgactaggaccgggatctggaccactgggggaaccactggctgatgggcttgccctggtgccagctacccttgccttcaatctggggtgcgatcctctggaaatgggagagctgcgcatccagcgctacttagagggttccatcgctcccgaggataagggctcctgtagcctcctgcctgggcctccttttgcacgcgagctgcacatcgagatcgtctcatcaccccactacagcacaaacggtaactacgatggggtgctctatcgccatttccagatacctcgcgttgtgcaggaaggcgatgtcctgtgcgtgcccactatcgggcaggtagaaattcttgagggctcacccgaaaaactgcctagatggcgcgagatgttttttaaagttaaaaagactgtgggtgaggctcccgatgggccagcctctgcctacttggcagatacgactcataccagcctctatatggttgggtccacactgtccccggttccatggctgcctagcgaagaatccacactgtggtcaagcctcagtccgccaggcctcgaagctctggtgagcgaactgtgtgccgtcctcaagcccaggctacaacctggtggggctctcctcacgggcaccagtagcgtcttgctcagaggccctccaggctgcggaaaaacaaccgtagtagccgcagcctgttcccaccttgggctgcatcttctgaaggtcccatgcagctctctctgcgctgagtcctccggcgcagtggaaacgaaactccaggctatcttctctagggctcggaggtgtcggcctgccgtgcttctgctgaccgccgtggacctgttgggaagggaccgtgatggactcggggaggacgcacgcgttatggcagtgttgagacacttacttcttaatgaagaccctttaaactcctgcccaccactcatggtggtggccacaactagtcgggctcaggatttgccagccgatgtgcaaaccgcattcccccacgaattggaagtgcctgcgcttagcgagggacagaggttaagtattcttcgggcactgacagcacacctccctctggggcaggaggtgaacctggctcaactggccagacgctgtgcaggatttgtcgttggtgacctgtacgcactactcactcacagcagcagggccgcatgcacacggatcaaaaacagcgggttggccggaggcctaaccgaagaggatgagggagaattgtgtgccgcaggctttcctctgttggctgaggattttggtcaggcactcgagcagctgcagacagcccacagccaggctgtgggagcgcctaaagtcgaaactaaatccctcgagtgcctgcctggtcccggacttcagctccacgctctgtccagtctgatgaactggaccttgtggccacaggctggtggcgaggttgagattttagaagaatag

SEQ ID NO: 234435 - DNA, 2943 bp, Artificial Sequence
  Description of Artificial Sequence: Synthetic coding sequence
atggccctcgcggtgctccgagtgctggagccattccctactgaaacgcctccactcgcggtgctgctccctcccggaggtccttggccggcagctgaactaggtcttgtgttagccctgagaccagcaggcgagtcccccgcaggacctgcactgttggtggcagccctggagggccctgatgcaggaacagaagaacaaggcccaggcccacctcagctgctggtgtctcgtgcacttctccgacttctggccctggggagtggggcatgggtccgcgctcgagcagtgcggagacccccagccctgggttgggccttgcttggtacatcccttggccctggtctggggccacgtgtggggccactgcttgtacggaggggtgagaccctgccagtgcctggacccagagtgctagaaaccaggcctgcgctccaagggttactcggacctggcactagactcgcagttactgagttaagggggcgagcccgtttgtgtccagaatctggggactcctctagacctcctccaccccctgtagtcagctctttcgccgtatcaggaactgtgcggaggctgcaaggcgtccttgggggtactggggactctctgggcgtgagtcggtcctgtctcagaggactcggactcttccagggcgaatgggtgtgggttgcacaagcccgtgaatcgagcaatacaagtcagcctcatttggccagagtgcaagtgctggagcccaggtgggacctctctgatcggctcggtccaggctccgggccactgggcgagccactggctgacgggctggccctggttccggctaccctcgctttcaatctggggtgtgatcccctggagatgggagaattacgtattcagcgttacttggagggctcaatcgcacctgaagacaaggggagctgtagtctcttacctggccctccatttgccagagagctacatatagagatagttagcagcccccactattccactaatggtaactacgacggcgtcctgtaccggcattttcagatccccagggtggttcaagaaggagacgtgctgtgtgtgcctacaattggacaagtcgagatcctggagggatcccctgaaaagttacccagatggagggaaatgttttttaaagtgaagaagacagtaggagaggctccggacgggccagcctctgcttacttagctgatacaacccataccagcctctacatggtggggtcaacccttagtcctgtgccctggctcccctctgaagagtcgaccttatggtcaagcctctcccccccaggcctcgaagccctcgtgtctgaactttgtgctgtgctgaaaccaaggctgcagcccggtggagctctgctcacagggacctcctcagtgctgctccggggtcctcctggatgtggcaagacaaccgttgttgcagccgcatgttcacacttggggttacacctgttaaaggtaccatgtagttccctgtgtgccgaatcgagcggagccgtggaaaccaaactgcaagccattttcagtagggctcggagatgcagacctgcggtgttgctcctcaccgccgtggacttactcggcagagaccgggacgggctgggggaggatgccagagtgatggcagttctgcggcacctcctgttaaacgaggatccgttgaacagttgtcctcctctaatggtcgtggctacaacaagtagggctcaggatttaccagccgacgtgcagacagctttcccacatgaactggaagtcccggctctgtctgaaggtcaacggctcagtatactgagagccttgaccgcccacttgcccttaggccaggaggtaaacctcgcacaactggcccgacggtgcgctggtttcgtggttggagatctttatgcactgctgactcacagcagcagagccgcatgcacccggatcaaaaattcgggattagccggagggctcaccgaggaagatgagggcgaattgtgtgcagcagggtttcccctgcttgctgaggactttggacaagccctggagcaactacagactgcccacagccaggccgttggcgctccaaagatcccaagcgtctcttggcacgatgtgggcggtcttcaggaggtgaaaaaggagatccttgaaactatacagcttccattagaacaccctgagctcctgtcactgggactccgtcgatccggtctgctgctgcacgggccaccaggcacaggaaagacattactggccaaagcagtcgccacagaatgcagtctcacgtttctgagcgttaaaggccctgaactgatcaacatgtatgtgggccagtcagaggagaacgtgagggaggtgtttgccagagccagggctgctgcaccctgcattattttcttcgacgagctggatagtctcgctccatccagaggacggagtggggacagtggaggtgtgatggaccgggtggtttcccaactattagccgaattggatggattacacagcacacaggacgtctttgtaataggtgccactaatcgacccgacctacttgatcctgccttattacgacccggtaggttcgacaagctggtgtttgttggggctaatgaggatcgggcatcccagcttagggtcctgtccgccatcactcggaaattcaagctcgagccatcagtaagcctggtgaacgtgctggactgctgccccccacagctgactggcgcagacctgtatagtctttgctctgacgccatgaccgcggcattgaagcgccgagtccacgacttggaggaagggctggaaccgggatcatccgcattaatgctgaccatggaagacctgctgcaagctgctgcacggttacagccatcagtaagcgagcaggagctcctacgctataagagaattcagcggaagtttgcagcatgctag

SEQ ID NO: 234436 - DNA, 972 bp, Artificial Sequence
  Description of Artificial Sequence: Synthetic coding sequence
atgtccgcagtatgtggaggggctgccagaatgttacggacaccgggacgccacggctacgcggcagagttcagcccttacctgcccggacgtcttgcttgtgccacagctcagcactatggcattgctggatgtggaaccctgctgatcttggaccccgatgaggccggactgcgcctcttccggtccttcgattggaacgatggccttttcgatgtgacctggtcagagaacaatgagcatgtactcatcacttgttccggcgatgggtcactacaactgtgggatacagcaaaagccgctgggccacttcaggtgtataaagaacatgcacaggaggtgtattctgtggactggagtcagactcggggtgaacagttagtagtctcgggttcctgggaccagaccgtgaagctgtgggaccctaccgtcggtaaaagtctctgtacattccgcggacacgagagtattatttactcaaccatctggtccccacacatacctggttgttttgccagcgcatcgggcgatcagaccctgagaatctgggatgtaaaggctgctggtgtccgaatcgttattcctgctcatcaagctgagattctgtcctgcgactggtgtaagtacaatgagaatttactggtcacaggcgctgttgattgctccctgagggggtgggatcttaggaatgtgaggcagcccgtgtttgagctcctgggccatacctatgccatcaggcgggtgaagttttctccattccatgcatcggtgttggcttcctgctcttacgacttcaccgtgcgcttctggaacttttctaagcccgattcactgctggagacagtggagcaccacacggaatttacctgtgggcttgattttagcctgcagagtccgacccaggtcgctgactgctcgtgggacgagacgatcaagatctacgatcccgcatgtctaaccattcccgcttag

SEQ ID NO: 234437 - DNA, 369 bp, Artificial Sequence
  Description of Artificial Sequence: Synthetic coding sequence
atgtcggccgtgtgcggaggagccgcaagaatgctccggacccccggaaggcatggatacgccgcagagttttcaccttacctacctggtaggttagcgtgtgccaccgcccagcactacgggattgccggatgtggtactttattaatcttagatcccgacgaagcaggattgaggctgttccgatccttcgactggaacgacggacttttcgacgtcacttggagtgagaacaatgagcatgtgcttatcacatgcagtggagacggatccctccagctttgggatacggctaaagccgcagggccactacaggtctacaaagagcatgcccaggagtatgtccaagggtcatgcgtagtcaagtag

SEQ ID NO: 234438 - DNA, 843 bp, Artificial Sequence
  Description of Artificial Sequence: Synthetic coding sequence
atgtctgctgtttgtggcggtgctgctcgaatgctgcgaactcctgggaggcacggctatgcagctgagttctctccttatctgcctggaagactggcctgcgctacagcgcaacattacggcatcgcaggttgcggaacattactgatacttgaccctgatgaagctggcttgcgacttttcaggtcattcgactggaacgatgggctattcgatgttacgtggtccgagaataacgagcacgtgttgattacatgctcgggcgatggatctctccagctgtgggatacagccaaggccgctggccctctgcaggtctacaaggagcacgcacaggaagtgtattcagtggattggtcacagacgcgcggtgagcagctcgtagtgtccggatcctgggaccagactgtaaagttatgggatcccacagtgggcaagagcctatgcaccttccggggacacgaatccataatttactccacaatttggagcccccatattcctgggtgcttcgcctctgcaagtggggatcagactttacggatttgggatgttaaagcagcgggagtgcgtattgtgatcccggcacatcaggccgaaatcctgagctgcgactggtgtaagtacaatgagaacttgctggtcacgggtgctgtggattgttcccttcgaggatgggacctgcgcaatgttcgccaaccggtcttcgagctgcttggtcacacctacgcaattaggcgcgtgaagatggagagctgccccgtgacccagacccggtcacagctgacggctaccagcgcgttttgggttcaggcagtgcttctaccacagcctacagagtag

SEQ ID NO: 234439 - DNA, 912 bp, Artificial Sequence
  Description of Artificial Sequence: Synthetic coding sequence
atggcatcttgggccaagggaagatcataccttgctcccggactcttacaggggcaggtggcaattgtgaccggcggagccactgggattggcaaagcaatcgtaaaagagttgctggagcttgggagtaatgtggtgatcgcctccaggaagctggagaggctgaaatctgctgctgatgagcttcaagctaatctgcccccaacaaagcaggccagagttattcccatccagtgcaatatcaggaacgaagaggaggtcaataatctcgtcaagtctactctggataccttcggcaagatcaacttcctcgtcaacaacggaggcggacagtttctttccccagcagagcatatctcgtcaaagggctggcatgccgtccttgaaaccaatctgactggcaccttctacatgtgtaaagcagtatattctagctggatgaaagaacacgggggatccattgtgaacataatcgtcccaactaaggcgggattccctttagcagtgcattctggggcagctagagccggagtgtacaacttaaccaaatcgctcgcgctcgagtgggcctgctctggcatcaggataaattgtgttgcccctggagtcatttactctcaaacagcagtggagaactacgggtcttggggccaaagcttctttgaggggtctttccagaagatccctgcaaagcgtattggcgttccagaagaggtgagctccgttgtttgcttcctgctcagcccagcagcctcctttatcaccggccagtcagtcgacgtggacggaggcaggtccttgtacacccattcctacgaggttccagatcatgataactggcccaaaggtgccggtgacctcagcgtggtcaaaaagatgaaagaaaccttcaaggagaaagctaagctgtag

SEQ ID NO: 234440 - DNA, 1407 bp, Artificial Sequence
  Description of Artificial Sequence: Synthetic coding sequence
atggtggacacagagagcccactctgtcctctgtctccactcgaggctggggacctcgagtcgccactgtcggaggaattcctccaggaaatgggcaatattcaggaaatatcacagtccataggcgaggattcctccgggtcctttggattcaccgagtatcaatacctgggtagttgcccgggttccgatgggtccgtgatcaccgatacattgagcccggcaagctctccgagctccgttacatatccagtagtgcccggaagcgtggatgagagtccatcaggtgctctaaatatcgaatgcagaatatgcggcgacaaggccagtgggtaccattacggggtgcatgcgtgtgagggttgcaaggggttcttcagaagaacaataagactgaaactggtctacgataagtgtgatcggtcctgcaaaattcagaagaaaaacaggaacaaatgccagtactgtagatttcacaagtgtctctctgtcgggatgtcacacaacgcgattcgattcggaagaatgcctagaagtgagaaggcaaagctgaaagctgaaattctcacctgcgagcatgatatcgaggactccgagactgctgatttaaaatctctggctaaacgtatctatgaagcttacctaaagaacttcaatatgaataaggtgaaagctagggttattctctctggaaaagcatccaacaatccgccatttgtgatccacgatatggagaccttatgtatggccgaaaaaaccctggtggccaaactggttgccaacggcatccaaaataaagaagctgaggttagaatctttcactgctgtcagtgtacaagtgttgagaccgttaccgagctgacagagttcgcaaaggccataccaggattcgccaacctcgatttgaacgaccaagtgactctcttgaagtatggggtatacgaggccatcttcgcaatgctaagttccgtaatgaacaaagacggaatgctggtcgcgtacggaaacgggttcataacccgggagtttctcaagtcgttacggaaacctttttgcgacatcatggaaccgaagttcgactttgctatgaaatttaacgcgctggaactggatgatagtgacatttcactctttgtggctgccatcatttgctgtggcgataggccaggtctgctaaacgttggtcacatcgagaagatgcaagaaggtatcgtgcatgtgctgcggctccatcttcagtccaatcaccccgacgacattttcctttttcctaagctgctgcagaaaatggctgaccttcggcagctggtcactgagcatgctcagctggtgcaaatcatcaaaaaaaccgagagcgatgcggcattacaccctctactgcaggaaatctacagagacatgtattag

SEQ ID NO: 234441 - DNA, 1407 bp, Artificial Sequence
  Description of Artificial Sequence: Synthetic coding sequence
atggtggacaccgaatcccctctgtgtcctttatcgcccttggaggcaggcgatctggagtctcccctgtccgaagaatttctgcaagaaatgggtaatatacaagagatatcacagagcataggggaagactccagtggttcctttggcttcaccgaatatcagtacctcggctcatgtcccggtagtgacggctccgtaataactgacacactatcccccgcttcaagtccgtctagcgttacttatcccgttgtgcccggatccgtcgacgaatcgcccagcggtgcactgaacatagaatgccgcatctgcggtgacaaggctagcggctaccattatggagtgcacgcctgcgagggttgtaaaggcttttttcggcgaaccattcgcctgaagctggtgtacgacaagtgcgaccgcagctgtaagattcagaaaaagaaccggaacaagtgtcagtactgcaggtttcataagtgcctcagcgtaggaatgtctcataatgctatacgctttggcaggatgcccaggagcgaaaaagccaaactgaaagctgagatcctgacatgcgaacacgacatagaagatagcgaaaccgcggacttgaagagcttagccaagcgcatttacgaggcttatctcaaaaacttcaacatgaataaggtcaaagctcgagtaattctgtccggtaaagcaagtaataatccaccctttgtgatacacgatatggagaccctgtgtatggccgagaagactcttgttgccaagcttgtggccaacgggatccagaacaaagaggccgaagtccggattttccactgctgtcagtgtacctctgtggagactgtcactgaactcaccgaattcgccaaagccatccctggattcgccaacctcgacctgaacgaccaagtgacgctactcaagtatggcgtgtacgaagctatcttcgctatgctctccagcgtgatgaacaaagatgggatgctcgtggcatatggcaatggattcattacacgggagttcctgaagtccctgcgcaagcctttttgtgacattatggagccaaagttcgactttgccatgaaattcaatgctctggaattggacgacagtgatatctcactcttcgtggctgctattatctgctgtggtgaccgacccggtctgctcaatgtgggtcatatcgaaaagatgcaggaagggatcgttcacgttctccggcttcacctccaatcgaatcaccccgacgatatctttcttttcccaaaactgctgcagaaaatggccgacctgcgtcagcttgtcaccgaacatgcccagcttgtacaaatcataaagaagactgaatcagatgcagctctgcatcccctgctccaagaaatttaccgtgatatgtattag

SEQ ID NO: 234442 - DNA, 1407 bp, Artificial Sequence
  Description of Artificial Sequence: Synthetic coding sequence
atggttgataccgagagtccactctgccctctctcaccacttgaggcaggagacttggaatcaccactgtctgaggaattcctgcaggagatgggaaacattcaggaaatcagtcagtcaatcggcgaggatagttctgggtcattcgggttcacggagtaccaatatctcggaagctgtcccggttccgatggaagtgtcatcacagacaccttgagtccggctagcagcccttctagcgtcacttatccagttgtgcccggaagcgtggacgagtctccatccggggcactgaatatcgagtgtcgaatatgtggagacaaagcctccggctaccattatggcgtgcatgcatgcgaagggtgtaaggggttttttcgtcggacaatcagactgaagctcgtttatgacaagtgcgacagatcatgcaagatccaaaagaaaaaccgcaacaaatgccaatactgtcggttccataaatgcctgtcagtcgggatgtcacacaatgcgataaggttcggacgcatgcctcggagtgagaaggccaaattaaaggccgagatcctgacttgtgagcacgatattgaggactcagaaaccgccgacttgaaatccttggctaagcggatatacgaggcctatctgaagaactttaacatgaacaaagtgaaagccagggtcatcctgagcggcaaagccagcaataaccccccttttgtgattcacgatatggaaacactgtgtatggccgagaaaaccttagtggccaagctggtagcaaacgggattcaaaacaaggaggcagaggtccggatatttcattgctgccaatgtacttccgttgagaccgtcacagagctcaccgagtttgccaaggccattcctggctttgcgaacctggatctgaatgaccaggtcacactgctcaagtacggggtgtacgaggcaatattcgccatgttgagtagtgtgatgaataaggacgggatgctggtcgcttacgggaatgggttcattacaagagaatttctgaagtctctgcgaaaacccttctgtgatattatggagcctaagttcgactttgccatgaagtttaacgcattagagctggatgatagtgacatcagtctgttcgtagccgcaattatctgctgcggggaccggccaggactattaaacgtcgggcacatcgagaaaatgcaggagggaatagtccatgttttaagactgcacttgcaatctaatcacccagatgacattttcctgtttcctaaactgctgcagaaaatggccgacctgagacagcttgtgacagaacacgctcagctggtccagataatcaagaagactgagtctgatgctgcactccacccgctcttacaagaaatctacagagatatgtactag

SEQ ID NO: 234443 - DNA, 1407 bp, Artificial Sequence
  Description of Artificial Sequence: Synthetic coding sequence
atggtggacacagagtcccccctgtgcccactgtcacctcttgaggcaggagatctggagagccctctgtctgaagagtttcttcaagagatgggtaacattcaggaaatcagccagtctatcggggaggactcctcaggctcctttgggtttaccgagtatcaatacctcgggtcatgtccaggtagtgatggctcagtcatcacagatacactaagcccagcctcctccccatcctccgttacttatcccgtcgtgcccggatccgtggatgaatccccctccggcgcactgaatattgagtgtagaatctgcggtgacaaggcctctggatatcactacggagttcatgcctgcgaaggttgtaagggcttcttcagaaggactatccgcctgaaactggtttacgacaaatgcgatagaagctgtaaaatccagaaaaagaacagaaacaagtgccagtactgtcgattccacaagtgtctgagcgtggggatgagccataatgctatccgctttggaaggatgcccaggtctgagaaggccaaacttaaggccgagatcctgacctgcgagcatgacatcgaggacagcgaaacagctgatctcaagagcctggccaagcgcatctacgaagcttacctcaaaaatttcaatatgaacaaggtgaaagcccgagtgattctgagtggaaaagcaagcaataatccgcctttcgtaattcacgatatggagaccttgtgcatggccgaaaaaactctcgttgcaaagcttgttgccaatggaattcagaacaaagaagcagaagtgaggatctttcactgctgtcagtgtacctcagttgaaacagtgaccgagctgacggagtttgctaaggccatacccggatttgcaaatctggacctgaatgaccaagtaacactcctcaagtatggggtctatgaggccatcttcgctatgctctcttctgtgatgaataaggatggcatgctcgttgcctatggcaacggttttatcactagggaattcttgaaatcactccgcaagcctttctgtgacatcatggagcccaaatttgattttgctatgaaattcaatgctcttgagctcgacgacagtgatataagtctctttgtggccgctatcatctgctgtggtgataggcctggcttattaaatgtaggccatatcgaaaagatgcaggagggaatagttcacgtgctgaggctgcaccttcaaagcaaccaccccgacgacatatttcttttccctaagctcctccagaagatggctgatctgaggcagctggtgaccgaacacgcccagctcgtacaaatcatcaagaaaactgaaagcgacgccgctctgcacccactcctccaggagatttatcgcgatatgtactag

SEQ ID NO: 234444 - DNA, 210 bp, Artificial Sequence
  Description of Artificial Sequence: Synthetic coding sequence
atggtagatacagagtctcctctgtgtccactctcaccactggaagccggtgacttggaatctcccctgtccgaagagttcttacaagagatgggaaatatacaggaaatatcacaatctataggagaggactcttccgggtcatttggcttcactgaataccaatacctgggctcctgtcctgggtctgacggcagcgtcataacttag

SEQ ID NO: 234445 - DNA, 402 bp, Artificial Sequence
  Description of Artificial Sequence: Synthetic coding sequence
atggtcgacaccgagtctccactctgtccactgtcacctctggaagccggagacctggagtctcccctgagtgaggagtttctgcaggaaatgggcaacatccaggagatcagtcagagcatcggtgaggattcttctggttccttcggctttaccgagtatcagtaccttggttcatgccctgggagcgatggcagcgtgattactgatacattatcacctgcttcatcaccgagctctgtgacatacccggtggtacctggttccgtagacgaatctcctagcggcgcactgaacatcgagtgcagaatttgcggagataaggccagcggataccattatggagtccatgcctgtgaaggttgcaaagtcgagggctcctggaatcgtgcatggtggtag

SEQ ID NO: 234446 - DNA, 525 bp, Artificial Sequence
  Description of Artificial Sequence: Synthetic coding sequence
atggtagacacagaatcgcccttgtgcccactttccccattagaagcaggcgacctggaatcccccctcagcgaagaatttctccaagagatgggaaatattcaagagatttcacagtctataggcgaggactcttctggtagctttgggtttacagagtaccagtatcttggaagttgtccgggaagtgatggaagcgtaataactgatactctctcccctgcaagtagtccatcctcagtgacatatcctgtagtgcctggttcagtcgatgagtctccgtccggagctctgaacattgagtgtaggatttgcggagataaggcgagtggctatcattatggcgttcacgcatgcgagggctgtaagggcttcttccgtcgcaccattagactgaagctcgtgtatgacaagtgcgatcggtcatgtaaaatccaaaaaaaaaaccggaataagtgccagtactgcagatttcataagtgcctgtctgtgggaatgtcgcacaatgccttctgtcacacctag

SEQ ID NO: 234447 - DNA, 30 bp, Artificial Sequence
  Description of Artificial Sequence: Synthetic coding sequence
atggtggataccgaatcacccctctgctag

SEQ ID NO: 234448 - DNA, 489 bp, Artificial Sequence
  Description of Artificial Sequence: Synthetic coding sequence
atgaataaagtcaaggcacgcgtgattttgtcaggcaaagctagcaataaccccccttttgtaatccacgatatggagactttatgcatggcagaaaaaacactagtggcaaaactggtggctaacgggatccagaacaaagaggctgaagtacgcatctttcactgttgccagtgtaccagcgtagagactgtcacagaacttacggagttcgctaaggctattccaggcttcgccaacctcgatctcaacgaccaagtgacccttctcaagtatggagtgtatgaggcaatttttgccatgttgagttctgtgatgaataaagacggtatgttggtagcctatggcaacggattcattacccgcgaatttctaaagagtctgcggaaacctttctgtgacataatggagcccaaattcgattttgccatgaaattcaacgccttagaattggatgattcagacatctctcttttcgtcgcggcttag

SEQ ID NO: 234449 - DNA, 1326 bp, Artificial Sequence
  Description of Artificial Sequence: Synthetic coding sequence
atggagcagccacaggaagaagcccctgaggtgcgtgaagaggaagagaaggaagaggtagctgaagcagagggagcccctgagctgaatggcggaccgcagcatgctcttcctagttcctcatataccgatttatctcggtcatcatcgcctccttctctcctggaccagttacagatgggctgcgatggggctagctgcgggtccttgaacatggagtgtcgggtctgtggagacaaggcatcagggtttcactacggagtccacgcctgcgagggctgcaaaggcttcttcagacggaccattcggatgaagcttgagtacgaaaaatgtgagcgcagctgcaagatccagaaaaaaaaccgcaataagtgccagtactgccggttccaaaagtgcctggccctcgggatgtcccataacgcaattcgattcggacgaatgcctgaagcggaaaagcgcaaactcgtagccggtctaaccgccaacgaggggagccaatataatcctcaggtggccgatctgaaggctttcagcaaacacatctataatgcttatctgaaaaactttaacatgacgaagaagaaagccaggtcgatcttgacagggaaggccagccataccgccccattcgtaatccacgacatcgaaaccctgtggcaggctgagaagggcctggtctggaagcagctagtgaacggactgccgccatacaaagagatctctgtgcacgtgttctaccgatgtcagtgtaccacggtagagaccgttcgcgagttaacagagtttgcgaagagcattccttcttttagtagcctgtttttgaacgatcaggtgaccctgttgaagtatggcgtgcatgaagccatctttgccatgttggccagtatagttaacaaggatggacttctggtggctaatggttccggcttcgtcaccagggaattcctcagaagtttgcgcaaaccattcagcgatataattgagccaaagttcgaattcgccgttaagttcaatgctctggagctagatgactctgacctcgccctattcatcgcagctattatcctttgcggcgataggccaggcttgatgaacgtgcccagagtggaagcaattcaggacacaatactgagagctctagaatttcacttgcaggctaatcacccagacgcccaatatctgtttcccaagttgcttcagaagatggccgatcttaggcaacttgtcacagagcatgctcagatgatgcagaggattaagaagacagaaacagaaaccagcctgcaccccttactgcaggagatctacaaagatatgtactag

SEQ ID NO: 234450 - DNA, 1086 bp, Artificial Sequence
  Description of Artificial Sequence: Synthetic coding sequence
atggaacaacctcaggaagaagcaccagaggttcgtgaggaagaggagaaggaggaggtggctgaagctgagggtgcaccagagctgaacggcggaccacaacatgcactgcccagttccagctatactgatttgtctcggagttcgtcacctcctagcttgttggatcagttgcagatgggctgtgacggcgcaagctgcggatcactaaacatggaatgcagagtttgcggtgacaaagcatccggctttcattatggggttcacgcttgcgagggatgtaaggggttctttcgacggactatccgcatgaaattagaatatgaaaagtgtgaacggtcatgtaagatccagaaaaagaatcggaacaaatgccaatactgccgattccagaagtgtctggcgctaggcatgtcgcataatgctattcgttttggcagaatgcccgaggcggagaagcggaagctggtggcaggcctgactgccaatgagggtagccaatataatccccaggttgcagacctgaaagcgtttagtaagcacatctacaatgcctacctcaagaattttaatatgacaaagaagaaagccagatccattcttacagggaaagctagtcatactgccccatttgttatccacgacatcgaaacgctgtggcaggccgaaaaggggctggtgtggaagcaattggtgaacggactcccaccctataaggagatctcagtgcatgtgttctaccgctgtcaatgtactacagtcgagaccgtgcgggaacttacagaatttgctaaaagcataccatcttttagctccctgttcctcaacgatcaggtgactcttctcaagtacggcgtgcatgaggcaatctttgcgatgctcgcatccatcgtcaataaagatggactacttgtcgccaacgggtccggtttcgtgacaagagagttcctgagatctctgcgaaaaccctttagtgatattatcgagccgaagtttgagtttgccgtcaaattcaatgctttagagttggacgacagtgatttggcccttttcattgctgccatcatactttgcggaggtgagtag

SEQ ID NO: 234451 - DNA, 1326 bp, Artificial Sequence
  Description of Artificial Sequence: Synthetic coding sequence
atggagcaaccccaggaagaagctccagaagttagggaagaagaggaaaaagaagaagtcgcagaggctgagggggctcctgagcttaatggtggccctcaacatgcgctgccatcgtcctcgtataccgacctgtcccgctcttctagccccccttctctcttggaccagttgcagatgggctgcgacggcgcttcttgcggctcactgaacatggagtgtcgcgtttgtggcgataaggcaagcggttttcactacggagttcatgcatgtgaagggtgtaaaggtttcttccgcagaacgataaggatgaagttagaatacgaaaagtgcgaaaggtcctgtaagatacaaaaaaagaatcgcaacaaatgccaatactgtaggttccagaaatgcttagcactgggtatgtctcataacgccatccggtttggcaggatgccagaagccgagaagcgcaagctagtggccggtctgactgcaaatgagggatcgcagtacaacccacaagtggcagacttaaaagctttttcaaaacatatctacaacgcctacctcaaaaattttaatatgaccaaaaagaaagcaagatcaattctgaccggcaaagcatcccatacagccccttttgttatccacgacattgagacattgtggcaggcagagaaaggccttgtgtggaagcagcttgtgaatggcctaccgccatacaaggaaatcagcgtgcacgtgttttacagatgtcagtgcacgaccgtggaaaccgttagggagcttaccgagtttgctaaaagcatcccaagcttctccagtctgttcctcaatgaccaagtgacactgcttaagtacggcgtacacgaggccatcttcgctatgctggcatccattgtgaataaagatggacttttggtagcaaacggatcgggcttcgtcacgagggagtttctccggagcttacgaaaaccttttagcgacattattgagcctaagtttgaattcgcagtaaagtttaatgcattggaactcgatgactcagacctggccctctttatcgccgctatcatcctctgtggcgacaggccagggctaatgaacgtccccagagtggaggctattcaagatacgattttgcgcgctctggaattccacctccaggccaaccacccagacgcccagtacctttttccaaagctgttacagaaaatggcagacctcaggcagctcgtaactgagcatgcccagatgatgcaaaggatcaagaaaacagagactgagacaagccttcaccctctgctacaggaaatatacaaagacatgtactag

SEQ ID NO: 234452 - DNA, 1032 bp, Artificial Sequence
  Description of Artificial Sequence: Synthetic coding sequence
atggagcagccacaagaggaagccccagaagtaagagaggaggaggaaaaggaggaagtggcggaggccgaaggggctccggaactgaacgggggaccacaacacgccctgccttcatcgagttataccgctattcgctttgggcgaatgccggaagcggaaaagcgaaagctagtcgcaggcctgactgctaatgaaggttctcagtataacccccaggtggccgacctaaaggcatttagtaaacacatttataatgcatacctgaagaatttcaatatgaccaaaaagaaggcccgatcaatcctcacaggtaaggcaagtcacacagctccattcgtcattcatgacattgagacactctggcaggccgaaaagggtctcgtgtggaaacagttggttaacggccttcctccttataaggaaatttctgtacacgttttttataggtgccagtgtacaacagtagaaacagtgcgtgaactgacggagttcgccaaatccatcccgtccttcagctctctctttttaaacgatcaagttacactgctcaagtacggggttcacgaagctatcttcgccatgctcgctagtatcgtgaataaagatggactcctcgtcgcgaatggttctgggtttgtgacccgcgaattcttaaggtccctgaggaagcccttttctgatatcattgaaccgaaatttgaatttgccgtaaagtttaatgctctggaactagatgatagcgatctcgctctgttcatcgcggctattatcctctgcggcgatagaccgggacttatgaatgtgcctagagtggaagcgattcaggacacaattttaagggctctagaatttcacctccaagctaatcaccccgatgcacagtatctgttcccgaagctgctccagaaaatggcagacttaagacagttagtgacagaacatgcacagatgatgcagcgaatcaagaagaccgaaacagagacatcactgcatccactactgcaggagatttacaaggacatgtattag

SEQ ID NO: 234453 - DNA, 1086 bp, Artificial Sequence
  Description of Artificial Sequence: Synthetic coding sequence
atggaacaacctcaggaggaggcaccagaagtgagagaggaagaggagaaagaggaggtggccgaggccgaaggggctcctgagctgaacggaggcccacaacacgccctgccgagcagcagttacactgatctttccagatccagctccccccctagtttactcgatcagttacaaatgggatgtgacggagcttcgtgtgggtccctcaacatggaatgtcgcgtgtgcggagataaggctagcggctttcactatggtgtccacgcgtgtgaaggctgtaaaggattctttagaaggacaattcggatgaaactcgagtacgaaaagtgcgaacgctcctgtaaaattcagaagaagaatcgcaacaagtgccagtattgccgattccaaaaatgtctggccctggggatgtcccacaatgctattagattcggccgtatgccagaggccgaaaaacgcaagttggtcgccggtctcacagcgaacgaaggatcacagtacaaccctcaggtggccgatctcaaagctttcagcaaacacatttataacgcctacctgaaaaatttcaacatgacgaagaagaaggcgcgttccatactgacagggaaagctagtcacacagctccttttgttattcatgatatcgagaccctctggcaagccgaaaaaggattggtgtggaagcagttggttaacgggctccctccatataaggagattagcgtccacgtcttttatagatgccaatgtacaaccgttgagaccgtgagagaactcactgaattcgctaaaagcatcccttccttttctagcttgtttctgaacgaccaggtgaccctgttgaaatacggtgttcatgaggccatcttcgcaatgttagcctccatcgtaaataaggatggtctgctcgtggcaaatggctccgggtttgtgacgagagagttcttgcggagtctccggaagcccttttctgacataatcgaacccaagttcgagttcgccgtcaagtttaatgctctggagctggacgatagcgacctagctctctttatcgcggctataattctttgcggcggagagtag

SEQ ID NO: 234454 - DNA, 1209 bp, Artificial Sequence
  Description of Artificial Sequence: Synthetic coding sequence
atgcatcaacgagacctttcacgttcctcttcccccccatccctgctggaccagctacagatgggctgcgacggtgccagctgcggctcccttaatatggagtgcagagtttgcggagacaaagcttctggatttcattatggcgtgcacgcatgcgagggctgcaaaggtttctttcggaggactattagaatgaagctcgagtacgagaaatgtgagaggagctgcaaaattcagaagaagaatcgcaataagtgccagtactgccggttccagaagtgtcttgcacttgggatgtcacataacgccatccgcttcgggagaatgccggaagcggaaaaacggaagctagttgctggactgacggcaaatgagggctcacagtacaacccgcaagtggccgatctcaaagcttttagtaagcatatttataatgcatatctcaagaacttcaatatgacaaagaagaaagccaggagtattctaactgggaaagcttctcatactgctcccttcgtgattcacgatatcgaaactctttggcaggcagaaaagggactggtttggaaacagctggttaatgggctgccaccctacaaggaaatctctgtccacgtattctaccgctgtcagtgcactacagttgaaactgtgcgggaactgactgagttcgcaaagagcattccatccttttcatccctgttcctgaacgatcaggtcaccctcttgaagtacggggtacacgaggcaatcttcgccatgttagcttccattgtgaataaagatggcctcctggttgccaacggatcaggatttgtgacccgggagtttctgcgaagcttgcgaaagccattttccgacatcatcgagccgaagttcgagtttgctgtcaagttcaacgccctcgagctggatgactcggaccttgccctttttatcgccgctattatcctgtgcggcgaccgccctggactcatgaacgtgcctcgggttgaagccatccaggatacaatcttgcgagctctggagttccatctccaggcaaaccaccccgacgcacagtatctgttccccaagttgcttcagaaaatggcggaccttagacagctcgtgactgagcacgctcagatgatgcaacgtatcaagaagaccgagaccgagacatcgctccaccccctgctgcaggagatctataaggatatgtattag

SEQ ID NO: 234455 - DNA, 1017 bp, Artificial Sequence
  Description of Artificial Sequence: Synthetic coding sequence
atgaaattagagtacgaaaagtgtgagcgtagctgcaagattcaaaagaaaaatcgaaataaatgtcaatactgtcgctttcaaaaatgcctggccctgggaatgagtcataacgccattcgcttcggccgaatgcccgaggctgagaagcgtaagttagtcgcgggtctgacagctaacgagggctcacagtataatccgcaggtggctgacctcaaagctttcagcaagcacatttacaacgcctacctgaagaattttaacatgacaaagaaaaaggcgagaagcatcctgactggcaaagcttcccacaccgcgcctttcgttatccatgatatcgagaccctgtggcaggccgaaaaaggacttgtgtggaagcagcttgtcaacggcctccctccctataaagagatttctgttcacgtgttctatagatgtcagtgtacaacagttgagacagtgcgagagctcactgagttcgccaagtctatcccatctttttcatccctattcttgaacgatcaggttaccctgctaaagtacggcgtgcacgaggccatcttcgcgatgttagcgagcattgtgaataaagacggtttactcgtcgccaacgggtctggattcgtaacccgcgaattcctgagatccttgcggaagccattcagtgatatcatcgagcctaagtttgagttcgctgtgaaattcaacgcccttgagctggacgacagtgacttagcactttttatagctgccatcattctttgtggggatcggcctggactgatgaacgtcccgagagttgaagctattcaggacaccattcttagggcactcgaatttcatttgcaggcaaaccatccagatgcgcagtacctattcccaaagctcctgcaaaaaatggctgatttgcggcaactggttactgagcatgcccagatgatgcagcgaattaagaagacagaaaccgagacgtcacttcatccactgctccaggagatatataaagacatgtattag

SEQ ID NO: 234456 - DNA, 1518 bp, Artificial Sequence
  Description of Artificial Sequence: Synthetic coding sequence
atgggtgagacactgggcgatagccccatcgaccctgagtcggattctttcactgataccctgagcgcgaacatttcacaggagatgaccatggtcgataccgagatgcccttttggcctaccaatttcggcatctcctcagtcgatctatctgttatggaggatcactctcactcctttgatatcaagccattcaccaccgtcgactttagttccatcagcacgccacactatgaagacatcccattcaccagaaccgatcccgtggtggcagactacaagtacgacctcaaactgcaagagtatcagtccgcgattaaggtggaaccggctagtccgccttactatagtgagaaaacgcagctatacaacaagcctcacgaggaaccatcaaattctttaatggcaatcgaatgcagagtgtgtggggataaggctagcggttttcactatggagtccacgcgtgtgaggggtgcaagggatttttccgcaggacaatccgattaaaactcatttatgaccggtgtgatctgaactgccgtattcacaagaagtcaagaaacaagtgtcagtattgcaggttccagaagtgtctcgccgtggggatgagccataacgccattcggtttgggagaatgccacaggctgagaaggaaaaactcctcgctgagatcagtagcgatatcgaccaactgaatccggagtccgctgatctgcgagctcttgccaaacatctctacgacagttacatcaaaagctttccactaaccaaggcaaaggcaagagccatcttgacaggtaagactacggataagtcaccttttgtgatctacgacatgaacagtctgatgatgggcgaggataaaatcaagttcaaacatatcacgcccctgcaagaacaatcaaaggaagttgccattagaattttccagggctgccagttccgctccgtggaggccgtgcaagaaatcacagagtacgctaagagcatacccggattcgtcaaccttgatctaaacgaccaggtaaccctccttaagtatggggtgcacgaaataatctacacaatgctggcctcgctgatgaataaagatggggtgctgatcagcgaaggtcagggcttcatgactcgcgagttcctcaagtctttgcgaaaaccctttggcgacttcatggaacctaaatttgagtttgctgttaaatttaatgccctggagcttgacgactccgatctggctatttttatcgccgtgatcattctctcaggagatcgcccagggctgttaaacgttaaaccaatcgaagacatacaagacaatcttctgcaggccctggagcttcagcttaagcttaatcacccagagagctcccagctgtttgcaaaattactgcagaagatgaccgatctcaggcaaatagtgacagagcatgttcaattactccaggtgataaagaagaccgagactgacatgtctctgcaccctctgctgcaagaaatctataaggatctctactag

SEQ ID NO: 234457 - DNA, 1434 bp, Artificial Sequence
  Description of Artificial Sequence: Synthetic coding sequence
atgaccatggttgacaccgaaatgccgttttggcctactaattttggcatcagttctgtcgatttatcagtcatggaggatcactcccatagctttgatattaagccgttcaccacagtcgacttttcgtctatttccacgcctcattatgaggatatacctttcaccagaactgaccccgtggtcgctgattataaatacgatctgaaattgcaggagtaccagagcgctatcaaagtagagcccgctagtcccccatattacagcgagaagactcagctttataacaagccacacgaggaacccagcaacagcttgatggctatcgagtgccgtgtgtgcggggataaggccagtgggttccactacggagttcatgcatgcgaaggctgcaagggattcttccggaggacgatccgcctcaagctgatttatgaccggtgcgatcttaattgccgtatccacaagaaaagtcgcaacaaatgtcagtattgtcggttccagaagtgcttagcagtgggcatgtcgcacaatgcaattcggttcggacgaatgccacaggccgagaaggaaaagctgcttgccgagatctcaagcgatatcgaccagctaaacccggagtccgcagacctccgggcactggcaaagcatctatatgatagttatattaaaagttttccattgaccaaagccaaggccagggcaatcctcaccgggaaaaccactgataaatctcctttcgtgatttacgatatgaactcactgatgatgggagaggacaagattaaattcaagcatattactcctctgcaggagcagtcaaaagaagtggccataaggatctttcaggggtgtcagtttagatccgtcgaagccgttcaagaaatcactgaatatgccaaaagcattccaggatttgtaaacttagatctaaacgaccaagttacactgctcaaatacggtgtgcacgaaattatctatactatgctagcatcccttatgaataaagacggcgtactcatttctgagggtcagggctttatgacacgggaattcctgaaatcattgcggaaaccgtttggagactttatggagccgaaattcgagttcgccgtgaagttcaacgccttggagctcgatgattctgatctggccatattcattgcagtgattatactgagcggcgacaggcccggactgcttaacgtgaagcccatcgaggacattcaagacaacctcctgcaggcactggagctgcagctcaaacttaatcaccctgaatcatctcagctttttgctaagcttctgcaaaagatgacagacctgaggcagattgtcacggagcatgttcagctgcttcaggtcatcaaaaaaaccgaaacagacatgagtcttcaccctctgctgcaggaaatatacaaggatctctactag

SEQ ID NO: 234458 - DNA, 753 bp, Artificial Sequence
  Description of Artificial Sequence: Synthetic coding sequence
atgaccatggtggatacggaaatgccattctggcctaccaatttcggcatcagtagcgtggatcttagtgttatggaagatcacagccactcattcgatatcaagccctttaccacggtagacttttcttcaattagtactcctcattacgaggatatcccattcactaggactgatcccgtagtggctgattataagtatgatttgaaactgcaggagtaccagagcgcaatcaaggtggagccagcttctcccccatattattccgagaagacccagttgtataacaagccacacgaggagcccagcaactccctgatggctatcgagtgtcgggtctgcggtgataaagccagcgggtttcactatggggtgcatgcttgcgagggctgtaaggggttcttccgaaggacaattcggctgaagttgatttacgatcggtgcgacctgaattgtcggattcataagaaatcacgcaacaaatgtcaatactgcaggttccaaaaatgccttgcagtcgggatgtcccacaatgctattagattcggcaggatgccgcaggccgaaaaggaaaagctgctggccgagatttcctctgacatcgaccagctcaatcccgagagtgcagacctaagagccctcgcaaagcacctttatgattcctacattaaatcattccctcttacaaaagctaaggccagagctatcctcacagggaagaccactgataagagcaccgcccaggtttgctag

SEQ ID NO: 234459 - DNA, 1434 bp, Artificial Sequence
  Description of Artificial Sequence: Synthetic coding sequence
atgaccatggtggacaccgagatgcctttctggccgacaaattttgggatcagttccgtggatctgagtgtgatggaagaccacagtcactccttcgatatcaaaccttttaccacagtagacttttcttctatatccacgcctcattatgaagacattccatttactcgcacagaccctgtggtggctgattataagtatgacttaaagcttcaagaataccagagcgccattaaagtggaaccagcctcacctccatactactcagagaaaacgcaactgtacaataagccacacgaagagccatcaaacagcctgatggcaatcgaatgtcgcgtgtgcggcgacaaagccagcgggttccattatggcgtccatgcctgcgaagggtgcaaaggcttcttcaggaggactatccgcctgaaactaatctatgataggtgtgacttgaactgcagaatccacaaaaaatcgaggaacaaatgccagtactgtcggttccagaaatgtctagcggtgggaatgtctcacaatgcgatcagatttggccgtatgcctcaggcggaaaaggaaaagcttttggcggagatcagctccgatattgaccagctgaacccagagtccgctgacttgcgcgctctcgcaaaacacctatatgattcctacatcaagtcattccctctaactaaagctaaagcccgtgccattttgaccggcaagactactgataaatccccgttcgtgatttatgacatgaattccctcatgatgggagaggataagatcaagtttaaacacatcacccctctgcaggagcagagtaaggaggtggccatacgtattttccagggttgtcagttccgtagtgttgaagccgtgcaggagatcactgagtatgcgaagagcatacctggattcgtcaacctggatctaaatgatcaggtgacacttctgaaatatggagtccacgaaataatttataccatgcttgccagcctgatgaataaggatggggtcctcatctccgaaggccagggattcatgactcgggaatttctgaaatctttaagaaagccttttggcgatttcatggaacctaaattcgaattcgcagttaaatttaacgccctcgagctcgatgactctgatctggccatctttatagccgtgatcattctctcgggggatcggcctggccttctcaatgtgaagcctatcgaagacatccaggacaatctgttgcaggcactagaactgcagctgaaactaaatcacccggagagcagtcagctcttcgctaaattactccagaagatgactgacctaaggcaaattgtgactgagcacgtgcaactcctgcaggtgatcaagaagactgagaccgacatgagcctgcaccctttgctgcaagagatctacaaggacctgtattag

SEQ ID NO: 234460 - DNA, 1434 bp, Artificial Sequence
  Description of Artificial Sequence: Synthetic coding sequence
atgactatggtcgatactgaaatgcctttttggccgaccaatttcggtatcagttcagttgacctaagcgttatggaagatcattctcactcattcgatatcaagccttttacaaccgtggatttttctagcatcagtaccccccactacgaggacatcccttttacccggacagatcccgttgtggcagattacaagtatgatctcaaactgcaggagtaccagtccgctataaaggtggaacctgcctcacctccatattactctgagaagacgcaattgtataacaagcctcacgaggagccgtcaaacagcctgatggctatcgagtgtagggtttgcggagataaggctagcggctttcattacggtgtccacgcttgtgagggctgtaagggtttcttccgacgcactatccgactgaaactcatttacgatcggtgtgatttgaactgtcggatccacaagaagtcccgaaataagtgtcagtattgtaggttccagaaatgtttagccgttgggatgtcacataacgccatcagattcggcaggatgccccaagccgagaaagaaaagctgctggccgaaatttctagcgacatagatcagttgaatcccgagtccgccgacctccgagcactggccaagcatctgtatgattcctacatcaagtctttcccgcttacaaaggctaaggcccgagctatcttaaccggcaagacgacagacaagtcccctttcgtcatctatgacatgaatagtttgatgatgggcgaggataaaattaagttcaagcacatcacgccactccaggaacagagtaaagaggttgccatacgcattttccaagggtgtcagtttaggtccgtcgaagcagtgcaggagatcacagagtatgccaaatctattccagggttcgtgaacctggatttgaacgaccaagtgactctgcttaaatacggggtgcacgagatcatttacacaatgcttgcctcactcatgaacaaagacggcgtgctgatatctgaaggtcaggggttcatgacccgcgaattcctgaaaagtctgaggaagccctttggcgattttatggagcctaagttcgagtttgccgttaagtttaacgcgttagagctggacgatagcgatctcgcaatctttatcgctgtgatcatcctgtctggagatcgtcccggtctgctaaatgtgaagccaatagaagatatccaggataatctgctgcaggctttagagttacagctgaagcttaatcatccagagagctctcagctgttcgccaagcttctccagaagatgaccgatctgcgacagatcgtgacagaacacgtacagctgttgcaggtaattaaaaaaactgagaccgacatgagcctgcaccccctactgcaagagatttataaagacctgtactag

SEQ ID NO: 234461 - DNA, 1434 bp, Artificial Sequence
  Description of Artificial Sequence: Synthetic coding sequence
atgaccatggttgataccgaaatgcctttctggccgactaacttcggaatttcttccgtagacttgtccgtcatggaagaccactcccacagctttgacattaagcctttcaccaccgtcgatttctcctccattagcactccccattatgaagatattccatttactaggactgatccagtcgtagccgactacaagtatgacctgaaactacaggaataccaaagcgcaattaaagtcgaacccgcatcccctccttactactctgagaagacccagctatataacaagccacacgaggagccttcgaactcattgatggcgatcgaatgccgagtttgcggggataaagcctcgggatttcactacggggtacacgcctgtgagggctgcaagggcttcttcagacggacaattaggctgaagcttatctatgatcggtgtgacttgaactgccgaatccacaagaagtctcgaaacaaatgccaatattgtcgattccagaagtgtctggctgtcggcatgagccataatgctatcaggttcggcaggatgccacaagcagaaaaggagaagttgctcgctgagatctcctctgacatcgatcagttgaaccctgagtctgcagatctgagggccctggccaaacatctatacgactcatatatcaagtcattccctctcacaaaggccaaggccagggccatactcacaggtaaaaccaccgataagtcaccattcgtaatttatgacatgaactcactaatgatgggcgaggacaagattaagttcaagcacatcactcctctgcaagaacagtccaaggaagtggctatcagaatattccagggatgccagttcaggagtgtggaagccgtgcaggagattacagaatacgcaaagagtattccaggatttgtgaacctggacctgaatgatcaagtgaccttgctaaagtacggcgtgcacgaaataatttacacaatgctggcgtccctgatgaacaaggacggcgttctgattagtgaggggcaggggttcatgactcgcgagtttctcaaatccttaaggaaaccgttcggcgactttatggaaccgaagtttgaattcgccgtgaaattcaacgctttggagctggacgattccgatctggcaatcttcatcgctgtgattatcctgtctggagacaggccaggcctgctgaacgtgaaacccatagaagacatccaggataatctactccaggccctggaattgcagctgaagttgaaccaccctgagagctcccagctgttcgcgaaactgctgcaaaagatgacggacctccgtcagatcgtcacagagcacgtccaacttttgcaagtgatcaagaaaacggagactgatatgtcactgcaccccctgctgcaggagatctataaagacctgtattag

SEQ ID NO: 234462 - DNA, 1452 bp, Artificial Sequence
  Description of Artificial Sequence: Synthetic coding sequence
atgaagggattttccgaaatgacaatggtagacactgagatgcctttttggcctaccaatttcggtattagcagtgtagaccttagtgtgatggaagatcactcccactcgtttgatatcaaacccttcaccacagttgacttctcttccatctcaacaccacactacgaagacataccattcactaggactgaccctgtagtggctgactataagtacgatttgaaactccaggagtaccagtccgctatcaaggtcgagccagccagcccgccttactacagtgaaaagactcagctgtacaataaaccgcatgaggagccttccaattcgcttatggctattgagtgtcgagtttgtggcgacaaggcgagtggttttcactacggagtgcatgcatgcgaggggtgtaagggattcttccgccgaaccattagactcaaattgatctacgaccggtgcgacctcaactgtagaatacataagaagtcacgcaataagtgccagtactgtagatttcaaaaatgcctagcagtcggcatgagtcataatgctatccgtttcggtcgcatgccgcaggcagagaaggaaaaactcctggcagagatcagctcagatatcgatcagctgaacccggaatctgccgatctgagagctcttgcgaaacatctgtacgacagttacataaagagcttcccattgactaaggctaaagctcgagctatcctgaccggtaaaacaaccgacaagtcccccttcgtaatctatgacatgaattccttgatgatgggcgaagacaagattaaattcaagcatatcacccctttgcaggaacagtctaaagaggttgccatccgtattttccaggggtgtcagttccgaagcgtggaggcggtgcaagagatcacagaatatgctaagtccattcccggttttgtgaatctggacctcaacgatcaggtaactctcctgaagtacggagttcatgagattatatacaccatgctcgctagcctaatgaataaagacggcgtgctgatctctgaaggccagggctttatgacaagggaattcttaaagtcactcaggaaaccttttggcgatttcatggagccaaagttcgagttcgctgttaagtttaacgcgttagagctcgacgactctgatctggcgatattcatcgcagtcattatcctctctggagaccgtcccggtttacttaatgtcaagcccatagaggatatccaagataatctactccaggccctagagctacagcttaagctcaaccatccagagagctctcaacttttcgccaaactcctgcaaaagatgactgatctccgacagatagttacagaacacgtgcagcttttgcaggtgataaagaaaactgagacggatatgtcgctgcaccctctgctgcaggagatttataaggacctttactag

SEQ ID NO: 234463 - DNA, 399 bp, Artificial Sequence
  Description of Artificial Sequence: Synthetic coding sequence
atgacaatggtcgatactgagatgcccttctggccaacaaattttggaatctccagcgtggacctgtcagtgatggaggatcattcacatagcttcgacataaaaccctttaccacagtagacttttcttctatcagtactccacactacgaggatataccctttactaggacagacccagtggtggccgactacaagtacgatttgaaactccaggagtaccaaagtgccatcaaggtggagccagcctctccaccatattactcagaaaaaacccaactgtataacaagccccacgaggaaccatccaattctcttatggcaattgagtgtcgggtctgcggcgacaaggcttcaggcttccactatggagtgcatgcatgcgagggatgcaagtag

SEQ ID NO: 234464 - DNA, 300 bp, Artificial Sequence
  Description of Artificial Sequence: Synthetic coding sequence
atgactatggtcgacaccgaaatgcccttctggcccacgaattttggtatctcctctgtcgacctgagtgtcatggaagatcattcccattcttttgatatcaaaccattcaccacagtggattttagcagcatatccacacctcattacgaagatatcccttttacgcgaacagatcccgtggtggccgattacaagtacgatctgaaactgcaagagtatcagagcgctattaaggttgaacccgctagccccccttactactccgagaagacccagctgtataataagccacattag

SEQ ID NO: 234465 - DNA, 132 bp, Artificial Sequence
  Description of Artificial Sequence: Synthetic coding sequence
atgaccatggtagatacagagatgccattttggccaactaacttcggaatctcctccgtagacctaagtgttatggaggaccacagccactcctttgacattaagccatttaccacagtggatttcagttag

SEQ ID NO: 234466 - DNA, 747 bp, Artificial Sequence
  Description of Artificial Sequence: Synthetic coding sequence
atggttgatacagagatgcctttctggcccactaatttcgggatcagtagcgtagatctgtccgtgatggaagaccacagccactcttttgacattaaaccattcaccactgtagacttcagttcaatttcaacaccccattacgaggacatccccttcaccaggactgaccccgttgtggccgactacaaatatgacctcaaactgcaggagtatcagagcgccatcaaggtcgagccagcctcacccccttattattccgaaaaaacacagttgtataataagcctcacgaggagccgtccaattcgcttatggccattgagtgcagggtatgcggtgataaggcttctgggtttcactacggagtgcatgcttgcgaagggtgcaaaggctttttcaggcgcactattcggctgaaacttatctatgatagatgcgatctgaattgcaggattcacaagaaatctcgcaataagtgccagtattgtcggtttcagaaatgcttagcggtagggatgtctcataacgctatcaggttcggccgtatgccccaggcagaaaaggaaaagctgctcgctgagatcagctccgatatcgatcaactgaatccagaaagcgctgaccttcgtgcccttgccaaacatctttacgactcatacattaaaagcttcccactgaccaaagctaaggcccgtgctattctaaccggaaaaacgacagataagtccacggcacaggtttgctag

SEQ ID NO: 234467 - DNA, 2955 bp, Artificial Sequence
  Description of Artificial Sequence: Synthetic coding sequence
atggctggcaacgactgcggagcactcctggacgaggagctgtcatcattcttcctgaactacctagctgacacgcagggcggaggcagtggggaagagcagctgtatgccgattttccggagttggacctctctcaactggatgcatcggatttcgactccgcaacctgcttcggagaattacagtggtgccccgagaactccgagacggagcccaatcagtactcccccgacgacagcgagctattccagattgattccgaaaatgaagcccttctcgcagaattgactaaaacgctggacgacatccctgaagacgatgtggggcttgccgcatttcccgcattagatgggggagatgccttgtcatgtacttccgcctcccccgcaccttcatccgcccctccatcccccgctccagaaaagccttccgcacctgccccagaggtggatgaactgagcctcgccgattcgactcaagataaaaaggccccaatgatgcaaagtcagagtcgatcatgtacagaattacacaaacaccttaccagtgcacaatgctgtctccaggatcgcggattgcagcccccttgtctgcagtcaccaagactgcccgctaaagaagataaggagcctggagaggattgtccttccccccagcctgctccggcttcccctcgtgatagtctcgctctggggcgtgccgatcccggtgccccagtgagccaggaagacatgcaggcaatggtccagctaatcagatacatgcacacatattgtcttccacagagaaagctacctcctcagaccccggagcctctgccaaaagcctgcagcaatccatctcagcaggtccggtctaggccttggtcacgccaccattcaaaggcttcttgggccgaattcagcatcctccgcgaattactggcccaggatgtgctgtgcgatgttagcaagccataccgattagccactcctgtgtacgcctctttgactccccgatcgagacctcgcccacccaaagattcgcaggccagcccgggtagaccctctagcgtggaagaggtgcggattgcagcatccccaaagtctactggcccaaggccttccttacggcctctccggctggaagtgaaacgggaggtgcggaggcccgcacgtctgcaacagcaagaagaggaagacgaggaagaagaagaggaggaggaagaggaggaaaaagaagaggaagaagagtggggccgtaagaggccaggccgaggtctgccttggaccaagctaggtcgaaagcttgagagttctgtctgcccagttcggaggagccgaaggttaaaccccgaactcggtccatggttgacatttgccgatgaacctttggtaccaagcgaacctcaaggcgcacttcctagtctgtgcctggccccaaaggcctatgacgtggagcgcgagctaggcagccctacagatgaggactcaggtcaagaccagcagttgctgcgcggtccacaaatacccgcactggaatcaccctgcgaaagcgggtgcggcgacatggacgaggaccctagctgtcctcagctccccccaagagacagcccccgttgtctaatgcttgcactttcacagagcgatccaacattcggcaagaagtcattcgagcaaaccctgacggtcgagctttgcgggactgcagggctcactccccctaccaccccaccgtataaaccgacggaggaagaccccttcaagccagacattaagcatagccttggaaaggagatcgctctttcactgccgagccctgagggcctgtcccttaaggctacccctggcgctgcacataagcttcctaagaagcaccctgagagaagtgagctgctcagccaccttaggcatgccaccgcgcagcccgcaagccaggccggtcaaaagcgccctttctcgtgcagtttcggcgatcacgactattgtcaggtccttagacctgagggcgtcctgcagagaaaggtgctcaggtcgtgggaaccttcaggggtccacttagaagactggccccagcagggagccccttgggcagaggcccaggcccctggcagggaagaagacaggagctgtgatgctggcgctcctcccaaagattcaacactgctgcgggaccacgagatcagggcaagccttaccaagcatttcggactgttagaaaccgctcttgaagaggaagacctcgcctcctgtaaaagtcccgagtatgatactgtatttgaggattcctcgtctagctcaggcgaatcctcctttcttccagaagaagaagaggaagaaggagaggaggaagaagaggacgatgaggaagaagattcgggagtgagtccaacatgtagtgatcactgcccctaccaatccccgccatccaaagccaataggcagttgtgttctcgaagtaggagctcaagcgggtcatctccttgccatagctggagccctgcaacccgccgaaacttcaggtgtgagagtcggggaccctgtagcgatagaaccccttccatcaggcacgccaggaagcgaagagaaaaagccataggcgaagggagagtggtctacattcaaaacctaagcagtgatatgtcctctcgtgaactcaagaggcgattcgaagtcttcggggaaatcgaggagtgtgaggtgctcacacgcaatcgtcggggtgagaaatatggcttcattacctacagatgttccgagcacgccgcactaagcctgactaagggtgcggctctgcgcaaaaggaacgaaccatcctttcaactcagctatggtggtcttagacatttctgctggccgaggtatacagattatgattccaacagcgaggaagcattgcccgcttccggcaagtcaaagtacgaagctatggattttgactctctgctgaaggaggctcagcagagtttgcactag

SEQ ID NO: 234468 - DNA, 2880 bp, Artificial Sequence
  Description of Artificial Sequence: Synthetic coding sequence
atgggcggaggatccggtgaggaacagctctacgccgattttcccgaattggacctgtcccagctggatgcatcagatttcgacagcgctacgtgctttggtgagctccaatggtgtcccgaaaatagcgagacagagcccaaccaatattctcccgacgattcagagctctttcagatcgattcagaaaacgaagctctgctggccgaattaactaaaactctggatgacatccccgaagatgacgtggggctggccgcattccctgccttggacggtggggacgctctcagctgtaccagcgcaagccctgctccctccagtgcccctccctcacctgcccctgaaaagcctagtgcacccgctcccgaggtggacgaactgtccctcgcggactctactcaagacaagaaggccccaatgatgcagtcccagagccggtcatgcaccgagctccacaaacatcttacatccgcacagtgttgtctacaagacaggggattgcaacctccctgcctgcaatcccccagactgccagccaaagaggacaaggaaccaggcgaagattgtccttccccacagccagcccctgccagtcccagggattcactcgcgctcggcagggcagaccctggtgccccagtgagccaagaggatatgcaggccatggtccaattgatcaggtatatgcatacctactgcttgcctcagcgcaaactgcctcctcagactccagagccgcttcccaaagcctgcagcaacccctcgcaacaggtgaggagcaggccctggtcccggcaccattcaaaggccagctgggccgagttctccatcttacgggaactcctggctcaagacgtgttgtgcgacgtctccaagccctacagattggccacacccgtgtacgcaagcctgacgcctcgttctcggccacgccctcctaaggattcccaagcttcacccggtagaccctccagcgtggaggaagttcggatagcagcaagccctaagtcaacaggtccacggccttccctgcgccctttgagactggaggtgaagagggaggtgcgtcgcccagctagattacagcagcaggaggaagaggatgaagaggaggaagaagaagaggaggaagaggagaaggaagaggaagaagaatggggcaggaagcgccctgggagaggcctgccatggacgaagctcggcaggaagctggagtcatccgtatgcccagtgcgccgatcccggcgtttgaaccctgagttaggcccatggctcacatttgccgatgagccattagttccatctgagcctcagggggctctgccttcactgtgcctggcaccgaaggcttacgacgtggagagagaactggggtcaccaacagacgaggacagtgggcaggatcagcagttactcagaggcccacaaattccagcactcgaatccccttgcgaatctgggtgtggtgatatggatgaagatcctagctgccctcagctgccccctagagacagtccgagatgcctgatgttagcgttgtctcagtcagatcccacttttgggaagaagtcctttgagcagactctaactgtggaattatgtggaacagccggtctgaccccccctaccacccccccttataaacctacagaagaggatccattcaagccagacatcaaacactctctggggaaggaaattgctctgtccctcccctcacccgaagggctgtccctgaaggccactcctggcgctgcacacaagctgcccaagaaacacccggagcggtcggagctactgagccatcttcggcacgctacagctcagcccgctagtcaggcaggccagaagcgccctttttcctgttcctttggagaccacgactattgccaggttctgcgacctgaaggggtgctacaacgaaaagtactcagatcatgggaaccatcaggggtccacttagaagactggcctcagcagggtgccccatgggcagaggcccaggccccaggtcgggaggaggatcgttcttgcgacgctggcgctccaccaaaggattcgacactgctccgggaccacgaaatccgcgcatcactgaccaaacacttcggcctgctggaaacggctcttgaagaggaagatcttgcctcgtgcaagtcaccagaatacgacacagtatttgaggacagcagctcatcgagtggcgagtcctcattcctgcccgaagaggaggaggaggaaggggaggaggaggaagaagatgacgaagaagaggatagcggggtctccccaacctgctccgatcactgcccctatcagtcccctccatcaaaggccaataggcaactctgctctagatctcgtagtagctctggtagttccccatgccattcctggtctcccgctacccgccgtaactttcgctgtgagagccgcggaccttgtagtgaccgaactccgtccattcgccacgccagaaaacgtagagaaaaagccatcggcgagggcagagtcgtgtacatacagaacctgagcagcgacatgtcaagccgcgagctgaaaaggagattcgaagtgtttggagaaatcgaggagtgcgaggtgttgacgagaaatcgacgaggggaaaaatatggatttatcacttatagatgcagcgaacacgcggctctatctctcactaagggagcggctctgcgtaagcgcaatgagccgtccttccagctgagttatggaggtctgcgacatttttgttggcctcggtacaccgattatgattccaactctgaggaagcgctgcctgcttcaggcaagagcaagtatgaggctatggattttgacagtctgttaaaggaggcccaacagagtctgcactag

SEQ ID NO: 234469 - DNA, 2397 bp, Artificial Sequence
  Description of Artificial Sequence: Synthetic coding sequence
atggcatgggatatgtgcaaccaagatagtgaatcagtgtggtccgacatcgagtgcgctgcgttggtgggcgaggaccagccactgtgccccgacctgccagagctcgatctgtctgagctcgatgtgaacgatctggacaccgattctttcctcggagggctgaagtggtgtagcgatcagtctgagatcatcagtaaccaatataacaacgagccaagcaacatcttcgagaagatcgatgaggagaacgaggccaacctcctggcagtcctgacagaaactcttgattccctgcccgtcgatgaggacgggttgccatccttcgatgccctcaccgatggcgatgtcaccaccgacaacgaggccagcccatccagtatgccagacggcacaccgccaccgcaggaggctgaggaacctagcctgctaaagaaactgcttctggctcccgctaatacacagctgtcgtacaacgaatgcagcggcctgtcaactcagaaccacgctaatcacaaccaccgcatacggaccaacccagccatcgttaagaccgagaacagctggtctaacaaggcaaagtctatttgtcagcagcagaagccccagcgtcggccttgcagtgaattgttgaaatacctcaccactaacgatgatccaccccataccaagccgacagaaaatcggaacagttcgcgcgacaaatgtacctctaaaaagaaatcccatacgcagtctcagtcgcaacacctccaggccaagccaacaaccctgtctcttcctttgaccccagaatcccccaatgaccccaaagggtcccctttcgaaaacaagacaattgagcgcaccctttctgtggagctcagtggcactgccggtctgactccacccaccacaccccctcataaagctaatcaggataacccattccgggctagtccaaaattgaaatcaagctgcaagaccgtggtgccgcctccctccaaaaagccccgatacagcgaatctagtgggacccaggggaacaattccactaaaaagggccctgagcaaagcgagctgtatgctcagctgtctaagagttccgttctgactggcggacacgaggagcgaaagactaagcgcccttcactccggctgttcggggaccacgactattgtcagagcataaattctaagaccgaaattttaatcaatatcagccaggagctgcaagacagtcgtcagctggagaataaagacgtgagctccgactggcagggccagatatgcagttccactgatagcgatcagtgctatctgagagaaaccctcgaggccagcaagcaggtgtcgccatgttctacccggaaacaactgcaggatcaggagattcgggctgaattaaacaagcatttcgggcatccgtcccaggccgtatttgacgacgaggctgacaaaaccggggaactgcgtgacagtgatttctcaaatgaacagttcagcaagttaccaatgttcattaactctggactcgccatggacggactgtttgatgacagcgaggatgaatccgataaactctcttatccatgggatgggacgcagtcctattctttgttcaacgtttctccaagctgtagttcctttaactcaccatgccgcgattcagtatctcctcctaagagcctcttttcacagaggccacagaggatgcgctcccggtcaaggtcttttagcagacatcgctcttgttcaaggtctccctatagtagatctaggagtcgcagcccgggatcccgatcatcatcaaggtcgtgctattactatgagtcatctcactaccgacatcgcacacaccgaaactctccactatacgtgagatccaggagtcggtctccttactcaagaaggccaaggtacgactcatacgaggagtatcaacatgagagacttaaaagggaggagtaccggcgagagtacgaaaaacgtgaaagtgagagagccaagcaacgcgaaagacagcgtcagaaagcaattgaggagcgcagggttatatacgtgggaaaaattaggccagatactactagaacagaactgcgagacaggtttgaagtgttcggggagatagaggagtgcaccgttaatctgcgcgacgacggtgacagttacggtttcattacatatcgatacacgtgcgatgcttttgcagcgctcgagaacgggtatacactcaggaggagcaacgagaccgatttcgagctgtatttttgtgggcgaaagcagtttttcaaatcaaattacgcagacctggatagtaattctgatgactttgacccagcttcaactaagtcaaaatacgactccctggactttgactctctcctgaaggaggcccaacggtctctccgccgatag

SEQ ID NO: 234470 - DNA, 3072 bp, Artificial Sequence
  Description of Artificial Sequence: Synthetic coding sequence
atggcaggaaatgactgtggtgcgctgttagacgaggaactgtcctccttttttctcaattaccttgccgacacccaaggaggtgggagcggggaagaacaactctacgccgactttcctgaattggacctgtctcaactcgacgcctccgatttcgatagcgctacttgttttggggagctgcagtggtgtcctgagaactccgaaactgagcctaaccagtatagccccgacgactccgagctgtttcagatagatagtgaaaacgaggctctcctggccgagttaaccaagacccttgacgacatcccggaggatgacgtgggtctggccgcttttcctgccttagatgggggtgacgcactctcatgcacttctgctagtcctgccccaagctcagcaccaccatctccagcgccagaaaagccatccgccccagcaccagaggtagacgagctgagtttacttcagaagctgttgctggccactagctaccccacaagcagcagcgatacgcagaaggagggcactgcgtggagacaggctgggctacgaagcaagtctcaacgaccttgcgtcaaggctgatagtactcaggacaaaaaagcccctatgatgcagagccagtcacggtcatgcaccgagctgcataagcaccttacatccgcacagtgttgcttacaggaccggggattgcaaccgccttgcctccagagtcccagacttccagctaaggaggacaaagagcctggggaggattgtccatctccgcagccagcaccggctagtcctcgagacagcctcgcgctgggtcgggctgaccccggagccccagtgagccaagaagatatgcaggccatggtgcagttgatacgatacatgcatacttactgcttgccccagcggaaactgcccccacagaccccagagcctctgccaaaagcgtgttcgaatccttcgcagcaggtaagatctagaccttggtcacgtcatcacagtaaggcttcttgggctgaattttccatcctgagagaactgttggcccaggacgttctgtgcgacgtctctaagccatacagactggctaccccagtgtatgccagtctcacaccgagatcaagaccaaggccccctaaggattcacaggccagcccaggacgcccatcgagtgtcgaggaagttcggatcgcggcttcacctaagagcaccggaccccgtccgagcctgcgacccttgcgcctggaggtaaagcgcgaagtcagacgacccgcaaggctgcagcagcaagaagaagaagatgaagaagaagaagaggaagaggaggaggaggagaaggaagaggaggaagaatgggggagaaagcggccaggtagaggcctcccgtggactaagctgggccgaaaactggagagctcagtctgcccagtccgcagaagtcggaggctcaatcctgagttgggcccatggttgaccttcgctgatgagccgctggtgcctagcgagcctcaaggcgctttgccttcactgtgcctggcccctaaagcctacgacgtggagcgcgaactgggatcccctactgacgaagactctggccaggaccagcagctactcagaggcccacagattcccgctctcgagtcgccatgtgagagtggatgcggcgatatggacgaagaccctagttgtcctcagttgccccctcgggattctcctcgctgcctaatgcttgccctttcccagagcgaccctacatttggaaaaaaaagcttcgagcagacgctgacagttgagctctgtggaactgccggtctgaccccccctaccacccccccttataagccaacagaggaggacccttttaagccggatatcaaacatagcctgggaaaggagattgctctgagcctcccatcccccgaaggactgtcactcaaggctacacctggggctgctcacaagctcccaaagaagcaccccgaacgatctgaactactatcccacctacgccacgccacagcccagccagccagccaggctgggcaaaaacgacctttcagctgctccttcggtgatcacgattattgccaagttctcaggcccgaaggagtgttgcagcggaaagtgctcaggagctgggagccctccggcgtgcaccttgaagactggccccagcagggagctccctgggctgaggcgcaggcgccaggaagagaggaggaccggtcatgcgatgctggtgccccacctaaggacagtacgctgttgagggaccacgagatcagggcctctctgacaaagcactttggcctgcttgagacagctttagaagaagaggacttggccagctgcaagtccccagagtatgacactgtcttcgaggactcatccagctctagtggagaatcctccttcctcccggaggaggaggaggaggagggagaggaagaagaagaggacgacgaagaagaggacagtggcgtatcccctacctgcagtgatcactgcccatatcaatcccccccttccaaggccaatcgccagttatgttccaggtctaggtcctcttcgggatctagtccctgtcactcttggtccccagcgacccgaaggaacttcaggtgtgagtcccgaggaccctgcagtgatcgcactccttcaatcaggcatgcgaggaagcgcagggaaaaggctataggcgaggggcgtgtggtttacatacagaatctttccagcgacatgagcagtagggaactcaagcggcgatttgaggtcttcggcgagatcgaagaatgcgaggtactcactaggaaccggcgtggagagaaatacgggttcattacataccgatgttccgagcacgccgcactgtccctgacgaaaggtgccgctcttcgcaaacgtaatgaaccctcgttccagctttcctacggcggattgcggcatttttgctggcccaggtataccgattatgatagtaacagcgaagaagccctgccggcttcaggaaagtctaagtacgaagcgatggatttcgactcattgctgaaggaggcgcagcaatcgctgcactag

SEQ ID NO: 234471 - DNA, 3054 bp, Artificial Sequence
  Description of Artificial Sequence: Synthetic coding sequence
atggccggtaatgactgtggggctctgctggacgaagagctttcgtctttcttcctaaattacttggcagacacgcaaggcggaggtagtggagaggagcagctatatgccgatttcccggaattagacttgagccaactggatgcaagtgatttcgacagcgccacatgtttcggggagctccaatggtgtcccgagaatagcgaaacagagcccaatcagtattctccggacgactccgaactttttcagatagattccgagaacgaggctctgctggccgaactgacaaaaaccctggacgatatcccagaggatgacgtaggcctcgcagccttccccgcactggacggtggggacgcactctcatgcacgagcgcaagtccagccccatcctcagctcctccaagtccagctcccgaaaagccaagtgcccctgcccctgaggtcgatgagctgtccctgctgcagaaattgctgctggctacttcttaccctacaagcagcagtgacacacaaaaggagggtactgcctggcggcaagcgggactgagatcaaagtcacagagaccatgcgtgaaggctgacagcacccaggacaaaaaggcgcctatgatgcagagtcagtcccgatcctgtactgaactccataagcatctgactagcgcccaatgctgtcttcaggaccggggattgcagcctccttgtctgcagagtccacggctgcccgctaaagaggataaggagccgggagaggactgcccatcaccgcagcccgctcccgcaagtccaagagattctctcgctttgggcagagccgaccccggtgcacccgtgtcacaagaggacatgcaggcaatggtgcagctcatacgctacatgcatacctactgtttaccacagaggaaattaccacctcaaactccagaacctctgcccaaggcctgttctaatccgagtcaacaggtccgctcacgaccttggagccggcatcactcaaaggcgtcctgggctgagttttcgatcctgagggaactcctggctcaggatgtcctgtgtgatgtctctaagccttatagactggctacaccggtatacgcttctttaacaccacgttcacggcctagaccccctaaggacagccaggcctctcccggacgaccatcctctgtggaggaagtgaggatcgccgcaagccctaagtcgactgggccaaggcctagcctgagacctctgcgcctcgaagtgaaacgagaggtgcgtcggccagcaagacttcagcagcaggaagaggaggacgaggaagaagaggaggaggaggaggaggaggagaaggaggaggaggaagagtggggacggaagcgtcccggaagggggctgccctggacaaaactggggagaaagctggagtcatccgtgtgtcccgttaggcggtctaggagattgaacccagagctcgggccttggctgacattcgccgacgagcctctcgtccctagcgagccccagggtgcgctgccttcactgtgtcttgcgcctaaagcgtatgacgttgagagagagttggggagccccactgatgaagacagcgggcaagatcagcagttgttgagaggccctcagattccagctcttgagagtccatgcgaatccggttgcggggacatggacgaggaccccagttgccctcagctgcctcctcgggacagccctcgctgtctcatgctggccctgtcccaaagtgaccctacttttggcaaaaagagcttcgaacagaccctgacggtcgaactgtgtggcacagccggacttacacctcccacaacaccaccctataagcctaccgaagaggatccatttaaaccagacataaagcactcccttggaaaagagattgctctgtctctgccctcccctgagggtttatcgcttaaggctacaccaggggcagctcataagctgccaaaaaagcaccccgagcggtcagaattgctaagccatcttcgtcatgcaactgcacagcctgcgtcccaggctgggcaaaaaaggcctttcagttgctcctttggagatcatgattactgtcaagtgttaagaccggagggagtcctccaaagaaaagtgcttcggtcctgggagcccagcggggtacacctcgaagactggccccagcaaggagccccatgggccgaggcacaagcacccggtagggaggaagaccgctcctgtgacgccggagcgcctcccaaggactccaccctgctccgggaccacgagattcgggcaagcctgactaaacacttcgggctattggaaactgccctagaagaggaggacctggcctcatgcaaaagtccagagtatgataccgtgttcgaggacagctcttccagtagcggagagagctcattcctccccgaggaggaagaagaggagggcgaggaagaggaagaggacgatgaggaagaggattccggggtgtctccaacttgctccgatcactgcccttaccagtctcctccgtctaaagctaaccgtcagctatgctcccggagccggtcttcgtccggcagttccccttgccactcctggtcccctgccacccggaggaactttagatgcgaatctaggggcccttgctcagacaggacaccatccattcggcacgcacggaagaggcgcgaaaaggctatcggtgaaggacgggtcgtgtatatacagaatctgtcttcagatatgagcagccgggaactgaagcgccgattcgaagtctttggcgaaattgaagaatgtgaagtcctcacccgtaaccgaagaggtgaaaaatacggatttataacatacagatgctctgagcacgccgctctgagtctgactaaaggagccgctttgcggaagaggaacgagccgagtttccaattgtcctacggaggcctaagacacttttgttggccgaggtataccgattacggtaagcctttaaaaccctctcattcactggttcggctcaaagcttgggaggcggtcccctctcttaacaagacacaaagctag

SEQ ID NO: 234472 - DNA, 471 bp, Artificial Sequence
  Description of Artificial Sequence: Synthetic coding sequence
atggcggtggggaaattcctgctgggctcattgttactgctttccttgcaactaggtcaagggtggggaccggacgccaggggagtcccggtggccgacggcgaattctcctctgagcaggttgccaaagcgggaggaacgtggctgggcacgcaccgtccattggccagactcagaagggccctgagcgggccatgtcagctgtggtcactcaccctgtcagtggccgagcttggcctggggtacgcatccgaggagaaggtgatctttcgatattgtgccggatcctgccctaggggtgccagaacacaacatggccttgccctggcccgacttcagggccaggggagagcccacggcggtccctgctgtagacccactagatacaccgatgtagccttcctcgacgacagacatcgttggcagagactgccccagctgagcgccgctgcctgcggatgtggcggatag

SEQ ID NO: 234473 - DNA, 1422 bp, Artificial Sequence
  Description of Artificial Sequence: Synthetic coding sequence
atggggcagagcggtcgctctcgacaccagaagcgcgctagagcacaagcccagctgaggaatctggaggcgtatgctgccaacccgcacagctttgtgttcacccgaggctgcactgggcgaaacatccgacagctttctctggacgtccgcagggtcatggaacccctgacagcctcccggctacaggtacggaaaaaaaattcacttaaggactgcgttgccgtcgcaggtcctctaggcgtcacacattttctaatattgagcaagacagaaaccaatgtttacttcaaactgatgaggctgcctggtgggcctactctgacatttcaggtcaagaaatactctcttgtacgtgacgtggtgagctcactgaggaggcaccgtatgcatgagcaacagtttgcccaccccccactgctggtacttaacagttttggtccccacgggatgcatgtgaagctaatggcaacaatgtttcaaaatctcttcccatctatcaacgtgcataaggttaatcttaacactatcaagaggtgccttctcattgattataatcctgatagccaagagctggactttcgtcactattctatcaaagtagtgcctgtcggcgctagtcggggtatgaagaagctgctccaggagaagtttcccaacatgagccgcctgcaggacatatcagagctgctcgccaccggtgcaggcttatcggaatctgaggctgagcccgatggtgatcataatatcaccgagcttccacaggccgtggctggcagaggcaatatgcgagcacagcaaagtgccgtgagactcaccgaaatcggcccaaggatgacattgcagctgatcaaagtacaggagggtgtgggtgagggaaaagtgatgtttcactcatttgtcagtaagactgaggaagaactgcaagctattctggaggctaaagaaaagaagctgaggctgaaggcgcaacggcaggcacaacaagcacaaaatgtacaaaggaagcaggagcagagagaggcccaccggaagaagagtctcgaaggtatgaaaaaagctcgcgtcggcggtagcgatgaggaagccagcggaatccctagccggacggcgtctctggaactcggggaagacgacgacgaacaggaggacgacgatatcgagtatttttgtcaggccgtgggtgaagctcccagcgaggacctgttccctgaagctaaacagaaacgcttggccaaaagcccgggacgaaagcggaagaggtgggagatggacagaggacggggacgcctctgcgaccagaaatttccaaaaactaaagacaaatcacagggcgctcaggcaagacggggaccgagaggcgctagtcgagatggaggtcgaggtcgaggcagaggcagacccggaaaacgcgtcgcctag

SEQ ID NO: 234474 - DNA, 1383 bp, Artificial Sequence
  Description of Artificial Sequence: Synthetic coding sequence
atgggacagagcgggaggagccgccatcaaaagagagcccgtgctcaggcccaactacgtaacctcgaggcttacgcagctaatccacattctttcgtcttcactagaggttgcacaggtagaaatattcgccagctatccctcgacgtgaggcgcgtgatggaacccttgacagcatctcgtctgcaagtacgaaagaagaattctctcaaggactgtgtggccgtggcaggccctctcggcgtgactcacttcctgatcctgtctaagacggagaccaatgtttacttcaagctgatgcggcttcctggcggacccacactcacatttcaagtcaaaaagtattcactcgtgagagatgtggtaagctctcttaggagacacagaatgcacgagcagcagtttgcccaccccccactgctggtgttgaatagtttcggtcctcacgggatgcacgtcaagctcatggcaacgatgtttcagaacctcttccccagcatcaacgtccacaaagtgaatttgaacactatcaagaggtgtcttctcatagactataacccggattctcaggagcttgacttccgtcattattctatcaaggtcgtgcccgtgggggcatccagaggcatgaaaaaactgttgcaagaaaaattcccaaacatgtcaaggctccaggacatctccgagctgcttgctactggcgctggcctaagtgagagcgaagccgaaccagacggggaccacaatataacagaactgccccaggccgtggctggcagaggaaatatgcgggctcagcaatccgctgtaagacttacagaaatcggccctcggatgacgctgcagttgatcaaggtccaggagggtgttggagagggaaaagttatgttccattctttcgtgtccaagaccgaagaggagttgcaagccatcctggaggctaaagaaaagaaactgaggcttaaagctcagcggcaagctcaacaggctcaaaacgtccagcgcaaacaggagcagagagaggctcaccggaagaaatccctggagggcatgaagaaagcaagggtgggcggatcagacgaagaagcctctgggataccctccaggactgcctcactcgagctgggagaggacgacgacgagcaagaggacgatgatatcgaatacttttgccaggccgtgggcgaagccccttctgaggacctctttcccgaggctaagcagaagcggctagccaaatccccaggcaggaagcgaaaaagatgggaaatggatcggggaagagggcgactctgtgaccagaagttccctaaaactaaggacaagtcccaggatggaggtcgaggccgaggaagaggtcgccctggcaaacgtgtcgcctag

SEQ ID NO: 234475 - DNA, 2385 bp, Artificial Sequence
  Description of Artificial Sequence: Synthetic coding sequence
atgggccagagcgggagaagtaggcatcagaagcgggctcgggcacaagctcaactgagaaaccttgaagcttatgcggcaaatccccactccttcgtgttcacaaggggttgcactggcagaaatattaggcaactaagcctagatgtgcggagagtcatggaacccctcactgcttcccgcctgcaagtcaggaagaagaattctttgaaggactgtgttgctgtggctggaccactcggggttacccactttctgatcctgtcaaaaactgaaactaacgtctatttcaaactcatgcgattacccggaggacctactctgactttccaagttaagaaatacagcctggtgcgagacgtcgtgtccagtctcagacgacacaggatgcacgaacagcagtttgcccacccacccctcctagttctgaactcctttggtcctcacggtatgcacgtgaaattgatggctaccatgtttcaaaatctgtttccttctatcaatgttcataaggtgaaccttaatacgatcaagaggtgccttcttattgactataatcccgattcccaagaactggattttaggcactacagcattaaagtggtcccagtgggtgcaagcagaggaatgaagaagctgctgcaggagaaattccccaatatgagccgtctccaggacattagcgagctgctcgcaaccggggcaggactctccgagtcagaggccgaaccagacggggatcacaatattacagaactcccacaggctgtggctgggagaggaaacatgcgggcacagcagagcgccgtgaggcttacagaaatagggcctcgcatgacactccagctgatcaaggtgcaggagggcgtcggagaaggaaaagtgatgttccacagctttgttagtaaaacagaggaagaattgcaggccatcctcgaggccaaggaaaagaagctccggttgaaagcccaacgccaagcacagcaggctcaaaacgtccagaggaaacaggagcagagagaagctcatcggaaaaagagcctcgagggaatgaaaaaagcaagggttgggggttccgacgaagaggcttcaggcatcccctcgcgtaccgcgtcacttgagcttggagaagatgacgacgagcaggaagatgatgacattgagtacttctgccaagccgtgggagaagcaccaagcgaagatctgtttccagaggccaagcagaagcgcctcgcaaaaagccccggtcgcaaacgtaaacgatgggaaatggaccgtggagccaaatcctgtccagccaactttctagcagccgctgacgataaactcagtgggtttcaaggggattttctgtggcctattctggtagttgaattccttgttgcggtggcgtccaatggcttggccctctacaggttctcaatccggaaacaaagaccttggcaccccgctgtcgtgttttctgtgcagctggccgtgagtgatttactgtgtgctctcacactgccgccactggccgcttacctttatccaccgaaacactggcgatatggcgaagccgcttgccgactggaaaggtttttgttcacatgcaatctgctcgggtcagtcattttcatcacttgtataagcctgaatagatacctcggaatcgtccacccattcttcgccaggtcacatttacgccctaagcatgcatgggctgtttcagcagcgggatgggtgctcgctgcgctgctcgccatgcctaccctctcgttcagccatctgaagcgcccacagcagggcgctggtaattgtagcgtagccagacccgaagcatgtattaagtgtctgggaactgctgaccacggcctggctgcctacagagcatacagcctggtgttagctggccttggctgtggactccctttgctgctcaccctggccgcttacggtgcactgggcagggccgttctacgaagcccaggtatgactgttgctgagaaactacgagtcgccgctctggtagcatccggcgtggctctgtacgcctcatcatacgtgccctatcacattatgagagtgctgaacgtagacgctcgaagacgatggtctactcgctgtccaagcttcgctgatatcgcccaggctactgccgcactcgagttgggcccttatgtcggctaccaagtgatgcgcggactgatgccgctggcgttttgcgtccaccctctgttatatatggctgcagtaccttccctgggttgctgttgtcgccattgtcccggatatagagactcttggaatccagaggatgccaagtcaactggccaggcactcccattgaatgctacggcagcacccaagccttcggagccgcagtccagagagttgtctcagtag

SEQ ID NO: 234476 - DNA, 1374 bp, Artificial Sequence
  Description of Artificial Sequence: Synthetic coding sequence
atggctcagccacccaggctttcgagaagcggagcaagtagcctctgggacccagccagtcccgctcctaccagcggccctcgccctcggctctgggaaggccaggacgtgttggccagatggacagatggactgctttatctaggcacaattaaaaaggtggattcagccagggaagtttgtctagtgcagtttgaagacgacagtcagtttctggtgctgtggaaggacatctctcctgcagctctgccaggcgaagaacttttatgctgtgtatgccgtagtgagaccgtggtccctgggaaccggcttgtgtcatgcgagaagtgcaggcacgcataccaccaggattgccacgttcccagagcacccgctcctggcgaaggtgaggggacgagctgggtctgtagacaatgtgttttcgccattgccaccaagcgcggaggcgcactgaaaaaagggccatacgcaagagctatgctgggcatgaagctcagtctgccatacgggcttaaggggcttgattgggatgccggtcacctgtctaatcgacaacagtcttactgctactgcgggggtccgggtgaatggaacctgaagatgcttcagtgcaggagttgcctccagtggttccacgaggcatgtacccagtgcttgtccaagcctttgctgtacggggaccggttttacgaattcgaatgctgcgtctgccgaggtggacccgagaaagtccggaggttacagttgcgttgggttgatgtcgctcacttggtactgtaccacttatctgtgtgctgtaagaaaaagtattttgattttgaccgcgagatccttccttttacctcagagaattgggactcattactgttgggagaactcagcgacacgcctaaaggagagcgctcatcacggctcctgtcagctctgaactctcataaagacagatttatctccggtcgggagattaagaagcgcaagtgcctttttgggctccacgccaggatgccccctccggttgagccacccaccggagatggggctctgaccagggctggcccttggggcagggggctcacttcccccggagaggcacctgaggccggtgcgcgagctcccgaggaggaggccgagggagagtctgggggtgccggtgctacactttccagcgcacagtcagcacgggcacccggtgctgagggagcagggtcaagcgcagaaggcactgctgcagctccatcaggctgtctactgccctccactctcctgcctgccccacaaggacccttgggtacagtggacccccagacaggccacccttggaactttacactggtgtctcctcagacctcactcaaggtgcctcccactcgctag

SEQ ID NO: 234477 - DNA, 1704 bp, Artificial Sequence
  Description of Artificial Sequence: Synthetic coding sequence
atggcgcagccaccgaggctgtccagatccggcgcaagtagtctatgggaccctgcttctccagcacctacctcaggaccaagaccaagactctgggagggccaggatgtgctcgccaggtggacggacgggttgctatatctggggaccataaagaaggttgactcggcacgggaagtgtgcttggttcaatttgaagacgattcccagttcctggtcctctggaaagacatctctcccgctgcactgccgggagaggagctgctctgctgcgtgtgccgaagtgagaccgtcgtgcccggtaaccgcttagtctcctgcgagaagtgcaggcacgcctaccaccaggactgtcacgtgcccagggcccctgcccctggcgagggagaaggcacttcgtgggtgtgtcgacaatgtgtcttcgcaatcgccactaagcgaggaggtgcactgaaaaagggaccttatgcacgcgcaatgctcggcatgaaattgagtctgccatacggcctgaagggcctggattgggacgccggtcacctaagcaatagacagcagtcctattgttactgtggcggacccggagagtggaatttaaaaatgctgcagtgtagatcctgtctgcaatggtttcacgaggcttgcacccagtgtctgagcaagccactcctgtacggcgatagattttacgaattcgaatgctgtgtgtgtagaggtggcccagagaaagttcggcgtttacaactccgatgggtcgacgtggcccatttagtactctatcacttatcggtttgttgtaagaagaagtattttgacttcgacagggagatcctgccattcacctccgagaactgggatagcctgttgctcggagagctgtccgatactccaaagggtgaaaggtcctcacgcctcctatcggcactgaactctcacaaagatcggttcatttccgggagagagatcaaaaagcgcaagtgcctgttcggccttcacgcccgtatgcctcccccagtcgaaccgccaactggcgacggggcactcacaagctttcccagcggacaagggcctggtggcggtgtttccagaccgttaggtaagaggcgacgacccgagccagagcccttacgccgtaggcaaaaaggtaaggtagaagaactgggcccaccgtcagctgtgcgcaatcaacctgagccccaagagcagcgagagcgcgctcatttacaacgggcattacaggcatcagtgagtccaccctcaccatcccccaatcagagctaccagggatcctccggttacaatttccgcccaacggacgccagatgtctgccctcaagtcctataaggatgtttgcctctttccacccaagcgcctctacggcaggcacttccggtgatagcgggcctcccgatagatcgccactagaactgcacattgggtttcctaccgacattcccaagtcagctccccactccatgaccgcgtccagcagctccgtgagctctccctctccgggactgcccaggagatccgctcccccttctcctctctgccggagcctgagtccaggaacagggggaggagtcaggggaggcgtgggctacctcagccggggagaccccgtccgcgttctggcgaggagggtcaggcccgatggcagtgtacagtatttggtagaatggggagggggagggatattttag

SEQ ID NO: 234478 - DNA, 732 bp, Artificial Sequence
  Description of Artificial Sequence: Synthetic coding sequence
tagtccttgctgctgactgcaacacgtacagtgtcctttcaaggtgaaaggttgaggcggggaaatgtatgtctcgtcagcatgttaggatgcctgcccctctggagccctctgttagagatggagcattctcccggacagggaccagggggaggggtgagcagacctctggggaaaaggagacgccctgagcctgaacctttgcggcgacggcaaaaggggaaggtggaagagcttgggccaccctcagcagtgcggaatcagcccgaaccgcaggagcagagggagcgcgcacacctgcagcgggcactccaagcctcggtcagccctccttccccttcacctaaccagtcctaccagggctcgtctggatacaacttcagacccactgatgctaggtgtctgccttctcccataagaatgttcgcttccttccacccttcagccagcacggctggcacctctggcgactccggcccacccgacagaagcccgctggaactccatataggcttccctactgatatccctaagtctgctccacattccatgacagccagttcctcctctgtatccagccccagtcctggccttcctcgccgatccgccccaccatcccccctgtgcaggtccttatcacctggtacgggcggtggggtcaggggcggagtgggctacttaagccgtggggacccagtgcgcgtattggctagaagagtgcggcctgattag

SEQ ID NO: 234479 - DNA, 438 bp, Artificial Sequence
  Description of Artificial Sequence: Synthetic coding sequence
atggcccaacctcctaggctcagtagatctggagctagctccctctgggatcccgcatccccggcacccacatccggccctaggccgagattgtgggagggtcaggatgtcctggcaaggtggaccgatggtctgctgtaccttggaacaattaaaaaggtggactcagcgagggaagtgtgtctggttcagttcgaggacgatagccagtttcttgtgctatggaaggacatctctccagccgctctacctggcgaagaactgctgtgctgcgtgtgccgatccgaaaccgttgtgcccggtaaccgcttagtgtcttgtgagaaatgccgccacgcataccaccaggattgccatgtgcccagggcccctgcaccaggcgagggcgaagggaccagctgggtctgtcggcagtgcgtctttgcaatcgctacctag

SEQ ID NO: 234480 - DNA, 546 bp, Artificial Sequence
  Description of Artificial Sequence: Synthetic coding sequence
tgggggcacccacagcagtgcgccatttctcctagcccgcgatctagaggctcagggctcatctgccgcggacactgtagaccacagtgcctccaccatccgccagcacttacaagagttaccagggctgcggcagcgacaacttctggaccccagatgcccgcagcatgccccggtcaccctattcggatgtttgctagttttcacccctccgccagcacggccggtacatcaggagatagcgggccacctgaccgatctcccctggagctacacattggttttcccacagatattcccaagagtgctccacattcgatgacggccagctcatcatccgtgagcagcccctcaccaggattaccacgcaggtccgccccaccgagccccttgtgccgttcgctgtcgccgggtacgggcggaggtgtaagaggtggggttggctatcttagcaggggcgaccctgtgagagtcctggcacggcgagtccgtcctgatggctcagtgcagtatctcgtggagtggggcggtgggggaatattttag

SEQ ID NO: 234481 - DNA, 438 bp, Artificial Sequence
  Description of Artificial Sequence: Synthetic coding sequence
atggcgcagcctccccgattgagtaggtccggcgctagttccttatgggatccggcatctccggcacctacatctgggcctcggccaaggttatgggaagggcaggatgtgctcgctcgctggacagacgggttactgtatctcgggaccataaagaaagtcgactctgctagagaggtttgcctcgtccaattcgaagacgactcccagtttttagtgctctggaaggatatctctcctgcagcactgcccggagaagaactattgtgctgcgtctgtagaagcgaaactgtggtgccgggaaatcgactcgtatcctgcgaaaaatgtaggcacgcataccatcaggattgtcacgtgccacgagcacctgccccaggcgagggggaggggacttcatgggtgtgtcggcagtgtgtgttcgccatagcgacctag

SEQ ID NO: 234482 - DNA, 1704 bp, Artificial Sequence
  Description of Artificial Sequence: Synthetic coding sequence
atggctcaaccgccacgcctgtcacgcagcggcgcttccagcttgtgggatccggctagtccggcacctaccagtggcccacggccacgcttgtgggaagggcaggacgtgctggctagatggacagatggcctcctgtacctcgggacaatcaagaaagtcgattccgcaagagaggtgtgcctggtgcagtttgaggacgacagccagttcctggtgctgtggaaggatatttcgccagctgccctcccaggcgaagaactcttgtgctgtgtgtgccgctccgagactgtcgtgcccggaaaccgattagtgagctgcgagaaatgcaggcacgcttatcatcaggattgtcatgtcccaagggccccagctcccggtgagggggaaggtacgagttgggtatgtagacagtgcgtctttgccattgcaactaagaggggaggggctctgaagaagggaccctatgcacgcgctatgttaggcatgaagctcagcctgccatatggcctaaagggcctggactgggacgcaggccacctctctaaccgtcagcagagttactgctactgtggcggtcccggtgaatggaatctgaagatgcttcagtgcagaagttgtctccaatggttccatgaggcttgcacccagtgtctcagcaagcccctactatacggggatcggttctacgaatttgagtgctgcgtgtgccgcggtggaccagaaaaagtcagacgccttcagttgcgttgggtggatgttgctcacctggttttgtatcatctgagcgtgtgctgcaagaaaaagtacttcgattttgatcgggaaatccttccgttcacatccgagaactgggattcactgctgctcggcgagctctcggatacccccaagggtgaaagaagtagcaagttattatctgccctaaatagtcataaagatcgcttcatttctggtcgggaaataaagaagagaaagtgcttatttgggctgcacgcacggatgcctccaccagtagagcctcctacaggcgacggcgctctgactagctttccatcagggcagggtccaggaggaggcgtgtcgcggccactcgggaagcggagacgccctgagcccgagccactcaggaggagacagaagggcaaagtcgaagaactggggcctccttctgccgtccgaaaccaaccagagccacaagagcagagagagagagcacacctccagcgtgccctccaagcctccgtgtctccaccctcaccatcacctaatcaaagctatcaggggagttccggatacaatttccgcccaaccgatgctcggtgcttacctagttcgccaattagaatgtttgcatcattccatcctagtgcttctactgctggcacgtctggagatagcggtcctcctgaccggtcccctctggaactgcacatagggttccctacagacattccaaagtccgcaccacatagcatgacagcctcttcatctagcgtgtcaagtccatcacctggcctgccacggaggagcgccccaccgagcccactatgtcgatccctctcacccggaacaggaggaggcgttcggggtggggtcggttatcttagtagaggggatcccgtgagagtcctggcgagaagagtgcgccctgatgggtccgtccagtatctggttgagtggggcggagggggtattttctag

SEQ ID NO: 234483 - DNA, 684 bp, Artificial Sequence
  Description of Artificial Sequence: Synthetic coding sequence
atggcacaaccacctcgcctttctagatctggagcttcttcactgtgggacccagcaagccctgccccaacatcaggtcctcgtcctcgattatgggaagggcaggatgttttggcacgctggacagacggtctgctgtatctgggtacaatcaagaaggttgatagtgcacgggaagtttgtctcgtccaattcgaggacgatagtcagtttctcgtgctttggaaagatatcagccccgctgcgctgcctggggaagaacttctgtgctgcgtttgccgctccgagactgtggtgcccggtaacaggctggtgagctgtgagaaatgccgacacgcctaccaccaagactgccacgttccacgggcaccggcaccaggagagggtgagggtacctcatgggtgtgcaggcagtgcgtgtttgctattgccactaagcgaggaggggcactgaaaaaaggcccatacgcacgcgcaatgctcggaatgaaattatcgcttccgtacggtctgaagggattagattgggacgccggacatctgtccaacagacagcagtcctattgctattgcgggggacccggtgagtggaatctgaaaatgctccaatgcagatcatgtctgcagtggttccacgaagcctgcacccagtgtctgtcaaagccattgctatatggtgactag

SEQ ID NO: 234484 - DNA, 684 bp, Artificial Sequence
  Description of Artificial Sequence: Synthetic coding sequence
atggctcagcctcctcgactcagccgctctggagcatcctcgctctgggacccagcctctcccgctcctacatccgggcctcgcccacgactttgggaagggcaagacgtcttggcacgttggacagatggcctgctatacctggggactatcaagaaggtggacagtgcaagagaggtttgcctggtgcaatttgaggacgatagccagttcctcgtattgtggaaggacatttctcccgcagcactgcctggtgaggaactgctgtgctgtgtgtgtagatctgaaaccgtggtgccagggaatcggctggtcagctgcgagaaatgtcgacacgcataccatcaagattgccatgttccccgtgcgccagcccctggggagggagaggggacatcatgggtttgtcggcagtgtgttttcgccattgccactaaacggggtggagcccttaaaaaaggcccttacgcccgagccatgctggggatgaagctgagccttccatacgggttgaaaggtctggactgggacgccggacacctttctaatagacaacagagttactgttactgtggaggcccaggggaatggaacttgaagatgctacagtgcaggtcctgcctccagtggttccacgaggcctgcacccagtgcctgagtaagcctctcttatacggagattag

SEQ ID NO: 234485 - DNA, 1374 bp, Artificial Sequence
  Description of Artificial Sequence: Synthetic coding sequence
atggcacaacctccccgactgtctaggagcggtgcctcctcactgtgggatcccgctagccctgcccctactagcggacctcggccaaggctgtgggaagggcaggatgtgctggcccgttggacagatggcctcctatacctcggcacaatcaagaaggtggacagtgctagagaggtgtgcttggtacagttcgaggacgattcccagtttctggttctctggaaggacatttcccccgctgcactccctggcgaggagctgctatgttgcgtgtgcagatcggaaacggtcgtgcccggtaaccggctagtcagttgcgagaaatgtcgccatgcataccaccaggactgccacgttcctagggcacctgcccctggtgaaggagagggcactagctgggtgtgcagacagtgtgtgttcgctatagctaccaagcgaggcggagcactcaaaaagggaccctacgctcgcgcaatgctcggcatgaagttgagtctgccctatggcttgaaaggattagattgggacgctgggcacctgagtaatcggcaacaaagctattgttattgtgggggacctggggaatggaacctgaagatgctccaatgccggagctgtttacagtggttccatgaagcatgcactcagtgtctgagtaaacctctgttgtacggagacagattttacgaattcgagtgttgcgtgtgcagaggagggccagaaaaagtcagacggcttcaactgagatgggtcgatgtggcccatctcgtgttgtaccacttgagcgtgtgttgtaaaaagaaatactttgatttcgaccgggagattctaccgttcacctcagagaattgggactccctgctcctcggggagcttagcgacaccccaaagggcgagcgttcatctaagctcctcagcgccttgaattcgcataaagataggtttatttcaggtcgagaaattaagaagcggaagtgcctgttcgggcttcacgcacggatgccgcctcctgtcgaacctcccaccggtgatggcgctttgacccgcgctgggccttgggggagggggttgacttctccgggagaggcccctgaagcaggagcccgagcacccgaggaagaagctgaaggggaatccgggggagcaggcgctaccctgtcatcggctcagtccgctcgcgctcccggagctgagggagcaggctcatcggccgaagggaccgcagctgcaccgtcgggatgtctgctgcctagcacccttctgccagcccctcagggtccgctaggtacggtggatcctcaaacagggcacccatggaactttacgctagttagcccacagacaagcttgaaagtgcctcccacacggtag

SEQ ID NO: 234486 - DNA, 1497 bp, Artificial Sequence
  Description of Artificial Sequence: Synthetic coding sequence
atggctgccgctgccggacccggagcagcattaagccctcggccttgcgattccgatcccgcaacacccggtgcccagagcccaaaagatgacaatgaggacaactcaaacgatgggacacagccctctaaacgcaggcggatgggctccggggacagcagccggagttgcgagacctccagtcaggacttaggttttagctactacccagctgaaaatcttatcgaatataagtggcctcccgatgagacgggagaatactatatgctgcaggaacaggtgagcgaatacctgggcgtgacttccttcaagcggaagtatcccgacctcgaaaggcgggacctgtctcacaaggagaagctttaccttcgagaactgaacgttattacagagacccagtgcactcttggcctgaccgcgctgaggtctgatgaggttattgatctgatgataaaggagtatcccgctaaacatgccgagtacagcgttatcctgcaggagaaggagagacagcggattactgatcactataaagagtatagtcagatgcagcaacagaatacccagaaagtcgaggcttcaaaagtgcccgaatatattaagaaggcagcaaaaaaggccgctgaatttaactctaaccttaatcgcgagcgaatggaggaaaggcgggcatatttcgacctgcaaacccatgtgatccaagtgcctcaaggaaagtacaaggttctgcctactgagaggacaaaggtatctagttaccctgtagcgcttatccctggtcagtttcaggaatactataaacgatatagcccagacgagctgcgctacctccccttgaataccgcgctttacgagccacccctggatcctgagctgccagctctggattccgacggggatagtgacgatggtgaagacgggagaggagacgagaagcgcaagaacaagggcacatcagactcctcatctgggaacgtgtccgagggtgagagccctcctgattcccaggaggattctttccaaggcaggcagaagagcaaagacaaagccgctactccgagaaaggatggacctaagcggagcgtactgagcaagagtgtccctggttacaaacccaaagtgattcccaacgcaatttgcgggatctgcttaaaaggaaaagaaagcaacaagaaaggaaaggctgaaagtcttattcactgctcgcagtgtgaaaattccggacatccttcttgtctggacatgaccatggagttggtgagcatgattaagacctatccatggcagtgtatggagtgcaagacttgtatcatctgcggtcagccacaccacgaggaggagatgatgttctgtgatatgtgcgatcggggttatcatacgttctgcgtgggattgggagcaattccaagcggaaggtggatctgcgactgttgtcagcgggcacctcctacaccaagaaaggttgggagacgcggaaagaacagcaaggagggttag

SEQ ID NO: 234487 - DNA, 1491 bp, Artificial Sequence
  Description of Artificial Sequence: Synthetic coding sequence
atggcagctgccgcaggtccaggagctgctttgagccccaggccttgtgactccgacccagctacccctggcgctcagagtccaaaggatgataacgaggataatagcaatgatggcacccagccatcaaagagacgacgaatgggatcaggggacagcagtcggtcttgtgagacgagctctcaagatctgggattctcttactatccagctgagaatcttattgaatacaagtggcctcctgatgaaaccggggagtattatatgctgcaggagcaggtctctgagtacctcggcgtcacttcctttaaaaggaagtacccagagcggagagacctgtcacacaaagaaaagctttatctacgcgaactgaacgtgatcacagagacccaatgtacgcttggactcaccgcactgcggtccgacgaggtgattgacctgatgattaaggaatatccggcaaaacacgcagagtatagcgtgatcctgcaggagaaagaaaggcagcggatcacggatcattataaagagtacagtcaaatgcagcagcaaaatacacaaaaagtggaggcttctaaggtccccgagtatattaagaaggcggctaagaaggcggctgaattcaattccaacctgaaccgagagcgcatggaggaacgcagggcctatttcgatttgcagactcatgttattcaggtgcctcagggtaagtataaggtgcttccgaccgagcgcaccaaggtgtccagctatccagtggctctaattcccggacagtttcaagaatactataagcggtattcgccagacgaactgcgatatctccctttgaacactgccctctacgagcccccattggatcctgagctgcctgccctggatagcgacggtgatagcgacgatggtgaggatggacgaggcgacgaaaaaagaaaaaataaaggtactagcgactcatccagtggaaacgtgtcagaaggggaaagtcctccagattcacaggaagactccttccagggtcgacaaaaatcaaaggataaagcagctactcctagaaaggatggccctaaaagatcggtgctgtcaaaatcagttcccggttacaaacctaaagttatccctaacgctatctgcggaatttgcctcaaaggtaaggaatcaaataaaaagggaaaggctgaatctctgatccactgttctcaatgtgagaactccggtcatccctcctgcctggacatgacaatggaactggtctctatgatcaaaacatatccctggcagtgtatggaatgcaagacgtgcatcatctgcggccaacctcaccatgaagaggaaatgatgttctgtgacatgtgtgaccggggttaccatacattctgtgtagggttgggggctattccgagtggtcgctggatctgtgactgctgtcagagagcgcctcccacgcccaggaaagtgggtcggagggggaagaacagtaaggaaggatag

SEQ ID NO: 234488 - DNA, 879 bp, Artificial Sequence
  Description of Artificial Sequence: Synthetic coding sequence
atggagaagaggacctgtgcgctgtgcccaaaagatgttgagtacaatgtcctctattttgctcagtccgagaatattgctgcacacgagaattgtctgctgtattcatccggattagtggagtgcgaggaccaagatcctctgaatcctgacagaagttttgatgttgagtccgtcaagaaggaaattcagcgcggaagaaagctgaaatgtaaattctgtcacaagaggggggcaacggtgggatgtgacctgaaaaattgtaataaaaactaccacttcttctgcgctaagaaagacgatgcagtgccacagtctgatggcgtgaggggcatctataaactcctgtgccagcagcacgcccagttcccaatcattgcacagtccgcaaaatttagtggggtaaaacggaagagaggcagaaagaaaccactatcaggcaatcacgtgcagccacctgagaccatgaaatgcaatacatttattcgccaagttaaggaggagcatggtaggcatacagatgccacagtcaaagtaccattccttaagaagtgtaaagaagctggcctgcttaactatttgcttgaagaaatcctagacaaagttcatagtatcccagagaagctcatggatgaaacaacttcagagtctgattacgaggaaattggcagcgctctttttgattgccgccttttcgaggacactttcgtaaattttcaagcggcaatcgagaagaagatccacgccagccaacaacgctggcagcagctgaaagaggagatcgaactgctgcaagatttaaaacaaacactatgctcattccaggaaaaccgtgatttgatgtcttcgtccacaagtatcagctctctgtcctactag

SEQ ID NO: 234489 - DNA, 996 bp, Artificial Sequence
  Description of Artificial Sequence: Synthetic coding sequence
atggcccaggctagtcccccaaggcccgagcgggtcctgggcgcaagcagtccagaggcacggccagctcaggaggcactgctcctgcccaccggcgtcttccaagttgccgagaagatggagaagcgtacatgcgccctctgtccaaaagatgtcgaatacaatgtcctgtactttgcgcagtcagagaatatcgctgcacacgaaaattgtctgctgtacagcagtggcctggttgagtgcgaggatcaggaccccctcaacccagacaggtcatttgacgtcgagtctgtgaagaaagagatacagagaggaaggaaactaaagtgtaagttttgtcacaagagaggcgctaccgtgggatgcgatctcaagaactgcaacaaaaattatcatttcttttgtgctaagaaagacgatgctgtcccacagtctgacggcgttcgcggaatctacaagctactttgtcagcagcacgcgcagttccctataatcgcccagagtgctaagtttagtggagtgaaacggaagcgaggacgcaagaaaccgctgtccggtaaccatgtacagccccctgagactatgaaatgcaataccttcataaggcaggtaaaggaagaacatggccgtcacaccgacgccactgtcaaagtgccctttctgaaaaaatgtaaggaggcagggttattgaactatttgctggaggagatcctcgacaaggtgcattctatccccgagaagctgatggatgagacaacttcagagagtgactacgaagaaatcgggtccgccttgtttgactgccgcctcttcgaagatacctttgtgaacttccaagccgctatcgaaaagaaaatccatgcttcccagcagcgatggcagcagctaaaagaagaaattgagctactgcaggacttaaaacagacactttgttcattccaggagaatcgtgacctgatgtcatcctctacctccatttcttctttatcttattag

SEQ ID NO: 234490 - DNA, 861 bp, Artificial Sequence
  Description of Artificial Sequence: Synthetic coding sequence
taacgcccaggaccacggggatgcagcgcacctgcagctcgcaggcctggacctagacgaagaaggagttccttcccgccattgtattcgtctggactcgtggaatgtgaagaccaagatccattgaaccctgatcgctcatttgatgtcgaaagcgtgaagaaggagatccagagaggaaggaagttgaaatgcaaattttgtcataaacgcggtgctactgttggctgcgacttaaagaattgcaataagaattatcacttcttctgcgcaaagaaagacgacgccgttccccaatctgacggcgtgaggggcatatataaattactatgccagcagcacgctcagttcccgataatcgcccagagtgcgaaatttagtggcgtgaaaagaaagcgcggacgaaagaagcccttgtctggcaatcatgtccagccacccgaaactatgaaatgcaacaccttcattaggcaggtgaaggaggaacacggacgccatactgatgctacagtaaaagttccctttctgaaaaaatgcaaggaggctggactgctgaattacctgcttgaagagatcctcgacaaagtccattccatccctgaaaagttgatggacgagacaacctcagagtccgactacgaagaaatcggaagtgcactctttgactgccggttgtttgaggacacgttcgtgaattttcaggcggcaatcgaaaaaaagatacacgcttctcagcagagatggcaacagctgaaggaggaaatcgagcttctccaggatctcaaacagacactgtgttcctttcaggagaatagggatctgatgagtagctcaacttccatctccagcctttcatactag

SEQ ID NO: 234491 - DNA, 507 bp, Artificial Sequence
  Description of Artificial Sequence: Synthetic coding sequence
atggaaaagcgcacctgcgcactgtgtcctaaagatgtcgaatataacgtcctgtattttgcacagagcgagaacattgccgctcacgagaattgtctgctatacagcagcgggctggtcgagtgcgaagatcaggacccattgaaccccgacaggtcctttgacgtagaatcagtgaagaaagagattcagcgcggtagaaagcttaagtgcaaattctgtcacaaaagaggcgctaccgtgggttgcgacctcaagaactgtaacaagaactatcattttttctgtgcgaagaaggatgacgcagtgccccaatcagacggcgtgcgcggtatttacaaactcctgtgccagcaacatgcccaattccctataatcgcccaatccgcaaagttcagcggcgtcaaacgaaaaagaggacggaagaagcccctatctggaaaccacgttcagccccctgagaccatgaagtgcaacacgttcatcaggcaggtcaaagaggagtag

SEQ ID NO: 234492 - DNA, 297 bp, Artificial Sequence
  Description of Artificial Sequence: Synthetic coding sequence
atggagaagcgaacttgtgcattgtgtcctaaagacgttgagtataacgtgctttattttgcacagagcgagaatatagccgctcatgagaactgcttattgtatagcagcggattggtggagtgtgaagatcaggacccattgaaccccgacaggtccttcgatgtcgaaagcgtgaagaaggaaatccaacgcggacgcaagctcaaatgcaaattttgccacaaaagaggggctacggtaggttgcgatctgaagaactgcaacaagaactatcatttcttctgcgccaaatag

SEQ ID NO: 234493 - DNA, 879 bp, Artificial Sequence
  Description of Artificial Sequence: Synthetic coding sequence
atggagaaacggacctgtgccctttgtcctaaggatgtggagtacaatgtactgtactttgcccagtcggagaatattgccgcacacgagaactgcctgctttatagctccgggcttgtcgagtgtgaggaccaagatcctctgaaccctgacaggtcgttcgatgtggagagcgtgaaaaaggagatccagcgcggacgcaagcttaaatgcaaattttgccataaaagaggggctaccgtgggctgcgacctgaagaattgtaataagaactaccatttcttttgtgcaaaaaaggacgatgccgtcccccaatctgacggagttcgtggaatctacaagctgttatgccagcaacatgcccaatttccaatcatcgcgcagtccgccaagttctccggggtgaagaggaaacgaggcagaaaaaaacctctgtccggcaatcacgtccagcctccggagaccatgaaatgtaacacctttatccgccaggtgaaagaggaacatggtcggcacaccgacgccactgtcaaggtcccttttttgaagaaatgtaaggaggcaggactcttgaactatcttctggaggagatccttgacaaagtccactccatcccagaaaagttgatggacgagaccacttccgagagcgattacgaagagatagggagtgctctgttcgactgccgtctttttgaggatacctttgtgaactttcaggctgccatcgagaagaagatccacgcttcacaacagaggtggcaacaactcaaggaggaaattgaactgcttcaggatctgaagcaaactctgtgctccttccaagagaaccgcgacctcatgtcatcctcaactagcatttcctctctctcatactag

SEQ ID NO: 234494 - DNA, 624 bp, Artificial Sequence
  Description of Artificial Sequence: Synthetic coding sequence
atggagaatcgagccctggatccgggtactcgcgacagctacggggctacctcccacttaccaaataagggagccctcgcaaaagtgaagaacaatttcaaagatcttatgagcaagttgaccgaaggacagtatgtcttgtgtcgctggaccgatgggctctactatttagggaagatcaagcgggttagctctagtaagcagtcctgcttggttacctttgaggacaactctaagtactgggtactttggaaggatatccaacatgccggagtgcctggggaggaacccaaatgtaacatctgcctagggaagacctctggacccctcaacgaaatcctaatatgcgggaagtgtgggctggggtatcaccaacagtgtcatattccgatcgctggctctgcggaccagcctctactgacgccttggttctgcaggcgatgtatctttgccctcgctgttcgcgtgagcttaccgagcagccccgtccctgcttctcctgcttcatcttctggtgccgaccagagacttccttcccaatccctgagctctaaacagaaggggcatacctgggccctcgagaccgacagcgctagcgctacagtcctagggcaagatctctag

SEQ ID NO: 234495 - DNA, 1743 bp, Artificial Sequence
  Description of Artificial Sequence: Synthetic coding sequence
atggagaatagagcactcgatcccggaacccgcgactcctacggggcaacaagccatcttcccaataaaggcgctctggctaaggtcaaaaataatttcaaggatctgatgagcaagctcaccgaaggccagtacgtgctgtgccggtggacggacggcctgtattatctgggcaagatcaagcgcgtgtcaagtagcaagcagagctgcttagtaacattcgaggataactccaagtactgggtcttgtggaaggatatccagcatgccggtgtcccaggcgaggagccaaaatgcaacatttgcctcgggaaaacttccgggccactgaatgagatcttgatctgtgggaagtgcggtttgggatatcaccagcaatgtcacatccctattgctgggagcgctgaccagcccctcctgaccccctggttttgccggaggtgcatctttgcacttgccgtgagaaagggcggagctctaaagaagggagctatagcccgtaccctgcaggccgttaaaatggttctatcataccaacctgaagagctggagtgggactcaccgcacagaacaaaccagcagcagtgttattgttattgcgggggtccaggtgaatggtatttgcggatgcttcaatgttatcgatgtagacaatggttccacgaggcgtgcactcaatgtctcaatgagccaatgatgtttggtgaccgcttttacttgttcttttgttctgtgtgtaatcagggacccgaatacatcgagaggctgccactgcgctgggtggacgttgtgcatctcgctctttacaacctgggcgtacagagcaaaaaaaaatatttcgattttgaagagatattggcatttgtcaaccatcactgggagctgctccaactgggcaaattaacttccacgccagtcactgaccggggaccccacttgctgaatgccttgaactcctacaaatcacggttcctgtgtggcaaagagataaagaaaaaaaaatgcattttccgtcttcggataagggtcccccctaatcctcccggtaagctactgcctgacaaaggcttacttccgaatgagaacagtgcatccagcgaattgagaaaacgaggcaaatcgaagccgggtctgctgcctcacgagttccagcaacagaagcgccgtgtttatcggaggaaacgtagtaagttcctcctggaggatgcaattccatcatccgatttcacatcggcgtggagtaccaaccatcatctcgcaagtatatttgatttcactctcgatgagatacagtccctcaagtccgcctcatccggccagacttttttctcggatgtagatagcactgatgccgcttccacatcggggtcagcctcaacatctctttcctatgatagccgttggaccgttggatcgcggaaacgcaagctggccgctaaagcttacatgccactgagagctaagcggtgggccgcagagctggacggcaggtgcccctctgattccagtgctgaaggcgcaagcgtgcccgaaaggccagacgagggaattgacagccacacattcgagtctatatcagaagatgatagctccttatcccaccttaagtcatctatcaccaactacttcggagctgctggaagactggcctgcggcgaaaagtaccaagtgctcgccagacgcgtgactccggaggggaaggttcagtatctcgtggagtgggagggcacaacaccctattag

SEQ ID NO: 234496 - DNA, 1116 bp, Artificial Sequence
  Description of Artificial Sequence: Synthetic coding sequence
atgctacagtgttaccggtgccgtcagtggttccacgaggcttgcactcagtgcctgaatgaacccatgatgttcggggaccgcttttaccttttcttctgcagtgtctgtaatcaggggcctgaatatattgagaggctgccacttcggtgggtggatgtggtccacttggccttgtacaacctcggcgtccagtctaagaagaaatatttcgattttgaagagatcctcgcgttcgtcaaccatcattgggaattgcttcaactcggcaagctaacctctacgccggtcaccgatagagggcctcaccttctgaatgcgctgaattcctataaaagccgcttcctttgtggaaaagaaatcaagaagaaaaagtgcatcttccgtctgagaatccgcgtcccccctaacccgccaggcaagctgttgcccgataagggcttgctgccaaatgagaactctgccagtagcgaactcaggaaaagagggaaaagcaaacccggactgctgccacatgagtttcagcagcaaaagcgcagagtctacaggcgcaaacggtccaagttcttactggaggatgccatccctagctcagacttcaccagcgcctggagcactaaccaccacctggctagcatctttgacttcacactggatgaaatccagtcacttaagagtgcctccagtggacagactttcttctcagatgtggacagcaccgacgctgctagcaccagtggctccgccagcacctccttatcatacgatagtaggtggaccgtgggcagtaggaagaggaagttagcggctaaagcctacatgcccctgcgtgctaagagatgggccgcagaactggatgggaggtgcccttcagacagttccgcggagggcgcatctgtccccgaacgaccagatgaaggtattgattcccacacattcgagagtatctccgaagatgacagcagtctgagccatctgaagtcctcaattacgaactattttggagcggcagggaggctggcctgcggtgagaagtatcaggtgttagcgagaagagtaaccccggagggcaaggtgcaatacttggtcgagtgggaaggcacgaccccttactag

SEQ ID NO: 234497 - DNA, 501 bp, Artificial Sequence
  Description of Artificial Sequence: Synthetic coding sequence
atggagaacagggccctggatcccggaactagggactcttatggcgctaccagtcatctgccaaataaaggagcactcgccaaagtgaaaaacaattttaaggacctcatgagtaaattgacagaagggcaatacgttctgtgtcgctggacagacggtctttactacctgggtaagattaaacgcgtgagcagtagtaagcagtcctgcctggtcacgtttgaggataactctaagtactgggtcctatggaaagacatccagcacgcaggtgtgcctggcgaggagcctaagtgcaacatctgcctggggaagacttcaggccctctcaacgagatcctcatttgtggcaaatgcggactggggtaccaccagcagtgtcacattcctatagcagggtccgccgatcagcccctcctaaccccctggttttgccggcgatgcatctttgcccttgctgtacgtaagggcggtgccctaaagaaaggggcaatcgcttag

SEQ ID NO: 234498 - DNA, 324 bp, Artificial Sequence
  Description of Artificial Sequence: Synthetic coding sequence
atggaaaatagagctttagatcccggaaccagagacagctacggcgctacatcacatctgcccaataaaggcgctctagcgaaagtgaaaaacaatttcaaagacctgatgtccaagctcaccgaggggcagtacgtcctgtgtaggtggacggacggcttgtactatcttggaaaaattaaacgagtgtcgagtagcaaacaaagttgtctggtaaccttcgaagacaattctaagtattgggtcctgtggaaggatatccagcacgcaggcgtccccggtgaggagcccaagtgtaacatttgtctcggcaaaactagttag

SEQ ID NO: 234499 - DNA, 1692 bp, Artificial Sequence
  Description of Artificial Sequence: Synthetic coding sequence
atggaaaacagggcgctggatcccggaacacgcgacagctatggcgctacatcccatctgcctaacaaaggggctctggccaaggtaaagaacaacttcaaagaccttatgagtaagttaactgagggacagtacgtgttgtgcaggtggacagatgggctctattacctgggaaaaattaaacgggtgagttcgagcaaacagagctgtctggttacatttgaggataatagtaaatattgggtgctttggaaggatattcaacatgcgggtgtaccaggagaggaaccaaagtgcaacatttgtttgggtaagacctccggcccacttaacgaaatcctgatctgcggcaaatgcggactgggttatcaccaacagtgccatatacctatcgccggttctgcagatcagccactgttgacaccttggttttgccgcaggtgtatttttgccctagctgtacgtaagggcggagcattgaagaagggagccatcgcaagaactctccaggcagtaaagatggtcctgtcttatcaaccagaagagctggagtgggatagtccacacaggactaaccaacagcagtgttattgctactgcggcggacctggggagtggtatttgagaatgctgcagtgttaccggtgcagacagtggttccacgaggcttgcacacagtgcttgaacgaacctatgatgttcggggacaggttttatctttttttctgcagcgtttgtaatcaggggccagagtatatcgaacggctgcccttgcggtgggtggacgtagtacacctagctctctataacctcggagtccagagtaaaaagaagtactttgattttgaagaaatcttggcctttgtgaatcatcactgggaactgctccagctggggaagctgacttccacaccagtcaccgacaggggaccacacctgttaaacgcactgaattcttacaaaagccggttcttgtgtggaaaagagatcaagaagaagaagtgtatcttcaggctacggatccgggtgccgccaaatccccctgggaaactgctcccggacaagggactcctgccaaacgagaatagcgcctcctccgagttgaggaaaaggggaaaatctaaacccggactcttgcctcacgaattccaacagcaaaaacggagagtatatcgccgtaagcgctccaagtttctgttagaagatgcaatacctagcagtgacttcacttctgcgtggagcactaatcatcatctggcttcaatcttcgacttcacactggatgagattcaatcgttgaagtccgcttctagcggacagacatttttctcagacgttgactcgaccgatgccgcatctactagcggcagcgctagcacatcccttagttatgacagccgctggacagtcggctccaggaaaaggaagctcgcagccaaagcctatatgccacttcgggctaaacgctgggccgctgaactcgatggaaggtgcccttctgatagttcggccgagggcgcatcggtgccagaacgacccgacgaggggatcgactctcacaccttcgagagcataagcgaggatgacagcagcctaagccatctcaaaagcagtatcacaaactatttcggggctgcgggacggttagcctggggtgaggtgccaggagttggtagtgaggggcacacctag

SEQ ID NO: 234500 - DNA, 3291 bp, Artificial Sequence
  Description of Artificial Sequence: Synthetic coding sequence
atggctaccgttccagtctattgcgtgtgccgccttccttatgacgtgacccgttttatgattgagtgcgatgcttgtaaggattggttccatgggagttgcgtgggcgttgaagaggaggaggctccggacattgacatttaccattgccccaactgcgaaaagacccatggaaagtctaccctgaaaaaaaagaggacatggcataaacacggtcccggtcaggcaccagacgtgaagccagtgcagaatggctcccagcttttcattaaggagttgaggtcccgaacattcccctcagcagaagatgtcgtggcgcgagtgccagggagccaattgactcttggatacatggaagaacacgggttcacagagcctatcctagtaccgaagaaggatggtctggggcttgcagtgcccgcaccgacgttttatgtgagcgacgtcgagaactacgtcggtcccgaacgctccgtagacgtcacagacgtaactaagcagaaggactgtaaaatgaagcttaaagagttcgtcgactattactattccaccaacaggaaacgcgtgttgaacgtgacaaacctcgagttctccgatacaagaatgtcctcttttgttgaaccaccagatattgtgaaaaaactgtcctgggtcgagaattactggccagacgacgctttgctggccaaacctaaagtgacaaagtactgcctgatttgtgtgaaggactcctataccgacttccatattgacagcgggggagcttcagcctggtatcacgtgctgaagggcgagaagactttttatctgatccgccctgcgagcgcaaacatcagtctgtacgaaaggtggcgatctgcatcgaaccacagcgaaatgttcttcgccgaccaggtggataaatgttataagtgcatcgtcaaacaagggcagaccctgtttataccctccgggtggatctatgccacacttactcctgttgattgtttagcatttgctggacattttttacacagtctgagtgtggagatgcagatgagagcatacgaggtggagcgccgtttaaagcttggctcattgacacagtttcccaatttcgaaacagcctgttggtacatgggaaaacacctcctggaagcattcaaggggtcacacaagtctggcaagcaacttccaccacatcttgtgcaaggcgcaaagatcctgaatggagctttccggtcgtggacaaaaaagcaggccttggcagaacacgaggacgaactaccggaacattttaagcccagtcagctcattaaagatctggcgaaagaaattcggttgagtgagaatgcatctaaggcggtccgcccagaggtcaatacggtagcttcctcagatgaagtctgcgatggcgatagagaaaaggaagaaccacccagccctattgaagctacacctcctcaatccctgctcgagaaggtgagtaagaagaagacgccgaaaaccgtgaagatgccaaaaccatcaaaaattcctaagccacccaagcccccaaagcctccaagacctcccaagactcttaaactcaaggatggcggtaagaagaaaggaaagaagagccgcgagagcgcttcacccacaattcccaacttagatctgctcgaggctcacaccaaggaagccctcacaaagatggaacccccaaagaaaggaaaggcaacaaaaagcgtactgtcggtaccaaataaggacgtagtccatatgcagaatgatgttgaacggctcgaaatccgcgagcagacgaaaagcaaaagtgaagccaagtggaagtacaagaattcaaagccagattcccttttaaaaatggaggaggagcaaaaactcgaaaagtcaccattagccggaaacaaggataacaaattttccttttcatttagcaacaagaagcttttggggagcaaggccctgcggcctcctacatcaccgggagtctttggcgcattacagaactttaaagaagacaaaccaaagccggtgcgggatgaatatgaatatgtctctgacgacggagagctgaagatcgatgaatttcccattcggagaaaaaaaaacgctccgaagagagacctgagcttcttgcttgataagaaggctgtgcttccaacgccggtgaccaagcccaagctggactctgcggcatacaaaagtgacgacagctcggacgagggctcactccacatcgatactgacacaaaacctgggaggaatgctcgagtgaagaaggagtccggctcctccgctgccggtattctagatctactccaggcaagtgaagaggtcggagcccttgagtacaacccctctagccagcctccggcttcccccagcacccaggaggccatccaggggatgctgtctatggccaacctgcaggcttcagactcttgtttgcagactacctggggcgcaggacaggcaaaaggcagcagcctggccgctcacggggcacggaagaatggcggagggtccggaaaaagcgcaggaaagagactcctcaagcgcgctgccaagaattcagtggacctggacgactacgaagaagaacaggatcatctcgatgcctgttttaaggattcagattacgtgtacccttcactcgaaagcgatgaagacaaccctattttcaagagtcggtctaagaaaaggaaagggtctgatgatgccccttacagtccgaccgctagggtgggtccctccgtgcctaggcaggataggcccgtgcgtgagggcacccgagtcgcctctatcgagactggcctcgccgctgctgctgccaaactgagccaacaagaggagcagaaaagcaagaaaaaaaaatctgcaaagaggaagctgactcccaacacaacatcaccttccacttcgacgtcaattagcgccggaactacatccacgtccaccactccggcatccactacaccggcaagcacaacccctgcttcaacctccaccgctagtagtcaggctagtcaggaggggtccagccctgagccacctccagagtctcacagttcgagcctggccgatcacgagtatacagccgctggaacgttcactggagcgcaagccggtagaacatcacagcctatggctccaggagtttttctgacacagcgtcgcccaagtgcttcctcgcctaacaacaacactgccgctaaaggcaagaggactaaaaagggtatggctactgcaaaacagagactaggaaagattctgaagatccacagaaacgggaagctgcttctctag

SEQ ID NO: 234501 - DNA, 984 bp, Artificial Sequence
  Description of Artificial Sequence: Synthetic coding sequence
atggccactgttcccgtctattgcgtgtgccggctcccgtatgatgtgacaagatttatgattgaatgcgatgcttgcaaggattggtttcatggctcctgtgtgggagtggaggaggaggaagcgcctgatatagatatctatcactgtccaaattgcgaaaaaacacatggcaaaagtacgctcaaaaagaagaggacctggcacaagcatggccctggacaggctccagatgtgaaaccaaagaatagcgtggatctggacgattacgaagaggagcaggaccacttagacgcttgctttaaagactctgactatgtctacccttctcttgaatcagatgaagacaatccgatctttaagtcccggtccaagaagaggaagggaagcgacgatgcaccctatagtccaacagctagagtagggccaagcgtcccaaggcaggatcgccctgtgcgagagggaacacgcgtcgcctccattgaaaccggactggcggctgcggctgcgaaactctcccagcaagaagagcagaaatcaaaaaaaaagaagagcgcaaagcgcaaattaacaccgaacactacatccccatctacgtcgactagcatcagtgcagggacaacaagcacctccacaactcccgcttcaaccacccccgcatcaacaacaccagctagcacgtccaccgcatctagccaagcatcccaagaaggaagcagccctgaacctccccctgagagccattcatcatcattggccgatcatgagtacacagccgcagggacatttaccggggctcaggcaggcaggacctcccaaccgatggctccaggcgtgttcctaactcaaaggagacccagtgctagttctccaaacaataatacggctgcaaaaggtaaaagaactaaaaagggcatggctactgccaaacagcgtcttggcaagatcctcaagatccaccggaatggaaagttactgctctag

SEQ ID NO: 234502 - DNA, 2046 bp, Artificial Sequence
  Description of Artificial Sequence: Synthetic coding sequence
atggagctccagaccctgcaagaggctctcaaggtagaaatccaagtccaccagaagctcgtggcacaaatgaagcaagacccccagaatgcagacctgaaaaagcagctgcacgaactgcaggccaaaattactgcgctgtcggagaagcaaaagagggttgttgagcagctgcgcaagaatttgatcgtgaagcaggagcagcctgacaagttccagatccagcctctgccacaatctgaaaacaaactgcagacggcgcagcagcagcccctgcaacagctgcagcagcagcagcaataccaccatcatcacgcccagcagagtgctgcagcttcccctaacctcacagcttctcaaaagacggttaccactgctagcatgatcactaccaaaactctgccgttggtattgaaagctgccactgcgacaatgccggctagcgtagttggccagaggcccacaattgccatggtgacagccatcaactcacagaaagccgtgctgtcaactgacgtgcagaacactcccgtcaacttgcaaacatccagtaaggtgaccgggcctggcgctgaggcagtccaaatcgtggccaagaacaccgtgacactgcaggtgcaagcaacacctccacagcccatcaaagtgcctcagtttattccgcctccgagactcactccgagacctaattttctgccccaggtgaggcccaaacctgtggcacagaataatatccccattgcacccgcaccacctcctatgctagccgctccccagttgatacaaaggcctgttatgcttaccaagtttactcccaccacgttgcctacaagccagaacagcattcatcccgtgcgggtggtgaatggccagaccgcaactatcgccaagacattccccatggcacaattaacctccatcgttattgccacgccaggaactcgacttgccggaccacaaaccgtacagttgagcaagccctccctcgaaaagcaaaccgtgaagagtcatacagagaccgatgaaaagcagactgagagccgaactattactccccctgctgcgccaaagcctaagagggaggagaatcctcaaaaattggcttttatggtctctctcgggctggtcacccacgaccaccttgaggagatccagtccaagcgccaggagcggaagcggaggacaaccgcgaatccagtgtattccggagcggtctttgaacccgaacgaaagaagtctgcggtcacctatctcaactccacaatgcaccctggcacaaggaagcggggacgaccacccaaatacaatgcggtgctgggctttggagcgctgaccccaacatcaccacagagcagtcaccctgacagtcccgagaatgaaaagacggagaccacctttaccttccctgctcctgtgcagcccgtcagccttccttctcccacgagtaccgacggcgatatccatgaagatttctgttcggtgtgcaggaagagtggccaactgctgatgtgtgatacgtgctctagggtgtaccacctggactgtttagacccccctctgaaaactattcccaagggcatgtggatatgcccgaggtgccaagaccagatgctcaagaaggaggaggctattccatggccaggaactctggccatcgttcactcatatatcgcttacaaggcagccaaagaagaggagaaacaaaagctgctcaagtggtcatctgatcttaaacaggagcgcgaacaactggagcagaaggtgaaacagctgtctaacagcatctctaagtgcatggagatgaaaaataccattctggcgaggcagaaagaaatgcattctagcctggagaaggtcaagcagctgattcgcctcatccacgggattgatctctcgaagccagtggactccgaggctacagtgggggctattagcaacggacctgactgtactccccctgctaacgcagcaacatccacaccggctccttcaccaagttcccagtcatgcacagcgaattgtaatcaaggcgaggaaacaaagtag

SEQ ID NO: 234503 - DNA, 1905 bp, Artificial Sequence
  Description of Artificial Sequence: Synthetic coding sequence
atggaactgcagactctacaggaagccttgaaggttgagatacaggtccaccagaagcttgtggcccagatgaaacaggaccctcagaatgctgatcttaagaagcagttacatgaacttcaggcgaagattaccgctctgtcggaaaagcagaagagggtggttgagcagctcaggaagaacctcattgtcaagcaggagcagcctgataagtttcagatacagccattgcctcagagtgagaataaactacagactgcacagcaacagcctctgcagcaactgcagcaacagcagcagtaccaccatcaccatgctcagcagtcagccgcagcctcccctaatctgacagcttcccagaaaacagtcacaaccgcgtctatgatcacaactaagaccttgccactggtgctaaaggccgctaccgccaccatgcccgcatctgtcgtaggtcaaaggcccacaatcgcgatggtaaccgcaataaatagccaaaaagcggttttgagtacagatgtacagaatacccccgtcaatctgcagaccagtagtaaagtaaccgggccaggtgcagaagccgtgcagatcgtggccaaaaacaccgtgaccttgcaagtgcaagccactccacctcaacccatcaaggtcccccagttcatccctccccctcgcctgacaccaagaccgaatttccttccacaggtgcggccaaaacccgtagcccagaacaacattccaatagcccctgccccacctccaatgctggccgcacctcaactgatccagcgcccagtcatgctgactaaatttacaccaacgactttgcccacgtcccaaaactccattcatcccgtccgtgttgtgaacgggcaaacagctactattgcaaaaacattccctatggcacagctcacctccatcgtgatcgcaactcctggtacccggcttgcagggccacaaaccgttcagctatcaaagccttctctcgaaaagcaaaccgtgaaatcacatactgagaccgacgagaagcagacagagtcccggaccatcacacctcccgcagcccctaaaccgaagagagaagagaacccgcaaaagctggcctttatggtgtcactggggctggtgactcatgaccacctggaggagatccagtccaagcggcaggagagaaaacggaggaccacagcgaatcccgtatacagcggggctgttttcgaaccagagagaaaaaagtccgcagtcacgtatctgaattccacaatgcaccccggtactcgaaagagagcaaatgaagaacactggccaaaaggggatatccacgaggatttttgcagcgtgtgcaggaagtcaggccagcttcttatgtgtgatacttgcagcagagtttatcaccttgattgcctcgatcctccccttaaaacaatccctaagggaatgtggatatgccccaggtgccaggaccagatgctgaaaaaggaggaggccattccctggcctgggaccctggcaatcgtgcatagttatatcgcctataaggcagctaaggaagaagaaaaacaaaagttgctgaaatggagtagtgacctgaagcaggagcgcgagcaacttgaacagaaagtgaaacagctctctaactccatctccaaatgtatggaaatgaaaaataccatactggctcggcagaaagagatgcacagcagcctagaaaaagtaaaacagcttataagacttattcatggcatagacctgtccaaacctgtggatagcgaagcaaccgttggggctatttccaacggtcccgactgtactcctcccgcaaatgctgctacatccaccccagcaccgagtcctagctcgcagagctgcaccgctaactgtaaccagggcgaggagacgaagtag

SEQ ID NO: 234504 - DNA, 2043 bp, Artificial Sequence
  Description of Artificial Sequence: Synthetic coding sequence
atggagctgcagacgctccaggaagcgctgaaggtggagatacaagtgcaccagaagttggttgcccagatgaagcaagatccgcagaatgccgacctgaagaagcagttgcatgagctgcaggccaaaatcactgcactatcggagaaacagaagcgggtcgtggagcaactacgtaagaacctcattgtaaagcaggaacagcccgataaattccagatccagccattgccccagtccgagaataaactgcagaccgcgcagcagcagccattacagcagctgcagcagcagcagcagtatcaccaccaccatgcccagcagtccgcagccgcttctccgaaccttacagccagtcagaagacagtcacaacagcatcgatgattaccactaaaaccttgcctctggtgttgaaagccgctacagccaccatgccggctagcgtagtcgggcagcgacctacaattgccatggtcactgccattaacagtcaaaaggctgtcctcagcactgacgtgcagaatacccctgtcaacttgcagaccagttcaaaagtgacaggcccaggggctgaagccgtgcagatcgtcgccaagaacactgtcaccctagtgcaggccacgccgccacagcccattaaggtaccacagttcatcccccctccgcgtcttacacctcgacctaattttctgccccaagttaggccaaaacccgtggcacagaacaatattccgatagcaccagccccaccaccaatgttagccgcaccacaacttattcagcgccctgtgatgttaacaaaattcacccctacgactctgccaaccagtcagaactctattcaccccgttcgggtcgttaacggtcagacagccactatcgccaagacttttcctatggcgcagctgaccagcatcgtgattgccacacccggaacacggctcgcaggcccacaaactgtgcagttgtcaaagccctcacttgaaaaacaaacagtaaaatctcatacggagacggatgagaaacagaccgaaagccgcacaatcacacctcccgcagcgcctaagccgaaacgggaggagaacccccagaagttagccttcatggtgtcccttggtctggtgacccatgaccatttggaggaaatccagtctaaaaggcaagaaaggaagaggcgtaccacggccaatccggtctatagcggggctgtgttcgaacccgaaagaaaaaagtctgctgttacttacttgaattccactatgcatccgggaacccggaagaggggcaggcctcctaaatataacgccgtgttgggtttcggagccctgacaccgaccagcccccaatcatctcatcctgattcacccgaaaatgagaagactgaaacaaccttcactttccctgctcccgtacaacccgtgagcttaccatccccaaccagcacagacggggacattcatgaggacttctgttcagtgtgtcgaaaatccggacagctgctgatgtgcgacacatgcagccgcgtgtatcatctggattgccttgacccaccgttaaagactatccctaagggtatgtggatctgccccaggtgccaggatcaaatgttgaagaaggaggaggccattccgtggccaggcaccctcgcaatagtgcattcttacatcgcttacaaggccgcaaaggaggaggaaaagcagaagctgctcaaatggtcctccgacctcaagcaggaaagggagcagctcgaacagaaggtgaaacagctatctaacagcatatctaagtgcatggaaatgaagaacactatactcgcaagacagaaagagatgcattcatctctggaaaaggtgaaacaactgataagacttattcatggcatcgatctgtctaaaccagttgatagtgaggccacagtcggagccatatcgaacggacccgactgtacgcctcccgctaacgctgctacgtccacacctgccccatccccctcctcccagagttgcaccgcaaattgcaaccagggtgaggagacgaagtag

SEQ ID NO: 234505 - DNA, 81 bp, Artificial Sequence
  Description of Artificial Sequence: Synthetic coding sequence
atggagctgcagacattgcaggaagcactgaaggtggaaatacaagtgcatcaaaaattagtggcccaaatgaagcaatag

SEQ ID NO: 234506 - DNA, 36 bp, Artificial Sequence
  Description of Artificial Sequence: Synthetic coding sequence
atggaacttcagactctccaagaagccttgaagtag

SEQ ID NO: 234507 - DNA, 306 bp, Artificial Sequence
  Description of Artificial Sequence: Synthetic coding sequence
atggagctgcaaaccctccaggaggctctgaaagttgaaatacaggtccaccagaagctcgtcgcacagatgaagcaagatcctcagaacgctgatctgaagaaacaactacacgagttgcaggcaaagatcacagcccttagcgagaagcaaaagagggttgtggaacagcttcgcaaaaaccttatcgtcaagcaggaacagccggacaaattccagatccagcctctcccgcagagcgagaacaaactgcagacagcccagcagcagccacttcagcaacttcagcagcagcagcagtattag

SEQ ID NO: 234508 - DNA, 30 bp, Artificial Sequence
  Description of Artificial Sequence: Synthetic coding sequence
atggaactgcagaccctccaggaagcttag

SEQ ID NO: 234509 - DNA, 156 bp, Artificial Sequence
  Description of Artificial Sequence: Synthetic coding sequence
atggaactccaaacactccaagaggcactgaaagtggaaatccaggttcaccagaaattagtggcgcagatgaaacaggatcctcagaatgctgacctcaagaagcagcttcatgagttgcaggcaaaaattacagctctaagcgaaaagcaatag

SEQ ID NO: 234510 - DNA, 477 bp, Artificial Sequence
  Description of Artificial Sequence: Synthetic coding sequence
atgctggaagcgatggcagagccatccccggaagacccacctccaactctcaagcctgaaacccaacccccagaaaagcgccgtcgaaccatcgaagactttaacaaattttgcagcttcgtgctagcctacgctgggtacattcccccttcaaaagaggagtcagactggcctgcctccgggagcagcagtccactgaggggtgagtcagccgctgactccgacggttgggatagcgctccttccgacctgcggacaatacaaaccttcgttaagaaggccaagtcctccaagcgcagggccgcacaagcaggacccacccagcccggaccacctagatccacattcagtagactgcaggctccagatagcgccacactgttagaaaagatgaaactgaaggattctttgtttgacctggacgggccaaaagtggcctctccgctgtccccaccatgtgctgccaacactccctag

SEQ ID NO: 234511 - DNA, 1212 bp, Artificial Sequence
  Description of Artificial Sequence: Synthetic coding sequence
atgctggaagccatggcggagccatccccagaagatccacctccaactctaaagcccgagacgcaaccaccggagaagcggagacgcaccatcgaagatttcaataaattttgttcctttgtgcttgcctacgccggatacatccctccatcaaaggaagagtcggactggcctgcaagcggaagctcctcgcctctgagaggggaaagcgcagctgacagtgatggatgggattccgctcctagtgatctgcgaacaatccagacctttgttaagaaggccaaatccagtaagcgcagggcggctcaggccggacctacccagccaggcccacccagatcaacatttagcaggttgcaggctcccgactctgctacactgttggagaaaatgaagttgaaggatagcctcttcgatttagacggccctaaggtagcatctccacttagcccaacaagtctgacccataccagcagacctccggcagccctgacacccgtgcccttgtcccagggcgatctgtcacatccaccaagaaaaaaggaccggaagaatcgcaaactggggccaggcgcaggcgctggattcggagtcttgcggagaccaaggcccacacccggtgatggggaaaagaggtccagaattaagaaatcgaaaaagaggaagttgaagaaggctgagaggggggatagattgcccccacctggacctccgcaggcccctccgtcagacaccgatagcgaagaggaagaggaagaggaggaggaggaagaggaagaggagatggctaccgttgtcgggggagaggcacccgtgccagttttgcccaccccccctgaggccccacggccaccggcaacggtgcatccggagggtgtaccacctgctgattcagagtccaaggaggtcgggtccacagaaacctcccaggatggcgacgcaagctcttccgagggagaaatgcgggtgatggatgaggatattatggtcgagagtggtgacgacagctgggatctgatcacttgctactgtagaaaacctttcgcgggtagacctatgattgagtgctcactgtgtggaacgtggatccacctcagctgtgcgaagatcaagaaaacgaacgtgcccgatttcttttattgtcagaaatgcaaagagttgcggcctgaagccaggaggctggggggtcctcctaagagcggtgagccctag

SEQ ID NO: 234512 - DNA, 1200 bp, Artificial Sequence
  Description of Artificial Sequence: Synthetic coding sequence
atgccgggtgactgccggagggacccgcctcccactctgaaacccgaaacgcagccaccagagaagcgaaggagaaccatcgaggactttaataaattttgttccttcgtccttgcttatgccggatatatacctcctagtaaagaggagtcagattggcccgcttctggatccagtagccccctcaggggggagtcggccgctgactcggacgggtgggactccgctcccagcgacttgcggaccatccaaacattcgttaagaaggctaagtcttcaaaacgtcgcgcagcccaggcaggcccaactcagcccggacccccacggagcaccttcagccgacttcaagcccctgacagcgccactctgctggagaaaatgaaactcaaggactccctgttcgatctcgacgggccaaaagttgcatcgcctctttcacctacctcactgactcacacctctagacctccagcggctctgactccagtgcccctctctcagggtgatctgtcccaccccccacgaaagaaagacaggaaaaaccggaagttaggtccaggcgcaggcgctggctttggcgtgctccgaagacctagaccaacccctggcgacggagagaaaagatctcgcatcaagaagagtaagaagaggaaactaaaaaaggccgaaagaggagacaggctccccccaccaggccctcctcaggctcccccttcggataccgactccgaagaggaggaagaagaggaagaggaggaggaagaggaagagatggcaacagtggtaggaggcgaggccccagtgccagtccttccgacccctcccgaagcaccacgtcctcccgcaaccgtgcatccggaaggcgtaccgccagccgatagcgagagcaaagaagtggggtctactgagacttcccaggacggggacgctagcagcagcgagggagagatgcgggttatggatgaggatataatggtggagtcgggtgacgactcctgggatctcattacttgttactgtaggaagcctttcgctggaagaccaatgatcgagtgttcactgtgtggcacctggatccatctgtcttgcgctaagatcaagaagactaatgtaccggactttttctactgccagaagtgtaaagaacttcgacccgaggcacgcaggctgggcggtcccccaaaaagtggcgagccatag

SEQ ID NO: 234513 - DNA, 6120 bp, Artificial Sequence
  Description of Artificial Sequence: Synthetic coding sequence
atggatatcgtcgacaccttcaaccacttgattcctacggaacacctcgatgacgccctgtttctgggttcaaacctagaaaatgaagtctgtgaggatttctcagcatctcagaatgtgctagaggacagcttgaagaatatgctctccgataaggatcctatgctgggatccgcttctaatcagttctgtctacccgtcctcgatagcaacgatcccaactttcagatgccatgctctacagtggtgggattggatgatattatggatgagggagtcgtaaaagagagtggtaacgacacgatcgacgaagaagagttgatcctccctaatcgcaacctgcgagacaaggtcgaagaaaattccgtcaggagcccgcgtaagtccccaaggctgatggctcaagaacaggtgcgatccttgaggcagagtaccatcgctaaacgttccaacgccgctccgctgtccaatactaagaaagcctccggaaagaccgtatctaccgccaaggctggggtgaagcagccagaacgttcacaggttaaggaggaggtgtgtatgtccctgaagccagagtaccacaaggaaaaccggaggtgcagtagaaatagtggacagattgaggtggttcccgaagtgagcgtgtcatccagccactcttctgtgagctcctgtcttgagatgaaagacgaggatggactcgattcaaagcacaagtgcaacaatccgggagaaatcgatgtaccgtcacacgagctgaactgctctctcctgtccgagacgtgtgtgactattggtgagaagaagaatgaggcgctgatggagtgcaaggccaagcccgtgggctcccctttgttcaagttctcggacaaagaggagcacgaacagaatgatagtatctcgggaaaaaccggggaaacagtggtggaagaaatgatcgctacacgcaaggtggaacaggatagcaaggagacagtgaagctgagccacgaggacgaccatatcttagaggatgccggaagttccgacattagcagtgacgccgcttgtacaaaccctaataaaactgagaattccctggtggggctgccctcctgcgtggacgaggtgaccgagtgtaacctggagctgaaggatacgatgggtatagccgacaagaccgaaaacacgctggaacggaacaagatcgaaccgttgggttattgcgaggatgctgaatctaaccgtcagctggaaagtactgagttcaacaagagcaatctggaggtggtggacaccagcacttttgggccagaatctaacatactggaaaacgccatatgtgacgttccggatcagaactcaaagcagcttaatgctatcgaatccaccaagatcgaatctcatgaaaccgccaatctgcaggatgacaggaactctcagagcagcagtgtgagctatctggaatctaaaagcgtcaagtccaagcatacaaagcctgtaatccatagcaaacagaacatgaccactgacgctcctaagaagatcgtcgccgcaaagtacgaggtcattcattccaaaacgaaggttaatgtaaaatctgttaagcggaatacagacgtgccggaatcgcagcagaactttcacaggcctgtaaaggtacgaaagaaacaaatagataaagagcccaaaatccagtcctgtaatagtggggtgaagtccgtcaaaaaccaggcccacagcgtcttaaagaagaccctgcaggaccaaaccctggtacagattttcaaaccactcacacacagcttgagcgacaagagccacgcacatcccggatgtcttaaagaaccccaccatcccgctcaaacgggccatgtttcccacagtagccaaaagcagtgtcataagccccagcagcaggctcccgctatgaagaccaattctcacgtgaaagaggaactggaacatccaggcgtagaacactttaaagaggaggataaacttaagctgaagaagcccgaaaaaaatcttcagcccagacagaggcggtcttccaagtccttcagcctagacgagccaccactcttcatccctgacaacattgccactatacggagagagggttccgaccactcttcttcttttgagtccaagtatatgtggactccttccaaacagtgcggtttctgcaaaaagccccacggcaaccgtttcatggtcggatgtggtcggtgcgatgactggtttcatggcgactgtgttggactcagcctttctcaggcacagcagatgggtgaagaggacaaggagtatgtgtgtgtgaagtgttgcgcggaagaggacaaaaagacagaaatcctcgaccctgacaccctggaaaaccaggctacagtggaatttcacagcggggacaaaacaatggaatgtgaaaaacttggtttgagcaagcatactacaaacgataggaccaagtatatcgacgatacggtgaagcataaggtaaagatcctgaagcgcgaaagcggcgagggacgcaacagttctgattgtcgggataacgagataaaaaagtggcagctcgcccctctgaggaagatggggcaacccgtcctgccacggcgtagctccgaggagaagagtgagaaaattccaaaggaaagcaccacagtgacatgcacgggagaaaaggcgagtaagccgggaacccacgaaaagcaggagatgaagaaaaagaaggtcgagaagggagtgcttaacgtgcacccggcagcctctgcaagtaagcccagcgcggatcagatacgtcagtccgttcgccactccctgaaggatattctgatgaagcgtcttactgactcaaatttgaaggtgcccgaggaaaaggctgccaaggttgccacaaagatcgagaaggagctgttttcattcttccgggacacagacgcgaagtacaagaacaagtaccgctccctgatgtttaaccttaaggaccctaaaaacaacatactattcaaaaaggttctcaagggcgaggtgacaccagaccatttaatcagaatgtctccagaagaactagctagcaaggagctcgctgcgtggcgtagacgggaaaaccgccatacgatcgaaatgattgagaaggagcagagagaagtagaacggagacccataacaaagatcacacacaagggcgagattgaaatagagtccgatgcaccgatgaaggagcaggaggcggcaatggagattcaggagccggctgctaataagagtctggagaaacctgagggatcagaaaaacagaaggaagaagtagactctatgagtaaggatacgacatcccagcataggcagcacctgttcgatttgaactgcaaaatctgcattgggagaatggccccacccgtggacgatctcagccccaaaaaagtgaaagtagtggttggggtggcgcgtaagcatagtgataatgaggccgagtcaatcgcagacgccttgtcttctacctcaaatatcctggccagtgagttcttcgaagaggagaagcaagaatcaccaaaatccacattctcacccgcacctagaccagaaatgccaggcactgtcgaagtcgagtcaacttttctcgcacgcctaaacttcatttggaagggttttattaacatgccatccgttgccaagtttgtgactaaggcctatcctgtttccgggagtccagaatatttgaccgaggacttgcctgactctatccaagtcgggggtcggatcagcccacagaccgtatgggactatgtagagaagatcaaggcctccgggacaaaggagatctgtgtcgtgagattcacgccagtcacggaggaggaccagatctcctacaccctgctcttcgcatactttagctctcggaaacgttacggcgtggctgccaataacatgaaacaagtgaaggacatgtacctgataccactgggagccaccgacaaaatccctcatcctctcgtgccttttgacggacccggtctcgagttacatcgccctaacttgctactagggcttataattagacagaagctgaaacgccaacacagtgcctgcgcatcaacctcacacatagcggagacccccgaaagcgcaccgcctatcgcgctgcctccggacaaaaaatctaagatcgaagtgtctaccgaagaagccccagaagaggagaacgattttttcaatagttttaccaccgtgctgcataaacaaaggaataaaccgcagcagaacctgcaagaagatttaccaacagccgttgagccattaatggaagtcactaaacaagagccaccgaaacccctgaggtttcttccaggtgtcttaataggatgggagaatcagcccacaacactggaattagcaaacaagccccttcctgtggacgacatcctccaatctctgctgggcactacgggacaggtctatgaccaggctcagtcagtgatggaacaaaataccgtcaaggagatacccttcctcaatgaacagaccaattctaaaatcgagaagacagataatgtcgaagtcactgatggtgagaacaaggaaatcaaggtcaaggttgacaacataagcgaaagcacagataaaagtgcggagatcgagacttctgtagtgggctcctcctctatttctgctggatccttgacttctttgagtctccggggaaaacctccagacgtctcaaccgaggcctttttaacaaacctgagcattcagtccaagcaagaagaaaccgtggagtctaaggagaagaccttaaagcgacagttacaggaggatcaggagaacaatctgcaggacaatcagaccagtaattctagcccgtgcagatcaaatgtgggaaaggggaatatagacggtaacgtgagctgctctgagaatctggtcgccaacacagctcgctcgccacagtttatcaatctgaagcgagacccccgacaggccgcaggcaggtcgcagcccgttacaacgagtgaaagtaaggacggagactcctgccgaaacggggagaaacacatgctgcccggactgtcacataacaaggaacatctgacagaacagatcaatgtggaggaaaaactgtgtagcgccgagaagaactcgtgtgtacagcagtctgacaatcttaaggttgcgcaaaatagcccgagcgtggaaaatatccagacatcgcaggcggagcaggcaaagcctctgcaagaggacatacttatgcagaatatcgaaacagtgcacccatttcgtagaggtagcgctgtggccactagccattttgaggtcggcaatacttgtccctctgagtttccaagcaaaagtataacctttacaagccgcagcacttcaccaaggacatcaaccaatttctcccccatgcgaccacagcagccaaacctacagcatctgaagtcttctcctcccggtttcccctttcctggaccccctaactttcctccgcagagtatgtttggtttcccccctcatctcccccctcccctgctgcctccccctggcttcggctttgctcagaaccccatggtgccgtggccacccgtggtccacctgccaggccagccacagcggatgatgggtcccctctcccaagcttctcggtatatcgggcctcagaatttctatcaggttaaagacatccggaggcctgagaggcggcactcagatccttgggggagacaagaccagcaacagctggaccgcccttttaaccgcggaaagggggatcgtcagcgcttttacagtgactcacatcacctcaaacgtgaacgccacgagaaggaatgggagcaggaatcagagagacacaggaggcgcgatcggagccaagataaggaccgggatcggaagtcacgcgaagaaggccataaggataaagaacgtgccagactctctcatggggacagggggacggacggcaaggccagtagggactctagaaacgtggacaagaagcccgacaaacccaaaagcgaagattatgagaaggacaaggaacgggagaagtctaaacatagagagggcgaaaaggatcgagatcggtatcacaaagatagggatcatacagacagaaccaaatctaaacgttaa

SEQ ID NO: 234514 - DNA, 6119 bp, Artificial Sequence
  Description of Artificial Sequence: Synthetic coding sequence
atggacatcgtggacaccttcaatcatctcattcccactgagcatctcgatgacgctctgtttctcggatccaacctagagaacgaagtctgcgaggatttctctgctagccagaacgtgctggaagactcccttaaaaatatgctctccgataaagaccccatgctcgggtctgcaagtaatcagttttgcctacccgtgctggacagcaatgaccctaatttccaaatgccctgttctaccgtcgtcggactggacgatatcatggacgaaggcgtcgtcaaggaatctggaaacgacacgatcgatgaagaggagctcatcttacccaaccgcaacctccgcgataaagtcgaagagaatagcgtccggtcccccagaaagtctcccaggcttatggcccaggaacaagtgaggtcgctgcggcagtccactatcgccaaacgctcgaacgcggctccattgtccaatacaaagaaagcatcgggaaagactgtcagtactgctaaagcgggagtgaagcagcccgagcgcagtcaggtcaaagaagaagtttgtatgagcctcaaaccagaataccacaaagagaatcggaggtgctctagaaattctggacagatcgaggttgtccccgaagtctctgttagtagctcacattcgagcgtgagttcttgcctggaaatgaaagacgaagatggcctggattcaaagcacaaatgcaataaccccggagagatcgatgtgcccagccacgaacttaactgtagtctgttgagcgaaacttgtgtcacgatcggtgagaaaaagaacgaagcgctaatggaatgcaaggcgaagcctgtgggaagccctctattcaaattttctgacaaagaggagcacgaacagaacgatagcattagcgggaagaccggcgaaaccgtcgtggaggagatgatcgccacccgaaaagttgaacaggatagcaaggaaaccgtgaaattgagccacgaggacgatcatatcctggaagacgccggatcctctgatatcagctctgacgcagcctgtacgaacccaaataaaactgagaactccctggtaggattgccatcgtgcgtggatgaggtcacggaatgcaatctcgaactgaaggacaccatgggcatcgctgataagacggagaatactctcgagcggaacaaaatcgagcccctgggttactgtgaagacgccgagtcaaacaggcagctcgaaagcacagagttcaacaaatccaatctggaggtagtggacaccagcacttttgggcctgagtcgaatattctggagaacgctatttgtgatgtccccgaccagaatagtaagcagttgaatgctatcgaatcaactaagattgaaagtcacgaaactgcaaacctgcaggatgacaggaattcgcagtcttcaagcgtctcctacttggaatccaagtctgtgaaatccaaacacaccaagcctgtcatccacagcaaacagaatatgacgacagacgcccctaaaaaaatcgtggccgcaaagtacgaggtcatccattctaagacaaaagtgaacgtgaaatctgtcaagagaaacaccgatgttcctgaaagccagcagaatttccatcgcccagtcaaagtgcgcaaaaaacagattgataaagagccgaagattcaatcttgtaatagtggcgtcaaatccgtaaaaaatcaggcccactctgtgttgaaaaagaccctgcaggatcagacgttggttcagattttcaaaccactgacccacagcctcagcgacaaaagtcatgcacatcctggctgcctgaaagaacctcatcaccctgcccagaccgggcacgtctcacactcctcacagaagcaatgccacaaacctcaacagcaggcccctgccatgaaaaccaattcacatgtaaaggaggagctcgaacaccccggtgtcgagcacttcaaagaagaagacaaactaaaactcaagaagcccgagaaaaacctccagcccagacagagaagatcttccaagagcttctcccttgatgaaccccctctcttcatccccgacaatattgccaccatccgcagagagggttccgaccatagtagttcctttgagtcaaagtatatgtggacaccctctaaacagtgtggtttttgcaaaaaaccgcatggcaaccgctttatggtggggtgtggacggtgtgacgactggtttcacggagattgcgttggcctctccctgtcccaggcgcaacagatgggtgaggaggacaaggagtacgtgtgcgtgaagtgctgtgctgaggaggacaagaagactgaaattctggacccggataccctggagaatcaggcgactgtcgagttccacagcggagataagacaatggaatgcgagaagctcggattgagcaaacacactaccaatgatagaaccaagtatattgacgacactgtgaaacataaggtgaagatcctgaaaagggaatccggcgaaggtaggaactctagcgattgcagggacaacgagattaagaaatggcagctggccccactccgcaagatgggccaaccggtgcttcctcggagaagctccgaggagaagagcgagaaaatcccaaaggaaagcacgactgtcacctgtaccggtgaaaaggctagtaagcctggtactcacgaaaagcaagagatgaagaaaaagaaagttgaaaagggcgtgcttaacgttcatccagctgcttccgcctccaaacccagtgcagaccagattcgccagtccgttcgccacagcctgaaggacatccttatgaagcgacttactgacagtaatctgaaggttccagaggagaaggcggctaaggtagccaccaaaattgagaaggagctgtttagttttttccgcgacacagatgctaagtataagaataaataccgatctctcatgtttaacctgaaagaccctaagaataacatcttgttcaaaaaggtgctgaaaggtgaggtaaccccggaccatcttataaggatgtcaccagaggagttggcatctaaggagctggcagcatggcgccgaagggaaaaccggcataccatagaaatgatagagaaagaacaacgagaggtggagaggaggcccattacaaaaatcacccataaaggtgaaatcgagattgaatccgatgcaccaatgaaagagcaagaagctgctatggagatccaggaacccgcagcaaacaagagtttggaaaaaccagagggcagtgaaaagcagaaagaagaagtggattctatgtcaaaagataccacaagccagcatcggcagcatctatttgatctgaactgcaagatttgcatcgggagaatggcccctcccgtcgacgatctgtcgccgaaaaaggtgaaggtggtagtgggagtggcacgtaagcattccgacaatgaagcggaatccatagctgatgccctgagcagtaccagcaacattcttgcatccgagttttttgaagaggagaaacaggagtccccgaaaagcacctttagtcctgcacctcggccagaaatgcccggaactgtggaagttgagagcacctttcttgcacgcctgaattttatatggaaaggcttcataaatatgccctctgtcgcaaagttcgtgacgaaagcatacccggtgtctggttcccctgagtatctgacagaagatttgcctgatagtatacaggtggggggtagaataagtccacagaccgtttgggattacgttgaaaagatcaaggcaagcggtactaaagaaatatgcgtggtgaggtttacccccgtcacggaggaggaccagatttcctacacgcttttgttcgcttacttttcttcccgaaagagatatggtgtcgcagccaacaacatgaaacaggttaaagacatgtatctgataccattgggtgccaccgacaagatcccacacccactcgtgccattcgacggcccaggtctggaactgcatcggcctaacctactgctagggcttatcattaggcagaagctgaagcggcagcacagtgcttgtgcctcaacctcccatattgctgaaacccccgaatcggcccctccaatcgccctgcccccagacaaaaaaagcaaaattgaggtttcaacagaagaagccccagaagaggagaatgactttttcaacagtttcaccacggttttgcacaagcaacggaataaaccccaacagaacctccaagaagacttacctaccgcagtggagcccctcatggaagtgaccaagcaggagccacctaaacccctgcgcttcctgcccggagttttgatcggatgggagaaccagccaacaacattagagttggcaaataaaccactccctgtcgatgacatcctccagtccctactcggaaccactggccaagtgtacgaccaagctcagtcggtgatggaacaaaataccgtcaaggagatcccctttcttaacgaacagacaaactctaagatcgagaagaccgataacgtggaggtgacagacggtgagaacaaggagattaaggtgaaggtggataacatcagtgagagcacagataagtcagcggagatcgaaactagcgtcgtagggagcagtagcatttcagcaggatcactcactagtctctccctgcgcggtaagccgcctgatgttagcacagaggccttcctcaccaatttgagtatacagagtaaacaggaggaaacagtagagtccaaggagaaaaccctcaaaagacagctccaggaagatcaagagaataaccttcaggacaaccaaacctctaacagcagcccgtgtcgaagtaacgtgggcaaaggtaacatcgatggtaacgtgagctgcagcgagaatcttgtggctaacacagcccgaagccctcaatttatcaacctcaaacgggaccctaggcaggctgctggcagatcgcaacctgttacaacttccgagtccaaggatggcgatagctgcaggaatggagaaaaacacatgctgcccggtctgagccataataaagagcacctaaccgagcagattaatgttgaggagaaattatgttccgctgagaagaatagttgtgtgcagcagtccgataacttgaaagttgcacagaatagcccgagtgtcgaaaatatccaaacctcacaggctgagcaggcgaagcctctgcaagaggacattctgatgcagaatatcgaaactgtgcacccgttcagacggggatctgcagtggctacctcgcactttgaagtcggtaacacctgccctagcgaattcccaagcaagtccatcaccttcacctctcggagcacttctccaaggacatctaccaatttcagtccgatgagaccccagcaaccgaacctacagcacctgaaaagcagcccgccaggtttccctttccccggtcccccaaatttcccaccacagagtatgttcggtttcccacctcacctacctccgccactgctccctcccccaggcttcggcttcgcccaaaaccccatggtgccctggcctccagtggtccacttacccggtcagccacagagaatgatgggacccctctcacaggcttcccggtacatcggtcctcaaaatttttatcaggtgaaagatatacgacggccagagagacgccacagcgacccatggggccgtcaggaccagcagcaactggacaggccctttaatcgcggtaaaggagacaggcaaaggttttattctgatagtcatcacctgaaacgtgaacgccacgagaaggaatgggaacaggagagtgagcgacataggcgccgagatagatcccaggacaaggatagagatcggaagtctagggaagaaggccataaggataaggagcgagctcggctgagccatggcgaccgtggcacagatgggaaggcttcgagagacagtagaaacgtggacaagaagcctgataagcccaagtctgaagattatgagaaagataaagaacgagaaaaaagcaagcaccgagagggcgagaaagatcgtgataggtatcacaaagatcgagaccataccgatcgcactaagtctaagcgata

SEQ ID NO: 234515 - DNA, 1098 bp, Artificial Sequence
  Description of Artificial Sequence: Synthetic coding sequence
atgtccagctcggttgaacagaagaaagggccaacaagacagagaaaatgtgggttttgcaagtccaacagggacaaagaatgcggacaactgctcatatccgagaatcagaaggttgcagcacaccacaagtgcatgttatttagtagtgccctggtgtcctcacacagtgacaacgagtcactcggaggtttctctatcgaggacgtgcaaaaggaaattaaaaggggcaccaagctgatgtgctctctgtgccactgccctggagccactatcggctgcgatgtgaagacgtgtcaccgtacataccactaccactgcgcccttcatgataaagcccagatcagggaaaagccatcacaggggatctatatggtctattgtcgcaagcacaagaagacagcgcataacagcgaagcagatcttgaagagtctttcaacgaacacgaacttgaaccttctagcccaaagtctaagaagaagagccggaagggcagaccccgaaagaccaatttcaaaggactatctgaagatactcgctcaacgtccagccatggaaccgacgagatggagtctagctcttaccgggacagaagtccacatcgctcttccccaagcgacactagacctaagtgcggattctgccacgtaggcgaggaggaaaatgaggcaagaggcaagctgcacatcttcaatgcaaagaaggctgccgctcattataagtgcatgctcttctcttctggcactgtgcagctgactactacctccagggcagaatttggggacttcgatatcaaaactgtgctccaggagatcaagcggggaaaaaggatgaaatgcaccttatgcagtcaaccaggggctacgattggctgcgagattaaggcctgcgtgaaaacataccattaccattgtggcgtccaagataaggccaaatacattgagaatatgagccggggtatatacaagctgtactgcaagaaccatagcggcaatgatgagagggatgaggaggacgaagagcgcgagagtaaatcccggggtaaggtagaaattgatcagcagcagctgacccagcaacaacttaatggcaactag

SEQ ID NO: 234516 - DNA, 975 bp, Artificial Sequence
  Description of Artificial Sequence: Synthetic coding sequence
atgagctctagcgttgaacaaaaaaagggaccaacacgacaaagaaaatgcgggttttgcaagagcaacagggataaggagtgcggacaactattgatcagtgagaatcagaaggtggcggctcatcataagtgtatgctcttttccagcgcgctcgtatcctctcattccgataatgaatcactggggggttttagtatcgaggatgtgcagaaggagatcaagagagggaccaaattgatgtgcagcctatgccactgccctggagctactatcggatgcgatgtgaaaacttgtcaccgcacttatcattatcactgtgccctccatgataaagcacaaatccgcgaaaagccgagccagggaatatatatggtgtattgtcgtaaacataagaagactgcccacaattccgaagcggctgacctcgaggagtcatttaacgagcacgaacttgaacccagttccccaaagtccaagaagaaaagccggaaaggtcgccctaggaaaactaactttaagggacttagtgaagatacccgctctacctccagccacggaacagacgagatggaaagttccagttaccgtgaccgcagcccgcaccggtcctctccctctgatacaagacccaagtgtggattctgccatgttggggaagaagagaacgaggctaggggcaagctgcatatttttaacgcaaaaaaggcagctgcacactacaaatgtatgctcttcagctctggcaccgtacagctgactaccacgagccgcgctgaattcggagacttcgacatcaagacggtgctgcaggaaataaaacggggaaagcggatgaagtgtaccctctgttcacaaccaggcgctactatcgggtgcgagatcaaggcatgtgtcaagacttatcactaccactgtggcgtccaggacaaggctaagtatattgaaaatatgtcgcggggaatctacaaatag

SEQ ID NO: 234517 - DNA, 939 bp, Artificial Sequence
  Description of Artificial Sequence: Synthetic coding sequence
atgagctcttcagtggaacagaagaagggcccaaccaggcagaggaagtgtggcttttgcaaaagtaacagagataaggagtgcgggcagcttctcatctctgagaatcagaaggttgctgcacatcacaaatgcatgctgtttagcagcgcgctcgtctccagtcacagtgacaacgagtccctcggagggtttagcattgaagatgtgcagaaagaaattaagcgtggtacaaagttgatgtgcagtttatgccattgccctggcgcaaccatcggctgtgatgtcaagacctgccatcgcacctaccattaccattgtgccctgcacgacaaagctcagattagagaaaaacccagtcagggaatctatatggtgtactgtcggaagcacaagaaaaccgcccataactctgaagccgcagatctggaggagtcttttaacgaacacgaactcgaaccttcatcacccaagagcaagaagaagtcgcgcaagggcagacctcgtaaaaccaactttaaaggattgtctgaagacactcgcagcacttcgtctcacggtacagacgagatggaatccagcagttacagagaccgttccccgcaccgttcgtccccgtcagacactaggccaaagtgtggcttctgccacgtgggtgaggaggaaaatgaagcccgaggtaaactccatatattcaatgctaaaaaagccgcagcacactacaaatgtatgttatttagttcgggcacagtacagctgactaccacatcgagagcggagtttggagattttgatatcaaaacagtgctccaggaaatcaaaagaggtaagagaatggtttgctctttctacatttgctacgctacgctgcaccttatttgctgcttcaagttccgtgtacacccaaaatttatacaatcgagcgagaatcttaagtag

SEQ ID NO: 234518 - DNA, 1098 bp, Artificial Sequence
  Description of Artificial Sequence: Synthetic coding sequence
atgtcctcaagtgtggaacagaagaagggtcccactaggcagcgcaagtgtggattctgcaaatcaaatcgggataaagaatgtggccagctgctgattagcgaaaatcaaaaagtagcagcccaccacaagtgcatgttgtttagttctgccctcgtctcctcccactctgacaatgagtctttgggtgggttctcgatcgaagacgtacaaaaagaaataaaacgcggtactaaactcatgtgcagcttgtgccactgtccgggagctaccattggctgcgacgtcaagacctgccaccgcacttatcactatcactgcgctctccatgataaagcccagatcagggagaagccttcacagggcatctacatggtttattgtcgtaaacataagaaaacagcacacaacagtgaggccgatctcgaggagtcctttaacgagcacgaacttgaaccatcttctcctaaatccaagaaaaagagccggaaaggccgtccgaggaagaccaactttaaaggactgtccgaggatactaggagcaccagcagtcacgggacagacgaaatggagtcttcctcttacagggacagatctccacaccgctccagtccttctgacacccgccctaagtgtggcttctgccatgttggcgaagaggagaacgaagcaagggggaagttacatattttcaatgccaaaaaagctgccgcacattacaagtgtatgttattctcctcagggactgtgcagctgacaactactagtcgggctgaattcggggatttcgatataaaaactgtcctgcaggagatcaagcgaggcaaacgcatgaagtgcacgctgtgcagtcagccaggcgctacgattggatgcgagatcaaagcctgcgttaaaacatatcattaccattgcggcgtccaggataaggccaaatatatcgaaaacatgagccgtgggatctacaagttgtattgtaaaaatcacagtggcaacgacgaacgagacgaggaggacgaagagagagaatctaaatctcggggaaaggtggagatagaccagcagcaactaactcagcagcagctgaacggcaattag

SEQ ID NO: 234519 - DNA, 1101 bp, Artificial Sequence
  Description of Artificial Sequence: Synthetic coding sequence
atgtcttcatctgttgagcagaagaagggacccaccaggcagaggaaatgtggcttttgtaaatcaaatcgcgacaaggagtgcggtcaactgcttatcagtgaaaaccagaaggtggccgcacatcacaaatgcatgcttttctcaagtgctctggtgtcttcccacagtgacaacgaatctctcggcggtttttctattgaggatgtgcagaaagagatcaaacggggtacaaagctcatgtgcagtttatgccactgccccggtgccaccatcggctgcgatgtcaaaacatgccaccgcacttaccactaccattgtgccctgcatgataaggcccagattcgggaaaagcccagtcaaggtatatacatggtctattgtagaaaacataagaagactgcccacaattccgaggcggctgatctggaagaaagttttaatgaacacgaactcgaaccaagttctcccaagtccaagaagaagtccaggaaaggcagacccaggaaaaccaattttaaggggctttccgaggacaccagaagtacatcaagccacgggaccgatgagatggagtcttcctcttatcgagatagaagtccacacaggagtagtccatccgacacgcggccaaagtgtgggttttgtcatgtgggcgaggaggagaacgaggctaggggcaagctccacatcttcaacgctaaaaaggctgcagcacactataagtgtatgctcttctcttccgggacagtccagttgacaacgaccagcagagccgagtttggggatttcgatatcaagaccgtcctgcaggaaatcaaacgcggtaaacgaatgaaatgtacactgtgctcccagcctggcgctaccattgggtgtgaaataaaggcttgcgtgaagacttatcactatcattgcggggtgcaggacaaggccaagtacatcgagaacatgtcccgtggcatctataagctttactgcaaaaatcattcaggcaatgacgaacgggacgaggaggatgaggaaagggagtccaaatcccgcggtaaagtggagattgatcagcagcagctaactcaacaacagttgaacggaaattag

SEQ ID NO: 234520 - DNA, 996 bp, Artificial Sequence
  Description of Artificial Sequence: Synthetic coding sequence
atgtcgtccagtgtggagcagaagaaagggcctacccgccaaagaaaatgcggattttgcaagagcaaccgcgacaaggaatgtggacagctcttaatttctgagaaccagaaagtggccgcacatcataaatgtatgatgtgcagtctgtgtcactgccccggtgcaactattggctgcgacgtgaaaacttgtcacaggacttatcattaccattgcgccctccatgacaaagcccagattagagagaaacccagtcaggggatctatatggtctactgccgtaaacacaaaaaaactgcccacaatagtgaggccgacctggaagagtccttcaatgaacacgaactggagcctagcagcccaaaaagcaagaaaaagagtaggaaaggtcgcccacgtaagacaaactttaaagggctgtccgaggatacaaggtcaacatccagccacggaacggatgagatggaatcatcgtcttaccgcgatcgtagccctcaccgtagttcacccagcgacacaaggccaaaatgcggattttgtcacgtaggggaagaagagaatgaagcaagaggtaaactacacatttttaacgcaaagaaagcagctgctcattataagtgcatgctgttttcatccgggaccgtgcagctgaccaccaccagtagagcggagttcggtgactttgacataaaaactgtgctccaggagatcaaacgagggaagagaatgaagtgcactttgtgctcacagccgggagcgaccattggttgtgagattaaagcctgcgtgaaaacgtatcactaccattgtggtgttcaagataaggccaaatacatcgaaaacatgagccggggaatatacaagctatactgtaagaatcacagcgggaacgacgagagagatgaggaggatgaggagcgggagagcaaatcgaggggtaaggtggaaatcgaccagcagcagctgacacagcagcaactcaatggtaattag

SEQ ID NO: 234521 - DNA, 3075 bp, Artificial Sequence
  Description of Artificial Sequence: Synthetic coding sequence
atggcgagtgttcctgtttactgcctatgtcgactgccttatgatgtcactagatttatgatcgaatgcgatatgtgccaggactggttccacggctcatgtgtgggagtcgaggaggagaaagctgcagatatcgatctgtaccattgtccgaattgcgaagtcctgcacggtccctccatcatgaaaaagagaaggggatcctccaaaggacatgatactcataagggcaagcctgtgaagactgggtccccgacgttcgtgcgtgaactgagaagtagaacctttgacagctcagatgaggtaatcctcaaacctacaggcaaccagttaacagtcgagtttctggaggaaaacagtttctccgttccaattctcgtactgaagaaggacggcctggggatgacattgccatcgccctcttttactgtgagagacgtggagcactacgtgggttctgacaaggagatcgacgtcattgatgtgacacgtcaggcagactgcaaaatgaaactgggagattttgtcaagtactactattcaggtaagagagagaaggtgctgaatgtgatcagcttagagtttagcgacacacgactcagcaacctggtggagactccaaaaatcgtgcggaagctttcctgggttgagaacttatggcccgaagaatgcgtttttgaacgcccaaatgttcagaagtactgcctgatgagtgtgcgcgattcctacaccgattttcacatagatttcggaggcacgtcggtgtggtatcatgttctcaagggcgaaaagatattttacctcattagacctaccaacgccaacctgaccttgttcgaatgctggtctagctcctccaaccagaacgagatgttttttggagatcaggtggataagtgttacaagtgctccgtgaaacaggggcagactttgttcatccccaccggatggatccatgctgtgctgacacccgttgactgcctcgctttcgggggaaatttccttcactctttaaatatcgagatgcaacttaaggcctacgagatcgagaagaggctaagcactgctgatctatttcgattccccaattttgaaacgatctgctggtatgtaggcaagcacattcttgatatttttcggggtctgcgcgagaaccggcgtcacccagcctcttatttggttcacggtggcaaggctctgaatctggccttcagagcctggactcggaaagaagcactgcccgaccacgaggacgagatccccgaaaccgtgaggacggtacaactcatcaaggacctggcacgcgagattcgactcgtggaggatattttccagcagaacgtgggtaaaacctccaacatcttcgggctccagcgtattttccccgcaggtagtattccactgacccgccctgcccactctacgtcagtgtcaatgtcccggttgagtctaccctctaagaacggctccaagaaaaaaggacttaaaccaaaagagctctttaagaaggccgagcgcaagggcaaggagtcaagtgccctcggacccgctggacagctgagctataatctaatggacacctactcccatcaggcccttaaaacaggctctttccagaaggcaaagttcaacattactggagcctgcctgaatgactccgatgatgattcgcccgatctcgatctcgacggtaatgagagtccgttagctctgctgatgagtaacggatctaccaaaagggtaaaaagcctgagcaagtctcggagaacaaagatcgcgaaaaaagttgacaaagctcggctgatggcagagcaagttatggaggacgagttcgacctcgattccgatgacgaactgcagatcgatgagcgactgggaaaagaaaaagcgactctgatcatccggcctaagttcccccgtaagctccccagagccaaaccatgttcagatccgaatagggttagggagcctggagaggttgagttcgacatcgaggaggactataccaccgacgaggatatggtggagggcgtagaagggaagctgggaaacgggtcgggcgctggagggattctggatttactgaaggcctctaggcaagttggcggacccgactacgccgctctgaccgaggcccctgcttcacccagtacacaggaggcaatacagggcatgctctgtatggccaatctgcaatcttcctcatccagtcccgctacatcaagtctccaggcctggtggacagggggacaggaccggtcttctggctcttctagtagcggcctgggcactgttagcaactcccccgcatcccagaggactcctggtaaaagacccatcaagcgaccagcctactggaggacagagtccgaggaggaagaagagaacgcatcccttgacgagcaggactccctgggggcatgtttcaaggacgcggaatatatttacccctccctcgagtctgacgacgatgatcccgcacttaagagtcgtcctaaaaagaagaaaaactcagacgacgccccatggtcccccaaggccagggtgacccctactcttcccaaacaagaccgcccagtaagggagggaacccgagttgcctcaatcgagaccggccttgcagccgcagcagccaaactggcccagcaggagctccagaaagctcagaagaaaaagtatatcaaaaaaaaacccctcttaaaggaggtggaacagcctaggccccaggattcaaacctgtccctgacagttccagctcccacggtcgctgcaactccccagttagtgacctctagcagcccgttgccgccaccagagccaaaacaggaagcgctgtctggttctcttgctgaccacgagtacactgctcgaccaaacgcattcgggatggcacaagcaaacagaagcactactccaatggcaccgggagtgttcttgacacagcgtcgtccctctgtgggttcgcaatcaaatcaggcaggtcaagggaaaagacccaaaaagggcctggcaactgcaaaacagcgcttgggtagaattttgaagattcacaggaatggcaagctactgctctag

SEQ ID NO: 234522 - DNA, 2847 bp, Artificial Sequence
  Description of Artificial Sequence: Synthetic coding sequence
atggcctcagttccagtctattgtttatgtcggctgccctatgacgtcactcggttcatgatcgaatgcgacatgtgtcaggattggttccacgggtcctgtgtaggcgtcgaagaagagaaggccgctgatatagacttataccactgtcccaactgcgaggtcctgcacggccctagtatcatgaaaaagcggcgagggtcttccaagggtcacgacacacacaaaggcaaacctgtgaaaacaggtagtccaacatttgtgagggagctgcgcagccgtactttcgattcctccgacgaggtaattctgaagccgaccggaaatcagcttaccgtcgaattcctggaagagaactccttcagtgtgcccatactggtgttgaaaaaggacggccttggaatgactttgccaagcccctcatttactgtgcgggacgtggagcactatgtgggttcagataaggagatagacgtcatagatgtgacgaggcaggccgattgcaagatgaagctgggcgactttgtaaaatattactactccggaaagcgggaaaaagtgctgaatgtgatttcgctcgaattctcagacacaagactgtctaatctggtcgagacacccaaaatcgtcaggaaactatcctgggtggagaatctgtggccggaagagtgcgtgttcgaaaggcccaacgtgcagaagtactgcctaatgtcggttcgtgattcatacaccgactttcatattgacttcgggggtactagcgtttggtatcatgtcttgaagggagagaaaattttctatttaatccgacccactaacgccaatcttacactgtttgagtgttggagttccagttcgaatcagaatgagatgttttttggggatcaggttgataaatgttataagtgctcagtgaaacaggggcagaccttattcatacctaccgggtggattcatgccgtgctgactcccgtggactgcctggctttcgggggaaactttctccattcgttaaacattgagatgcagctgaaggcatatgagatagaaaagaggctgagcacagccgatctatttcgattcccaaattttgaaactatctgctggtacgtcgggaaacatatcctagacatttttaggggcctgcgggagaaccgcagacatcccgctagctacctcgttcacgggggtaaagccctgaacctcgccttcagggcttggaccaggaaggaagccctccctgaccatgaggacgaaatccccgaaaccgttaggacagtccagctgatcaaagaccttgcgagagagatcaggctggtggagtttaatataactggagcgtgtctcaacgacagtgatgacgactccccggacttagacctcgatggcaatgagagcccactggcactactgatgtctaatggcagtacaaagcgggtgaagtccctatcaaaaagtaggcgaaccaagattgccaaaaaggttgacaaggcgagactaatggctgagcaggtgatggaggatgagtttgatctggattcagatgacgaattgcagatagacgaaaggttgggaaaagagaaggccaccctgatcatcagaccaaaattcccaaggaaactgccacgcgcaaagccttgttccgatcccaatcgtgttcgggaaccgggtgaggtggagttcgacatagaggaggactataccaccgacgaggacatggtggaaggcgtggagggaaagcttgggaacggaagcggcgcaggtggcattttggacttgctgaaagcgtcccgccaggttggcggacctgactatgccgctctgactgaagccccagcttccccttccacacaggaggccattcaagggatgctctgcatggcgaatctacagtcctccagtagtagccctgccacttcaagccttcaggcatggtggactgggggtcaggatcgctcctctgggtctagtagttctggtctgggaacggtttccaatagtcctgctagccagcggacacctggaaaacgccctatcaaaaggccggcatactggcgcacggagtcggaggaagaggaagagaatgcctcccttgacgagcaggactccttaggtgcctgtttcaaggacgcggaatatatctatccgtctctggaatcagatgacgacgatccggcattaaagtccagaccaaagaaaaaaaaaaacagtgatgacgcaccctggtcaccaaaggcccgtgtcactcctaccctgcctaaacaagatcgtcccgtgagggagggtactcgggttgccagcatagaaacagggctggctgctgccgctgctaagctggcccagcaggaactccagaaggcacagaagaagaagtacatcaaaaagaaacccttgttaaaggaagtggagcaaccacggcctcaggattcaaatcttagcttaaccgtgccagcacccaccgtggccgctacacctcagctcgtgacttcctcaagtcctctgccccctcctgagcctaagcaagaggccctatcaggatctctggcggatcatgagtacactgcccgaccaaatgcatttggaatggcccaggcaaaccgtagtacaactcctatggccccaggcgtatttctaacgcagagacgcccatccgttggatcccagtcaaaccaggccggtcaaggaaagcggcctaaaaaaggtctggccaccgccaagcagaggcttgggcgaatcctcaaaatacatcgcaatgggaagctcctgctcaggcaggtcatcgttcaggccgaatgtcgacaggctattcacgaacccaagctgaagaggagggacgcccacccatag

SEQ ID NO: 234523 - DNA, 3183 bp, Artificial Sequence
  Description of Artificial Sequence: Synthetic coding sequence
atgaataggagtcgggcaattgtacaacggggaagggtgctcccaccacctgctccactcgacacaaccaacctcgccggtcgacgaactctccagggcagagccaaaatggcttccgtccctgtttactgtttgtgtaggctgccttatgatgtgaccaggttcatgattgaatgcgatatgtgtcaagattggttccatggctcctgtgttggcgtggaggaggagaaagcggcagatatcgacttataccactgtcccaattgtgaagtccttcacggaccgagtattatgaagaagcgtcgtggctctagcaaggggcacgatacccacaagggtaaacccgtgaaaaccggttcgccaaccttcgtgcgagagctcaggtccagaacttttgatagcagtgacgaggtgatattgaaacctacaggcaaccaactcacggtcgaattcctggaggaaaactcttttagtgttcccatattggtcctgaaaaaggacggactcgggatgacgctgccttctccttcgtttacagtgcgggatgtcgagcactacgttggctctgacaaggaaatcgatgtgattgacgtaactcgccaagccgattgtaaaatgaagctcggggacttcgtcaagtactactattccggtaagcgtgaaaaggtgctgaacgtaatctccttggagttcagcgatacaaggctctcaaacctggtggagacacccaagatcgttcggaaacttagctgggtggagaatctgtggcccgaggagtgtgtgttcgagaggcccaatgtccagaagtactgcttaatgagtgtcagagacagctacactgattttcacattgattttggcggaacaagcgtgtggtaccacgtgctaaaaggcgaaaaaatcttctacttaattcgccctacgaacgccaatcttacattgtttgaatgttggtcctcaagcagtaatcagaatgagatgttttttggagatcaggtggacaagtgctacaagtgctcagtaaagcaggggcagacactctttattcctacaggatggatccatgctgtcctgaccccggttgattgcctcgcgtttggcggtaactttctgcattcacttaatatagaaatgcagctcaaggcctacgagattgagaaacggttgtccactgctgatctgtttcggtttcctaatttcgaaactatatgctggtacgtcgggaagcacatcctggatatcttccgtggcctgagggagaacaggagacatccggcaagttatctcgtccacgggggaaaggcgctgaacctggcatttcgagcctggacaagaaaagaagctcttcccgaccacgaggatgaaattcccgaaaccgtacggactgtgcagcttatcaaggacttggcacgggaaattcgtctcgtggaggacatcttccagcagaacgtgggaaagacctccaacatcttcggcttgcagcggatctttcccgctgggagcattccccttacgagacctgctcactcgacttctgtgtccatgtcaagactgtctttgccctctaaaaacgggtctaagaaaaagggattgaaaccaaaggaactcttcaagaaggcggagaggaaaggcaaggagtcaagtgcccttggccctgccggacagctctcatataacctcatggacacctactctcatcaggccctgaagaccggatcatttcagaaagccaagtttaacataacgggtgcatgtcttaatgattctgatgacgactcccccgacttggatcttgacggtaatgagtcacccctagctttattaatgagcaacggttcaaccaagcgagttaagagcttgtcaaagtctcggagaaccaagattgcgaagaaggtcgacaaggcaaggctaatggccgagcaggtgatggaggacgagtttgatctcgattctgatgatgagctgcaaatcgacgagcgattgggcaaagagaaagccacactgatcattcgccctaaatttcctaggaaactacccagggcaaagccatgctccgacccaaatcgggtgcgggaaccgggtgaagtggagtttgatatcgaagaggactacaccaccgacgaagacatggtagaaggtgtggagggaaaactgggcaacgggtccggcgctgggggaattctggacctcctaaaagcttctcggcaggtcggtggacctgactatgccgctctgactgaagctccggcaagcccatccactcaggaagccattcagggaatgctatgtatggcaaatctccagtcttcaagctccagccccgctacatcgtccctgcaggcctggtggactggcggacaggaccggagcagcggctcctcttcctcaggcctcggtacagtatccaacagccctgcaagccagagaacacctgggaaacggcctatcaagaggcccgcttactggcgcaccgaatccgaagaggaggaggagaatgcatctttggacgaacaggattcactcggggcttgttttaaggacgctgagtacatttatccatcactggagagcgacgacgacgacccagccctgaagtccagacctaagaaaaagaaaaattccgacgacgctccctggagtccaaaggcgagagtgactccaactctgcctaaacaagaccggccagtcagagaggggacacgcgtagcgtctattgagactggcttggctgccgctgcagctaaactcgcccaacaagagctccaaaaggcccagaagaagaaatatattaagaaaaagccacttctcaaggaagtcgaacagcccagaccccaggacagcaacctttctctcacggttcctgccccaactgtggccgcaactccacaactcgttactagcagcagccccttgccccctccagagccaaaacaggaagcactgtctggctcgctggctgaccatgagtatacagcccgtccaaacgcattcgggatggcccaggcaaatcggagcacaactcccatggctcccggtgtcttcttaactcagaggcgcccatccgtcgggtctcagtcaaaccaagccggacaaggaaagaggcctaaaaaaggtctggcgaccgcgaaacagaggttaggccgaatcctcaaaattcaccgaaacggcaagctcctgctgtag

SEQ ID NO: 234524 - DNA, 912 bp, Artificial Sequence
  Description of Artificial Sequence: Synthetic coding sequence
atggacacatattcccatcaggccctgaagaccgggtcatttcaaaaagcgaaattcaacattaccggggcttgtttgaacgatagcgacgacgactctccagacctggatcttgacggcaacgaatctcccctggccttactcatgtccaacggaagcaccaagcgggtgaagtcactgtcaaagtcaaggcgaaccaagatcgctaagaaagttgacaaagcccgactgatggctgaacaggtgatggaggatgaattcgacctggacagcgatgatgaactgcagatagacgagcggcttgggaaagagaaggccaccttgatcatcaggcccaaatttccgaggaaactgccaagggcttcattggccctcacacccacagaattcgttaatcaggagaagctatccttgacactgcggaggacaatccagcaaatgaggacatggtggaaaggtctcaaggccagtctcggaatggttgttgccttagttgctttccttatctgtagccgacctgcgggacgatggggggacttaacgatgcttcccagtcccaggcctcagctgttgccagcgttgcgaagaccatcccgagcctgttgcgcctggccaacctgctcacctcacagaccgcatcgtctcccgctcgcttgtcgccctggaggtctcggagatcgcatagaagccgtcggtgccccagccgtgggttgggcccagtgcctgaccgtactattgcctagcgcccctcagggaagcggcccaagttccgggcagcatacgggagaacccagagcgaggcgcaggagacgcacacccgtttggatgaaccgcactgcctgggagcgtgccagccgcatgcagtctattagcattctccattggtctttgatgatgatgaccttactgtag

SEQ ID NO: 234525 - DNA, 2862 bp, Artificial Sequence
  Description of Artificial Sequence: Synthetic coding sequence
atagtgcaaagggggcgagttcttccaccacctgcccctcttgatacaaccaatctagctggccgacgcacgctgcagggtcgggcaaaaatggccagcgtcccagtgtattgcctgtgtaggcttccctacgatgtgacacggttcatgattgaatgtgacatgtgccaggactggtttcacggaagttgcgtgggcgtggaagaggagaaagctgcagacatagacctgtaccattgtcccaattgcgaagttctgcatggtccatccatcatgaaaaagaggcgcggatcttcaaagggacatgacacacacaaggggaagccagttaaaactgggtcacccacctttgttcgagagctgagaagtcggactttcgatagtagcgatgaggtgattctaaagcctactggaaaccagcttacggtggagttcttggaggagaactccttttcagtgcctattctggtgctcaagaaggatggactaggcatgaccctgcctagcccatctttcaccgtgcgcgatgtggagcactacgtaggctctgacaaagagatcgacgtgatagatgttacccggcaagccgattgcaagatgaaactgggggactttgtgaaatactactacagtggaaaacgggaaaaagtcctaaacgtcatctctctggagttcagtgatacccgcctctctaatctcgtggaaacccccaaaatagttaggaagctgtcctgggtggagaacttatggcctgaagagtgtgtgttcgaaagacctaatgtccagaagtattgtctaatgtctgtgagagactcgtatactgatttccacattgactttggcggaacaagcgtgtggtatcatgttctaaaaggcgaaaaaattttttatctaatccggccaacaaacgcgaacctgacccttttcgaatgttggtcttctagctctaatcagaatgagatgtttttcggcgatcaagtggacaagtgctataaatgctccgtcaaacagggacagacactgtttatccccactggctggatccacgccgtgttaacaccagtggattgtctcgcctttggcggtaacttcttacatagcctcaatatagagatgcagctgaaggcctatgaaatcgaaaaacggcttagcactgccgacttatttagatttcctaactttgaaaccatttgctggtacgtgggaaaacatatactggatattttcaggggtttacgcgagaataggagacaccccgcatcttatttagtacacgggggtaaggcccttaacctggcgtttagagcgtggactcgcaaggaagctctacctgatcacgaagacgaaataccagaaacggtgaggacagtgcagttaatcaaggacctcgccagagagattagacttgtggaattcaacataaccggcgcttgccttaacgattctgatgatgacagccctgatctcgatttggacgggaacgagagtcctttggccctgctgatgtcaaacggctccactaagcgtgtaaaatctctctccaagtcccggcgaacaaagatcgctaaaaaagtcgataaggctcgtctgatggccgagcaggtaatggaggacgaattcgacctggattctgatgatgaactccagattgatgagaggctgggcaaagaaaaagccacccttatcatacgaccaaagttccctaggaaactgccgcgagctaagccctgctccgaccctaatcgagttagggagccaggcgaggttgagttcgatatagaagaggactacacaacggatgaagatatggttgagggcgtggaaggaaagctgggcaatggtagcggggctggtggtattcttgatcttctgaaagcctcccgccaggttggcggaccagactatgctgcccttactgaagcgccagcctctcccagtacacaggaggccatccaaggaatgctgtgcatggctaatttgcagtcatcttcttccagccccgcaacatcttccctgcaggcttggtggaccggtgggcaagatcgatcatctggatcatccagctcaggattggggaccgtatccaatagccctgcctcacagagaacacctggtaaacgaccaatcaaaaggcccgcatactggagaacagaatcagaagaggaggaggaaaacgcttccctggacgagcaggactctttaggtgcctgtttcaaggacgcggagtatatctatccttctctggaaagcgacgatgacgatccagcccttaagagccgtccaaagaagaaaaaaaacagcgacgacgcaccgtggtctcccaaggctagagtaacgcctacgttgcctaagcaagatcgccctgtgcgggaaggcaccagggtggcctctatcgaaacgggcttggccgcagcggcagcgaagctggcccagcaggagctgcagaaggcccagaagaaaaaatacatcaaaaagaaacctcttttaaaagaagtggagcagcccaggccccaggactctaacttatcactcaccgtccctgctcctaccgtcgcagccaccccccagttggtgacgtccagctcccctctcccacctccagagcctaaacaggaggccctttccggatcgctggccgatcatgagtataccgcacgcccaaatgctttcgggatggcccaggctaataggtccacaacacccatggctcccggtgtattcctcacccagaggcggcctagcgttggctcacagtctaaccaggcgggtcaggggaaaaggccaaagaaaggccttgcaacggctaaacaaaggctcggcaggatccttaagatccataggaatggaaaattactgctctag

SEQ ID NO: 234526 - DNA, 345 bp, Artificial Sequence
  Description of Artificial Sequence: Synthetic coding sequence
atggcctccgtgcccgtttattgtctgtgccggctgccctatgatgtcactagattcatgattgaatgtgacatgtgtcaggactggtttcacgggtcttgcgtgggggtggaggaggaaaaagcggctgacattgacctgtaccactgtccaaattgtgaggtgctgcatggaccctcaattatgaaaaagaggaggggctcaagcaaaggacacgatacacacaaaggcaaacccgttaaaaccgggagtccaacctttgtaagagaactgaggtcacgaacatttgattcttcagacgaagtgattctgaaacccacagggaatcagctgaccgttgagtag

SEQ ID NO: 234527 - DNA, 381 bp, Artificial Sequence
  Description of Artificial Sequence: Synthetic coding sequence
atggcctctgtgcccgtctactgcctttgtagactgccatacgatgtgacacgtttcatgatcgaatgtgacatgtgtcaagactggttccacggttcctgcgtgggcgtggaagaggagaaggcagctgatatcgatctgtatcactgtccgaattgcgaagtcctgcacgggccatctataatgaaaaaaagacggggatcaagcaaaggccacgatacgcataagggtaaacccgtgaagaccggatctcccacattcgtgcgggagcttaggagcagaacctttgattccagcgatgaggttattctaaagcctactggcaatcaactcacagtggaatttctcgaagagaactccttcagcgtacccatcttatag

SEQ ID NO: 234528 - DNA, 294 bp, Artificial Sequence
  Description of Artificial Sequence: Synthetic coding sequence
atggcttctgtcccagtctactgcctctgccggttaccctacgacgtgacacgatttatgatagagtgtgacatgtgccaggactggttccatggttcttgcgtgggagtcgaggaagagaaggcggcagatatcgacctgtaccactgccccaactgtgaagttctgcacgggccttccatcatgaaaaagagacggggatctagcaaaggacacgacacacacaaaggaaagccagtgaagacaggttcccctacctttgtcagggagctaaggtctcgcacttttgactag

SEQ ID NO: 234529 - DNA, 348 bp, Artificial Sequence
  Description of Artificial Sequence: Synthetic coding sequence
atggcatccgtcccggtgtattgcctgtgcaggctcccttatgatgtcactcgattcatgattgagtgtgacatgtgccaggactggtttcatgggtcatgtgtgggagtggaagaggagaaggccgctgatatcgacctgtaccattgccctaactgtgaagtgcttcatgggcctagtatcatgaagaagagaagaggctccagtaaggggcacgatacacacaaaggtaagccagtgaaaacgggctcccctacattcgtgcgggaactaaggagccggacgtttgattcttcagacgaggtgattttaaaacccactggaaaccagctcaccgtcgagttctag

SEQ ID NO: 234530 - DNA, 294 bp, Artificial Sequence
  Description of Artificial Sequence: Synthetic coding sequence
atggcttctgtgccagtgtactgcctttgtcgactcccttacgacgtgactcggttcatgattgagtgcgacatgtgccaagattggttccacggatcatgcgtgggtgtggaagaagaaaaagctgccgacattgacctgtaccactgcccgaattgcgaggtactgcatggaccctccatcatgaaaaaacggcgtggatcttctaagggccatgacacccacaagggaaaacctgtgaagaccgggtcccccacattcgttagggagctgcgcagtcgaacgttcgactag

SEQ ID NO: 234531 - DNA, 447 bp, Artificial Sequence
  Description of Artificial Sequence: Synthetic coding sequence
atgaaccggtcacgtgccattgtccagcgaggcagagtgctgcccccacccgcacctctggacactacgaacctggcaggccgtcgcactttacagggtagggcaaaaatggcatcagttcctgtatactgtctgtgccggctcccttatgacgtcacacggtttatgattgagtgcgatatgtgtcaggattggtttcacgggagctgcgtcggggtagaagaagagaaagcagccgacattgacctataccactgtcctaattgtgaggtcctgcacggaccatcgatcatgaagaagaggcgcggatcgtccaaagggcacgacacacataaagggaagccagtgaagactggctcgcctacattcgtgcgggagcttcgaagccggactttcgattcctctgacgaggtgatactgaagcctaccggcaaccaactgacatag

SEQ ID NO: 234532 - DNA, 2637 bp, Artificial Sequence
  Description of Artificial Sequence: Synthetic coding sequence
atggcttccgtacccgtctactgcctgtgccggctgccttacgatgtgacccgcttcatgatcgagtgcgatatgtgtcaggattggtttcacggttcttgtgtgggcgttgaggaggagaaggcggctgacattgacctgtaccactgccctaactgcgaagtcctccatggccctagtattatgaaaaaaaggaggggaagttcaaaggggcacgacacccacaagggtaagcccgtcaaaacagggagtccaacctttgtacgcgaattacggtcccgcacctttgactcatccgatgaagtaatcctaaaacccacgggcaaccaacttactgtagaatttttagaggaaaactcttttagtgtcccaatcctggttctgaaaaaggatggcctcggcatgactctgccatcgccttccttcactgtgagagatgtagagcactacgtgggatcagacaaagagatcgatgtgatagacgttacaagacaggctgattgcaagatgaaacttggcgatttcgtaaagtactactactccggcaagcgggaaaaggtcctaaacgtgattagcttggagttttctgacactagactgagcaatcttgtggagacccctaaaattgttcggaagctgagttgggtcgaaaacctttggcctgaggagtgcgtgttcgagagacctaacgttcaaaagtactgcttaatgtcagtgagagattcatacactgactttcacatcgattttgggggaacctcagtgtggtatcacgtgctgaagggagagaagatattttacctgattaggccgacaaatgctaacctgaccctgttcgagtgctggagctccagttccaaccagaacgagatgttttttggtgaccaagtagataagtgctacaaatgttccgtcaagcaggggcagaccttgttcattcctaccggttggattcatgccgtgctgacccccgtggattgccttgcgttcggtggaaatttcctgcacagcctcaatattgagatgcagctgaaagcttacgaaatcgagaagagacttagcaccgccgacctgtttaggtttcccaatttcgagaccatatgctggtatgtagggaagcacatactggacatatttagggggctgcgcgagaacaggagacacccggcttcttatctcgtgcatggcggtaaggcactcaatctagcctttcgtgcttggacaaggaaagaagctctgcctgatcatgaggatgagattcctgagacggtgagaaccgttcagctgatcaaggacctcgccagagagataaggttggtcgaggatatcttccagcagaacgtaggcaaaacatctaacatattcgggctccaaagaatctttcccgctggaagtatcccactcactcggcctgcgcattccacgagcgtttctatgagcaggctctctctcccttcaaagaatggctctaagaaaaaggggttgaagccaaaggagctctttaaaaaagccgagcgcaaaggcaaggagtccagtgcccttgggcctgcaggtcagttgtcttacaacctgatggatacatacagtcaccaggcgttgaagacgggatcctttcaaaaggcaaaatttaacattacaggagcctgcctcaacgactccgacgatgacagtcccgatctggatttggacggcaatgagtcccctctcgccctgcttatgtccaatggctctacaaagcgggtcaagtctctttccaagtcgcgcaggactaagatagccaaaaaagtggacaaggccagactcatggcagagcaggtgatggaagacgaatttgacctcgattcagatgacgagctccagatcgacgaaagactggggaaggagaaagctaccttgatcattcgcccaaaattccccagaaagttgccaagggcgaagccctgtagcgatccaaaccgtgttcgagagcccggagaagtagagtttgacattgaggaagattatacgactgacgaggacatggtagaaggcgtggaggggtaccagacagctacccccgctccagcccagggcgcaagcgaggcccctgcctccccttccactcaggaagccattcagggaatgctttgtatggctaacctgcagagttcctctagtagtcccgctacctcatcactccaggcctggtggaccggaggtcaggaccgctcaagcggatcttccagctctggccttggcacagtcagtaattcgccggcatcacaaagaacacctggtaaacggccaattaaaagaccagcctactggagaacagagtctgaggaggaggaggagaacgccagcctcgatgagcaagatagcctgggtgcctgttttaaagatgcagaatatatctaccccagcctagagagtgacgacgacgatcctgcactgaaatctcgccctaagaagaaaaagaatagcgacgatgccccatggagcccaaaggcccgagtgaccccaacactaccgaagcaggaccggcctgtcagagaaggaacaagagttgcatctattgaaacgggcctcgctgctgctgctgctaagctcgcccagcaagttaaaaagatgaagctgagcctcacggattcaggttag

SEQ ID NO: 234533 - DNA, 417 bp, Artificial Sequence
  Description of Artificial Sequence: Synthetic coding sequence
atgaagctacctatcttcatcgccgatgctttcacagcacgcgcatttcgcggaaaccccgcagccgtgtgtcttctcgagaatgagctcgatgaggacatgcaccagaaaattgccagggaaatgaacctgtccgagaccgcattcattcggaagttacatccgactgacaattttgctcagaagaacatgaactcaacactcaccttcgttactttgagcggagagctccgggctcgtagagctgaggacggaatagtcctcgacttacccctgtatccagcacatcctcaggacttccacgaagtcgaagacctcattaagactgcaataggaaacaccttagttcaggatatttgttacagccccgacacccagaagctgttggtcagattgtcagatgtctataatcggtag

SEQ ID NO: 234534 - DNA, 867 bp, Artificial Sequence
  Description of Artificial Sequence: Synthetic coding sequence
atgaaattaccaatatttatcgccgacgcgttcaccgccagagccttccgtggaaatcccgcagccgtttgcctgctcgagaatgaactggatgaagatatgcatcagaaaatcgccagagaaatgaacttgtccgaaacggctttcattcggaaattgcaccctaccgacaatttcgcacagtcaagttgttttggcctgaggtggttcaccccagcctcagaggtccctctgtgtggccacgcgacgctggcaagcgccgcagtgctgttccacaaaattaaaaacatgaactctacactgacatttgtcactctctctggggagctgcgcgctcgacgtgcagaagacggcatagtgctggacctaccactataccccgctcacccacaggatttccacgaggtggaggatcttatcaagactgccatcggaaatactctcgtgcaagatatatgttattctccagatactcaaaaactgctagtccggctgtccgacgtatataatcgctccttcttggaaaatctgaaagttaatactgagaacctgttacaggtcgagaatacgggcaaggtgaagggactgatcctaacccttaagggggagccagggggacagactcaagcatttgatttttattctcggtacttcgccccatgggttggggtcgccgaagacccagtgaccggaagtgcgcacgccgttctcagtagttactggtctcaacatcttgggaaaaaggaaatgcatgccttccaatgcagccaccgaggcggtgagctcggaatcagtctgagacctgatggcagagtggacatcagggggggtgccgcagttgtcttggagggtaccctcactgcctag

SEQ ID NO: 234535 - DNA, 768 bp, Artificial Sequence
  Description of Artificial Sequence: Synthetic coding sequence
atgcaccagaagattgccagggagatgaatctgagcgaaaccgctttcatcaggaagctccacccaacagacaacttcgcacagtcttcttgtttcggactccgttggttcactcccgcatcggaagtacctctatgtgggcacgcaacactggcatctgcagccgttctgtttcacaaaataaaaaatatgaacagcacattaacattcgtcactctcagcggggagcttagggcaaggcgcgcagaggacgggattgtgttggacctacccctttacccagcacatcctcaggatttccacgaagtggaggacttaatcaagacagccataggcaacacactagtacaggatatctgttacagccctgatacacagaaactgctggtcagattgagtgatgtgtataacagatcgtttttagaaaatttaaaggtgaataccgagaatcttctgcaggtagaaaacacgggtaaagtcaaaggcctgatcctcaccttaaaaggcgaacccggaggtcagacccaggcattcgacttttactctagatacttcgcaccttgggtcggtgtggctgaagaccctgtcaccggctctgcccacgctgtgctctcatcctattggtctcagcaccttggaaaaaaagagatgcatgcctttcagtgcagccatagaggtggagagctgggaatctcgctgaggccagacggccgtgtggacatccggggaggtgccgctgttgtcctggaaggcacactcaccgcctag

SEQ ID NO: 234536 - DNA, 867 bp, Artificial Sequence
  Description of Artificial Sequence: Synthetic coding sequence
atgaaactgccaatcttcattgctgacgccttcaccgcacgagcattccgtgggaatccagcagcagtttgcctgctggaaaacgaactggatgaagacatgcatcagaaaattgccagagagatgaatctttcagagacggcgttcatccgaaaattgcatcccaccgataacttcgcccagagtagctgctttggacttcgctggttcactccagcttccgaagtccctctgtgcggacacgcgacactggcctcagctgccgtactgtttcataagatcaagaacatgaatagtaccctgacctttgtgacactgagtggggaactgcgcgctaggagagcggaagacggcatcgtcttagacttacccctttacccggctcatccacaggacttccatgaagtggaagacctgattaaaacagcaattggaaacacattggtgcaggacatctgttactctccagacacccagaagctcctggtacgcctctccgatgtctacaaccgctcgttcctggagaatttgaaagtgaatacagaaaatttactgcaggttgaaaataccgggaaggtgaagggtctaatcctaacactaaagggtgagccgggtgggcagacacaggcattcgatttctatagcaggtactttgcaccttgggtgggagttgcggaggatcctgtcactggcagcgcccacgccgtcctcagctcttattggagccagcacctagggaagaaggaaatgcacgccttccagtgcagccaccgaggcggtgagcttgggatcagtttgagacccgatgggagagttgatatccggggtggtgccgcagttgttctggaggggactctgaccgcatag

SEQ ID NO: 234537 - DNA, 843 bp, Artificial Sequence
  Description of Artificial Sequence: Synthetic coding sequence
atgaagctgcccatcttcatagcagacgccttcaccgccagagcctttaggggcaatcctgctgccgtttgccttctggaaaacgaattggatgaagacatgcatcagaaaattgctcgggagatgaatctctccgaaactgctttcatcaggaagctgcaccccacagataactttgcccagagttcatgtttcggactgcgatggttcactccggctagtgaggtgccactatgtggacacgccacactcgcatcagccgcagttctgtttcacaagataaagaatatgaattccacgcttaccttcgtgacactcagcggggagctcagagccagacgcgcagaggacggcattgtgctcgatttgcccctctaccctgcccatccccaagattttcacgaagtggaggacctgatcaagactgccatcggtaacacgctcgttcaggacatctgctactctcctgatacccaaaaactactggtccggctgagtgatgtgtacaataggagctttctggaaaacctcaaggtcaacaccgagaatctccttcaagtggaaaacaccggcaaggttaagggactgattttgacactcaagggagagccgggagggcagacacaagcgtttgatttttacagtcggtacttcgccccttgggttggagtggctgaagatccagtgacggggtcagctcatgccgtgctgtcaagttactggagccagcacttgggcaaaaaagaaatgcatggcaggaccgctttgtaccaatttctcttctacctgccaaactcaaagctggtctttctgctgatatgcactatacctctgaagatgtag

SEQ ID NO: 234538 - DNA, 1356 bp, Artificial Sequence
  Description of Artificial Sequence: Synthetic coding sequence
atggtcggctcggcccttcgaagaggcgcacacgcatatgtctacctggttagtaaggccagccacatatccaggggccaccaacaccaggcctggggttcccgcccaccagctgccgagtgtgctactcagcgggctcctggcagcgtggttgagctgttgggcaagtcctatcctcaagacgaccatagcaacctaacaaggaaagtcctgacccgcgtggggaggaacctgcacaaccagcagcaccatcccttgtggcttataaaggagcgcgtaaaggagcacttttacaaacagtatgtcggccgttttggcacgccccttttttcggtttacgacaatttgagcccagtggtcaccacatggcagaactttgactctctgcttatccctgctgaccaccctagtcggaagaagggggataactattacctcaataggacccatatgcttcgggctcatacaagtgcccaccagtgggacctcctccatgctgggctggacgcctttctggtagtgggggacgtctatcggcgagatcaaatcgatagccagcattacccaatcttccatcaactcgaggcagtgcggttgttttcaaagcatgaattgttcgccggaatcaaggatggcgaaagcctacagttgtttgagcagtcctcaagaagtgcccataaacaggagacacacacgatggaagccgtgaaactcgttgagtttgacttgaaacagaccttaacccggttgatggcccaccttttcggcgacgaacttgagataagatgggttgactgctatttccctttcacccatccgtcgtttgagatggagattaacttccacggcgagtggctggaagtgctcggctgcggagtaatggagcagcaacttgtgaattcagcaggagctcaggatcgcattggctgggcattcgggctgggcctggagcgcctggcaatgatcctgtacgatataccggatattcggctcttttggtgtgaagatgagcgcttcctgaaacagttctgcgtgagtaacatcaatcaaaaggtgaagttccagcctctgtcaaagtaccccgctgtaattaatgatatcagtttttggctgccatccgagaattacgctgagaacgatttctatgatctcgtgcgcaccataggcggagatctggtcgaaaaagtagatctaatcgacaaatttgttcacccgaagactcataaaacaagtcattgttataggattacctataggcatatggaacggacactgagccagcgggaagtgcgtcatatccaccaagcactacaggaggcagccgttcagctgctgggcgtggaagggaggttctag

SEQ ID NO: 234539 - DNA, 1356 bp, Artificial Sequence
  Description of Artificial Sequence: Synthetic coding sequence
atggtcggctcagccctccggagaggcgcacacgcctacgtttacttggtgagcaaagcatcccacatcagccgcggtcaccaacaccaggcttggggctcccgacccccagctgccgaatgtgccacacagagagcccctggcagcgtcgtcgagctcctgggaaaaagctatccccaggacgatcacagtaatcttacgcgcaaagtccttacccgggtcggccgaaatctccataaccaacagcaccaccccctgtggctgattaaggagcgtgttaaagaacacttctataagcagtatgttgggcgatttggcaccccacttttcagtgtttacgataacctgagtcctgtggtcacgacctggcagaactttgatagcttgctgatccctgccgaccacccttctcggaagaagggcgataattactacctgaacaggacacatatgctgcgggcacacacatcagcacaccagtgggacctgcttcatgcagggcttgacgcctttctggtcgttggcgacgtctacagaagggaccagatcgatagccagcactatcctatctttcaccagctagaggccgtaaggctattctcaaagcacgagctctttgcaggcattaaggacggggagtccctacaactattcgaacagagctcaagatcagcccataagcaggagactcatactatggaggcagtgaagttggtggagttcgacctgaagcagactttaacacgacttatggcgcacctgttcggtgacgagcttgaaataaggtgggtggactgttatttcccatttactcatccctcattcgagatggagattaacttccacggggagtggctggaggtgctgggatgcggggtgatggaacaacagctggtgaacagtgccggagcacaggatcgaatcggctgggcctttgggctgggtctggaacgattggccatgatattgtacgatatccccgatattagactcttttggtgcgaggatgagagattcctaaagcagttttgcgtgtccaacatcaaccaaaaggtcaaattccaaccgctgagcaagtaccccgcagtgataaacgacattagtttctggctcccctcggaaaattatgctgagaatgacttctacgacctcgtccgcactattggaggggatctcgtcgagaaggtggatctcatcgataaatttgtgcatcctaagactcacaaaacctcacattgctaccggattacctatagacacatggagaggacactgtcacagcgcgaagtccgacacattcaccaggccctgcaggaggctgcagtgcaactattgggggtcgagggacggttttag

SEQ ID NO: 234540 - DNA, 468 bp, Artificial Sequence
  Description of Artificial Sequence: Synthetic coding sequence
atgctgagggctcacacatctgctcaccagtgggacctgttgcacgcgggactggacgcattcctggtcgtgggggatgtgtaccggcgtgaccagatagactcccagcattatccaatatttcaccagctggaagccgtccgcctctttagtaagcacgagctgtttgctgggattaaagacggcgaatcactacagctgtttgaacaatctagcagatcagcacacaagcaagagactcacacaatggaagctgtgaagctggtcgagttcgatctgaaacagacactgaccaggctcatggcgcacctgtttggagacgagctggagattcgctgggtggattgctatttcccgtttactcacccgtcattcgagatggaaattaatttccacggtgaatggttagaggtgctgggatgcggagtaatggaacagcagttagttaactccggaggtgcaacttag

SEQ ID NO: 234541 - DNA, 306 bp, Artificial Sequence
  Description of Artificial Sequence: Synthetic coding sequence
ctctttgcaggaatcaaagatggagagtctctccaacttttcgagcagagcagtaggtctgctcataagcaggagacccatacgatggaggccgtgaaactggtggaatttgatttaaagcaaacattgaccaggctgatggcccacttgtttggcgatgaacttgagatcagatgggttgattgctacttcccctttactcatcctagttttgaaatggaaataaattttcatggcgaatggctggaggtgctaggttgtggcgtgatggaacagcagctcgtgaactccggcggtgcaacctag

SEQ ID NO: 234542 - DNA, 849 bp, Artificial Sequence
  Description of Artificial Sequence: Synthetic coding sequence
atgtccggggctgaccggagcccaaatgctggggcagcccctgacagtgctcctggccaggctgctgttgccagcgcgtatcagcggttcgagccccgagcttacctgcggaataactacgcgccacccaggggtgatctatgcaaccccaacggagtgggcccttggaaactgcgttgtctggcccaaactttcgctaccggcgaagtgtctggaaggactttaatcgacatcggaagcgggcctaccgtgtaccagctgctcagcgcctgttcacactttgaagacattacaatgaccgactttctcgaggtgaatagacaagaacttggccgatggctgcaggaggaacctggtgcttttaattggtccatgtactcccaacatgcatgcttgattgagggaaagggtgagtgctggcaggacaaggaacgccaactgagggcaagggtgaagagggtcctgcctatcgatgtccatcagccacagccactgggagccggatcccccgctcccctgcctgcagacgccctcgtaagcgcattttgtcttgaagccgtgagccctgacctcgctagctttcagagggcgttggaccatatcaccaccctgttgaggccagggggtcacctcctactcattggagctttggaggagtcctggtacttggccggagaagccaggttgactgtggtccctgtgagtgaggaagaagtccgtgaagccctcgtaagaagcgggtacaaagtgagggatctcagaacatacatcatgccagctcatctgcagacaggcgtggacgacgtaaagggggtttttttcgcctgggcacagaaagtcgggctctag

SEQ ID NO: 234543 - DNA, 555 bp, Artificial Sequence
  Description of Artificial Sequence: Synthetic coding sequence
atgacagacttcctggaagtcaatagacaggagctcggacggtggctgcaagaagaacctggcgcattcaattggagcatgtacagccagcatgcctgcctgatagaagggaagggtgagtgctggcaggacaaggagcgccagcttagggcgagagtgaagagggtattacccatcgacgtccatcagccgcagccccttggcgcaggcagccctgctcccctaccagctgatgccttggtatccgcattctgtctggaagcagtcagtcccgatcttgcctcctttcagagagccctggaccacataacgacactgctgcgccctggcggtcacctgctgttaattggagctctggaggagagttggtacctggcaggggaggccaggttaactgtggtccccgtgtcagaagaggaagtcagagaggctcttgtgcggagcggctacaaggtgcgtgatctaagaacttacattatgcctgcccacctgcagacaggcgtggatgacgtcaagggcgtatttttcgcctgggctcagaaggtgggactctag

SEQ ID NO: 234544 - DNA, 741 bp, Artificial Sequence
  Description of Artificial Sequence: Synthetic coding sequence
atggaagaagccaagtcccaatctttagaggaggattttgaaggtcaggcaactcatacaggccctaagggggtcatcaacgactggagaaagttcaagctggagtcccaggactcagattccattcctcccagcaagaaggagatcctgaggcaaatgtcatcaccccagtcccggaacggtaaagactcaaaggaacgtgtttctcggaaaatgagtatccaggagtacgaacttatccataaggaaaaagaagacgaaaactgtctgcggaaatatagaagacagtgtatgcaggatatgcatcagaagctctctttcgggccacgctacgggtttgtgtatgaactggagacagggaaacaattcttggagaccattgagaaggaattgaagatcactactatagtggtccacatctacgaagatggtattaagggctgcgacgcactgaattcaagtctcacctgcctggcagctgaatacccaatagtcaagttttgtaaaatcaaagcttcaaacacaggtgcgggagatcgcttctccttggatgtgctacctactttgttgatttataaggggggagagctcatcagtaactttatcagcgtggcagagcagttcgccgaggagttttttgccggtgacgtggagtcctttctcaacgagtatggcttgctgccggagcgagaggtgcatgtgttggagcatactaaaatagaagaagaagatgtggagtag

SEQ ID NO: 234545 - DNA, 741 bp, Artificial Sequence
  Description of Artificial Sequence: Synthetic coding sequence
atggaggaggccaaaagtcagtccctggaggaagacttcgaaggccaggcgacacacaccggtccgaaaggggtgatcaacgattggcgcaagtttaagctggaatcccaggactccgattccattcccccatctaaaaaagaaatcctgaggcagatgtctagcccacagagccgaaacggcaaagattctaaggagcgggtctcaaggaagatgtccatccaagaatacgaactcattcacaaagaaaaggaggatgaaaactgtctgcggaaatatcgtagacagtgtatgcaagacatgcaccagaaattatccttcggccctaggtacggtttcgtgtacgagctggagaccggaaaacaatttctggagactattgagaaagagctgaaaattacaacaatcgttgtacatatttacgaggacgggattaaaggctgcgatgcattaaattcaagcctaacctgtctggccgctgaatacccaatcgtgaaattctgtaagatcaaggctagtaacacaggagccggagataggttttccctagatgttttgccgactctcctgatttacaaaggcggtgagctgatctcaaattttatctcggtggccgaacaattcgctgaggagttcttcgcaggtgacgttgagagcttcctaaacgaatatggcctgctcccggaaagggaagtgcacgtgttagagcacactaagatagaggaggaggacgttgagtag

SEQ ID NO: 234546 - DNA, 585 bp, Artificial Sequence
  Description of Artificial Sequence: Synthetic coding sequence
atgagcagcccacagtcgcggaatggcaaagactctaaagagcgagtgagtcgtaagatgtctatacaagagtatgaattaatacacaaagagaaagaggatgaaaattgtctgcggaagtacaggcgccagtgcatgcaagacatgcaccaaaagctgtccttcggcccacgttacggctttgtttatgagctggaaactggaaaacagtttctggagaccattgaaaaggagctgaagattacaaccatagttgtccatatctatgaagatggtataaagggatgcgacgcactaaacagctctctgacctgtctggctgccgagtatcctattgtgaaattctgcaaaatcaaagcttccaataccggagccggagatcgattctccctggacgtgctgcctacactgctcatatacaagggaggagagctaatttccaatttcatctctgtggcggagcaatttgctgaagagtttttcgcaggggacgttgaatcttttctgaacgagtatggactgctgccggagagggaggtccacgtgttggaacataccaaaattgaggaggaggatgtagaatag

SEQ ID NO: 234547 - DNA, 585 bp, Artificial Sequence
  Description of Artificial Sequence: Synthetic coding sequence
atgagctccccccagtcacgcaacgggaaggattcaaaagaacgggtatctcgcaagatgagcatccaagaatatgagttaattcataaagagaaagaagacgaaaattgcctgcgtaaatatcggaggcagtgcatgcaggacatgcaccagaagctcagcttcggacctcgctacggatttgtgtacgaactggagactggaaaacagttccttgagacaatcgagaaagagctgaagattaccacaatagtggtccacatttatgaggatgggatcaaaggctgcgacgcgttaaatagctcactgacctgcttagctgctgaatatcccatcgtaaagttctgcaagatcaaagcctcaaatactggtgccggagataggttttccctggatgtactccctacgctcctaatttacaaaggcggagaactgatatccaattttatttcggtcgccgagcagtttgctgaagaattttttgcaggtgacgtcgaaagcttcttgaatgagtacggtctcctcccggaaagagaggtacatgttctggagcatacaaagatcgaagaggaagacgtagagtag

SEQ ID NO: 234548 - DNA, 906 bp, Artificial Sequence
  Description of Artificial Sequence: Synthetic coding sequence
atgactactctggacgacaagttactaggagaaaaattacagtactactactcttcaagcgaggatgaagactcagaccacgaggacaaagaccgaggccgatgtgcacctgcctcctctagtgtacccgctgaagctgaactggccggagagggcatttctgtgaacaccggcccaaaaggcgtgataaatgactggagacgctttaagcagcttgaaacagaacagagagaggagcaatgcagagagatggagcggcttattaagaagctttccatgacctgccgatctcacctggatgaggaggaggaacaacagaaacaaaaagacctgcaggagaagattagtggcaagatgacacttaaggaatttgctattatgaacgaggaccaagatgacgaagaattcctgcagcaatatcggaagcagcgaatggaggagatgcggcagcaactgcacaagggccctcagtttaagcaggtctttgaaatttcatctggtgaaggtttccttgatatgattgacaaagaacaaaagtcaatagtgatcatggtgcacatctatgaggacggaatacctgggacagaagccatgaacgggtgcatgatctgtctggccgcagagtatcccgctgtcaagttttgtaaggtgaaaagttcagtgattggggcaagctcacagttcacccgcaacgctttgcccgctctcctgatctataagggcggagagctcatcggcaacttcgtacgggtcaccgatcagcttggagacgacttcttcgccgtggacttggaagcgttcttacaggagttcgggttgttgcctgagaaagaggtgctcgtcctcacttccgttcggaactccgcaacttgccattctgaagacagtgaccttgagatagattag

SEQ ID NO: 234549 - DNA, 330 bp, Artificial Sequence
  Description of Artificial Sequence: Synthetic coding sequence
taattacagtactattatagttctagcgaggatgaggactcagaccatgaggacaaggatcgcggtcgttgtgctcctgctagctcctctgtgcccgcagaggcagaattggcgggtgagggaatctccgtcaatacaggtcccaagggcgtcataaatgactggagaaggtttaaacaactggaaactgagcaacgggaagaacagtgccgcgagatggagagactaattaagaagctgtctatgacttgccgcagtcatctcgatgaggaagaagagcagcagaaacagaaggacctgcaagaaaagatctccggtaaggagcgctag

SEQ ID NO: 234550 - DNA, 276 bp, Artificial Sequence
  Description of Artificial Sequence: Synthetic coding sequence
tagtgcgcacctgcttctagctctgttccagccgaagccgaactagcaggtgagggtattagcgttaatactggtcctaaaggggtaatcaacgactggaggaggtttaagcagttggagacagaacagcgcgaggagcagtgtagagaaatggagcggcttataaagaaactgagtatgacgtgtagatcgcatttggacgaggaagaagaacagcagaaacagaaagacctgcaggagaagatctcaggcaagaaaagttgggcgatactgtag

SEQ ID NO: 234551 - DNA, 726 bp, Artificial Sequence
  Description of Artificial Sequence: Synthetic coding sequence
atgcaggaccccaacgaggacacagagtggaacgacatcctccgagatttcggcatcctgcctcctaaggaggagtcaaaagacgagattgaagagatggttttgcgcctgcaaaaagaggctatggtgaaaccctttgagaagatgaccctggctcagttgaaggaagcggaagatgagttcgatgaggaggacatgcaggctgtagaaacctacagaaagaagaggctccaggagtggaaagccctaaagaagaaacaaaaatttggtgagcttcgcgaaattagcggtaatcagtacgtgaatgaggttacaaatgctgaggaggatgtttgggtgattatacatctgtacaggagctcaattcccatgtgcttgttagtcaaccagcatctcagtctactcgcccgaaagttcccggaaactaagtttgttaaagccatcgtgaactcctgtatccagcactaccacgataattgcctgccgactatattcgtgtacaaaaacggccagattgaggctaagtttatagggataatagagtgtgggggtattaacctgaagctggaagagctggaatggaaactggctgaggtgggcgctatccaaactgacttggaggagaacccgagaaaagatatggttgatatgatggtttccagcattcgcaataccagcattcacgacgactccgatagctctaacagcgacaacgatacaaagtag

SEQ ID NO: 234552 - DNA, 720 bp, Artificial Sequence
  Description of Artificial Sequence: Synthetic coding sequence
atgcaagatcctaatgccgacacagaatggaatgatatactgcgaaagaagggcatactgcctccaaaggaatccttgaaagagctcgaggaagaagccgaggaggagcagcgtattcttcagcagtctgtggtgaagacttacgaagacatgactctggaggaacttgaagaccacgaggacgaattcaatgaggaagacgagagggctatcgagatgtacagacggaggcggctggccgaatggaaggctacgaaactgaagaataaatttggggaagtattagagatcagcggaaaagactacgtgcaggaagtcaccaaggccggagagggcctgtgggttattttacatctttataagcaaggcatacccctgtgcgccctcataaatcagcatctgtctgggctggcgagaaagtttccggacgtgaagtttataaaagccattagcaccacatgcataccaaattacccagataggaatctccccacaatatttgtgtatctcgagggcgacattaaagcacagtttattgggccactggtgttcgggggtatgaacttgactcgagacgagctggagtggaaactctccgaatctggcgctatcatgaccgatctagaagaaaatccgaagaagcccattgaggacgtgttattaagctctgtgaggcgttctgtgctgatgaagcgtgactcagatagcgagggtgattag

SEQ ID NO: 234553 - DNA, 1104 bp, Artificial Sequence
  Description of Artificial Sequence: Synthetic coding sequence
atggacgcccagtgctctgccaaagtgaatgccaggaagcgtcgcaaggaggcacctggccctaatggcgcaaccgaagaggacggcgtcccttccaaggttcagagatgcgcagttggactgagacagcctgcaccgttctctgacgagatcgaggttgacttcagcaaaccgtacgtaagagtgaccatggaggaggcctctcgcggtaccccctgcgagcggccagttagggtgtatgctgacgggatcttcgatctattccacagtggccatgccagagcccttatgcaagccaaaaatctattccccaatacgtacttgatcgtgggagtgtgcagtgacgagttaacccataactttaaagggtttaccgtcatgaacgaaaacgagaggtatgatgcagtacagcactgtcgctatgtggacgaggtggttcgtaacgccccatggacacttacccccgaatttctcgccgagcatcgaatcgatttcgtggcacatgatgatattccctatagctctgctggctccgacgatgtctataaacatataaaggaagccggaatgtttgctccaacccagcgcactgagggaatttctacatctgatattatcactaggatagtgcgcgactacgacgtgtacgccaggcggaatctccagcggggatataccgctaaagagttgaatgtatcgttcattaacgagaaaaagtaccacctgcaggaaagggtggacaaagtaaagaaaaaagttaaagacgtggaggaaaaatcaaaggagtttgtgcagaaggtcgaggagaagtcaattgacctcattcagaagtgggaagaaaagtccagggaattcattggctcgttcctggagatgtttggtcctgaaggtgcgctgaagcatatgctcaaggaggggaagggaaggatgctccaggctattagccccaagcaatcaccctccagtagtcctacacgtgagcggagtcctagcccatccttccggtggccattctcgggcaagacctcccctccgtgttctccggcaaacctgtctcggcataaagcagctgcctatgatatttcagaggatgaggaagactag

SEQ ID NO: 234554 - DNA, 882 bp, Artificial Sequence
  Description of Artificial Sequence: Synthetic coding sequence
atggacgctcaatgcagcgccaaagtgaatgcaaggaagaggaggaaggaggcacctggccctaacggagcaaccgaagaagatggagtgccgtcaaaggtgcagaggtgcgccgtcggcctacgtcagccggctcccttttccgacgaaatcgaggtggacttctctaaaccgtatgtgcgggtcactatggaggaggcgtctcgtggcactccgtgtgagcggccagtgcgcgtctacgctgacgggatctttgatctgttccatagcggacatgctagggcactcatgcaagccaagaacctctttccaaacacttacctgatagtgggagtgtgtagcgatgagctgactcataacttcaagggcttcaccgtgatgaatgaaaacgagcgttacgatgccgtccaacactgtcgatatgttgatgaggtcgtgagaaatgctccttggactctgacgccagagttcctggcagaacaccgaattgacttcgtggcccatgatgatatcccctactcttccgcgggatcagatgacgtgtacaaacatatcaaggaggctggaatgttcgccccaactcagagaactgagggaatctccacatcagatattattacaaggattgttcgggactatgacgtctatgcaaggcgtaatcttcagcggggatataccgctaaggaactgaacgtctcattcattaatgagaaaaaataccatctgcaggagcgtgtcgacaaggtgaagaaaaaagttaaggatgtggaagaaaaatcgaaggagtttgtgcagaaggttgaagaaaagtccatcgatctgatacagaagtgggaggagaagtcaagagagttcatcggatcatttctggagatgttttag

SEQ ID NO: 234555 - DNA, 402 bp, Artificial Sequence
  Description of Artificial Sequence: Synthetic coding sequence
atggatgcacagtgctctgctaaggttaatgccaggaagagaaggaaggaggcaccaggccctaatggggctaccgaagaagatggggttccctccaaggttcagaggtgtgcggtcggcctccgccagcccgcacctttctcggatgaaatagaggttgacttcagtaagccctacgtgagggtgacaatggaagaggcctctagaggcaccccgtgtgaacgcccagttcgcgtgtacgctgacggtatcttcgatctgttccactcagggcatgctcgagccttgatgcaggccaagaacctgtttccaaacacatatctgattgtgggcgtgtgttctgatgagctcacccacaactttaaaggatttacggtcatgaatgagaatgagagatactag

SEQ ID NO: 234556 - DNA, 987 bp, Artificial Sequence
  Description of Artificial Sequence: Synthetic coding sequence
atggatgctcagtgtagcgccaaagtgaatgcgagaaagcggaggaaggaggcgcctggcccaaatggcgcaactgaagaggcttctagaggtaccccctgtgaacgccctgtgagagtgtacgccgacgggatcttcgatttgttccattccggccacgccagagccctgatgcaagctaagaacttgttccccaatacatacctcatcgttggggtgtgttctgatgaactaacacacaattttaaagggttcactgtgatgaacgagaacgagcgatacgacgcggtccagcactgccgatatgtggatgaagtcgttaggaacgccccatggaccctgacacccgagtttctggccgagcatcgcattgattttgtcgcccacgatgatatcccttactcctccgccggatctgacgacgtgtacaagcacatcaaagaagccggtatgtttgcacccacacagcggacagaaggcatcagcacaagtgatattatcacccggatcgttagggattacgatgtgtacgcgagaaggaatctccagcgaggatacacggccaaggagctgaacgtgtctttcattaatgaaaagaagtaccatctccaagaaagagtggacaaagttaaaaaaaaagtaaaagacgtcgaagagaagtccaaggagttcgtgcagaaagtcgaggaaaagagtattgacctcatacaaaagtgggaagagaagagcagagagtttattggctcctttctggagatgttcggaccagagggtgccttaaagcacatgcttaaggagggcaagggaaggatgctgcaggccatctctccgaagcagtctccatcgtctagcccgactagagaacgctctcccagcccgagcttccggtggcctttttctggaaagacttccccaccttgttcaccagccaacttgtcacgccataaggccgcagcttatgatatctctgaggatgaggaagactag

SEQ ID NO: 234557 - DNA, 1104 bp, Artificial Sequence
  Description of Artificial Sequence: Synthetic coding sequence
atggacgcccagtgcagcgccaaggtcaatgcacggaagcgacggaaggaggctcccggaccgaacggcgcaaccgaagaagatggcgtgccctcaaaggtgcaacggtgcgctgtgggtctgcgtcaacccgcacctttctcggatgaaatcgaagtggatttcagcaagccttatgtgagagtaacaatggaggaggcgagtcgtggcaccccttgcgagcgacccgttcgcgtgtatgctgatggcatcttcgacctctttcactccggtcacgccagggcattgatgcaggctaagaacctatttccgaacacctaccttatcgttggggtgtgttcggatgagttgactcacaatttcaagggcttcacggtgatgaacgaaaacgaacgatacgacgccgtgcagcattgtagatatgtggacgaagtggtgaggaatgccccatggacactcacaccagagttcctcgccgaacatcggatagactttgtggcccacgacgacataccctattcctctgcaggctctgacgatgtgtataaacacatcaaggaggctggaatgtttgctccaacacagaggaccgagggcatcagtaccagtgatatcattacacgcatcgttagagactatgatgtctatgcgaggagaaatctgcaacgaggttacacagccaaggagttgaacgttagctttataaatgaaaaaaaatatcacctccaggaaagggtagacaaagttaaaaagaaggtgaaggacgtggaagaaaaatccaaagagttcgtgcaaaaggtggaagaaaagagtattgacctgatccaaaagtgggaagagaaatctagggaattcattggatccttcctggaaatgtttgggccagaaggcgcactgaagcatatgctcaaggagggaaagggacggatgctgcaggcgatctctccgaaacaatccccctctagcagccccaccagggaaagatctccatctccaagcttccggtggccattcagcggtaaaacgagtcctccctgtagtcccgctaacctgtctcgccacaaagccgcagcttacgacatcagcgaggacgaggaggattag

SEQ ID NO: 234558 - DNA, 348 bp, Artificial Sequence
  Description of Artificial Sequence: Synthetic coding sequence
atggacgctcaatgcagtgccaaggtgaatgctaggaaaagaaggaaagaggcaccgggacctaacggcgctacagaggaggacggagttccaagcaaggtgcagaggtgtgctgtgggcctgcgacagccagcacctttcagtgacgaaattgaagtagacttctctaagccctatgtcagagtcacaatggaggaagcaagcaggggtacaccatgcgagaggcccgtgagagtctatgcagatggaatcttcgatctatttcactctggacatgccagggcgcttatgcaggctaaaaatctctttcctaatacctacttaatcgtaggtgtgtgcagcgactag

SEQ ID NO: 234559 - DNA, 2250 bp, Artificial Sequence
  Description of Artificial Sequence: Synthetic coding sequence
atggaggccgaaacggggtccagcgtggagaccggaaagaaggctaatcgtggaactcggattgcgctggtggttttcgtgggcggaaccctggttctaggcaccattcttttcctggtgagtcaggggttattgagtttacaggccaagcaggaatactgtctgaaaccagagtgtatcgaagcagccgctgccatactgagtaaagtgaatctatcagtggatccctgtgataatttctttaggtttgcgtgcgacggctggatctccaacaaccccatacccgaagatatgccatcctacggcgtgtacccatggttgaggcacaacgttgatttaaaattgaaagagctcctggagaaaagtattagtcggcgacgtgataccgaagccatccagaaggccaagatactctattcaagctgcatgaacgagaaagcaattgaaaaggccgatgccaaaccactgctgcatatcctgcggcattcccccttcagatggcccgtgctcgagtctaatatcggacccgagggcgtgtggtccgaaagaaagttttctttgctccaaacactagccaccttccgcggacagtattccaacagcgtattcataagactgtacgtgagccccgatgataaagcttctaacgagcatatccttaagctggatcaggccacgctttctctcgctgtgagagaagattacctggataactctaccgaggccaaaagttatagggacgctctctataaatttatggtggacactgccgtgcttttgggtgcaaattcaagcagggcggagcatgacatgaaaagcgtgctgagactggaaattaaaatcgccgaaattatgatcccccacgaaaatcgtacttctgaagcaatgtacaacaagatgaatatctccgagctctcggccatgattcctcagttcgactggctgggttatatcaaaaaggtgatcgatacccgcctataccctcatctaaaggacatctctccatctgagaacgtggtggtgagggtcccccagtactttaaagacttgttccgcatactgggtagcgaacggaagaagactattgcgaattatctcgtttggcgcatggtgtacagcaggatacctaatctgtcaagaaggttccaataccggtggttagagttttcccgagtgattcagggcaccacgactttgctgccccagtgggacaagtgcgtcaatttcattgagtcagcattgccgtatgtggtgggaaagatgtttgtagacgtttattttcaggaggacaagaaagagatgatggaggaacttgtggaaggagtcaggtgggccttcattgatatgttggagaaggagaatgagtggatggatgcgggaacaaaaaggaaggccaaagaaaaggccagagctgtcctggctaaagttggatatccagaattcattatgaacgacacccatgtgaatgaggatctgaaagccatcaagtttagcgaggcagattactttggtaatgtgctgcagacccgaaagtatttggcccagtctgactttttctggctgcggaaggctgttcccaaaaccgagtggttcacaaatccgactaccgtgaatgccttttactcagcttcaactaaccagattaggtttcccgctggggaactacaaaaacccttcttttgggggacggagtaccctcgctcactgagttatggcgcaatcggcgtaatcgtcggccatgagtttacccacggcttcgataataatgggcgtaagtacgacaaaaacggcaacttggatccatggtggtcgacagaaagcgaggaaaaattcaaagagaagaccaaatgtatgattaatcaatattctaactattactggaaaaaagctggcctcaacgtgaagggcaagagaaccttaggagagaacattgcagataacgggggacttcgggaggctttccgggcatataggaaatggatcaacgaccgacgccagggcctggaagagccgctgttgcccggaatcacctttaccaacaatcagctattttttctcagctacgcccatgtccgttgtaacagctacaggccggaggctgccagggagcaggtccagattggagctcactcgcctccccagttcagagtgaacggagcgatttcaaattttgaagagtttcagaaggcttttaactgcccccctaactctaccatgaataggggcatggatagttgccgcctttggtag

SEQ ID NO: 234560 - DNA, 1359 bp, Artificial Sequence
  Description of Artificial Sequence: Synthetic coding sequence
atgattcacctcccccgtccccctaaggtcttaggactgcagtttgattggcttgggtacatcaagaaagtcattgatacgaggctctacccacacctcaaagatatatcacctagcgaaaatgtggtggtcagagtccctcagtactttaaagacctatttagaattctggggagcgagagaaagaagacaatcgccaactacctggtgtggagaatggtctattccaggatacccaacctgtctaggagatttcagtatcgctggttggagttcagccgcgtgatccagggcactaccactcttctgccacagtgggataagtgtgtgaatttcattgagtcagccttaccctacgtagtgggtaagatgtttgttgacgtttacttccaggaagacaagaaagagatgatggaggagctcgtggaaggagtcaggtgggccttcatagatatgttagagaaggagaatgagtggatggacgctgggactaagaggaaagccaaggagaaggcgagggcggtcctggccaaagtggggtatcccgagtttatcatgaatgatacccatgttaacgaggacctcaaagcgatcaaatttagcgaagcagactatttcgggaacgttctgcagactcggaaatatttggctcaaagcgacttcttttggctgcgaaaggctgtgcctaaaaccgagtggttcaccaacccaacgaccgtgaacgcgttttactctgctagcacaaatcaaatccgatttcccgctggcgaacttcaaaaaccattcttctggggaacagagtacccacgctcattaagttacggagccatcggggtgatcgtgggtcacgagttcactcatggatttgacaacaatggacgcaaatatgataaaaacggtaacctcgacccgtggtggtctacggaatctgaggagaagtttaaagagaaaaccaaatgcatgattaaccaatattcaaactattactggaagaaagccggactgaacgtgaaagggaaacggacactgggtgagaatatcgcagacaacggagggctgcgcgaggccttccgcgcttatcggaagtggataaatgatagacgccagggtctggaagagcctttgctgccaggcatcactttcaccaataatcagttgttctttctatcttatgcacacgtgaggtgcaactcctatcgtcctgaggccgctcgcgaacaggtgcagattggggcacattctcctccccaatttagggtgaacggtgcaattagcaattttgaggaattccagaaggcattcaactgcccgccaaatagcaccatgaacagaggtatggacagttgcaggttatggtag

SEQ ID NO: 234561 - DNA, 1959 bp, Artificial Sequence
  Description of Artificial Sequence: Synthetic coding sequence
atgccctcatatggggtctacccttggctccgccataacgtggacctgaagcttaaagagttgctggagaagagcatctcgagacgtagagacactgaagccattcaaaaggctaaaatactttacagcagctgcatgaatgagaaagccatcgagaaggcagacgctaagcccctgcttcatatacttcgacatagccctttccgttggcccgtgctggaaagtaatatagggccagaaggcgtgtggagtgaaaggaagttctcactgctacagactcttgcgacctttagaggccagtattcaaactccgtttttattcgtctatatgtaagccctgacgataaggcctccaatgagcacattctgaagctggaccaggccactctctcattagccgtgcgagaggactatttagataattctacagaggccaagtcctatagggacgcgttgtacaaattcatggtggatacggccgtgttgctcggtgcaaactcttcgcgagccgaacatgacatgaaatccgtgctccggctggagatcaagatcgccgaaataatgatccctcatgaaaaccgaacgtcagaggccatgtataacaagatgaatatctccgagctttctgccatgattccacagtttgactggctggggtatattaaaaaggtcatcgataccaggctatatcctcatctgaaggatatcagcccctcagagaatgtagtggttagagtgccccaatacttcaaggatctgttccgaattctggggtccgagcgcaaaaaaactattgcgaactatctggtttggagaatggtgtacagccgcatcccaaacctctctaggcgattccaatatcggtggctggagttctcccgcgtgatccaaggtaccacaaccctccttccccaatgggacaaatgcgtcaattttattgagagcgcactgccgtacgtggtgggaaaaatgtttgtcgacgtctatttccaggaggataagaaagaaatgatggaagagctggtggagggcgtccgttgggcattcatcgatatgctcgagaaggagaatgagtggatggatgccggaaccaagcgaaaagccaaggagaaagcgagagctgttctggcaaaagtgggctatccagagttcattatgaacgacactcatgtgaacgaagaccttaaggcaatcaagtttagcgaggcagactactttggtaatgtactccagacccgtaagtacctcgcccaatccgattttttctggctcagaaaggccgtccccaagactgaatggttcacaaacccaacaacagtcaacgcattctactctgcttcaacgaatcaaattcgctttccagccggtgagctgcagaaaccctttttttggggcacagaatacccccgaagccttagctacggggcaataggtgtcatcgtcggccacgaattcacacacggatttgacaataacgggaggaaatacgataagaacgggaatttagacccttggtggtctacagaatcagaagagaaatttaaggagaaaaccaagtgtatgattaatcagtatagcaactactattggaaaaaagcaggactgaatgtgaaagggaaaaggacactgggtgaaaacattgcagataacggtggattaagggaggcattccgggcatacagaaagtggatcaacgatcggagacaaggtctggaggaacctttgcttcctggcattaccttcactaataatcagctgttttttctgtcttatgcccacgtaagatgtaattcatacaggcccgaagcggctcgtgaacaggtccagatcggcgcacattcaccaccccagttccgtgtgaacggggcaatatcgaattttgaggagtttcagaaagcctttaactgcccccctaacagcaccatgaaccggggtatggactcatgccgcctgtggtag

SEQ ID NO: 234562 - DNA, 2088 bp, Artificial Sequence
  Description of Artificial Sequence: Synthetic coding sequence
atggaggctgagactggctcttctgtggaaacaggtaaaaaagccaacaggggtactcgtatcgccctggtggtgttcgttggcggaaccctggttcttggcaccatcttattcttagtgtctcagggacttctctccctgcaggcgaagcaggaatactgtctgaaacccgagtgcatcgaggccgcagcagccatcctctccaaagttaatctgtctgtggacccatgtgacaatttctttagatttgcctgtgatggatggatatccaataatccgatcccggaggatatgccttcatacggggtctatccttggctgaggcacaacgtggaccttaagctgaaggagctactcgaaaagtccatttcccgacggagggatacagaagctattcagaaggccaaaattctgtactcttcatgtatgaacgagaaggcaatagagaaagctgacgccaaacccctgctgcacatcttgcgccactctcccttccgatggcctgtcctggagtcaaacataggcccagaaggggtatggagcgagagaaagttcagtcttcttcagaccttggcaaccttcaggggacagtactcaaacagtgtgttcatccgactgtacgtcagccccgatgataaggcaagcaacgaacatattctcaagctggaccaggcaacactgagtcttgctgtgagagaagattaccttgataattccaccgaggccaagagctaccgagacgccttatataagtttatggtggatacagccgtacttctgggggcaaatagttccagagcagagcacgacatgaaatctgtcctgagacttgagatcaaaattgccgaaattatgatccctcacgagaatcgtacctccgaagcgatgtacaataagatgaacatctctgaactctccgctatgatccctcagttcgactggctgggatatatcaaaaaagtaatcgatacaagactctaccctcatctgaaggatatttcgcccagtgagaacgtggtagtcagagtgcctcagtactttaaggacctatttcgtatcttggggtcagagagaaagaaaactatcgcaaattacttagtgtggcggatggtctacagccgcataccgaatctgtccagacgtttccaatatcgttggctagaattctccagagtcattcagggcacaaccaccctgctcccgcagtgggacaagtgtgtcaattttatcgaatccgcattgccttatgtggtcggaaaaatgtttgtggatgtttactttcaggaggataagaaggaaatgatggaagaactggtcgaaggagtccgatgggctttcatcgacatgttggagaaagagaacgagtggatggacgccggtaccaaaagaaaggccaaggaaaaagctagggcagttctggccaaggtcggttatccagagttcataatgaacgatacacacgtgaacgaggacctgaaggcaataaaatttagtgaagccgactattttgggaatgtgttacagactcggaaatatctagcccaatctgactttttctggttgaggaaggcagttcctaaaactgagtggttcactaacccaaccacagtcaacgcattttatagtgcttcaaccaaccagatcaggtttcctgcgggtgagctgcagaagccgttcttttggggaactgagtacccaagatcactgagctatggggcaatcggtgtgattgtggggcatgaatttacccatggcttcgataataacggccgtaagtatgacaagaatggaaatttagatccgtggtggtcaaccgagtccgaggaaaagttcaaggagaagactaagtgcatgattaaccaatactctaactactactggaaaaaagccggacttaacgtaaaaggcaaacgcacacttggtgagaatatagcggacaatgggggactgagggaggcattccgggcttaccgaaagtggatcaacgacagaaggcagggacttgaggagcccctgttgccaggtattaccttcaccaataaccagctcttcttcctgagttatgcacacggtcagtggtgcaattag

SEQ ID NO: 234563 - DNA, 888 bp, Artificial Sequence
  Description of Artificial Sequence: Synthetic coding sequence
atgcctagccccaggcgaagcatggaaggacgccctctcggggtttccgcgtccagctcaagtagctcccccggaagtcccgcacatggcggaggcggagggggatcaaggtttgaattccaatccctcttatcaagccgggcaacagccgtagatcccacatgtgcccgattgagggctagtgagagtcctgtccaccggaggggcagttttccgctcgccgctgctgggcctagtcaatcccctgcaccaccactcccagaagaagaccgtatggatctgaacccatctttcctcggcatagctttgagaagtctcctggctatcgacctgtggcttagcaagaaactgggggtttgcgccggagaatcttcatcttggggcagcgtgaggccactgatgaaactcctcgagatatccgggcacggcattccatggctgcttggcacattgtactgcctgtgccgttccgattcatgggccggtcgcgaagtcttgatgaatttgctcttcgcactgctgcttgatctgcttctagtcgccctgatcaaaggacttgtgcgcagaagacgaccggctcacaaccagatggacatgttcgtaactctgagtgtggacaagtattcattcccgtccggccacgccactcgggcagcactgatgagcagatttatcctaaatcacctggtattggctatacctctgagagtgcttgtggttctatgggctttcgtgctcggcctaagtagggtaatgttgggacgacacaacgtgactgatgtggcgtttgggttcttcctggggtatatgcagtactctatcgtcgactattgctggctgtctccgcataacgccccagtgctgttcttactgtggtctcagaggtag

SEQ ID NO: 234564 - DNA, 615 bp, Artificial Sequence
  Description of Artificial Sequence: Synthetic coding sequence
atggaccttaatcccagtttccttggtatcgcgcttcgaagccttctggcaattgacctgtggctgtcaaagaaattgggggtttgcgcaggcgagtctagctcttggggtagtgtccgtcccctgatgaagctgttggagatttctggacacgggataccgtggttactgggaacgctgtactgcctgtgccgctccgattcctgggccggaagggaagtgctcatgaacctgctgtttgcgctgctattggatctcttgctcgtcgcccttatcaaaggcctcgtgcgaaggcgcagaccagcccacaatcaaatggacatgttcgtgacgctgtcagtggacaaatattccttcccctccggccatgcaactcgcgcagctctcatgtctcgcttcattctaaatcatttggtgctcgctatcccgttaagggttttagtagtgctgtgggctttcgtcttgggcctctccagggtgatgctcggcagacacaacgttactgatgttgccttcggtttttttctgggctacatgcagtatagcatcgtggactactgctggttgagccctcacaatgcccctgtcttattcctcctatggtctcagagatag

SEQ ID NO: 234565 - DNA, 645 bp, Artificial Sequence
  Description of Artificial Sequence: Synthetic coding sequence
atggagctcgccgctggcagctttagcgaggaacagttctgggaagcctgtgctgaactgcagcaaccagctctggccggagccgattggcagttgctagtggagaccagtggcatatctatttataggctccttgacaagaagacaggcttgtacgagtacaaggtgtttggggtactagaagactgctcccccacattactggcagatatttacatggacagcgactaccgtaaacagtgggaccaatacgttaaagagctgtacgagcaggaatgtaacggcgagacagtggtgtactgggaggtcaaataccctttccccatgtccaaccgcgattacgtctacttgaggcaacgtagggacttagacatggaaggtagaaaaatacatgttatactcgcacgaagtaccagcatgccacaactgggggaaaggtccggagtgatcagggttaaacagtataagcagtcactcgcaattgagtcagacggaaaaaaaggcagcaaagtgttcatgtattactttgataatcctggagggcagatccccagctggctgatcaactgggctgcaaagaacggggtacccaactttcttaaggacatggcgagggcttgccagaactacctgaaaaagacctag

SEQ ID NO: 234566 - DNA, 582 bp, Artificial Sequence
  Description of Artificial Sequence: Synthetic coding sequence
ctggcccaagggaggtgcctccaggttacagccgtgcagattcagggtagttggaaagtaaccggggtgcagccccagaagaccggactgtatgagtacaaagtctttggcgtcttggaggactgttctccgacccttttagccgacatttatatggactcggattatagaaagcagtgggaccaatacgtcaaggagctgtatgagcaggaatgcaatggcgagaccgtcgtgtattgggaggtgaaataccccttccctatgagcaaccgggactacgtgtatctgaggcagcgtagagacttggacatggaaggacggaaaatccatgtgatcctagccaggtccacaagtatgcctcaactgggtgaacggtcaggcgtgatcagggtgaaacagtacaaacagagccttgcaatagagtccgacggaaagaagggatccaaagtctttatgtattactttgacaatcccggaggccagattccttcttggttgatcaactgggccgctaaaaacggtgtccctaatttcctgaaagacatggctcgggcttgccagaattacttaaagaaaacctag

SEQ ID NO: 234567 - DNA, 429 bp, Artificial Sequence
  Description of Artificial Sequence: Synthetic coding sequence
atggactcagactacagaaagcagtgggatcagtacgtgaaggagctctacgaacaggagtgtaatggcgaaactgtggtgtactgggaggttaagtaccccttccccatgtctaacagggactatgtgtaccttagacagcgaagagatctggacatggagggcagaaagattcacgtgatactggcccgtagtactagcatgccacaattaggggagcgctctggcgtgatccgcgtcaagcagtataaacagtctctcgcgatagagtctgacggtaaaaagggcagcaaggtattcatgtattatttcgacaatcccggaggacagatcccaagctggcttattaactgggcggctaagaatggggtgccaaattttcttaaggatatggctcgggcatgtcagaattacttaaaaaaaacctag

SEQ ID NO: 234568 - DNA, 564 bp, Artificial Sequence
  Description of Artificial Sequence: Synthetic coding sequence
atgccggtcgatctctcaaaatggagtggccctttgtcactccaggaggtcgacgagcagccccagcatccactgcacgtgacttatgccggagctgccgtggatgaattaggcaaagtgctcacacctactcaggtcaagaacagaccaacttccatctcatgggacgggctggattccggaaagttatacaccctggtgctgactgaccccgacgccccttcccgcaaagatccaaagtaccgggaatggcatcattttctggtggtgaacatgaagggaaatgacattagttcaggcactgtgctgtccgattatgtgggcagtggaccccctaaaggcaccggtttacacaggtatgtctggctcgtgtatgagcaggacagacccctcaaatgcgatgagcccatcctatctaaccgatctggcgaccaccggggtaagttcaaagttgcttcctttcgtaagaaatacgaattgcgagctccagttgccggaacttgttatcaggcagagtgggacgattacgtgccgaaactttacgagcagctctccggaaaatag

SEQ ID NO: 234569 - DNA, 468 bp, Artificial Sequence
  Description of Artificial Sequence: Synthetic coding sequence
atgcctgtggatctgagcaagtggtctgggccactgtctcttcaggaggtagacgaacaaccccagcaccctctgcatgttacatatgccggagcagccgtggacgaattaggaaaggttctgacacctacccaggtgaaaaatcgccctactagtatcagttgggacggcctggattctggcaagctgtacactctggtgctgaccgaccctgacgcgccatcacgcaaagaccctaagtatcgcgagtggcaccactttctggtcgtgaatatgaaaggaaacgacatttcctccggtaccgtcttatctgattacgtgggatccggacccccaaagggaaccggcctccatcgctatgtttggctggtatatgagcaggataggcccctcaagtgcgattttagttgttgtcttgcattcatcattcttctgacccactcagatctgtgttttgaccagatctag

SEQ ID NO: 234570 - DNA, 6134 bp, Artificial Sequence
  Description of Artificial Sequence: Synthetic coding sequence
atgtgtcctgtggactttcacgggattttccaactggacgagcgtagaagagacgcagtgatagctctagggatcttcctgatcgaaagcgacctgcaacataaggactgtgtcgtaccctacctattgcggctattgaagggattaccgaaagtttattgggtggaggagtccactgctcgcaaaggtcgcggagcactcccagtcgctgagagctttagcttctgtttggtgacactactgtctgatgtcgcctacagggatccgtccctccgtgacgaaattctcgaagttctcctgcaagtcctccacgtgctgttaggaatgtgtcaagctctggagatacaagataaagagtacctgtgcaagtatgctataccatgcctgatagggatcagccgagcttttggcaggtacagcaacatggaggagtcacttctatcaaagctcttccctaaaatacccccacactccctccgagtgcttgaagagctggagggcgtgcggaggcgctccttcaatgacttcaggagcatcctcccttccaaccttttgaccgtttgccaggaggggaccctgaagcgcaaaacgtcatctgtttcctctatatcccaggttagccccgagcgtgggatgcctcctccaagctctcctgggggatctgccttccactactttgaggcttcatgcctgcccgatggcactgctcttgagcccgaatactattttagcaccatttcaagctctttctctgtaagtcctctctttaacggtgtaacttacaaggaattcaacatcccactcgaaatgctgcgcgagctcttaaacctcgtgaaaaagatcgtcgaagaagcagtcctgaaatccctggacgccattgtggccagtgtgatggaggctaatcccagcgccgatctgtactatacctctttttccgaccccctgtatctgactatgttcaaaatgctgcgtgacacactgtactacatgaaggatttacctaccagcttcgtgaaagagattcatgactttgttttagaacagttcaatacaagtcagggcgagcttcagaagatactgcacgacgctgatagaatccataacgaattatctccactaaaactgagatgccaggcaaatgcagcttgcgtggatttgatggtttgggctgtgaaggatgaacagggcgctgagaatctctgtatcaagctctctgagaagttacaatcaaagaccagctccaaggttattattgcgcatctgcctctgcttatctgctgtctccagggtctgggcagactttgtgagcgcttccctgtcgttgtacacagcgttacaccgagtcttcgtgattttctggtcattccttccccagtgctcgttaaactgtataagtaccatagccaatatcacaccgtggctggcaacgatattaaaatttccgttacaaatgagcactcagagtccaccctgaatgtcatgtccgggaagaagtcacagccatccatgtacgaacagctcagggatatcgccatcgacaacatctgccgctgtcttaaggccggactgaccgtagatccagtcatcgttgaagcgtttctcgcaagcctctcaaaccgtctctacatctcccaagagtctgacaaggatgcccacctgatacccgatcacacaattcgcgctctgggccatatcgctgtggccctgagagatacccccaaggtcatggaaccgatcctgcagattctacaacagaagttctgccagccacctagtcctctggacgtcctgatcatcgaccagctcggttgtctggtcatcacaggaaaccagtatatataccaagaagtctggaatctgttccagcagatttcagttaaggcaagcagcgtggtgtattcggccacgaaggactacaaagaccatgggtaccgccattgtagcctcgctgtaatcaacgcacttgctaacattgcagccaatatacaggacgagcacctggtagatgagcttctaatgaatctccttgagctattcgtacagctggggctggaaggaaaaagggccagcgagcgggcttctgagaaggggcctgctttaaaagcgagctcctccgcgggaaaccttggagtattgatacctgtaattgctgttctcacccgccgactgccacccatcaaggaagccaagccacgcctgcagaagttgtttagggatttctggctgtactccgtcctcatggggttcgctgtggagggctcaggtctgtggcccgaggaatggtatgagggtgtgtgcgagatcgcaacgaaaagccctcttctgacctttccgtctaaggaaccactgaggtctgttctgcaatataactcagcgatgaaaaacgacacagtaactcctgcagaactgagcgagctgagaagtaccatcattaacctgcttgaccctccccctgaagttagcgctctgattaataaactagattttgctatgagcacctatttactaagcgtgtatagattggagtacatgagggtgcttcgttctaccgaccccgaccgctttcaagtaatgttttgttatttcgaggacaaagctatccagaaggataagtccggcatgatgcaatgcgttatcgctgttgccgacaaggtttttgatgcattcctaaacatgatggctgacaaggctaaaacaaaagagaacgaggaggaattggaacgtcacgcccaatttctccttgtgaatttcaatcacatccataagcggatccgaagggtcgcggataagtacctatctggactcgtcgataagtttccacacttgctctggagtgggaccgtgctgaaaacaatgctggatattctgcagaccctttctttgtcgctctccgccgacattcataaggaccagccatattacgacataccagacgcgccataccgaataaccgttcccgacacatatgaggctcgagagagcatcgtcaaggatttcgccgctaggtgcgggatgattctgcaggaagctatgaaatgggctccaaccgtaacaaagtctcatctacaggaatacctgaacaagcaccagaattgggtttctggccttagccagcacacagggctcgcaatggctacggagagtattttacacttcgccggatataataaacagaacactacgcttggcgcaactcagctctctgaacgaccagcatgtgtcaagaaagattattcaaacttcatggccagtttaaacctgagaaatagatacgcaggagaggtctacggtatgatcaggttctcgggcactacaggtcaaatgagcgacctgaataagatgatggtgcaggacctccattctgcccttgatcggtcccatccacagcactacacgcaagccatgtttaagctcacggcgatgctgatctcctctaaggattgtgacccacagcttctgcaccatttatgttggggcccactgcgcatgtttaacgagcacggaatggaaacagccctggcctgttgggaatggcttttggccggaaaagatggagtcgaggtccctttcatgcgggaaatggccggagcatggcatatgaccgtggagcaaaaatttggactgtttagcgctgagatcaaagaagccgatcccttggcagccagcgaggcatctcagccaaaaccctgtcccccagaagtcactccccactacatctggattgatttcttggtgcaacgttttgaaattgccaaatattgctcatcagatcaggttgagatcttctcaagcctcctgcagcggtcaatgagcctcaatataggcggagccaaggggtcaatgaataggcatgtcgccgcaatcgggcctcgtttcaagctcctaactttaggactgtccctgctccatgccgacgtggtacccaatgcaacgattaggaatgtcttaagggaaaagatttattctaccgcctttgactacttttcatgcccccctaagtttccgactcagggggaaaaacgtctgcgggaggacatttcgattatgattaagttttggactgcgatgttctcagataaaaagtacctgacagcctcacagctggtgccaccagacaaccaagacacacgctcgaacctggacataacagtcggcagcaggcaacaggccacacaaggctggatcaacacatatcccctgagtagcggaatgtctacaatcagtaagaagtctggcatgtcaaaaaagaccaaccggggatcccagctccacaaatactacatgaaacggaggaccctgctgctctcactcctggcaaccgaaattgaacgcctcataacctggtacaaccctctgtctgccccagaattggaactggatcaagcgggagaaaattctgtggctaattggcgctccaagtacatatcactctcagaaaagcagtggaaggataatgttaacctcgcctggagcatttcaccctacctggctgtgcagcttcccgcaagatttaagaacacggaagccatcggcaatgaggtgactagactggttaggctagaccccggagctgtctctgatgttcctgaggccatcaaatttttagtgacctggcacacgattgatgccgatgccccagagctgtctcacgtgctttgttgggctccaactgatcctccaaccggcctgagttacttctcaagcatgtatccaccacatcctctcaccgctcagtatggggtgaaagttttgagatcctttccccctgacgccattctcttctatattcctcaaatagtccaggccctaaggtatgataagatggggtacgtgagggaatatatcctatgggccgcatcaaagagtcagctcttagcacaccagttcatctggaatatgaagaccaacatttacttggacgaagaaggccaccagaaagaccccgatattggggatctgctggatcagttagtggaggaaatcacagggtccctcagcggacctgccaaggacttttatcagcgggagttcgatttcttcaacaaaattacaaatgtgagcgccattatcaaaccttatcccaagggagacgaaagaaagaaggcgtgcctaagcgcactttccgaggtgaaagtgcagcccggttgctacctcccctcaaacccagaggctattgtcctggacattgattacaaatccggcaccccaatgcaaagtgcagcaaaagcgccatacctggctaaatttaaggtgaagagatgcggtgttagcgagctcgagaaggaaggactccgctgccgtagcgactctgaggatgaatgttccacccaggaggccgatggccagaagataagctggcaggcagcaatctttaaagtgggcgacgattgcaggcaggatatgctggccctgcagatcatagacctattcaagaacatttttcagcttgtgggcttggacttgtttgtctttccttaccgcgtggttgctacagctcccggatgtggcgtgatcgagtgcatccctgactgcacaagccgagaccagctgggtaggcagaccgacttcggaatgtatgactactttacccgtcaatacggagatgagagcacactggccttccagcaagcccgatacaatttcattcgcagcatggccgcttatagcctacttcttttcctcttgcagatcaaagacagacataacggaaatattatgctggacaaaaagggacatatcattcatatcgactttggatttatgttcgagagcagcccaggcggaaacctcgggtgggagccagacatcaagcttacggatgagatggtgatgattatgggcggaaagatggaggctacaccctttaaatggtttatggaaatgtgcgtgcgaggctatctcgcagtgaggccctatatggacgcggtcgtttctctcgtgacactcatgctggatacaggcttaccttgcttccgcggacagactatcaagctgctcaaacacaggttctctccaaatatgaccgaacgtgaagccgctaacttcataatgaaggtgatccagagttgcttcctatcaaaccgaagtcgcacctatgacatgatacaatactatcaaaacgatatcccatatta

SEQ ID NO: 234571 - DNA, 1440 bp, Artificial Sequence
  Description of Artificial Sequence: Synthetic coding sequence
atggacgaaactagcccactggtaagtccggaaagggcacagcccccagactatacctttccctccggatccggggctcactttccacaggtgcctgggggagcggttcgcgtcgcagcggctgcgggaagcggtccctctccacccggttcaccaggccacgatcgggaaaggcagcccctcctggacagagcacgcggagccgctgcgcaggggcagacacaaaccgtggccgctcaggcccaggccctcgccgctcaggctgcagcagccgctcatgcagcgcaggctcaccgcgagagaaacgagtttccggaagatcctgagttcgaagccgtagttcgtcaggctgagcttgcaattgagagatgcattttcccagagagaatctaccagggcagtagcggctcctattttgttaaggatccacagggcagaatcattgctgtatttaaaccaaaaaacgaggagccctacgggcacctgaacccaaagtggactaaatggcttcaaaaattgtgctgcccttgttgctttgggagagactgtctggttctgaaccaggggtatctgtccgaagccggtgcctccctagtagatcagaaattagagctgaacattgtgcctagaacaaaggttgtgtatctggccagtgagaccttcaattactcggccatagaccgggtaaaaagccgcggaaagcgcctggcccttgagaaagtacccaaggtgggccagcgatttaataggatcggacttccgccaaaggttggatcttttcagctgtttgtggaaggttataaagatgccgactactggctgcgcaggtttgaagctgagcccctcccggagaatactaatcgccaacttcttctccaattcgagcgattggtggtcctggactatataatccgtaacaccgaccgcggtaacgataattggctgattaaatacgactgtccgatggattcatcctctagcagggacacggattgggtagtggtgaaagaaccagtcatcaaggtggccgcaatcgacaatggcttggcctttccactcaagcatcccgactcatggagagcataccctttttattgggcctggctcccccaggctaaggtgcccttctcacaggaaataaaggacctgatcctgcctaagatttctgatcccaactttgtgaaggatcttgaggaagacctctacgagctgtttaagaaagaccccggttttgaccgtgggcagttccataaacagattgctgttatgcgaggccagattctcaatctcacccaggcccttaaagacaacaagagtccactgcacctagttcagatgcctcccgtgattgttgagacagcaagaagccatcagcgtagtagtagcgagtcctacacccagagcttccagtccagaaagccgtttttttcctggtggtag

SEQ ID NO: 234572 - DNA, 1350 bp, Artificial Sequence
  Description of Artificial Sequence: Synthetic coding sequence
atgttaggtccccaagtctggtcatctgttaggcaggggctgtctaggtctctgagcaggaacgtgggagtctgggcaagcggtgaaggtaagaaagtagacatcgccggaatttatcccccagttactaccccttttaccgccactgccgaagtcgactacggaaaactggaggaaaatcttcataaattgggcacttttccctttcgtggggctgtcggcggagtttgcgcgctcgccaacgtcctgggagcccaggtctgccagctggaaagactttgctgtaccggacagtgggaggatgcccagaaattgcagcatcggctgatcgaaccaaacgccgctcgtatcatagcagtgttcaaaccaaaaaatgaagaaccctatggccatcttaaccccaagtggactaagtggttgcagaagctttgctgtccatgctgtttcggacgcgactgccttgtgctcaaccaggggtatctgtcagaagccggagcttccctggttgaccaaaaattggaactgaacatcgtcccaaggaccaaggtggtatacctggcatcggagacgttcaattattctgccatcgaccgagtcaagtctaggggtaagaggctggccttggagaaggtccccaaggttggccagagatttaacaggatcggcctgccgccaaaagtgggttcttttcagttgttcgttgagggatacaaggatgccgactattggctgcggagattcgaagctgaacctctccccgaaaataccaatcggcagctgctgcttcaattcgagcgattagttgttctcgattacataatccgtaatacagatcgcggtaatgataattggctgataaagtatgactgtcccatggattcctctagttcgagagatacagattgggtcgtggtcaaggagcccgtgatcaaagtagccgctatcgataacggactcgccttccctttaaaacatcctgactcctggcgcgcttacccattctactgggcctggctgccacaggccaaggttcctttctctcaggaaattaaggatctgattctgccgaaaatcagtgacccaaacttcgtgaaggatctggaagaggacctgtatgagctatttaaaaaggaccccggtttcgacagaggacagttccataagcaaattgcggtgatgaggggccagattctaaatcttacacaagctttgaaggataacaagtctcctcttcacttggtgcagatgcctcccgtgatcgtggagacagcaagatctcaccagcggtccagcagcgagtcctacacccagtcgtttcagtcccgaaagccattcttttcctggtggtag

SEQ ID NO: 234573 - DNA, 1446 bp, Artificial Sequence
  Description of Artificial Sequence: Synthetic coding sequence
atggaagacccttctgagcccgatagactggcctccgctgatggcggtagcccggaagaagaggaggatggtgagcgtgagcctctgttacctcgtattgcctgggcccacccacggaggggagccccagggtccgccgtgcgactcctcgatgccgctggagaggagggggaggcaggggacgaagagttaccactgcctcccggagatgtgggcgtgtccagatcttcctccgcagaactggaccgatccagaccagccgtctccgtaaccattggtacctccgaaatgaatgcgttcctcgacgatccagagtttgccgatattatgctcagagctgagcaggcaatcgaagtaggaatatttcccgagcgcatatctcagggttcaagcggcagttacttcgtcaaggacccaaagcgtaagatcatcggcgtcttcaagccaaaaagcgaagaaccttacgggcagcttaaccctaaatggacgaagtacgtccacaaagtatgttgcccctgctgctttggacggggttgtttgattcccaatcaaggctacttatctgaggctggagcctacctggttgataataaactgcacctgagcatcgttcctaagaccaaggtggtgtggctggtgagtgagaccttcaattacaacgctatcgatagagcaaaaagccgtggcaaaaagtacgccctcgagaaggtgccaaaggtgggacggaaatttcaccgaattggcctcccccctaagatcggctcttttcaactcttcgtggagggttataaggaggccgaatactggctgcggaaatttgaagccgaccctctgcccgagaacattagaaaacagtttcagagtcagtttgaaaggttagttatcctggactacatcatcagaaacacagatagaggcaacgacaactggctagtacggtacgaaaaacagaaatgcgaaaaggagattgatcataaggaatccaaatggattgatgacgaggagtttctcattaagatcgccgcaatcgacaacggactggcattcccattcaaacaccctgacgaatggcgggcatacccctttcactgggcatggctgccccaggctaaagtaccattttctgaagagattcggaacctgatactcccctacatctccgatatgaatttcgtgcaggatctgtgcgaggacctgtacgagctgtttaaaactgataaaggatttgacaaggccacctttgaatctcaaatgtctgttatgcgcggacagatactgaacctaactcaagccttgcgggatggcaagtccccgttccaattggtgcagatcccttgtgtgatcgtggagagatcacaggggggttctcagggacgcattgttcacttatctaatagcttcactcaaaccgtaaattgcaggaaacccttcttctcctcttggtag

SEQ ID NO: 234574 - DNA, 1353 bp, Artificial Sequence
  Description of Artificial Sequence: Synthetic coding sequence
atggaggatccaagcgaaccagatcgcctggctagcgctgatgggggaagccccgaagaagaagaagacggagagagagagccattgttaccgcgaatcgcttgggcacatcccagacgcggagcaccagggtctgccgtgagactcctcgaccgctcccggccagccgtgtccgttaccattgggaccagtgaaatgaatgcatttctagacgatcccgaatttgccgacataatgctgagagccgagcaagcaattgaggtcgggatctttcctgaacgcatctctcaggggagcagtggctcttatttcgtgaaggaccccaaaaggaagatcatcggagtgttcaagcccaagtccgaggagccctatggtcagctcaacccaaaatggacgaaatacgttcacaaggtgtgttgcccctgttgcttcggacgtgggtgtttgattccaaaccagggctatctgtcagaggctggggcttatctggtcgataacaagctacacctgagcattgtacctaaaaccaaggttgtgtggctagtctccgagacttttaattacaacgctatcgatcgcgcaaagtcacgagggaagaagtacgcattggagaaagtgccgaaagtagggaggaagttccacaggattggactgccccctaaaattggctcgtttcagcttttcgtcgaaggatacaaggaagccgagtactggctgcgtaaatttgaggccgacccactgcccgaaaatatccggaaacagtttcagagtcagttcgagcgtttagtgatccttgattatatcatccggaatactgaccgtggaaatgataactggctagtgcgctacgaaaagcagaagtgcgagaaggagattgaccacaaagaatccaagtggatcgacgatgaagagtttctaattaagatcgccgcaatcgacaatggtctggccttccccttcaaacacccagatgaatggagggcgtatccatttcactgggcttggctgccccaagccaaggtcccgtttagcgaggaaatccgcaacctcattctgccttacatttctgacatgaattttgtccaagacctgtgtgaggacctgtacgaactgttcaagacggacaaggggtttgataaagccaccttcgagtcccagatgagtgtcatgaggggacagattttgaatctcactcaggccctgcgggacggcaaaagtcctttccagctcgttcaaataccttgcgtcatcgtggagcggagccagggtggcagccagggacggatcgtacatctctctaacagcttcacgcagactgtgaattgccgtaaaccttttttttcatcatggtag

SEQ ID NO: 234575 - DNA, 6135 bp, Artificial Sequence
  Description of Artificial Sequence: Synthetic coding sequence
atgtgtcccgtggacttccacggtatctttcagctggatgaacgccgaagggacgcggtgattgccctcggcatctttctgattgaatctgatttgcagcacaaggactgcgtggtgccgtatctgctcaggctcctgaagggattacctaaggtgtattgggtggaagaatctaccgctagaaagggacgcggagctctacctgttgctgagagcttttcattttgtcttgtgacacttctctctgacgtggcctaccgggatccgtcattgagggatgaaatcctcgaggtccttctgcaggttctgcatgtattattaggaatgtgtcaagccctagaaattcaagacaaagaatacctgtgcaaatacgccatcccatgtcttattggcatttcacgggcttttgggaggtacagcaatatggaagaaagtctgctgtcaaagttgtttcctaagatccctccacattctttgagagtgctagaagagctggaaggagtgaggaggaggtcttttaacgactttagaagcattctgcctagtaatcttctaaccgtgtgccaggagggcaccctcaagcgcaagacctcatcagtctcatcaattagccaggtcagtcctgaaaggggaatgccccctccttcatcgcctgggggatctgcgtttcactacttcgaagcgtcatgcctaccggatgggacggccctggaacccgagtactactttagcacaatcagcagctcattctcagtgagtcccctgtttaacggcgttacatacaaggagttcaatattccactggagatgctccgggagctgctgaatctagtcaaaaagatagtcgaagaggctgtgctgaaatccctagacgcaatcgtagccagcgttatggaagctaatccaagtgcagatttatactacacatcattctcagacccgctgtaccttacaatgtttaagatgctgcgagacaccctatattatatgaaggacctcccaacctcttttgtgaaggaaattcatgacttcgttctcgagcagtttaatacgtcccagggagaactgcagaaaatcctacacgatgctgaccgaattcataatgagctgagccctctaaaactcaggtgtcaggccaacgctgcttgtgtcgatttaatggtctgggcagtcaaagacgagcaaggagctgagaatctgtgtattaaacttagcgagaagctgcagagtaaaacgagctcgaaggtgatcatcgctcacctgcctctgctcatatgctgcttgcagggtctgggacggttatgtgagaggttccctgtggtcgtgcattcagtgacgccgtcccttcgagatttcctcgtgatcccctccccggtgctggtgaagctttacaaataccacagccaatatcataccgtggccggtaatgatatcaaaataagtgtgacgaacgagcactcagaaagcactttaaacgtgatgtccggcaaaaagagtcagccctcaatgtatgagcagttacgcgacatcgcaatcgacaacatctgccggtgtcttaaggcaggcctgacagttgaccctgttattgtagaggcctttctggcaagtttgagcaataggctgtatattagccaggaatccgacaaggatgctcacctgattcccgaccatactattagagccttaggccacattgcagtcgccctgagggacaccccaaaggttatggagcctatcctgcaaatcttacaacaaaagttttgtcaacccccatcaccgctggacgtgttgattatcgatcaactgggatgccttgtgatcaccggtaatcaatatatctatcaggaagtttggaatctcttccagcagatctcagtgaaagcctcatctgtggtgtattcagctactaaggactacaaagatcacgggtaccggcattgctccctggccgtgattaatgctctggcaaacatcgctgccaatatccaagatgagcacctggtggatgaactgttgatgaacctcctggaattattcgtgcagctcggactcgagggaaagcgagcttccgagcgcgcatcagagaagggaccagcgctgaaggctagtagcagtgcaggtaacctgggagtactgatccctgtgatcgcggtgctcacacggaggctaccgcctataaaagaggccaaaccgaggttacagaagcttttccgggacttctggctctacagcgtcctcatgggctttgctgtcgaggggtcaggactgtggccggaagagtggtacgagggagtgtgtgagattgccactaagagccctttattaacattcccatcgaaggagcctctgcgttccgtgctacaatacaattcagcaatgaagaatgataccgtgacaccggctgagctgagcgagttgcgaagcaccattattaatctcctggacccgccacccgaagtgtctgcgctgatcaataaactcgactttgcgatgagcacctaccttctgtccgtgtataggcttgaatatatgagggttctgcgttctaccgacccagaccgctttcaagtgatgttttgttactttgaggacaaagcaatccagaaggataaaagcgggatgatgcagtgcgtgatagcagtcgcagacaaagtcttcgatgcattcctcaatatgatggccgataaagcaaagacaaaggagaatgaggaagagctggaaagacatgcgcagttcctgctggtgaatttcaaccacattcataaaaggattcggagggtcgccgacaaatacttaagcgggctcgtcgacaaattcccccatttgctgtggtccgggactgtactgaagacaatgctcgatattttacagaccttgtcactgtctctctccgcggacattcataaagatcagccctactacgacatccctgatgccccttataggatcactgttcccgacacatacgaggccagagaaagcatcgtgaaggactttgcagcgaggtgcgggatgatcctgcaggaggcaatgaaatgggccccaactgtgaccaaatcccaccttcaggagtatttgaacaaacaccagaactgggtctctggattaagtcaacacaccggccttgctatggcaaccgaatcaattctacacttcgcgggatacaataaacagaatacgacccttggagccacacagttatctgagaggcctgcgtgcgtaaagaaggactatagtaattttatggcctcccttaatttaagaaatcgatacgcgggtgaggtgtacggtatgatccggttttctgggaccactggccagatgtcagacctaaataagatgatggtgcaggatctgcatagtgcactggatagaagccatccacagcactacacgcaggccatgtttaaacttacagccatgctgattagttctaaggattgcgatcctcagctgcttcaccatctgtgttggggccctctaagaatgtttaatgagcacggtatggagaccgcgctcgcctgttgggagtggcttcttgccggtaaagacggggtcgaggtcccgttcatgcgtgaaatggctggtgcttggcacatgactgttgagcaaaaattcggcttgttctccgctgagataaaggaggccgacccactggcagcatctgaagccagtcaacccaaaccctgtccaccagaggttacaccccactacatctggatagactttctggtgcaaaggtttgaaatcgccaaatactgctcaagtgaccaggtggagattttttctagcttattgcagcgaagcatgagtcttaatatcggcggagctaagggcagtatgaacaggcacgtggccgcaatcgggccaagatttaagctcttgaccctcggtctctcactgctgcatgccgacgtggtaccaaacgcaactatacggaacgtgctgagagaaaaaatttacagcacggcctttgattacttctcctgccctcccaagttccccacgcaaggggaaaagaggctgagggaggacatcagcattatgattaaattctggaccgccatgttctccgataagaaatacttgaccgcctcccagcttgttcctcccgacaaccaggacacaaggagtaatttggacataacggtggggtcacgccaacaggccactcaaggatggattaatacatatcccctttctagcggaatgtcaacgatctccaagaaatctggaatgtctaaaaagacaaatcgcggatcccagctgcataagtactacatgaagagacgaaccctcttgcttagcttgttagccactgagattgagcgcctcatcacatggtacaaccccttgtcagcaccagaacttgaactcgaccaggccggtgaaaacagcgtggcgaattggcgctctaagtatattagcctctccgagaagcagtggaaggataacgtgaacctagcgtggtctatctccccctatcttgctgtgcagttgccagcccgtttcaaaaatacagaagccattggaaacgaggtaactaggctggtgcgcctcgatcccggagcagtatcggatgtccctgaggcaatcaaatttctggtgacatggcatacgatagatgccgatgcccctgagctctcccatgtattgtgttgggcacccaccgacccaccaaccgggctgtcttacttttcatcgatgtacccccctcaccccctgaccgcgcagtatggggtgaaagtgctgcgtagcttcccaccagacgccattctgttttacattccccagatcgtccaggcacttcgttacgataagatggggtatgtcagagaatatattctctgggccgcttctaagtctcagcttctggctcatcagtttatttggaatatgaaaacaaatatctacctggatgaggagggccaccagaaggaccccgatattggggaccttctggatcagttggtggaagagatcacggggtccctgagtggtcccgctaaggacttttatcagcgggaatttgatttttttaataagattaccaatgttagcgcaataatcaaaccgtaccccaagggggatgagcgcaagaaagcctgcctgtctgccttgtcagaggtaaaagtccagcctggctgctacctcccatcaaatccagaagcgatcgtgcttgatatcgattataagagtgggacgccaatgcagtcagcagccaaggcaccctacctggccaaattcaaagtgaaaagatgcggggtttcggagctagaaaaggaggggctgagatgccgaagcgactcagaggacgagtgtagtactcaagaagcagatgggcagaagatatcttggcaggccgctatctttaaggttggggacgactgcagacaggacatgcttgcactgcagattatagatctgttcaagaatatctttcagttggtgggacttgacctttttgtgtttccttatcgcgtcgtcgcaactgcccctgggtgcggggtcattgagtgtatcccggactgcacttccagagaccagctcggccgtcagaccgactttggaatgtatgattatttcaccagacaatatggcgatgagagcactctggccttccagcaggccaggtacaacttcatcaggtccatggccgcatatagcctgttgttatttttactgcagataaaagatagacacaatggaaacatcatgcttgacaagaagggccacattattcatattgattttggtttcatgttcgaaagtagccccggagggaacctagggtgggaacctgacattaaactgaccgacgaaatggtgatgattatgggcggaaaaatggaggccacaccctttaaatggtttatggagatgtgtgtgagagggtatctagctgttcggccttatatggatgccgtggtcagtctggtgacactgatgttagataccggactcccttgctttagggggcagacgattaaactgctaaaacaccgcttttcccctaacatgactgaacgcgaggctgccaatttcattatgaaagtcatacagtcttgctttctgagcaaccgatctcggacctacgacatgattcagtactatcagaatgacatcccatattaa

SEQ ID NO: 234576 - DNA, 2565 bp, Artificial Sequence
  Description of Artificial Sequence: Synthetic coding sequence
atgagagagatggccggagcctggcacatgactgtggagcagaaatttggtctgttctcagctgagattaaggaggccgacccattggccgctagcgaggcgagccagcctaaaccatgtcccccagaggtgaccccacactatatctggatcgatttcctggttcagcgatttgagattgcaaaatactgttcctccgaccaggtggagatctttagcagcctcctgcaacggtctatgtcacttaacattgggggtgcaaaaggctctatgaatcgccatgttgctgcgatcggcccacgttttaagctgcttactcttgggttatccctcctgcacgctgacgtcgtgccgaatgcaactatccgtaacgtgctccgcgaaaagatatacagcaccgcatttgactatttctcatgccccccaaagttccctacccagggagagaaaagactgagggaagatataagtatcatgatcaagttctggaccgccatgttctccgacaagaagtacctgacagcaagccagttggtgcctcccgacaatcaggacacccgatccaatctggatattactgtgggctcccggcaacaggcaactcaaggctggataaacacataccctctttcatctgggatgtctacaatctcaaagaagagtgggatgagtaagaagaccaaccgcggatctcaactccacaaatactacatgaagagacgcactctactgctctccctgctagcaacagaaattgaacggctgatcacctggtacaaccccctgagtgcccctgagctcgagctcgaccaggctggcgaaaactccgtcgccaactggagatctaagtatatctccctgagtgagaagcagtggaaggacaatgtgaacttagcttggtccatttcgccctatctggcagtccagctgccagcaagattcaaaaacactgaggccatcggaaatgaagtaactaggttggtgcgacttgaccctggggctgttagcgacgtccccgaggctatcaagtttctcgtgacctggcataccatagatgcagatgcccctgagctctcccatgtcttgtgctgggccccaaccgaccctcctaccggactgagttatttctcatcaatgtatcccccacacccactaaccgcacagtatggagtaaaggttctgagaagcttcccacctgacgccattttattctatattccacagatcgtgcaagccctgcgctacgataagatgggttatgtgagggagtatatcctgtgggcagcaagcaagagtcagctattggcccaccagttcatatggaacatgaaaaccaatatctacctcgacgaggagggtcaccagaaagatcctgatatcggcgacctgctggaccagctcgtggaggaaattacaggatctctttccggaccagcgaaagatttttaccaacgggagtttgactttttcaataagattaccaatgtgtccgctatcataaaaccatacccaaagggtgatgagcgcaaaaaagcttgcctgtcagccctgtcagaggttaaagtgcagccgggatgctacctcccctccaaccccgaggccattgtgctcgacattgattacaagtctggaacccccatgcagtctgccgcaaaggccccttacctggctaaatttaaggtcaaacgttgcggggtgagcgagttggagaaagaggggttgaggtgccgctcagatagcgaggacgaatgttccacgcaagaggccgacggccagaaaattagttggcaggcagctatcttcaaggtcggagatgactgtagacaagacatgctggccttgcaaattatcgacctgttcaaaaacatctttcaactggtggggttagacctcttcgtgtttccatatcgggttgtggcaacagccccaggatgtggagtaattgagtgcattcccgactgtaccagcagagatcaactgggccgtcagactgattttgggatgtacgattattttactagacagtacggagacgagtctactctggcattccagcaggcaagatacaacttcattcgcagcatggctgcgtattcattgctgttgttccttctgcagatcaaagaccgccacaatggcaatatcatgctcgacaaaaaggggcacatcatccatatcgatttcggatttatgtttgagtcctctcccggagggaatctggggtgggaaccagacattaagttgacggatgaaatggtgatgattatgggaggtaagatggaggccacccctttcaagtggttcatggagatgtgtgttcgaggatacctagctgtgcgaccctacatggatgcagtcgtgagcctggtgacattgatgctggatacggggttgccctgttttagaggacaaactatcaaattactgaagcataggttttcccccaatatgactgagagagaagcagcaaactttatcatgaaggttattcagagctgtttcttgagcaatcgttcacgcacttacgacatgattcaatattaccagaatgatatcccatactag

SEQ ID NO: 234577 - DNA, 264 bp, Artificial Sequence
  Description of Artificial Sequence: Synthetic coding sequence
atgtgtcctgtcgacttccacggcatattccagctggatgaacggcgaagagacgcggtgatagctctgggaatcttcttgatcgaaagtgacttgcaacataaggactgtgtcgtcccctatctgcttagactactcaaaggtttaccaaaggtgtattgggtggaagaatccacagcacgtaagggacgaggagcacttcctgtggccgaatcctttagtttctgcctcgtgacactactcagcgatgttgcctaccgctag

SEQ ID NO: 234578 - DNA, 1959 bp, Artificial Sequence
  Description of Artificial Sequence: Synthetic coding sequence
atgtctggtcagtcactgaccgaccgcattaccgctgcacagcattctgtgaccggctccgcggtgagcaaaactgtttgtaaagccaccacccacgagatcatgggccctaaaaagaagcacttagactacctgatccagtgcaccaatgagatgaacgtgaacatcccacaacttgcggattccttgttcgagagaaccacaaattcaagttgggtcgttgtgttcaaaagtctgatcacaactcaccacctgatggtatatggaaatgaacggtttatccagtatctggctagccggaacactctgttcaacctctctaattttctagacaaatctggtctgcagggatatgacatgtccaccttcatccgccgatattcccgctacctcaatgaaaaagcagtgtcctatcgtcaggtggcttttgattttacaaaggtgaagaggggagccgacggtgtgatgaggactatgaatacggaaaaattgctcaaaaccgtccctatcattcagaatcaaatggacgccctgctggacttcaacgttaattctaatgaacttaccaacggggttatcaacgccgcttttatgctgttattcaaggacgctatccgcttatttgccgcatataacgaaggcatcataaacctacttgagaaatattttgatatgaaaaagaatcagtgcaaagaaggactcgacatctacaagaaattccttacccgcatgaccagaatctcagaattcctgaaagtggccgagcaggtaggaatcgaccggggagatattccggatctgtcccaagcaccgagcagcctgctggatgccctagaacagcacctggccagcctggagggcaagaagatcaaagattcgaccgctgcgagtagagctacaactctatctaacgcagtctcctcacttgccagtaccggactctccctgaccaaggttgacgaacgggaaaaacaggcagcgctggaagaagagcaggccagactgaaagccctgaaagagcagcgcctcaaagaactcgcaaaaaaaccgcatacgtcccttacaaccgccgcttcacccgtctccacttcagctggtggcattatgacagctcctgcgattgacatcttttcgaccccctcatcctccaactccaccagcaaactcccaaatgacctgctagacctgcagcagccaactttccatccttccgttcaccccatgagcaccgcatctcaagtggccagcacctggggcgaccctttttccgccactgttgacgccgtggatgacgccatacccagcctgaacccatttctgactaagtcgtccggagatgtgcatcttagcataagttcggatgtgagcacattcactactagaacgccaacccacgagatgtttgtcggattcacaccaagccccgttgctcagcctcaccctagcgccggtctgaatgtggatttcgaaagtgtatttggcaacaaatcaactaacgttatagtggattctgggggatttgacgaactgggaggactactgaagcctactgtcgctagtcagaatcagaatctgccagtggccaagctgcccccttccaagttagtctcagacgatctggatagctcccttgctaacctggtgggaaaccttggcattggaaatggaaccacgaaaaatgacgtgaattggtctcagcccggagagaaaaagctcaccgggggaagtaactggcaacccaaggtggcacccacaaccgcttggaatgccgcaacaatggctcccccagtgatggcatatcccgctaccacaccgacaggtatgatcggctatggtatacccccacaaatgggcagtgtccctgtaatgacgcagccaacactgatttacagtcagccagtgatgagaccaccaaaccccttcggaccagtgtctggagcccagatacagtttatgtag

SEQ ID NO: 234579 - DNA, 1959 bp, Artificial Sequence
  Description of Artificial Sequence: Synthetic coding sequence
atgagtggccagagtctcacagatcgaattaccgccgctcagcattcggtgacaggctccgccgtctctaaaacagtgtgtaaggccacaacccatgaaattatgggtccaaagaaaaagcacctagactacctgattcagtgtactaacgaaatgaacgtgaatataccccagttggcggattcgctgttcgaacgaacaacgaactctagttgggtggtggtctttaaatccctgattacgacccaccatctgatggtgtacggcaacgagagatttatccaatacttagcatccagaaatactctctttaacctgtccaacttcttggataagagtggtctccagggctatgacatgtcaacctttatccggagatactctcggtatctgaacgaaaaggcagtttcctatcgccaggtggcctttgattttacaaaagttaagcggggagctgacggcgtgatgagaacaatgaacacggagaagctgcttaagaccgtgccgataattcaaaaccagatggatgccctgttggattttaacgtgaacagtaacgagctaaccaacggggttatcaatgcagcattcatgttactgtttaaagacgcaatcaggctcttcgctgcctataacgagggcattatcaatctcctcgagaagtatttcgacatgaagaagaatcagtgtaaagaagggctggatatctataagaaatttctgacacggatgacccggatcagtgagtttctgaaagtggcagagcaggtgggtatcgacaggggagatatccccgatctttcgcaggccccaagttcactcctcgacgctctggaacagcacctggccagcctcgaaggcaaaaaaattaaagactccacagctgcctctagagcgactactctgtcgaatgccgtcagctctctggccagcactggtctgagcctgaccaaggttgatgaacgagagaagcaggcagccctggaggaggagcaggcacggctcaaggccctgaaagaacaacggcttaaagagttagctaaaaagcctcacacctctcttacaacagcagcttctcctgtcagtacgtccgccggaggcatcatgactgcccctgctattgacatcttctccacacctagctctagtaattccacaagtaaactgccaaatgaccttctcgacctccagcaacccactttccaccccagcgtgcaccctatgagcacagcctcgcaagtggcatccacctggggggatcccttcagtgcaaccgtcgacgcggtcgatgatgccattccttctttgaatcccttcctcactaaatcttcgggtgacgtgcatctgagtatcagcagcgacgtgagcacttttactacccgcacacctacacacgagatgttcgtgggatttacgccgtcccctgtggcacaaccccatccgagcgctgggctgaatgttgattttgagtcagtttttggtaacaagtctaccaatgttatcgtagactcagggggttttgacgagctggggggattgctgaagcccacagttgcctcccaaaatcagaacctccccgtcgctaagctccccccatccaagctggtgtctgatgacctggactccagcctcgccaatctggttggcaatcttggaattggtaatgggaccacaaaaaatgatgtgaactggtcacagcccggagagaagaaactcaccggcggatccaattggcagcctaaagttgccccaacaacggcctggaatgccgctactatggctcctcccgttatggcctatcccgcaaccacccccacaggaatgatcggctacggtatcccaccccagatgggctccgtacctgtgatgacgcagcctactctgatctactcccaacccgtaatgcggcctcccaaccctttcggcccagtcagcggcgctcaaatacagttcatgtag

SEQ ID NO: 234580 - DNA, 1938 bp, Artificial Sequence
  Description of Artificial Sequence: Synthetic coding sequence
atgtcgggccagagcctgaccgaccggattacagctgctcagcatagcgtgacaggctccgctgtttccaagaccgtctgcaaagcaactactcacgagataatgggcccaaaaaaaaagcatttggattatttgatccagtgcaccaatgaaatgaatgtcaatattccacagctggccgacagtctattcgaacgcactaccaattcctcctgggtggtcgttttcaagagtctgatcactacacatcatctgatggtttacggaaatgaacgttttattcaatatctggccagtcggaatacattgttcaatctgtcaaactttttagataaatccgggctgcagggctacgatatgtctacgtttattcgccgttatagcaggtatcttaacgagaaggctgtctcctataggcaggtcgcatttgatttcaccaaggttaagagaggcgcagacggcgtcatgagaaccatgaatacggaaaaactgctgaagacagttccaatcatacagaatcagatggacgccttgctggactttaatgtaaacagcaacgaattgactaatggcgtgatcaatgccgcattcatgctactgtttaaggacgctattcgtctgttcgctgcttacaacgagggtatcatcaaccttttagagaagtattttgatatgaaaaagaaccagtgcaaagagggtcttgacatttataaaaagttcctgacgcgtatgactcggatctctgagttcctcaaagtggctgagcaggtgggtattgacagaggagatatccccgatctgagccaggccccatcatccctgctcgatgcattggaacagcatctcgcaagcttggaggggaaaaaaataaaggatagtactgctgctagccgcgcaacaaccctgagcaatgcggtgtcctccttggccagcaccggtttgagcctaactaaggtggacgagcgagaaaaacaggcagctctggaagaggaacaagccagacttaaagcactgaaagaacaaaggctaaaggagttggcaaagaaaccgcatacaagtctgactaccgctgcctccccagtgtctaccagcgccggagggattatgacagcccctgcaatagatatttttagtacccccagttcctcaaattccacatcaaaactgcctaatgatcttcttgatctgcagcaaccgacctttcacccatcagttcatcccatgagtacagcatctcaggtggcttcaacctggggcgatgcggtcgatgatgccataccgtctctgaaccccttcttaaccaagtcctcaggagacgtgcacctgtccatctcttccgatgtgagcactttcacgacacgaactcctactcacgagatgtttgtggggtttaccccctcccccgtggcgcagccacacccctccgccggactgaacgtggatttcgaatccgtgttcgggaacaaatcaacaaatgtgattgtcgacagcggtggctttgatgagttgggcggtcttcttaaaccgaccgtggccagccagaatcagaatctgccagtagctaaactacctccctctaaacttgtcagtgacgacctggatagcagcctggccaaccttgtagggaacttgggcattgggaacggcaccacaaagaacgatgtaaactggtctcagcccggagagaaaaagctgactggagggagcaactggcaacccaaggtggctcctaccactgcatggaacgccgctaccatggcaccccctgtaatggcctaccccgcaaccacacctaccggtatgattgggtatggaattcccccacagatgggctcagtacctgtgatgactcagcccaccttaatctactcccagccagtaatgcgacctcccaatccctttgggccagtctctggagctcaaatacagtttatgtag

SEQ ID NO: 234581 - DNA, 1833 bp, Artificial Sequence
  Description of Artificial Sequence: Synthetic coding sequence
atgtcaggacagtccctgacagacagaataaccgcagcccaacatagtgtaactgggagcgcggtaagcaagacagtgtgcaaggccactacacatgaaatcatgggcccaaaaaaaaaacacttggattacctgattcagtgtacaaatgagatgaacgttaacatcccacagctcgcagattccctcttcgagcgcactaccaatagttcatgggtggtggtattcaaaagcctgatcacaacacaccatcttatggtgtacggtaacgaaaggtttatccaatacttggcctccagaaacaccctgtttaatctgtccaacttcctcgacaaatccggactgcaaggatatgatatgagcacctttatccggaggtacagccgctatttgaatgagaaggctgtgtcataccgccaggtggcctttgacttcacaaaggtcaagcgaggtgccgacggagtgatgcggacaatgaatacggaaaagcttctgaagacagttcccataatccaaaaccagatggatgccctgttagactttaacgtgaacagtaacgaattgactaacggtgttatcaatgcggcttttatgctgctgttcaaggatgccattcgactgttcgccgcatataatgagggaatcattaacttgttggagaagtacttcgacatgaagaagaatcagtgcaaggaggggctcgatatttataagaaattcttaactcgaatgacgcgcatcagtgaatttctgaaggtggccgaacaagtgggcatcgacaggggtgacattcccgatctgtctcaggctcccagctccctcctggatgccctcgaacaacacctggccagcctggaaggaaaaaagattaaggattccactgccgcaagccgagccaccacccttagtaatgccgtctcgtcactggcatccaccggcctttctttgaccaaagtggatgagcgggaaaagcaggccgcattggaagaggaacaggcccgtcttaaagccctgaaggaacagaggctgaaagaactcgccaagaagccacatacttcattaactaccgccgcaagcccggtgtctacatctgccggaggaatcatgacagcacctgccatcgacatattcagcaccccctcctcctctaactccacctccaagctgccaaacgacctcttggacttgcagcagcctacctttcacccctccgtccacccgatgtcaactgcatctcaggttgccagcacttggggcggatttaccccctcccccgtggctcagccacacccctctgccggactgaatgtagacttcgagtctgtgttcggcaacaaatcaacaaatgtgatcgtggacagcgggggtttcgacgaactcgggggactactcaagccgacggtggcttcgcagaaccagaatcttcccgttgctaagctgcctccctcaaagttggtgagtgacgacctggattcaagtctggccaacctggttgggaatctggggataggtaatggcactaccaaaaacgatgttaactggagccagcccggagagaaaaagctgaccggtggttcaaattggcagcccaaagtggctcctaccacagcgtggaatgccgcaaccatgaacgggatgcacttccctcaatacgcacctcccgtaatggcctacccagccacgaccccgactggaatgattggttacgggattcccccacagatggggtccgtgcctgtgatgacgcagcctaccttaatttactctcaaccggtgatgcgcccaccaaatccattcgggcctgtttccggagcccaaattcagttcatgtag

SEQ ID NO: 234582 - DNA, 1656 bp, Artificial Sequence
  Description of Artificial Sequence: Synthetic coding sequence
atgaacgtaaacattccacagctggcagactcactgtttgaacgcacgaccaattcctcctgggtcgtggtcttcaaaagtctcataactacccatcaccttatggtgtatggcaacgaaaggtttatccagtatcttgcatcccggaatacgttgtttaacctgtccaacttcctggacaaatcaggcctgcaaggctatgatatgtctactttcatcagacgatatagcaggtatttgaacgagaaggcagtgagctatcggcaggttgcctttgactttactaaggtgaagcgcggagccgacggggtgatgcgaaccatgaacaccgagaagttgctcaagacagtgccaatcatccagaaccagatggacgccctgttggactttaatgtgaactctaacgagctgaccaatggcgtgatcaacgccgcattcatgctgctgtttaaggatgccatacgtctttttgccgcatataacgaggggataatcaatttgctagagaagtacttcgacatgaaaaaaaatcaatgcaaggagggtttagatatctataagaagtttttgacaaggatgacccggataagtgagttcctgaaggttgcagaacaggtgggtattgacaggggagatattcctgatctttcccaagccccttccagcctacttgatgccctggagcagcacctggcctcgctggaggggaagaaaattaaagatagtacagctgctagcagagcgactaccctctccaatgctgtaagttctcttgcaagtacagggctgtctctgaccaaagtcgacgaacgggaaaaacaggccgcactcgaggaagagcaggctcgactgaaggccctcaaggagcagcgcctcaaggaattagccaaaaaacctcatacctctctgacaactgccgcaagtcccgtcagcacatccgctggcggaataatgaccgcgccagccatagacatcttcagcacgccatccagctccaactccacgtcaaaactcccaaatgacctactggacctgcagcagcccacattccacccatctgtacacccgatgagtacagcttcccaagttgcgtcgacatggggcggttttacacctagtccggtggcccaacctcaccctagcgcgggacttaacgttgactttgaatctgtgtttggaaacaaaagtactaacgttattgttgattctggcggattcgatgagttgggtgggctgcttaagccaactgtggcgtcacaaaatcagaacctccctgtggctaagttgccgccatctaaactggtttcagatgaccttgactcttcactggctaacctcgtcggcaacctgggtattgggaatgggaccactaaaaacgacgtcaattggagccagccgggtgagaagaaactgaccggtggttcaaactggcagccaaaggtagcgcctaccacagcttggaacgctgccacgatggcgcctccagtcatggcttatcctgcgacaacccctaccggcatgattggctatggcatcccaccgcagatggggtctgttcccgtgatgacccaacccaccctgatctactctcagcctgtcatgcgacctcctaatccctttggtccagtgagtggggctcagattcagtttatgtag

SEQ ID NO: 234583 - DNA, 1455 bp, Artificial Sequence
  Description of Artificial Sequence: Synthetic coding sequence
atggcttgtagaggaggcgcaggtaacgggcacagagcatcagccacattatccagagtgtctccgggtagcctgtatacatgtcgaacaagaactcacaatatctgcatggtcagtgactttttttacccgaacatgggcggtgtggaatctcatatctaccagctgagccaatgtctgatagagcgcggtcacaaagtaattatcgtgacccatgcttacggcaatcgcaaggggataaggtacctgaccagcggcctgaaggtgtactacctgccacttaaggttatgtacaaccagagtacggccaccactctctttcactctctgcccctcctgagatacatcttcgttcgggagagggtcactatcattcactcgcacagctctttttccgcaatggcccatgatgctctgtttcatgctaaaactatgggcctccagaccgtattcactgatcattctctgtttgggttcgctgacgtttcctccgtactcaccaataagctccttaccgtgtccctctgcgatactaaccacattatctgtgtctcctacactagcaaagaaaacaccgtcctccgagccgctttgaaccccgaaatcgtaagcgttatcccaaatgcggtggaccccaccgacttcacacctgatccattcaggagacacgactctatcactattgttgtcgtatcgaggctggtgtacagaaagggcatcgaccttttgagcggaatcattccagaattgtgccagaaatatccagatctgaatttcatcatcggtggagagggccctaagcgcatcatcctcgaggaggttcgcgagagatatcagctgcatgaccgcgtgcggttattgggagcattagaacataaggacgtcagaaatgttctggtgcaggggcacatctttctcaatacctctttgactgaggctttttgcatggcaatagttgaagccgcatcttgcggtctccaggtcgtctccacccgtgtgggtggcatccccgaggtgctacctgagaacctgatcattctctgtgagccctccgttaaatctctttgcgagggtctcgaaaaggctatattccagctgaaatcgggcacgctcccagcccctgagaatatccacaacatcgtcaagaccttttacacgtggcgcaacgtagccgagcgcactgagaaagtgtacgatcgcgtctccgtggaggctgtcctccctatggacaaaaggttggaccgactgatttcccattgcgggccagtgacaggctacatctttgccctgcttgcagttttcaatttcctgtttttaatctttctgagatggatgacccccgacagcataatagacgtggccatagatgccacagggcctagaggcgcatggaccaataactactctcattctaagagaggcggagagaataacgaaatctccgagacacgctag

SEQ ID NO: 234584 - DNA, 510 bp, Artificial Sequence
  Description of Artificial Sequence: Synthetic coding sequence
atggccatcgtggaagctgcctcttgtggcctgcaggtggttagcactcgagtgggtggcatacctgaggttctccccgaaaatttaattatactatgcgaaccctctgtcaaatcactgtgcgaaggcctagaaaaggctattttccagttgaagtctggtacattacctgctccagagaacatacacaacatcgtaaagacattctacacctggcgcaacgtagcagaacgcaccgagaaggtgtacgaccgagtgtccgtggaggctgtacttcctatggacaagagactcgaccgcctcatatctcactgcggccctgtgacaggctacatcttcgcactgctcgccgtcttcaactttctcttcctgattttcctcaggtggatgactccggatagcatcatcgacgttgccattgatgcaacaggaccaaggggcgcttggacgaacaattattcccactccaaacgaggaggtgagaacaatgaaatctccgagaccagatag

SEQ ID NO: 234585 - DNA, 753 bp, Artificial Sequence
  Description of Artificial Sequence: Synthetic coding sequence
atggagctgacaggaatagacttgttaagcggaattattcctgagctatgccaaaagtatccagatttaaattttatcatcggaggggaggggccaaaaaggattatcctcgaggaagtccgggagagatatcagttgcatgacagggtgagactgctgggggcattggagcacaaagatgtccgaaacgtattggtccagggtcatatattcctcaatacatcactcaccgaggccttttgcatggctatagttgaagctgcctcctgtggactccaagtcgttagcacccgggtcggcggtatacctgaggttctgcccgagaatctgatcatcctctgcgaaccctcggtgaagtcgttgtgcgagggcttggagaaagcaatatttcagctgaaaagcgggacattgccagccccagaaaacatccacaatatcgtgaagacattctacacctggaggaatgtcgccgaaagaacagaaaaggtctacgatcgtgtcagcgtcgaggccgtcctacccatggacaagaggcttgaccgcttgattagccattgtggcccagtgacagggtatatctttgctctgctggcagtttttaactttctcttcctgatcttcctgagatggatgacgcccgactcgatcatcgacgtcgcgatcgacgccaccggcccacggggagcatggactaataactattcgcatagcaaacggggaggagaaaacaatgagatcagcgaaacacgctag

SEQ ID NO: 234586 - DNA, 1665 bp, Artificial Sequence
  Description of Artificial Sequence: Synthetic coding sequence
atgaggaggcctctgtctaaatgtggcatggaaccaggcggaggcgatgcaagcttgacactccacggcttgcagaaccgatcacacgggaagatcaagctgcgaaagcgcaagagcacactgtacttcaacacccaggagaagagcgccaggcgtaggggggacctcctcggcgagaatatctacctcttgcttttcacaatcgccctgcggattctgaactgctttttggtccagacctccttcgttccggacgaatattggcagtcactagaagtgagccaccacatggtttttaactatgggtatttgacttgggagtggacagaacggctgcggtcctatacataccctttaatattcgcttcaatctacaagattctgcatctcctcggcaaggatagtgtacagttacttatctggattcctagactggcacaggccctgttatcggccgttgcagacgtccgattgtacagcctgatgaaacagttggaaaaccaagaggtggccaggtgggtctttttctgccagctctgctcatggtttacttggtattgctgtactcgtacattgacgaacaccatggaaaccgttcttactattatcgcactgttttattacccactcgagggaagcaagtctatgaacagcgtgaagtactcaagtctcgtcgctctggcctttataatcaggcccactgccgtgatattatggaccccacttctgttcagacacttttgccaagagccacgtaaacttgacctgatattacaccacttccttcccgtcggatttgttaccttgtccctctcactgatgatagacaggattttcttcggtcagtggactctcgtgcagttcaatttccttaagttcaacgttctgcagaattggggaaccttctatggcagccacccctggcactggtacttcagccaaggttttccagtaatcttgggcactcacttgccgttctttatccatggctgctacctggcacccaaaagatatcgcatcctgctggttactgtgctgtggacgctccttgtgtacagcatgctctcacataaggaattcagattcatctatcccgttctacctttttgcatggtgttttgtggctattctctcacacacctgaaaacctggaagaagcccgctctctccttcctctttctcagtaatctgtttctggctttatatactggcctggtgcaccaaagagggactcttgatgtgatgagtcatatccagaaagtgtgttataataatccaaataagtccagtgcatccatttttatcatgatgccatgccattccactccctactatagccatgtgcactgccctttacccatgaggtttcttcagtgcccccctgatctgaccgggaaatcacattacctcgacgaggccgatgtcttttacctgaatcccctgaactggttgcatcgagagttccatgatgatgcatcgctgccaacccacttgatcacattttccatcttggaggaggaaatttccgcatttttgattagcagtaattacaagagaaccgccgtcttcttccacacccacctgccagagggtcgaatcgggagccatatttatgtgtatgagagaaagctcaaggggaaattcaatatgaaaatgaagttctag

SEQ ID NO: 234587 - DNA, 1080 bp, Artificial Sequence
  Description of Artificial Sequence: Synthetic coding sequence
atggagacagtattgacaatcattgcccttttctattacccattggaggggagtaagagtatgaatagtgtgaaatactcctcactggtggccctcgccttcatcatccgaccaacggccgttatcctgtggacccctctattgtttagacatttttgtcaggagcccagaaaactcgatcttatcctccaccattttctgcctgttggcttcgtaactctttcccttagcctgatgatcgatcggatcttttttgggcagtggacactcgttcagtttaattttctgaaatttaacgttttgcagaactggggtacattctatggatctcatccttggcactggtacttctcacagggtttccctgtgattctcggcacccacctgcccttctttatccatggatgctacctcgccccaaagaggtaccggattttgctggtcacggtgctgtggacacttttagtttattcaatgctaagtcacaaagagttccgctttatttaccctgttttgcccttctgcatggtgttttgcggatattcactaacgcacctcaaaacatggaagaagccggcactgtcgttcctgtttctgtctaatttgttcctggctctgtacacgggcttggtacatcagcgaggcacgctggacgtcatgtcccatatacagaaagtttgctacaataaccccaacaagtcctcagcctctatcttcattatgatgccgtgtcacagtactccttactattcccacgtgcactgtccccttcccatgcggttcctgcagtgcccacccgacctgaccggcaagtcccactacctggatgaagcggacgttttttacttgaacccacttaattggctgcatcgggaattccatgatgatgcttcgctccccactcacctcatcacgtttagcatcctggaggaggagatctcagcctttcttatctcttctaactacaaaaggacagcagtgttcttccacacacacctccctgaggggaggattggaagccatatctacgtatatgagaggaagctgaaaggcaagtttaacatgaaaatgaaattttag

SEQ ID NO: 234588 - DNA, 894 bp, Artificial Sequence
  Description of Artificial Sequence: Synthetic coding sequence
atgtacgcacagccagtgaccaatacaaaagaggtgaagtggcagaaagtcctgtacgagagacagccttttcctgacaattacgtggataggcggttcttggaagagctcaggaaaaatatccacgcaaggaaatatcagtactgggccgtggtgttcgaatctagcgtggtgatccaacagctgtgctctgtttgcgttttcgtcgttatctggtggtatatggacgaaggattgctggcccctcactggcttctgggcacaggcctggcaagcagcttaatcggatacgtgctgtttgaccttattgatggtggcgagggcagaaaaaagtcaggccagaccagatgggcagatctaaagagcgcgttggtatttatcacattcacttacgggtttagtcctgtgctgaagactctaactgagtcagttagtaccgatactatttacgccatgagtgtgttcatgctgctgggacatctgatattttttgactacggggcaaacgctgccatcgtgtctagtactctgtcccttaacatggccatcttcgcatctgtgtgcttggcctctcgcctccccaggagtcttcacgcctttatcatggttacctttgcaatccaaattttcgccctgtggcctatgctgcagaagaaactaaaggcttgtactccacggtcttatgtgggagtgacactcctgttcgcatttagtgccgtgggcggattattgtccatttctgcagttggggctgttctgttcgccctacttctgatgtctattagctgcttgtgcccattctatttgatcaggctccagctgttcaaagagaatatccacggtccttgggacgaggccgaaataaaagaggacctttccaggtttttgtcttag

SEQ ID NO: 234589 - DNA, 894 bp, Artificial Sequence
  Description of Artificial Sequence: Synthetic coding sequence
atgtatgcgcagcctgtgactaacactaaagaggtgaagtggcagaaggtgctgtacgaaaggcaaccgttccccgataattacgtggaccggcgtttcctggaggagttgcgtaaaaatattcatgctcggaagtaccaatattgggccgtggttttcgagtccagtgtcgttattcagcagctgtgctcagtttgcgtgttcgtcgtcatctggtggtacatggatgaaggcctactggcgcctcactggctcttagggaccggattggctagcagtcttataggttacgtcctcttcgatctcattgacggaggcgaaggtcgaaaaaagtcaggtcagaccaggtgggccgacctaaaatctgcactcgtctttattacttttacttacggcttctcccctgttctgaagactttgactgagtccgtgagtacagatactatctatgcgatgtccgtgttcatgttactaggccatttaattttttttgattatggcgcaaatgccgcaattgttagctctaccttatcactgaacatggcaatcttcgcatctgtctgcctggctagccgcctcccaagaagtctgcacgcttttatcatggttactttcgcgatccagatcttcgctctgtggcccatgcttcagaaaaagttaaaagcttgcacccccaggagttacgtgggagtaactctgctcttcgccttcagtgccgtaggcggtcttctgagtattagcgcagtaggcgctgttctattcgcactgctcctgatgtctatctcttgcctgtgtccattctatctgatcaggctccagctctttaaggaaaatatccatggcccttgggatgaggccgaaattaaagaggacctctcgcgcttcctgtcttag

SEQ ID NO: 234590 - DNA, 894 bp, Artificial Sequence
  Description of Artificial Sequence: Synthetic coding sequence
atgtatgctcagcctgtcaccaatacgaaagaggtgaaatggcagaaggtgctgtatgagagacagccattccccgacaattatgtggatagacgctttctggaagaattaaggaagaatattcacgccagaaagtaccaatactgggcagtggtctttgagagctccgtagtcatccagcagctgtgcagcgtgtgtgtatttgtagtcatttggtggtacatggacgagggcctgctagcgcctcattggctgctgggtaccgggctcgcatcctccttaataggatacgtactttttgatttgatcgacggcggagaggggcgaaagaaaagtgggcagacaaggtgggcagaccttaagtcagctctggtgttcatcacgtttacctatggattcagcccagttctgaaaacgcttactgagtcagtgtccaccgacactatttacgccatgtccgtatttatgttgctgggccatctgatctttttcgattatggagccaatgccgcaatcgtgagtagcacacttagcctgaacatggcgatcttcgccagtgtgtgcctcgccagtagattgccccgttcattgcacgctttcatcatggtcacctttgcaattcaaatattcgctctctggccgatgctccagaagaagttgaaagcctgcacccccagatcttacgtgggtgtgacactcctattcgccttctccgccgttgggggactgctctcaatctctgccgttggagccgttctctttgccctgctgctgatgagcatcagctgcctttgccccttctacttaatccgactccaactcttcaaggaaaacatccacggtccttgggatgaggccgagatcaaggaggacctgagcagatttctgagttag

SEQ ID NO: 234591 - DNA, 660 bp, Artificial Sequence
  Description of Artificial Sequence: Synthetic coding sequence
atgaaagataacgacatcaagcggctgctgtatacacaccttctgtgcatctttagcatcatcctatccgtttttatcccttctctgtttctcgaaaactttagtatcttagaaactcacctaacctggttgtgcatatgcagcggctttgtcaccgcagtgaacctagttctttatctcgtagtgaaacccaacacatcttctaaacggtccagtctcagccacaaggtgaccgggttccttaaatgctgtatctactttttaatgagctgttttagcttccatgtgatttttgttctgtacggtgccccactgatcgagctggctctcgaaacgttcttattcgccgtcatcctgtccacgtttaccacagtgccatgcctttgccttctgggacccaatctgaaggcatggttgagagtctttagtagaaacggcgtgacttcgatctgggagaacagtctccagatcactactatttcgagctttgttggcgcttggctgggcgcattaccaattccccttgattgggagcgcccatggcaagtttggcccatctcatgcacccttggtgcgactttcgggtatgtggctggtcttgtgatttccccattgtggatatactggaaccgaaagcagctcacctataagaataactag

SEQ ID NO: 234592 - DNA, 621 bp, Artificial Sequence
  Description of Artificial Sequence: Synthetic coding sequence
atgaaggacaacgacatcaaacggctcctctacacccatttgctttgcatattcagtatcattctatccgtgtttattccctcattgttccttgaaaatttttcaattttggaaacacatttgacatggctgtgtatctgttctggctttgtgaccgcagtgaacctggtactgtaccttgtggtgaagcctaatacgtcatccaaacgcagcagcctgtcgcataaagtcacgggattcctcaaatgctgcatctactttcttatgtcttgctttagttttcacgtaatcttcgtcctttacggagccccactgatcgaactggccctggagacgttcctatttgccgtaatcctctccacctttactacagttccatgcctctgcttactcggcccaaacctcaaggcatggctgcgtgtcttctcacggaatggggtgactagcatctgggagaacagtttgcagataacgaccatctcctctttcgtaggtgcctggctgggcgcattgccaatccccctggactgggaaaggccctggcagatgactgttgagcgcaaaaggtccacctacagatccctccatgtcccctgtcggggactgggaactgtgaaatag

SEQ ID NO: 234593 - DNA, 150 bp, Artificial Sequence
  Description of Artificial Sequence: Synthetic coding sequence
atgaaggacaatgatatcaagaggctcctgtacactcatctgttatgtatattctctatcattctgagcgtattcatccctagcctgtttctcgaaaacttctccatcctggagacgcaccttacctggctctgcatttgcagcgggtag

SEQ ID NO: 234594 - DNA, 999 bp, Artificial Sequence
  Description of Artificial Sequence: Synthetic coding sequence
atggccgtgaccgatagcttgtcacgcgctgcaaccgtcctcgcaaccgtgctgttactgtccttcgggtccgttgcagcttctcacatcgaggatcaggccgagcagttcttccgatccggccatacgaataattgggcagtccttgtatgcacatctaggttctggtttaactaccgtcatgtggcaaatacactttccgtgtataggagcgtgaagcgtcttggcatacctgattcgcatatcgtcctgatgctggccgatgacatggcctgcaatccaagaaaccctaaacccgctacagtgttcagccacaaaaacatggagttgaacgtctacggggacgacgtggaggtcgactatcgttcatacgaggtgaccgttgagaattttctcagggtgttgaccggaagaattcccccaagcacaccccgatccaaacgcctgctttcagatgaccgtagcaacatactgatctatatgacagggcacggcggtaacggctttcttaagttccaggattcggaggagattaccaacatcgagctcgcggatgccttcgagcaaatgtggcaaaaaagaaggtacaacgagcttctctttatcattgatacctgtcagggagcatctatgtacgagcgcttctactctcccaacatcatggctctagcaagctcccaggtgggagaggattccttatctcaccagcctgatcctgccataggagtgcatctgatggaccgttacactttctatgtcttggagttcttagaggagattaaccctgccagtcagaccaacatgaatgacttattccaggtttgccccaaaagcctgtgcgtcagcactcctggccacagaacagacctgtttcagagagaccccaagaacgtccttataacagatttcttcggttctgtccggaaagtcgaaataacgacagagacaattaaactgcagcaggactccgagataatggaaagcaggtactccagttag

SEQ ID NO: 234595 - DNA, 1188 bp, Artificial Sequence
  Description of Artificial Sequence: Synthetic coding sequence
atggctgttactgatagcctgagcagagcagccaccgtcttggctaccgtcttactccttagcttcggtagtgttgctgcgagccacatcgaagaccaggcagaacaattctttagatccgggcatactaataactgggcagtgttggtttgtacctcacgtttctggttcaattatcggcatgtggccaacactttgtctgtttatcgctctgtgaagaggctgggtatcccagattcccatatcgtgctgatgcttgccgacgatatggcctgtaatcccagaaatcctaagcctgcgacagtgttctctcacaaaaatatggagctaaatgtgtacggcgacgacgtggaagtggattatcggtcatacgaggtgactgtggaaaactttctgagagtcctcacaggccgaatcccgccttctactcccagatcaaagagactgcttagcgacgaccgatctaatattttaatttacatgaccggtcacggcggaaatgggttcttgaaattccaagattccgaagagattaccaacatagagctggccgatgcctttgaacagatgtggcaaaagagaagatataacgagctgttatttattatagatacatgccagggcgctagtatgtatgaacggttttatagcccaaatatcatggccctcgcgtcctcccaagtcggggaagacagcctgtcacaccaacccgatccagcaataggggtccacctgatggataggtacacattttacgtgctcgagttcctggaggagatcaaccctgcttcccaaacaaacatgaacgacctgttccaggtgtgccccaaatccctgtgcgtgtcaacccccggacaccgcacggacctgtttcagagggaccctaaaaacgtgctcatcaccgatttttttggctctgtgagaaaggtcgagataaccacagagacgatcaaactgcaacaggacagtgaaattatggagtccagctataaagaggatcagatggacgaaaagctgatggaacctctcaagtacgctgaacagctgcccgtggcccagatcatacatcagaaacccaaactgaaagattggcaccctcccggagggttcatactgggcctgtgggccctaatcattatggtttttttcaagacctatgggataaagcacatgaagttcattttttag

SEQ ID NO: 234596 - DNA, 960 bp, Artificial Sequence
  Description of Artificial Sequence: Synthetic coding sequence
atggcagttaccgattccctttccagagccgctaccgtgctggccaccgtcctcctgctgagtttcggctccgtggctgccagccacattgaggatcaggcagaacagttcttccggtctggacatactaataactgggcagtgcttgtcacagtcgagaattttcttcgggtgctgacaggccgaatcccgccttctactcccaggagcaaacgtctcttgtcagacgaccgcagcaacatcctgatctatatgaccgggcatggagggaacgggttccttaagttccaggattcggaggaaatcacgaacatagaattagccgacgcttttgaacagatgtggcagaagcgcagatataacgaactcttgttcattattgatacgtgccaaggggcatcgatgtatgaaagattctactcccccaatattatggccctggcctcctcacaggtgggcgaggattctctcagtcatcagcccgatcccgctattggcgtccatctcatggatagatacacattttatgtactcgagttccttgaagagatcaatcctgcaagccagaccaacatgaatgacttattccaggtgtgcccaaagagtctgtgtgtgtccacccccggtcacaggactgatttgttccagcgggacccaaagaacgttcttatcactgacttcttcggatctgtgcggaaagtggagatcacgaccgagactattaagctgcagcaggacagtgagattatggagtcaagctataaggaggatcagatggacgaaaaactgatggaaccactgaaatacgctgaacagttgccagtggctcagatcatccaccagaagcctaaactgaaggactggcatccccctggcggatttattttaggcctttgggcactcataattatggtcttcttcaagacttacggcatcaagcacatgaaattcattttctag

SEQ ID NO: 234597 - DNA, 906 bp, Artificial Sequence
  Description of Artificial Sequence: Synthetic coding sequence
atggctgtcactgactccctgagccgcgcagctactgtcttggctactgtgcttctactgagtttcgggagtgtggctgcctctcacatagaagttactgtggaaaacttcttgcgagtactcaccgggaggatccctcccagtactccacggtcaaagcgcttgttgtcagacgacaggtctaatattctcatctatatgactggacatggtggtaacgggtttttgaagtttcaggattccgaggagataacgaacatcgagctggcggacgcgtttgagcagatgtggcagaagcgacggtacaacgagttactattcatcatcgacacctgccagggcgcttcaatgtatgaaagattttatagcccgaatattatggctctggccagttctcaggtcggggaggacagcctaagccaccaaccggatcccgcaattggggtgcatctgatggatagatataccttctatgtcctcgagtttttggaagaaatcaatccagcctctcagaccaatatgaatgacctctttcaggtgtgtccaaagtcactctgtgtgagcacaccaggccacagaaccgatctgttccagcgggaccctaaaaacgtgttaattaccgatttttttggatcggtacggaaggtggaaattactacagagacaatcaagctccagcaggacagtgagattatggagagctcatacaaggaggaccagatggacgagaaactcatggagccgctcaagtacgcggaacagctgcccgttgctcagattattcaccaaaaaccaaaattgaaagattggcaccctcccggaggttttatccttgggctgtgggccctgataataatggttttttttaaaacatacgggattaaacatatgaagtttattttctag

SEQ ID NO: 234598 - DNA, 558 bp, Artificial Sequence
  Description of Artificial Sequence: Synthetic coding sequence
atgggcaaaaaacagaataagaagaaggtcgaggaggtgctggaggaagaagaggaggagtacgtggttgaaaaagtccttgatcgtcgagttgtgaaagggaaagtggagtacctgctgaagtggaaggggttcagtgacgaggataatacctgggagcctgaggaaaacttggattgccccgaccttattgcagaatttctgcagtcgcaaaaaaccgcacacgagaccgacaagtctgagggtgggaaaagaaaagctgacagtgactcagaagataagggagaggagtctaaaccaaagaaaaagaaagaagagagcgaaaagcccagaggttttgcacggggacttgagccagaaaggataatcggggctaccgattcttccggcgagctgatgttcttgatgaagtggaagaatagcgacgaagcagacttggtccccgcaaaagaggcaaatgtgaagtgtccacaggtggtcatcagcttttacgaagaaaggttaacctggcactcatatccctcagaggacgacgataagaaggacgataagaactag

SEQ ID NO: 234599 - DNA, 735 bp, Artificial Sequence
  Description of Artificial Sequence: Synthetic coding sequence
atggaggccatgtggctgttgtgtgttgccctcgcagtgctggcctggggctttctctgggtttgggatagcagtgagaggatgaagtccagggaacagggaggcaggctgggggcagaatcgcgcaccctgctggtgatcgctcacccagacgacgaagccatgttctttgctccaacagttcttggcctcgctcggctgagacactgggtttacctcttgtgcttctcagcgggaaactattacaatcagggggaaacaaggaagaaggagctgttacagtcttgcgacgtcctggggatccccctgtcctcagtcatgatcatcgacaatagggatttccctgacgacccaggaatgcaatgggacacagagcacgtggcgagagtgctgctgcagcacatcgaggtgaatggaatcaatcttgtcgtgactttcgatgcgggaggagtctcgggccactcgaatcacattgccttgtacgccgctgttagagttttgtgcgcccatgcaagcgtatgtgaatgcgcagctcaagttcatctgccgagtggcagcgctttggtgagtgctagttatgctggttgcccactgcgtgctcaacagcaaagaagcggcactggccaggaatcccacgtgcttcccccacagcccgctccactcgttcccccacctctccactacttactccctgtccacgagaatcagttaacagaactgcctctgaagccatag

SEQ ID NO: 234600 - DNA, 1272 bp, Artificial Sequence
  Description of Artificial Sequence: Synthetic coding sequence
atgggctcaactaagcactggggtgaatggctgttaaacctgaaggtggctcccgcaggggtatttggggtcgcgtttctggccagggtggccctcgtattctatggggttttccaggaccgaacattgcacgttcgctatactgacatcgactaccaagtgttcactgatgccgcacgctttgtaacagaaggcagaagcccatacctccgagcaacttacaggtatacacccctgctgggatggctattgactccaaacatctatctgagcgagctgtttggcaaattccttttcataagctgtgacctgttaacagcctttttactttataggctcttgctccttaagggactgggcaggcgccaggcctgcggatattgtgtcttctggctccttaatcccctgcctatggcggtgtcgtccagagggaatgccgattcaatcgtggcctccctcgtcctaatggttctctatttaatcaaaaagaggctggttgcctgcgctgcagtgttctatggctttgctgtccatatgaagatctatcctgtgacttacatccttccgataacgctgcaccttctgcccgatagagacaatgataagagtctgcggcaatttaggtatacctttcaagcatgtctttatgagctgctgaaaagactctgtaatcgcgcagttcttttattcgttgcagtggccggtctgaccttttttgccctgagttttggattctactatgaatatgggtgggagtttctggaacacacctatttttaccacctcacgcggcgtgatattcggcacaatttcagcccatatttctacatgttgtatctgactgcagaaagtaaatggtccttctcgctgggtattgctgccttcctgccacagttgatcctgctttctgctgttagtttcgcctattatagggaccttgttttttgttgctttctgcatacctccattttcgtgacatttaacaaagtgtgtaccagccagtacttcctttggtacctgtgtcttctgcccttagtgatgcctttggtcagaatgccttggaagagagctgtggtattgctcatgctatggtttatcggacaagccatgtggctggcaccagcctatgtgctggagtttcaaggaaaaaatactttcctatttatctggctggctggcctgttctttctgcttattaattgctccatactcattcagattattagtcactacaaagaagagcccctaactgaacgcatcaagtatgactag

SEQ ID NO: 234601 - DNA, 2796 bp, Artificial Sequence
  Description of Artificial Sequence: Synthetic coding sequence
atgctgcttttcttcaccctcggcctgctgatccattttgtattttttgcttctatcttcgacatctacttcacctccccgctggtgcacggaatgaccccacagtttacacccctgccccctcctgcacggaggctcgtcctctttgtggctgacggtttgagggccgatgccctctacgaactcgacgagaatgggaactcacgggcaccttttattcgtaacatcatcatgcatgagggctcgtgggggatcagccatacaagggttccaaccgaatccaggcctggacatgttgcacttatcgcgggattctatgaagacgtgtccgctgttgccaagggatggaaagaaaatccagtcgaattcgatagtctgttcaacgagtcaaagtacacatggtcgtggggtagtccagatattctccctatgtttgcgaaaggggcttcgggcgatcatgtgtacacatacagctacgacgcaaagcgggaggatttcggcgctcaggatgcgaccaaactggacacttgggttttcgacaacgtgaaggacttcttccatcacgcaagaaacaaccagtcactcttttccaagataaacgaggagaagattgtcttttttctgcacctgctaggaatagataccaatgggcacgcgcatagacccagctctagagattacaaacacaatatcaagaaggtggacgatggagtgaaagaaattgtttcaatgtttaaccacttctatggaaatgatgggaaaactactttcatatttacctccgatcacggtatgaccgattggggctcccatggagcaggccatccaagcgaaactcttaccccgcttgtcacatggggggcaggcattaaatacccacagagagtgtccgcacaacagttcgacgatgcgtttttgaaggagtggaggctcgagaattggaagaggctggacgtcaatcaggcagacatcgctccactcatgacatctttgatcggggtgccattccccttaaatagcgtcggtatcctgcctgtggactacttaaacaacacagatctcttcaaggctgagagcatgtttacaaatgccgtgcagattcttgaacagtttaaagtaaagatgactcaaaaaaaagaggtcacattgcctttcttgttcacacctttcaaactcttgtcagatagcaagcagttcaacattttgcgaaaagcaaggtcatacatcaaacacagaaagttcgacgaagtcgtgagcttgtgcaaagagttaattcatctcgcactcaaaggactcagctattatcacacatacgatcgcttcttcctgggagtgaacgtggttatcggcttcgtggggtggatttcctatgcctcactcttgattatcaagtcacactctaacctgatcaagggcgtaagcaaagaggtcaagaagccaagccacctcctgccctgtagttttgtggcaatagggatactggtggctttctttctgctgatccaagcttgtccctggacctattatgtatacgggctgctgccccttcccatttggtacgctgtgctccgggagtttcaagtgattcaggacctagtggtgtccgtacttacgtatccactgtcccacttcgtcggataccttctggcctttactttggggattgaggtgctcgtgctttcgttcttctatcgatacatgctaacagctggtttaacagcatttgcagcctggcccttcctgacccggctgtggaccagagccaaaatgacatctcttagctggacattttttagcctgctgctggctgtttttcctctaatgccagtggtgggccgtaagcctgacatctccctggtaatgggtgccggactgctggttcttttgttatcactatgcgtggtgacttctctgatgaagaggaaggattctttcatcaaagaagaactcctagtacacctacttcaggtcctctcaacggtcctgtccatgtacgtggtgtattccactcagtctagcttgctgcgaaaacagggcctgcccctgatgaatcaaattatttcatgggctacccttgcttcatctcttgtggttccgttactgagcagccctgtattgtttcagcgacttttttccattctgctctccctgatgtcgacatacctactgctgtctacaggctatgaggcattgtttcctctggtactgagctgcctgatgtttgtatggatcaatattgaacaagaaaccctgcagcaaagcggagtatgttgtaaacagaaattgacatcgatacagttctcttacaatactgacattacccagtttcgacagttgtatctagacgacatcaggagggcgttctttctggtattctttctagtgacagctttttttggaacaggcaatatcgcgagcattaatagttttgatctggcatctgtgtactgttttttgactgtattctccccatttatgatgggtgcgctcatgatgtggaagattctaattccttttgtcctagtgatgtgcgcgttcgaagcagttcaactaactactcagctctcttccaagtccctcttcttgatagttctcgtgatcagcgatataatggccctgcatttcttctttcttgttaaagattacggttcttggctggatatcggaaccagcatctcacactacgtgatagtaatgagcatgacaatcttcctcgtttttctgaacggtctcgctcagctgctgaccaccaagaagctgcgcttgtgcggcaaaccaaagtcacactttatgtag

SEQ ID NO: 234602 - DNA, 2796 bp, Artificial Sequence
  Description of Artificial Sequence: Synthetic coding sequence
atgctgcttttttttacgctgggtttgctcatacacttcgtatttttcgctagtatctttgacatctatttcacctcacctctcgtgcacggcatgacgccacagtttacccccctgccacctccggcaagaaggttggtgctgtttgtcgctgatggacttcgcgcagatgcattatacgagctggacgaaaatggtaacagtcgcgcaccatttattaggaatataatcatgcacgaagggtcctggggtataagccacaccagagtaccaaccgagagtaggcccggacatgtagcattgattgcagggttttatgaggacgtgagcgccgttgctaagggatggaaagagaaccctgtggagttcgacagccttttcaacgaatctaaatacacttggtcttggggcagccccgacatcctcccaatgtttgctaaaggggcaagcggggaccatgtgtacacatatagttatgacgccaagagagaagatttcggggcacaagatgctactaaattggatacctgggtgttcgacaatgtcaaggattttttccatcacgccaggaataatcagagcctgttttccaagattaatgaggaaaagatcgtttttttcctgcatctccttggaattgatacaaacggccacgcacatcgaccctcatcccgtgactacaagcacaatattaaaaaggtggacgacggtgtgaaggagatcgtgtccatgtttaatcatttttatggcaatgacggcaaaactacttttatctttacctctgaccatggaatgaccgactggggtagccatggcgcaggacatccttccgagaccttgacccccctcgttacttggggcgcagggattaagtacccgcagagggtcagtgcacaacagttcgatgatgccttcttgaaggaatggagactggaaaactggaaacgtttggacgttaaccaggctgatatagccccactgatgacctccttaatcggggtgccttttcctcttaatagtgttggaatcctgcctgtggattatcttaacaacaccgacctgttcaaagccgagtcgatgtttacaaacgcagtgcagattctagagcagttcaaagttaagatgacccagaagaaagaggttaccctgcccttcctcttcactccgttcaagctgctgagcgatagtaaacagttcaatatcctccgtaaggctagaagctacatcaagcatagaaagtttgacgaagtggtgagtctctgcaaagaactgatccacttagcgttgaaagggttgtcatactaccacacttacgaccgcttcttccttggagttaatgtcgttatcggattcgttgggtggattagttatgcctcactgctaattataaagagccactccaatctcatcaagggcgtatcaaaagaggtgaaaaagccatcccacctcctgccctgctcctttgtcgcaatcgggattctggtcgctttcttcctcctcatccaggcctgcccctggacgtactatgtgtacggtctactgcccttgccaatatggtatgccgttctacgagagtttcaagttatccaggacctggtggtgtccgttttgacttatcctttgagccatttcgtgggctacctgctcgcatttactctaggaatcgaggtgctggtgctttcattcttttaccgatatatgctcaccgcaggtctgaccgcttttgcagcatggccatttctcacccggctctggactcgggcaaaaatgacctccctgagctggacatttttttccctgctcttggctgtgtttcctctcatgccagttgtgggacgcaagccagacatcagcttagtgatgggcgctggcttattggttctgctgctaagcctttgcgttgttaccagtctgatgaaacgcaaggattctttcataaaggaagaactgctggtccacctgttgcaagttttgtcaaccgttctctccatgtacgtggtatactcaactcagtcaagcctccttcgcaaacaggggctccctttaatgaaccagattatctcttgggccacattggctagctctctcgtggtccctcttctgtcctcgcctgtgctgttccagcggctcttcagcattctcttatccttgatgtctacatatttactccttagtacaggttatgaggcactgttcccactcgtgctgagctgtctgatgttcgtgtggatcaatatagagcaagaaaccctccagcagtccggggtctgctgtaaacagaaactcacctccattcagtttagttacaataccgatattactcagtttaggcagctctatctggacgacatccggagagctttctttctggtatttttcttggtgactgcttttttcgggacaggcaacatagcatctatcaactccttcgacttggccagcgtatactgttttctgacagttttcagccccttcatgatgggggctttaatgatgtggaagattcttataccgttcgtgctcgtgatgtgcgcttttgaggccgtccagctgacaactcagctgtcaagtaagtctctttttctgatcgtgctagttatttcagatataatggccttacactttttttttctggtcaaagattacggctcttggctcgatattgggacatctattagccactacgttattgtgatgagcatgacaatcttcctggtgttcctcaatggccttgcccagctgctgacaacaaaaaagcttaggctgtgtgggaagccgaaaagccactttatgtag

SEQ ID NO: 234603 - DNA, 405 bp, Artificial Sequence
  Description of Artificial Sequence: Synthetic coding sequence
atggtggagaattctccctcccctctgcccgagcgggctatttacggttttgtgctcttcctcagctctcagtttgggttcattctgtatcttgtgtgggcatttatacccgagagttggttgaattccctcggcctgacatactggccccagaaatattgggctgtggctttacccgtctatttactcatcgctatagttatcggttacgtcctcctcttcggaattaatatgatgtcgacttcgcccttggacagtattcataccataaccgataattacgccaaaaaccaacagcagaaaaaataccaagaggaagcaattcccgcacttagagatatttcaatctccgaagttaaccaaatgttttttctcgcagctaaagagctgtacacaaagaactag

SEQ ID NO: 234604 - DNA, 327 bp, Artificial Sequence
  Description of Artificial Sequence: Synthetic coding sequence
atggtactgtaccttgtctgggccttcatccctgaaagttggctgaacagtctcggcctgacttactggccgcagaagtattgggccgtcgctcttccggtctacctgctgatagcaatcgttattggatacgtcctcctgtttggtataaatatgatgtccacaagccctctagattctatccatactattactgacaactatgcgaagaaccagcagcagaagaaataccaggaagaagccatccccgctctgagggatatcagcatatcagaggtgaaccagatgttttttctggccgctaaggagttatacactaagaactag

SEQ ID NO: 234605 - DNA, 405 bp, Artificial Sequence
  Description of Artificial Sequence: Synthetic coding sequence
atggtcgagaacagtccatctccactgcctgaaagggcaatctacggattcgtcctgtttctttcctctcaatttggcttcatactgtaccttgtgtgggcgttcatacctgagtcctggctaaatagcctgggtttgacatactggccacagaaatattgggccgtcgcactgcctgtctacttactgattgctatcgtcataggatatgtcctcttattcggcattaacatgatgagcacaagtccactggactcaattcatacaattaccgataattacgccaaaaaccagcagcaaaaaaagtaccaggaagaagctatcccggcacttcgcgatatctcgatctcagaagtaaaccagatgttcttcctcgctgccaaagagttgtatactaagaactag

SEQ ID NO: 234606 - DNA, 405 bp, Artificial Sequence
  Description of Artificial Sequence: Synthetic coding sequence
atggttgaaaactcccctagtccattgcccgaacgggctatctatgggtttgtgctgtttttatcatcgcaattcggatttatcttgtacctggtgtgggctttcataccagagagttggctaaactcacttggcttgacatattggccacaaaagtactgggcagtcgctcttcccgtgtatttgctgatcgcgatcgtgatcggctacgtgttgctgtttgggatcaatatgatgtccacctctccactggacagcatacatacgatcacagacaattatgcaaagaatcagcagcagaaaaaatatcaggaagaggcaatacccgctctcagagatatatccatcagtgaggtcaaccaaatgtttttcctggccgctaaagaactgtacactaagaattag

SEQ ID NO: 234607 - DNA, 78 bp, Artificial Sequence
  Description of Artificial Sequence: Synthetic coding sequence
atggtgctgtatctggtctgggctttcattcctgagagttggctcaactcactggggttgacctactggccccagtag

SEQ ID NO: 234608 - DNA, 477 bp, Artificial Sequence
  Description of Artificial Sequence: Synthetic coding sequence
atggtgcctcgctctacatcactcgcgttaattgtgtttctgtttcatcggctcagcaaagctccaggcaagatggtagaaaactctccttcaccattacccgagcgcgctatctacggattcgtactgtttttgtccagtcagtttgggttcattttgtatcttgtgtgggcctttatccctgagtcttggctcaattctctcggcctgacttattggccacagaagtactgggcagtcgccctgccagtctacctgttgatagcaatcgttattggatacgttcttctttttgggatcaatatgatgtcgacatctccactggatagcatccacacaatcaccgataattacgcaaaaaatcagcaacagaagaaataccaggaggaggctattcctgcactcagagacatttcaatcagcgaggtcaatcagatgttctttctcgccgcaaaggaactatatacaaaaaactag

SEQ ID NO: 234609 - DNA, 1848 bp, Artificial Sequence
  Description of Artificial Sequence: Synthetic coding sequence
atggcaagagcctgcctgattcaacgtctccctattaaaagagactgcacacccgttttcgtgaggggcttgagctctccgtcggctgccatggccttgctgagtgaaggcctggacgaagttccagcagcctgtttatcgccctgtggccctcctaatcccactgagttgttcagtgagtcaagacgactcgcacttgaagagttagttgctggcggacctgaggccttcgccgcttttctccggagagagagactagcaaggtttctgaaccccgacgaggttcacgcaatactgcgtgccgcagagaggcctggcgaggagggggcagctgctgcagccgctgcagaagacagctttggcagctcgcatgattgtagtagcgggacatacttcccagagcaatccgacctcgagccacctttactcgagctgggttggccagctttttatcaaggggcataccggggagcaactcgggttgagacccactttcagccgcgaggagccggagaaggaggtccgtacggatgtaaggacgcgctccggcagcaacttagatctgccagagaggtaatcgccgtggtgatggatgtgtttacagatatcgatatttttagagatttgcaagaaatttgcaggaagcagggggtcgccgtgtacattctgctagatcaggctttactctcacagtttttagacatgtgtatggatcttaaggtgcatcccgagcaagagaagctgatgactgtgcggaccattacgggcaacatatactacgccagatctggtactaaaatcattggcaaagtgcacgagaaatttacccttatcgatggcatccgtgtggccaccgggtcgtattccttcacctggacagacgggaaattgaactcttcgaatctggtgatactctctgggcaggttgtcgagcacttcgaccttgaatttagaattctatacgcccagtctaaaccaatcagccctaaacttttaagtcatttccagagtagcaataaattcgatcatcttacaaatagaaaaccgcagtccaaggaactcactctcgggaatttgttgcgtatgaggctggcacggttgagctctactccaagaaaagccgacttggatccagaaatgcctgcagaaggaaaggcggaacggaaaccacatgactgcgagtcaagcacagtgtctgaggaagactacttctctagtcaccgggatgaattacagagtcgtaaagccatcgatgcagcaacccagaccgaaccaggagaagaaatgcccggtttgagcgtgtcagaggttggaactcagactagcatcacaactgcctgtgccggaactcaaactgccgtgatcacacggattgcatcctctcagactacaatctggtcacgcagcaccactactcagacagatatggacgagaacatattatttccacggggaacccaaagcacggaagggtccccagtctctaaaatgagtgtgagtcggagcagttctctgaagtcatcgtcatccgtcagctcgcagggatctgtcgcctcctccactggaagtccagcgagcatcaggacgaccgatttccataacccaggttaccctaagtacctcggtacgcctcacctcgagctttacctgtcagattccctgcgaaatctcaacaaagaacggcagttccacttcgctgggattaggagccgactgaatcacatgctggctatgctctctcgtcggactctgtttactgaaaatcatttagggctgcactccggcaacttctcccgagtgaacctgcttgccgtccgcgacgttgccttatacccgagctaccagtag

SEQ ID NO: 234610 - DNA, 1248 bp, Artificial Sequence
  Description of Artificial Sequence: Synthetic coding sequence
atggccgctcccctggtcctggttctcgtggtggcggttactgtgagggccgcactgttcaggtcaagtctggcagagttcattagcgagagggtggaggtcgtgagccccctcagttcctggaaaagggttgtggaggggctgagcctcctggatctcggagtgtctccctactctggggctgtgttccatgaaatcacagatgctttgaccgccatagctttgtacttcgccatacaggactttaataaagttgtttttaagaagcagaaactgttactggagctggaccagtatgccccagacgttgctgagttaattcgaacaccgatggagatgcgctacatacctttaaaggtcgcacttttttacttgctaaacccctatacaatactgtcgtgtgtcgcgaagtccacctgtgctattaacaataccctcatagcctttttcattctcaccactattaagggctctgccttcttaagtgccatttttcttgctttggccacatatcagagtctctacccgctcacattattcgtgcctggcctgttgtacctgctccaacgccagtatatccccgtcaaaatgaaatccaaggctttttggattttctcctgggaatatgcgatgatgtacgtaggaagtttagtggtcattatttgtctctccttcttcctgctgagcagttgggatttcatacccgcagtatacgggtttattctgagcgtcccagatctgaccccgaacattggtctattttggtacttttttgccgagatgttcgagcatttctccttattttttgtttgcgtgtttcagataaacgtgttcttttatacaatcccactcgccattaagctcaaggaacatcccatcttcttcatgttcatacagatcgctgttattgctatctttaagtcttaccctaccgtgggagacgttgcactgtatatggcatttttcccagtatggaaccatttataccgattcctgaggaacatatttgtgctgacatgtattatcattgtgtgttcactgttatttcctgtgctgtggcacctgtggatatatgcagggagcgccaactccaacttcttttacgcaatcactcttacttttaacgtagggcaaatactgctgatctctgactacttctatgcctttctcagacgcgagtattacctgacccacggtctgtatctgacagccaaagacggaacagaggccatgctggtcctgaagtag

SEQ ID NO: 234611 - DNA, 513 bp, Artificial Sequence
  Description of Artificial Sequence: Synthetic coding sequence
gtgagtgtacctacccatttggtgtgcccacgaactcctttgtcacctcccgctgctgtgcatacctgcgaaaacgaagaacagtccctccttgacctgttcttgggagtgtgccacgacattaatgtgttcttttatacaatacccctagcaattaagctcaaagagcacccgatattctttatgttcattcaaattgccgtgattgctattttcaagagctatcccactgtcggggatgtggccctgtacatggcgttctttcccgtgtggaaccacttatacagattcctgagaaatattttcgtcctcacatgtataataatcgtctgtagccttttgtttcccgtgttgtggcacctgtggatttacgctggctcggctaatagtaacttcttttatgctatcacgctcaccttcaacgtgggccaaatactgctgatctccgactacttctacgccttcctgcgccgtgagtactatctgacacacggactgtatttaacagcatag

SEQ ID NO: 234612 - DNA, 1272 bp, Artificial Sequence
  Description of Artificial Sequence: Synthetic coding sequence
atggctgctccgctagtcctggttttagttgtggcagtcactgttagggccgcactgttccgcagcagcctcgcagagttcataagtgaaagagtcgaagtggtgtcccctctgagcagctggaaaagagtcgttgagggcctgtctctccttgacctgggggtgtcaccatactccggcgcagtctttcacgagacccccctcattatctacctgttccactttctcattgattacgcggagctcgtttttatgattacagacgcgttgaccgcaattgccctgtacttcgccatacaggatttcaataaagtagtgtttaaaaaacagaagctgctgctggaactggaccagtacgcccctgacgtagctgagctgatccgcacgcctatggagatgcgctacatccctctgaaggtggcattattctacctcctgaatccttatactattctgtcttgcgtggccaaatccacttgcgcaattaacaataccctgattgctttcttcatactgaccactattaagggaagtgcttttctcagtgctattttcctggcccttgccacatatcaatcactgtaccccctgaccctgttcgtcccaggcctgctctatctgctgcagagacaatatataccggtgaagatgaagtctaaggctttctggatctttagctgggagtatgcaatgatgtacgtcggctctctggtggtgataatctgcctgagtttcttcctgctgtctagctgggactttatacccgcagtatacggatttattctcagcgttcccgatctgacccctaacattggcctcttctggtacttcttcgcggaaatgttcgagcacttttcccttttcttcgtgtgtgtgtttcagatcaatgttttcttttatacaatccctcttgcaatcaaactcaaggaacatccaatattctttatgttcatacaaattgcagttattgccatctttaaatcttaccccacggtaggggatgtcgctctgtatatggccttcttcccggtttggaaccacctgtatcgatttctgagaaacatctttgttttgacatgcatcattatcgtttgtagtctgctttttccagtactgtggcacttatggatatacgcaggctctgccaacagcaattttttttacgccattaccttgacttttaacgtgggacagatgggcttctgcggtgatcgcatggcgggtacttgcccagaggcaatccgcgctgcaggagaccgcacccccagttag

SEQ ID NO: 234613 - DNA, 1482 bp, Artificial Sequence
  Description of Artificial Sequence: Synthetic coding sequence
atgtggccacaggatcctagccggaaggaggtgcttcggtttgcagtgagctgccggattctaacgttgatgctccaggccttgtttaatgccattattcctgatcaccacgccgaggcgtttagccctcctagactcgcgccttctgggtttgtggatcagttggtagagggcctgctgggagggctgtctcactgggatgccgagcacttcctctttatcgcagaacacgggtatctgtatgaacacaatttcgctttcttccctggtttcccccttgcactgttagtggggactgaactgctgcgtccgctgcgcggactgcttagcctgcgatcatgcttattaatttctgtcgcctcgctgaacttcttgttctttatgttggccgctgtggcgctgcatgacctgggctgcctggttctgcattgcccacaccagtccttctacgctgcattgctgttttgcctcagccctgccaacgtattcttggccgcaggctactctgaggccctctttgccctgctgactttcagtgccatgggacagctagaaagaggtcgcgtgtggacgagcgtactcctgttcgcatttgccactggtgtcaggtctaacggccttgtgtccgtcgggttcctcatgcactcacagtgccagggcttcttcagtagcctgaccatgttgaatccgttaaggcagctattcaaactgatggcaagtctctttctgtcagtcttcactctgggcttgccttttgcgctctttcagtattacgcatatacacaattctgtctcccagggtctgccaggccgattcctgagccccttgtgcagctcgctgtggacaaaggatatcggatcgcggagggaaacgagccaccttggtgcttttgggacgtcccactgatctatagctatatccaggatgtgtactggaatgtcggctttctgaagtattacgagctcaaacaggtcccaaacttcctcctcgccgctcccgtggccatattggtcgcgtgggctacctggacctacgtcaccacccacccttggctttgcttgaccctgggactccaaagatcaaagaataacaaaactctagagaaacccgatctcgggtttctctctccccaggtatttgtgtacgtggtccatgcggcagtgttgttgctgttcggcggtttatgcatgcatgttcaggtactgactcgcttcttaggctctagtacacccattatgtattggtttccagcccacctgcttcaggaccaggaaccactgctgcgctccctaaaaaccgtaccctggaagcctctcgccgaggacagtccacccggtcaaaaagtgccccgtaaccccatcatgggcttgctctatcattggaagacatgctcgcccgttacaaggtacatcctcggatacttcctgacctactggctgctcggtctcctcctgcattgcaactttcttccctggacctag

SEQ ID NO: 234614 - DNA, 1482 bp, Artificial Sequence
  Description of Artificial Sequence: Synthetic coding sequence
atgtggccgcaggatccatctaggaaggaggtgcttagattcgctgtaagttgtaggatcctgacactgatgttgcaggccttgtttaatgcgattatcccagaccaccacgcagaagccttctcccctccacggttagctccgagcggttttgtggaccaattggtggaaggattgctgggcggtctgagccactgggacgccgagcacttcctttttattgccgaacatgggtatttgtatgagcacaactttgcattttttccgggattcccactcgcactgctggtggggaccgagctgcttcggccactccgcggactccttagtctgcggtcgtgtctgctgatctccgtcgcatccttgaactttctcttctttatgcttgcggctgtcgcgttacacgacctggggtgccttgtgctacactgcccgcatcagtccttctacgccgcactcctgttctgtctgtctcccgctaatgtcttcttggccgcaggctactccgaagctctgttcgccctgcttacctttagtgcaatgggccaactggaaaggggacgcgtgtggacgagtgttcttctgttcgcgtttgccacaggggtgaggtccaatggccttgtttccgttggattcctcatgcattcccagtgccaaggtttttttagctctcttaccatgttaaatccattgaggcagctttttaaactcatggcatccctgttcctgtctgttttcaccctgggcctccctttcgccctattccagtactacgcgtatacacagttctgtctaccaggctcagctcggcctattccagagcctttagtgcagctcgccgtcgataaagggtatcgaatagccgagggtaatgagcccccttggtgcttctgggacgtcccactgatatactcttacatccaggatgtctactggaatgtggggtttctcaagtactacgaactaaagcaggtgcccaattttctattggctgcacccgtcgccatcttggtggcctgggccacctggacctatgtcacgacccatccttggttgtgtctgaccttgggtctacagcgcagcaagaataacaagacactcgagaaacccgatcttggcttcttatctccccaagttttcgtgtacgttgtccacgcagccgtgcttctcctgtttggcggtctgtgcatgcacgtgcaagtattgaccaggttcctgggttcctcgacacccattatgtattggtttcccgctcatctcttgcaagaccaagagccattgttacgcagcctgaaaacagtgccttggaaacctttagcagaagacagtccacctgggcagaaagtgcctcggaatccaatcatgggattgctgtatcactggaaaacctgtagtccagtgacacgatacatcctgggttattttctcacttactggctacttggacttctacttcattgtaattttttgccttggacgtag

SEQ ID NO: 234615 - DNA, 219 bp, Artificial Sequence
  Description of Artificial Sequence: Synthetic coding sequence
atgtggccgcaggatccctctagaaaggaagtgttgcgattcgcagtgtcctgcagaatactgaccttgatgttgcaggccttgtttaacgctattattcctgaccatcatgccgaagctttttctccaccaaggttggcaccttcaggcttcgtggatcaattagtagagggactgcttggcggtctgtcacattgggacgctgagcattttttgtag

SEQ ID NO: 234616 - DNA, 366 bp, Artificial Sequence
  Description of Artificial Sequence: Synthetic coding sequence
atgtggccacaagaccctagcagaaaggaagtgttgagattcgccgtgagttgtcgcatcctcacactaatgctgcaagcattgttcaacgccattattcccgatcaccacgccgaggcgttttcaccaccccgactggcgccatccgggttcgtcgaccagctcgttgaggggcttctggggggactgtcacattgggacgccgaacactttctttttattgccgaacacggttatctgtacgaacacaactttgcctttttccctggatttccccttgctctcctggtaggcacggagctgctgagaccattgcggggattgctgtcgttgagatcctgtttattgatctcagtggccagctag

SEQ ID NO: 234617 - DNA, 798 bp, Artificial Sequence
  Description of Artificial Sequence: Synthetic coding sequence
atgccttcctcccagattaccatgcagaaaccatctctgctactggcatggccacctcaggccttgtggacaaactcttggaagtactatgcgtatacccagttttgtctgcccggttccgccagaccgattcccgagcccctggtgcagctggcagttgacaagggttaccggatcgcagaaggaaacgaacctccttggtgtttctgggatgtgcctttaatttactcctatattcaggacgtgtattggaacgtgggcttcttgaagtactatgagctcaagcaggtccctaatttcctacttgccgctcctgtggccatcctggtggcctgggctacctggacctatgttactacgcacccctggctgtgtctaacactgggccttcagagatcgaagaataacaagacactagagaagccagatctgggctttctatctcctcaagtttttgtatacgtcgtacacgccgctgtgctcctattgttcggtgggctatgcatgcatgtgcaggtgttgacacggtttctgggatcttcgaccccaattatgtactggttccctgcgcatttgttgcaagaccaggaaccattactcaggagcttaaaaaccgtgccttggaaacctctggccgaagattccccaccaggacaaaaggtgcctcggaatcctataatgggcctgctgtatcattggaaaacctgttcccccgtgaccagatacattctgggatacttcctgacgtattggctgctgggcttacttcttcattgcaatttcctaccttggacatag

SEQ ID NO: 234618 - DNA, 549 bp, Artificial Sequence
  Description of Artificial Sequence: Synthetic coding sequence
atgtggcctcaggacccaagccgtaaggaggtactcagatttgctgtatcctgccgaatccttacccttatgctccaggccctttttaatgctattatcccagatcaccatgctgaagccttctctcctccgaggctagcaccttccgggttcgtcgaccagctcgtcgagggtttgctggggggtctctctcattgggacgctgaacactttctctttatcgcagagcatggttatttatacgagcataattttgccttttttcccggatttcccttggccctcctcgttgggactgaactcctgaggcctctgcgcggtctgctctccttaaggtcctgcctgttgatcagtgtggcaagcctcaactttctgttttttatgctcgcggctgtcgccctgcacgatctggggtgccttgtcctgcactgcccacaccagagcttctacgcagcgcttctgttctgcttgtcccctgccaatgtctttctggcagccggttactccgaagcgctgtttgccctcctgacatttagcgctatgggctag

SEQ ID NO: 234619 - DNA, 1515 bp, Artificial Sequence
  Description of Artificial Sequence: Synthetic coding sequence
atgtccgagaaacagatgaaggaagcatttgtcagtaatctcaacggaacaaccgtgctcgaaataacccagggactatgcttcccagctttctgtatcctgtgcagaggttttttgattatcttttcccaatacctgtgttcattctcccctacctggaaaactcggttcctgactgatttcgtggttctgatagttcccatggttgctaccctgaccatctgggccagctttattctacttgagctgctgggggtgatcattttcggggctggtttgctctatcaaatttacaggagaaggacctgttatgcccgtctgccttttttgaagatcctggagaaattcctgaatatcagtttagagtccgaatataatccagcgatttcatgcttccgggtcattacttcagcctttacagctattgcaatactggccgtggactttccccttttcccgagacgctttgccaagactgagttgtacggcacaggcgcaatggattttggcgtggggggattcgtcttcggaagtgccatggtgtgcctcgaggtgagacggaggaaatatatggagggaagtaagcttcactatttcaccaattcactgtatagcgtttggcctctggtgttcctcgggatcggtaggttggccatcatcaaaagcattgggtaccaagaacatttgaccgaatatggagttcactggaatttcttcttcactatcatcgtggtgaagcttatcacaccactcttgctgatcattttcccgctgaacaagtcatggatcatcgctttagggatcacagttttgtatcagctagcgctggacttcacttctctaaagagactcatcctgtacggcaccgacggctctggcacccgagttgggctgttgaacgcgaaccgggaaggcatcatcagtacgcttgggtacgttgcaattcacatggcaggggtgcaaactggattgtacatgcataaaaacaggagtcacattaaggatctcatcaaagtggcttgtttcctacttcttgctgccatctccctgtttatctccctttacgtggtccaggtaaatgttgaggcggtgagccggcgaatggcaaatctggcattttgcatatggattgtcgccagcagtctcatccttcttagttccctgctgctaggtgacatcatactgtctttcgccaagtttcttatcaaaggcgcactggttccttgctcgtggaaactgatacagtccccggttacaaataaaaagcactctgagtctcttgtccccgaggccgagagaatggagccctctctgtgcttgattaccgctcttaatcgtaagcagctgatattttttctgctttcaaatattacgactggcctgataaacctcatggtggacacccttcacagcagtactctgtgggccctctttgtcgtcaatttgtacatgttttccaattgcctcattgtctatgtcctctacctgcaggacaaaacagtccagttttggtag

SEQ ID NO: 234620 - DNA, 318 bp, Artificial Sequence
  Description of Artificial Sequence: Synthetic coding sequence
atgtcggaaaagcagatgaaggaagcattcgtaagtaacttaaacgggacaacggtgttggaaattacccagggcctgtgcttcccagcattttgtatactgtgtagaggttttctgattattttcagccagtacctatgttcgttcagtcctacctggaaaaccaggttcctgacagacttcgtggtgctgatagtgcctatggttgcgaccttaaccatatgggctagctttattttactcgaactcctgggcgtgatcattttcggcgctggacttctgtatcaaatttaccgcaggcggacatgctacgcatag

SEQ ID NO: 234621 - DNA, 831 bp, Artificial Sequence
  Description of Artificial Sequence: Synthetic coding sequence
ctggccgcacgggtggccgcagtgagagccgcagcttggctactcctgggagcggctactggactgacacgcggaccagcggcagcctttactgcagcacgcagtgatgccggaattcgcgctatgtgctccgaaataatattgcgccaagaggtgctgaaggacggatttcaccgagatttgctaatcaaggtgaaattcggcgaaagcatagaggatctgcatacatgtagactattgataaaacaggatattccagctgggttgtacgtagatccttatgagctggccagtttgagagagaggaatatcactgaagctgtgatggtcagcgaaaacttcgacatcgaggccccaaattatctttccaaggaatccgaggtgctgatttatgctagacgcgacagtcagtgtattgattgcttccaggcctttctcccagttcactgtcggtatcataggcctcacagcgaggatggggaggcaagcatagtcgtcaacaacccggatcttctgatgttctgcgaccaagccggatctcgacgaatgatccgcttcagatttgattcttttgacaagacaatcgaattccctattctaaaatgttgggcccactctgaagtggctgcaccctgtgccctggaaaacgaagacatctgccaatggaacaaaatgaagtacaaaagtgtatacaaaaatgttattctgcaggtgccggtgggcttaactgtccacacatcattggtatgttcagtgaccctgcttattactattctctgctcaacattaatcctagtggccgtgttcaagtacgggcacttctcactatag

SEQ ID NO: 234622 - DNA, 654 bp, Artificial Sequence
  Description of Artificial Sequence: Synthetic coding sequence
atgtgtagtgagatcatcctcagacaagaagtactcaaggacggctttcatcgagatctactgatcaaggtcaagttcggcgaatccatagaagatttgcatacctgtagactcctgattaagcaggatattccagcgggtttatacgtggacccatacgagctagcctcgctgagggagaggaatattaccgaagccgtgatggtctccgagaacttcgacattgaggcccctaattacctgagcaaggagagcgaggtccttatatacgcgaggcgggatagtcagtgtattgattgctttcaggcttttctacccgtccattgtcggtaccatagacctcactcagaagatggcgaagcaagtatagtggtgaataatcctgatttgctcatgttctgtgatcaggagttcccgatcctgaagtgctgggcccattctgaagtggcagccccatgcgcacttgagaacgaggacatctgtcaatggaacaagatgaagtataagagcgtatataagaatgttatactacaggtccctgtgggtctcaccgtgcacacgagcctagtctgcagtgtgaccctcttgattacaattctgtgttccactcttatccttgtggctgtttttaaatacggccatttcagcctatag

SEQ ID NO: 234623 - DNA, 777 bp, Artificial Sequence
  Description of Artificial Sequence: Synthetic coding sequence
ctagctgccagagtggctgctgtgcgggcagcggcttggttacttctgggagcagccaccggacttacccgcggacctgcagccgcattcaccgccgctcggagcgatgccggaatcagagctatgtgttctgagatcatcctgaggcaggaggtgctcaaagacggtttccatagagatctcctgataaaagtgaagtttggggagtcaatagaggacctccacacatgcagactcctgataaaacaggatatacctgcgggtttgtatgtggatccctacgaactcgcctccctgcgggaacgaaatatcacagaagctgtgatggtttccgagaacttcgatattgaagccccaaactatctgtccaaggagagcgaagtactcatctatgcccgacgggactctcaatgcatagattgttttcaggcctttctcccggttcactgccggtatcatcggccacattcagaggatggcgaggcgtccatcgtagtcaacaatccggatctgctgatgttctgtgaccaggaattccccatattgaagtgctgggcacacagtgaggtggcagccccatgtgccctggagaacgaggatatctgtcagtggaacaagatgaagtacaagtccgtttacaagaacgtgatactccaagttccagtgggcttgactgtgcataccagccttgtgtgttccgtgaccctcctgattaccattttgtgcagtaccctcattcttgttgccgtttttaagtatggccacttcagcttgtag

SEQ ID NO: 234624 - DNA, 507 bp, Artificial Sequence
  Description of Artificial Sequence: Synthetic coding sequence
atggtatccgaaaactttgatatcgaggcgccaaactacctctctaaagagagcgaggtgttgatttacgctagacgagatagccaatgtatcgattgtttccaggcctttctcccagtgcactgccgctatcacaggccacattcggaggatggcgaggctagtatcgtagtgaacaatcccgatctccttatgttttgcgaccaagccggatctcggcgtatgattaggttccggtttgacagcttcgataagacgatagagttcccgatcctcaaatgctgggcccactcagaggtcgcagcaccctgcgcactggagaacgaagacatttgccagtggaataagatgaagtacaagtcggtgtataagaacgtaatcctgcaggtccctgtagggctgacagtacatactagtctggtatgctccgtaaccctgcttataaccattctctgctcaacgctgatcttagtcgcagtgtttaagtatggccacttcagcctgtag

SEQ ID NO: 234625 - DNA, 1740 bp, Artificial Sequence
  Description of Artificial Sequence: Synthetic coding sequence
atgcagatctgcgggagctccgtcgccagcgtcgctgccggaaccagttttcaggttttagggcctgtgtgctggcagcaattggatctcaagatggccgtgcgcgttctgtggggaggccttagcttactgcgcgtgctgtggtgcctattgccgcagaccggctacgttcaccccgatgaattcttccaaagccctgaggtcatggccgaagatattctgggggtccaggctgcccgtccttgggagttctacccaagctctagctgtaggtctgtccttttcccgctgcttatctccggcagcaccttctggttactgcggctgtgggaggaactgggtccatggcccggtttggtcagcggatatgcacttttagtggggccacgccttctcctcacggccctgtcctttgcgctcgatggcgctgtgtatcacctcgctcctccaatgggcgctgacaggtggaacgccctcgccctcctgtctggatcgtacgtcaccctggtgttttatacccggacattttccaacacaattgagggtctactgttcacctggcttttagtcttggttagtagtcatgtgacctggggccctacgcggaaggaacccgcacccggacctagatggagatcttggctcctggggggtatagtggccgctggcttcttcaataggcctacctttctggcattcgctgtggttcccctgtatctctggggaacccgcggagctacaaatccaggcctgaaaagcttaactcgagaggccttggtgctcctcccgggagcagcgctgactgccgcagtgtttgttgcaacggactcctggtactttagctcccccgctacatcccgtaatttagtactcacgccagtcaattttttacactacaatctgaatcctcaaaatcttgctcgacacggaacgcatgcaagactcacccacctcgcggtcaacggatttctgctctttggtgtcctgcatgcccaggcactgcaggcggcatggcagcgcctccaggtcggcctgcaggccagcgcacaaatggggctgcttagagctcttggagccagatcattactatcatcccccagatcatacctgctcttactttactttatgccactggccctgctgtctgcctttagtcatcaggaggctcgctttttaattcctcttctggtgccactggtgctcttgtgcagcccgcagacacagcccgtgccctggaagggtactgtcgtgctctttaatgcccttggcgctctgctattcggatgcctgcaccagggtggtctggttcctggactggaatatctcgaacaggtggttcacgcaccagtattaccctcaacacctacacattacaccctcctgtttacccatacttacatgcccccacgacacctcctgcacctcccaggcctgggcgctccagtggaggtggtggacatggggggaacggaagattgggctttatgtcaaaccctcaagagtttcactaggcagccggcttgtcaggtcgccggaggtccatggctctgcaggctgtttgtggttaccccaggtactacacgcagagcagtagaaaagtgctcttttccattcaagaatgaaactctgttgtttccacacctgacactggaggaccctcccgcactctcatctctgctgtctggggcatggcgtgatcatttgtctttacacatagtggagctaggggaggaaacttag

SEQ ID NO: 234626 - DNA, 813 bp, Artificial Sequence
  Description of Artificial Sequence: Synthetic coding sequence
atggttttactgaaggagtatagggtgatcctgccggtgagtgtagacgagtaccaggtaggccagttgtactctgtggcggaggcatctaagaatgagacgggcggaggagagggcgtagaagtactggtcaatgaaccttacgaaaaagatggggagaagggccagtacacccacaagatctaccacctccagtctaaggtgcccacgttcgtgcggatgttagctcccgagggtgcactcaatatacacgaaaaagcatggaacgcctatccctattgccgaaccgtaataacgaacgagtacatgaaggaagacttcttgattaaaattgagacatggcacaagccagacctggggacccaggaaaacgtgcataaattggagcccgaggcatggaaacacgtggaggctgtgtatatcgatatcgctgatcggtctcaagtgttatctaaggactataaagcagaagaagaccccgctaaattcaagtcaatcaagactgggcgaggacccctgggtccaaattggaaacaggaactggtcaaccaaaaggattgtccctatatgtgtgcctataaactcgttacagtgaagttcaagtggtgggggctgcagaacaaggtggagaactttatccataaacaggagcgccgtctcttcaccaattttcaccgccaactgttctgttggctggataaatgggtcgacttgactatggacgatattagacgtatggaggaggagacaaaacgtcagcttgacgaaatgagacagaaggatccagtgaaagggatgaccgcggacgactag

SEQ ID NO: 234627 - DNA, 813 bp, Artificial Sequence
  Description of Artificial Sequence: Synthetic coding sequence
atggtgctgctgaaagaataccgggtaatcctgcccgtgtccgtagatgagtatcaggtaggccagttatattcagtcgccgaggcttcaaaaaacgagaccggagggggagaaggcgttgaggtattggtaaatgagccatacgaaaaggatggggagaagggccagtatactcacaagatttatcatctgcagtccaaggtcccaacctttgtaaggatgcttgcccctgagggggctctgaacatacacgagaaagcttggaatgcatacccctattgtcgaactgttttgcctaatgaatatatgaaggaagacttcctgatcaagattgagacttggcataagcccgatctgggaacccaggaaaacgtccataaactggagcccgaggcatggaaacatgtggaagcagtgtacatcgacatcgctgacaggtcccaagtcttgtcaaaggactataaggccgaagaggaccccgctaaatttaagagcatcaagacaggacggggacctctgggacctaattggaagcaggagctggtaaaccaaaaagattgcccttacatgtgcgcatacaaattagtgactgtgaaatttaaatggtggggactgcaaaacaaagtggagaactttatccataaacaagaacggcgtctgttcacaaattttcacaggcagctcttctgttggctggacaagtgggtcgatctgactatggatgacataaggaggatggaggaagagacaaaaaggcaactcgatgaaatgagacaaaaggaccctgtcaaaggcatgactgcagacgattag

SEQ ID NO: 234628 - DNA, 594 bp, Artificial Sequence
  Description of Artificial Sequence: Synthetic coding sequence
atgctcgcccctgaaggtgcacttaacatccacgagaaggcctggaatgcatacccctattgccgaactgtgctccccaacgagtatatgaaagaggacttcctgattaagatcgagacttggcacaaacccgacttggggactcaggagaacgtgcacaagttagagcctgaggcctggaagcacgtggaagcggtgtacatcgacatcgccgacaggtcacaagtcctcagtaaggattacaaggcagaagaggaccctgcgaaattcaaatctataaagaccgggagaggcccactgggcccaaactggaaacaagagctcgtgaaccagaaagattgtccctatatgtgtgcctataaacttgttaccgtcaaattcaagtggtggggcctccagaataaagtggaaaattttatccacaagcaggagaggcggctgttcacaaatttccatagacagctcttctgctggctcgataaatgggtcgacctaaccatggacgatattcgcagaatggaggaggagacaaaaaggcaactggatgagatgcggcagaaggacccagtcaaaggaatgaccgcggacgactag

SEQ ID NO: 234629 - DNA, 819 bp, Artificial Sequence
  Description of Artificial Sequence: Synthetic coding sequence
atggtgctaatcaaagagtttagagttgtgctgccttgcagcgtccaggaataccaagttgggcagttgtattccgttgccgaggcaagcaaaaacgagaccgggggaggggaaggcatcgaagtccttaagaatgagccatacgaaaaagatggggaaaaaggtcaatatacacataaaatttaccacctgaagtccaaagttccggcttttgtgagaatgatcgcacctgagggaagtctcgtatttcacgaaaaagcctggaacgcttacccctattgtcggactatcgtaactaatgaatacatgaaggacgactttttcattaaaatcgagacatggcataagcccgacctcgggaccctggaaaacgtacatggcctggatcctaacacttggaaaacggtcgaaatagttcatattgatatcgccgacaggagccaagttgaacctgcagactataaagccgatgaggatccagccctgttccagtccgtgaagactaagcgtggaccacttggcccaaattggaaaaaggaattggccaattcgcctgattgtccacagatgtgcgcatacaaactggttacgatcaaatttaagtggtggggtctgcagtccaaggtcgagaatttcatccagaagcaggagaagagaattttcaccaacttccatcggcagctcttctgctggattgacaagtggatagatctcactatggaagacattcggcgaatggaagacgaaacgcagaaagagcttgagaccttgcgcaatcaggggcaagtgcgaggaacatccgccgcttcggacgaatag

SEQ ID NO: 234630 - DNA, 816 bp, Artificial Sequence
  Description of Artificial Sequence: Synthetic coding sequence
atggtcttgattaaggaattcagagtggtgttgccttgttccgttcaggagtaccaagtcggacagctctattcagttgccgaagcctcaaaaaacgaaacgggcggtggggagggcatcgaggttctcaaaaacgaaccctacgaaaaagatggggaaaaagggcagtacactcacaagatataccatttaaagagtaaagtgccggcttttgtgcgcatgatcgctcccgaggggtccctggtgttccatgagaaagcctggaatgcttatccctactgccgcacaattgtgaccaacgagtatatgaaagacgactttttcattaaaattgagacatggcacaaacctgacctcggaaccttggaaaatgtgcacggactcgatcctaatacgtggaaaacagttgaaatcgttcatatcgatatcgccgaccgaagtcaggttgaaccggctgactataaagcagacgaggaccctgcactgtttcagtccgtcaagactaaacgaggccctctcgggcctaactggaaaaaagagctagcaaactctccagactgtccccagatgtgtgcatataaactggttaccattaaattcaaatggtggggacttcagagcaaggtcgaaaatttcatccaaaagcaggaaaagcgaatttttactaattttcatcgccagttgttctgttggatcgacaagtggatagatctgaccatggaagatattcgacgtatggaagatgaaactcagaaagagctggagacgatgaggaagagggggtctgtgaggggtacttccgcagcagacgtatag

SEQ ID NO: 234631 - DNA, 363 bp, Artificial Sequence
  Description of Artificial Sequence: Synthetic coding sequence
atgatcgcgcctgagggaagcctcgtgtttcacgaaaaggcatggaatgcctacccttattgcagaacaatcgttactaatgaatacatgaaggacgactttttcattaaaatcgaaacctggcacaaaccagacctaggaactttagagaacgttcacggactggaccccaacacctggaaaaccgtcgagattgtgcacatcgacatcgctgacaggtctcaggtcgaacctgcggattacaaggcagacgaggacccagcactctttcagagtgtgaaaactaaacgcggaccgctcggtcctaactggaaaaaagagctggccaatagtcccgactgtcctcaaatgtgtgcttactag

SEQ ID NO: 234632 - DNA, 507 bp, Artificial Sequence
  Description of Artificial Sequence: Synthetic coding sequence
atgggcgacctcttgatggagaagtgcagagtggtcctcccatgttctgtccaagagtaccaggtgggccagctatactcagtggcagaagcgtccaagaatgagacagggggtggcgaagggatcgaagtactgaagaatgagccttatgaaaaagacggcgagaaaggtcagtacacgcataagatctatcacttaaagtctaaagtgcccgcattcgtaaggatgattgccccagaaggtagcctggtgtttcacgaaaaagcctggaacgcttacccgtattgccgaacaatcgtgactaatgagtatatgaaagatgacttcttcattaaaatcgaaacgtggcacaagccagacctcggaactctcgagaacgtccatggattagatccaaatacctggaagaccgtcgaaatcgtgcatattgacatcgccgatcggagccaagtggagccagcggactacaaagcggatgaggacccagcgttgttccagtccgtctag

SEQ ID NO: 234633 - DNA, 822 bp, Artificial Sequence
  Description of Artificial Sequence: Synthetic coding sequence
atgggagatctccttatggagaagtgtagggtcgttctgccttgttcagtgcaggagtatcaggtgggccagctttatagtgtagcagaggcctcgaagaacgaaactggcggtggcgagggtatcgaggtcctgaagaatgagccttatgagaaagatggcgaaaaggggcagtatacacataaaatataccatctcaaaagtaaggtgcctgccttcgtccgcatgatcgcacccgagggcagcctcgtattccatgagaaggcctggaacgcttatccctactgccgaacaatcgtgaccaacgaatacatgaaggatgattttttcataaagatcgagacctggcacaagcctgacctaggcaccctggagaacgtgcatggtcttgatcctaacacatggaagacggtcgagattgtgcatatcgacatagccgatcgcagtcaggttgagcccgcagattataaggccgacgaagaccctgctctctttcagtccgtgaagaccaagcgcggtcctcttggaccgaactggaagaaagagctggctaattcacctgattgccctcaaatgtgcgcatataagttggtcacaatcaagtttaagtggtgggggcttcagtctaaggtggagaatttcatccagaagcaggaaaaaagaattttcaccaactttcaccgacagttgttttgttggatagacaaatggattgatctaaccatggaggacattcgccgaatggaggacgaaacgcagaaggaattagagactatgagaaaaaggggctcagtaagaggtacctcggcagctgatgtctag

SEQ ID NO: 234634 - DNA, 4979 bp, Artificial Sequence
  Description of Artificial Sequence: Synthetic coding sequence
atggaagccccatctgggagcgagcccggaggggatggagccggagattgtgctcaccctgatcctcgtgcacctggtgccgctgccccatcctctggacctggcccatgtgctgctgccagggaatcagagcgacagctgaggctgaggttatgcgttctcaacgagattctcggcactgagagagactacgtgggcaccttaagatttctccagtcagccttcctacatcgcatccggcagaatgtggcagattccgtagaaaaaggcttaacagaggagaacgtcaaggtgttgttttctaatattgaggatattttagaggtgcataaggactttctggcggctctggaatactgcctgcacccggaaccgcagtctcagcatgagttaggtaacgtgttcctgaaattcaaggacaaattttgtgtgtacgaggagtactgctcaaatcacgaaaaagccctgcgattgctggttgaattgaacaaaattcccaccgtgcgggctttcctcctttcctgtatgttgctcggcggaaggaagactactgacatccctctggaggggtatctgctgtcccctatccagagaatttgtaagtaccccctgttgctgaaggagctggctaaaaggacccctggaaagcatccagaccatcctgctgtgcaatctgcccttcaggctatgaagaccgtgtgctctaacattaacgaaacaaagcgtcagatggaaaagttagaggccctggagcagctccagtcccatatcgagggctgggagggaagtaatctgacagacatctgcacccagctcctgctacagggaaccctcctgaagatttctgcaggtaacattcaggagcgggcattttttctctttgacaacttactggtctactgcaaacgcaagtcccgcgtgaccggaagcaaaaagtcgaccaagcggaccaagtccattaatggctccctttatatattccggggacgtattaatactgaagtgatggaggtcgagaacgtggaagacgggacagccgactaccactctaacggctacactgtgacgaatggttggaaaatccacaacaccgccaaaaacaagtggtttgtttgtatggctaaaactgctgaagagaaacagaaatggttggacgccatcatcagggagcgcgagcagagggaaagtttgaaactcgggatggagagggatgcatatgtcatgattgccgaaaaaggagagaaactatatcatatgatgatgaacaaaaaagtcaacctgatcaaggaccggaggcggaaactgagcacggttcccaaatgctttctgggtaatgagtttgttgcgtggctgctggagattggtgagatcagcaagactgaagaaggcgtcaacctggggcaggccctgttggagaatgggatcattcaccacgtcagtgacaagcaccagttcaagaatgagcaggtcatgtataggtttagatatgacgatggaacttacaaggccagaagtgaactggaggatatcatgtcaaagggcgtgcgcctctattgtcggctccattctttgtatacccccgtgatcaaggaccgggattaccatcttaaaacatacaagtccgtgctgccagggtctaagttggtcgactggctgctggctcaaggcgattgccagacccgcgaggaggccgtagcactgggggtggggctgtgcaacaacggctttatgcatcacgtcctggagaaaagcgagtttcgcgacgagtcgcagtattttcggttccacgcagacgaggaaatggagggaacatccagcaaaaacaaacagctgagaaacgacttcaagctcgtcgaaaacattctggccaaaagactcctgatcctgccgcaggaagaagattatgggttcgatattgaggagaaaaacaaagcagtggtggtgaagtcagtccagcggggaagtctggcagaggtggccggattgcaggtggggagaaaaatatacagcattaacgaggacctggtgttcctgcggccattttctgaagttgagagtatcctgaaccagagtttctgcagccgacgaccactccgactgctcgttgcaaccaaggccaaggaaattattaagatacccgatcaacctgatactctgtgcttccaaatcaggggagcagctcccccatacgtgtatgcggtcggccgaggttcggaggctatggcggctggcttgtgtgcaggtcaatgtatactcaaggtgaacggctccaatgttatgaatgacggagcccctgaagtgctggagcatttccaggctttccggagcaggcgggaggaagctctgggcctgtaccagtggatctatcatacacatgaggacgctcaggaggctcgtgcttcgcaggaagcgagtactgaagatccctcaggcgagcaagcacaagaagaggaccaggccgactcagcatttcccttactctcgctggggccaagactgtctctgtgcgaggactcacctatggtgacattaacggtcgacaacgtgcatctagagcacggcgtggtttacgaatatgtgagtaccgctggagtgaggtgtcacgtccttgaaaaaatcgtggaaccgagagggtgcttcggactgacagcaaagatattggaggccttcgccgctaacgacagcgtcttcgtagaaaactgtcgcagactgatggctttgtccagcgccatcgtgaccatgccccacttcgagttccggaacatttgtgacacaaagctggaaagcattggccagaggattgcttgttaccaagagttcgctgcccagctgaagtccagagtctccccaccatttaaacaggcccctctcgagcctcacccactgtgtgggctggatttttgtcccacaaattgccacataaacctgatggaggtctcctatccaaaaacaaccccatcagtggggagatcatttagtattagattcgggcgaaagccttctcttatcggtttggatcctgaacagggtcatctcaaccctatgagctacacgcagcactgtattacaaccatggccgctcctagttggaagtgcctgccggctgcagagggcgatccccagggccagggcctgcacgacgggtcattcgggccagcatcaggcacactcgggcaagaggatagaggtctgtcctttctccttaaacaagaggacagggaaatacaggacgcttatttacaactgttcaccaagctggatgtggccctcaaagagatgaagcagtacgtgacccagatcaacagactgctttctacaatcacggagcctacaagtgggggttcttgtgacgcttccctggcagaggaagccagctccttgcctctagtatctgaggaatcggaaatggaccgctctgaccatggaggaattaaaaaagtctgctttaaagtggctgaagaagaccaggaggatagcgggcacgataccatgagctatcgggattcctacagcgagtgcaattctaaccgtgattcagtcctcagttacacctccgtcagaagtaatagctcgtacctgggttctgacgagatggggagcggggatgagctgccctgcgatatgcggatcccgagcgacaagcaggacaagctgcacggctgcctggagcacctcttcaatcaggtcgacagcatcaatgccctcctgaagggcccagtgatgtccagagcatttgaagaaacgaagcacttccctatgaaccatagtttgcaggagtttaaacagaaagaagagtgtaccattcggggacgcagcctgatccagatctccatacaagaggacccttggaacttgcccaacagtatcaaaactctggtggataacatccaacggtacgtggaggatggaaaaaatcagttgctactggctctacttaaatgtacagatacagagcttcaactgcggagagacgcaatattctgccaggctttggtagccgcagtctgcacattctccaaacaactgttggctgcgctaggttaccggtataacaacaatggggagtacgaagaaagctctagagatgcctcacgaaaatggctggaacaagtagcagctacaggcgtgctgctgcactgtcagtcgctgttgagccccgctactgttaaggaggagcgcaccatgttagaagatatttgggtcactcttagtgaactggacaacgtcaccttcagcttcaagcagttagatgaaaattacgtcgcaaatacaaacgtgttctaccacatagagggctcaagacaggcactgaaagtgatcttctaccttgatagctatcatttctcgaaactcccaagcagattggagggaggggcaagccttagactacataccgccctgttcacaaaagtgctggagaacgtcgagggattaccaagtcctggctcccaggctgctgaagatcttcagcaagacattaacgcacagtctttggagaaggtacagcaatattaccgaaaattgagagctttttacttggagagaagtaatcttccaacagatgcctcaacgactgcggttaaaattgatcaactgatccgaccaatcaacgccttggacgagctgtgccgcctcatgaaatcgttcgtgcatccaaagcctggcgctgccggaagcgtgggggctggccttattcccataagttctgaactgtgctatcgtctgggcgcatgtcaaatggttatgtgtggtacagggatgcagaggtcaaccctgtcagttagcttagaacaggcagcgatcctggctagatcacacgggttgctgcccaaatgcatcatgcaggcaacagatatcatgaggaaacaagggcctcgagtggagatccttgcaaaaaacctgcgtgttaaggatcagatgccccagggcgctcctagattgtatagactgtgccagccaccagtagacggtgatctgta

SEQ ID NO: 234635 - DNA, 4686 bp, Artificial Sequence
  Description of Artificial Sequence: Synthetic coding sequence
atggaagccccatcaggctcagagccaggcggagatggcgcaggtgactgtgcccaccccgatcccagagcccctggagccgcagctccatcgagcgggcctgggccatgtgctgctgcgagggagtctgaacggcaattgaggcttcgcctatgtgtgttgaacgaaatcttgggaactgaaagggactatgtcgggaccctccggttcctgcagagcgcttttttgcatagaattagacagaatgtggcagactctgtggagaaaggattaacagaggagaacgtgaaggtcctgttcagtaatattgaagatatccttgaggtccacaaagattttctcgcggctctggagtattgtctgcatcctgaaccacagtcccagcacgagctgggcaatgtcttcttaaaatttaaggacaagttctgcgtgtacgaagaatactgctctaaccatgagaaggctctgagactgctggttgaacttaacaagatacccaccgtaagggcgttcctgctgagctgcatgctgctggggggaaggaaaacaacggatataccgctggaggggtacctgcttagccccatccaacgaatctgcaagtatccacttctgttgaaggaactggccaagcgcacccccggaaagcatccggaccacccagccgttcaatcggctctacaagcaatgaaaaccgtgtgctctaatataaatgaaacaaagcgtcagatggagaagctggaggctttggagcagctccagtctcacattgaaggctgggagggatctaatcttacggatatatgcacccagcttcttctgcagggcaccctgttgaagatctccgccggaaacatacaagagagggccttcttcctcttcgacaatctgctcgtgtattgcaaacgtaaaagtcgagtgaccgggagtaagaagtcgacgaaacgcaccaagtccatcaacggatctctctacatcttccgtgggagaatcaacacagaagtgatggaagtagaaaacgttgaagacgggacagctgattatcactccaacggctatacggtgactaatggctggaagatccataacacggctaaaaacaaatggttcgtgtgcatggcaaaaacagcagaggagaagcagaagtggctggacgctataatcagggaacgagagcagagggagtcactgaaactgggaatggagagagatgcctatgtcatgatagcagaaaaaggcgagaagttgtaccatatgatgatgaacaagaaggtgaacttgatcaaggatagacggcgtaaattgagcaccgtccccaaatgtttccttggcaacgaattcgtggcctggctgctcgaaattggcgaaatctcgaagacagaagagggtgttaacctgggacaggcactgctggagaacggcatcatccatcatgtctccgataaacatcagtttaagaatgagcaggtgatgtaccgtttccggtacgacgacggcacctataaggcgcgtagcgaactcgaggacattatgtccaagggcgtcagactgtattgccgcctgcattctctctatactcctgtcattaaggatcgagactaccatctcaagacttataagtcagtgctccccggatcaaaactggtcgattggctcttggcccagggcgattgtcagacgagagaagaagctgtagcccttggcgtaggtctatgcaacaacggcttcatgcatcacgtgctcgaaaagtcagagttccgggacgaatctcagtactttaggttccatgcggatgaggaaatggagggcacatcttcgaaaaacaaacaactcagaaacgatttcaagttggtcgagaacatactggctaaacggctgcttatcttgccgcaagaggaagactacggcttcgacatcgaagagaagaacaaggcagtagtcgtcaaatccgtgcagcggggaagccttgccgaggtggcaggattgcaggtgggccgtaaaatctacagcatcaatgaagacctagtctttctgcggcctttctcggaggttgagtccattcttaaccagagtttttgttcaagacggccactgcgcctgttagtggcaacaaaagcgaaggaaattatcaaaatacccgaccagcctgataccctgtgcttccaaattcgaggtgcagctccgccttatgtatacgccgtgggaagaggatccgaggctatggctgccggactctgtgccggtcagtgcatcttaaaggtcaatgggtccaatgtaatgaacgacggcgctccagaggtgttagagcattttcaggcatttcggagccggcgtgaggaggctctggggctgtaccaatggatctaccacacccatgaggatgcccaggaggcacgggctagtcaggaggccagcacggaggatccatctggggaacaggcgcaggaggaggaccaagccgatagcgcattccctcttctttcactggggccaaggcttagcctgtgtgaggatagtcctatggtgactcttaccgtcgataacgttcacctggaacacggggtggtgtacgaatatgtgagcactgccggtgtgagatgtcatgtactggagaagatcgtggagcccagaggttgcttcgggctgactgctaaaattctggaggccttcgctgctaatgatagtgtgtttgtggagaactgcaggcggcttatggctctgagcagtgccatcgtaactatgccccatttcgagttccgcaatatttgtgacacgaagctggagtcaataggacagcggatcgcttgttatcaggagtttgcggcacagctcaagagccgtgtgagtccgccatttaagcaggcccctctcgagcctcaccctctatgcgggctcgatttctgccccaccaactgtcacattaatctgatggaggtgagctatccaaagaccacccccagtgtgggacgttctttcagtatccgattcggacgtaagccctccctgataggtctggatcccgagcagggccatttgaatcctatgtcatatacccaacactgtattaccactatggccgcaccatcctggaaatgcctccctgctgccgagggcgatccacaagggcagggtctgcacgacggcagctttggacccgcatcaggcactttgggccaggaggaccgaggtctgtcttttctcctgaaacaggaagaccgggagatccaagacgcctatttgcagttgtttaccaaattggatgtcgctttgaaggagatgaagcaatacgtaacacaaatcaataggctgctgagtacaattacggaacccacatctgggggtagttgtgacgcctccctggctgaagaggcctccagcctcccccttgtgtccgaagaaagtgagatggatcgctcggatcatggcggaatcaagaaggtatgctttaaggttgcggaagaggaccaggaagactccgggcacgacacaatgtcctaccgggacagctactcagagtgcaattctaatcgcgatagcgttttaagttatacctcagtgagaagtaactctagttatctagggtctgacgagatggggagcggagacgagctgccctgcgacatgaggattccttcagataaacaagacaaacttcacgggtgcttggaacatttgtttaatcaagtggatagtatcaatgcactgcttaaggggccagtgatgtcacgggcattcgaagaaactaaacattttccaatgaatcatagcctccaggaatttaaacagaaagaggagtgcactattcgcggaaggtccctgattcagatatccatccaggaggacccatggaacctccccaattccatcaagaccttggtggacaatattcagcgatacgtagaagacggtaagaaccagctgctgctcgctctgctcaagtgtaccgatactgaactccagttacggcgagatgctattttctgtcaagcactggtggccgcagtgtgtacttttagtaaacagctgctggctgcacttggctaccggtacaacaacaatggtgagtacgaggagtcctcccgggatgctagccgtaagtggctcgagcaggttgccgcaacgggtgtactgctccattgccagtccctgctaagtcctgctacagtaaaagaggagcggaccatgctcgaggatatctgggtcaccctctccgagcttgacaacgtgactttttcttttaagcaacttgatgagaattacgtggccaatacgaacgtgttctaccatatcgaaggttcccggcaagctctgaaggtgattttttacctcgatagttatcacttctcgaagctgccgagccgactggagggcggagcttcgctgcgtttgcatacggccctgtttaccaaaggggaactgcaggcgtggggccgagaagatcacggaggtcgggcaaaggccaccaagcacacaggttcccagccaccagcacgcccaaggcacctgccatcccagtgctggcgaacatggcgcggatgcctgctccaagccgcaaggccaaggagaatttgctctagaacttccacccggtctccttggcgtaaattttcatctattacagccaactccgggcacttcacctggagtgggctcacctgtccccgtatgcccgcaccacgccgatag

SEQ ID NO: 234636 - DNA, 4821 bp, Artificial Sequence
  Description of Artificial Sequence: Synthetic coding sequence
atgtccgaggatagtcgcggtgattcaagggccgagtcagcaaaagatctggagaagcagttgaggctgcgagtgtgcgtgctgtcagagcttcaaaaaactgagcgcgactatgtgggaacccttgagtttctggttagtgcctttctacacagaatgaaccagtgcgctgcttccaaggtcgacaagaacgttaccgaggagacagttaagatgctcttctccaatatcgaggacattctggctgtgcacaaagaattcctgaaggttgtcgaggagtgtctccatcccgaacctaatgcccaacaggaagtggggacatgttttctgcactttaaggataaatttagaatctacgacgagtattgttcaaaccatgagaaagctcagaagctgttgctagagctgaacaagattcggaccatccggacattcctgttaaactgtatgctcttaggcggacgtaagaacactgatgtacccttggagggatatttggtcacacctatacagaggatctgcaagtaccctttaattctcaaagagctgctaaagcgcaccccaagaaagcactctgactacgccgctgttatggaagccctccaggccatgaaagctgtttgctcaaacataaatgaagcaaaaaggcagatggaaaaactcgaggtgctagaggaatggcagagtcatatcgaaggatgggagggtagtaacataacggacacatgtaccgagatgctaatgtgcggagttctgcttaagatcagctccgggaatatccaagagagggtctttttcttgtttgacaacttgctggtgtactgtaagcgcaaacacagaaggcttaaaaactctaaggcttcaacagatggtcacagatacctgtttcggggaaggataaatactgaagttatggaagtggaaaacgtagacgacggcaccgctgattttcactccagcgggcacatcgtggtcaatggttggaagattcacaacaccgctaagaataagtggtttgtgtgtatggccaagacccccgaagaaaagcatgaatggttcgaagcgatccttaaagaacgggaacgtagaaaagggctaaagctcggcatggaacaggacacttgggtgatgatctccgaacaaggagagaagttatacaagatgatgtgccggcaaggcaacttgatcaaagaccgcaagcgtaagctgaccaccttccccaaatgtttcctgggctcagagttcgtaagttggctcctggagattggtgaaatccaccgccctgaagagggggtacacctggggcaagcactactggagaacggtataatccaccatgttacagataagcatcaattcaaaccagagcaaatgctttaccgctttagatatgacgacggaaccttctacccacggaacgagatgcaggacgttattagtaagggggtcaggctgtattgtcggctacactctttatttacccctgtaatccgcgacaaggattatcacttgcggacatataaatccgtcgtgatggcgaataaactcattgactggctaatcgcccaaggagactgccgcaccagagaagaggcgatgatctttggggttgggctgtgcgacaacgggtttatgcaccatgttcttgagaagagcgaattcaaagatgagccattattatttcgctttttctcagacgaggaaatggaaggttcaaatatgaaacacagattaatgaaacacgacctcaaggtcgttgaaaacgtaattgccaagtctctgctaataaagtccaatgaaggttcatacggatttggtctggaagacaagaacaaagttcccatcattaagctcgttgaaaaagggagtaacgccgaaatggccggtatggaagtgggcaagaaaattttcgctatcaatggagacctcgtctttatgcggcctttcaacgaagttgactgctttctgaaatcctgccttaatagtcgcaaacccctgagggttttagtttcaactaaaccaagagagaccgtgaagatcccggactcagctgatggactcggcttccagatacgaggattcggcccatccgtggttcatgctgtaggcagggggactgtggctgcagccgcagggctgcacccaggccagtgcattatcaaagttaacgggataaacgtgagcaaggagactcatgccagcgtcatcgcgcacgtcactgcctgtagaaagtaccgccgtccaacaaagcaggatagcatccaatgggtctataactcaatcgagtccgcacaagaggatctgcagaagagtcatagcaagccgccaggggatgaagcgggtgacgcgtttgactgtaaagtcgaggaagtgattgacaaattcaacaccatggctatcatcgacgggaagaaggaacatgtttccctgacggtggataatgtccacctcgaatatggtgtggtgtatgaatatgactcgacggctggcataaagtgcaatgtcgttgagaaaatgatagagccaaaaggatttttctcactgactgcaaagatcctcgaagcactcgcaaagagcgatgagcactttgtgcagaattgcactagtttgaacagcctgaatgaggtgatacctactgatctccagagcaagtttagtgctctttgtagcgagaggattgagcacctctgccagcgcatatccagctacaaaaagttttcaagagtgctgaaaaacagggcctggccgacgtttaagcaggctaagagtaagatctctcccctccacagtagcgacttctgtccaactaattgtcatgttaatgtgatggaggtgtcttaccctaaaacttcaacttccctaggatccgcgttcggagtgcagctagacagtcggaagcacaacagccatgacaaggaaaacaagagctctgaacagggaaagcttagccccatggtgtacatccaacatacaattactacaatggctgcgccatccggcttgtcgctcgggcagcaggacggccacgggcttcgatacctgttgaaggaggaagatctggaaacgcaggatatctatcagaaactactcggcaagctgcagaccgctctgaaagaggttgagatgtgtgtttgccagatcgacgacctgctttctagcattacttactcacctaaacttgaaaggaaaacgtctgagggaatcataccaacagactcagacaatgagaaaggcgagcgtaactctaaaagggtgtgtttcaacgtggccggagacgaacaggaggacagcggccatgatactatcagcaatcgggacagctatagcgattgcaattccaacaggaatagcattgcctcattcacctcaatatgctcatcccagtgtagttcctactttcactccgacgagatggacagtggcgatgagttacctcttagcgttaggatatcacatgataagcaagacaagatccactcgtgtctagaacatcttttctcccaagttgatagtattaccaatttactgaagggacaagctgttgtccgggcttttgatcagactaagtacctgacccctgggagagggctccaggaatttcaacaagagatggagcctaaattgtcttgtccaaagcgcctgagactgcatattaaacaggatccttggaacttaccctcgagtgtacgtaccctcgcgcagaacatccgtaaattcgtggaggaagttaaatgtcgtctcctgctagctctcctggagtactctgacagcgagacacagttgagacgggacatggtattttgtcaaaccctagtggcaactgtgtgcgcttttagcgaacagctaatggccgcacttaaccagatgtttgataactcaaaggaaaacgagatggaaacttgggaagcctctcgacgctggctggatcagattgccaacgctggcgtgctgtttcactttcagtctctcctcagtccgaatctgaccgatgaacaggccatgctagaggacacgttagtcgcactgtttgatctggagaaggtctccttttatttcaagccctcagaagaggaacccctcgtagcaaatgtgcccctgacttaccaggccgagggctcaaggcaggctctgaaggtctatttttacatagatagttaccacttcgaacagctgccccagcgtctcaagaatgggggaggtttcaaaatccaccccgtgctcttcgctcaggccctggaaagcatggaaggctattactacagggacaacgtttccgtggaagaattccaggctcagattaatgccgcaagtctcgaaaaagtgaagcagtacaaccaaaagctgcgcgctttttacctggacaaaagtaattcccccccaaacagcacttccaaagccgcttacgtggataaacttatgcgtcccctaaacgctcttgacgagctgtatcgattagtcgccagctttatacgctcaaagcgcacagcggcttgtgctaataccgcgtgtagcgctagcggggtaggcctgctgtccgtcagtagtgagctttgtaatcgcctgggcgcttgtcatattatcatgtgttcttccggggtgcacaggtgcacactgtctgtgacactggagcaagcaattattctcgctaggtctcacggcctcccgccaaggtatattatgcaggcaacagatgtcatgagaaagcaaggggctagggtccagaacaccgctaagaatctgggggttagggatcggaccccccagagcgctcccagactttataagctgtgtgagcccccaccgcctgccggtgaggagtat

SEQ ID NO: 234637 - DNA, 3525 bp, Artificial Sequence
  Description of Artificial Sequence: Synthetic coding sequence
atgtcagaagatagcaggggcgactccagagcagagagcgcaaaagatctagagaaacagctccgactgcgcgtgtgcgttttgtccgaacttcagaagacggagcgggattatgttggaacactcgagtttctggtgagtgcttttctccacagaatgaaccagtgtgctgctagcaaggttgataaaaatgtaacagaggagaccgtcaagatgctcttttcaaatatcgaagatatccttgccgtgcacaaggaatttctgaaagtcgtggaggagtgcctgcatcccgagccaaacgcccagcaggaagtggggacatgctttctccacttcaaggacaaattcaggatctacgacgaatattgtagcaatcatgagaaggcccagaaacttctgctagaactcaataaaatccgcactatcagaacctttctactgaactgcatgttactgggtggtcgtaagaacacagatgtgcccttggaggggtacctcgtgacgcctatccagcggatatgcaagtacccattgatacttaaggaacttttgaaacgaacgccgagaaagcactccgactacgccgctgttatggaagctctacaggccatgaaggctgtgtgcagcaatatcaatgaagctaagcgacagatggagaagctggaggtgctcgaagagtggcagagccacatcgaagggtgggaaggtagcaacattactgatacgtgcacagaaatgttaatgtgtggtgttctgttgaaaatcagcagcgggaatattcaggaacgagtgttctttttatttgacaacctccttgtgtattgtaaaaggaaacatcggcgactgaagaacagtaaggcgtctacagatggacacagatacttgttccggggaagaattaacactgaggtgatggaagtggaaaacgtggatgacggaaccgccgacttccactcttcgggtcacatcgtagtgaatgggtggaagattcataacactgctaagaataaatggttcgtctgcatggcgaagaccccagaagagaagcatgagtggtttgaggcaattttgaaggaaagagaacgaaggaagggacttaaactgggtatggaacaagatacatgggtaatgatttccgagcagggcgagaagctctacaaaatgatgtgtagacagggcaatctgatcaaggaccgcaagcggaaactgaccaccttccctaagtgtttcctgggatcagagtttgtcagttggctcctggaaatcggagaaatacaccgcccagaagagggagtgcaccttggacaagccctgctcgagaacggtataattcaccacgttacagacaaacaccagttcaagccagagcagatgctgtatagatttagatatgacgacggcacgttctacccccgaaacgaaatgcaggatgtaatcagtaagggagttcgcttgtattgtagactccactcactctttactcctgtcatccgggacaaggactatcacctgaggacctacaagtcggtagtgatggccaacaagctgattgattggctgatcgcgcagggcgactgcagaacaagggaagaagccatgatttttggcgtgggcctgtgcgataatggctttatgcaccacgtgctggaaaagtctgagtttaaagatgaaccgctgctgttcagattcttttctgatgaggagatggaaggctcaaacatgaaacatagactgatgaaacatgacctgaaggtggtagaaaatgtcatcgccaaatcgttactgatcaagtctaacgagggttcctatggcttcggcctggaggacaagaataaagtgccaatcattaagctggtggagaaaggctctaatgctgagatggcaggcatggaggtgggcaagaaaatttttgcgatcaacggggatcttgttttcatgaggccatttaacgaagtcgattgtttcctcaaatcctgtctcaactcacgcaaacctctccgggtgttggtgtccaccaagcctcgagaaaccgtcaaaattccagattcagcggatgggctgggcttccagattcgaggattcggccctagtgttgttcatgctgtagggcgtggaaccgtggccgctgctgcgggactccaccccggacagtgcatcattaaagtcaacgggattaatgtcagcaaagagacccacgcaagtgtgatcgcacatgtgacagcctgtagaaagtaccgcagacctaccaagcaggatagcattcaatgggtctacaattcaattgagtccgcccaggaggatctgcagaagtcacactcaaaaccacccggagatgaagctggcgacgctttcgattgcaaagtcgaagaagtgattgacaaatttaacaccatggctatcatcgatggtaagaaggaacacgtgtctctgacggtcgataacgtgcaccttgagtatggggtcgtgtacgagtacgattccacggcaggcattaagtgcaacgtggtggagaagatgatagaaccaaaagggttcttctcgctcaccgccaagattcttgaggcactggctaagtcggacgagcactttgtgcaaaattgtacatccttgaattccctgaacgaagtgataccaactgatttgcagtctaagttctcggcactgtgcagcgagcgaatcgagcacctgtgtcagaggatctcctcttacaaaaaagtgagcgtactactcattttgtacaccataatcgtggagatgtaccatttcaccgaaatgattactctatataatattctggagttagtcagaccaccgaattccgagttctttttctcgtttttgcccaccaaaagaatgaagacgctgaaccaaaagaaagtgacgcatatgaagaagacaaatatccagttgcagttcagtcgtgtccttaaaaaccgcgcatggccaacgtttaagcaggcgaagtctaaaatttcaccgctacactccagcgacttctgccctacaaactgccatgtgaatgtcatggaagtgagctaccccaagacgtctacttccttaggctccgcatttggagttcagtggaaattgagtccaatggtctacattcagcacactattaccacgatggctgctccaagtgggctgtctttggggcagcaggacggccacggtctccggtatctcttggagaggaagacaagcgagggaataattcctaccgatagcgacaatgaaaagggagaacggaattcaaagcgcgtttgttttaacgtcgcgggtgatgagcaagaggattctggtcacgacacaattagcaatagagacagttattcctttagtgattgcaactcgaaccgaaattccatcgcatccttcacctctatttgttctagtcagtgtagttcctactttcattcagatgagatggatagcggatccgacgaactcccactttcggtccggatctcccatgataaacaggataagattcattcatgtctggaacacttgttttctcagtag

SEQ ID NO: 234638 - DNA, 1650 bp, Artificial Sequence
  Description of Artificial Sequence: Synthetic coding sequence
atggcatctgcttcatctgggccaagctcgtctgtagggttttcctcttttgaccccgcagtaccaagctgtactttatcgagcgcctctggtattaagaggccaatggcttctgaagtgccatacgcaagcggaatgccaattaagaagatcggacacagaagcgtggattccagcggagaaactacttacaaaaaaactaccagttcagccctgaagggcgctattcagctgggaatcacccataccgtcgggtccctgtccactaagccagaacgagatgtgctaatgcaggacttttatgtggtggaatccatattctttcctagcgagggctccaatttgacccctgcccaccattacaatgacttcaggtttaaaacctatgctcccgtcgcctttaggtatttccgtgagctgtttggtattcggcctgatgattacctgtacagtttgtgctcagagccactgatcgaattgtgtagttctggggcatcaggtagtctgttctatgtgtcctccgacgatgagttcataattaaaaccgttcaacacaaggaggctgaatttttgcagaagctgctcccaggctactatatgaatttgaaccaaaaccctcggacgttgctgccaaagttctacggcctatactgcgtccaagccggtggcaaaaacatacgcattgtggtgatgaacaatctgctcccaagatccgtcaagatgcacatcaaatatgacctgaagggttctacatataaacgccgtgcatcacagaaggagagggaaaaacctttgccaacttttaaggatctagacttcctacaggacatccccgatggcctctttctcgacgccgacatgtacaatgcactgtgcaaaactctccagcgcgattgcctagtactgcagagctttaaaatcatggactacagcttactgatgtccatccataatattgatcacgcacaacgggaaccactgagctccgagacccaatacagtgtagatacacgtcgtccagcaccccaaaaagctctctacagcactgcaatggaatccatccaaggagaggccagaagggggggaaccatggagacagacgaccatatgggcggaatcccagcgagaaattccaagggggagcgtcttttgctgtacattggcatcatagacatcttgcagtcatataggttcgtcaagaagctggagcacagctggaaagccctggtccacgacggcgataccgtcagcgtgcacagaccgggattctatgcagagcggtttcagagatttatgtgcaacactgttttcaaaaaaattccactgaagccaagtccatcaaaaaagttcagaagcggcagttccttctcccgcagggcagggtcaagcggtaacagttgtatcacgtatcagccctctgtgtccggcgagcataaggcacaagttactactaaggccgaagtggagccaggagtacatctgggtaggccagacgtcctccctcagacaccaccactggaggagataagtgagggctcaccaatacctgacccatccttctcaccccttgtgggagagaccctacagatgctgactactagcactactttagagaagctggaggtggctgagtcagagttcacacactag

SEQ ID NO: 234639 - DNA, 1689 bp, Artificial Sequence
  Description of Artificial Sequence: Synthetic coding sequence
atggcttcggcctcttctggtccatcctcctcggtggggttctcatcctttgatcctgctgtcccgagttgcacactgagctccgccgcatccgggatcaagagacccatggctagtgaggtcctagaggccagacaggacagctacatttcactggtgccttatgcgtcgggtatgccaatcaaaaaaatcggacataggtccgtagactcctctggagaaaccacctataagaaaacaacaagctcagccctcaaaggtgctatccagcttggaataactcataccgtgggcagtctgagcacaaaacccgaacgcgatgttctgatgcaggatttctacgtcgtggaatccatcttttttccctcagaggggtctaacctgacacccgcacaccattacaatgacttcagatttaagacctatgcaccagtcgcctttagatacttccgtgaactttttggcattagaccagatgactatctctacagcctgtgtagtgagccacttatcgaattgtgctcctccggcgcttctggatccttgttctatgtgtcatccgatgatgaattcataattaagacagtccaacacaaggaagcagagttcctgcaaaaactcctgccaggttactacatgaacctgaaccaaaacccgaggacactgctgcctaagttttacggactgtattgcgtgcaagctggcggtaagaacatacgaatagtagtcatgaacaatctgcttccacgctctgttaagatgcacataaagtatgacctgaaaggttctacctacaagagacgagcgagtcagaaagagcgggagaagcctcttcccacattcaaagatctggacttccttcaggatataccagatggattattcctggacgccgatatgtataatgctttgtgcaagaccctgcagcgagattgccttgtcctgcagtcctttaaaattatggactactcgcttctgatgagtattcacaacatcgaccacgcacaacgagagcctctcagcagcgaaacacaatactccgtggatacacggcgtccagccccacaaaaagccctctactccaccgctatggagtctatccagggcgaggctcgtaggggcggaacaatggagaccgacgaccacatgggcggaatccccgcacggaattctaagggtgagaggttactgctgtatatcgggataatagacatcctccagtcttaccgttttgtgaagaagctggagcattcctggaaggccctagtacatgacggggataccgtaagcgtccatagaccgggattttatgcagaaagatttcagcgtttcatgtgcaatacagtgtttaaaaagatccccctaaaaccaagccctagcaaaaagttccgctctggctcttctttttcaaggcgcgcaggctcaagcggaaactcatgcataacatatcagcctagcgtgagtggcgagcataaagctcaggtaacaacaaaggccgaggtggagcccggtgttcacttgggccgaccagacgtgttgccacagacccctcctctggaagagattagcgagggctcaccaatacctgaccctagcttctctcccctggtcggcgaaaccctacagatgttgaccaccagcacgaccctggaaaagctcgaggtcgctgagtctgagttcactcattag

SEQ ID NO: 234640 - DNA, 1503 bp, Artificial Sequence
  Description of Artificial Sequence: Synthetic coding sequence
atggcctccgctagctccgggccaagctcatccgttgggttttcctccttcgatcctgccgtaccatcgtgtacactgagctccgcaagcgggataaagcggcctatggcaagcgaggtcccctatgcgtccgggatgcccataaagaaaattggacacagatctgtggatagctctggtgagaccacttacaaaaagactactagctccgccctcaaaggggcaatccagctgggcataacccataccgtggggtccctgtcaacgaagcccgagcgcgatgttctcatgcaggacttttacgtggttgagagcatattcttcccttcggaaggaagcaatcttacacccgcacaccattacaatgacttccggttcaaaacttacgcccctgtggcctttcgatacttccgcgagctgttcgggattaggccagatgactacttgtattctttatgctcagaaccgctaatagagctctgttcatctggagcttctggatcactgttctacgtttcttccgatgatgagtttattatcaagaccgtgcagcacaaggaagccgagttcctgcaaaagctgcttccaggttactatatgaaccttaaccagaaccccagaacgcttctgccgaaattttatgggctatactgtgtgcaggccggaggcaagaacatcagaattgtggtcatgaacaacctgctcccccgatcagtcaaaatgcacatcaaatacgacctgaagggttcgacctacaagaggagggcatctcaaaaggagcgggagaagcctctgccgacctttaaggacctggatttcctccaggatatacctgacgggttgttccttgacgcggacatgtataacgctctgtgcaaaacccttcagcgggattgcttagtgctccagtctttcaagatcatggattactccctgctgatgagcatccataacatcgaccatgcacagcgcgagcctctgagctccgaaacacaatactcagttgatacaagaagaccggctcctcaaaaggctctgtattcgacggctatggagagcatacagggcgaggcacggaggggtggcaccatggaaacagatgatcatatgggtggaatcccagcccgaaatagcaagggagaaaggctcttgctttatataggcattattgatatcctgcagtcataccggttcgtcaaaaaattggaacactcctggaaggctctcgtccacgatggcgataccgtgagcgtgcatagaccaggtttctatgcagagagatttcagcggttcatgtgcaacacagtgttcaagaagatcccgtgtgtccacctgggacgcccagatgtactgcctcagacacctccgctggaagaaatctctgaggggagccctatcccagatccttctttcagccctctcgtgggcgagactctgcagatgctgaccacctcaactactctagagaagttggaagtagcagaatctgaattcacccattag

SEQ ID NO: 234641 - DNA, 1653 bp, Artificial Sequence
  Description of Artificial Sequence: Synthetic coding sequence
atggcttccgctagctctggaccatcaagctcagttggcttttcctcgttcgaccctgctgtcccatcatgcaccctttcttctgctgcctccggaattaagagacccatggcctccgaggtgccctacgccagcggtatgcccattaagaagattggacaccggtccgttgattcaagcggagaaacgacctacaagaagactaccagcagcgccctgaaaggggcaatccagctggggattacacatactgtgggctctctctcgactaagccagaacgcgatgtgctgatgcaggatttctacgtggtagaaagcatttttttcccttccgaaggctctaatctgaccccggcacatcactacaacgattttagatttaaaacgtatgctcccgttgcctttcgatattttagggagctcttcggaatccggcctgacgattacctatactccctctgcagtgagcctctgatagaattatgcagctccggcgcttcaggcagcctcttctatgtaagcagcgatgacgaattcattattaaaactgttcaacacaaggaagctgagtttttgcagaaacttctgcctgggtattatatgaaccttaaccagaatccccgaaccttacttccgaagttctacggactgtactgcgtccaagccggaggcaagaacattaggatcgtggtgatgaacaatctgctgcccaggtccgttaaaatgcatataaagtacgacctgaaagggagtacttacaagagacgcgcatcccagaaagagagagagaaacccttaccaaccttcaaagacctcgacttcttgcaggatatccccgacgggcttttccttgacgccgatatgtataacgccctgtgtaaaacactgcagcgtgattgcctggtgcttcagtcctttaaaatcatggattactctctgctcatgtctatacataacattgaccatgcccagcgcgagcccctgagttcagagacacagtatagcgttgatacacggaggccagcaccgcaaaaggcgttgtatagcacagcaatggagagtatacagggagaggccaggagaggcggaacaatggaaaccgatgaccacatgggtggaatccccgctagaaattccaagggagagaggttattgctttacatcgggattatcgacatcttgcaatcctacagatttgttaagaaactcgagcacagctggaaagcactggtgcatgatggtgacaccgtatcagtgcatagacctgggttctatgccgagcgcttccagaggtttatgtgtaataccgtgtttaagaaaatccctctgaagccgtcaccgagtaagaaatttcgcagcggctcgtccttctctcgcagagcgggtagcagcgggaatagttgcatcacttaccagccctcagtgagcggtgagcacaaggcccaggttaccaccaaggcagaagtggagcctggggtgcatttaggcagaccggacgtgctccctcagacgccccctctggaggagatctccgagggcagtcccattccagaccccagctttagccctctcgtaggagaaaccctccaaatgcttaccacctcaaccacactggagaagctcgaggtggcagaaagtgaatttacgcactag

SEQ ID NO: 234642 - DNA, 597 bp, Artificial Sequence
  Description of Artificial Sequence: Synthetic coding sequence
atgtataacgccctgtgtaaaactctccagagggactgcttagtgttacagtcttttaagattatggattattctttgctgatgtccattcacaacattgaccatgcacagcgggagcctctgagcagcgaaactcagtactcggttgacactaggagacctgctccccagaaagccctctactccaccgccatggaaagcattcaaggcgaggcacgaagggggggaactatggagactgacgaccatatgggcggtatcccagccaggaatagcaaaggggaaagactgctcctctatattggaattatcgatatactgcagtcataccgttttgtgaaaaaactagagcacagttggaaagccctcgtgcacgatggtgataccgtgtctgtccatcgcccaggattttacgccgaacggttccagcgattcatgtgtaacactgtgttcaaaaagattccactccagccctggaagtcgttaaaactccagtctcagagttctcccatcaagcgcaaggcaagcgaggacctggagcaggattcagctataagcgtcatacctaggtgccagcccctgcctcagcagtgctag

SEQ ID NO: 234643 - DNA, 261 bp, Artificial Sequence
  Description of Artificial Sequence: Synthetic coding sequence
atggcgagtgaagtgctggaggcaagacaggactcttacatctccctcgtgccttacgcatctggaatgcccataaagaagataggtcaccgctctgtggatagcagcggcgagaccacttacaagaagacaacgtcgtctgccttgaaaggcgctattcagctgggcatcactcatacggtagggtccttaagcaccaagcccgagcgggatgtgctgatgcaggacttttatgtggtggagtccatcttctttccctag

SEQ ID NO: 234644 - DNA, 1569 bp, Artificial Sequence
  Description of Artificial Sequence: Synthetic coding sequence
atggcatctgctagttctggccctagtagctccgtcggattcagttctttcgaccccgctgttccttcttgtacattatcctcagccgcatccgggatcaagcgcccaatggcctctgaagtgccatacgcatctggaatgccaatcaaaaagataggtcaccggagtgtcgattcaagcggcgagacaacatacaagaagactacttctagcgcactgaagggtgcaattcagctgggcattacgcacactgtcgggagcctcagcacaaagcctgagcgcgacgtgctgatgcaagacttctacgtcgtcgagagcatttttttcccttctgagggatcaaacctgacacccgcacatcactacaacgattttcggttcaagacctatgccccagtggcttttaggtactttcgagaattgtttggaattcggccagatgattacctctattcactatgctcggagccgctgatcgagctttgcagctcgggtgccagtggatcattattttacgtgtctagcgatgatgagttcatcattaaaaccgttcagcacaaagaagccgaatttcttcagaagctgctgccaggctattatatgaacttaaaccagaatccccgtacgcttctccctaaattctatggactttattgcgtgcaagcaggcggaaaaaatatccgtattgtcgtgatgaacaatctgctgccccgttctgtgaagatgcatattaagtacgacttaaagggctcgacatacaagaggagagcctcacagaaggagcgagagaaacccttgcccacctttaaagacctcgattttttacaagatatcccagacggactgttcctagacgctgacatgtacaacgcgctgtgtaaaaccctacagcgcgattgcctcgtgttgcagagctttaagatcatggattacagtcttctgatgtctatccataatatcgatcacgctcagcgagaacctctttcttccgaaacgcagtacagtgtagacaccaggagacccgctccacagaaagccctctatagcacagcgatggagagcattcagggggaggcaagaaggggtggcaccatggagacagatgaccagttcgttaaaaaactggagcactcgtggaaggccctggttcacgacggcgatacagtcagcgtccaccggccaggtttttatgccgaacgttttcagaggttcatgtgtaacacagtgttcaaaaaaatccctctgaagccatcgccatccaagaaattccgtagcgggagctcattctcacggagagccggatctagtggaaacagctgcattacatatcagccctcagtgagcggagagcataaggcacaggtcaccactaaggccgaggtcgagccaggtgtgcatctggggaggcccgacgtgttaccacaaactccccctcttgaggaaatctcagaggggagccctatacctgatccaagctttagtcccctcgtcggggagacactgcaaatgctgacaacatcaactacgcttgagaagttggaagtcgctgagtccgagtttacccactag

SEQ ID NO: 234645 - DNA, 1623 bp, Artificial Sequence
  Description of Artificial Sequence: Synthetic coding sequence
atgtcctcagccgcagaaaacggcgaagcagctcccggtaaacagaacgaagaaaagacctacaagaaaaccgcatcctctgcaataaaaggcgcaatccagctgggcatcggatacacagtgggtaacctaaccagcaagccggagagggacgtcctcatgcaggacttctatgtggtcgaatcggttttcttaccaagtgaagggagcaatctcaccccagcccatcactatcctgattttcgcttcaagacctatgcgccactcgcctttcggtactttcgagaactgttcgggataaaacccgacgattatctatattccatatgctctgagccattgattgagctgtctaacccgggagcctccggaagcttgttttttgtgactagtgatgacgagttcatcattaaaacagtgcagcacaaggaggccgaattcttgcagaaacttttacccggatattacatgaatttaaatcagaatccaaggaccttgctacctaaattctatggcctctattgtatgcagtcgggcggaatcaacataagaatcgtagtcatgaacaacgtgttgcctagatccatgcggatgcactttacgtacgacctcaagggttccacatacaaaagacgagcttcgcggaaggaacgcgaaaagtccaaccctacttttaaagatcttgattttttgcaggatatgcacgaaggactgtattttgacaccgagacatacaacgctctgatgaaaaccctccaacgggattgcagagtgctggaatcctttaagatcatggattattccctgctgctaggaattcattttctggaccatagcctgaaggaaaaggaagaagaaactccacagaacgtgcccgatgccaaacggacagggatgcaaaaagttctgtacagcactgcaatggagtcaattcagggacctgggaagagcggggatgggatcatcacagaaaatccggacactatggggggtattccagctaagtcacaccgcggagaaaaattgctgttgttcatgggcatcattgatatcctgcagagctaccgccttatgaagaaactggaacactcatggaaggccctcgtatacgatggggatacagttagtgtacaccgcccttccttctacgcagatcgctttctaaaattcatgaacagtcgggtctttaagaagatacaggccttaaaggcctcaccatcgaagaagcgatgcaacagtatcgccgctctcaaagcgacatcccaagaaatcgtgagcagtatcagccaggaatggaaggacgagaagagggacctgttaaccgaagggcagagcttttcatctctggacgaggaggccttgggcagtcgtcacaggcccgacttagtaccaagtaccccgagcctctttgaagctgccagcttggcaacgaccatttcttcttcatccctgtacgtaaatgaacattacccccacgacagaccaacgctttactccaactccaaggggctgccctcgtcatctacgttcactctggaggagggcactatatacctcacagccgagccaaatactcttgaggtgcaggatgacaacgcctccgtgctggacgtgtatctctag

SEQ ID NO: 234646 - DNA, 312 bp, Artificial Sequence
  Description of Artificial Sequence: Synthetic coding sequence
atgtccagcgcagccgagaacggcgaggctgctccagggaaacagaacgaagagaagacttataaaaaaaccgcgagtagcgcaattaaaggcgctatccagttggggatcggttacacagttgggaacctcacctcgaagccggagagggacgtgctgatgcaggatttctatgtcgtcgagagcgtgtttctgccctcagaaggctccaatctgacccccgctcaccactaccccgattttcgctttaagacttatgcgccactggcctttcggtacttcagagagcttttcgggattaagcctgattag

SEQ ID NO: 234647 - DNA, 1623 bp, Artificial Sequence
  Description of Artificial Sequence: Synthetic coding sequence
atgtcctcagccgctgaaaacggagaagcagctcctggcaagcagaacgaggagaagacctacaaaaaaaccgcaagcagtgctattaaaggggctatacagctgggcataggctatacggttgggaacctgacctctaagcctgaaagagacgtccttatgcaggacttctatgtggtcgaatccgtgtttctgccgagtgaaggttcaaatctgacccccgcacaccactaccctgacttccgtttcaaaacatatgctccgctggcattcaggtacttccgggagctgttcgggattaagccagatgattacctttacagtatctgctccgagcctctgattgaactgagcaatcccggagcatctggttccttgttcttcgtcaccagcgatgatgagttcattatcaagacagtgcaacacaaggaggccgaatttctgcagaagctgctgcctgggtactacatgaacttgaaccaaaaccccagaaccctcttgccaaagttttatgggctctattgcatgcagagcggcggtatcaatattcgcatcgtggtgatgaacaacgtcttgcccaggtctatgagaatgcattttacgtacgacctcaagggttcaacctataagagacgtgcatcacgcaaagagagagaaaaaagtaaccctacttttaaagacttagacttcctgcaggatatgcatgagggactatacttcgacacagagacttacaatgccctgatgaaaaccctccagcgagactgtcgggtgctggaatcgtttaagattatggattatagcctactgttagggattcatttcctggaccactcgctgaaagagaaagaggaagagacacctcagaatgtgccagatgctaaaagaactggaatgcaaaaggtgctgtattcaactgccatggaaagtatccagggtcccggaaaatctggagatggcataattactgaaaaccctgacacaatgggcggtataccggcaaagtcacatcgcggtgaaaaactcctgctttttatggggatcatcgacattctgcagagctacagactgatgaaaaagctggaacactcatggaaagccctcgtttacgatggcgacaccgtgagcgtgcatagaccttcattctatgctgaccggtttctgaaatttatgaattcacgggtgttcaagaagatacaggccctgaaagcaagtccctcgaaaaaacgctgcaatagcatagcagctttgaaagcaacctctcaggagatcgtgtcttcaattagccaagagtggaaagacgagaaacgcgacctgctgacggaaggacagtcattttcatcccttgacgaggaggccctggggtcccgccatcgtcctgatttggtgccttccactcccagcctgtttgaagcggctagcctcgccaccaccattagttcttctagcttgtacgtgaacgagcattacccacacgacagaccaacactgtattcgaactccaagggcctgcccagttcctctacctttaccctggaagagggcacgatatatcttacagcagagcctaacactcttgaagtccaggatgataacgcttctgtcctggacgtttatctgtag

SEQ ID NO: 234648 - DNA, 1350 bp, Artificial Sequence
  Description of Artificial Sequence: Synthetic coding sequence
atgcaggacttctatgtggtggagtctgttttccttccatcagaagggtccaatctgacccctgcccatcactacccagactttaggtttaaaacttacgccccactggccttccgctattttagagagctgttcggaatcaagcccgatgattatttgtactcaatatgttcagagccactgatcgaactgtccaacccaggcgcttccggaagccttttctttgttacatccgatgacgagtttatcattaagaccgtccagcataaggaggccgagtttctgcagaagctgctgcctgggtattacatgaacctgaaccagaacccgcgtactctcttacctaaattttatggcctctactgcatgcagtcagggggtattaacataagaatcgtggtgatgaacaatgttctgcccagaagcatgcgcatgcactttacttatgaccttaagggaagcacctataaacgcagggctagtagaaaagaacgggaaaagagcaacccaacttttaaggacctcgactttctgcaggacatgcacgaaggattatattttgacaccgagacttataatgccttgatgaagaccctccagcgcgattgtagagttttggaatccttcaaaatcatggattactctctcctgctggggatccactttttagatcattccctcaaagagaaggaggaggagacccctcagaacgttccagatgctaaaagaactggaatgcagaaggtcctgtactcgacagcgatggagagcattcagggacctgggaagagcggcgatggaattattaccgaaaatccggatacaatggggggtatcccagccaagtcccatcgcggtgaaaaattgctactcttcatggggattattgatatcctgcagtcctatcgcctcatgaagaaactcgagcactcttggaaagccttggtgtacgatggagatactgtgtcagtgcacagacctagcttctacgccgacaggtttttgaagtttatgaactcccgcgtgttcaagaaaattcaagcccttaaggcctctccctctaaaaagaggtgtaactccatcgcggctctgaaggcaacaagccaggagattgtctcttcaatcagtcaggagtggaaagatgagaaacgggatctcttaacagagggacagagcttctcctctctggatgaggaggcacttggaagtcgccatcgccctgatcttgtcccgagtacaccgagcctcttcgaagctgcctccctcgccacaactatctctagcagtagtttgtacgtgaacgagcactacccacacgaccggccaacgctttatagcaactcgaaatag

SEQ ID NO: 234649 - DNA, 489 bp, Artificial Sequence
  Description of Artificial Sequence: Synthetic coding sequence
atgtcgagtgcggcagagaacggggaggccgctccaggcaagcaaaacgaagagaagacatacaaaaagacggcctccagtgccataaaaggggctatacaactgggaataggatacaccgtaggcaaccttactagcaagccggagcgagatgtgcttatgcaagacttttatgttgtcgagtccgtcttcctcccctctgaggggtctaatctgacgccggcacaccattacccggatttcagattcaagacctacgcacctctcgccttcagatacttcagagagctcttcggcatcaagcccgacgattacctatattccatctgctctgagccgctcatcgagctgtctaatcctggcgcaagcgggagcctgttctttgttacgtctgacgatgagtttattataaaaactgtgcagcacaaggaggctgagtttctgcagaaactgctgcccggatactacatgaatctgaaccagaactag

SEQ ID NO: 234650 - DNA, 474 bp, Artificial Sequence
  Description of Artificial Sequence: Synthetic coding sequence
atgtcaagtgcagccgagaacggcgaagccgcaccaggaaaacagaacgaagagaagacatacaagaaaaccgcttcgtctgcaattaagggagcaattcagctgggtattgggtacacagtcggaaacttgaccagtaaacctgagcgtgacgttctgatgcaggacttctatgtagtggaatctgtgtttctgccatctgaagggtccaatctgaccccggcacaccactacccagacttccgctttaaaacgtacgcaccgttagcctttcggtacttcagagagctgtttggaataaagcctgacgactatctgtattccatctgttccgagcctctgattgaactgagcaatcccggtgccagcggatccctcttcttcgtaacttccgatgacgagttcatcattaagaccgtgcagcacaaggaagccgagtttctgcagaagctgctgcctggctattacatgtag

SEQ ID NO: 234651 - DNA, 1509 bp, Artificial Sequence
  Description of Artificial Sequence: Synthetic coding sequence
atgtctagtgcggctgagaacggtgaggcggcacccggtaaacaaaatgaagaaaagacatacaaaaagacagcgtctagtgctattaagggtgccatccagctaggaattggatacaccgtcggaaacctcacgagcaagccagaaagagacgtcctgatgcaggatttctatgtagtggagagcgtttttctgcctagcgaaggcagcaacttaacccccgctcaccattacccggacttccggttcaagacttacgctcctttggccttccgctatttccgggaactcttcggaattaaacctgacgactacttgtatagcatttgctctgagcctctgatcgagctgagcaaccccggagcatccgggtctctgttttttgtcactagcgacgacgagtttattataaagactgtgcagcataaagaggccgaatttctccaaaagcttcttccgggatactacatgaacctcaaccagaacccacgaacgctgctccctaagttttatggattgtactgtatgcagtcggggggtataaatatccggatagttgtaatgaacaacgttttgcctcgttctatgcgcatgcatttcacatacgatctcaagggatccacttacaaacgcagagcatcacggaaagagcgcgaaaaatctaatccaaccttcaaggatctggactttttacaagatatgcatgaagggctctattttgacactgagacctataacgcactaatgaaaaccctacagagagactgccgcgttctcgaatccttcaagataatggactacagcctcctcctgggaatccactttctggaccattcactcaaggaaaaggaggaggaaaccccacaaaatgtccccgacgccaagcggactgggatgcagaaggtgctgtatagcacagcgatggagtccatccagggaccaggaaagtcaggtgatggaatcataactgagaatcccgacaccatgggtggaatacccgcaaagagccatcgcggagagaagctcttgctgttcatgggaatcatcgacattctccagtcctatcgccttatgaaaaagcttgagcattcttggaaggcactggtgtatgatggggatacagtttccgttcaccgccctagtttctacgctgatcggttccttaagtttatgaactcgagggtgttcaagaaaatacaggcactcaaagcatctcccagtaagaagcgctgcaattccatcgccgcactgaaggctacctcccaggagatcgtgtcttcaattagccaggagtggaaagacgagaaaagggatttgctgacagagggacagtccttctcctcactggatgaggaagctctgggatcgcgccaccggccagacctagtacccagcacacctagtctttttgaggcagctagcttagccacaaccatctcatcctcatccctatacgtgaacgaacactatcctcacgacagaccaaccctttactcaaacagcaaatag

SEQ ID NO: 234652 - DNA, 2007 bp, Artificial Sequence
  Description of Artificial Sequence: Synthetic coding sequence
atggagctcgaagtgcctgatgaagccgaaagcgcagaagccggagctgtgccgagcgaagccgcttgggcagcagagtctggagcagccgctggcctggcccaaaaaaaagcggcaccgacagaggtcctgagtatgaccgcccagcccggaccagggcatggaaagaaactgggccacagaggggtcgatgcctcgggggaaacgacctacaaaaagactacatcgagcactctgaagggcgcaattcagctgggcattggctacacggtgggccacctgagttccaaacccgaaagggacgtgctgatgcaagatttctacgttgtagagagcatcttttttccttctgaaggctccaacctcacaccagctcaccatttccaggacttccggttcaaaacctacgcccctgtggcttttagatacttcagagaactttttggcattaggcccgacgattatctttattccctgtgcaatgaaccgctcatagaactttcaaacccgggagcaagtggctcactattctacgtgactagtgacgacgaattcataataaagaccgtgatgcataaggaagcagaattcctacagaagttgctaccagggtattacatgaatctgaaccagaacccgaggacgctcctccccaagttctatgggttgtactgcgttcaatccggcggaaaaaatatccgagtggtggtgatgaacaacattctgcccagagtggttaaaatgcacctgaagttcgacctgaagggatctacttacaagcgtagggcttcaaaaaaagagaaggagaagagtttccctacctataaggacctggattttatgcaggacatgccagaaggtctcctccttgatgccgataccttttcagccctggttaagacgttgcagcgcgactgtctggtgctcgagtccttcaaaataatggactactccctgttgttaggcgtccacaatatagaccagcatgagcgagaaaggcaggcccaaggtgctcagagcaccagcgatgaaaagaggcccgttggccagaaagcactgtatagcactgccatggaatctatacaaggcggtgctgcgcgtggggaagccatagagtctgacgacacaatgggagggattccggctgtgaacgggagaggcgagcggctcctgctccatattggcattattgatattctacagagttacagatttataaagaaattggagcacacctggaaggctctggttcatgacggagatacagttagcgtccaccggcctagcttctacgcggaaagattcttcaagttcatgtctaacactgtgttccggaagaactccagcttgaaaagcagcccttctaaaaagggtagaggcggagcgcttcttgccgtcaagcccctgggacctactgccgcattctccgcttcccagattccgtccgagagagaggaggcccagtatgacttgcgtggagccaggagctaccccaccctggaagacgaagggcgaccagacctactgccctgcactccgccatcattcgaagaggcaacaaccgcctcaattgctacgactttgtcttccacctccctaagtattccagagcgcagtcccagcgagacctccgaacagccaaggtatcgacgacgaactcagagcagcggccaggacggacgcccacaggaggaacctcctgcggaggaggatcttcaacagataaccgtgcaggtcgagcctgcctgtagtgtggagatagtggtgccaaaagaggaggatgccggagtcgaagctagcccggcaggcgcatcagccgctgtggaggtggagaccgcctcacaggccagtgacgaagagggagcccctgcctcccaagcctctgacgaagaggatgcgcctgccacggatatatattttccgacagacgaacggtcctgggtgtattcacctctccactattccgctcaggcccctcccgcaagcgatggagaatccgatacatag

SEQ ID NO: 234653 - DNA, 2103 bp, Artificial Sequence
  Description of Artificial Sequence: Synthetic coding sequence
atggagttggaagtacctgatgaagcagaatcagccgaggccggagcagtcccctcagaggcggcttgggctgctgaaagtggggcagcggcaggcctggcccagaagaaggccgctcctaccgaggtgttgtctatgactgcccagcctgggccagggcacggtaagaaacttggccatcgcggagtcgatgccagcggggaaaccacatataagaagaccacatccagtactctgaagggggctattcaactgggaattggctatactgtgggccatctctcctctaagccggagagagacgtgctgatgcaagacttctatgtggtggagtctatttttttcccgagtgagggaagcaatcttacccccgctcaccacttccaagattttcgattcaagacatacgcccctgtagccttccgctacttccgagagttgtttgggattaggcctgatgactacctctattctctgtgcaatgagccattaatcgaactgtcgaaccccggagctagtggcagtctgttttacgtcacatccgacgatgagtttataattaagacagtgatgcataaggaggctgagtttcttcagaagctcttgcccggatattatatgaatctgaatcagaaccccagaacactgctacctaagttttacggtctctactgcgtacaatctggaggcaaaaacatacgggtggtcgttatgaataacatcttgccacgggtagtcaaaatgcatctgaagttcgatcttaaaggtagcacttataagcggagagctagtaagaaagaaaaagaaaagtcatttccaacctataaggacctcgacttcatgcaggatatgcccgaagggctgctactggacgctgataccttcagcgcacttgtgaagaccttacagcgggattgcttggtgctggagagttttaagatcatggactactccctccttctgggtgtgcataacattgaccagcatgaacgggaacggcaggcacagggggcacagtccacatccgacgaaaaaaggccggtggggcaaaaggccctgtactccacagccatggaatccattcagggtggcgcagccaggggagaagcaatcgagagcgatgatacaatgggtgggatccctgcagtgaacgggaggggagaacgcctgttgctgcacatcggaattatagacattctacagtcgtaccgttttattaagaagctggaacatacctggaaggcactcgtccatgacggcgatactgtgagtgtgcacagaccaagcttttacgccgagcgattttttaaatttatgagtaacaccgtgtttagaaaaaactcttccctcaaatcatctccgtctaagaaggggcgaggaggtgcccttctggccgttaaacctttgggcccaaccgccgcttttagtgcttcccagattccttctgaacgcgaggaagctcagtatgaccttaggggagcacgatcataccccaccctcgaagacgaaggcaggcccgatttattgccgtgcacgccaccaagcttcgaggaggctacaacagcatcaattgccactactttgtctagcacttcactttcaatcccggagaggtctccctctgaaactagcgagcagccccgttaccggagaaggacccagtcatcgggtcaggatggcaggcctcaagaagaaccacctgctgaggaagacctgcagcagataacagtgcaggtggagcccgcttgtagcgtcgaaattgttgtacctaaggaggaggatgccggagtcgaggcctccccagcaggcgcatccgcagctgtggaggtggagactgcttcacaggccagtgacgaagagggggcaccggctagccaggcgtccgatgaggaagacgccccagcaacagacatttacttctggcgcctctggggaccgcatgcaccgacttggccatggagaagggaggggagggcagcttgtctgtgcccatatccgcctcatgtggtgactcccttccctggaaccggtctctgtgcctcttggtcaccagacggaacaggtggactgggggctatgtcctgctgtgtgagcgtgagctag

SEQ ID NO: 234654 - DNA, 1923 bp, Artificial Sequence
  Description of Artificial Sequence: Synthetic coding sequence
atggaactcgaagttcccgatgaggccgaaagcgcagaagccggtgccgtgccatctgaagcagcttgggccgctgaatcgggcgcagcggctgggctggctcagaagaaggccgctcccactgaggtgctgtctatgacagcacagcctggacctggacacggtaagaagttggggcatcgcggtgtggacgcctccggcgaaactacatacaagaagacaacgtcctcaacattgaagggtgctattcagctcggcatcggttacactgtcggacatttgagtagtaagcctgaacgtgacgtcctgatgcaggatttttacgtggtcgaaagcatattcttcccgagcgagggaagcaacctgactcccgctcaccactttcaggatttccgttttaagacctatgcccctgtggctttcagatacttccgcgagctatttggaattcgcccagatgattacttatacagcctgtgtaatgaacccttgatcgagctgtctaatcctggtgcatccggtagccttttctacgtgacctcagacgacgaattcatcatcaagactgtgatgcacaaggaggcagagttcctgcagaagttactccctggctattatatgaacttgaaccagaaccccaggacccttctgccaaaattttacggcctttattgtgtccagtctgggggaaagaatatcagggtggtggtgatgaataacatactgcccagggtcgtgaaaatgcacctgaagtttgacctaaagggctccacttataaaaggagggcatctaagaaggaaaaagagaagtccttcccaacgtataaagacctggactttatgcaggatatgcctgaggggctgctcttggatgcagatactttttcagcactcgtgaaaacccttcagagggactgcctggtgctggagtcattcaaaatcatggactacagtcttctgttgggggtgcacaacatcgatcagcatgagcgggagaggcaagcacaaggagcccaatccaccagcgacgagaagcggccagtcgggcagaaagctctatacagcactgccatggaaagtattcaggggggtgcagcccgaggagaagctattgagtccgatgacacaatgggcggaatcccagccgtaaacggaagaggcgagagactactactgcatatcggaatcatagatatcctgcaaagctatcggtttataaagaaacttgagcacacctggaaagccctggtacacgatggcgacactgtcagcgtccaccgcccaagcttctatgccgaacggtttttcaaattcatgtctaatactgtgttccgtaaaaacagctccctcaaatcaagtccatccaagaagggcaggggaggtgcgcttctggcagttaaacccttaggacccaccgccgctttttccgcttcacagattccatctgaaagggaggaagcccagtacgatctgagaggtgccagatcctatcctactctcgaggacgagggcagacccgacctcctgccttgcacaccaccatcattcgaggaagccactaccgccagtattgctacgactctgtcatctacttccctgagtatcccggaacggtctccctcagaaacctctgagcaacccagatatcgacgccgtacacagtcctctgggcaagacggccgacctcaggaggagccaccggctgaggaagacttgcagcagattaccgttcaggttgagccagcctgctcagtcgaaatcgtggtgccaaaagaggaggacgccggtgtcgaggcgagtccagcaggcgctagcgcagccgtggaagtcgaaacagctagccaggcttcagatgaggaaggcgcaccggcaagccaagcctccgatgaggaagacgctcctgctaccgatatctacttttag

SEQ ID NO: 234655 - DNA, 576 bp, Artificial Sequence
  Description of Artificial Sequence: Synthetic coding sequence
atgcagagcgtcttttatcctgcaggcaggatatccgaaaggtacgatattaagggatgtgaggtcagccggtgggttgatcccgctcctgagggatcacccctagtgcttgttttaaaggacctaaacttccagggaaagactattaatttgggtcctcagagatcctggtttctgaggcaaatggagctggatactaccttcttgcgcgaacttaacgtgctggactacagcctgctgatcgccttccaacgcttgcatgaagacgagagaggcccaggcagctcattaatattcaggactgccagatcggtgcagggcgcacaaagtccagaggaatctagagcccagaatagacgcctgcttccggatgcacctaacgccttacacatacttgacggccctgagcagaggtactttcttggcgtagttgacctggcaacagtgtacggattgagaaaaagattagagcatctgtggaaaacccttcgatacccaggcaggacctttagcactgtatcgccggctcgatacgctcgaagactgtgccagtgggtggaggcacatactgaatag

SEQ ID NO: 234656 - DNA, 1185 bp, Artificial Sequence
  Description of Artificial Sequence: Synthetic coding sequence
atggctgccccttcgcctggccctagggaagtacttgctccttcaccggaggccggatgcagggcagtcacaagcagtaggagagggctcctgtggaggctccgtgataagcaaagcagattggggctgtttgaaatcagccccggacatgagcttcatggaatgacctgcatgatgcaagccggtctttgggccgcaactcaagtgagtatggaccaccctcccaccggcccaccatcccgcgatgatttttctgaagtattgacgcaagtccatgaaggatttgagctcggcaccctcgcaggccctgcgttcgcatggctgcgccgatcgcttggattagcggaggaagattaccaggccgctctgggcccagggggtccttatctgcagttcttgtccacctccaagtccaaagcttcattcttcctcagccacgaccagaggtttttccttaagacacagggacgcagggaggtccaagctctgctggctcaccttccacgctatgtccaacacctgcagaggcaccctcattcactgctcgcaaggctgcttggcgtccattcccttagggtggatcgtggcaagaaaacttacttcatcgtgatgcagtccgtattctacccggcaggaaggatttcggaaaggtacgatatcaaaggttgtgaggtgtcaagatgggtcgatcctgcgccagagggatcccccctcgtgttagtgctcaaagatttgaacttccaaggtaagacaatcaatctggggccacaacgatcgtggttcctgcgccagatggagcttgacacaacatttctgcgggagctgaacgttcttgattacagcttgctcatagcttttcagagactgcatgaggacgagcggggaccgggatctagcctgatcttccgcacagcacggagcgtgcagggggcacagagcccggaggagagccgagctcagaaccggagactcctgccggacgcccctaacgccctacacatattggacggacctgagcaacgatactttctaggcgtggtggacctggccacagtgtatggactgcggaaaagactcgaacacctgtggaagaccttgagatacccaggtcggaccttcagcaccgtgtctccagccagatacgcacggaggttgtgtcaatgggtcgaagcacacacagagtag

SEQ ID NO: 234657 - DNA, 1128 bp, Artificial Sequence
  Description of Artificial Sequence: Synthetic coding sequence
atgatgtgccagagtgaagcccgacagggtcctgaactacgagctgctaaatggcttcacttccctcaacttgccctgcgacggcgtcttggtcagctcagctgcatgagccggccagcgcttaagttacgctcatggccactgacagtgctctactatctgctccccttcggggctctccgtcccttgagccgagtcggctggagacccgtgtcaagagtggccctctacaagagcgtgcctactaggcttctgagccgcgcttgggggaggctgaaccaggttgagctcccccactggctccgtcgtccagtctactcattatacatctggacctttggcgttaatatgaaagaagcggcagtggaggatctgcatcactaccggaatctgtcagagttcttcaggaggaagctgaaaccgcaggcaagacctgtgtgcggcctgcacagcgttatctctccctctgatgggaggatcctgaatttcggccaggttaaaaactgcgaggtagagcaggttaagggtgtgacctactcacttgaatctttcctagggcctagaatgtgcactgaagatctgcctttcccaccagcagcctcctgtgattcttttaagaaccaactcgtcactagagagggaaacgagctttaccactgtgtcatttatctcgcacccggtgactaccattgtttccacagtccaacagactggacagtgagccaccggagacacttcccagggagcctgatgtcagtcaatccgggaatggcccgttggattaaagagctgttttgtcacaacgagagggttgtgctgacaggagactggaagcacggcttcttctctctgaccgccgtcggcgctacgaatgtcggtagcatcagaatctactttgacagggatctccacaccaactcaccaaggcattccaagggcagctataacgatttctcattcgtaactcacaccaacagagaaggtgtgcccatgagaaagggggagcatctgggagagtttaacctgggcagtacaattgtgctcatctttgaggcccctaaggactttaactttcagctgaagacagggcagaaaattcggtttggcgaggctctggggtctctatag

SEQ ID NO: 234658 - DNA, 1227 bp, Artificial Sequence
  Description of Artificial Sequence: Synthetic coding sequence
atggctaccagcgtgggtcaccggtgtctggggctgctccacggcgtggccccatggcgcagctccctccatccatgtgagatcaccgcccttagccagtccctgcagccactccggaaactgcctttccgggcttttagaaccgacgctcgcaagatccataccgctcccgctcgcacaatgttcttactcagaccactgccaatccttctcgtgacgggaggcggttatgcgggttatcgccagtacgaaaagtatcgggaacgggagctggagaagttgggattggagatcccacccaaactggctggccactgggaagtcgctctgtataagtccgtccctactagactgttaagccgcgcttggggaagactgaatcaagtagaattgccccattggctgagacgcccagtgtactctctctacatttggaccttcggcgttaacatgaaagaggccgctgttgaggatttgcatcattatcgaaatctcagcgagttcttcaggcgtaaacttaagcctcaggcgagacccgtctgtggcctccattcaatctcaccctctgatgggagaattctgaattttggccaagtcaaaaactgcgaggtggaacaggtcaagggcgtgacttatagccttgagtcatttctagggcctcgaatgtgtacagaagacctccccttcccaccggctgctagctgcgattcctttaagaaccagctcgttacccgcgaagggaacgagctttatcattgcgtgatctatcttgcgccaggcgattatcattgcttccactctcccactgactggactgtttcccataggaggcactttcctggctccctgatgtctgttaaccctggtatggcgcgttggataaaagaactgttctgtcacaacgagcgtgtggttctgaccggggattggaagcacggtttcttttctctcacagcagtgggggctactaacgttgggtcaattaggatctatttcgaccgggatctgcatactaactcccctcggcattctaaaggttcttataacgacttctcctttgtaactcatacaaatcgggaaggagtccccatgaggaagggcgagcacctgggagaatttaacctcggctctaccattgtgctgattttcgaagctccaaaggacttcaactttcagctcaaaacgggccagaagatccgcttcggcgaagctctaggcagcctgtag

SEQ ID NO: 234659 - DNA, 1128 bp, Artificial Sequence
  Description of Artificial Sequence: Synthetic coding sequence
atgatgtgccagtccgaggccaggcaaggtcctgagttgcgcgcagccaagtggctgcactttccccaactcgccctgcgcagacgactgggccagctgagctgcatgagtcggccagccttgaagttgagaagttggcccctaaccgttctgtactatctactgccattcggggcacttaggcccctgagcagggttggctggagaccagtatcaagagtagccctgtacaagtctgtcccaaccaggttgctcagcagggcctggggcagattaaaccaggtcgaacttcctcactggttacgaaggcccgtatactctctatacatctggacttttggcgtgaatatgaaagaagcagcggtagaagacctccatcattacaggaatctctccgaattctttcggagaaagctcaagccacaggccaggcccgtgtgtggattgcatagcgtgatctccccatctgacggtcgtatactcaattttgggcaggtgaagaactgcgaggtggagcaggtaaagggggttacatacagcctggagtctttcctggggcctcgaatgtgtaccgaggaccttccttttcctcccgcagccagctgcgactcttttaagaaccagctggtgacgagggaagggaatgagctgtaccattgcgtgatatatctggctcctggggattaccattgtttccacagtccaaccgattggactgtatctcaccggagacattttccagggtctctgatgagtgttaacccaggaatggcacgctggatcaaggagctcttttgtcataacgagagagtagtcctgaccggcgactggaaacatgggttttttagcttgacagccgttggagctacaaatgttggttcgatacgcatctatttcgaccgggatttgcacaccaattcaccccgacacagtaagggaagttataacgatttttcttttgtcacacacacaaatcgggaaggcgtgccgatgaggaagggtgagcacctgggtgaatttaatctgggatcaactatcgtgttaatctttgaagcgcctaaggatttcaactttcaattaaaaaccgggcagaagattcgattcggagaggcgttaggcagcctgtag

SEQ ID NO: 234660 - DNA, 789 bp, Artificial Sequence
  Description of Artificial Sequence: Synthetic coding sequence
atgatgtgccagagcgaggcaagacagggtccggagttacgggctgcgaagtggctgcactttcctcagcttgctctgagaagacgtctgggacaacttagttgcatgagccgccctgctttgaaattgaggagttggccattgacagtactctattacctgttaccgtttggggctttgagacccctttctagggtgggctggcggcctgtgtctcgtgtcgccctatacaagagtgtccctacacggctcctgtcacgcgcttggggccgactgaatcaggttgagttgccccactggctgaggcggccagtctattctttgtatatttggaccttcggcgtgaatatgaaggaagcggcagtcgaagacctgcatcattaccggaacctctctgagtttttcagacggaagctgaaaccacaggcaaggcctgtgtgtggactccattcagtcatcagccccagcgacgggagaattctgaatttcggacaggtcaagaattgcgaagtggagcaagtgaagggggtcacgtactccctggagagtttcctgggcccaagaatgtgcactgaggacctgccctttcccccagcagccagctgtgactcttttaagaatcagctggtgacccgcgaaggcaacgaactgtatcattgcgtgatttatctggctcctggtgactaccattgctttcattcacctactgattggactgtgagccacaggcgacactttcccggtccagcccacaaacaacccaaagctcagcagggactactacagtag

SEQ ID NO: 234661 - DNA, 687 bp, Artificial Sequence
  Description of Artificial Sequence: Synthetic coding sequence
atgatgtgtcagtccgaagccaggcaaggcccagaattgcgcgcagccaaatggctgcatttcccccagcttgcattgagaaggcgcttaggtcagctctcttgcatgtcccgccctgctttgaagctacggtcctggcccctaacagtgttatactatctgctgccctttggcgcactacgtccattatccagggttggctggaggcccgtgagccgcgtcgcgctgtacaagagcgtgccaacacggctcctgtctagggcttggggtagactcaaccaggtggagctgcctcattggttaagaaggcctgtctatagtctatacatttggactttcggcgtcaacatgaaggaggccgcagtcgaagacctgcaccattaccgcaacctgtccgaattcttccgaagaaaactgaagccgcaggccagacccgtgtgcgggctgcactctgtgatctcacccagcgatggtcgaattcttaacttcgggcaggtaaagaattgcgaggttgaacaggttaagggcgtcacatactccctcgagtcatttctgggcccacggatgtgtaccgaagatttgccctttcccccagccgcatcatgtgattcattcaagaaccagctcgtgactcgtgagggaaatgagctctatcattgcgtgatttaccttgccccaggcgattag

SEQ ID NO: 234662 - DNA, 222 bp, Artificial Sequence
  Description of Artificial Sequence: Synthetic coding sequence
atgatgtgtcaatctgaagccaggcaggggccagaactgagagccgctaaatggttacactttccccagcttgccctgcgacggcgattaggacagctgtcttgtatgagccgacctgccttaaaactgcgttcatggcccttgacagtgctctactacttactgccttttggtgccttgaggcctttgtctagagtcggctggcgccctgtctccagatag

SEQ ID NO: 234663 - DNA, 222 bp, Artificial Sequence
  Description of Artificial Sequence: Synthetic coding sequence
atgatgtgccagagcgaagccaggcagggtcccgagctgcgagcggcaaaatggcttcatttcccacagctggctttaagaaggcgcctagggcagctttcctgcatgtctcggccagccctgaaacttcgatcttggccgctgaccgtcctgtactacctactgcccttcggcgctctgcgaccattgtcgcgggtaggatggaggccagtaagtcgctag

SEQ ID NO: 234664 - DNA, 1230 bp, Artificial Sequence
  Description of Artificial Sequence: Synthetic coding sequence
atggccacatccgtgggacaccgctgcctcggccttctgcatggcgtggctccgtggaggagctccttacatccatgcgaaattaccgccctttcacagtcactgcagccgctgaggaagctacctttcagagccttcaggacagacgcgaggaagatacacacagctcccgctcgtactatgttcctgcttcgaccattgccgattctcttggtaacaggtgggggttatgcagggtacaggcagtatgaaaagtaccgcgagagagagctggaaaagctgggcctggaaatcccccctaaactggccggacactgggaggtggcactgtataaatctgtaccgactcggttgctgagtcgggcttggggacgactcaatcaggtggaactcccacactggctgaggagaccagtctattcactgtatatatggacctttggggtcaatatgaaagaggctgcagtggaggacctgcatcattatagaaacctgtcagaattctttagaaggaagttgaaacctcaagcacgccctgtgtgtggattgcatagtgtgatctctccgtccgatggtcgaatccttaattttggacaggtgaaaaattgcgaggtggagcaagtcaaaggggtgacctactctcttgagagctttttaggccctcggatgtgtacagaggacttgccctttcctcccgcagcatcgtgcgactcttttaaaaaccaattagttacccgcgaagggaacgaactttaccactgcgtcatatacctggcacctggtgactatcactgtttccattctcctactgattggactgtcagccacaggaggcattttcctggctcacttatgtctgtgaatcccggaatggctcgctggattaaagagctgttctgtcacaatgagcgggtcgtccttacaggagattggaagcatggatttttcagcctgacagcggtgggagctacaaatgtgggatctattcgcatctactttgatagggatctccacactaacagccctaggcatagtaaggggtcatataatgactttagctttgtgacccatacgaacagggagggggttccaatgcggaagggtgagcacctcggcgaattcaatctggggagcacaattgtgctcatcttcgaggcgccaaaagatttcaacttccaacttaagaccggacagaagatccgcttcggcgaggctctggggtccctgtag

SEQ ID NO: 234665 - DNA, 246 bp, Artificial Sequence
  Description of Artificial Sequence: Synthetic coding sequence
atgatgtgccagtctgaagcgaggcagggccctgagctgcgcgcagccaagtggttacactttccacagctagccttacggaggcggctcgggcagctgtcctgcatgtcccgtcctgctctcaaattgcggtcctggcccttaaccgtcctctattaccttcttccttttggtgccctgagaccactgagcagagttgggtggcgtccagtttcacgcgtcgctctttataaatccgttccttag

SEQ ID NO: 234666 - DNA, 981 bp, Artificial Sequence
  Description of Artificial Sequence: Synthetic coding sequence
atgatgtgccagagtgaggccaggcagggacctgagctgcgcgcagcaaagtggttacacttcccacagctcgcactgcggagacgactgggccaactgagttgtatgtctcgtcccgctctgaaactgcggtcttggcctctgactgtcctctattatctgctcccttttggagctctccgaccgctgtctcgcgtgggatggagacccgtgagtagagtcgctctttacaagagcgtccctacccgcttgctgtcccgcgcatgggggaggctcaatcaggtcgagttaccacactggttgcgacggcctgtctatagcttatatatctggactttcggtgttaatatgaaagaggccgcagtggaggatttacaccactatcgcaatttatctgagtttttccgcagaaagctcaaaccccaggctaggcccgtctgcggtctccatagtgtcatcagccccagcgatgggaggattctgaactttggccaagtaaagaattgtgaagtggagcaagtgaaaggcgtgacatattccctggaatcctttttgggacctcggatgtgcactgaagacctcccctttcctccagcggcatcttgcgatagtttcaagaaccagcttgtaaccagggaaggcaatgaattgtatcattgcgtgatttatctagccccaggcgattatcactgtttccactctcctacagattggactgtcagccaccgacggcattttcctggctcactgatgagcgttaatccgggaatggcaaggtggattaaggagctcttttgccataatgagcgcgtagttctcaccggcgactggaagcacggattcttttccctaacagcagttggcgctacaaatgtcggctctattcgcatctattttgatcgggacttgcataccaactctccacgccactccaaggggtcctataatgatttctccgtcgtgggctcccttactaggtag

SEQ ID NO: 234667 - DNA, 984 bp, Artificial Sequence
  Description of Artificial Sequence: Synthetic coding sequence
atggagtacgctgttaattgccacgttataacttgggagcgaatcatcagccattttgatatcttcgcattcggccacttttggggatgggctatgaaggctcttctgatacggtcctacggtttatgttggactatcagcatcacctgggagctcacagaattattctttatgcacctgttacctaactttgcagaatgctggtgggaccaggtaattctggacatacttttgtgtaacggaggcggaatctggcttgggatggtcgtgtgtcgattcctggagatgaggacctaccactgggcatcatttaaagacattcataccacaaccggtaagattaagagggctgttcttcagttcacgcccgcttcttggacttacgtcaggtggtttgaccccaagagcagtttccaaagagtcgctggggtgtatttatttatgatcatctggcagttgactgaactcaatacatttttcttgaaacacattttcgtgttccaggcttctcacccgctctcttggggcaggatcctttttattggtggtatcaccgcgccaactgtcagacaatactacgcatatctcaccgatactcaatgcaaaagggtcggaacccagtgctgggtgtttggagtgataggatttctggaggccatcgtctgcatcaaatttggccaggatctgttttcaaagacccagattctgtacgtggtcctctggttactttgcgttgctttcactactttcctttgcctctacggtatgatttggtacgccgaacactatggacatcgcgaaaagacatactccgagtgcgaagacggcacctactcacctgagatcagctggcaccaccggaaaggcactaaggggtcagaagactctcctcccaaacacgccggtaataatgagtcacatagctctcgtcggcgaaataggcatagcaaatccaaggtgacaaatggcgttggaaagaaatag

SEQ ID NO: 234668 - DNA, 1422 bp, Artificial Sequence
  Description of Artificial Sequence: Synthetic coding sequence
atggcttcatgcgtcgggagcaggaccttatcaaaggatgacgtgaactacaagatgcattttcgcatgattaacgagcagcaagttgaagatattaccatcgactttttttatcggcctcacactattacccttctctctttcactattgtctcgcttatgtatttcgcttttacgcgggacgactcagtgccagaagataacatctggcggggaatcctaagtgttattttcttcttcttaatcataagcgtgctggcgttccccaacgggcctttcaccaggcctcaccctgcactctggagaatggtgtttggattatccgtgttatatttcttattccttgtgttcctcctttttctgaatttcgagcaggtgaagagcctcatgtattggctcgaccccaatttaaggtatgccacgagggaagctgatgttatggaatatgctgtgaattgtcatgtgataacatgggaaagaatcatctcgcatttcgacatctttgccttcgggcacttttggggatgggctatgaaagctttgttgatcaggtcttatggactgtgttggaccatttccataacttgggaactcactgagcttttcttcatgcaccttctcccaaattttgctgaatgctggtgggaccaagtgattctcgacatcctgctatgtaacggcggtggcatatggctcggaatggtagtgtgtcggtttttagagatgcggacatatcactgggctagttttaaagacattcatactaccactggcaaaataaaaagggctgtactgcagtttaccccggcttcatggacatatgtgcggtggtttgaccccaaaagttctttccagagagtagcaggggtgtacctgttcatgataatctggcagctgactgaactgaatacattctttttgaaacacatcttcgttttccaggcctcccatcccctgagctggggcagaatcctcttcattggcggaattacagcgcctaccgtgagacagtactatgcttatctgacagatacccaatgtaagagagtcggcactcagtgttgggtttttggcgtcataggtttcctggaagccattgtctgcattaagttcgggcaggatctgttcagcaagacccagattctctacgtcgtactgtggttactgtgcgttgcctttaccacttttctgtgtctctatgggatgatctggtatgccgagcactatggtcaccgagagaaaacatatagcgagtgcgaagacgggacctactcccccgagatcagctggcatcacagaaaagggaccaagggtagcgaagactctcccccaaagcatgccggtaataatgagagtcacagtagtcgacggagaaatagacacagcaaaagcaaggtgaccaacggagttgggaagaaatag

SEQ ID NO: 234669 - DNA, 1464 bp, Artificial Sequence
  Description of Artificial Sequence: Synthetic coding sequence
atgaggaggggagaacgcagggatgcaggcggacctcggcctgaaagtcccgtgcctgctgggagagcctccttggaagagccgccagacgggccaagcgccggacaggcaacaggaccaggtgaaggtaggcggagcacggaatcggaggtgtacgacgacggcaccaatacattcttttggagggcacacactctgacagtgctctttattctaacatgcaccctcggttatgtaaccctgctagaagaaactcctcaggatacagcatataacactaagaggggcatagtcgcctcaatactggtcttcttatgcttcggagtgacccaggctaaggatggtccattttcccgcccacatcctgcctactggcgattttggctgtgcgtatcagtggtgtatgaactgttcttaatcttcatcctctttcagacagtgcaagatggacgccagttcctgaagtatgttgatcccaagctgggggtgcccctgcctgagcgggactacggtggaaattgtttaatctacgaccccgacaatgaaaccgacccatttcacaatatttgggataagctggatggctttgtgcccgctcattttttaggctggtaccttaagaccctaatgatccgggattggtggatgtgcatgatcatctctgtcatgtttgagttcctcgaatattctctggaacatcaattgcctaattttagcgagtgttggtgggatcactggatcatggacgtactggtgtgcaatggcctcggaatttactgtggcatgaaaacactcgaatggctttcgctgaaaacatacaagtggcagggtttgtggaacattcccacttacaagggcaagatgaagcgtattgcgttccaatttaccccatactcctgggtgaggtttgaatggaaacctgctagcagtctcaggcgctggttggccgtgtgcgggattattctggtgtttcttctggcggaactgaacacgttttacctgaagtttgtgctgtggatgccacctgaacattatctcgtgctgctcagactcgtcttttttgtcaatgtcggaggcgttgccatgagagagatctacgacttcatggatgaccccaaaccgcacaagaaactggggcctcaagcctggctggtggccgctatcacagccaccgaactcctgattgtggtgaagtatgatcctcacactctgacactctccctacccttttacatctctcagtgctggacgctgggaagcgtgcttgctttaacttggactgtatggcggttctttctgcgcgacatcaccttgagatacaaggagactcgctggcagaagtggcagaacaaggatgaccagggctctacagtcggcaacggcgatcagcaccctctcgggctagatgaagatctgctcgggcctggtgtggctgaaggcgagggtgcaccaacgcccaactag

SEQ ID NO: 234670 - DNA, 2802 bp, Artificial Sequence
  Description of Artificial Sequence: Synthetic coding sequence
atggccgcaagccggctggattttggcgaagtggagactttcctggaccgccatcccgaattattcgaggattatctgatgcggaaagggaagcaagagatggtcgagaaatggctgcagcgacacagtcaagggcagggagctcttggacctagaccaagcctggctggaacatcttccctagcccactcaacatgccgtggcggatcatccgtgggaggaggaaccggtccaaacgggtccgctcacagtcagccactccctggagggggagattgcgggggagttcctctatcgccttcttgggcaggaggtagtcggggagacggaaatctacaacgcagggcgtcacagaaagagcttcgaaaatccttcgccaggagtaaagctatacatgtcaaccgcacatacgatgaacaggtgacctctagggcccaggagccgctttcatcagtgagaaggcgcgcactcctccggaaagcttccagcctgcctcccacaaccgctcatatacttagtgccctgttggaatcccgcgtaaacctgcctcggtatcctccgactgccattgactacaagtgccacctcaagaagcacaacgagagacaattttttcttgagttagtgaaggacatctctaatgatctggacctgacttccctgtcttacaagattcttatcttcgtgtgtctaatggtcgacgctgaccggtgttctctgtttctggttgaaggggctgcagctgggaaaaaaacgctcgtaagtaagttctttgacgttcatgcgggtaccccattgcttccgtgttcctccaccgaaaacagcaatgaagtgcaagttccctggggtaaaggcatcattgggtacgtaggcgaacacggagagacagttaacattcctgatgcctaccaagatagacgtttcaacgatgagatcgacaaactgacagggtacaaaacgaaatctctgttgtgtatgcccattcggtcctcagacggagagattattggggtcgcgcaggccatcaataagatcccggagggagcacctttcacggaggacgatgagaaggtgatgcagatgtatttacccttttgcggcattgctatttccaacgctcagttattcgctgcttcacgtaaggagtatgaaagatctagagccctcttggaagtggtcaatgatctgttcgaagagcagaccgacctcgagaaaattgttaaaaagatcatgcaccgagcacagacacttcttaagtgtgaacgatgttctgtgttgctgctcgaagatatagagagcccagtcgtgaaattcacgaagtcctttgaactgatgtcacccaaatgtagcgctgacgcagaaaacagctttaaggagagcatggaaaaatccagctattccgactggctcattaacaattcaattgccgagcttgtcgccagcacgggtctacccgtgaacatttctgatgcatatcaagacccccgtttcgatgcagaggccgaccagatttcaggttttcacatccgcagcgttctgtgcgttccaatctggaactcaaatcatcagattattggtgtagcacaagttttgaatcgtctggatggaaaacctttcgacgacgcagaccaacggctcttcgaagcttttgtcatcttctgcggtttaggtatcaataacaccataatgtacgaccaagtgaaaaagtcttgggcaaagcaatcagtagccctggatgtgctcagctaccatgccacctgctcgaaggctgaggtcgacaaattcaaagctgccaacattccactggtctctgaacttgctatcgacgacatacactttgacgatttttccctggatgtggatgcaatgataacagcagcactccggatgtttatggagctgggcatggttcagaaattcaaaatcgactacgagacattgtgcaggtggctgctgacagtccgaaagaactaccggatggtcttataccataactggaggcacgcctttaatgtttgtcagttgatgtttgcaatgttgacaaccgctgggttccaggacatcctgaccgaagtggagattctcgcagtgattgtcgggtgtctgtgccacgacctggaccaccggggaacgaacaacgcattccaggccaagagtggatcagccttggcccagttgtatggcacaagcgcgaccctggagcaccatcatttcaaccatgccgtaatgatcctgcagagtgaaggacacaacatttttgcaaatctgagctccaaagagtattctgacctgatgcagctcctgaagcagagcatcctcgcaacggacttgacactctactttgaaagacgaacggaattctttgagcttgtctcgaagggcgaatacgactggaatatcaagaaccatagggacatttttcgctcaatgctgatgaccgcttgtgatctcggagccgttactaagccttgggagatctcccgtcaagtggctgagttggtcacctctgagttttttgaacaaggagacagagagagactggagctgaaacttacgccttccgccatctttgatagaaaccgtaaggacgaactgccacgcctccagctggaatggatcgactccatctgtatgcctctgtaccaggcactcgtgaaggtaaacgtgaaattgaaacctatgctggactccgtggccaccaacaggagcaagtgggaggagttacaccaaaagcggctcctcgccagtacagccagttcatcgcctgcaagcgtgatggtcgccaaggaggatcggaactag

SEQ ID NO: 234671 - DNA, 2052 bp, Artificial Sequence
  Description of Artificial Sequence: Synthetic coding sequence
atgctcaaacaggctagaagacccctgtttagaaatgtcctgtcggctacccagtggaaaaaggtaaaaatcacacgcctggtccaaatctctggtgcctcactggcggagaaacaggaaaagcatcaggactttcttatacagcgacaaacaaagaccaaggatcggcgattcaatgatgagatcgacaagctaacagggtataaaaccaagtccttactctgcatgccgatacgtagttccgacggagagataatcggagtcgcccaggcaattaacaaaattcccgagggggcaccatttactgaggatgacgaaaaggtcatgcaaatgtacctcccgttttgtggaatcgctattagcaacgctcagctctttgctgcctcacgaaaggagtatgaacgctctcgcgctctgctggaggtggtcaatgatcttttcgaagagcaaactgaccttgagaagattgtgaagaagatcatgcatcgcgcacagacactgctcaaatgtgagagatgtagcgtactcctattggaagacatcgagtcacctgtcgtcaagtttaccaagtcgtttgaattaatgtcacctaagtgttccgcagatgccgagaatagttttaaggaatctatggagaaaagtagctattcagactggctgataaataattcaatagccgaactagtcgcaagcactggattgcccgtcaacatcagtgatgcataccaggaccccagattcgacgccgaggccgaccagatctcagggtttcacatcaggtccgtcttatgtgtgcccatttggaatagtaatcaccaaatcattggggtggcgcaggtgttgaatagactcgacggcaaaccatttgacgatgcagaccagaggctctttgaagcctttgtgattttttgtgggttgggtatcaataacaccataatgtatgaccaggtgaagaaatcatgggctaaacagagtgtcgccttggatgttctgagctatcatgccacgtgctcaaaggccgaagtcgataaatttaaggctgccaatatcccactagtcagcgagttagccattgacgacatacacttcgacgatttctctctcgatgtggacgccatgatcaccgccgcactgcgaatgttcatggagctcggaatggtgcagaagttcaagattgattacgaaactctgtgccgctggctgcttaccgtgcgtaaaaactaccggatggtgctgtaccataactggagacatgctttcaatgtttgccaactcatgtttgctatgttgaccactgccggattccaggatattctgacggaggtggaaattctggcagtgatcgtcggatgcttatgccatgacctggatcacagaggaacgaacaacgccttccaggctaaatcaggttcagcactcgctcaactttacggcacctctgccactctggaacaccaccacttcaatcacgcagtcatgatcttgcagagtgaggggcacaatatctttgctaacctgtctagcaaggaatactccgatttgatgcagcttttgaagcaatccattttggccactgacctgactctgtattttgagagacggaccgagttttttgaacttgtgtctaaaggggaatatgactggaatattaagaatcatcgagatatcttcaggtctatgctgatgaccgcgtgcgaccttggggctgtgacaaaaccctgggagataagtagacaagtagcagagctcgtcaccagtgagttctttgaacaaggcgacagagagagattggagctaaagctaacaccctctgccattttcgaccgaaaccgtaaagacgaactgccccgtctgcagcttgagtggatcgacagtatctgtatgcccctgtaccaagccctcgtcaaagtaaatgtcaaactgaagccaatgttggactcagtggccacaaaccggtccaaatgggaggagctgcaccagaagagactgctggcgtccacagcatctagctcccccgcatctgtcatggtcgcaaaagaagatcggaattag

SEQ ID NO: 234672 - DNA, 1470 bp, Artificial Sequence
  Description of Artificial Sequence: Synthetic coding sequence
atgagcccaaagtgcagtgccgacgctgaaaattcattcaaggagtctatggaaaagtcgagttattctgactggctgattaacaattctatcgcagaactcgtggctagcacagggcttcctgtgaatatctcagacgcttaccaggaccccagattcgacgcggaggccgatcagatatccggtttccacataagatctgtgttgtgcgtacccatctggaactccaaccaccagattatcggagtcgcacaggtgctaaatagacttgatggcaagcccttcgacgatgcagaccaacgactttttgaggcgttcgtgatcttttgcgggctggggatcaataataccatcatgtacgaccaggtgaagaaaagctgggccaaacagtctgttgcactggatgtcctgagctaccacgctacctgttccaaggcagaggtagataagttcaaagccgcaaacatccctctggtgagcgagctcgctatcgatgatatccacttcgatgatttttccctggatgtcgatgctatgatcactgccgctctacgcatgttcatggagttgggcatggtacagaagttcaagattgattacgagacgttgtgtaggtggctgctgaccgtaagaaagaattacagaatggtattatatcataactggcggcatgcattcaacgtctgccagctcatgtttgccatgttaactacagctggcttccaagacattttgaccgaggtggaaattctggctgtcattgtgggctgtctgtgtcatgacctggatcacaggggtaccaataacgcctttcaggctaaaagcggcagcgcgttagcacagctatatggaacctcagccactttagagcaccaccactttaaccacgccgtgatgatcctgcagagcgaggggcataatatctttgcaaatctaagcagtaaagagtactcagacttgatgcagctgctaaagcaatcaatcctcgccaccgatctaactctttacttcgaacggaggacagagttcttcgaactcgtttccaagggggaatacgactggaacattaaaaatcacagagacattttccggtcaatgctgatgacagcttgtgatttaggcgctgtcacgaagccttgggagatcagccggcaggtggcagagctagtgacttctgaatttttcgaacagggagaccgcgaacgtctggagttgaagcttacccccagcgccattttcgacaggaatcgcaaagacgagttgccccgactgcaactcgagtggatcgactctatttgcatgcccctctatcaggctctggtgaaagttaatgtcaagttgaagcctatgctggattccgtggctactaaccgaagcaagtgggaggaacttcaccagaagcgcctactggcttctaccgccagcagtagccctgcctccgttatggttgcaaaggaagaccgcaattag

SEQ ID NO: 234673 - DNA, 1728 bp, Artificial Sequence
  Description of Artificial Sequence: Synthetic coding sequence
atgcagatgtatcttccattctgtgggatcgccatctccaacgcacaactgtttgcagcctcccgaaaagagtatgaaagaagccgggctctgcttgaagtcgtcaatgacctgttcgaagagcagactgacctggaaaagattgttaagaaaatcatgcaccgggcacaaaccctgctgaaatgtgagagatgctctgttctcctgttagaggacatcgaatcgcccgtagtgaaattcaccaagagcttcgaacttatgtctcccaaatgcagcgcagacgctgaaaactcattcaaagagtcaatggaaaagagcagctacagcgactggctaattaacaattccatagccgagctcgttgcaagcacggggctccccgtgaatattagtgatgcttatcaagatccgcgttttgacgccgaagcggatcaaattagtggcttccacattcggtccgtcctgtgcgtgccgatttggaacagtaatcaccagatcattggtgtggctcaagtcctaaacagactcgatggcaagccctttgacgacgctgaccagcgcctctttgaggcgttcgtgatcttttgcggcctggggatcaacaatacaataatgtacgaccaagtcaaaaaaagttgggcaaagcagtctgttgcgctggatgtcctgtcctaccacgccacatgtagcaaagccgaggtcgataaattcaaagccgctaatattccactggtctctgaattggctattgatgacatacacttcgacgacttttcactggacgtcgacgccatgatcaccgctgcactgcgcatgtttatggagctgggcatggtccagaaattcaagattgactacgagaccttatgccggtggctgctgaccgtgcgtaagaattatcgcatggtgctctatcataactggaggcacgcctttaatgtctgtcagctcatgttcgcaatgctgacaacagccggatttcaggacattctcaccgaggtggagatcctcgcagtgattgtgggatgcctctgtcatgacctggaccacaggggaactaataatgccttccaggcaaagagtggcagcgcattagcacaactgtatggtacctccgccaccttggagcaccaccatttcaaccacgcagttatgatcctgcagtctgagggtcataacattttcgcgaatctgtcatcaaaagaatattccgatctgatgcagctgctgaagcagtctatcctggctacagatttgacactatatttcgaacgacgaacagaattttttgagcttgtctctaagggtgagtacgattggaacatcaaaaaccatagggacattttccggtcgatgctaatgacagcctgcgatcttggcgctgtaactaagccttgggagatttcgcggcaggtcgcagagctggttacctctgagtttttcgagcagggtgacagagagagactggaactgaaacttacccctagtgctattttcgacaggaacaggaaagatgagctccctcggctgcaactagaatggatcgactccatctgtatgccattataccaggcactagtcaaggtgaacgtgaagcttaagcccatgctggatagtgtcgcaacaaaccgtagtaaatgggaagagctccatcagaaacgcctgcttgcctctactgcaagcagctcccccgcatccgtgatggtggccaaggaggaccgaaattag

SEQ ID NO: 234674 - DNA, 393 bp, Artificial Sequence
  Description of Artificial Sequence: Synthetic coding sequence
atgcccattagaagcagtgatggggaaatcatcggggttgctcaggcaataaataaaatccctgagggggctccattcaccgaggacgatgaaaaggtgatgcagatgtacctgccattctgcggaatagccattagtaacgcacagctgtttgccgcttctcgaaaggagtatgagcggagtcgtgccttactcgaggtagtgaatgacctgtttgaagagcagactgacctcgagaaaattgtgaagaagattatgcaccgagctcagactctgttgaagtgtgaaagatgttctgtgctcctgctggaagatatagaatcacccgtggtgaagttcacaaaaagtttcgagctgatgtccccaaaatgcagtgctgatgccgaaaactag

SEQ ID NO: 234675 - DNA, 1728 bp, Artificial Sequence
  Description of Artificial Sequence: Synthetic coding sequence
atgcagatgtacctgcctttctgcggtattgcaatttcaaacgctcaactcttcgctgcttccagaaaggaatacgagaggtcacgggctcttctcgaggtggttaacgacctctttgaagagcaaacagatctagagaagattgtgaagaagataatgcacagagcccagacgctgctgaaatgtgaacggtgcagcgtgctgctcttggaggatattgaaagtcctgtggttaaatttacaaaatccttcgaactcatgtctcccaaatgtagtgccgatgcagaaaactcttttaaagagtctatggagaagagttcctacagtgactggctgatcaacaatagtatcgccgagctcgtggcttcaaccggtctgcctgttaacatctccgacgcctatcaggatccaaggtttgacgcggaggcggaccagatctctggatttcacatcagatccgtgttgtgcgttccaatatggaacagcaatcaccaaatcatcggagtggctcaagttctgaaccgtctcgacgggaaaccctttgacgacgcagaccaaagactgttcgaggccttcgtgatcttctgcggtctcggaatcaataatacaattatgtatgaccaggttaagaaatcgtgggccaaacagtcagtggcactggacgttcttagctatcacgcaacctgtagtaaagccgaggttgataagtttaaggccgcaaacattcctttggtcagtgaactggcaatcgacgacattcattttgacgacttttccctggatgtggacgccatgatcaccgcagcactccgcatgttcatggagctgggtatggtgcagaagtttaaaatcgactacgagacgctctgtaggtggctactgaccgtgcgcaagaactacagaatggttctctaccacaactggagacatgcattcaatgtgtgccaactcatgtttgctatgcttacaacggctggcttccaggacatcctaaccgaagtggagatcctggcagtgatcgtcggctgtctgtgtcacgatctggatcaccggggtactaacaatgccttccaggctaagtccggctccgcactggcccaactgtacggaacgtcggccaccttggagcaccatcatttcaaccacgcagtaatgattctccagtctgaagggcataatatttttgcgaatctttcctctaaagagtactccgacttgatgcagctgctgaagcagtcaattctcgccacagacctgaccctctacttcgagcgcaggacagagttcttcgaattggtgtccaagggtgaatatgactggaacattaaaaaccaccgtgacatcttcaggtctatgttgatgaccgcctgcgacctgggcgctgtgacgaagccctgggaaatctccaggcaggtggctgagctggtgacctcggagttcttcgagcagggggatcgggaacgtctggagcttaaactgaccccatcagcgatttttgataggaatcgaaaagacgaactccctagacttcagctggaatggattgacagcatttgtatgccactctatcaggctcttgttaaggtaaacgtcaagctgaaaccgatgctggactccgtggccaccaacagatccaagtgggaggaactgcatcagaaaaggcttttggccagcaccgctagcagctcaccggcaagtgtgatggtggctaaggaggaccggaattag

SEQ ID NO: 234676 - DNA, 375 bp, Artificial Sequence
  Description of Artificial Sequence: Synthetic coding sequence
atgttgatgaccgcttgcgacctaggcgctgttactaaaccctgggaaatttcccgacaagtggctgagctggtgacaagtgaattttttgaacaaggcgacagggaacgccttgagcttaaattgactccatctgctatcttcgacagaaataggaaggacgagcttccgaggctgcaattggagtggatcgatagtatttgcatgcctctgtaccaggcactggttaaagtgaacgtgaagctcaaacccatgctcgactcagtggccacaaaccgcagcaaatgggaagagctgcaccagaaacggctgctggcaagtactgcctcaagctcaccagcatctgtaatggtggcaaaggaagataggaattag

SEQ ID NO: 234677 - DNA, 1638 bp, Artificial Sequence
  Description of Artificial Sequence: Synthetic coding sequence
atgggttcgtcggcaacagagatagaagagctcgaaaataccaccttcaagtaccttacaggagaacagacagagaagatgtggcagaggctgaaaggcattctccgctgtctggtgaaacagctcgagcgcggagacgtgaacgtcgttgacttgaaaaaaaatatagagtacgcagcctccgtactggaggctgtgtatatagatgaaacacggcgtctacttgacaccgaggatgaactaagtgacattcagactgactccgttcccagcgaggtgcgggactggttggcttccacattcaccaggaaaatggggatgaccaagaagaagcccgaggagaagcctaagtttaggagtatcgtgcatgccgtgcaggcagggatttttgtggagcggatgtacagaaagacctaccacatggtcggactggcctaccccgcagctgtgatagtcacactgaaggacgttgacaagtggtcctttgatgtgtttgccttaaatgaggcttcaggggaacacagcctgaaatttatgatctatgagttgttcacaagatacgacctcattaatagatttaaaatcccagtgagctgcttgattacatttgccgaggctttggaagtgggctactccaaatacaaaaatccatatcataatctcatacacgccgctgatgtgacacagacagtgcactatattatgttacacaccgggatcatgcattggctgaccgagcttgagatactggccatggtgttcgcagctgctatacacgattatgagcacaccggaactacaaataactttcacatccaaaccagatcagatgtcgccatcctctataatgatcgctctgtcttagaaaatcatcacgttagcgcagcgtatcgactgatgcaggaagaggaaatgaatatcctcatcaaccttagtaaagatgattggcgagatctcaggaacttagtcatcgaaatggtcctgtcaactgatatgtcgggccactttcagcagataaagaatatcaggaactccctgcaacagccggaaggtattgatcgcgctaagactatgagtctgatcctgcacgccgctgatatctcgcatcccgcaaagagctggaagctacactatcgctggactatggctctcatggaggagttttttctgcaaggggacaaggaagccgagctaggacttcctttttctcccttatgtgacagaaaaagcactatggtggcacagagtcagataggtttcatcgacttcatcgttgaaccaaccttcagtctcctcaccgactcaaccgagaagatcgtgatccccctgatcgaggaagcaagtaaagccgagacttctagctacgtggcttcttctagcactactattgtggggctgcatatcgccgatgcactccgcaggagcaacacaaaggggtcaatgagtgacggcagctacagtcctgactactccttagccgctgtcgacctgaaaagttttaaaaataacctggtggacatcatccagcagaataaagaacgttggaaagagttggccgctcagggtgagagcgatctgcataaaaatagtgaggatctggtcaacgctgaagaaaaacacgacgaaacccacagttag

SEQ ID NO: 234678 - DNA, 1536 bp, Artificial Sequence
  Description of Artificial Sequence: Synthetic coding sequence
atgggcaaaaaaatcaataaactgttctgcttcaatttcctagtgcagtgctttagaggcaagagtaaaccttctaaatgccaaatccggaaaaaggtcaaaaaccacatcgaaagattgcttgacaccgaggatgaactaagcgacatacagacagattctgttccaagcgaagtcagggactggctcgcttctacattcacaaggaagatgggaatgacaaagaagaaacccgaggagaagccaaagtttagaagtatcgtgcacgctgtccaggctggaatcttcgtggaacggatgtatcgaaagacttatcacatggtgggtttagcttaccccgcagccgtgattgtaacgctgaaggacgtggacaagtggagctttgatgtgtttgcgctgaatgaggcctctggggagcactcattgaagtttatgatttatgaactatttaccaggtacgacctgattaaccgcttcaagattcctgtttcctgcctcattactttcgccgaggctctggaagttgggtactctaagtacaaaaacccttatcacaacctaatccacgctgccgatgtaacacaaactgtgcactatattatgctgcacactggcatcatgcattggctcaccgagcttgaaatcctggcaatggttttcgctgccgctatacacgattacgagcacaccggcactaccaacaacttccacattcagacccggtcggacgtagccatcttatataacgaccgcagtgtcctggagaatcaccacgtctccgctgcctaccgcctcatgcaggaggaagagatgaatatcctaataaacctgtccaaagacgattggcgtgacctccggaatctcgtaatagagatggtgctcagcactgacatgtcaggacatttccagcagataaagaacattaggaactctctgcagcagcctgagggcatcgaccgggctaagacgatgagcctgatactccatgcagcggatataagccacccagcaaaatcgtggaagctgcattacaggtggaccatggcccttatggaggagttttttctccagggcgacaaagaagccgagctcggcctgccgttcagcccgctgtgtgacaggaagtcaaccatggtcgcccagagtcagatcggatttatagacttcatcgtcgaacctacattctctctgctgacagattcgacagaaaagatcgtgattccactgattgaagaggcgtcaaaagcggagacatcttcctacgtcgcctctagcagcactacgatcgtgggcctccatattgctgatgctctaagaaggtctaacaccaagggcagtatgtccgacggttcgtattcccccgactatagcctcgctgcggtcgatttgaagagcttcaagaataaccttgtggatatcattcagcagaacaaggagcgctggaaggaactggccgcacagggcgaatcagacttgcataagaacagtgaggacttggtcaatgctgaagagaagcacgatgagactcactcttag

SEQ ID NO: 234679 - DNA, 1560 bp, Artificial Sequence
  Description of Artificial Sequence: Synthetic coding sequence
atggacgatcacgtgaccatacgaaagaagcatcttcaacggccaatcttcagactccgttgtctggtgaagcaactggaacggggagacgtgaacgtggttgatctgaaaaagaatattgaatatgccgcttcagtgttagaagcggtctatattgatgaaactcgacgtcttcttgataccgaggacgaattaagtgacatccagacagattccgtccccagtgaagtccgggactggctggcctccactttcacccgcaagatgggtatgaccaagaaaaaacccgaagaaaaaccaaagttccgatcaatcgtgcacgccgtgcaagcaggcatatttgtggaaagaatgtaccggaagacttatcacatggtcggtctggcatatccagccgcagtgatcgtgactctgaaagacgtggacaagtggagcttcgatgtgtttgctctaaacgaggctagtggcgagcattctctgaaatttatgatttacgagttgttcacaaggtacgatcttatcaatcgttttaaaattccggtgtcctgtctcattacatttgcggaggctctcgaggtgggatattcaaagtacaagaatccttaccacaatctgatccacgccgcagacgtgacccagactgttcattatattatgcttcacactggcattatgcattggctaaccgaactcgagatcctcgccatggtgttcgcagctgctattcatgattacgaacatacgggcacaacaaataacttccatatacagaccagaagtgatgtggccattttgtataatgatcgttcagtcctcgaaaaccaccatgtttcggccgcttacaggttgatgcaggaggaggaaatgaacatactcattaacctgtcaaaagatgactggcgcgacctgagaaacctcgtgattgaaatggtcctgtccacggacatgagtggtcactttcagcagattaaaaacatcagaaatagccttcaacaacccgaaggcattgacagagccaagacaatgtcactcatcctccatgccgctgacattagccaccccgctaagtcatggaagctgcactacagatggacaatggctcttatggaagagttctttctccaaggagataaagaagcagaactcggtctgccattctcccctctgtgcgacagaaaatctacaatggtggcacagtcacagatcggtttcatcgacttcatcgtggaacccaccttcagcctattgaccgactcaaccgaaaaaatcgtgatccccttgatcgaagaggcatctaaagccgaaacaagttcatacgtggcctccagtagcaccaccatcgtgggcctgcatatcgctgacgctctgaggcgcagcaacactaaaggatctatgtctgacggttcatacagcccagactatagcctcgccgcagtagatctgaagagctttaagaataacctagttgatattattcagcagaataaagaacggtggaaggagctagcagcacaagaggcacgcacatccagtcagaaatgtgagttcatacatcagtag

SEQ ID NO: 234680 - DNA, 1608 bp, Artificial Sequence
  Description of Artificial Sequence: Synthetic coding sequence
atgggttcgagtgctactgaaatcgaagagctggaaaataccaccttcaagtacctcaccggggagcaaactgaaaagatgtggcagaggctgaagggcatccttcgatgtttggtaaagcagctagaaaggggggatgtcaacgtcgttgacctaaaaaagaacatcgagtatgcggcttctgtcttggaggcggtatatatagacgagaccaggagattgttagacactgaggatgaactgtccgatattcagacagattccgtcccctccgaggtgcgcgactggctggcaagtacgtttacaaggaagatggggatgactaaaaaaaagccagaagagaagcctaagtttaggagtattgttcacgcagtacaggctggcatcttcgttgaaaggatgtaccggaagacctaccatatggtaggattggcctaccccgctgctgtaatcgtgacattaaaagacgtcgacaagtggtcgtttgatgtatttgccttaaatgaagctagcggagagcatagcctcaagtttatgatttatgaattgtttacccggtacgatctcattaatcgattcaaaattccggttagctgtctgattacgttcgccgaggccctggaggtcggttacagcaaatacaaaaacccctaccacaacttaattcacgcagctgacgtgacacagacagtccattatatcatgctgcataccgggattatgcactggctgactgaactggaaatcctggccatggtgttcgcagccgctatccacgactatgagcatactggtaccacgaacaatttccatattcagactaggagcgatgtcgccatcctgtacaatgacagaagtgtacttgagaatcatcatgttagtgcagcctatcgtctgatgcaagaagaggagatgaatattctgattaacctgtcaaaagatgactggcgggatctgagaaatctggtgattgagatggttctgagcactgatatgtcaggccattttcaacagatcaagaatatccggaactcactgcaacagccagagggtatcgacagggcgaagactatgtcgctaattctgcacgctgcggatatctctcacccggcaaagagttggaaactccattacaggtggacgatggctctgatggaagaattcttcttgcagggtgataaagaggccgaattaggtcttccattctctcctttgtgcgatcgaaagagtaccatggttgcccagtcccagatcggattcattgactttatagtagaaccaaccttcagcctgttgaccgattctaccgaaaaaatagtgatcccgctcattgaggaagctagcaaagctgagacttcaagctacgtggctagctcgagtaccactatcgtaggcctccacattgcggacgcgttgcgacgttcaaatacgaaagggtcaatgtccgacgggagctactcaccagactactctctagctgccgtggatctaaagagttttaagaacaacctggtggacattattcagcagaataaagaacgctggaaggagcttgctgcccaagaggccagaactagctcacagaaatgtgaattcatacatcagtag

SEQ ID NO: 234681 - DNA, 1590 bp, Artificial Sequence
  Description of Artificial Sequence: Synthetic coding sequence
atggacgatcacgtgaccatccggaaaaagcatttacagcggcctatctttagactgcggtgtctcgtgaaacagctggagcgcggtgatgtcaacgtggttgatctgaaaaagaacatcgagtatgctgcgtccgtgttggaagctgtgtacatcgacgagacaaggcggcttctcgacaccgaagatgagctgagtgacattcagacagatagtgttccttccgaagtgcgcgactggttggctagcacttttacaagaaaaatggggatgacaaagaagaagccggaggagaaacccaaattccgcagtattgtgcatgcagtgcaggccggaatcttcgtcgagcggatgtatagaaagacctaccacatggtgggcctggcataccctgccgctgtgatcgtgaccctgaaagatgttgacaagtggtccttcgacgtctttgccttgaatgaagccagcggcgagcattccctgaaatttatgatctatgaacttttcaccaggtatgacctgattaataggttcaagattcccgtgagctgtctgattacattcgctgaggcactggaggtcggttattccaagtacaagaacccatatcacaatttaattcacgccgctgacgtgacacagaccgtgcactacataatgctgcatactggcataatgcactggctgacggaacttgagattctggccatggtcttcgccgcagcaatccatgactacgaacataccggcacaacaaacaatttccacattcagactagatcagatgttgctattctttacaacgatagaagcgtgctcgagaaccatcatgtctccgctgcttatagactcatgcaagaagaggaaatgaacattttgattaacctgtctaaggacgattggcgggacctccgaaatctcgtgatcgagatggtgctgagtacagacatgtcaggtcatttccagcagatcaagaatattagaaactctctgcaacagcccgaaggcattgatagagctaaaacaatgtctctaatccttcacgccgctgacatttcccatccagctaaaagctggaagctccattacagatggaccatggctctcatggaagagttcttcttgcagggggacaaggaagctgaactgggactgcccttcagccctctgtgcgaccgcaagtccacaatggtagcccaaagccagataggtttcatagactttattgtcgaaccgaccttcagcttgcttaccgattccacagagaagatcgtgatacccctgattgaggaggcttccaaggccgagacttcttcttatgtcgcatctagcagcacaacaatagttggtcttcatatcgccgacgccctgcgtcgatccaacaccaagggcagcatgtctgacggctcttactctccagattacagtttggccgctgtcgacttaaagtccttcaaaaataatcttgtggacataattcaacagaataaagaacgctggaaagaactggctgcacaaggagagtctgacctccacaagaacagcgaagatctggtaaacgccgaagaaaagcacgatgagacccactcttag

SEQ ID NO: 234682 - DNA, 1608 bp, Artificial Sequence
  Description of Artificial Sequence: Synthetic coding sequence
atgggttcaagcgccacagagatcgaagaactcgagaacactacttttaagtacttaactggcgagcagacagagaaaatgtggcagcggctcaagggtatcttacggtgcctggtgaagcagctggaaaggggggatgtgaatgtggtcgatttgaaaaaaaacatagagtacgccgctagcgttctcgaagccgtgtatattgatgagactcggcgtttgctggacacagaggacgaactcagtgacattcaaactgattctgtgccaagcgaggtgagagattggctcgcttcaacctttacgcggaagatgggcatgacaaagaaaaagcctgaggaaaagcccaaattcagatctatagtacacgccgttcaagccggaatttttgtggaaaggatgtacaggaaaacctatcacatggtggggttggcgtatcccgctgctgtaatcgttacactcaaggatgttgataaatggagcttcgacgtgttcgcacttaatgaggcttccggggagcacagcctgaagtttatgatttacgaactgttcactagatacgacctgattaaccgctttaaaatcccagtgagttgtctgatcacttttgctgaggccctcgaagtggggtactctaagtataaaaacccatatcacaatttgatccatgccgcagacgtgacacagaccgttcactacataatgctacacaccgggattatgcactggctgaccgagctcgagattctggccatggtatttgccgcagctatccacgattacgaacacactggcacaacaaacaactttcatatccagacacggagtgacgtggccatcttgtataatgatcgctcagttctggagaaccaccacgtgtcagccgcataccgactaatgcaggaagaagagatgaacatcctcattaacttgtccaaggacgactggcgcgatcttcggaacctggtcatcgagatggtgctgagtaccgatatgtctggacatttccagcagattaaaaatatcaggaactccctccagcaacctgagggtatagatagggctaaaactatgtcactgatccttcatgcagcagacatctcccatccagcaaaatcgtggaagctgcactatcgctggacaatggctctcatggaggagtttttcctgcagggagacaaagaggccgagctcggcctgccattttctccgctgtgtgaccggaagtccacgatggtggcacagagccagattggtttcatcgactttatcgttgagccgactttctccctcctaacagattccacggagaagatcgtgatacctctgattgaggaagcaagtaaagcggagacatctagctatgtcgctagttctagcaccacaattgtcgggctacacattgcagacgcattaaggcgatctaatactaaagggagtatgtctgatggaagctactcaccagattactctctggctgctgttgatctgaagtctttcaaaaataatttagtcgacatcattcagcagaacaaagaaagatggaaggagctggccgctcaggaagctcgaacaagctcccagaagtgtgagttcatacaccagtag

SEQ ID NO: 234683 - DNA, 1638 bp, Artificial Sequence
  Description of Artificial Sequence: Synthetic coding sequence
atggggtcctcggccaccgagatcgaggaactcgagaacacaacctttaaatatttgaccggagaacagaccgaaaaaatgtggcagcgcctaaaaggcattctgaggtgcctggtgaagcagttagagagaggggacgtcaacgtggtggacctcaaaaagaatatagagtacgccgcaagcgtgctagaagcagtgtacatcgatgaaaccaggagactcctggacaccgaagatgagctcagtgacattcaaaccgatagcgtcccaagtgaggtgcgagactggctcgccagcactttcactagaaaaatggggatgaccaagaagaaacccgaggagaaacccaagtttcggagcatcgttcacgccgtgcaagccggtatattcgtggaaaggatgtatcgtaaaacctatcacatggtcggactagcctatcccgcagctgtgatagttacactaaaggacgttgacaagtggagctttgacgtattcgcactgaatgaggcctccggagagcacagcctgaaattcatgatctatgaattgttcactaggtacgatctcattaataggtttaaaattccagtttcttgcctgatcacatttgctgaagccctggaggtgggttattccaagtacaagaacccctatcacaacctgatccatgctgccgacgtgacacagaccgtgcactacattatgttgcatacagggattatgcattggctgacagagctcgaaattctggcaatggtttttgccgcagcaatccacgactatgaacatactggtacgactaacaattttcatatccagactagatccgacgtagccatactatacaatgatcgctccgtgttggaaaatcaccacgtgtctgcggcatatcgcttgatgcaggaagaggagatgaatatcctcatcaatctctccaaggacgattggcgggaccttaggaacttggtcatcgagatggttctgtctaccgatatgagtggacactttcaacagataaaaaatatccggaactctctgcagcagccagagggtatcgacagggctaagactatgagcctcatattgcacgcagcagacatctctcaccccgcaaaaagttggaaactgcattaccggtggaccatggcgctgatggaggagttcttcttgcagggcgacaaagaggccgagttgggtctgcctttcagcccactctgcgaccgtaagtcgactatggtggcccagagtcagattgggttcattgatttcattgttgagcccacatttagcttgctcactgactctaccgaaaaaattgtaataccactaattgaggaagcgtctaaggccgaaacgtcctcatacgtggctagtagtagtaccactatcgtcggtctccatatcgccgatgcccttcgaagatctaataccaaaggcagcatgtccgatggctcgtattctcctgattattcactcgctgctgtagacttgaagtcattcaaaaacaaccttgtcgatatcatccaacagaacaaagaaaggtggaaggagctcgctgcacagggcgagtccgacctccataaaaactccgaagacttggtgaacgcggaagagaaacacgatgagacccatagttag

SEQ ID NO: 234684 - DNA, 1659 bp, Artificial Sequence
  Description of Artificial Sequence: Synthetic coding sequence
atggggtcaagcgccacggagatagaagagctggaaaatacaacctttaaatatctgactggagagcagaccgaaaaaatgtggcagagattaaaagggatactccgatgcctggttaagcaactggaaagaggggatgtaaatgttgtggatttaaagaaaaacatcgaatacgcagcaagcgttctggaagccgtgtacatagatgagacccgtcgtcttttagataccgaggacgagttatctgacattcagaccgacagtgtaccttcggaggttagagactggctggcctctactttcactcgtaaaatgggcatgactaagaagaaacccgaagaaaagcctaagtttcgctccatcgtacatgcggtgcaggccggaatatttgtggagagaatgtatcggaaaacctatcatatggtcggtctggcctaccctgcggctgtgatcgtgactctgaaggacgtggataaatggtccttcgacgtgttcgccctgaatgaggcctccggagaacactccttgaagtttatgatctacgagctgtttacgcgctatgacctcattaatagatttaaaattcctgtgagctgtctcattacctttgctgaggccctagaagtcgggtattcgaagtataagaacccctatcataatctcattcatgcagccgacgtgactcagacagtccattacatcatgctacatacgggtatcatgcattggctgacagaactcgagattctcgcaatggtgtttgcagcggcaattcacgactatgaacatactggtacaacaaataattttcatatccaaacacggtccgacgtcgctatcttgtacaacgaccggagcgtcctagagaaccatcacgtgtcagcggcttataggctgatgcaagaggaggagatgaacatattgatcaacttgagcaaggacgattggagagatctaaggaacctggtaatcgagatggtacttagtaccgatatgagcggacattttcagcagattaaaaatatcaggaatagtttacagcagcctgagggaatcgacagagctaaaactatgtcactaatcctgcatgccgcagatatctctcatcccgcaaaatcttggaagctccactatcgctggaccatggcgctgatggaggagttttttctccaaggagacaaagaggcagagttagggttgcctttttcaccattatgcgacagaaaaagtacgatggtagctcaatcccagattggatttatcgattttatcgtggaaccgaccttttccctgctcaccgactcaacagagaagatcgtaatacccctcatcgaggaggctagtaaagctgaaacttcctcgtatgttgccagcagttcaactactatagtcggactgcatattgccgacgctctgagacgatccaacactaagggttcaatgtctgacgggtcctactcccccgattattccttggcggctgtggatctcaagtcattcaagaacaacctcgtagacattatccagcaaaacaaggaacggtggaaagaactggccgcacagggctccgtcgtgtacgaagcgctgttaccttctctatctgtgttcacctcaccactccgagtttggattactagctctagatttctcctcctttag

SEQ ID NO: 234685 - DNA, 1326 bp, Artificial Sequence
  Description of Artificial Sequence: Synthetic coding sequence
atgggcatgacgaagaaaaaaccagaggagaaacctaagtttaggagcattgttcacgccgtccaagcagggatctttgtcgagcggatgtacagaaagacataccatatggtggggctggcctaccccgctgctgtgatcgtgacactgaaggatgtggataagtggtcttttgacgtgttcgccctgaacgaggcttcaggtgagcacagcctaaaatttatgatctatgagttgttcactcgctacgatctaattaataggtttaaaattccagtgtcctgtctaatcacctttgccgaggcactcgaagttggatattcgaaatataagaacccctaccacaatctgatccatgctgccgatgtgacccaaactgtgcactacatcatgcttcatactggaatcatgcattggttgaccgagttagagatactcgctatggtgtttgccgctgctatccatgactacgagcataccggaactaccaataattttcacattcagacaaggtccgacgttgctatactgtataacgatcgttccgtgctggaaaatcaccatgtaagtgccgcttaccggctcatgcaggaagaagaaatgaatatcctcattaatctgagcaaagatgactggcgggatcttcggaatctggtcattgagatggtgctctccactgatatgagtgggcattttcagcaaatcaagaacatcaggaatagcctgcagcaaccagaaggtattgacagggcaaaaactatgagcctgattcttcatgccgcagatatctcccaccctgccaagagctggaaattgcactatcgctggactatggcgctcatggaggagtttttcttacagggcgacaaagaggccgaactagggctcccattttctcctctgtgtgacaggaaaagcacgatggtggcacagtcgcagattgggtttatcgattttatcgtggaaccaactttttctctcctaacggacagtactgagaagattgtgatcccactgatcgaagaagcctctaaggctgagactagttcttatgttgcttcttcatctacaacaatcgtgggactgcatattgccgacgccctaaggcggagtaacaccaaaggctccatgagtgacggctcctactcacccgattattccctggcagcagtcgacctcaagagtttcaaaaacaacttggtggatataatccaacagaataaggagaggtggaaggagctcgcagcacagggcgagagcgatttacacaagaactctgaagacttggtgaacgcggaggaaaaacacgatgagacgcacagctag

SEQ ID NO: 234686 - DNA, 1611 bp, Artificial Sequence
  Description of Artificial Sequence: Synthetic coding sequence
atggagctgagtccacgatcacctccggaaatgctcgaggagagtgactgcccatctcccctcgagctgaagagtgctcctagcaaaaagatgtggatcaaactgagatcattacttcgttatatggtgaaacagctcgagaatggagaaattaacatagaggagcttaaaaagaaccttgaatataccgcttcattactcgaagccgtgtatattgacgaaacccgccagatcctggacactgaggacgaactacaggaactgagatctgacgccgttcccagtgaagtgagggattggttagcctctacatttacgcagcaggctagagccaaaggcagaagggcagaagaaaagcctaaatttcggagcattgtccacgctgtccaagccggaatatttgtggaaagaatgttcaggaggacttacacgtccgtgggacctacttattctacggccgtcctgaattgcctgaagaaccttgacttatggtgttttgatgtcttctcattgaatcaggccgcagatgaccacgccctgagaaccatagtgttcgagctgctcactcgccataacctcatctctcgctttaagatcccaaccgtctttttaatgtctttcctcgatgcccttgagaccggatatgggaaatacaagaatccataccacaatcagatacacgccgcagatgtcacccagactgtgcactgcttccttctcaggacggggatggtgcattgccttagcgaaatcgaattgctggcaataatctttgcggctgccattcatgattacgaacatacagggacaacaaactcctttcacatccaaaccaagtctgagtgcgctatagtgtataacgatcggtccgttctggagaaccatcacatttcctctgtctttcggctgatgcaggatgacgagatgaacatttttataaacttaaccaaggacgaatttgtcgagctccgggctctggtgatcgagatggtcctggcaacggatatgtcatgtcatttccagcaggtgaaaacgatgaaaacagcccttcagcagttggaacgcattgacaaacccaaagctttgtccctgctgctgcatgctgctgatatcagtcacccaactaaacagtggctggtgcattccaggtggacaaaagcactcatggaagagttctttcgacagggcgacaaggaagctgaattaggactgccattttctccgctatgcgaccgcactagtacacttgttgcacagtcccagatcggttttatcgattttatcgtggaaccaacattttccgtgctgaccgacgtggccgaaaaatctgtacagcctcttgccgacgaagacagtaagtctaaaaatcagccatctttccagtggcgccagccatctctcgacgtggaggtcggagaccccaatccagatgtcgttagttttaggagcacttgggtgaaaaggatccaggagaataagcagaagtggaaagagagagccgcttccggtataactaaccagatgtcgattgacgaactgtccccctgcgaggaagaagcccctccatcccccgcagaggatgagcacaatcagaacgggaacctcgactag

SEQ ID NO: 234687 - DNA, 1488 bp, Artificial Sequence
  Description of Artificial Sequence: Synthetic coding sequence
atggtgaaacaattggagaacggggaaatcaacattgaggagctgaagaagaatttggaatatactgcttccctgctggaggccgtctatatagatgaaaccagacagattctcgacactgaagacgagctccaggaactaaggtcagacgcagttccatcagaggtgcgagactggctggcctccacattcacacagcaggcccgagctaaaggtaggagagcggaagagaaaccgaaatttagatccatcgtgcatgcagtccaggccggtatttttgtcgagcggatgtttcggcgaacttatacctctgtggggccaacttacagcactgcggtgcttaactgtctgaaaaatctggacctctggtgctttgacgttttctccttaaaccaggctgccgacgaccatgccctccgaacaattgttttcgagctcttaacgagacacaacctgattagccggttcaagatcccgacggtctttcttatgtctttccttgacgcactggaaactggctacgggaaatataagaacccttaccacaaccaaatccacgccgctgacgtgactcagacagtccactgcttcctgcttagaaccggcatggtccactgcctcagcgaaatcgagctgcttgccattatatttgccgctgccatccacgactacgaacacaccggaactacaaactccttccacattcagaccaaaagtgaatgtgcgatagtgtataacgaccggagcgtcctggagaaccaccacataagctccgtctttagactcatgcaggacgacgagatgaacattttcataaacttaacgaaggacgagttcgtggaactacgtgctctggtgattgagatggtgttagctacggacatgagttgtcacttccagcaggtgaagactatgaaaaccgccctacaacaacttgagcggattgacaaacccaaggctctgtccctgctacttcacgcagccgatatttctcatccaaccaaacagtggctggtgcactcgcggtggacgaaagccctgatggaagagttcttccgccagggagataaggaggcagagctcggcctgccattttcccccttgtgcgatcgaactagtacactggtcgctcagtcacagatcggctttattgatttcattgtggagcccaccttttcggtgctgactgacgttgccgagaagtcggtccaaccactggccgatgaggattccaaaagcaagaatcaacctagcttccagtggcggcaaccgagtcttgatgttgaggtgggtgaccctaacccagacgtggtgagtttccgttccacatgggttaagagaatccaagaaaacaaacagaaatggaaggagcgtgccgcaagcggcattactaatcagatgagtatcgatgagctaagcccttgtgaggaagaagctcccccttcgcccgcagaggatgagcacaaccagaacgggaatctcgactag

SEQ ID NO: 234688 - DNA, 1551 bp, Artificial Sequence
  Description of Artificial Sequence: Synthetic coding sequence
atggctaatccagtcccagtgcagcggtctcacctacagggccctatactaagactccggtacatggtcaaacaactggagaatggagagatcaatatcgaggagttgaaaaaaaatttggaatatacggcgtctctcctggaggccgtgtacattgatgagactcgccaaattttggatactgaagatgaacttcaggagttacggtcagacgccgtgccgagcgaagtgcgggattggctggcatccacctttacacagcaggccagggcgaagggccgtagagctgaggaaaagcccaagttcaggagcatcgtccatgccgtgcaagctgggatctttgtggagcggatgtttaggagaacgtacacaagcgttggcccaacttacagtacagcggtgctgaattgtttgaaaaacctggatctttggtgttttgatgtcttcagcctgaatcaggccgcagatgatcatgctctgagaaccatcgttttcgagttattaaccagacataatctcattagccgatttaaaataccaacggttttcctgatgagctttctggatgcattggagacgggctatggaaaatacaaaaacccctatcacaatcagattcatgccgcagacgttacacagactgttcattgtttcttactgcgaaccggcatggtccactgtttatccgaaattgaactgctagctatcattttcgcggcagctattcatgactatgagcacactggcactacaaactcttttcatatccagacaaaaagcgagtgtgctatcgtgtataacgacagaagtgtactggaaaatcatcacatcagttctgtttttagactaatgcaggatgatgaaatgaacatttttatcaatctgactaaggacgaattcgttgaactgcgggcactggtgatcgagatggtattggcaaccgacatgtcttgtcactttcagcaggtgaaaacaatgaaaaccgccctgcagcagttggagcgcatagataagcccaaggctctgtcattgcttctgcatgccgcagatataagtcatcccacaaagcagtggctggtgcacagcagatggaccaaggcattgatggaggagttctttagacagggtgataaggaggccgagttgggcttacctttcagtcccttgtgtgacagaacatccacacttgtggctcaaagtcaaattgggtttatcgatttcatcgtggagcctactttttcagtgcttactgatgtcgccgagaaaagtgtgcagcctctggctgatgaggatagtaagagtaaaaatcagcccagtttccaatggcgccagcctagtttggatgtggaggtgggggaccctaacccagacgtcgttagtttccggtcaacctgggtcaaaaggatccaagaaaacaagcagaagtggaaagagagggctgccagcggcattactaatcagatgtccatcgacgaactttccccctgcgaggaggaggctccgccttcccccgctgaagacgaacacaaccagaacgggaatctggactag

SEQ ID NO: 234689 - DNA, 2310 bp, Artificial Sequence
  Description of Artificial Sequence: Synthetic coding sequence
atgacggatgccggaaacagaaaggaggggttcaagaaatgccgatccgccacattttcaattgatgggtactccttcaccattgtagctaacgaggctggagataagaacgccagacccttggcccgtttctcacggagcaaatctcagaattgcctctggaattccctgatagacggtcttaccggcaacgtgaaggagaagcctcggcctaccattgtgcacgatcctagaccacccgaggagatcctcgccgacgaactgccccagttggatagctcagaggtcttggtcaaaaccagcttccgtctgaggtcactcgttaagcagcttgagagaggcgaagcttccgtcgtagacttgaagaagaacctcgaatatgccgcaactgtacttgaatccgtctacattgacgaaacccggcgactcctggacactgaggatgaactttctgatatacagagcgatgctgtgccaagcgaagttcgcgactggcttgcctctacgttcactcgccagatgggcatgatgctgcgaagatcagacgagaagcccaggttcaaatccattgtccacgcagtgcaggccggaatttttgtggagcggatgtacaggagaacatctaacatggtaggtttgtcctatccacccgctgtgattgaggccctgaaagacgttgataaatggtcctttgacgtattttccctcaacgaggcctctggagaccatgccctgaagttcatcttttacgagctgctgacacggtatgacctgatcagcaggttcaagatccctatctccgctttggtctctttcgtagaggccttggaggtgggatactccaaacacaaaaacccctaccacaacctgatgcacgcggcagacgtcacccagaccgtacattacctgctgtacaagactggcgtagcgaattggctgacagagctggaaatctttgcaataatttttagcgccgctattcacgattatgaacatacaggcaccacaaataatttccacatccagacgaggtccgatcctgctattctgtacaatgaccggagtgtgctggaaaatcaccacctcagtgcagcgtataggttgttacaggatgatgaggagatgaacatcttaattaatctcagcaaagatgattggcgagagttcagaactctggtgatcgagatggtcatggctaccgacatgtcctgccacttccaacagatcaaggccatgaaaaccgcgctgcagcagcccgaggccatcgagaagcctaaagctctgagtctcatgctgcacactgcagacatcagtcacccggctaaggcatgggacttgcatcataggtggacaatgagccttttagaggagttctttcgacagggagatagagaggcagagttaggcctccctttctctcctctgtgtgatcgcaaatcgactatggtggcccagagccaagtggggtttatagatttcattgtggagccaaccttcacggtcctgacggacatgacagagaagattgtatcacccctgatagacgaaacctctcagaccggaggcacgggccagcggaggtcttccctcaactctatctcgtcatctgacgcaaaacgatcgggtgtaaagacgtccggctctgagggatcagccccaataaacaactcagtgatctcagtggattataagtctttcaaggcaacatggacagaggttgtgcacattaaccgcgaacgctggcgtgctaaagtgccaaaagaggaaaaggctaaaaaagaagccgaagagaaggcaaggcttgccgctgaggagcagcagaaggaaatggaggcaaaatctcaggccgaagagggagctagtggcaaagctgagaagaaaacttccggggaaacaaaaaatcaggtgaatggcacccgggcaaacaaatctgacaacccgaggggaaagaatagcaaggctgagaagagctcaggagagcagcagcagaatggcgattttaaggacggaaagaataaaaccgacaaaaaggaccacagcaatataggcaatgatagtaaaaaaaccgatggcaccaagcagcgtagccacgggtcccccgctccaagcacctcctctacttgtaggctgactctcccagtgatcaaacctccccttcgccacttcaagagacccgcatacgcttctagtagttatgcccctagtgtaagtaaaaagactgatgagcaccccgctcgctacaagatgctggatcagagaataaagatgaaaaaaatccaaaacatctcccataactggaatcgcaagtag

SEQ ID NO: 234690 - DNA, 2130 bp, Artificial Sequence
  Description of Artificial Sequence: Synthetic coding sequence
atggagagccccacgaaagagatcgaagaattcgagagtaatagccttaagtacctgcaacccgagcagatagaaaaaatctggcttcgactccgtggcctccgtaagtataaaaagacttcacagagactgcgttctctagtgaagcagcttgagagaggcgaggccagcgtagtggatctgaaaaagaatctagaatacgctgcaacagtgctggaatccgtctacattgacgagaccaggcgcctccttgacacggaggacgagctgagtgacatccagtctgacgctgtgcctagcgaggttagagattggttggcctccaccttcacaaggcagatgggaatgatgcttcgacgcagcgacgagaagccaaggtttaaatccatagtgcacgctgtccaagccggtatattcgtagagaggatgtaccgcagaacctctaacatggtggggctctcgtacccccctgccgtgatcgaggcactgaaggacgtagataagtggtcctttgacgtctttagtctgaacgaggctagcggggaccatgccttgaaattcattttttatgagctgctgaccagatatgatctaattagcagattcaaaatccccatcagcgccttggtctcttttgtggaggctctcgaggtcggctattcaaagcacaagaacccctatcacaacctgatgcacgcagcagacgtgactcaaacggtgcactacctcctgtacaagactggagtggccaactggctgacagaattggaaattttcgctattatattttccgccgcaatccacgattatgagcacacaggcacaaccaacaattttcatatccaaacccgctccgatccggcaattctctacaacgatcgctctgtgctagaaaatcaccatctgtccgcagcttatcgcctgttacaggacgacgaagagatgaacattctgattaacctctccaaggatgactggcgtgaatttcgcactttagtgattgagatggttatggccaccgatatgtcctgccacttccagcagatcaaagctatgaagacagccctgcagcagcctgaagcaatcgaaaaacctaaagcacttagtttgatgctgcacactgccgatattagccatcctgccaaagcgtgggacctgcatcaccggtggacaatgtcgctgctagaagagttttttcgccagggagaccgcgaggccgaactgggtttaccattctcaccactgtgtgaccggaagagtacaatggtggcgcaaagccaagtgggcttcatcgacttcattgtggaaccaacgtttaccgtgctcacggacatgacggagaaaattgtgtctccattgatcgacgaaacctcacagactggagggacaggccagcgcaggagctccctgaattcaattagcagttctgatgcaaagaggtcaggtgtgaaaacatccggaagtgaaggtagcgcccctatcaataattctgtgatcagtgtagattacaaatcatttaaagccacctggactgaggtcgtccatattaaccgggagcggtggcgggcaaaggtcccaaaggaggagaaagccaagaaggaggcagaagaaaaagctaggctcgcagctgaggaacaacagaaggagatggaggccaagtcccaggcagaagaaggggcaagcggaaaggctgagaagaaaacatcgggcgagactaagaaccaagtcaatggaaccagagccaacaaatctgataaccccaggggtaagaatagcaaagccgaaaagtcatctggtgagcaacagcagaatggtgacttcaaagatggcaagaacaaaacggataagaaggatcactcgaatatcgggaacgacagcaagaagactgacgggacgaagcaaagatctcatggatcccctgctccctcgacgtcctctacttgcaggctgaccctgcccgtaattaagcccccacttcggcatttcaaacgccctgcttatgccagttcctcgtacgcccctagcgtaagcaagaagacagatgagcacccagccaggtacaagatgctcgatcagcgcattaaaatgaagaagatccaaaacatcagccacaactggaacaggaagtag

SEQ ID NO: 234691 - DNA, 1905 bp, Artificial Sequence
  Description of Artificial Sequence: Synthetic coding sequence
atggaaagccctaccaaagagatcgaagaattcgaaagtaacagtctcaagtaccttcagccagagcagattgagaagatctggctccggctgaggggccttcgaaagtataagaaaacctcacagcgcctgagatctctggtgaagcagttggaaaggggggaggcctcggtggtggatctgaagaagaatttggagtatgctgccacagtgctggagtccgtatatatcgatgagacacggcgattactggatactgaggatgagctatccgatattcagtccgatgccgtgccaagcgaggtacgcgactggctagcatctacattcaccagacagatgggcatgatgctccgaaggtccgacgagaagcccaggttcaagtctatcgtacatgccgtccaagctgggatcttcgtggaacggatgtatcgcaggactagcaacatggtgggattgagctatccacccgcagtaatcgaggcactgaaggatgtcgataaatggtcctttgatgtcttttcactgaacgaggccagtggcgaccatgctctcaagttcattttttatgaattactcacgcgctatgacctgatcagccggttcaagattccgatttcagctcttgtaagtttcgtggaggccctggaggttgggtacagcaaacacaaaaacccatatcataacctgatgcacgctgccgacgtcacacaaactgtgcattacttgctgtacaaaacaggtgttgcaaactggcttactgagctggaaatcttcgccatcatcttttctgctgctattcatgactatgagcataccggaacaaccaataacttccacatccagacccggagcgaccctgcaatcctgtataacgatagatctgttctggaaaaccaccacctctcagccgcatacaggttgctgcaggatgacgaggagatgaacatcctcataaatctctcaaaggacgactggagggagttccgcactctggtgatcgagatggtgatggccaccgacatgtcttgccactttcaacagataaaagctatgaaaacagctctccagcagcccgaagccattgaaaaacctaaagcactgtccttgatgctgcataccgccgatattagccatcccgctaaagcctgggatctccaccatcggtggacaatgagcctgctggaagagttctttcgacagggagatcgggaagcagaacttggtctacccttcagccctctctgtgaccggaagagcaccatggtggcgcaatcacaggtcggttttatcgattttattgtcgaacctacttttacagtgctcaccgacatgacagaaaagatcgtcagcccattgattgacgagacatcacagacaggagggacgggtcagagacggagttcacttaattccataagctccagcgacgccaagcgatcgggggtaaaaacgtctggcagcgagggatctgccccaataaacaattcggtcatttccgtagactataagagttttaaggccacatggaccgaggtggtacatattaaccgggagagatggcgggcaaaagtccccaaagaggaaaaggcaaagaaggaagcagaagagaaggccagattagccgctgaggaacaacagaaggagatggaggccaagtcccaggccgaagagggtgcatcaggcaaggccgaaaaaaagacctctggtgaaaccaagaaccaggtcaacggcactcgtgcgaataagtctgacaaccccaggggtaaaaattctaaggccgagaagtcatccggcgaacaacagcagaacggtgattttaaagatgggaaaaacaaaactgataaaaaggatcactcaaatataggaaatgacagcaaaaaaacagacgactcccaggagtag

SEQ ID NO: 234692 - DNA, 1905 bp, Artificial Sequence
  Description of Artificial Sequence: Synthetic coding sequence
atggaatctcccaccaaagaaatcgaagagttcgaaagcaattcactgaagtacctgcagcctgagcagattgaaaagatatggctgcggctgcgaggcctgcgcaaatataagaagacctcgcaacgattgcgttctctcgtgaagcagctggagaggggtgaggcttccgtcgtggatcttaaaaaaaacctggagtatgctgccacagtgcttgagtccgtctatatagatgaaactcggaggctactggacacagaggacgagctcagcgacattcaatccgacgccgtgcctagcgaggtccgggactggctggcatccacattcacaaggcagatgggcatgatgttgcggcgatccgacgagaagccacggttcaaatccatcgtccatgctgtgcaggcaggaatttttgtggagcggatgtacagaaggacaagcaacatggtgggcctaagctaccctcctgccgtgattgaagccctgaaggatgttgataaatggtcatttgatgtctttagtcttaatgaagcttctggagatcatgcccttaaattcatcttttatgaattgcttacacggtatgacctgatttcccggtttaagataccgatatcagcactggtgtcttttgtggaggcactcgaggtgggttactcgaagcataagaacccctatcacaatctgatgcatgccgctgatgttacacagactgtccattacctgctgtataaaacgggtgtggctaattggctcaccgagttggaaatcttcgctatcatctttagcgccgcaatacatgactacgaacatactggaacgaccaataattttcacatccagacgaggagcgacccagccattctgtacaatgaccggtccgtgctggagaatcaccatttaagcgctgcataccggctgttacaagatgatgaagaaatgaatatcctaattaatctaagcaaggacgattggagagagttccgcaccctggtgatagaaatggtcatggccaccgacatgtcatgccattttcagcaaataaaggctatgaagacagccctacagcagcctgaagcaattgaaaagccaaaagcactctcgctgatgcttcacaccgctgatatctctcacccggcaaaagcctgggacctccaccaccgctggacaatgtcactcctcgaagagtttttccgtcagggtgacagagaagctgaactggggctgcccttttcgccactgtgcgaccgaaagtcgaccatggtagcccagtctcaggtgggatttatcgattttattgtggaacccactttcacagtgctgacagacatgaccgagaagatcgtgtccccattaattgacgaaacatcccagactggcggaaccggccagcgtcgttccagcctgaatagcatctcttcctcagatgcaaagaggagcggtgttaaaacaagcggatctgagggctcagcccctatcaataacagcgttatttcagtggattacaaaagctttaaggcgacatggaccgaggtggtgcacatcaacagggaacgctggcgcgctaaggtgccaaaagaagaaaaagccaagaaagaggcagaggaaaaagccaggctggctgcagaggaacagcagaaggaaatggaggccaaatcgcaggctgaagaaggggctagtggcaaggcggagaagaagacttcgggcgagacgaagaaccaggttaacgggacccgggctaacaagtctgataatcctcgtggaaaaaactccaaggccgagaagagctccggtgaacaacagcagaacggagatttcaaggatggtaaaaacaagactgacaagaaagatcattcaaacattggtaacgactcaaagaagaccgatgacagccaggaatag

SEQ ID NO: 234693 - DNA, 141 bp, Artificial Sequence
  Description of Artificial Sequence: Synthetic coding sequence
atggagtccccgacaaaagaaatcgaggaatttgaatctaattccctgaagtacctgcagccagagcaaatagaaaagatctggctgcggctccgaggactgcgaaagtacaagaagacgagccagcggttacgcagttag

SEQ ID NO: 234694 - DNA, 2130 bp, Artificial Sequence
  Description of Artificial Sequence: Synthetic coding sequence
atggaaagtcctacgaaggagatcgaggagttcgaatccaactccctcaagtacctccaacctgagcagatcgagaaaatctggttgcgccttcgcggactcaggaaatacaagaagactagccagaggctgcggagcctcgtgaagcagctggagagaggggaggctagcgtagtggacctgaagaagaacctggagtatgcagccaccgtgcttgaaagcgtttacatcgatgagacaagaagactcctggataccgaggatgagttgtccgatatacaaagcgacgcagtccccagtgaggtgcgggactggctggcttccacctttacacggcagatgggtatgatgctgagaaggagcgacgaaaagccccgtttcaaatcaattgtccacgctgtgcaagccggaattttcgtggagaggatgtatcggagaacctctaatatggtgggcctgagctatcctcccgcagtgatcgaagctttgaaggatgtggataagtggtcttttgatgtgttttctcttaacgaagcttcaggagaccacgcactcaaatttattttctatgagcttctaacaaggtacgatctgatctctcgttttaagatccccatatctgccctcgtctcgttcgtcgaagctcttgaggtcggatattccaaacacaagaacccataccataatctcatgcatgcggctgacgtgacacaaactgttcactatttactgtacaagactggagtcgctaactggcttaccgaactggagatattcgcaattatctttagtgctgcgatccacgactatgagcacacaggaaccaccaacaacttccatatacaaaccagatcagatcccgctatactttataatgatagatccgtcctggagaaccatcatctgtcagccgcttaccggctgttgcaagatgacgaggaaatgaacattctgattaacctcagtaaggatgactggagagagtttcggaccctggtgatcgaaatggttatggccaccgatatgtcatgtcattttcagcagataaaggcaatgaaaaccgccctgcagcagcccgaagcaatcgaaaagcccaaggcactgtctctgatgttgcacaccgcggatattagccaccccgctaaggcctgggacctgcatcacaggtggaccatgagcttgctggaggagtttttccgacagggagatcgtgaagccgagctgggactgcccttttcacccctttgtgacagaaaatctacaatggtagcccagagtcaggtcggcttcatcgacttcatcgtggaacccacttttaccgtactcaccgatatgaccgagaaaatcgtgtcacccctaatagatgaaacctcgcagaccggaggcacaggacagcgcaggagcagcttgaactctatcagcagctctgatgcaaagaggagtggcgtcaagaccagcggatccgagggatctgcaccaatcaataactcggtgatttccgtcgattataaatctttcaaggccacctggaccgaggtcgtccatattaaccgggagcggtggcgggcaaaagtgcctaaggaagagaaggccaaaaaggaagcggaggagaaggctaggctcgccgctgaggagcagcagaaggagatggaagcgaaatcacaggccgaagagggagcatctgggaaagccgagaagaagacatctggcgagaccaagaaccaggtgaacggaaccagagccaacaaaagtgacaaccctaggggtaaaaattctaaggccgagaaaagctccggggagcagcagcaaaatggagacttcaaagatgggaagaacaagactgacaagaaggaccactctaatatcggtaacgactcgaagaaaacagatggaaccaagcagaggtcccacggcagcccagcccctagtacatcaagtacatgtagactgaccctgcccgtcataaaaccccctctgaggcactttaaacgcccagcttacgcaagctcctcctacgcacccagcgtgagtaagaaaactgacgagcaccctgcaaggtataaaatgctggaccagcgtataaagatgaaaaaaatccagaacatttcacacaactggaaccgaaagtag

SEQ ID NO: 234695 - DNA, 3339 bp, Artificial Sequence
  Description of Artificial Sequence: Synthetic coding sequence
atgcgtcgggacgagagggatgctaaagcgatgaggtccctgcaaccacctgacggcgctggatctccgccagagtcactgcgtaacgggtatgtgaaaagctgcgtctctcccctccgccaggacccccctcgaggatttttttttcacctgtgcagattttgtaatgtcgagctaaggccgcctccagcaagtccccaacagcctcgcaggtgttccccgttttgccgggcacggctctcacttggcgcattggctgctttcgtgttggccctgctgttaggggcagaaccagaaagttgggcggctggagccgcatggctgagaacccttctaagtgtgtgttcccacagcttgagccccctattttctattgcctgcgccttcttttttctcacatgcttcctcactaggaccaagcgcggacctggcccaggtcggtcctgcggctcttggtggctgctcgcacttccggcttgctgctatctgggcgacttcttggtgtggcagtggtggagttggccatggggggatggggatgcagggtctgcagcgccacatacaccaccggaagcggctgcgggtcgtctgctgcttgtgttgagttgcgttggactcttgctgaccctggctcaccctttgaggctccggcactgtgttttagttcttttgctggcctcattcgtgtggtgggtatctttcacaagtctgggtagtctgccaagcgccctcaggcctctcctttctggcctagtgggaggcgctgggtgtctgcttgcccttggcctggatcactttttccagatcagagaagccccacttcacccacgtctgtcctcagccgcagaagagaaggtgcccgtgatccggccaaggcggaggtctagttgcgtgtctctaggggagactgcggcaagctactacgggtcctgtaaaatcttccgaaggccttcattgccttgcatcagtcgggagcagatgattttgtgggattgggacctcaaacagtggtacaagccccactatcagaacagcggtgggggaaatggcgtcgatctgtctgtactcaatgaggcgcgtaatatggtttccgatctattgaccgatcctagcctgccaccacaggtgatttcttctctccgctccatatcgtcgcttatgggagcgttcagtggttcctgcaggcccaagatcaaccccctcacccccttccccggattctacccatgcagcgaaattgaggaccctgccgagaagggcgacagaaagctgaacaagggactgaataggaactccctccctacaccccagttgcggaggagttcaggcacctccgggctgctccctgtggaacagagtagtaggtgggataggaacaatggcaagagacctcatcaggaatttggcatttcaagtcaaggttgttatttgaatgggcctttcaactcaaaccttcttacaattcctaaacagcgaagcagctctgtgagcctgacccatcacgtgggactgcggagagcgggtgtgctttcaagtctgagccccgtcaatagcagcaaccacggccctgtttcaactggctcattgaccaaccgaagcccaatagaatttccagacaccgccgactttctgaataagcccagtgtgatcctccagaggagtctgggcaatgcacctaatacacctgatttctaccagcagttgcgcaactcggacagcaacctgtgtaatagttgcgggcaccagatgctgaaatacgtaagtacctcggaatctgacggcacggattgttgcagcggaaaatcaggggaggaagagaatattttcagcaaagagagctttaaactgatggaaacacagcaggaagaggagactgagaagaaagactcgagaaaactgttccaagaaggcgacaaatggctcactgaggaggcccagtccgagcaacaaacgaacattgaacaggaagtcagcctcgatctcatcctggtcgaggagtacgactccctcatcgagaagatgtctaattggaatttcccaatcttcgagctcgttgaaaagatgggggaaaagagcggacgaatcctgtcccaggtgatgtataccctcttccaggacaccggcctgctggagatcttcaagattcctacgcagcagtttatgaactattttcgcgcacttgaaaatggctatcgcgatattccttatcataatcgtatccatgccactgacgtgctgcacgcggtctggtaccttacaacacgcccagtgcccggtttgcagcagattcacaacggctgtggtaccgggaatgagactgactcagacggcaggattaatcacggaaggattgcctacatctcatctaagtcatgttcaaaccctgacgaaagctacgggtgcctgtccagcaacatccctgcactggagttgatggcgctctatgtagccgctgctatgcacgattacgatcaccctggccgaacgaacgcatttctcgtggcaaccaatgcacctcaggcagtgttgtacaacgaccgcagcgtacttgaaaaccaccatgccgcttcggcctggaatctgtatctcagccgccctgaatacaatttcctccttcacctcgaccacgtcgagttcaagaggttccggtttctagtgatcgaggccattcttgccactgacttgaaaaaacactttgattttctcgcagagttcaacgccaaggcaaatgatgtcaatagcaacggaatcgagtggtccaacgaaaacgacagactgttggtgtgccaggtgtgtatcaaactggcagacatcaacggacctgctaaggtgcgcgacctccacttgaagtggaccgaggggatagtgaacgaattttatgaacaaggcgacgaagaggctaacctcggtctgcctatctccccttttatggaccgctcctcccctcaactggctaagctgcaggagagttttatcacacacatcgtcggccctttatgcaacagctatgacgccgctggtttgctcccgggacagtggctggaagcagaggaagataatgacaccgagagcggcgacgatgaggatggcgaggaattagacacagaggatgaggagatggaaaacaacctgaacccgaagccacccaggagaaagtccagaaggcgtattttctgtcagctcatgcaccatctcacagaaaatcataagatatggaaagagattgtcgaagaagaggaaaagtgtaaagccgacgggaacaagcttcaggtcgaaaactcatcgctgccacaggctgatgagattcaggtgatcgaagaagccgacgaggaggaatag

SEQ ID NO: 234696 - DNA, 3186 bp, Artificial Sequence
  Description of Artificial Sequence: Synthetic coding sequence
atgaggagggacgagcgcgatgcaaaagccatgaggagcctgcagcctccagatggagctggtagccccccagaaagcctgcggaacggatatgtcaaatcctgtgtgagccctttgcgacaggatcccccacgcggttttttctttcatctttgtcggttttgtaatgtcgagctgcgcccaccacccgcttcccctcagcagcccaggagatgctccccgttctgcagggccaggttgtcactaggcgctcttgcagcctttgtgctcgcactcctactgggcgctgaaccggagagctgggctgcaggcgctgcctggctaaggacgctgctctctgtgtgttctcactctctctcacctctgttcagtatagcctgcgcctttttttttcttacctgttttttgactcggaccaaaagaggtcccggaccagggagatcttgcggttcttggtggctgctagcactgcctgcgtgttgctatttgggcgacttcctggtttggcaatggtggtcctggccctggggcgacggggatgccggatccgcggcaccccacacaccccctgaagccgcagccggaaggttgttactcgtactcagttgcgtaggtcttctcctcaccttggcccaccccctccggttacgccactgtgtgctagttctgctgctcgcgagcttcgtctggtgggtaagctttacctcactgggatcccttccttcagctttgcgtccactgctgtcaggccttgtcgggggagccggatgcctgcttgccctgggcttagatcatttctttcagatccgagaggccccacttcatcctaggctctccagcgcggctgaggagaaggtgccagtgattcggccaagaaggagatcaagctgcgtatcacttggggagactgccgctagctactacggatcttgcaaaattttccgcaggccaagcttgccctgcatcagtagggagcagatgattttgtgggactgggacttaaagcagtggtacaaaccacattaccagaactctgggggtggtaatggcgtggacctgagcgtcttgaatgaagcgcgaaatatggtctccgacctactgacagatcctagtctcccaccgcagggcctgaatcgtaattcactgcccacacctcaactgcgcagaagcagcggaaccagcggcctgctccccgtggaacaaagctctcggtgggatcggaataatggcaagcgccctcaccaggagtttggaatcagtagccagggctgctacttgaatggacctttcaatagtaacctcttgacaatccccaagcagcggtctagttctgtgtcgctcacacaccacgtggggctgagacgggctggcgtactcagctcattgagccccgtgaactcttcaaatcacggaccagtgtccacaggatctctcaccaatagatcaccaattgagttccctgatacagccgactttctgaataaacctagcgttattctgcaacgaagcctgggtaacgcacctaataccccagatttctaccaacaactgagaaacagtgacagcaacctgtgcaactcctgcgggcatcagatgctgaagtacgtgagcacgagtgaaagcgatggaacagattgctgtagcggtaaatcaggtgaggaggagaacatattcagcaaagagagctttaaattaatggaaacgcagcaggaagaggagacggaaaaaaaggactccaggaagttgtttcaggaaggggacaagtggttaaccgaggaggcacagagtgagcaacaaaccaatatcgagcaggaagtctctttagacctaatacttgtggaagagtacgattcacttatcgagaaaatgagcaattggaacttccccattttcgaactagtagaaaaaatgggcgaaaaaagcggcagaattcttagtcaggtaatgtacacgctgttccaggatacagggctattggaaatttttaagatacccacccagcagttcatgaattactttagagccctggagaatggttaccgagacatcccttaccataatcgaattcacgccacagatgtcctgcacgcagtgtggtacttaacaaccagacctgtgcctggtctccaacagatccataacgggtgcggcactgggaatgagactgacagcgacggaagaattaatcacggtaggattgcttacatttcctccaagtcctgctctaatccagacgagtcctacggatgtctcagcagtaacattcccgctctggagctgatggctctatacgtcgctgctgctatgcacgactatgaccatccagggaggactaacgcctttctggttgctacgaacgcacctcaggccgtcctttataatgatcgctctgtcctggagaatcaccacgctgccagtgcatggaatctgtacttgtcgcgcccagaatataatttcctcctgcacttagaccatgttgagttcaagcgcttccgatttctcgtcattgaggctattcttgccacagacttgaagaaacattttgatttccttgcagagttcaatgccaaggcgaatgacgtaaatagtaacggaattgagtggagcaacgaaaacgacagactcctagtttgccaggtgtgtatcaaattggccgacataaacggacccgctaaggttcgcgacctacatctcaagtggactgaagggattgtcaacgaattctatgagcagggagatgaggaagcgaatcttgggcttccgatttccccgttcatggatagaagctcccctcagctggccaagttacaggagagttttatcacgcacatcgtcggaccgctatgcaacagctacgatgctgccggtctcctgcctggacagtggcttgaggccgaggaggataacgatacagagagcggcgatgacgaggacggggaagaactggatacagaggacgaggaaatggaaaacaacctcaacccaaaaccgccacgacgtaagtcccggagaaggatcttttgccagctgatgcatcatcttaccgagaatcacaagatctggaaggaaatcgtggaagaggaggagaagtgtaaagcggacggcaacaagctgcaggtggaaaactcctccctgcctcaggccgacgaaatccaggtgattgaagaggctgacgaggaggagtag

SEQ ID NO: 234697 - DNA, 2583 bp, Artificial Sequence
  Description of Artificial Sequence: Synthetic coding sequence
atggcaagaccaagaggactgggcaggatccctgaattgcaactggtggcttttcccgttgcagtcgcagcagaagatgaagcctttttgcctgagccacttgctccccgagccccacgccgtccaaggagccccccatctagtccggtgtttttcgcttctccatcccccacattccgccgtcggttgcgcttgctacgctcctgccaggacctgggcaggcaggcttgggccggtgcaggattcgaggcagaaaacggcccaacacccagtcccggtagatcccctcttgactcccaggcctctcccggactggtgctgcatgctggtgcagccacttctcagcggagggagtctttcttgtacaggagtgattccgattatgatatgtcacctaagactatgtcgaggaactccagcgtcaccagcgaggcccatgccgaggatctcatagtgactccgttcgcgcaagtcttggcgtccctccgtagcgttcggagcaacttttccttgctcaccaacgttcccgttccatccaacaaaagatctcctctgggcggtcctacccctgtatgcaaagctactctgagtgaggaaacgtgccaacagctggcccgtgagacacttgaagagttggattggtgcctcgagcagctggagacgatgcagacatatcgttccgtgagcgaaatggcgagccataaattcaagaggatgctgaatcgtgaactcacccatttgagcgagatgtcccgctctggtaaccaagtgagcgaatacatttcaaccaccttcctggataagcaaaacgaggttgagataccttcaccaaccatgaaagaacgggaaaaacagcaggctccacggcctcggccatctcaacctccacctccacccgttccacatctccagcccatgtcccagattaccggcctcaaaaaactcatgcacagcaacagccttaacaactccaacataccccgattcggagttaaaactgaccaggaagagttgctggcgcaggaacttgagaacctgaataaatggggactgaacattttctgtgtttctgattatgccggagggagatccttgacatgtataatgtacatgatcttccaagagagagatctgcttaaaaagttccgtattccggtcgatacaatggtgacatatatgctgacactggaggaccactatcatgcggacgtggcttatcataacagcctgcacgctgccgacgtgcttcagtcgacccacgtattgttggccactcccgctctggacgccgtcttcacagacctggaaatcttggcagctttattcgcagctgccattcacgatgtggaccaccctggtgttagtaatcagttcctgattaataccaactccgagctggcgctgatgtacaatgacgagtccgtgctggaaaaccaccacctggcagtgggttttaagctgcttcaggaggacaactgcgatatatttcagaacctttcaaagcgccagcgacaatcactgcgaaaaatggttatcgatatggtgttggcaactgatatgagtaagcacatgactctgctggccgacctgaagacaatggtcgagactaaaaaggtgacatcttctggcgtgttactgctcgacaattattccgaccgaatacaggttctaagaaatatggtacattgcgctgacctctccaatccgaccaaacccttggagctctatcggcagtggacagacaggattatggcagaattttttcagcagggcgatagagaacgagaacgtggtatggaaataagccctatgtgtgataagcacaccgcctccgtggagaagtcccaggtaggtttcatcgattacatcgtgcaccctctgtgggagacctgggcagatctcgtacatcctgacgcacaggagatcctggacactcttgaagataaccgggattggtattatagcgcaattaggcagtccccaagtccgcctccagaagaggagagccggggacctgggcatcccccactgccggataagtttcaatttgaactgacgttggaggaggaggaggaggaagaaatcagtatggcgcaaatcccctgcactgcccaggaggccctgaccgcccaaggactctcgggcgtggaggaggccctggatgccactattgcctgggaggcgagcccggctcaggaaagcctggaagtcatggcccaagaagctagcctggaggccgagcttgaggcagtttatttgactcagcaggcacagagcaccgggagcgctccagtggcccctgatgagttttcttcccgagaagagttcgtcgtggccgtgtcacattcatctcctagcgccttagcacttcaaagtcccctgctgcccgcttggcgcactttgagcgttagtgaacacgccccaggactccccggtttgccttcaaccgcagccgaggtcgaagcacaacgcgagcaccaggctgccaagcgcgcatgcagcgcttgcgcagggacttttggtgaagacaccagcgccttgcctgcccctggtggcggtgggagtggcggagaccctacttag

SEQ ID NO: 234698 - DNA, 1944 bp, Artificial Sequence
  Description of Artificial Sequence: Synthetic coding sequence
atgccactggtagactttttctgtgaaacgtgctccaagccctggctggttggctggtgggatcagtttaagaggatgttgaaccgcgaactgactcatcttagtgagatgagccgctccgggaaccaggtttccgagtacatctccactacctttttggacaaacagaacgaagtggaaatcccgtccccgaccatgaaagagagggaaaagcagcaggctccacgacctcgcccatcacagcctcctccgccacccgtcccccacctgcagcccatgtcccaaattactggacttaaaaagctcatgcattctaacagtcttaacaactcaaacattccgagattcggagtcaagacagatcaagaggaactactggcacaggagctggaaaacctcaataaatggggccttaatatcttctgtgtgagtgactacgccggaggccgttccttaacatgcattatgtatatgatttttcaggagcgtgacctgttgaaaaaatttcgcatcccagtagatactatggtgacgtacatgcttacccttgaggatcactatcacgcagacgtcgcctaccacaattccctgcacgccgctgatgtgcttcagtctacccatgtactccttgctactcctgcactggacgcagtgtttaccgatctagagatcctggctgcactattcgctgcagctattcatgatgtcgaccaccctggagttagcaatcagtttttgatcaacacgaatagcgaactggcactgatgtataatgacgagagtgtcctcgagaaccatcacctcgccgtcggtttcaaattgcttcaggaagataactgtgacatttttcagaacttatcaaagaggcagaggcagagcctgcgaaaaatggttatcgatatggtgttggcaacagacatgtcaaagcacatgaccctgctggccgacctgaaaacaatggttgagacaaagaaggtcacctcctccggcgtgcttctgctcgacaattactccgacaggattcaggtgctaagaaacatggtgcattgtgcggacctgtcgaatcctaccaagccattggagctgtacagacagtggacagataggatcatggccgagttcttccaacaaggtgacagagaaagagagcgcggtatggagataagcccgatgtgcgacaaacacacagcaagtgtagagaagagtcaggtgggctttattgattatatcgtgcatccgctatgggagacttgggcggatctggtgcatccagacgcccaagaaatcttggacacattagaggataacagggactggtattactcagctattaggcagagccccagtccccctccagaagaagagagtagggggccaggccaccctccgttgcccgacaaatttcaattcgagctcacattggaagaagaggaggaggaggaaataagtatggcgcagattccctgtaccgcccaggaggctctcacagctcaggggctttcgggcgtcgaggaagcactggatgcaaccatagcctgggaggcgtccccagctcaggaaagcttggaggtgatggctcaggaggcctccttggaggctgaacttgaggctgtgtatctgacacagcaggcccaatccactggcagcgcaccggtagcgccagatgaatttagtagtcgagaagagtttgttgttgctgtgagtcattccagtccaagtgccctcgcactgcagagccctctgctgccggcatggcggacattgagcgtgagcgaacacgcacctggcctgcccggtctcccctctacagctgccgaggtggaggcgcagcgcgaacaccaggccgctaaaagggcctgctcggcctgcgcagggactttcggagaggatacctctgccctgccagctcctggaggcggtggatcggggggagaccctacgtag

SEQ ID NO: 234699 - DNA, 2661 bp, Artificial Sequence
  Description of Artificial Sequence: Synthetic coding sequence
atggagccacccaccgttcccagtgaacgatccctgtcactaagtttacccggaccgagggaggggcaggcaaccctgaaacctcccccacagcacctctggcgacagcccagaacaccaatccgcatccagcagaggggttatagcgacagcgcagaacgggcagagcgcgagcgccaacctcatcggccaattgaacgagctgacgccatggacacctctgacagacccggactgcgcaccacacgaatgtcatggcctagcagctttcacggaaccggcactggatcaggcggagccggtggcggatcctctcgcaggttcgaggccgagaacgggcctaccccaagcccgggaagaagccctcttgatagtcaggcgagcccagggctggtcctacacgccggtgccgcaacttctcagcgcagagagagttttctgtaccgctctgactcagactacgacatgtctcccaaaactatgtcccggaattctagcgttactagcgaagcccatgccgaagacctgatcgttacaccctttgcacaggtacttgcctccctgcggagcgtacgctctaacttttctctactgactaacgtgcccgtgccttcaaataaaagaagtcccctgggagggccaactcccgtgtgtaaggctacactctcagaggagacctgtcagcagctggccagagagacgctcgaggaactggactggtgtttagaacagctggagacaatgcagacctaccggtctgtgtctgagatggctagccacaagttcaaacggatgctcaacagagaactcacccatttgtctgagatgtcaagatctggcaaccaagtctccgagtacatttctacaacattcctggacaagcagaatgaagtcgagatcccctctccaactatgaaagagcgcgaaaaacaacaggccccaagaccacgtcctagtcaacccccaccacccccagtccctcaccttcagccgatgagccagattaccggactgaagaagctaatgcattcaaatagcctgaacaattctaatatccctagattcggggtgaaaaccgaccaggaagagctgctggctcaagagctggagaatctcaataagtggggattaaacatcttctgtgtaagcgactatgccggaggcaggtctctgacgtgcattatgtatatgatcttccaggaaagagacctgctgaagaagtttcgcattcccgtggacacaatggtgacatacatgttgactttagaagaccattaccatgcagacgtggcataccataatagcctgcacgcagcagacgttcttcagagcacacacgtattgctggcaacccccgctctggacgcggtattcaccgacttagagatcctggctgcactttttgccgcagctatccacgatgtggatcacccgggtgtaagcaaccaatttttgataaacactaattctgaactggcgttaatgtacaacgacgagtctgtcctggagaaccaccatttggcggtcgggttcaagctgctccaagaggataattgcgatatattccaaaatctgtccaagcgacagcgacaaagtctccgaaagatggtcattgatatggtgctggctaccgacatgtccaagcacatgacactgttagcggatctgaagacaatggtagaaaccaaaaaagtcacttcgagtggcgtgctgctgcttgacaattatagtgaccggattcaggtcctgcgcaacatggttcattgtgccgacctctcaaatcccacaaagcccctcgaactgtatcgacagtggacggaccggatcatggccgagttctttcaacagggggatcgggaacgcgagcgcggaatggagatctcccccatgtgcgataagcacactgcttcagtcgagaaaagccaagtaggctttatcgattatattgtgcaccctctctgggagacttgggctgacctcgtgcaccccgatgcgcaggagatcctagacaccttggaagacaatcgagactggtactactccgccattcgtcaatcccccagtccccctcctgaggaggaaagcagagggcctggacacccccctctccctgataaatttcaatttgaacttaccctggaagaggaggaggaggaagagattagcatggcccaaatcccttgtacagctcaggaagccctgaccgcacagggcctgagtggagtggaggaggccctcgatgcaacaatagcttgggaggcctcccctgcccaggagtcccttgaggtcatggcacaggaagcaagtttggaggctgagttggaagcagtttatctcacacaacaggcccagtctaccggtagtgcaccagtcgcccctgatgaattttcctcccgagaggagtttgttgtcgctgtcagccatagttccccgagcgcacttgccctgcagagccccctgctccccgcatggaggaccctgtcagtgtcagaacacgcgcctggcctcccaggactgcccagcactgccgctgaggtcgaagctcagagggagcaccaagctgctaaaagggcctgttccgcgtgtgctggcacatttggagaggatacctccgccttaccagccccagggggaggaggttcagggggtgacccgacctag

SEQ ID NO: 234700 - DNA, 972 bp, Artificial Sequence
  Description of Artificial Sequence: Synthetic coding sequence
atggtccttccgtccgaccagggcttcaaactgttggggaatgttctgcagggacctgagccctatcgccttctcacgtccggactcaggctacatcaagagctggagaacctgaacaaatggggcctcaatattttttgcgtctccgactacgcgggaggaaggagcttgacctgcattatgtacatgatcttccaggagagagatctcctgaagaaatttcggatacccgtggacaccatggtaacctacatgctcacactcgaggaccattaccacgccgacgtggcctatcataacagtttgcacgcagctgacgtcctgcagagtactcacgtcctgctcgccactcccgcattggatgccgtgtttactgacctggagattctggctgccctcttcgctgccgctatccatgacgtggaccacccgggtgtctctaatcagttcctaataaacactaattcagaactcgcactgatgtacaacgacgagtcggtgctggaaaatcaccaccttgcagtcggattcaaattattacaggaggacaactgcgatatttttcagaatctgagtaagaggcaacgccagtccctgaggaagatggtgatcgacatggttctcgccacagatatgtccaagcacatgaccctgcttgccgacctaaagaccatggtggaaactaagaaagtaacatctagcggagtactcctgctggataattattcagacaggatccaagtcctgcgcaacatggtccactgtgctgacctgtctaatccgaccaaaccacttgagctttacagacagtggacggatcgtataatggctgagttcttccagcagggagacagggagcgtgagcgaggcatggagatcagccctatgtgtgataaacatacggcaagtgtggagaaaagtcaggtacaggctcgagggattgatggccgagcccagggtgaattctactag

SEQ ID NO: 234701 - DNA, 2595 bp, Artificial Sequence
  Description of Artificial Sequence: Synthetic coding sequence
atgaagcgtagccgatccgcactgagcgtcgccggaaccggcgatgagcggtctcgggaaactcccgaaagtgaccgtgcaaatatgttaggagcagacctccgacggccaaggaggagactgtcctcagggccaggactgggctgggcgcagcctgagccatccgatcccggagtcccgttgccgcctaggcctacgaccttacctttactgattccacccaggatttctatcacaagagcagaaaatgattcctttgaagccgagaacggccctacccccagtcctggacggtcccctctcgacagtcaggcgtccccaggcttggttctgcacgccggtgctgcgacctcccagcgcagagagagctttttgtataggtccgacagcgactatgacatgtctccaaaaaccatgagtaggaattcctccgtgacttcggaagcacacgctgaggatctgatagtgacaccctttgctcaggtactggcatccctcaggtcagtgcgtagcaacttctccctgctgactaacgtgcccgtgcccagcaacaagcgctctccccttggcggaccaactcccgtatgcaaagcaaccttatcagaggagacctgccagcagcttgccagagagacgctggaagagctagattggtgcctcgagcagcttgagacaatgcagacttaccggtcagtctcggaaatggcttcccataaatttaagagaatgcttaatagagagctgacacatttgtctgagatgagtaggtccggtaaccaggttagtgagtacatctccactactttcttagataaacagaacgaggtggagataccttctcctactatgaaggagcgtgagaagcagcaagctcctagaccccgtcctagtcagcctccaccccctcctgttcctcacctccagcccatgtcacagatcaccgggcttaagaagctcatgcactcgaactccctgaacaattctaatatccccaggtttggagtcaagaccgaccaggaggaattgctggcccaagaactggagaacctcaacaagtgggggcttaacattttctgcgttagcgactacgcaggcggaagaagcttgacatgcataatgtatatgatttttcaggagagagacttgcttaagaaattcagaatccctgtcgataccatggtgacatacatgttgacactggaggatcactatcacgccgacgtggcctaccacaactccttgcacgcggcagatgtactccagtctacacatgtgctcctggctacacctgccctagacgctgtcttcaccgatctggagatcctggctgctctcttcgccgctgccatccacgatgtggatcaccccggtgtgagcaaccaattcctgatcaacacaaattctgaactggcgctcatgtataatgacgagagcgtgttagagaatcatcacctggccgtcggctttaaactcctccaggaggataattgcgacattttccagaacctgagtaaacgccagcggcaaagtctccggaaaatggtcattgatatggtcctggcaacagacatgagcaagcacatgactcttcttgctgatctgaagactatggttgagaccaagaaggtgacctcctccggcgtcttgctgctggacaactacagcgatcggatacaagtccttaggaacatggtgcattgcgccgacctgtcaaatcccacaaaacccctggagttgtatagacagtggacggaccggataatggcagaatttttccagcagggtgaccgtgagcgcgagcggggaatggaaatttcccccatgtgtgacaaacatacggcctctgtggaaaagtcccaggtggggttcatcgactatatcgtgcatccactctgggagacatgggctgacttggtgcaccccgacgctcaggaaattctggacactctggaagataaccgggattggtactattctgcaatacggcaatcccctagccctccccctgaagaagaaagccgaggccctggacacccaccactgccagataaatttcaatttgagcttacactggaagaggaagaagaggaggaaattagcatggcacaaataccgtgcacagcccaggaggctctgaccgcccagggcctgagcggagtggaggaggccctggacgctaccatcgcctgggaagcttcaccagctcaagaaagtcttgaggtgatggctcaagaagcaagcctggaggccgagctagaagccgtatacttgacacaacaggctcagagcacaggctctgcgccagttgcccctgatgagtttagtagtcgcgaggagttcgtggtggccgtctcacattcctcaccgtccgcgctggcactgcagtctccactccttcctgcctggaggacattgtccgtctccgagcatgcccctggtctgccgggtttaccctccacagctgctgaggtagaggcccagcgggagcaccaggcagcgaaaagagcgtgcagcgcatgcgctggcactttcggcgaggacaccagcgctctgccagccccaggcggagggggaagcggcggagatccgacctag

SEQ ID NO: 234702 - DNA, 309 bp, Artificial Sequence
  Description of Artificial Sequence: Synthetic coding sequence
atggtggagaccaaaaaggtcacaagcagcggtgtgctactgctggataactacagtgatagaattcaggtgctgaggaacatggtacactgtgcagaccttagcaatcccaccaagccccttgagctctaccgacagtggaccgatcgcattatggccgagttttttcagcagggggacagagaaagagaacgtgggatggaaatcagtcctatgtgtgataaacacaccgcttctgtcgagaaaagtcaggtcggtttcatcgactatatcgttcacccattatgggaaacatgggctgatctctag

SEQ ID NO: 234703 - DNA, 2478 bp, Artificial Sequence
  Description of Artificial Sequence: Synthetic coding sequence
atgcggagcggcgctgctcctagagctcggccacgccctccagccctggccctcccgcctacaggaccagaaagcctcactcattttcccttctccgatgaggacacgaggcgtcatcccccaggcagatccgtcagcttcgaggccgaaaacgggccaactccttctcctggaaggtcgcctcttgattcccaggccagccctgggctggtgttacatgccggagctgcaacctcccagagacgggagagttttctctatcgctcagacagtgactacgatatgagccctaaaacaatgagtaggaattctagcgttacctcagaagcacacgccgaggacctaattgtgaccccttttgcccaggtcttggcctcattgaggagcgtgcgatcaaacttttccctgctgacaaacgtgcccgtgcctagcaataaaaggagccccctgggcggacccactcccgtgtgcaaagcaacgctgtctgaggagacatgtcagcagctcgcaagagagacactggaagagttggattggtgccttgagcagctggagaccatgcagacctaccgtagtgtatctgagatggccagtcataaattcaagcgcatgctgaaccgagagctgacccacttgtcagagatgtcaagatccggcaaccaggtttccgagtatattagcactacatttcttgataagcagaacgaggttgagattcccagcccaaccatgaaagaaagagaaaagcagcaggccccaaggcccagaccctcacagccacctccgccacctgtgccccatcttcagccaatgtctcaaattaccggcctgaagaaactcatgcatagcaattcactgaataatagcaatattccccgttttggtgtcaaaacggaccaggaggagttacttgcgcaggagctcgagaatctgaataagtggggcctgaacatattctgcgtgagcgattatgctggagggagatctctgacgtgcatcatgtacatgattttccaagagagagatctgctgaagaaattccggatccctgtcgatacaatggtgacatacatgcttacactggaagatcactaccacgcagatgtcgcttaccacaatagccttcatgctgccgacgttctgcagtccacacatgtgctgttagctacacctgctcttgatgcggtctttacagacctggagattctggcagccctgttcgcagctgccatacatgacgtagatcacccgggagtgagtaaccagttccttataaacacgaactcggaactcgccctgatgtacaatgatgagtccgtcctggaaaaccaccatcttgcagtgggattcaagctgcttcaggaagacaattgtgacatctttcagaatctgagcaagcggcagcgccagtctctgcgtaagatggtcatcgacatggtcctcgcaacggatatgtccaaacacatgacactgctcgcagacctgaagacgatggtggaaactaaaaaggtaacatccagcggggtcctgcttcttgacaactactctgataggatacaggttctgagaaatatggtgcattgcgctgatttgagtaaccccaccaaaccgctcgagctgtaccgtcaatggactgatcggatcatggccgaattttttcagcaaggagacagagagcgggagagaggtatggaaattagtcctatgtgtgacaagcacacagcaagtgttgaaaagagccaggtgggtttcattgattacattgtccatccactgtgggaaacctgggctgatcttgtccatcccgatgcccaggagattctggatacccttgaggataatagagactggtattacagcgccatcagacaatctcctagccctccacctgaagaagagagccgaggccctggtcacccacctctgcctgacaaattccagttcgaattgaccttagaagaggaggaggaggaagaaatcagcatggctcaaattccgtgcacagcccaagaagctctgaccgcccagggtctgtctggcgttgaagaagccctggatgctaccatcgcatgggaagcatctcccgcacaggaaagtctggaggttatggcacaggaagcctccctagaggcagaattggaggctgtctatctgacccagcaggctcagtctacaggatcagctcctgttgccccagacgaattcagctctagagaagaatttgttgtagctgtgtcccatagctctccatccgcactggccctgcagagcccattgttaccagcatggaggacgctgtccgtatccgaacacgccccaggactgccaggactcccttctactgcagctgaggtggaagctcagagggagcatcaagctgctaagagagcctgctccgcatgcgctgggaccttcggagaggatacttctgctttgcccgcaccaggcggtggcggttcgggaggcgatcccacctag

SEQ ID NO: 234704 - DNA, 2211 bp, Artificial Sequence
  Description of Artificial Sequence: Synthetic coding sequence
atgaagaagtcacggagtgtgatgactgtaatggccgatgacaacgtcaaggactactttgagtgctctctgtccaagtcgtactctagttcctctaacaccttagggatcgacttgtggcgcggacgacgctgctgttccggcaatctgcagctgcctcccctgtcccagagacagagcgagcgcgctagaacacctgagggtgacggtatctctcgtcccactactcttccgctgacaaccctcccatcgatagcaataactaccgtaagccaggagtgtttcgatgtggagaacggaccaagtcccggacgaagcccgctcgaccctcaggcgtcctcctcggcaggcctggttctgcacgccacattcccaggacattcacaaaggcgtgagtcttttctctaccgatctgacagcgattatgacctaagcccaaaagctatgagtcgtaacagcagcctgccatcggagcaacacggtgatgatctgatcgtgacgccgttcgcccaagtactcgcgtccctgcgaagtgtgagaaataatttcacgatcctcaccaatttacacgggaccagcaacaagcgcagccctgctgcctcccagcctcctgtgagcagagtgaatcctcaggaggagagctatcaaaaactggccatggagacgctcgaagaactggattggtgcctagaccagctcgagaccatacaaacctataggtccgtgagcgagatggcctctaacaagttcaaacggatgttgaaccgggaactgacccatctctctgagatgtctcgcagcggtaaccaggtgtccgaatatatatcaaacacatttttggacaaacagaacgatgtggaaatcccttcacccacacagaaagatagagaaaagaaaaaaaagcagcagttgatgacccaaatctctggcgtcaaaaagctgatgcacagttcatcgcttaacaatacgagcatttctcggttcggtgttaataccgagaacgaggatcacttagcgaaggagctggaggaccttaacaagtggggactcaacatctttaacgtagccggatactcccataatcggccactgacctgcataatgtatgctatttttcaggaacgggatctgttgaaaacctttcggattagcagtgatacttttattacatatatgatgactttagaagatcattaccactccgacgtagcctaccacaactcactgcatgccgcagacgtggctcagtcaactcatgttttgctgagcacccccgcattagatgccgtctttaccgatttggaaattctggccgctattttcgcggctgccatacatgacgtggatcacccaggggtctctaaccagtttttgataaacacaaattccgaattggcactcatgtataacgacgagtcagtgctagagaatcaccatcttgctgttggatttaaattgctccaagaggaacattgcgatatatttatgaatctgaccaaaaaacagcgacaaactctgcgtaaaatggtgatcgacatggttctggctaccgatatgtccaaacacatgtcattattggccgacctgaagacgatggtagaaacaaaaaaagtaacaagttcaggcgtgctgctgctcgataactataccgatagaatccaggtgctcaggaacatggtacattgtgctgatttatccaatccgaccaagagcctggaactttatagacaatggacggatcgcattatggaggagttcttccagcagggcgataaggagcgggagcgagggatggagatttccccgatgtgcgacaaacacactgcatccgttgaaaaaagtcaggtcggctttatcgactatatcgtgcatcccctgtgggagacttgggcagatctcgtgcagccggacgctcaggatatactagacaccctggaggacaaccgtaactggtatcagtccatgatcccccagtctcctagcccacccctggatgaacaaaaccgcgattgccaaggcctgatggagaaatttcagtttgagctgactctggacgaggaagactccgaaggcccagagaaagagggggagggccacagttacttcagtagtacaaagacgctttgcgtaatcgaccctgaaaatcgcgactctcttggagaaacagatattgacatcgcaaccgaggataagagcccagtggatacatag

SEQ ID NO: 234705 - DNA, 2211 bp, Artificial Sequence
  Description of Artificial Sequence: Synthetic coding sequence
atgaagaaaagccgttctgtcatgaccgttatggccgacgataatgtgaaagattactttgagtgctctctgagtaagagttattcgtcaagctcaaacactctcggaattgatctgtggagggggaggcgctgttgctccggaaatctgcagctgccgcctttatcgcagcggcagtccgagcgggctcgcactccagaaggggatgggataagtcggccaactactctgcctctaacaaccttaccatccatcgctatcaccaccgtttctcaggaatgcttcgacgtggaaaacgggccatcacccggtcggtcgcctctggatcctcaggcgagttcctctgcaggtttggtactccatgccacttttcccggtcacagccagcgaagggagtcctttctttatcggtcagactcagactacgacctttcccccaaggcaatgtctcgtaattcctcactcccttccgagcagcacggggacgatttaatcgtcaccccttttgcccaggtactggccagcctgcgatcggtgaggaataacttcaccatcctgacgaacctgcacggaacctccaacaagagatcccccgcagccagccaacctcctgtctcacgagtgaacccccaggaggagtcctaccagaaactggccatggagacgctagaggagctggactggtgtttggaccagctagagactatccaaacttacagatcagttagcgagatggcgagcaataagtttaaaagaatgctgaaccgagagttgacccacttaagcgaaatgtctcgttctggaaatcaagtctcagagtacatttctaacaccttcttggataagcaaaacgatgttgaaattccatccccaactcagaaagatcgtgaaaagaagaaaaagcagcagttgatgacccagataagcggggtgaaaaagctcatgcacagctcgtccctgaataacacctcaatatctcgcttcggcgttaataccgaaaacgaggatcatctggctaaggaactggaggatctgaacaagtggggtctgaacattttcaacgtggccggttattcccacaatcgccctcttacctgcataatgtatgcaattttccaggagcgcgatctactgaagactttcagaatcagcagcgatactttcataacatacatgatgacgctggaggatcactatcactctgacgtggcttatcacaactctctccacgccgcagacgtggcacagtcgactcatgtgttattatcgactccagccttggatgctgtgttcaccgatttagaaattctggccgctatcttcgccgcagccatccacgatgtcgaccatcccggtgtcagcaaccagtttctcattaataccaattccgaactagcccttatgtacaacgacgaatcagtgctagaaaaccatcacctcgccgtagggtttaagctgctgcaggaggagcactgtgatatcttcatgaatcttactaaaaaacagaggcagacactgcgtaaaatggtaatcgacatggtcctagccaccgacatgtccaagcatatgtcccttctcgcagatttaaagacaatggtggaaaccaaaaaggtgacttcaagcggagtactactgttggataattataccgacagaattcaggttctcagaaatatggtacattgtgctgacctcagtaaccccactaagagcctcgagctgtataggcagtggaccgaccggataatggaggagtttttccagcagggcgacaaggaacgcgagagggggatggagatcagcccgatgtgcgacaagcacacagcgagtgtcgagaaatctcaggttggattcatcgattacatcgtgcacccattgtgggaaacatgggctgatcttgtgcagccagacgcccaagatatcctggacacattagaggacaacaggaattggtatcagtctatgattcctcagtctccaagcccccctttagacgagcagaacagagactgccagggcttgatggagaaattccagtttgagttgaccttggatgaagaagacagcgagggccctgaaaaggagggagaaggacattcttacttctccagcaccaagactctctgcgtgattgatcctgaaaaccgggattccctgggcgagactgatatcgatatcgccaccgaggacaagtcaccagtggacacatag

SEQ ID NO: 234706 - DNA, 1695 bp, Artificial Sequence
  Description of Artificial Sequence: Synthetic coding sequence
atgaaggagcatggcggaactttcagcagcaccggtatcagtgggggaagtggggattcagctatggattccctgcagcctctgcagcccaactatatgccagtgtgtttgtttgccgaggagagctaccagaaactggccatggaaaccctagaagaactagattggtgcctggaccagctcgaaacaatccagacttaccgcagcgtaagcgaaatggccagcaacaagtttaagcgaatgctgaatagagagcttacgcacctttccgagatgtccagaagcggcaatcaggtcagcgagtatatttccaataccttcctcgacaagcagaacgatgttgagatcccctctcccactcagaaggaccgggaaaaaaaaaaaaagcagcagcttatgacccaaatctctggtgtcaagaaactgatgcatagctcctcactcaacaacacgtccatcagcagattcggggtgaatactgaaaacgaggatcacttagcaaaagagctggaggatctgaataagtgggggctgaacattttcaacgtggcaggctacagtcacaaccgaccactgacctgtattatgtacgccatattccaagagcgggatcttcttaagacttttaggatctcctcagatacgttcattacatacatgatgaccctggaagaccactatcacagtgatgttgcatatcacaactctctgcatgccgctgatgtcgcacagtctacccacgtgttactgagtacacccgctcttgacgccgtattcacagacttggagattctcgcggctatcttcgccgcagctatccatgacgtggatcaccctggggtcagtaaccagttcctcatcaacacaaacagcgaactggctctgatgtacaacgatgaatcagttctggaaaaccaccaccttgctgtgggttttaaactccttcaggaagagcactgcgatatcttcatgaatcttactaaaaagcagagacagacattgcgcaaaatggtgatcgatatggtcctggctaccgatatgtcgaagcatatgagcctacttgccgacttaaagaccatggtggagactaagaaggtgacatcatccggggtactgttactggataactacaccgaccgaatccaggtactgaggaacatggtgcactgtgccgacctgtcaaaccctactaaaagtctcgagctgtatagacagtggacggacagaattatggaggagtttttccagcagggagataaagagagagagcggggaatggaaatcagtccaatgtgcgacaagcacaccgcctcagtggaaaagtcacaggtcgggtttattgactacatagtgcatccgctttgggagacatgggccgatctggtgcagcctgatgcccaggacattctggataccctggaggacaatcggaattggtatcaatctatgatccctcaatccccttctccgccactggatgagcaaaaccgggattgtcagggcctgatggagaaatttcagtttgagctaactctggacgaggaggattccgagggccctgagaaggaaggggaggggcactcctacttctcctccaccaagacactctgtgtgattgacccggagaatcgggactcactgggagaaactgacatagatattgcaaccgaagataaatctccggttgacacgtag

SEQ ID NO: 234707 - DNA, 2211 bp, Artificial Sequence
  Description of Artificial Sequence: Synthetic coding sequence
atgaagaaatcccgttcagttatgacagtgatggccgatgataatgtgaaagattacttcgagtgctctctgagcaagtcttattcctccagttccaataccttggggattgacctgtggcgaggtcgtagatgttgctccggcaatctgcagctgccgccattatctcagagacagtctgagcgggcacggacccccgagggcgacggcatatctcgtcctaccactctgccattgactaccctgccgagcatcgccatcacaactgtgtcccaggagtgcttcgacgtggagaacgggccttcaccaggtagaagtccgctcgatccccaagctagcagtagcgccggtctggttttacatgccaccttccccggtcattctcagcggagggaatctttcttgtaccgctcagactccgattacgacctgagtcctaaagccatgtccaggaacagctcattgccgtctgagcaacacggagacgatctaatcgtaacccctttcgcccaggttctggcatcactcagatccgtgcggaacaactttactattctgaccaacctccacggcaccagtaataaaagatctccagccgcatcccaacctccagtcagtagggttaatccacaagaggaatcttaccagaaactggccatggagacgctcgaagagctggattggtgcctcgaccaattggagacaatccagacctaccggtctgtttcggagatggcctccaataagtttaagcggatgctgaacagagagcttactcatctatcagaaatgtccagatccgggaatcaggtcagcgagtacatcagcaacacatttcttgataaacaaaacgacgtcgagatccccagcccaacgcagaaggatagggagaaaaaaaagaaacagcaactgatgactcagatttctggcgtaaaaaagctgatgcactcttcttctctgaacaatacttcaatctcgcgattcggtgttaacactgaaaacgaagatcacctggccaaggagctcgaggacctgaacaagtggggactaaatatcttcaacgtggcgggatactcacataaccgccctttaacctgtattatgtatgccatctttcaggagagagatctcttgaagacatttcgcatctcttctgacacgtttattacatatatgatgacattagaggaccactatcacagcgacgtggcttaccataatagcttgcatgcagcagatgtcgcccagtcaacgcatgtcctgctcagcaccccagcactggacgcagtgttcactgaccttgagatcctagccgctattttcgccgcagcgatacatgacgtagatcaccctggggtttccaaccaattcctcatcaacacaaacagcgaactcgctctgatgtataacgatgagtccgtgctcgagaatcaccatctggccgtgggctttaagctgcttcaagaggagcactgcgacattttcatgaatcttacgaaaaagcagcgccagacactccggaagatggtcattgacatggtactcgccaccgatatgagtaaacatatgagtctgctggctgatctaaaaactatggttgaaaccaagaaggtgacctctagcggcgtcctactgctcgataactataccgaccggatccaggtcctccgcaacatggtccactgcgccgacttatctaacccaactaaatctctggagctgtatcgccagtggaccgaccgcatcatggaggagttcttccagcagggcgataaagaacgggagcgaggcatggaaatctccccaatgtgcgataagcacaccgcctcagtggagaaatcccaggtgggtttcattgattatatcgttcaccctctgtgggaaacctgggctgacttagttcagcctgatgcacaggacatcctcgacacgctggaagataaccggaactggtaccagtcaatgatccctcaatcgccctctccacccttagatgagcaaaacagggattgccagggcctcatggaaaagtttcaattcgagctgacactggacgaagaagactcggaaggacccgaaaaagaaggcgagggacactcatattttagctccacaaagactctgtgcgtaatcgatcctgagaatagagactccctgggggagaccgacatcgatatcgccaccgaggacaaatctccagttgacacctag

SEQ ID NO: 234708 - DNA, 2166 bp, Artificial Sequence
  Description of Artificial Sequence: Synthetic coding sequence
atgactgccaaggacagttctaaagaactgactgccagtgaacctgaggtgtgtatcaagacatttaaagagcagatgcacctggagcttgagctgccacggctaccgggtaatagacccacatccccaaagatatcacctcgcagtagccctagaaacagcccctgtttcttcagaaaactattggtgaataagtctatcaggcaaaggcggagattcacggtcgcccacacatgcttcgacgtcgagaacggaccatctcccggtcggagccctctcgatccccaagccagttcgtctgcgggtttagtgttgcacgcgacttttccgggacattctcaaagaagagaaagcttcctttaccggagcgattcagactatgatttgtcccctaaggcaatgagccggaattcctccctcccctcagaacagcatggcgacgacctcatcgtaactccattcgcccaggtgctggcctctttgcggtctgtacggaacaactttaccattctgacaaacctgcatggaacatccaataaaagatcccctgccgcttctcagccccctgtttcccgcgtgaaccctcaagaagaaagttatcagaagctggccatggaaaccctcgaggaactggattggtgccttgaccagctggagaccatacagacttatcgcagcgtgtcagaaatggccagtaacaagttcaaaagaatgcttaacagggagctgacccacctgtccgaaatgagccgcagtgggaatcaggtgtctgagtacatctctaacacctttctggacaagcagaatgacgtggagattccgtcaccgactcagaaggaccgagagaagaagaaaaagcagcagctgatgactcagatctctggcgtgaagaaactgatgcatagcagcagtctgaacaatacatccattagtcggtttggagtgaacaccgagaacgaggaccaccttgcgaaggaactcgaggatctcaataagtggggactcaacatcttcaacgtcgctggatattcgcacaatagaccgctgacatgcataatgtacgctattttccaggagagagacttgttgaagaccttcagaatcagttccgacacatttattacatatatgatgacgttggaagaccactaccatagtgatgtggcctaccataactcgctccatgccgcagacgtcgcacagagtactcatgtattgctcagcactcctgcattagacgcggtattcaccgatctcgaaattctggcggctatcttcgcagccgcaatccatgacgtggaccacccaggagtgtcgaatcagttcctcattaacaccaattctgagctcgccctgatgtacaacgacgagtctgtgctggaaaaccatcacctggccgtagggtttaaattgctgcaagaagagcattgcgatatattcatgaaccttacaaaaaaacagaggcaaactttacgtaagatggtaatagacatggttctggccaccgatatgagcaaacacatgtcactgctcgcagatcttaaaactatggtagaaacaaagaaagtcacctcatcaggtgttttgctcctggataattatacagatcgcatccaggtcctgcggaatatggtgcattgtgccgacctttctaatcctacaaagtcgcttgagctttacagacagtggactgatagaatcatggaggagttttttcagcaaggtgataaggagcgggaaagaggcatggagattagccccatgtgtgacaaacatactgcctctgttgagaaatctcaagttgggttcatagattacatcgtccaccctctttgggagacttgggccgatttggtccagcccgatgcccaggacattttagacacactcgaggacaatagaaactggtaccagagcatgattccccagtccccttcaccccctttagatgagcagaaccgggattgccagggactcatggagaaatttcagtttgagcttactctagatgaggaagactcagaaggtcccgaaaaggagggagagggtcatagctactttagctcaactaaaaccctctgtgtcattgatcctgaaaatcgggattcactgggcgaaactgatatcgacatagccaccgaggataagtctccagttgatacatag

SEQ ID NO: 234709 - DNA, 2043 bp, Artificial Sequence
  Description of Artificial Sequence: Synthetic coding sequence
atgcaggggccaccagccccagccccagtaccaggaccaggctcccccagaggcagtccaaggggcagtccaggcctgttccgaaaactgttggtaaaccaatcaattcggctgcagagacgcttcactgtggcacaccctctctgcttcgatttggaaaacgggctgagttgcggacgcagggctttagatccccagtccagccccggactgggcagaataatgcaggccccagtaccccatagccagaggcgcgagagctttttatatcggagcgacagtgactacgaactgtctcccaaagccatgtccaggaactctagtgtggcaagtgatctccatggcgaagacatgatcgtcaccccattcgcccaggtgctggcatctctacggacagtcagatccaacgtggctgccttagcaagacagcaatgtcttggggctgcaaagcaagggccagtgggtaacccttcgagttccaatcagttgcctcccgcagaggatactggacagaaactggctttggagactcttgatgaattagactggtgtctcgaccagcttgagacattacagactaggcattccgtgggggaaatggcaagtaacaaattcaaacggatcctgaaccgagaactgacacacctaagcgagacatcgcgttctggcaaccaggtgtccgagtacattagccgcacatttctggaccagcagacggaagtggaattaccgaaggtgaccgctgaggaagcaccacaacccatgtcccgcatctccgggctgcacggcttgtgccactcagcatcactgtcatcagcgacggttccaagattcggtgtgcagacggatcaagaggagcagctggcaaaggagctcgaagacaccaacaaatggggcctggacgtgttcaaggtggccgagctctccggtaataggcccctgaccgctattatcttcagtattttccaagaacgagatctgctgaagaccttccagatcccagccgacacacttgccacttatctcctgatgctggaaggtcactatcacgcgaatgtagcgtatcacaactctttgcacgcagctgatgtcgcacaatctacccacgtgctgttggccaccccagcactggaagcagtatttacagacctagagatccttgcagccctgtttgccagcgctatccacgatgtagatcacccaggcgtgtcgaatcagttcttgataaacaccaattcggagctcgctctgatgtacaacgatgcctccgtgttggaaaaccaccacttagcagtcggatttaagttgctgcaggcagagaattgtgatatctttcaaaacctgagcgctaagcagagactaagccttcggagaatggtgatcgatatggtcctagctacggatatgtctaagcacatgaatcttttggccgacctgaagactatggtcgagaccaagaaggtcacatcactcggagtcttgctgttggataactatagtgatcggatccaggtgcttcaaaatttggttcactgtgcggacctgtctaatcccaccaagcccctgccgctgtacagacaatggactgacagaatcatggctgagttttttcagcaaggcgaccgggaacgggaaagcgggctcgatatctcacctatgtgtgacaaacacaccgcatctgtggagaaaagccaggtcggcttcattgattacatcgcacaccccctctgggagacgtgggcggaccttgtccatcccgatgcgcaggacctgctcgacactctggaagataaccgcgagtggtatcagtctaaaatcccaagatctccatctgacctcactaatccagaacgcgacggaccggacagattccagttcgagctcaccctcgaggaggccgaagaagaggacgaggaagaggaggaggaaggagaggaaacggcacttgcgaaagaggcacttgagctcccggacacggagctcctgagccctgaagcaggcccagaccctggcgacctccccctggataatcagagaacctag

SEQ ID NO: 234710 - DNA, 1281 bp, Artificial Sequence
  Description of Artificial Sequence: Synthetic coding sequence
atggcgagcaataagtttaagcgaattctcaacagggaacttactcatctaagcgagacatcgagatctggcaatcaagtgagcgagtacatatcccggacctttttagatcagcagacagaggttgaactgcccaaggtaacagccgaagaggcgcctcaaccaatgtcccggatctcgggcctccacggactgtgtcacagtgcctccttgagttccgctacggtaccacgctttggcgtgcagaccgaccaggaggagcaattagccaaggaactagaggacactaataaatgggggctggacgtatttaaagttgcagaactatcaggtaaccgtccactgacggccataattttcagcatctttcaagctgtgtttacggacctggagattctcgctgctctgttcgccagtgccattcacgacgtggatcaccctggagtcagtaaccagttcctcatcaatacgaactcagaattggcactcatgtataacgatgcctccgtactagagaaccaccacctcgctgtcgggttcaagttgcttcaggctgagaactgtgatatatttcagaatctttctgctaaacagaggttgtcattaaggcgaatggtcatcgacatggttctggctacggacatgtctaaacacatgaatttgctcgccgacctgaagactatggttgagacaaaaaaggtaacaagtctcggtgttctgcttttggataattactccgatcggattcaggttctccagaacctcgtgcattgcgcagaccttagcaatcctacaaagccactgccactgtatcgccagtggaccgacaggattatggccgagttttttcagcaaggagacagggaaagggaaagtggcctggatatatcccccatgtgtgacaaacacacggccagtgtcgagaaaagtcaagtgggcttcatcgattacatagcccaccccctgtgggaaacctgggcggatctcgtgcacccagatgcacaggacctcctcgatactttggaggataaccgcgagtggtaccaaagcaagattccacgaagcccatccgatctgaccaacccagaaagggacggcccagacagatttcagttcgaactgaccctggaggaggcagaagaagaggacgaggaggaggaggaagaaggcgaggagaccgctctcgcaaaagaagcattagagcttccagacaccgagctgctatctccggaagcgggtcctgatccgggagacctgccacttgacaatcaacggacctag

SEQ ID NO: 234711 - DNA, 2139 bp, Artificial Sequence
  Description of Artificial Sequence: Synthetic coding sequence
atggagaacttaggggtcggtgaaggcgcagaagcctgctccaggctgagtagaagcagaggcaggcatagcatgacccgagcacccaaacacctttggagacaacctcggagaccgatccgtatccaacaacggttctattccgacccagacaagagtgctggatgccgggaacgcgacctctctcctcggcctgagttacgtaagtctagattatcctggcctgtctcgtcttgtaggcgctttgaccttgaaaacggactgagctgtgggagacgggcacttgatccacagtcatcccctggactgggtcggattatgcaggctcccgtgccgcatagtcagcgacgtgagtccttcctctataggtctgattcagattatgagctgtcacccaaggctatgagcagaaactccagcgtggcctcagacctgcacggagaggatatgatcgtgacgcccttcgcccaggtcctcgcgagcctcagaaccgtgcgcagcaacgtggctgctctggccaggcagcagtgcctgggtgccgcaaagcagggtccggtcggtaatccctccagctccaaccagcttccgcctgcggaggatactggtcaaaaactcgccctagaaacgttggacgagctggactggtgtttagaccagctggagactctccagacgcgacattccgttggggagatggcctccaataagtttaagcggatcctaaatagggaactgacacacttaagcgagacctcaagaagtggaaatcaggtctcagagtatatcagtcgcacatttttagaccagcagacagaagtggagctgcccaaagtgaccgccgaagaggcccctcagccgatgtctcgcattagcggactgcatgggctctgtcactcagcctccctgtcgagtgctaccgtgcccaggttcggggtgcagacagatcaggaagaacagttggcaaaggagctcgaggatactaataagtggggcttagatgtcttcaaggtagctgagctctccgggaacagaccacttaccgctatcatcttcagtatcttccaagaaagggatttgctgaaaacttttcaaattccagcggataccttggcaacctatctgttgatgctcgaagggcactaccacgctaacgtcgcttaccataactctctacatgcagctgacgtggctcagtccacccacgttcttctggccacccccgctcttgaagccgtattcaccgaccttgagatcctggcagccctcttcgcgtccgccattcacgatgttgatcatccaggcgtaagtaatcagtttctgataaacactaattctgaattggcacttatgtacaatgacgcctccgtgctcgagaatcatcacctggctgtcggatttaagctactccaggcagagaattgtgacatcttccagaacctctctgccaagcagcggctgtctctgagacgcatggtgatcgacatggttctggccacagacatgtcaaaacacatgaatttgctcgctgatctgaaaaccatggtcgagactaagaaagtaacgagccttggggttcttctgctggacaattattcagaccggattcaggtcctccagaatctagtgcattgtgcagacctcagcaatccaactaagcccctccccctctaccggcaatggaccgatcgaattatggccgagtttttccagcaaggagatcgggaacgtgagagcggcttagatatctctcccatgtgcgataagcacaccgcctctgtggagaagtcacaggtcgggttcatcgattatatcgctcaccctctatgggagacctgggccgatctagtgcaccctgatgcacaggacctgctggatacactcgaggacaacagggagtggtatcagtctaaaattccgcgaagtccgagcgatcttactaacccagagagagacggacctgatagattccagttcgagctaaccctggaagaggcagaagaggaggatgaggaggaagaagaggagggcgaagagaccgcattagcgaaagaggccctggagctgcctgacacggagctactgagccccgaggctgggccagatcctggcgatctgcctctggacaatcagcggacatag

SEQ ID NO: 234712 - DNA, 1821 bp, Artificial Sequence
  Description of Artificial Sequence: Synthetic coding sequence
atgcaggctccagtccctcattcacagagacgcgaaagttttttgtaccggagcgactccgattatgagctgagcccaaaggccatgagcaggaactcatcagtggcctccgaccttcacggtgaagacatgattgtaaccccttttgcacaggttctggcctccctacgaacagtgcgctctaatgtagctgcattagcaagacagcagtgtctgggggctgcaaaacagggcccagtaggcaacccatcttcaagcaaccagctgccacctgcagaagacacaggccagaaactcgcactggaaactctggatgagctggattggtgtctggatcagctcgagaccctgcaaaccaggcactccgtgggagagatggcaagcaacaaatttaaacgtattctgaaccgagagctgactcacctttccgagactagccgttcaggcaatcaggtttctgaatacatttcccggaccttcctcgaccagcaaaccgaggttgagctgcccaaagtgacggcggaggaggcgcctcagcctatgtcgcggatctcaggactgcatggtctgtgccactctgccagtctgtcatcagctacggtcccacgttttggcgtgcagacagatcaagaagaacagctggcaaaggaactggaggacactaataagtggggcctcgatgtgtttaaagtggccgaactgtcagggaatcggcctttgacggcaattatttttagcatctttcaggagcgagacttacttaaaacgttccagatcccagccgacaccttagctacctacctcttaatgctggaaggtcattaccacgctaacgtagcataccacaactccctgcacgctgccgatgttgctcagtccactcacgtgcttctggctactcctgctctggaagccgttttcactgaccttgaaatcctggcggcacttttcgctagcgccattcatgatgttgaccaccccggagttagcaatcagttcctgatcaacacgaacagcgaactcgcactgatgtataatgatgcaagcgtgctggaaaaccatcatctggccgtgggctttaagctcctgcaagccgagaactgcgatattttccagaacctctcagctaagcagagactgagtctgagaagaatggtcattgatatggtcctggctactgacatgagtaagcacatgaatttgctggccgatctgaaaaccatggtggagaccaagaaggtaacctcactgggcgttttgctactggacaactactccgatcggatacaggtactgcagaatctcgtgcactgcgctgacctctcaaacccaacaaagccactgcctctatatcgccaatggacagatcgaataatggcagagtttttccaacagggtgacagagaacgcgagtcgggactggatatatcacctatgtgtgataaacatacagcctcagtcgaaaaaagtcaagtgggcttcatagactatatcgctcatcctctatgggaaacatgggccgatctggtccaccccgatgcgcaagacttgctggatacgctggaagacaatagggaatggtaccaaagcaagataccccgtagtccctccgatctgactaatccagagcgagatggccctgacagatttcaatttgaattaaccctcgaggaggccgaagaagaagatgaagaagaggaggaggagggggaagagaccgcgctggctaaggaggccctggagcttcctgacaccgagctgctttctcctgaagccggtccagacccaggagatttgcctctcgataatcagcggacttag

SEQ ID NO: 234713 - DNA, 2376 bp, Artificial Sequence
  Description of Artificial Sequence: Synthetic coding sequence
ggcacacaggccggtctaaggagcggtgcacccagcggtcaccgccaactgctaggggtcgggcctacgctgtcacctagcagcaccttctatcgattctcgacctccggggcagattccagcagcctgagccctccactgccggctctgggccgtacacgtgaacagacactgctgggagctcggagcagaggcagggtgctgctccccgctatacccgacccctttctatggcggatggagaatctgggcgtgggggagggggcagaggcatgttccagactgagccgctcgcggggaaggcactccatgactcgcgctcccaagcacctctggaggcagcccaggaggccaattcgcatacagcagcgtttttattccgaccctgacaagagtgccggatgccgggaacgagatctgagccccaggcctgaacttagaaagtccagattgagttggcccgtatcctcttgtaggaggttcgacttagaaaacgggctaagctgtggtagacgcgctcttgacccccaaagctctcctggattaggtaggataatgcaagcgcctgtgccccattcacagaggagggagagcttcctgtaccgaagtgatagcgattacgagctttctccaaaggcaatgtctagaaatagtagcgtggccagtgacctgcacggggaggatatgatcgttacaccctttgcacaggtattggcttccctgcgcacggtgcgaagcaatgttgcggctttggccaggcagcagtgccttggagctgccaaacagggacccgtggggaacccttcatcctcgaaccagctaccacctgccgaggataccggacagaaactcgctttggaaactctcgacgagctggactggtgtttagatcaacttgagacccttcaaactcgacattccgtgggcgagatggcaagcaataagtttaaacgaattctgaaccgcgaactcactcacctcagtgagacctctcgctcaggaaaccaggtctctgaatacattagtaggaccttccttgaccagcagactgaagtggagcttccgaaggtaaccgcggaggaggctccccagccaatgtccaggatttctgggctgcatggcttgtgtcacagcgcctcattgtcctcagccaccgtcccgcgttttggcgtgcagaccgatcaggaagagcagctggccaaggagctcgaagacacaaacaaatgggggctcgatgtgttcaaagtggctgagctcagcggcaataggcccctgactgctattatcttctctatcttccaggagcgcgacttactgaagaccttccagattcccgctgacaccctcgccacctacctgctgatgttagagggccattatcacgctaatgtggcctatcacaattcacttcacgccgcagatgtggcccagagtacacacgtgctgctggctacgcccgctttggaagccgtctttacagatctggagattctggcagctctgttcgcaagcgccattcatgatgtcgatcatccaggggtgtcgaaccaattcttgatcaacacaaattctgagctcgccttaatgtataacgatgcctccgttctagaaaatcatcatttggcagtggggttcaagctgctgcaggcagagaattgcgacatttttcaaaacctgtcggccaagcagcgtctgtccttgcgtagaatggtaatcgacatggtgttggccaccgatatgagtaagcacatgaacctcttagcagatctcaaaactatggtggagaccaaaaaagttacatcccttggagttctgctgctggacaattattcggaccgcatacaggtgctgcaaaacctagtgcactgcgccgacctgtcaaacccaacgaagccattacctctgtatcggcagtggaccgatcggatcatggcagagttctttcagcaaggggaccgggaacgcgagtcgggattagacatcagccctatgtgcgacaagcacacggccagtgtggagaaaagccaggtgggtttcattgattatatagctcacccgctgtgggagacttgggctgacctggttcacccggacgctcaggatttgctggatacattggaagataacagggagtggtaccagagcaaaattcctagatcacccagtgatctgacgaacccggagcgggatggccctgaccgctttcaatttgagctcacactggaggaagccgaggaagaagatgaagaagaggaagaagaaggtgaagagactgcattagcgaaagaggcgctggaactgcctgacactgaactgctgagtcctgaggcagggcctgatccaggggatctcccactggacaaccagaggacctag

SEQ ID NO: 234714 - DNA, 2103 bp, Artificial Sequence
  Description of Artificial Sequence: Synthetic coding sequence
gctgttcaaaagaggagtcgggctgcaggagcgcgatctagccttcacgctgttctggctatgcagggaccaccagcacccgctcccgtgcccggaccaggttcccctcgcggatcaccccgtggctcccctgggctcttcaggaagctccttgtaaatcagagtataaggctgcagagacgatttacagtagcgcacccactgtgcttcgacctggagaatggcttgagctgtgggcgaagagccctcgatcctcaatcttcacctggcctgggcagaataatgcaggctccggttccccacagccagagaagagaaagtttcttatacagatccgacagcgattatgagttatccccgaaggcaatgtccagaaactcttctgtggcctctgatctacatggtgaagatatgattgtcactccattcgctcaagtgttagccagcctaaggaccgtccggagtaatgttgcagcgttagctcgccagcagtgcttaggtgctgcgaaacaggggccagtaggcaatccatcatcatctaaccagctgcctcctgccgaagacactggtcagaaactggccctagaaaccctggacgagctggactggtgtttagatcagctggaaaccttgcagacacggcactccgtgggtgaaatggcctctaacaagttcaaaagaattctaaatagagaactcacccacttgtctgaaactagccggtctgggaaccaagtgagtgagtatattagccggacttttctcgaccagcagaccgaagtggaactgccaaaagtgaccgctgaagaagcaccgcagcctatgagtagaatctctggattacacggcctttgccacagcgcctcattgtcttctgccacagtgcccaggttcggcgtccagactgaccaagaggagcagctggcaaaggagctggaggataccaacaagtggggccttgatgtctttaaggtagcagagctaagcggcaatcggcctctaaccgctatcattttctcaatctttcaagagcgagacctgctgaagacatttcaaatcccagccgacaccttggctacctatcttctgatgttagagggccactaccacgccaatgtggcatatcacaattcactgcacgctgctgacgtggcccaatcaacgcatgtgctgcttgctacacccgctttggaggccgtattcactgatctcgagatcctcgccgctctgtttgctagcgcaatccacgatgttgaccacccaggtgtgtctaaccaattccttatcaacacgaactctgaactcgccttgatgtacaacgacgcgtctgtgctcgaaaaccatcatttagctgtgggattcaagctgctccaggcggaaaactgtgacatctttcagaatctgtcagccaagcagaggttgtcgctcaggaggatggtgatcgatatggtgctggccaccgacatgagtaaacatatgaacctgttggccgacctaaagaccatggtggagactaaaaaagtgactagccttggggtgcttctgctcgataattattctgaccgcatccaagtcctgcagaatttagtacactgtgcagacttgtcaaatccgaccaagcctctgcctttgtaccgccaatggacagatagaattatggctgaattttttcagcagggcgaccgcgaacgcgaaagcggcctggatattagtcccatgtgtgataagcataccgcttccgtcgaaaagtcccaggtgggctttatcgactatatcgctcatcccctgtgggaaacatgggctgacctagtgcatccagacgcccaggacctcttggatacattggaggacaacagggagtggtaccagagtaagatcccgagaagtccgtccgatctgactaatccggagagagatgggccagatcgatttcaatttgagttaacacttgaggaagctgaggaagaagacgaagaggaagaagaggagggagaggagacagcccttgctaaggaagctctggaactcccagataccgaactcctcagtccagaggccggacctgatcctggagatttgccgctggataaccagcggacctag

SEQ ID NO: 234715 - DNA, 1446 bp, Artificial Sequence
  Description of Artificial Sequence: Synthetic coding sequence
atggcatcaaacaagtttaagcgcatcctcaaccgggagttgacgcatttatcggaaaccagtagatccggtaatcaggtgagcgagtatatctctcgcactttcttagatcagcagactgaggttgagctccctaaagtaaccgccgaagaggccccacaaccgatgagtcgcatcagcgggctgcacgggctttgtcacagcgccagcttgtcaagtgctaccgtcccaagattcggggtgcagacggatcaggaagaacagctggccaaggaactggaggatactaataagtggggtctagacgtgttcaaggtcgcagagttatcaggtaatcggccactgaccgcaatcatattcagcatttttcaagaacgcgatttattgaaaactttccaaatccccgctgacacactggctacctatttgctcatgctggagggtcactaccatgccaacgttgcctaccacaatagcttgcatgccgcagatgttgcccagagtacacacgtgctgttggccacccctgccttagaggccgtattcaccgacctggaaatcctcgctgccctgttcgcatctgctatacacgatgtagaccaccccggagtgtctaatcaattcctgattaataccaattccgagctggcgttaatgtataacgacgcctcagtgctcgagaaccatcaccttgcagttgggttcaagctgcttcaggccgaaaattgcgacatcttccagaatttatcagccaagcaaaggctatcattaaggcgtatggtcatcgacatggttctcgccaccgatatgtccaaacacatgaacctgctcgcggacctcaagaccatggtcgagacgaaaaaggtaacctccctgggcgtcttgctgctagataactactccgatcgcattcaggtgctgcaaaatctggtccattgcgcagatctgagcaatcctactaagccactcccgctgtatcgacaatggactgaccgaattatggccgagttctttcagcagggagaccgcgagcgtgagagcggattagatatctccccgatgtgcgacaaacatactgcttccgtcgagaagtcccaggttggtttcatcgactacatcgcgcatccactgtgggagacatgggctgacctagtgcacccagacgcacaggatctgctcgacactctggaagacaaccgggagtggtatcagtcaaaaattcctcgatccccttcggacctgactaatccggagcgggatggacccgatcgtttccagttcgaactcacactggaagaggccgaagaagaggacgaggaggaggaagaagaaggggaggagaccgcactggccaaggaagccctggagctgcccgacacagaactcctgagccctgaggctggaccggacccaggcgacttaccattggacaaccagaggacctag

SEQ ID NO: 234716 - DNA, 2466 bp, Artificial Sequence
  Description of Artificial Sequence: Synthetic coding sequence
atgcaaaggtatagaggtagacagacggtgtttggagccggagtgttgggtggagtctcatccgctccgagcttcaacactccatcccctcgtagctcccctcttttctacccttccgcaccttccggccacaggcaactcctcggagtgggacccactctgagtcctagcagtacgttctataggttttctaccagcggcgctgattcctccagcctgagcccgccattgcctgcacttggacggacaagagagcaaaccctcctgggcgcacgatcacgcggaagggtactcctgcccgctatcccagaccctttcttatggcggatggaaaatctgggagtcggagaaggagccgaagcgtgctcccgcctgagcagatcacggggtaggcacagtatgacacgggcacccaagcacctatggcgccagcctcgtagaccaatcagaatccagcaacggttctactcagaccccgataaatctgctgggtgtcgggaacgggacctgtcccccagacctgagctgagaaagagccgactctcttggcctgtttcatcttgtcgacgcttcgatttggagaatggcttatcctgtggacggagagcccttgaccctcagagctcaccagggctgggtaggataatgcaagccccagtgcctcactcccagcggagagagtcctttctgtaccgctcagatagcgattacgagctgtcaccaaaggctatgtcccgaaactctagcgtcgcctccgatctacacggagaggacatgatcgttactccttttgcgcaggttctggcatcactgagaaccgtccggtccaacgtcgccgcactggctagacaacagtgtctcggcgctgctaagcagggtcccgttgggaatcctagctcaagcaatcagttgcctcccgctgaggataccggacaaaagctggccttggagaccttagatgagctcgactggtgtcttgatcagttagagaccctacagacacgccattcagtgggagagatggcgagcaacaagttcaaacggattctgaacagagaactgactcatctgagcgagacctccagatcagggaatcaggtctctgaatatatctcacgcaccttcctggaccagcagaccgaggtcgagcttcctaaagtgacagctgaggaagctccccagccaatgtcgcgcatttctggcctccacggcctttgccacagcgcatccttgtcaagtgcgaccgtgcctcggttcggagtgcagacggaccaggaagagcagttagctaaagagttagaggataccaataagtggggactggatgttttcaaggtggcagagttgagcggtaacaggccactgacagccatcatattctccattttccaagaaagagatctgctgaaaacctttcagatacctgctgacacactcgccacttacctgcttatgttagagggacactaccacgctaacgtggcctatcacaactcgctacacgccgcagatgtcgctcaatctacccatgtgttgttggccactcctgctttagaggccgtctttactgatctagagattctagctgccctgtttgcctctgccatacatgacgttgatcacccaggcgtctctaatcaattcctcatcaacactaactcagaactggctttgatgtataatgacgctagtgtcctcgagaatcaccaccttgccgttggattcaagcttctccaggctgaaaactgtgatatctttcaaaatctctcggcaaaacaacgtctatcattgagacggatggtgatcgatatggtgctagcaaccgacatgtccaaacatatgaatcttctcgcagatctgaagactatggtcgagaccaaaaaagtgactagcctaggcgtcctgctactagataattacagtgatcgcatccaggtgctacagaatctcgtccattgcgcagatctcagtaacccgactaaacccctccctctctacaggcaatggaccgatcggattatggcagagttttttcagcagggcgatagagagcgggaatctggattggacatctcccctatgtgtgataaacatacagccagcgtagaaaagtcccaagttggcttcattgattacatcgcccatcccctgtgggaaacctgggccgatcttgtccaccctgacgcccaggatttactggatacactcgaagataatagggagtggtatcagtcgaaaatcccacggtccccttccgatctcactaatcctgaaagggatggccctgacaggttccagtttgagctcacactcgaggaagccgaagaggaagatgaagaagaagaagaggagggagaggaaaccgctctggctaaagaggcattagaactgcccgatacagagctgctgtcacctgaagcaggcccagaccctggcgaccttcccctggataatcagagaacctag

SEQ ID NO: 234717 - DNA, 1557 bp, Artificial Sequence
  Description of Artificial Sequence: Synthetic coding sequence
cctctgcgaattcggccactactgcctactgcctaccacctgttgcccactgggccaggccagtccgccgataggtccgagcagcggggagggccatgcccacctgctatgcccagaagctcccagttcaaacgcatattaaacagagaactgactcatctgtccgaaacttcccggagcggcaatcaagtgtctgagtatatttctcgcacatttctcgatcagcagactgaggtggagctccccaaagtgacagcagaagaagctcctcaacccatgtcacgaatatccgggctgcacggcctgtgccactccgcttccctgagctccgccactgtgcccaggttcggtgtccagacggatcaagaggagcagctggcaaaagaactggaggacaccaacaaatgggggttggacgtattcaaggtagccgaactctccggaaaccgtccgttaacggctatcattttcagcatttttcaggagagggatctcttgaagacgttccagatccctgcagataccctcgctacatacctcctcatgctggagggccactatcacgcgaatgtggcgtatcacaactctctgcatgctgccgatgtggcccagagcacgcacgtactgttagcaactcctgctctcgaggctgtcttcacagatctggagatactagccgctctgtttgcttccgcaatccatgatgtcgaccaccctggcgtgtctaatcagttcctcattaacacgaattctgaactggcactgatgtacaacgatgcaagcgtgctggagaaccaccacctcgcagtgggtttcaagttgctgcaggccgaaaactgcgacatctttcagaacttatccgccaagcagaggctgtccctgaggcgtatggtgattgatatggtgttggccaccgacatgtcgaaacatatgaatctcctcgctgacctaaaaacaatggtggaaacaaaaaaggtcacttccttgggagtactcctgctggacaactattcagatcgcatacaggtccttcagaatctggttcactgtgccgacctgagcaacccaaccaaacctctgccactgtacagacagtggactgatagaattatggccgaattcttccagcagggagatcgtgagcgggaatccggactggacattagtcctatgtgcgataaacatacggcgtccgtcgaaaagagccaagttggattcattgattacatcgcacaccctctctgggaaacttgggcagatttggtgcaccctgacgcccaggacctactggacacgctggaggataatcgggaatggtatcagtccaaaatccccaggtctccatctgatcttacgaaccccgagcgcgatggacctgacagatttcagttcgagctcacgttggaggaggcagaggaagaagatgaagaggaggaagaggagggagaagaaaccgcactagctaaggaggcactggaattgcctgatacagagcttttgtcaccagaggccggacccgatcccggagacctccccctcgataatcagcgcacttag

SEQ ID NO: 234718 - DNA, 6723 bp, Artificial Sequence
  Description of Artificial Sequence: Synthetic coding sequence
atggaacagacgtggacaagggactatttcgccgaagatgacggcgaaatggtccctcggaccagccacactgccgctttccttagcgataccaaagatcgcggtcctccagtgcagtcacagatttggcgctccggcgaaaaagttccgttcgtgcaaacctactccctgagggcctttgaaaaaccccctcaagtccaaacacaggctcttcgggatttcgaaaaacatctgaatgaccttaagaaggagaacttcagtctgaagctccgaatatatttcctcgaggagcgcatgcagcagaaatatgaggcatcacgagaggacatttataaacgaaacattgagctgaaagtggaagtggagtccctaaagcgcgagcttcaggataagaaacagcacctggacaagacttgggcagacgtcgagaacctcaactctcaaaacgaggcggaactccgacggcagttcgaggagagacagcaggaaaccgagcacgtctacgaacttctggaaaacaaaatccagttgcttcaagaggagagccgactcgctaagaacgaggcagcgagaatggccgctctcgtcgaggcagagaaggaatgtaatttggagctgtcagagaagctcaagggggtgacgaaaaattgggaggatgtgcccggtgatcaagtcaagcctgaccagtataccgaggctttggctcagagggataagcgtatcgaggagttgaatcagagcctcgcggctcaggagcgcttggttgagcagctcagtcgtgaaaagcagcaactgctgcacctgctcgaggagcccacaagcatggaagtccagcccatgaccgaggagttgctgaaacaacagaaactaaactctcacgagacaaccatcacgcaacagagcgtaagcgactcacacctggccgagttacaggaaaagattcaacagaccgaggcgacaaataaaatactgcaggaaaaattgaacgagatgtcttacgaactcaaatgtgcccaggaatcctcccagaagcaagacggtaccattcagaatctcaaggaaaccctgaagtctcgcgaaagagaaacagaggaattgtatcaggtgatagagggccagaacgataccatggctaaattacgcgagatgttgcatcagagccaactcgggcaattgcacagctccgagggcacgagtcccgcacagcagcaggtggcacttctggatctgcaaagcgcactattttgcagtcagctggaaatccagaagctgcagcgggtcgtgaggcagaaggagaggcagttggcagatgctaagcaatgtgtccagtttgttgaggctgctgcccacgaaagcgaacagcagaaggaagccagttggaaacataatcaggagcttcgaaaggccctccaacagcttcaggaggaactgcagaacaagagtcagcagctacgagcttgggaggccgagaagtataatgagatcagaacccaagagcagaatatccagcatctgaatcactctctcagccataaggaacaactcttgcaggagtttagggaattattacagtatcgcgacaatagcgacaaaactcttgaggccaatgagatgttgctggagaaactcagacagcgtatccatgataaggccgtggctctggagagggcaattgacgaaaaatttagcgcgctcgaggagaaagagaaggagcttcggcagctgcgactagccgtccgtgagcgggaccatgacctagagagacttagggacgtactctctagcaatgaggcaacaatgcagtcaatggagtcactcttaagggccaagggactggaggtggaacagctgtctacaacctgccagaacttacaatggttgaaggaagagatggagaccaaatttagccggtggcagaaggagcaagaatccattatacaacagttacaaacttctctacatgataggaacaaagaggttgaagacctgtccgcaacgcttctgtgcaagcttggccctggtcaatctgagattgccgaggagttatgccagcggctacaaaggaaggaacgcatgctgcaggacctcctctctgaccgaaataagcaggtgctggagcacgaaatggaaattcaggggctcttgcaatccgtaagtaccagggaacaggagtcccaggcagccgcagaaaagctggttcaggcactgatggagcgaaactccgagctgcaagcactgcggcagtacctcggaggccgagactccctgatgagtcaagcacccatctcaaaccaacaagccgaggtgaccccaacaggttgcctcggcaagcaaacagaccagggctcaatgcagatcccgtctcgggacgactccacatccttgaccgcaaaagaggatgtctccatccctaggagtacattgggtgacttagatacagtcgctgggctcgagaaggaactctctaacgccaaggaagaattggaattaatggccaaaaaggagcgcgagagtcagatggaactgagtgcattgcaatccatgatggctgtgcaggaagaggagctacaggtgcaggcggctgatatggagtccctgacaagaaatatccagataaaggaggacttgataaaggatctgcagatgcagctggtagaccccgaagacatacctgctatggaaagactcactcaggaagtgctgctcctgagggagaaagtagctagcgtggagtcgcagggtcaggagatctcaggcaaccgacggcaacagctgttgctcatgctggaagggctggttgacgagcgcagccgcctgaatgaagcactacaagctgaacggcagctgtattcctcgttagttaagttccacgcccaccccgaaagtagtgagcgtgacaggacactgcaagtggaactggagggcgcacaagtcctcaggtctcgcctggaagaagtactgggtaggagtctagaaaggctgaacagattggagacccttgcagcgataggcggagccgctgccggagatgacacagaggatacgagtacagagttcacagacagtattgaagaggaagccgctcatcattctcatcagcagctcgtcaaggtggccctggagaagtccttggccaccgtcgagacccagaacccttccttcagcccgccttccccgatgggcggtgactcaaataggtgcctacaggaggaaatgctgcatcttcgtgccgagttccaccaacacttagaggagaaacggaaagctgaggaggagcttaaagaactcaaggcccaaatagaagaggccggattctcaagcgtgagccacatccggaatactatgctgagtctctgcctggagaatgccgaactgaaagagcaaatgggagaggccatgtcagatggatgggaaattgaagaagacaaggaaaaaggtgaactcgataatcagagtcagcctcgcgacccaggccctcaatccgccttcagtctcccaggatcaacccaacacctgcgctcccagctgtctcagtgcaagcagcgctatcaggacctccaagagaagctgctgctgagtgaggcaactgttttcgctcaggcgaatgaattggagaagtaccgggtgatgctgactggggagtctctggtgaaacaggacagcaagcagattcaggtggatttacaggacttaggctacgagacttgcgggcgatccgagaacgaggccgagcgtgaggagactacatcaccagagtgcgaggagcataattcccttaaagaaatggtgctcatggaagggttgtgctctgaacagggcaggcgcggatccacactggcttccagtagtgagaggaagcccctagagaatcagcttgggaaacaggaggaatttagggtttacggaaagtccgaaaacattctcgtgctgagaaaagacatcaaggacctaaaggcacagctacagaatgcaaataaggtcattcagaatttgaagtcccgggtgaggtccctgagtgtgaccagtgactattccagctcactggaaaggccctggaagctgcgggctgtgggcaccttggagggttccagcccccatagcgtgccagacgaggatgaggggtggctctcagatggtaccggggctttttacagtccaggccttcaggccaaaaaagatctggagagcctgattcagagagtgagtcaactcgaggcccaattgcccaagaacggcctcgaagagaaacttgcggaggagttacgatctgcctcttggccagggaaatacgactctctcatccaggaccaggccagagagctgtcctatctgagacaaaaaatcagggagggacggggaatctgctacctgatcacccgtcacgcgaaagacacagtgaaatcttttgaagatcttctgagatccaatgatatcgattactatcttggccagagcttccgagagcagctggctcaggggtcacagctgactgagagactgacaagtaaactcagcaccaaggaccataaatctgaaaaggaccaggccggtctggaacctctcgccctgcggctttcaagagaactgcaggagaaggagaaggtaattgaggtgctccaagcaaagctggacgcacggagtctgactccatcttctagccacgcactgtccgatagtcacagaagtccttcctccacaagtttcttaagtgacgagctcgaagcctgttcagatatggatatcgtgagcgagtatactcattacgaggagaaaaaagcaagtccgtctcacagcgactctatccaccactctagccactccgctgtcttatcttccaagcccagcagcacctcagcaagtcagggcgctaaggccgagagcaactcaaaccccataagtctgcccaccccgcagaatacaccaaaggaagcgaatcaagcacacagcggcgcttctacggtaccacccgcatctaccgctaccttattatcaaacgatctggaggcggacagtagctattatttgaacagcgcccagccacactctcctcccagaggaacaattgagctcggcaggatcctggaacccggttacctcggctcatcaggtaagtgggatgtcatgcgaccccagaagggttccgtgtcgggggatctatccagcggatctagcgtgtatcaactgaacagcaagcccacaggtgcagacctccttgaagaacatctgggggagatcagaaatttaaggcaacggctcgaagaatccatctgtatcaacgatcgactccgtgagcaactcgagcatagactgacgagtaccgcacgtggacgcggaagcacgagtaatttctatagccagggactagagtcaatcccacagctctgtaatgaaaaccgggtcctgagagaggacaatcggagactgcaagcacagctgtcacatgtgagccgggagcactctcaagagactgagtcattaagggaggccctgctttcttctaggtcccatctgcaagaactggaaaaagaactcgagcaccagaaggtcgagcggcagcagcttctcgaagatcttcgggagaagcagcaagaggtgcttcactttcgcgaagagaggttatccctgcaggagaatgacagtcgcctacagcacaaactagtgctgttacagcaacaatgtgaagagaaacaacaactctttgagtcgcttcagtcagaactgcagatctacgaagccctgtatggtaatagtaaaaagggtctcaaagcttacagcctggatgcatgtcatcagattcctctctccagcgacctgagtcacctggtggcagaagttagagcgctgagagggcagcttgaacagtcaatacagggtaataattgcctgaggttgcagcttcaacagcagctggaaagtggagccggtaaggcctccctatcaccttcctcgatcaaccagaactttcctgccagcacagacccaggaaataaacagctgctgctgcaagatagcgcagtgagccccccagtcagggacgttgggatgaattcgccggctttggtgtttccaagtagcgcatctagcacaccaggctccgagacccccataatcaatagagctaatgggctgggtttggacactagccccgtgatgaagaccccacccaaacttgagggcgacgcaactgatggcagtttcgccaacaagcacggcaggcatgttattggccatatcgacgattacagcgctctgcggcagcagattgccgagggcaaactactcgtgaagaaaattgttagcctcgtacgctccgcatgctcgttccccggactcgaggcccagggcactgaagtcttaggtagcaaagggattcacgagttgagaagctccacaagcgcgctgcaccatgcactggaagagagcgcctcactgcttacaatgttctggagggccgcactcccaagcacacacataccagtcctccctggtaaagtcggagagtcaaccgagagagagctcttagaattgcgtactaaagtgagtaaacaggaaaggctgttgcaaagcaccaccgagcatctgaaaaacgctaatcagcagaaagaatcaatggaacagtttattgtatcccagctcactcgaactcatgacgtgctgaagaaagccaggaccaacctggaggtgaagtccctgagagctctcccatgtacgcctgctctgtac

SEQ ID NO: 234719 - DNA, 3399 bp, Artificial Sequence
  Description of Artificial Sequence: Synthetic coding sequence
atgaaggagatctgtagaatttgcgctagggagctctgtgggaatcagaggaggtggatcttccataccgctagcaagctgaatcttcaagtgctgctgtcacacgtgcttggcaaggacgtacccagggacgggaaagcggagttcgcctgttcaaagtgcgcattcatgctagaccggatataccggtttgatacagtgattgcccgtattgaggctcttagtattgagcggttacaaaaactgcttctcgagaaggataggctcaagttttgtatcgcctctatgtatagaaagaacaatgacgattccggcgcagagattaaagctggcaatgggactgtcgacatgtccgtgctgcctgacgcacgctactctgcactgctacaggaggacttcgcctatagtggattcgagtgctgggttgaaaacgaggatcagatacaggagccccatagctgtcacgggagtgaaggacctggcaacagacctcggcgttgtcgcggttgcgcggctctccgcgttgctgattcagactatgaagccatatgcaaagtgcccagaaaagttgcgcgatcaatcagttgtgggccttctagccgatggtctacctccatttgtacagaagagccggctctgtctgaggtgggtccccctgacctggccagtactaaggtgccaccggacggggagtctatggaagaagaaaccccgggatcatccgtagagtccctggacgccagtgtccaggcctcccccccacaacagaaagatgaggagacggagagaagcgcaaaggaactgggcaagtgcgactgctgctccgatgaccaggctccacagcatggttgcaaccacaaactggaattagctttgtccatgattaaaggcttggattacaagccaatccaatccccacggggttcaagactccccatccccgtgaagagcagcttgcccggtgcgaagccaggccctagcatgaccgacggcgtgtcttccggcttcctcaaccggagcctgaaacccttatataagacgccggtatcctaccccctggagctatccgatctgcaggaattgtgggatgacctgtgtgaggactaccttcctctgcgcgtccagcctatgaccgaggagttactgaagcagcaaaaacttaactcacacgagacgacaattacccagcagtcagtcagcgattcccatcttgctgaactgcaagaaaagatccaacagactgaggctacgaacaagattctccaggagaagctcaatgagatgagctacgaactgaagtgtgctcaggaaagcagccagaaacaagacgggacgatccaaaatctgaaagaaactctcaaatctcgggagcgagagaccgaggaactgtaccaggtcattgaaggccaaaacgacacaatggctaaactgcgtgaaatgctgcaccagtcccagctgggccagctgcatagctccgaaggcaccagccccgctcagcagcaggtggcactccttgatttacaaagcgccttattttgcagccagctggagatccagaaattacaaagagtggtgaggcagaaggaacggcaacttgcagacgctaagcagtgcgttcagttcgtagaggccgctgcccacgagtccgagcagcagaaagaagcatcgtggaaacacaatcaggaactgcggaaagcccttcagcagctgcaagaggaactgcagaataagagccagcagttacgggcttgggaggcggaaaaatacaacgagatacggacgcaagaacagaatattcaacacttgaaccatagcctaagccataaggaacaactgttgcaggagtttagggaactcctgcagtaccgcgacaattccgacaagactctcgaagcaaacgaaatgctgttggaaaagctccgccagagaatacacgataaagccgtggcactggagcgtgccattgatgagaagttctcagccctagaggagaaggagaaggaacttcgccagctaaggctggccgtaagagaaagggatcatgaccttgagcgactgcgagatgtgctctcgtctaatgaggctaccatgcagagtatggaatccttgctcagagcaaaaggactggaggttgaacagctgtctaccacctgtcagaacctgcagtggcttaaggaggaaatggaaactaagttttcccgatggcagaaagagcaagagagcattatccagcagttgcagacttcgctgcatgaccgtaacaaagaggtggaagacctgtctgccaccctgctctgcaagctgggacctggacagtccgaaatcgctgaagagttgtgccagcgcttgcaaaggaaggagaggatgcttcaggacctcttaagtgatcgcaataaacaagtgctggagcacgagatggagattcagggactgcttcagagtgtctcaactcgcgaacaggaaagccaggctgcagctgagaagttggtgcaggcccttatggaaagaaattctgaactgcaggctctccgtcagtatctaggtgggcgagattcactgatgagccaggcccctatctctaatcagcaggctgaggtgacacctactggctgcctgggcaaacagactgaccaagggtcaatgcagatcccttctagagatgactcgacgagtctgactgccaaggaggacgtgtccatcccacggtccacgttgggagacctcgacaccgtggcaggcttggagaaagagctctctaatgcaaaggaggaactagagctgatggctaaaaaagagcgggagagccaaatggaattgagcgcccttcaatccatgatggcagttcaagaagaagaactccaggtgcaggctgcggacatggaaagcttgactcgcaacatccagataaaagaggacctgattaaagatctccagatgcaactggtcgatcctgaggatatcccagccatggagcggttgacccaggaggttctgctgttgagagagaaagtcgcctccgtcgaatctcagggtcaggaaatctccggaaacaggcggcagcagctgctcctcatgctggaagggctagtggacgagagaagcaggttgaacgaggccttgcaggccgagagacagctttactcctctctggtgaagttccacgcccaccccgaatcctcagagagggatcgcaccttacaggtagaacttgagggagcccaggtactccggtcacggttggaggaggtgcttggcaggtccctcgagcgccttaataggcttgaaacattagccgctatcggtggggcagcagccggagacgatactgaggacacctctaccgaattcaccgactcaatcgaggaggaggctgctcatcacagccaccagcagctttag

SEQ ID NO: 234720 - DNA, 522 bp, Artificial Sequence
  Description of Artificial Sequence: Synthetic coding sequence
atgagtaacggctatagaaccctatctcagcatctcaacgatctgaagaaggagaacttctcccttaagttgcgcatttacttcctggaagagcgcatgcagcagaagtatgaggcttccagggaggacatctacaaacgcaatattgagctgaaggtggaggtggaatccctgaagcgagagctccaggacaagaagcagcacttggataagacttgggcagatgtggagaacttgaactctcagaacgaggctgaactcagacggcaattcgaggagcgacagcaggagaccgaacacgtgtatgaattgctcgaaaacaagattcagctgctgcaggaggaatccaggctcgcgaaaaatgaggccgctcgcatggccgctctggtcgaggctgagaaggagtgcaatctcgaactatctgaaaaactcaagggcgtgaccaagaactgggaggacgtgcctggagaccaggtcaaacccgaccaatacactgaggctttggcccagcgcgataagtag

SEQ ID NO: 234721 - DNA, 933 bp, Artificial Sequence
  Description of Artificial Sequence: Synthetic coding sequence
atgaaagggactgattcaggatcctgttgccggagacggtgtgattttggctgctgttgcagagcctctaggcgagctcactacaccccatacagaagcggagatgctaccaggactccacaatcaccaagacagactccctctcgagaacgtcggagacctgagcccgctgggagctgggcagcggctgccgaagaggaagaagcggctgccgctgccaccccctggatgcgggactatttcgccgaggatgacggtgagatggtaccaaggactagccacaccgcagcctttctgtccgacaccaaagacagaggccctcctgtccagagtcagatctggaggtcaggtgagaaagttccctttgtgcaaacctatagtttgcgagcattcgaaaaacctccacaggtccaaacccaggcactacgggattttgaaaaacacctgaatgacctgaagaaggagaacttcagcctgaagctgcggatctactttctggaggagcggatgcagcagaagtatgaggcgagccgggaggacatttataagagaaacatcgaactgaaggtggaggtggagtcactcaagcgagagttgcaggataagaaacagcacctcgacaagacctgggcagatgtggagaacctgaactcccagaacgaggcagagctgcggaggcagtttgaagagcgccagcaggagaccgagcacgtttacgaattactggaaaacaaaattcaacttctccaggaagaaagtaggctagcaaaaaatgaagcagcccgtatggccgcactggtggaggccgagaaagaatgtaatctagaactgtccgaaaaactcaaaggcgtgacgaaaaattgggaggacgtgccaggtgaccaggtgaagccggatcagtatacggaggccctagcccagagggacaagtag

SEQ ID NO: 234722 - DNA, 2910 bp, Artificial Sequence
  Description of Artificial Sequence: Synthetic coding sequence
atgtccaatggttaccgcactctgtctcagcacctcaatgacctcaaaaaagagaactttagcctaaaactgcggatctatttcttagaggaaagaatgcagcagaagtacgaagcaagccgcgaagatatctacaaaagaaacatagaactgaaagtggaggttgagtcgttaaaacgtgaactgcaggacaagaagcagcacctggataaaacctgggccgacgtggagaacctcaacagccaaaatgaggcagaactgcgaagacagttcgaagagcggcagcaggagaccgagcacgtctacgaacttttggagaacaagatacagttgttacaagaagaaagtcggctggccaagaacgaggcagctaggatggccgctctggtggaggccgaaaaggaatgtaacttggaactttctgaaaagctgaaaggtgtgacaaagaattgggaggatgttccgggtgaccaggtcaaacctgaccagtatacagaggcgttggcccaacgcgacaaaagaatcgaggagcttaaccagtctctcgccgctcaggagaggttggtagagcagctgtctagggagaagcagcaattgcttcacttgctagaggagcccaccagtatggaagtgcagccgatgacagaggaactgctcaagcaacagaaactcaacagtcacgagacaacaatcactcagcagagcgtttccgatagccacctggccgagctgcaggagaaaatacagcaaacggaggctaccaataagatcctgcaggagaaactcaacgaaatgagttatgagctcaagtgtgcccaggagtcctcccagaagcaggacggtacaatccagaacctgaaggagaccctgaaaagccgcgagagagagactgaagagctttaccaggttattgagggacagaatgacacaatggctaagcttagagaaatgctgcaccagtcgcaattaggacaactccattcctctgaagggacctcccccgcacagcagcaggtggctctgctggatctgcaatcagcgctgttttgttcgcaattggaaattcagaagctccagagagttgtgcggcagaaagagaggcagttggccgacgcgaaacagtgtgtgcagttcgtagaggctgcggctcatgagtcagaacagcagaaggaggcttcatggaaacacaatcaagaattgcggaaagccctgcaacaactgcaggaagagctgcagaataagagccagcagctcagagcctgggaagcagaaaagtataatgagatcagaactcaggaacagaacattcagcacctgaatcatagcctcagccacaaggaacagctgctgcaggagtttcgagagctgcttcagtatcgagacaattcagacaaaacactagaggcgaatgagatgttactcgagaaattgaggcagagaatccatgacaaggctgtcgccctggagagggcaattgatgagaagttcagcgctttagaagaaaaggaaaaggaactccgccagctgcggttggcagtcagggagagagaccatgacctggagagactccgcgacgttctatcatccaacgaggccaccatgcagtccatggaaagcttgcttagagctaaagggctagaggttgagcagctgtctactacatgccagaacctccagtggttgaaagaagaaatggaaactaaattctctagatggcagaaagaacaggagagtattattcaacagctccagactagcctccatgaccgtaacaaggaggtggaagatctgagcgcaactctactgtgcaagctaggcccaggacagagtgagatcgcagaagaactgtgccagcgcctccagcggaaggagcgcatgctccaagaccttctttctgatcgcaataaacaagtactcgagcacgagatggaaatccagggtcttctgcaaagtgtgtcaacacgggagcaggaaagtcaggccgctgcagaaaagttagtgcaggccttaatggagcgcaacagcgagctgcaagcacttcgacaatatctcggcggtcgcgactccctgatgtctcaagcacctatcagcaatcagcaagctgaagtgacgcccactgggtgtttgggcaaacagacggatcagggctcaatgcagatcccgtcacgcgacgattccacctcactcacagcaaaagaggacgtatctatccctcgctcgacactcggtgatctggatactgtggcgggattggagaaagaactgagcaacgccaaggaggagctggagcttatggcaaaaaaggagcgagaaagccaaatggagttatctgccctgcaaagcatgatggccgtgcaagaggaagaacttcaggtccaagccgctgacatggagagcttaactcggaacatccaaattaaggaggatctgataaaggaccttcagatgcagctggttgacccagaagatatccctgcgatggaaagattgactcaggaggttctcttgttacgagagaaagtcgcatcagtcgaatcgcagggccaagagatatcgggcaacaggcgacaacagctgctgctcatgctggaggggctggttgatgagcgcagccgccttaacgaagccctgcaagccgaaaggcagctgtactcgagtctcgtgaagttccacgcgcaccctgaatccagcgagcgcgaccggaccctgcaggttgaactagagggagcgcaggttctacgcagccgtttagaggaggttctcggacgctctcttgagcgcttgaaccgccttgaaacactggctgccatcggaggcgcagcagccggtgacgacaccgaggataccagtacggagtttaccgattcgatcgaggaagaggctgcgcaccacagtcatcaacagctgtag

SEQ ID NO: 234723 - DNA, 2967 bp, Artificial Sequence
  Description of Artificial Sequence: Synthetic coding sequence
atgagcaatggatatcggactctatctcagcacctcaatgatctgaaaaaagagaacttttcattgaagctcaggatctactttcttgaagaaaggatgcagcagaaatatgaggcctctagggaagacatatacaagaggaacatcgaactgaaggtcgaggtggagtctttaaagagagagctgcaggacaaaaagcagcaccttgacaaaacctgggccgatgttgaaaatttgaatagccagaacgaagcagagctgagacgacagttcgaggagcgacaacaggaaacagagcacgtgtacgaactgctggaaaataaaatccagcttcttcaggaggagagcaggttagctaaaaacgaagcagccaggatggcggcacttgtggaggccgaaaaggagtgcaatttggagctgtccgaaaagctcaagggggtgacgaagaattgggaagatgtgcccggagatcaggtgaagcccgaccagtatactgaggccctagctcagcgggacaagagaattgaggagctcaaccagagcctggccgctcaggagagattggtggagcaactaagtcgggagaagcagcagctgttacacctcctggaggagcccacctccatggaggtacaacctatgacagaagagctgctgaaacagcagaagttgaattcccacgaaactacaatcacccagcagtctgtcagcgactctcacctggccgagctgcaagagaagattcaacaaactgaggctacaaataagattttgcaggaaaagctgaacgaaatgtcttatgagctaaagtgcgcgcaggaatctagtcagaaacaagacggcacaatccagaacctgaaggagacactgaaaagcagggagcgtgagacggaggagctctatcaggtgatcgaggggcagaacgataccatggctaaactgagggaaatgctgcaccaaagccagctggggcagttgcattcctcagagggaacctcacccgcacagcagcaagtggcattgctcgatctacagtcagccctcttttgttcccaacttgagattcagaagctgcagcgggtggtgcgccaaaaagaacggcagctggccgacgccaagcagtgtgtgcagtttgtggaggccgcagctcacgaatcagaacagcaaaaggaagctagttggaagcataaccaagaactacggaaggccctgcagcagctgcaggaggaactacaaaacaagagccagcaactccgtgcctgggaggccgaaaagtataatgagatcaggactcaagagcagaacattcagcacctaaatcactccctgtcacacaaggaacagctacttcaggaattccgagaacttcttcaatatagggacaattcagacaagacattagaagcaaatgagatgctgctggagaagttgcgccaaaggattcacgacaaggcagtagccctggagcgggctatcgatgaaaaattttcggcgctcgaggagaaagagaaagagctgcgccaattgcgccttgccgtacgtgagcgcgaccacgacctggaaaggctcagagacgtcctgtcgtctaacgaagcgacaatgcaatccatggagagtctcctgcgtgcaaagggcctggaagtggagcaactaagtacaacctgccaaaatttgcagtggctgaaggaggagatggaaacaaagttttctaggtggcagaaagaacaggagagcattattcagcaactgcagacaagcctgcatgataggaacaaagaagttgaggacctgtcggccacattactttgtaagcttggccctggccagagtgaaattgccgaggaactgtgccagcgattgcaaagaaaggaacgaatgctgcaggaccttttatccgaccggaataaacaggtgctggaacacgagatggagattcagggattgctccagagtgtctccacgcgagagcaggagtctcaggcggcagccgaaaagctagttcaggcactcatggagagaaacagtgagctgcaagccctccggcagtatctgggcggacgcgactcactaatgtcgcaggctcctatctccaaccagcaggcggaggtgacccctacaggctgtctcggcaaacagactgatcaagggtctatgcagattcctagtcgcgatgactctacctccctgacagccaaagaggatgtctccatccccaggtccaccctgggcgatctagacacagtggccggattggagaaggagcttagcaatgctaaggaggaactggagctgatggccaagaaggagagggagagccagatggaactgtcagctctgcaatctatgatggccgtccaggaagaggaacttcaggtacaggccgctgatatggagagcctcacccggaacatccagatcaaagaagaccttatcaaggatcttcaaatgcaactggtcgatcctgaggatattccagctatggaacgactcactcaagaagtcctattgctgcgcgagaaagtggcgtcagtagagagccagggacaggagatcagtggtaaccgcaggcagcaactgttgctgatgctggagggccttgtggatgagcgctccaggctcaatgaagcattgcaagctgagcgacagttatactcttcactcgtaaaattccacgcccatccagagtcatcggagcgcgacaggactctacaggtggaactcgaaggagcccaggtgttaaggtcgagattagaggaagtgctcggacgaagtctggagcggctgaatcggcttgaaaccctggctgccattggcggtgcagccgctggtgacgatactgaagacacttcaaccgagtttactgacagcatcgaggaagaggctgcacaccatagccatcagcaggtgtctcagtgccagggactgggcctacccggatggactgctcacagtccaagcgaagtttag

SEQ ID NO: 234724 - DNA, 3396 bp, Artificial Sequence
  Description of Artificial Sequence: Synthetic coding sequence
atgaaggaaatttgccgcatctgtgctagagaactgtgcggaaaccagcgaagatggatcttccataccgcaagtaaactgaacttgcaggtactgctttcccacgtgctcggcaaagacgtccctagagatggcaaggccgagttcgcttgcagcaaatgtgcgttcatgctggatcggatctataggtttgataccgttatagcaaggattgaagcgctgtccatagaaagactgcagaaattgttgctggagaaagaccgcctgaagttctgcattgctagtatgtaccgcaaaaataacgacgattctggggcagagataaaggcaggcaatgggacagtcgatatgagcgtgctcccagatgcgagatatagcgctctgctgcaggaagattttgcatactctggtttcgagtgttgggtcgaaaatgaggatcagattcaggaaccccattcctgccacggaagcgaaggcccaggcaaccggccacgcagatgtcgaggttgcgctgctcttagagtggcagacagcgactacgaggccatttgcaaggttcccaggaaagtggcccgtagcatatcctgtggtccttcctccaggtggtccacatctatttgcaccgaggaaccggctctgtcggaagtagggccaccagacctggcttccacaaaggtccccccagatggcgagtctatggaagaggaaactccagggtccagcgtagaaagcctcgacgcctccgtccaggcaagcccaccacagcagaaagacgaggaaacagaaaggtctgctaaggaactcggcaagtgtgactgctgttccgatgaccaggcacctcagcacggttgcaatcataagctggagcttgccctgagcatgattaagggattggattacaagcccatacagtctcctcgcggttctaggttgcccatccccgtgaagagctcactcccaggtgcaaaaccaggtcccagcatgaccgacggagtgagctctggctttctgaaccgatcattgaagccgctgtacaaaacgcccgtgagctatccgcttgagttgagcgacctgcaggaattatgggacgatctctgcgaagactatctcccgctgagagtccaacccatgacagaggaactgcttaagcaacaaaagctcaactcacacgaaaccacaatcacccagcaatccgtgagtgattcacatctcgcagagctccaagagaagatacagcagacagaggcgaccaacaagatcctccaggaaaagttgaatgagatgtcatatgaactgaagtgtgcgcaggaatcttctcagaagcaggatggcacgattcagaatctcaaagagaccctaaagtcacgggaaagagaaaccgaggaactatatcaggtgatcgaaggccaaaatgacacaatggccaagcttagagagatgctacaccagtcccagctgggtcagttacatagcagcgaggggacttctcccgcacagcagcaagtcgccttgctagatctacagagcgccctattctgctcacaattggagatccaaaagttgcaacgggttgtgcgacagaaggagcgacaattggcagacgcaaagcagtgcgtccagtttgtcgaagctgccgctcacgaatccgagcagcagaaggaagccagttggaaacataaccaagagttgcgtaaagcactgcaacaacttcaggaggaactccagaataaatcccagcagctcagagcttgggaggcagaaaaatataatgaaatccgcacacaagagcaaaacattcaacacttaaatcactctctctcacacaaggaacagctgctccaggaattccgcgaattactccagtacagagacaactcagacaagacactcgaggcgaacgagatgctcttagaaaagcttagacagcggattcacgataaggcagtggctctggagagagcaatcgatgagaaattctcggcactggaagagaaagagaaagagttgaggcagctgcggttggctgtcagggaaagggatcatgatctcgagagactgcgcgacgtgttaagtagtaacgaagctacaatgcagtccatggaatctcttctgcgggcaaagggtctcgaagtggagcagttatcgaccacctgccagaacttacagtggctgaaagaggagatggaaacgaagtttagcagatggcagaaggaacaggaatccatcatacagcagctgcagacctctctgcacgacaggaacaaagaggttgaagatttgtctgcaactctcctttgcaagctcggacctggacagtcggagatagcggaagagctttgccaaagactacagcgtaaagaacgcatgcttcaggaccttctgtctgaccgtaacaaacaggtgcttgagcacgagatggaaattcagggtctgctgcaatccgtctctactcgggagcaagaatcacaggctgcagccgagaagcttgtgcaggccctgatggagagaaatagcgaactgcaggctctgcgacaatacttgggaggcagagattccctgatgtcccaagccccaattagcaatcagcaggctgaggtcactcccaccgggtgtttggggaagcaaacagatcaaggcagcatgcagattccttctcgcgacgattccaccagcttgaccgccaaagaggacgtatcaatcccaagatccactctgggggatctggacaccgtggccggtctggaaaaagaactgtccaatgctaaggaggaattagagctcatggccaagaaggagagagagtcccagatggagttgtctgctctacagtcgatgatggctgtgcaggaagaagaacttcaagtccaggctgcagatatggaaagtctgacaagaaatattcagatcaaggaggacctcataaaagacctgcagatgcagctggtcgatcccgaggatatccctgccatggagcggcttacccaggaagtactgctcttgcgggaaaaggtcgcttctgttgagtcgcaggggcaggagatttctggcaacaggcggcagcagctcttgctcatgcttgaaggcctcgtcgacgagagaagccgcctgaacgaagcgctacaggccgaaagacaactttacagtagtctggtcaagtttcacgcacacccagaatccagcgaaagagacaggactctgcaggtggagcttgagggggcacaagttctgagatctaggcttgaagaggtactcggaagatcccttgagcgtctcaatcgcctagaaacactcgctgccataggcggagctgccgcaggagacgacacggaggacacctcaacagaatttactgatagcatagaggaggaggcagcacaccattctcatcagcagtag

SEQ ID NO: 234725 - DNA, 7040 bp, Artificial Sequence
  Description of Artificial Sequence: Synthetic coding sequence
atgagcaatggctaccgaactctgtcacagcatctgaatgaccttaagaaagagaatttcagcctgaagctcagaatctactttctggaagagagaatgcagcagaagtatgaggccagccgcgaagacatatacaagcgtaatattgaactaaaggtcgaggtggaatcgttgaaaagggagctgcaggacaagaagcagcatcttgataagacatgggccgatgtggaaaatctaaacagccagaacgaagccgaacttagacggcagttcgaagagagacaacaggaaaccgaacacgtctacgagctgctggagaataaaattcagcttttgcaggaggagtctcggctcgctaagaacgaggccgcacgtatggccgctctggtcgaggccgagaaagaatgtaacctggagctttcagagaaacttaagggggtaactaaaaattgggaggacgtaccaggcgatcaggtgaaaccggaccagtacacggaggccttggcacagagagataaacgtatcgaggaacttaaccagtccctggctgcacaggagcgcctggtggaacaactgagccgagaaaagcagcagctgcttcacctccttgaagagcctacttccatggaggttcagccaatgaccgaagaactcctgaaacagcagaaactgaatagccatgagactacaatcactcagcagagcgtctctgatagccatttggcagaactccaggaaaaaattcagcaaacagaggccactaacaagatcctgcaggaaaaactaaacgaaatgagctacgagctcaagtgcgcccaggaaagttcccagaaacaggatggaacaatacagaacctgaaagaaacattgaaatctcgggaacgtgagacagaggagctctaccaggtgatagaaggtcagaacgacacaatggccaagctgcgcgagatgctgcaccagagccagctcggccagttacactcttcagagggcacttcaccagcccagcagcaggtggccctgctggacctgcaaagcgctcttttctgctctcagcttgaaatccagaagctgcagcgagtggtgcgccagaaagagaggcagttagctgacgccaagcagtgcgttcagtttgtagaggccgctgcacacgaatctgagcaacagaaagaggccagttggaaacataatcaagaacttaggaaagctctgcaacagctgcaggaggagttgcagaacaagtcacagcaactgcgggcatgggaagcagaaaaatacaacgaaattaggactcaagaacaaaatatccagcatctgaaccatagcctgagccataaggaacagctccttcaggaattccgtgagctgcttcagtatagggataattctgataaaaccttggaagctaacgagatgctcttggagaagttacggcagaggatccacgacaaggccgttgctctcgagagagctattgatgagaagttttccgcgctggaggagaaggagaaggagctgagacagctgcgcctggctgtccgggaaagggaccacgacctggaacgccttcgagatgtcctgtctagcaatgaagccacaatgcagtcaatggagagcctgcttcgcgcaaagggcctcgaagtcgagcagctgagcaccacatgtcagaatttgcagtggctcaaagaggaaatggagaccaagtttagccggtggcagaaggaacaggagtctattatccaacagctccagacatcactgcacgatcggaacaaggaagtcgaagatctgtccgccactctcctatgcaaactgggaccaggacagagtgagatagccgaggagctgtgtcagaggttacagagaaaagaaaggatgctgcaggaccttctgtccgaccgtaacaagcaggtgctcgagcacgaaatggagattcagggactcctccagagcgtgtcgacccgcgagcaggagtctcaggcggctgccgaaaagctcgtccaggctttaatggagagaaactccgagctgcaagccttgcggcagtacctcggtggcagggactcactcatgtctcaagctcccattagcaaccaacaggcggaggttacgcccactgggtgcttgggtaaacagacggatcagggctctatgcagatcccgagccgggatgactccacttcgctgaccgcaaaagaggacgtctcaattccccgttcaacccttggcgatctcgacactgtcgccggactcgaaaaggaactgtcaaatgcaaaggaggagctggagctgatggccaaaaaggagagggagtctcagatggaattatcagccctccagagcatgatggccgtacaggaagaggagctgcaggtccaggccgcagatatggagagcctgactaggaatattcagattaaagaggatctgattaaggacctgcaaatgcagcttgtcgaccccgaggatataccggctatggagcgcctcacccaggaggtgctgctgctgcgcgaaaaagtggctagtgttgagtcccaaggacaggagatttctggcaatcggagacagcagttgctgttaatgcttgagggcctagtggatgagaggtcacggctaaacgaggccttacaggcagaacggcagctctattcctctctcgtaaaattccatgcacatcctgagtctagcgaaagggatcggacactgcaggttgagctggaaggagcccaggtcctgcgctccagactggaagaggtcctggggcgtagtctggaacggctgaaccggttggagacactagctgcaatcggcggagctgccgctggggacgacaccgaggatacctcaactgaattcacggactccatcgaagaagaggccgcacatcatagtcaccagcagctagtgaaggtagccctggagaaaagcctggctacagttgagacgcagaatccatccttcagtccaccaagccccatgggaggcgacagtaatcgatgtctacaggaggaaatgttacatttgagggcagagttccatcagcaccttgaagagaaaaggaaggcagaggaagagctgaaagaactgaaagcgcaaatagaggaggctggattcagttcagtatcccacattagaaacaccatgctttcattgtgtctggaaaatgcggagctgaaggaacaaatgggggaagctatgtcagacggatgggaaattgaagaagataaggagaagggtgaggttatggtggagactgtcgtgacaaaagagggactgtccgagagctccctacaggccgaatttaggaaactgcaggggaaactcaagaatgctcataatatcatcaatctgctgaaagagcagttagtgctgagcagtaaggaaggtaattccaagcttacacctgagttactggtgcacttgacttcaaccatcgaacggattaataccgagttggtggggagtcccggaaaacaccagcaccaggaagagggcaacgtgactgtgaggccgtttccacggcctcagagcttagacctgggggctactttcaccgtggatgcgcaccagctcgataaccagagccaaccgagagatcccggtccacaaagtgcatttagcttacccggatcgacccaacacctcaggtcccagttgagccagtgtaagcagaggtaccaggatctacaggaaaagctcttgctctcggaggcgactgtgtttgcacaagccaacgagctggagaaatatcgcgttatgctgacaggagaaagcctcgtcaaacaggatagtaaacagattcaggtcgacctgcaagacctcggctatgagacatgcggcagaagtgagaacgaagccgagcgggaagaaaccactagcccagagtgtgaggaacataattcactcaaggagatggttctcatggagggcttgtgtagcgaacagggacgacggggatcaacattggcttcctcgagtgaacggaagccgttggagaatcaattgggtaaacaggaagaattcagagtgtatggcaaatccgagaacatcctggttctgcgcaaagacataaaagatctgaaggcgcagctgcagaatgcaaacaaagtcatacagaacctaaagagccgtgttagaagtctgagcgtcacatctgactattcatccagtctggagcggccatggaaattaagggcagtgggaactttagaaggttcttctccacactctgtgcccgacgaagacgagggatggttatcagacggcacaggggcattctatagccctggcctgcaagctaagaaagatctggaatcactcatccagcgggtgtcccagctcgaggctcagttaccgaagaacggactagaggaaaaactggctgaagaactgcgcagtgccagttggcctgggaagtacgatagcctgattcaggaccaggcgcgtgagttaagctatttgcgccagaagatccgggaaggaagaggaatttgctacctcattactagacacgctaaggatacagttaagagcttcgaggatctgctgagaagcaatgacattgactactatctgggccagagctttcgagaacaacttgcccaaggttcccagttgactgaacgcctgactagcaagctaagcactaaggatcataagtccgaaaaggatcaagccggactggagcctctggccctccggctttctagagagctgcaggagaaagaaaaggtcatcgaggtactgcaagctaaactagatgcacggagcctgactcctagcagctcccatgcactgagtgactcacaccggtctcctagctccacctcgtttttatccgatgaacttgaggcttgtagcgatatggacatcgttagtgaatatacccactatgaggagaaaaaagccagcccgtcccacagcgacagtattcaccatagcagccactctgctgtccttagtagcaagccgagctccacctctgctagccagggggctaaagcagagtctaactctaatcccatcagccttcccacaccccagaacaccccaaaggaggctaaccaggcccactccggctttcactttcacagcatccccaagctggcctcactcccccaagcccctctgccatccgctccttcttcattcttacccttttcaccaacaggcccactcctcctcggctgttgcgagacgccagttgtaagcctcgctgaggcgcagcaggagctgcagatgttgcaaaaacagctgggagaatccgcgtccacggtcccaccggcatctaccgccaccctgctgtctaacgatctggaagcggatagctcttactatctaaatagcgcacagccacactcccccccaagaggtacaattgaactcggcaggattcttgaaccaggctatctcgggagttccggcaagtgggatgtcatgaggccccaaaaggggtccgtcagcggggatctatcatcagggtcaagcgtctaccagctcaattccaaaccaactggagcggacctattggaggaacatctcggagaaattcgaaacctgcgtcagcgactggaagagtctatctgcattaatgataggctgagagaacagctcgaacaccggctgacgagcacagcacgtgggagaggatctacctcgaatttttactcccaaggcttggaatctatcccccagctgtgtaatgaaaatcgagtgttaagagaagataatcgacgcctgcaagcccagctctctcacgtctcccgcgaacactcccaggagactgagagtctgagggaggctcttctgagttcccgatcgcacttgcaggagctggagaaggagctggaacaccaaaaggtcgaacgccaacagttgctggaagatctccgagagaagcaacaggaggtcctgcacttccgagaagagaggctgtcattacaagaaaacgacagcagactgcaacataagctagttctccttcagcagcagtgcgaagagaagcagcagctcttcgagtccctccaatctgaattgcagatctatgaggctttgtacggtaactccaaaaaggggctcaaggcctactctctagatgcctgccatcagataccactgtcttccgatctgagccatctggttgcagaagtgcgggctctcagggggcagctggagcaatctattcaagggaataactgcctccgtcttcagctacagcaacaactcgagagcggagcagggaaggcctcactgtccccaagttccatcaaccagaatttcccagcctcaacggaccctgggaataaacagctgctcctgcaggatagtgcggtatcaccccctgttcgggatgtggggatgaactctcccgctctggtgttccccagcagcgcgagttctactcccggttccgagacacctattatcaatagggcaaacggattaggtctggacacctcacctgtgatgaagacacctcctaagctggagggagatgctacagatggctcgtttgctaacaaacatggtcggcacgtgattgggcacattgatgactacagtgcactccggcagcaaattgccgagggcaagctgttagtgaagaaaatcgtgtcacttgtgcggagtgcatgttcttttccaggactcgaggcccaggggacagaggtcctcggcagcaagggaattcacgagctccgatcatctactagtgccctgcaccacgcccttgaagaaagtgcctcactgctgactatgttttggcgagccgctctcccctcaacccacatccccgtgttacctggcaaagtgggcgagtcaacagaacgcgagctcctcgaactgaggaccaaggtgtccaagcaggaacgactgctgcagagcaccacagaacacctgaagaacgccaatcaacaaaaggaaagcatggagcagttcattgtcagtcaattgactcgcacacacgacgttttgaagaaggcaaggacaaatttggaagtgaagagcctcagagctcttccatgtactcctgcattgta

SEQ ID NO: 234726 - DNA, 7088 bp, Artificial Sequence
  Description of Artificial Sequence: Synthetic coding sequence
atgagtaatggctatagaactctgagccagcatctcaacgaccttaagaaggagaacttttcccttaaactcaggatctactttctggaagagagaatgcagcaaaaatacgaagcaagccgggaagacatctataaaaggaatatagaactgaaggttgaggtggagagtctgaaacgagagctgcaggacaaaaagcaacacctcgataagacctgggctgacgtggagaatctcaactctcagaacgaggctgaactaaggcgccaattcgaggagcggcaacaagagactgaacatgtgtatgagttgttggagaacaagattcagctgttgcaggaggagtcaagattggctaagaacgaagctgccaggatggctgcccttgtagaggctgaaaaagagtgcaacctggagctctcagagaaactgaaaggagtcactaagaactgggaagacgtcccgggagaccaagtgaaaccagatcagtacaccgaggcattggcccagcgagacaaaaggattgaggaattgaatcaatcgctcgctgcccaggaaaggcttgttgaacagctgtcacgcgaaaagcaacagctcctccacctgcttgaggagcccaccagcatggaagttcagcccatgacggaagagctcttgaaacagcagaaactgaactctcatgaaacaacaatcacacagcagagcgtatcagattcccacctggcagaattgcaagaaaagattcagcaaacagaagccactaacaagattctacaagaaaaactgaacgagatgtcttacgaacttaaatgcgctcaggagagttctcagaaacaggatggaaccatccagaacctgaaagagaccctaaaatccagagaaagagagacggaggagctttatcaggtcatcgaggggcagaatgacaccatggccaagttacgcgaaatgctgcaccagagtcaactgggacagctgcactccagtgagggcacaagtccagcacaacaacaagttgctctgttggacttgcagtcagccctgttttgcagccaacttgagattcagaaactacaaagggtcgtcaggcagaaagagcgccagctggccgacgccaaacagtgtgtccagtttgtggaagctgcagcacatgaaagtgaacaacagaaggaggcctcatggaagcataatcaggagcttcgcaaggcactgcagcagctgcaggaggaactgcagaacaaaagccagcagctgcgggcttgggaagcagaaaagtacaatgaaataaggactcaggagcaaaacatccagcatctgaatcatagcttgtcccacaaagaacagttgctccaggagttccgtgaactgctgcagtacagggataattcagacaagacacttgaagccaacgagatgcttctggagaaattacgccagcggatccatgataaagctgtggcgcttgagagggccatcgacgaaaagttttcagcacttgaagaaaaggagaaggaattgaggcaacttcgtcttgctgtacgggagagagatcatgaccttgaaagacttcgcgatgttttatcttccaacgaggccaccatgcaatcaatggagagcctgctgcgtgccaaaggtttggaggtggagcagctgtcaactacatgccagaacctccagtggctcaaagaggaaatggagaccaagttctcccgctggcaaaaagagcaggaaagcattatccagcagctacagaccagcctgcatgacagaaataaggaagtggaagatttaagcgctactctgctctgtaagctggggcctggccagagtgaaattgccgaagagctctgccagagactgcaacgcaaggagagaatgctccaggacctcctctcagatcgcaacaaacaggtcctagagcatgaaatggagattcagggactcttacagagcgtgtccacccgcgagcaagaaagtcaagccgcagctgaaaagttagtacaggcgctcatggagagaaatagtgaacttcaggcattgcggcagtacttgggagggcgtgatagtttgatgtcccaggcacctatcagcaaccagcaggcggaagtgacgccaactggctgtctgggaaaacagacagaccaggggtctatgcagattcccagtagggacgacagcacaagcctgacagcgaaggaagacgtatccatccctcgatccactctgggcgaccttgacaccgtcgcgggtctggaaaaagagctctccaatgcaaaggaagaattggaacttatggccaagaaagaacgcgagagtcagatggagctttcagctctgcagagcatgatggcagtgcaggaggaagaacttcaggtgcaggcagccgacatggaaagtctgactcgcaacattcagatcaaagaagacctcatcaaagacttacagatgcagctcgtggaccccgaagatatccccgctatggagagactaacacaggaggtactgttacttcgcgaaaaggtggcctctgtggagagtcagggccaggaaatcagtggcaacagacgtcaacaattgcttctgatgctcgaaggcctggtcgatgaacgaagccggctgaacgaagcattgcaggctgaacggcagctctattcatcactggtgaagttccacgcacaccctgagtctagtgaaagagaccgaacactgcaggtcgagcttgaaggtgcgcaggtgttgcggtctaggctggaggaagtgttgggcagatccctggagcgactgaatcggttggaaactctggcagctatcggcggtgcagccgctggtgatgacaccgaggacaccagcaccgagttcacagacagcattgaggaggaagccgctcaccattcacatcaacagttggtgaaggttgctcttgaaaaatctttagctaccgtcgagactcagaaccccagcttttcccccccatctcctatgggaggagatagcaacaggtgcctccaggaggagatgttacacctcagggcggagttccatcagcatctggaagaaaaaagaaaggcagaggaagagctgaaagaactcaaagcccagattgaggaggcaggatttagctccgtaagccatattagaaacactatgctctctctgtgcctcgaaaacgcggagctcaaggagcagatgggtgaagccatgagcgacggatgggaaatcgaggaggacaaagaaaaaggcgaggtcatggttgaaacagtggtgaccaaagaaggattatctgagtcctcattacaggctgagtttcgcaagctgcagggaaagctgaaaaacgcccacaatatcatcaacctcttgaaggaacagctcgtcttatcctctaaggaagggaacagcaagcttacgcccgagttgctggtacacctgaccagcacgatcgagcgtatcaatacagagctggtaggatctcccggtaagcatcaacatcaagaggaggggaatgtaacagtccgtccattccctcgaccccagtctctggacctgggcgcaacattcaccgtcgatgctcatcagctagacaatcagagtcagccccgagacccagggccacagagtgccttctcccttcctggaagtacccagcatctccgaagccagttgagccagtgtaagcagaggtatcaagatctgcaggaaaaactgttgctctctgaagcgacagtcttcgcccaggccaatgagctggaaaagtaccgggttatgctgactggggaatccctagtaaagcaggattctaagcagatccaagtggatctgcaggacttgggatacgagacctgtggtaggtctgagaatgaggccgaaagagaggaaaccacttcgcctgagtgcgaggaacacaatagcctcaaagaaatggtgctgatggagggcctgtgtagtgagcagggtaggagagggtcaaccctcgcatctagcagcgagagaaagcccctcgagaatcaactcggtaagcaggaggagttcagggtttacgggaagagtgaaaatatcttagtgctcaggaaagacatcaaagacctgaaagcgcagctgcagaacgcgaacaaggtgatccagaatctgaaaagtcgtgtgagatctctctccgtgacaagcgactactcatctagcttggaacggccatggaaattgcgagcggtgggtactctagaggggtctagtccccactctgtcccagatgaagacgaaggctggctgagcgacggcaccggagccttctattctcctgggcttcaggcgaagaaggacctcgagagtcttatccagcgagtgagtcagttagaggcccaactacccaaaaacggcctggaagaaaagctggctgaagaattacgctctgccagctggcctggcaagtacgattcccttattcaagatcaagcaagggagttgagctatctcaggcagaagattcgggagggaagggggatttgctacctgatcacacggcatgccaaagacacagtgaaatcctttgaggatctgctgaggagcaacgacatcgactactatcttgggcaatcattcagagagcagttagcccagggctcccagctcacagaaaggttgacgtcaaagctgtccactaaagatcataaatcagaaaaggatcaggccggactggaacctctggccctacgcctgagcagggagctgcaggagaaggagaaagtcatcgaagttttgcaggccaaactcgacgcgaggtccctcactccatcttctagtcacgccctttctgatagccataggagtccgtcctccacaagtttccttagcgatgagttggaggcctgttctgacatggatattgtctctgaatacacgcactacgaagagaaaaaggcttctccttctcattcagattctattcaccacagctcccactccgcagtgctatcttctaagccatcatcaacctcagctagccaaggggcaaaagctgagagcaacagcaaccccatatccctcccgaccccacaaaatactcctaaagaagcgaatcaggctcacagcggttttcacttccactctatccccaaattagcttcactgccacaggctcctcttccatccgcgccttcgtcatttctgcctttttcacctaccgggcctttgcttctagggtgctgtgagactcccgtggtgagtctggctgaagcacagcaagagctccaaatgttgcagaaacaattaggcgagtccgcttccactgtccctcctgctagcaccgccacgcttttgtcgaacgatctggaggcagattctagctattacctcaactcggcacagccacatagtccacctcgcggtactattgaactcggcagaattctcgagcccggatacctcgggtccagcggcaagtgggatgtaatgcgtccacaaaaaggctctgtaagtggggacctcagctctggatccagcgtctatcagcttaactcgaaaccgaccggcgctgatctcctcgaagagcacctgggcgagattagaaacttgcggcagcggctcgaagagagcatttgtattaacgatagacttagagagcaactagagcacaggctaacgagcactgcacggggaagggggtccaccagtaacttctacagccagggccttgagagcataccacagttgtgtaacgagaaccgggtcttgagggaggataatcggagactgcaggcgcaactttctcatgtgtctcgcgaacattctcaggaaacagagtcactgcgagaggctctcctctcgagtcgctcccacctgcaggagctggagaaggagctggagcatcagaaggtagaaagacagcaacttctggaggacctccgggaaaagcagcaggaggttctgcattttcgggaggagcgcctctcactgcaagaaaacgatagtcggttacagcataagctggtcctgttacagcaacagtgcgaggagaaacagcagctgttcgagagccttcagtcggagctgcaaatttatgaagctctttacggaaactctaagaaagggctcaaagcctacagtctggacgcctgtcaccagattcccctcagcagtgatctgagccatctggtcgctgaggtaagggctctcaggggacagctggagcaatcaatccagggtaataactgcctgagactgcaactgcagcagcaacttgaatcaggtgcaggaaaagcttcgttgagcccctcctccattaaccaaaatttccctgcctcaactgatccaggcaacaagcagctgctccttcaagacagtgctgttagccctccggtgcgggacgtggggatgaatagcccagccctggttttcccttccagcgcctcctctaccccaggcagcgagacccctatcattaacagagcaaacggtctaggcctggacaccagtcctgtcatgaagacacctcccaaactggaaggagacgccacagatggcagttttgccaacaaacacggcaggcatgtgatagggcacattgatgattacagcgccctgaggcaacagatcgcagagggaaagctccttgtaaaaaaaatcgtttcgctggttcgatccgcgtgctcctttccgggactcgaggctcagggcactgaggtgctgggctctaagggaattcatgagttgagatcctcaacttctgctctgcaccacgccctcgaagagagcgcctcgctgctgaccatgttttggcgggctgccttaccatcaacacatatccccgtgctgccaggcaaagttggcgagagtacagagcgcgaactccttgagttacgcactaaggtatcaaagcaggaaaggctgctgcagtcaaccacggagcacctgaagaatgcaaatcagcaaaaggagtccatggagcaatttatcgtttctcagctcacaagaacccatgacgtactgaaaaaagcacgcactaacctagaagagccctgtaaaaagcggagtcaccagaagtcacttaaacagcaggaaaggtgggcctgcccccctttcgtccagctcccaatctgtta

SEQ ID NO: 234727 - DNA, 1557 bp, Artificial Sequence
  Description of Artificial Sequence: Synthetic coding sequence
atgcctgaagcaaactacctgctgtccgtcagttggggatatatcaaatttaaacggatgcttaaccgcgagttgacccacctgtcagaaatgagcagatcaggcaatcaagtcagcgagtttatctcaaataccttcctggataaacagcacgaggttgagatcccatcccccactcagaaggagaaagagaagaaaaagcggccaatgtcccagatatctggagtcaagaagctcatgcacagctcaagtctgaccaatagttccatcccacggttcggcgtgaaaactgagcaggaggacgtccttgcgaaggagctcgaagatgtgaataagtgggggcttcatgtctttcgtatcgctgagctgagtgggaaccgcccactgacagtgattatgcacacaattttccaagagcgggatttgctgaaaacattcaagattcctgttgatactctgattacttacctgatgactctggaggaccactaccacgccgatgtggcttatcacaataatatccacgccgctgatgtcgtgcaaagtacccacgtgctgctgtctaccccagctttagaagcagtcttcacggacctggaaatcttagctgccatattcgcgagcgcgattcatgacgtcgatcaccctggggtttcaaatcagtttttgatcaatacaaattctgagcttgctctcatgtataacgatagcagcgtgctggagaaccaccatctggccgtgggatttaagttgctgcaggaagaaaactgtgacatctttcagaatttaaccaagaagcagaggcagagccttagaaaaatggtcattgatatcgtgctggcaaccgacatgtctaagcacatgaatctgctagcagacttgaaaactatggtagaaaccaagaaggtgacctcatctggggtccttctgttagacaattattccgaccgaattcaggtcctgcagaacatggtccactgtgcagacctgtcaaatcccacgaagccactgcagctgtatagacagtggacagaccggattatggaagagttttttcgacaaggagacagagagcgcgagagaggtatggagatctcacctatgtgcgacaaacataacgccagtgtagagaaaagccaggtcggatttatcgactacattgttcaccctctgtgggaaacatgggccgatctagttcacccagatgcacaggatattctggatacactggaggacaaccgggaatggtatcagtcaacaatcccccagtccccaagccctgccccagatgatccagaggaggggagacaagggcagaccgagaaattccagttcgaactcactctggaggaagatggggagtccgacactgagaaagattccggtagtcaggtggaggaggatacctcatgcagcgatagcaagaccctttgcacccaggatagtgagtcgactgagatccctctcgacgagcaggtggaagaggaggctgtgggtgaagaagaggaatcccagcccgaagcttgcgtgatcgacgatcggtcacccgacacctag

SEQ ID NO: 234728 - DNA, 2430 bp, Artificial Sequence
  Description of Artificial Sequence: Synthetic coding sequence
atggaggcagagggctcctctgcgccagcacgtgccggatcaggagaggggtctgactccgctggcggagcaacgctcaaagctcctaaacatctctggagacatgagcagcatcaccagtacccacttcgtcagccacaatttagactcttacatccccaccatcacctgcctccgccaccacccccttcacctcagccccagccacaatgtccacttcagcctccgccacctccacccctgcctccgccaccgccaccacccggagccgcacgtgggaggtatgcatcttctggcgctaccggacgtgtccggcaccgcggatattccgatacagagcgttacctttactgccgggctatggatcgaacaagctatgccgtggaaacaggccacaggccaggccttaagaaaagccggatgtcctggccctcctctttccagggcctaaggagattcgacgtggacaatgggacgtctgctggcaggtctcctctggacccgatgactagcccaggctccggcctaatcctgcaggccaattttgtgcactcacagcgtcgcgagtcgttcctttatcgatctgactctgactatgacttgagccctaaatccatgagccggaactcgagtattgcatcagacatacatggtgacgatttgatagtgactccatttgcccaagtgctggccagcctgaggaccgtccgcaataactttgctgccctgaccaacctgcaggatcgtgcccctagtaagaggtcaccgatgtgtaaccagcccagcatcaacaaagcaactatcaccgaagaagcctatcagaaacttgcttccgaaacactggaggaactggactggtgcttggatcagctcgaaaccctgcagactaggcatagcgtgtcagagatggcctcaaacaaattcaagcgaatgttaaaccgggagctgactcacttaagcgagatgtctcgttcaggcaaccaggtctcagagttcatctcgaacaccttccttgataaacagcatgaggtcgagatcccctctcccacccagaaggaaaaggaaaaaaagaagagacccatgagtcagatcagtggcgttaagaagctaatgcactcaagtagtcttaccaattcctccatcccgaggttcggcgtgaaaacagagcaggaagacgtcctcgcaaaggaacttgaggacgtgaacaaatggggcttgcacgtgtttagaatagctgagctttccggcaataggccgctcacagtgattatgcacacaatttttcaggaaagagatctgctaaaaacatttaaaattcccgtcgacaccttgatcacttatctcatgacccttgaagaccattatcacgccgacgtggcttatcataacaatattcacgccgctgatgtggtgcagagcactcatgtgcttttatccacacctgccctcgaagccgtcttcacagatctcgaaatcttagctgccatcttcgcatcggccatccatgacgtggatcaccccggagtgtctaaccagtttttaattaatactaattcagagctggccctcatgtataatgattcgagtgtgcttgagaaccaccatttggctgtggggtttaagctccttcaggaagagaactgcgatatatttcagaacctcaccaagaagcagcgccagagtctgcgaaaaatggtcattgacatcgtccttgctacagatatgtctaaacatatgaacttactggccgacctaaaaacaatggtagaaaccaaaaaggtgacaagttcaggggtgcttttgctggataactatagcgaccgcattcaggtcctgcagaatatggtgcattgcgccgatctgtctaaccctactaaacctctacagctgtaccggcagtggacagacagaataatggaggagttcttcaggcagggtgatagagaacgagaaagaggaatggaaatcagcccgatgtgtgacaaacacaacgcgtctgtagagaagtcacaagtgggcttcattgattacattgtgcatcccctttgggagacgtgggcagacctcgtgcacccagatgctcaagatattctggatacgcttgaagacaatcgggaatggtatcagagcacgatcccccagagcccatcccctgcacccgatgatccggaagaagggaggcaggggcagaccgaaaagttccagttcgaactgacgttagaggaggatggagagtccgataccgagaaagacagcgggtctcaagtggaggaggacacctcttgtagcgatagcaaaactctttgcacccaagacagcgagagcaccgagattcctctggacgaacaggtggaagaggaggcagtgggcgaggaggaagagtcccagcctgaggcctgcgtgatcgatgatagatcacccgatacctag

SEQ ID NO: 234729 - DNA, 2037 bp, Artificial Sequence
  Description of Artificial Sequence: Synthetic coding sequence
atgttcatttactcctttaataaattttttttcaagacaacccattgttgggccatcattagtttcgatgtagataacggaactagcgctggtaggtctccattagaccctatgaccagtccaggcagcggactaattctccaggcgaactttgtgcatagtcaacggcgagaatcgtttctgtatagatccgattcggattacgaccttagccctaaatccatgagccggaatagtagtattgcaagtgacattcacggggatgatctgattgtcactcctttcgctcaggtgctggcatcgttgaggacagtgagaaacaattttgccgcactcacgaatctccaagatagagctcccagtaaaaggtcgccgatgtgtaaccagccgtctatcaataaagcaacgatcaccgaggaagcgtaccagaagctcgcaagcgaaaccctagaagaactcgactggtgcctggaccagcttgagactcttcagacccgtcactcagtgtcagagatggctagcaataagtttaagcgaatgctgaacagggagctcacccatctctctgagatgtctcgcagtggaaaccaggtgagcgagttcataagtaacaccttcctcgacaagcagcatgaggtggaaatcccttcaccaacccagaaggagaaagaaaagaagaaacgaccaatgagccaaatctcaggggttaaaaagctgatgcatagttcctcactgacaaattctagcatccccaggtttggcgtaaaaaccgaacaagaggatgtcctcgccaaagagctggaagacgttaataaatgggggctacacgtcttcagaattgctgaactttcggggaacaggcctctgaccgtgataatgcacacaattttccaggagagagacctgcttaagacattcaaaatccccgtggatacgctgattacttatctgatgaccctggaggaccactatcatgccgacgttgcctatcacaacaacatacacgccgcagacgtcgtgcagagtacacatgtgctcctgtccacccctgcacttgaagccgtgttcactgacctcgaaattttggccgctatcttcgccagtgctattcatgatgtagaccaccccggagtgagtaatcaattcctaatcaataccaactctgagctggcgctgatgtataatgactccagcgtcctggagaaccatcacctggcagtgggtttcaagctgctccaagaagagaactgtgacattttccagaatctcactaaaaagcagaggcagtcactgcgcaagatggtgattgatatagtccttgccaccgatatgagtaagcacatgaacctcctcgccgatctgaagaccatggtggagactaaaaaagtgacaagtagtggcgtccttttacttgacaattacagcgaccgaattcaggtcctgcagaatatggtccattgcgctgatctttccaatcccactaaacctcttcagctttatcggcagtggacagaccggattatggaagaattcttcaggcagggcgatcgggagagagagagaggcatggagatcagtcccatgtgcgacaagcataatgcatcggtcgaaaagtcccaagtcgggttcatcgattatatcgtacaccccctgtgggaaacatgggccgacctggtacatcccgatgcccaggatatactcgacaccttggaagacaatagggaatggtatcagagtactataccccaaagcccttcgccagcccctgatgacccggaggaggggagacaaggacaaacagagaagtttcagttcgaacttactctggaagaggatggtgaatcggacaccgagaaagactcgggtagccaagtggaggaagatactagttgtagcgacagcaagaccctgtgcactcaggactcagagtcaactgaaattccactagacgagcaggtggaagaagaggcagtgggtgaagaagaagaatcacagcccgaggcttgtgtcatcgacgaccgctccccagatacttag

SEQ ID NO: 234730 - DNA, 1524 bp, Artificial Sequence
  Description of Artificial Sequence: Synthetic coding sequence
atggcttccaacaagtttaaaaggatgctcaatcgcgagctgacacacctgagtgaaatgtctagaagtggcaatcaggtgtcggagtttatcagcaatacctttctggataaacagcacgaggtggagattcccagcccgacccagaaggagaaagaaaaaaaaaaaagacccatgtcacagatatctggcgtgaagaagctcatgcattcatcaagtctgacaaacagttccatccccaggttcggggttaagacagaacaggaagatgtgcttgcgaaggagctcgaggacgtgaacaagtgggggctgcacgtgttccgaatcgccgaactgtctggcaaccgacccctcaccgtgataatgcacaccatttttcaggagagggatttactaaagacatttaaaatcccagtggacaccctgattacatatcttatgaccctagaagatcactaccatgcggatgtagcctatcacaataatattcacgccgctgacgttgtacagagcacccacgtgctgctgagcacaccggctctggaggcagtgtttactgacttagaaatcctggctgctattttcgcgtccgctatccatgacgtcgatcaccccggagtttctaatcagttcctgattaacactaacagcgagctggccctaatgtataatgattccagcgtcctggaaaatcatcatctcgcagttgggtttaagctgctccaggaggagaactgtgacatttttcagaacctgaccaagaagcagcgacaatctctgcggaagatggtgattgacatagttctggccactgacatgagcaaacatatgaacctgcttgcggacctgaagacaatggtggagaccaagaaggtcacatccagcggagtgctgctgctggacaattattctgaccgtatccaggtcttgcagaacatggttcactgcgcagatctctctaatcccaccaaaccgctgcagctgtaccgtcagtggacagaccgtatcatggaagagttcttcaggcaaggcgaccgggagcgagaacggggaatggagatctcacccatgtgtgataagcataacgccagcgttgaaaagagccaagtcggattcattgactacattgtgcatcccctctgggagacctgggctgacctcgtgcacccagatgcacaagacatcctcgatacactggaggacaacagggaatggtaccaaagcacaataccccaatcaccctctcccgcaccagacgaccccgaagaggggagacagggccagacagagaagtttcagtttgagcttacattagaggaagacggagaaagtgacaccgagaaggacagtggatcccaagtggaagaggatacctcctgtagcgattccaagacattgtgtactcaggactcagaaagtaccgaaattcctctggatgagcaagtagaggaagaagccgttggtgaagaggaagagtcgcaaccagaggcatgcgtcatcgatgatcgcagccctgatacatag

SEQ ID NO: 234731 - DNA, 2022 bp, Artificial Sequence
  Description of Artificial Sequence: Synthetic coding sequence
atgatgcatgttaataacttcccttttaggaggcacagttggatttgtttcgatgttgacaacggaactagcgccggtagatcgccgctggatcccatgactagcccaggcagtggcctaattcttcaagccaattttgtgcactctcagcggagagagtccttcctttaccgttcagatagcgattatgatctctctccgaaatcaatgtctagaaactcttccatcgctagcgatattcacggggacgacctgatcgttacacccttcgcccaagttttagcttcactacgcacagtccgaaacaactttgccgctctcacaaatctacaagacagggctccttccaaacgaagcccaatgtgtaatcagccttctataaataaggccacaataactgaggaggcataccagaaactggcgtccgagaccttggaagagttagattggtgcctggatcagctggagacactccagactcggcacagtgtgtcggagatggcctcaaacaagtttaaacgtatgctgaatagagaactaactcacctctcagaaatgtcacgttcaggaaatcaggtcagtgagtttataagcaacacttttttggacaaacagcatgaggtcgaaataccctctcctacccagaaggagaaagagaaaaagaagaggccaatgagtcagatcagcggcgtgaaaaagctgatgcatagctcctccctgaccaactcctctataccacgctttggagtcaagacagagcaggaagacgtactagctaaggagctcgaggacgtaaataaatgggggctgcacgtgttcagaatcgcagagctgtctgggaatcggcctcttaccgttataatgcataccatattccaggagcgggatctactcaaaacctttaagattcctgtggataccctaatcacttacctgatgacgctagaagaccattaccatgccgatgtggcctaccacaacaacattcatgccgctgatgttgtgcagtcaacgcatgtcctgctctccacacctgctctggaggccgttttcaccgacctggagatcctcgcagccatatttgcctcagcgattcacgacgttgaccaccctggagtttccaatcagttccttatcaatacaaactctgagctggccctgatgtacaacgatagttctgtcttggaaaaccatcatttagctgttgggtttaaactgcttcaggaagaaaactgtgatatctttcaaaacttaactaaaaagcaaaggcagtctctccggaaaatggtcatagatatcgtgcttgccactgacatgtcaaagcatatgaatttgctggcggacttgaagaccatggtcgaaactaagaaggtgacttcctctggcgtgctgctattggataactactccgaccgcattcaggtcttgcaaaacatggttcattgtgctgacctatcaaaccccactaagcctctgcagctgtatcgccagtggaccgatcggatcatggaagaatttttccgccagggagaccgtgaacgcgaaaggggaatggagatttccccaatgtgtgataagcataacgctagtgtggagaaatcacaggtggggttcatcgactacatagtccacccactgtgggagacctgggctgacctggtgcatccagacgcccaggacatcctggacaccctggaggataatcgggaatggtatcaatctaccattccccagagcccttcaccagctcctgatgatcccgaggaagggaggcaaggccaaacagagaagtttcagtttgaactcactctcgaagaggacggcgagtctgataccgaaaaagactccgggagtcaagtggaggaagacacctcatgttccgacagcaagacattgtgcacccaggatagcgaatccaccgaaatcccgctcgacgagcaagttgaggaggaggcagtgggcgaggaagaggagtcgcagcctgaggcttgcgtgattgatgatcgatcccccgatacatag

SEQ ID NO: 234732 - DNA, 2064 bp, Artificial Sequence
  Description of Artificial Sequence: Synthetic coding sequence
atggccttcgtttgggaccctttgggagcaaccgtgcctgggccaagcacaagagccaagagccgcctgcgtttctcgaaatcttacagcttcgacgtggataatggtaccagtgcagggaggagtcctctggaccccatgacctcgcccggttccggattgatactccaggcaaacttcgttcattcccagcgccgagagagctttctctataggagcgattcagattacgacctgtcacccaagagcatgtccagaaactcatcaatcgcatcggacatccatggagacgaccttattgtcacccctttcgcacaggttttggcatctctaaggacagtcaggaataattttgctgcgctgaccaacttgcaagatagagcaccttccaagaggtcacccatgtgcaatcagccctccattaataaagccactatcactgaggaggcttatcagaagcttgcttcggagaccctggaagaactggactggtgtctggaccagctggagactctgcagactcgtcactctgtctcagaaatggcctccaacaaattcaagcggatgttgaatagagaactcacccatctctcagagatgtccagatcaggcaatcaggtgtccgaattcatctccaatacattcctcgataaacaacacgaagtcgaaatcccaagtcccacacaaaaagaaaaagagaagaaaaaacgacctatgtctcaaatttccggagtcaagaaactgatgcacagctcctccttaaccaattcatccatacctagatttggggtcaaaactgagcaagaggatgtgctcgccaaagagttagaggacgtgaacaagtggggtctgcacgttttccggattgcggagctctcaggcaaccggccactcacagtgatcatgcatactattttccaggagcgagatcttctgaaaactttcaaaatccctgtggacactttaattacttacttgatgacactcgaggatcactaccatgccgacgtcgcatatcacaataacatccacgcagcagacgtggttcagtctacacacgttctgctctcgacccccgctctggaggctgtgtttactgaccttgaaattctcgcagccatcttcgcctcggctatccacgacgtggaccacccgggtgtgtctaaccagtttctgattaataccaactccgaactggctctgatgtacaacgactcaagcgtacttgagaatcatcacctcgcagttggctttaagctgctgcaagaggagaactgcgacattttccaaaatctcaccaagaagcaaagacagtctctacgaaagatggtgatcgacatagtgttagccacagacatgtccaagcacatgaatctgctggcggaccttaagactatggtagagactaagaaagtcacgagttcaggggtgttgctcctggacaactacagcgacaggattcaagttctgcagaatatggtgcactgcgctgatcttagtaatcctacgaagcctctgcaactgtatcgacagtggacggaccggattatggaagagtttttccggcagggggatcgcgagagggagcgcggaatggaaatcagccccatgtgtgataaacacaacgcctccgttgagaagagccaggtgggattcatcgactacatcgtgcacccactgtgggagacctgggcagacttggtgcaccctgatgctcaggacattctggatacgcttgaagataatcgggagtggtatcaatctactattccacagtctccctccccggctcccgacgatccagaggagggaaggcaaggccagacagaaaaattccaatttgaactgaccttagaggaagacggcgaaagcgacactgaaaaagattccgggagccaggttgaagaggataccagctgcagcgacagcaaaacattgtgcacccaggatagcgagtcgacggaaattccactggatgagcaggttgaggaggaggctgtcggcgaggaggaagagtcacagccagaagcatgcgtcattgacgatcggagcccagatacgtag

SEQ ID NO: 234733 - DNA, 2247 bp, Artificial Sequence
  Description of Artificial Sequence: Synthetic coding sequence
atgaagcgaaacacctgtgacttgctgtccagatccaagtcagcaagtgaggagacgctgcattcgtccaatgaggaggaggatcccttccgaggcatggagccttatttggtcagaaggctctcctgcaggaatatccaacttccccctctcgcctttaggcagctcgaacaggcagacctgaagagtgagtctgagaacatccagaggcccaccagtctgcctttgaagattttgccccttatcgcaatcacgtccgcggaatcatctggctttgatgtcgacaatggaacgtccgctggcagatctccactggacccaatgaccagcccgggtagtggcttaatcctccaagcgaattttgtgcattcccagagacgggagagtttcctatatcgctcggactcagattatgatctgtcacccaagtcaatgtccaggaactcttcaattgcttccgacatccatggagatgacctgattgtgaccccctttgcacaagtgctcgcctctttgcgaacagtgaggaataattttgccgcactaaccaatctgcaggaccgggctccctctaagcggtctcctatgtgtaaccagccgagcattaacaaagcaaccatcacagaagaggcgtaccaaaaattagcatccgagaccctggaggaactggactggtgtctggatcagttggagaccctgcagacaagacactccgtttccgagatggcgtctaataagttcaaaaggatgctcaatcgcgaactaacacacttgtcagagatgtccaggtccgggaaccaagtcagtgagttcatcagtaatactttcctggacaaacagcacgaggtggaaattccatcccctacccagaaggaaaaggaaaagaaaaagcgccctatgagccaaataagcggcgtcaaaaagctgatgcatagctcctccctaacaaactcgtccatcccaagattcggggtcaagacagaacaggaggacgtcctcgcaaaggagctcgaggacgtgaacaaatggggcctgcacgtgtttcgcattgccgagttgtcaggcaaccgaccgttaaccgtgattatgcatactatatttcaggaacgtgatcttctcaagacatttaaaatacctgtggatactctcataacataccttatgaccctcgaggaccattaccatgctgacgtggcctaccacaacaacatacacgccgctgatgtagtacagtcaactcatgtgttgctgtccacaccagcactggaagctgtgtttacggatttggagattcttgcggctatcttcgccagcgccattcatgacgtggatcatcctggagtctccaatcaatttttaatcaataccaatagcgaattggcgctgatgtacaacgactcctccgtactcgaaaaccaccacctcgccgtcggattcaaacttttgcaagaggaaaattgcgatattttccagaacctgacgaagaagcagagacaatcgctaaggaagatggttattgacattgtattggcgacagacatgtccaagcatatgaatcttctggccgacttgaagaccatggttgaaacaaaaaaagtgacctcatcaggcgtgctgttgctggataactacagcgatagaattcaggtgctacagaacatggtccattgtgctgatctctcgaatcctaccaagcctctccagctgtataggcagtggaccgataggatcatggaagaatttttccgccaaggggacagggagcgcgaacggggtatggaaatcagccccatgtgtgataagcataacgccagtgtggagaaatcccaagtggggttcatcgattacatcgtgcaccctctatgggaaacttgggccgatctggtgcacccggacgctcaagacattcttgatactctggaagacaatcgtgaatggtaccagtccacgattccgcagagcccctctccagctcctgatgaccctgaggaagggcgacagggccagaccgagaagtttcagttcgagctgaccctggaggaggacggagaatccgatacagaaaaggatagtggctcccaagttgaggaggatacttcatgcagtgattccaagaccctgtgcacacaggacagcgagtccacagagattccacttgatgaacaggtagaagaggaagccgtcggagaggaggaggagtcacaaccagaagcctgtgtgattgacgatcggtccccagatacttag

SEQ ID NO: 234734 - DNA, 660 bp, Artificial Sequence
  Description of Artificial Sequence: Synthetic coding sequence
atggctcaacagaccagccccgacaccctcactgtccctgaggttgataaccctcactgtcccaacccatggctgaacgaggacctggtcaagagcctgcgggaaaacctgctgcaacacgagaagagcaaaacggcaaggaagtctgtgagccccaagttgagtccggtaatctccccccgtaatagtcccaggctattgcgcaggatgcttctatcttccaatatccccaaacagcgcaggtttacggtggcccacacatgttttgacgtcgacaacgggactagcgcaggcagatcccccctggatcctatgacatccccaggatctgggctgattctccaggcaaacttcgtacacagccagcgtcgcgaatcttttctgtatcgcagcgattctgattatgacctgtcccctaagagcatgagcaggaattcttcaattgcttccgacattcacggcgacgatctaatagtcacgccattcgcccaagtcctggcttccctgcgcactgtgcgcaacaatttcgccgcactaacaaatctgcaagaccgggctccttccaaacggagccctatgtgcaatcagccgtccatcaacaaggcaacaatcacgggttcctggatggagctaaatccgtatacattgctggacatgtag

SEQ ID NO: 234735 - DNA, 2040 bp, Artificial Sequence
  Description of Artificial Sequence: Synthetic coding sequence
atgagtatcattatgaagccacggagccggtcgacatcatcccttcggacagctgaggcggtgtgcttcgatgtagacaacggaacaagcgcaggtcgtagccctctcgacccaatgactagtcctggaagcggcctcatattgcaggctaatttcgtgcatagccagaggcgcgagtcatttctttatcgatctgattccgactacgatctgtcgccaaagtctatgagcaggaattcatctatcgcttccgacatccatggggacgacttaattgtgaccccgtttgcacaggtgcttgcttctcttcgcacagttcgaaataacttcgccgcactcacaaatctacaggaccgtgccccaagcaagcggtccccaatgtgtaatcagccttcaatcaacaaagccacaattacagaggaggcttatcagaagctagccagcgaaactctcgaggaacttgattggtgtctggaccagcttgaaactcttcagactcgacactcagtttccgagatggctagcaacaagtttaagagaatgctgaatagagagttgacccatttaagtgaaatgagcagatcaggaaatcaggtgtcggagttcatttctaatacttttcttgataagcagcacgaggtggagattccgagtcccacacaaaaagagaaggaaaaaaaaaagagacccatgtcccagattagtggcgtgaaaaaactgatgcattcatcctctctgaccaattcctccattccacggtttggagtcaagactgagcaggaggacgtactggccaaggagcttgaagatgtaaataagtgggggcttcatgtgttccggattgcagaactgtctgggaatagaccattgacagttatcatgcacacaatcttccaggagcgggacctgctcaagacttttaaaattcctgttgataccctcattacctacctgatgacattggaggatcactaccatgctgacgtagcataccataacaatatccacgccgctgacgtggtacaaagtacccatgtgttactctctactcctgccctggaggctgtgtttactgatctggagatcctagccgcaattttcgcctccgctattcatgacgtagatcatcccggagtaagcaaccagtttctcatcaataccaacagtgagcttgccttgatgtataacgattcctcagtattggaaaatcatcacctagctgtgggctttaagctgctgcaggaagaaaattgcgacatctttcagaacttgacaaaaaaacagcgccagtccttacgcaaaatggtcatcgatatcgtgctggccactgatatgtccaaacatatgaacctgctggccgaccttaagacaatggtggagactaaaaaagtgacctcaagcggcgtcctgttgcttgacaattatagtgatcgtatccaagtcctacaaaatatggtacattgtgctgatttatcgaatcctaccaagccattgcagctctatagacagtggaccgacaggattatggaggagttctttcggcagggtgatcgcgaaagggaacgcggaatggagatttcaccaatgtgcgacaaacataacgccagtgtggagaagtcccaagtggggttcattgattacatcgttcaccccctctgggaaacatgggctgaccttgtgcatccggatgcgcaggacatacttgataccctggaagataatcgagagtggtaccagtccaccataccccagagcccttccccagcccctgacgatccagaggaagggagacagggccagactgagaaatttcagttcgaactgaccctggaggaggatggtgaatcagataccgaaaaggactctgggtcccaagttgaagaggacacatcttgctccgatagcaagacactgtgtacacaggattccgagtccaccgagattcctttggacgaacaggtcgaagaagaagccgttggggaggaggaggagtcacaacccgaagcatgcgtgatcgatgaccgcagccctgatacctag

SEQ ID NO: 234736 - DNA, 1269 bp, Artificial Sequence
  Description of Artificial Sequence: Synthetic coding sequence
atggccagcaacaaatttaagcgcatgctgaaccgcgaattgacccacctttctgagatgagccgtagtgggaaccaggtatctgagttcatctccaatacctttcttgacaaacagcatgaggtggagataccatcccccacccaaaaggaaaaggagaaaaagaagcgtcccatgtcccagatttccggtgtgaaaaaacttatgcactcctctagcctgaccaacagctcgattcctcgatttggcgtgaagacagaacaggaagacgtattagccaaagagcttgaggatgtgaataaatggggtcttcacgtctttcgcatcgctgaactgtcaggaaatcgaccacttaccgtaattatgcataccatctttcaggagcgggacctcctcaagacattcaaaattcctgttgatacactgattacatacctgatgacactggaggaccattatcatgccgacgtggcgtatcataataatatacacgctgccgatgtggtgcagagcactcacgtacttctgagtacgccagccctcgaagctgtgttcaccgatctggaaatcctggctgctatattcgcctccgccatccacgatgtggatcatcccggagtctctaaccagttcctgatcaacaccaattccgagctggccttgatgtataacgattctagcgtgctggaaaatcatcatctggccgtggggttcaagctgttgcaggaagagaactgcgatatatttcagaacctgactaagaagcagcgccagagcctgcgcaagatggtaattgatatcgtactagcaaccgacatgtccaagcatatgaatcttctggctgacctcaaaaccatggtggagactaagaaggttacctcttctggtgtcctactcttagataattattcggacaggatacaggttctccagaacatggtgcattgcgccgacctgtctaatcctacaaaaccgctccagctgtatcgccagtggacagatcggataatggaggagtttttcagacagggagaccgcgagcgagagcgtggtatggaaatcagccctatgtgtgataaacacaacgccagcgtcgaaaagtcccaggttggtttcatagattacattgtccacccactgtgggagacctgggctgatctcgtccaccccgatgcacaagacatccttgacacactggaggataatagagagtggtatcagtccactattccccagtccccatcacctgccccagacgaccccgagtag

SEQ ID NO: 234737 - DNA, 246 bp, Artificial Sequence
  Description of Artificial Sequence: Synthetic coding sequence
atgaaaagaaacacctgcgatctgcttagtagaagcaaaagcgcctcggaagaaacacttcactcatctaacgaagaggaggatcctttccggggtatggaaccgtacctagtgcggaggctgtcctgtaggaatatccaactccctcctctcgcttttcgacagctcgagcaggccgatcttaaatctgagtccgaaaatattcagcggccaactagcctcccacttaagatcctgcctctctag

SEQ ID NO: 234738 - DNA, 2238 bp, Artificial Sequence
  Description of Artificial Sequence: Synthetic coding sequence
atggctcagcaaacctcccccgacacacttaccgtccccgaggttgacaacccacactgcccaaacccctggctaaacgaggacctggtaaaaagtctcagggaaaatctgctgcagcacgaaaaatctaagactgcgagaaaatcagtaagcccaaaactctcccctgtgatcagccccaggaacagccccagactgctgagacgtatgctgttgtcttccaacatccccaaacaacgtcgcttcaccgttgcccatacgtgcttcgacgtagataacgggacgtccgctgggaggagcccacttgatcctatgacttcacccggtagcggcctaattcttcaggctaacttcgtccattcacagcgcagagagtcttttctgtaccgatctgattccgactacgacctgagtcccaagtcaatgtcaaggaacagctctatcgcctccgatatccatggcgacgacttgattgtgacaccattcgcccaggtattggcgtcgctgcgtacggtgagaaacaacttcgcagcattaacaaatcttcaggaccgggcacccagtaaacgcagtcccatgtgtaaccaaccatccataaacaaggctacaatcaccgaagaggcatatcagaaactggcctcagagacccttgaagagttagactggtgcctcgaccaattggagactctgcagacccggcattctgtgagcgaaatggcatccaacaagttcaagcgcatgttgaaccgggaacttacccatttgtcagaaatgagtaggtcaggtaatcaggtgtccgaatttattagcaacacgtttctagacaagcagcatgaggtggaaattcccagcccaactcaaaaggagaaggagaagaagaagcgcccaatgagccagatctccggagtgaaaaaattgatgcattctagctctctaaccaattcctccatcccccgattcggagtgaagactgagcaggaggatgtgttagcgaaggagttagaggacgtgaataagtggggcttgcacgtgttccggatcgcagaactgagcgggaatcggcctctaactgtgataatgcacactatttttcaggagagagatctcttaaagacattcaagataccagtggacactctaatcacatacctcatgaccctggaggaccattaccacgcggacgttgcttaccacaacaacatccacgccgcagacgtggtacagagtactcatgtgctgctaagcacccctgccctggaggctgtgttcaccgacttggaaatcctggccgctatctttgcctccgccatccatgatgttgaccacccaggggtgtccaatcagttcttaataaatacaaattcagaattagccttaatgtataacgactctagcgtactagaaaatcaccacctggccgtgggtttcaagcttctgcaggaggagaattgcgacatatttcagaacttgacaaaaaagcagcgccagagcctgcgcaaaatggtgattgacatcgtcttggccacggatatgtcgaaacacatgaacctgctcgcagacctgaaaaccatggttgagaccaagaaggtgacatctagcggtgtacttttgctggataactattctgacaggatacaggtgttacagaacatggttcattgtgcagacctgagtaatcccaccaagcccctgcagctttacagacaatggaccgaccggataatggaagagttcttcagacagggggaccgcgagcgcgaacgaggaatggagattagcccaatgtgtgacaagcataatgctagcgtcgaaaaatcacaggtcgggtttattgactacattgtgcacccattgtgggagacttgggcagatctggtgcatcccgacgcccaggatatcttggataccttggaagacaatagggagtggtaccagagtactatcccacagagcccatcaccggcacctgatgacccggaggaaggcaggcagggccaaaccgagaagttccagtttgagctgaccctcgaagaggacggggagagtgataccgaaaaagacagtggttcccaggtggaggaggataccagctgctccgatagcaaaaccttatgcacccaggactccgagtcaaccgagattcctctagacgagcaggtggaagaggaagcagtcggggaggaggaggagtcacagccggaagcatgtgtaatcgacgacagatcacctgacacatag

SEQ ID NO: 234739 - DNA, 228 bp, Artificial Sequence
  Description of Artificial Sequence: Synthetic coding sequence
atgaaaagaaacacatgcgacttgctgtcacgctctaagtcagcgtctgaggaaactttacattcatctaatgaggaggaggatccatttagagggatggagccatatctggtgcgcagactcagttgcaggaacattcagctgcctccactcgcttttcgccagctggaacaagccgatctgaagtcagagagcgagaacatccagcgacccacatcactgccgtag

SEQ ID NO: 234740 - DNA, 2247 bp, Artificial Sequence
  Description of Artificial Sequence: Synthetic coding sequence
atgaagcgcaatacatgtgatctgctgtcccgatcaaagagtgccagtgaggagaccctgcactcaagtaatgaggaagaggatccatttcgtggtatggagccatatctggtgaggagacttagttgtcgcaacattcagctgccaccgttggcctttcggcagctagaacaggcagacttaaaatccgagagtgagaatatccagcgcccaactagtttacccctgaagatactgcccctgatcgccattacctcagctgagagctctggattcgacgtggacaatggaacatctgccggtcggagcccactggaccccatgaccagcccaggtagcggcctgattctgcaggccaatttcgtgcacagtcagcggagggaatcgttcctttatcgctccgactcagattacgacctatcccccaagtccatgagtagaaacagttccatcgccagcgatatccacggggacgacctgatagttaccccctttgctcaagtcctggcgtccctccgtactgtccggaacaacttcgcggctctgacaaatctgcaagatagagcaccatctaaaaggtctcctatgtgcaatcaaccatctattaataaggccacaattaccgaggaagcctatcagaaactggcgtccgagaccctggaagaactggactggtgtctcgaccagctggagaccttacaaacaagacacagcgtgagcgagatggccagcaataagttcaaacgcatgctcaaccgagagttgactcacctgagcgaaatgagcagaagcggcaatcaggtgtcagagttcatcagcaacacatttttagacaagcaacacgaggtggaaatccccagtcccactcagaaagagaaggaaaagaagaagcggccaatgtcccaaatctctggtgtgaaaaaactaatgcatagcagcagcttgactaatagctccatacccaggttcggggtgaagactgagcaggaggacgttcttgcaaaagaactggaagatgtgaacaagtggggccttcatgtcttcagaatcgctgagctttctggaaacagacccctcactgttataatgcatacaattttccaggaaagggatctcctgaaaacctttaagatcccagttgataccctgatcacctatctcatgaccttggaggaccattaccacgcagatgtggcctatcataacaatattcacgccgctgacgtggtccaatctacacacgtacttctctccacacccgcactggaggctgtctttacagacctcgagatcctagcggctatctttgcatccgctatccacgatgttgaccatccaggcgtgagtaatcagtttctcatcaacactaactctgaactggcactaatgtacaacgattcgtccgttttggagaaccatcatctggcagtgggctttaaactccttcaggaggagaactgcgatatttttcagaatctgactaagaagcaacgccaatctcttaggaagatggtgatcgacattgtgctcgcaacagatatgagtaagcacatgaacctcctggcggacctgaaaactatggtggaaactaaaaaggttacatcttctggcgtactgctcctcgacaattattccgatcgaatccaagtgctccaaaacatggtgcactgtgctgatctgtccaaccctacaaagccactccagctgtaccgccagtggactgataggatcatggaggagtttttccgacaaggcgaccgtgagcgcgagcggggaatggagataagtcccatgtgcgacaagcataacgcatccgtggagaaatcccaggtcggcttcattgactatatagtccacccgctctgggagacatgggccgacctggtccatcctgacgcccaagacatcttggataccctcgaagacaatcgtgagtggtaccaatcaacgattccacagtccccaagtccagccccagacgaccctgaagaaggaaggcaaggacagaccgaaaaattccagttcgagttgaccctggaagaagacggcgagtcagacaccgaaaaggactcaggctcccaagttgaggaagacacttcctgcagcgacagcaaaactctatgtactcaggactcagaatcgactgaaatcccgctggatgaacaggtggaggaggaagccgtgggggaggaggaggagagtcagcctgaggcctgcgtgattgacgataggtctcctgatacctag

SEQ ID NO: 234741 - DNA, 2502 bp, Artificial Sequence
  Description of Artificial Sequence: Synthetic coding sequence
atgctgccctttggggacaaaacaagggaaatggtgaacgcctggttcgccgaacgcgttcacacaattccggtctgcaaggagggtataagaggccacaccgagagctgctcctgccctcttcagcaatcccccagagccgataactcagcccctggaacccctacccgcaagatttcagcatccgagttcgatagacccttgagacctattgtggttaaagactccgagggcaccgtaagcttcctctccgactcagagaaaaaggaacaaatgcctctgaccccacccagatttgaccacgatgagggggatcaatgttcaagactgctggaacttgtaaaggatatcagttcacacctcgacgtaactgcactttgccataaaatattcctacacatccatggcttgatttccgccgatcgctattctttatttctggtatgtgaggatagttcaaatgataaattcctgatttcacgactgtttgacgttgctgaaggctccacactggaggaggtgtctaacaattgtattagactcgagtggaataaggggatagtgggccatgtggctgctctgggcgagcccctaaacatcaaagacgcctatgaagatcccaggtttaacgccgaggtggatcaaataaccggttacaagacgcagagcatcctttgcatgcccattaaaaaccatcgggaggaagttgtgggagtagcccaggccatcaataaaaagtccggaaatggcggtacttttactgagaaggacgaaaaagacttcgccgcatacctcgcgttttgtggcattgtgctccataatgcccaactgtatgagacttctttgctggagaacaaaaggaaccaggtgctcctggacctagcatcgctgatcttcgaggagcaacagtcccttgaggtgattctcaaaaagattgcagccaccattatttcttttatgcaagtacagaagtgcacaatctttatcgtcgacgaagattgcagtgattccttcagcagcgtattccatatggagtgcgaggagctcgaaaaaagctctgataccctcacgcgggaacacgatgctaataagataaattatatgtatgcccaatacgtgaaaaacaccatggaaccccttaatatccccgacgtaagtaaagacaaaaggttcccatggacaaccgaaaacacgggaaacgtgaatcagcagtgcattcgttctctgttatgcactccgatcaagaatggaaagaagaataaggtgatcggcgtgtgtcagctggtgaacaaaatggaggaaaatacaggaaaggtgaaaccttttaatcgaaacgacgaacagttcctagaggcattcgtgatattttgtggtttgggaatacagaacacccagatgtacgaagccgtggagcgggctatggccaagcagatggtgacgctggaagtgttaagttaccacgcgagcgctgcagaagaggagacaagagaactgcaaagtctggccgctgctgttgttcctagcgcccagacgctaaaaattacagacttctctttcagcgacttcgagctgagcgatctggagacggccctttgcacgattagaatgttcaccgatctaaatctggttcagaacttccagatgaaacatgaagtcctctgccggtggattttatcagtgaagaaaaactaccgcaagaatgtagcgtatcacaattggcgtcatgctttcaacacagctcaatgtatgtttgctgctcttaaagcaggcaagatccagaacaagctgaccgacttggaaatcctcgctcttctcattgccgctctctcccacgatctcgatcaccgaggtgtcaacaacagttacattcagaggtccgagcatcccctcgcccagctgtactgtcactccatcatggagcaccaccactttgaccagtgcctgatgatcctgaactcccctggcaaccagatcctgagcggactgtccatcgaggaatacaagacaacccttaaaattatcaaacaagcaatcttagcgacagacttagcattgtacatcaagcgacgaggcgagtttttcgagttaattcgaaagaatcagttcaacttggaggatccgcaccagaaggagctgttcctggccatgttgatgaccgcgtgtgatctctcggctatcactaaaccctggccaatccaacagcgaattgccgaactggtcgccacagagttcttcgaccagggggacagggagcggaaagagctgaatattgaacctaccgatcttatgaacagagagaagaaaaacaagatcccctcgatgcaagtaggctttatagatgctatctgtctgcagttgtatgaggcactgactcacgtgtcagaggattgcttccctcttcttgacggctgcagaaagaatcgacaaaagtggcaggctctcgccgagcagcaagaaaagatgttgataaacggagaaagtggccaggcaaaacgcaattag

SEQ ID NO: 234742 - DNA, 2628 bp, Artificial Sequence
  Description of Artificial Sequence: Synthetic coding sequence
atggagagggctggaccgagctttggacagcaaaggcaacagcaacagccccagcaacagaaacagcagcagagagaccaggactcagtggaagcctggctcgatgaccactgggattttacgtttagttattttgtgcgcaaagccactagggaaatggtgaatgcctggttcgcagagagggtgcacaccatcccagtgtgcaaggaggggataagggggcatacagagagctgcagctgcccattacaacagtcccctcgcgctgataattcagccccaggtactccaacccggaagatttcggcctccgaattcgatcggcctctgcgccctatcgtggttaaagactcagagggcacagtgtcttttttaagcgactcagaaaaaaaggagcaaatgcccctgactcccccacgctttgaccacgatgaaggagaccagtgctcccgactgctcgaactggtgaaagacatatccagccacctggatgttactgccctctgccataagattttcttgcacatccacgggctgattagtgccgacagatatagtctgttcctggtgtgcgaggactctagcaacgacaaatttctgataagcagattattcgatgtggctgagggatcaactctggaggaggtcagcaataactgcattcgcctcgagtggaataaggggatcgtgggccatgtcgccgctctgggggagccattgaacattaaggatgcctatgaagatccaagattcaatgctgaggtagaccagataacaggttacaagacacagagtattctgtgcatgcctatcaaaaaccatcgggaggaagttgttggtgtagcgcaggcgatcaataaaaagagcggaaatggaggtacattcaccgagaaggatgagaaggatttcgccgcttatctggccttctgcggtatcgtcctccataacgcacaattatacgaaacgtccctcttggaaaacaagcgcaatcaggtcctgctcgaccttgcatctctgatcttcgaggagcagcagtctcttgaagtaatcctcaaaaagattgctgccaccatcattagcttcatgcaggtgcaaaagtgcacaatcttcatcgttgatgaggattgctcagacagcttttccagcgtctttcacatggaatgcgaggaactggagaaaagctccgacaccctaacacgggagcacgacgcaaataagatcaactacatgtatgcacagtacgtgaagaacactatggagcctctgaacattcctgacgtgagcaaagataaaagattcccatggactacagaaaacactggcaacgtgaaccagcaatgcattaggagcctcctttgcacccccatcaagaacggaaagaagaacaaggtgataggagtatgtcagttagtgaataagatggaagaaaacacaggcaaggtgaaaccatttaatcgaaatgatgagcagtttttggaggccttcgtgatattctgcgggctcggcattcaaaatacccagatgtacgaagccgtggaacgcgcaatggccaaacagatggtgacgctggaggtgctttcataccacgcctccgccgctgaggaagaaactagagagctgcagagtctggctgctgccgtagtaccttccgcacagaccctgaaaatcaccgacttctcattttccgatttcgagctgtcggatcttgagactgccctttgcactattcgcatgtttacggatctgaatctggttcaaaatttccagatgaagcacgaagtcctgtgccgctggattctctccgttaaaaaaaattacagaaagaatgtggcataccacaattggagacacgccttcaacactgctcagtgcatgttcgctgccttgaaggccggtaaaattcaaaacaagctgaccgacttagaaatcctagcgttgcttatcgccgcactttcacatgacctggatcaccgaggggtcaacaactcctatatccagcgaagtgagcatcctctcgcccagctgtactgtcactccattatggaacatcatcacttcgaccagtgtctcatgattctcaacagtcctggaaatcaaatccttagcggtttgtccattgaggaatacaagaccacgcttaaaatcattaaacaggctattctggcgaccgacctggccctctacatcaaaaggagaggtgagttctttgagcttattagaaagaaccagtttaacctggaggatccccaccagaaagaactgttcctggctatgctcatgacagcatgtgatctctccgcaatcacaaagccttggcccatccaacagaggattgccgaactcgtggccactgaattcttcgatcagggggatcgtgaacgaaaagaactgaatatcgagcccaccgacctgatgaacagggaaaaaaaaaacaagatcccatccatgcaagtgggcttcatagacgctatctgtctgcagctttatgaggccttgacccacgtgtctgaggactgttttcccctcctcgacggatgtagaaagaaccgccagaagtggcaggctctggctgaacagcaggaaaagatgttaattaacggggaaagcggccaggcgaagcgaaactag

SEQ ID NO: 234743 - DNA, 2472 bp, Artificial Sequence
  Description of Artificial Sequence: Synthetic coding sequence
atggtgaacgcctggttcgccgagcgagtacatacgatccctgtatgcaaagagggcatacggggacatacggaatcctgctcctgccctctccagcagtcacccagagcagacaattccgctcctggaacacccactcgcaagatatcagcaagtgagttcgacaggccgcttagacctatcgttgttaaagattcagagggcacagtctcatttcttagtgactcagagaagaaggaacaaatgcctcttacccctcctcgcttcgaccatgacgagggggatcagtgcagtaggctcttggagctggtgaaagacatatcctcacacctcgatgtgactgctttgtgccacaagatctttttacacattcatggcctaatcagcgccgataggtattctctattcttggtatgcgaggacagcagtaatgacaagttcttaatcagccgactgtttgacgtggcggagggctcgaccctggaggaagtatcaaataactgcatccggctggaatggaacaagggaatcgtgggccacgtcgcagcattaggtgagcctttaaatatcaaggatgcttacgaagacccccgtttcaacgccgaagtggatcagataaccggatacaagactcaaagcatcctatgcatgcccatcaaaaaccatcgtgaggaggtcgtcggagtagctcaggccatcaacaagaaaagcgggaacgggggaacttttacagagaaagacgagaaagatttcgccgcataccttgccttttgtggcatcgtgttgcataatgcccagttgtatgaaaccagtctgcttgagaacaagaggaaccaggtgctgcttgacttagcgtctcttatcttcgaggagcagcagtcactggaagtgatcctcaagaaaatcgcagctactatcatttcgtttatgcaggtccagaaatgtaccatctttatcgtcgacgaagactgctccgattcgttttctagcgtgttccacatggaatgtgaggaactcgagaagagcagtgacacattgacaagagaacacgatgcaaacaaaatcaattatatgtacgctcagtatgtaaaaaataccatggagccactgaacatcccagatgtcagtaaggataagagattcccatggacaacagaaaacactggtaacgttaaccaacaatgcataaggtcattgctttgtaccccaataaaaaatggcaaaaaaaacaaagtgatcggcgtctgtcagctcgtaaataaaatggaagagaacacaggcaaggtgaaacccttcaaccgcaacgatgagcagtttctggaggcttttgttatcttctgcggactgggaattcagaatacccagatgtacgaggccgtggagcgtgcgatggccaagcagatggtcaccctggaagttctgtcataccacgcaagcgccgcagaagaagaaactcgagagttacagtcattagctgccgctgtcgttccgtcggcacagaccctcaaaatcacagacttttccttttctgacttcgaattgtccgacctggagaccgccctgtgcactataagaatgttcacagacttgaacttggttcagaattttcagatgaagcacgaggtgctgtgtcgatggatcttgtcagtgaaaaaaaactatagaaagaatgtggcctaccacaactggcgtcatgccttcaacactgcccagtgtatgttcgctgcactcaaagcagggaagattcagaataaactcactgacttagagatattagccctgttgatagctgcgctctcacacgacctggaccaccggggagtgaataactcctatatccagcgcagtgagcatcctttagcacagctatattgtcactctattatggagcatcatcactttgaccaatgtctgatgatacttaattctcctggaaaccaaattctctccggcctgagcattgaggaatacaagacgacactcaagataatcaagcaggccatacttgccaccgacttagctctgtacatcaagcgaaggggtgagttctttgaactgatccgaaagaaccaatttaatctggaagaccctcatcaaaaggaactttttcttgcgatgctcatgactgcttgcgacttatccgccattacaaaaccctggccgattcagcagagaattgctgagttggtggcaaccgagttttttgaccaaggcgatcgtgaaaggaaggaactgaacatcgaacccactgatctcatgaaccgagaaaagaaaaataagattccttctatgcaggtcggcttcatcgacgccatatgcttacagttgtatgaggccctgacccacgtgagcgaggattgcttccctctactggacggctgtcgtaagaatagacagaagtggcaagcgcttgccgaacagcaagagaaaatgctgattaatggagaaagtggacaagccaagagaaattag

SEQ ID NO: 234744 - DNA, 2583 bp, Artificial Sequence
  Description of Artificial Sequence: Synthetic coding sequence
atgggggaagtcacagccgaggaagttgaaaaattcctggatagtaatataggtttcgccaagcagtactacaatctgcattatcgggcaaaactgatttccgacctgttgggcgctaaagaagctgccgttgatttttctaattaccacagcccatcatctatggaagaatctgagatcattttcgacctcttgagagacttccaggaaaaccttcagactgagaaatgcatattcaacgtgatgaagaaactgtgctttctgctacaggctgaccgtatgtctcttttcatgtacagaaccagaaacgggattgcagagttggcaaccagactcttcaacgtgcacaaagacgcagtactggaggattgtttagtgatgccagatcaagaaatcgtgtttcctctcgatatgggcatcgttggccatgtggcgcacagcaaaaagatagcaaacgtgccaaataccgaggaggatgagcatttttgtgatttcgtagacatcctcacagaatacaaaacaaaaaatattcttgcgagtccgattatgaacggtaaagatgtggtggctattattatggcggtcaacaaggtcgacggaagccacttcacaaagagagatgaggaaatacttctgaaatacctgaacttcgctaacctgataatgaaggtataccatttaagctatcttcacaactgtgagaccaggagaggccaaattctgttatggtctggttcaaaggtctttgaggaattgaccgatatagagcgtcagttccataaggcattgtacacagtccgagccttcctgaactgcgatcgctacagtgtaggactgctggatatgaccaagcagaaagaattttttgatgtttggccggtactcatgggcgaggttccaccttactcgggcccacgcactcccgacggccgagaaatcaatttctataaggtgatagattacattctgcacggaaaggaggacattaaggttatcccaaatcctcctccagatcattgggcgctggtgagcgggctgccggcatatgtggcacagaacggattgatctgcaatatcatgaacgctcctgcagaggatttcttcgctttccagaaggagcccctcgacgaaagcggatggatgatcaagaatgtgcttagcatgcccattgtcaataaaaaagaagagattgtcggcgttgcaactttctacaacagaaaggatgggaagccttttgatgagatggacgagaccctgatggagagtctaacgcagttcttaggctggtcagtcctgaatcctgatacatacgagagtatgaataaattggagaacagaaaggacatttttcaagatattgtgaagtaccacgtcaaatgcgacaacgaagagattcagaaaatcttgaagacaagagaggtgtacggcaaggagccctgggaatgcgaggaggaggaattggccgagatactgcaggcggaattgccagacgccgacaagtatgagattaataagtttcacttcagcgacctgcctctgactgagttggagctagtcaaatgtggcatccagatgtactatgagctgaaagtagttgacaaattccacatcccccaagaagccttggtgcgtttcatgtacagtctgtccaaggggtatcggaagattacgtatcataattggagacacggcttcaacgttggtcagacaatgtttagcctgttggtcaccggcaagctaaaaaggtattttactgacttggaagccctcgctatggtgaccgcagccttttgccatgacatcgaccacaggggaaccaacaacctctaccagatgaagagccagaatcccctcgcaaagctccatggatctagcatcctcgaaaggcaccaccttgagtttgggaaaaccctgcttagagacgagagcctgaacatctttcagaatctgaatcggcgtcagcacgaacacgctatacatatgatggatatcgcaatcatcgctactgatctggccctctattttaagaaacggacaatgttccagaaaattgtggaccagagcaagacttatgagtctgaacaagagtggacacagtacatgatgttggagcagactcggaaggagattgtgatggcgatgatgatgacagcctgtgacttgtctgcaatcacgaagccctgggaagtccagtcacaagtcgccctactcgtggctgcagaattttgggagcagggcgacttggagaggactgtgctgcaacagaacccaataccgatgatggatcggaacaaagccgatgagctgcctaagctccaggtcggcttcatcgacttcgtctgtaccttcgtttataaagaatttagtcgatttcacgaagagatcacacccatgctggatggcattacgaataatcgaaaagaatggaaggcactggccgacgaatatgacgctaagatgaaggttcaggaagagaaaaaacagaaacagcaatctgctaaatcagcggctgccggtaaccagccgggaggaaatccctctccagggggagcaacaaccagtaaaagttgctgcatccaatag

SEQ ID NO: 234745 - DNA, 1728 bp, Artificial Sequence
  Description of Artificial Sequence: Synthetic coding sequence
atgacaaaggagaaggaatttttcgacgtctggagtgtcttaatgggcgagtcccagccctactccggtcccaggacaccagacggaagagagatcgtgttctataaagtgatcgactacgtgctgcacggtaaggaagagattaaggtgatcccaactcccagtgcggatcactgggcactggcgagtggcctgccaagctacgtggcggaatccgggttcatatgcaatatcatgaacgcaagcgcagatgaaatgttcaagtttcaagaaggggctctggatgattccgggtggctcatcaaaaatgtgctcagtatgccaatcgtgaataagaaggaagagattgtgggcgtggctacattctacaatagaaaggacggcaaaccttttgacgagcaggacgaggtgctgatggaatccttgacgcaattcctaggctggagtgtaatgaatactgacacttatgacaaaatgaacaagctggaaaatcgaaaggacatcgcacaagacatggtgctgtatcacgtgaagtgcgatagggatgagatccagctgatcctgccgacgcgagccaggctcggaaaagaacccgctgattgcgatgaggacgagctcggagagattctcaaagaggaactcccaggacccacaaccttcgatatttatgaatttcatttttccgatttggagtgtacggagttggatcttgtgaagtgcgggattcagatgtactatgaattaggggtcgtacgcaagttccaaatccctcaggaagtgctagttagatttctcttctcgatcagtaagggatatagaaggatcacgtaccataactggcgacacggattcaacgttgcccagaccatgttcacgctccttatgaccggaaagctgaaaagctattacacagacctagaggcattcgccatggttactgccggtttatgtcatgacatcgaccaccggggaacaaacaatctctatcaaatgaagtcccagaacccactggccaagcttcatggtagctccattctggagcgtcaccaccttgagttcggtaaatttctgctcagcgaggagactctcaacatttaccagaacctgaaccgtcggcagcacgagcacgtcatccacctaatggacattgcaatcatagccacagacctggcgctctactttaagaagcgagccatgttccagaagatagtcgacgagtcgaaaaactatcaagataaaaaatcatgggttgagtatttatcccttgaaaccacgcggaaggagatagtgatggccatgatgatgaccgcatgcgatctgagcgctattacaaaaccctgggaggtgcagagcaaggtggctcttctggtagcagccgagttttgggaacagggagatctcgaaaggaccgtcctggaccagcaaccaatcccaatgatggacagaaataaagccgcagaactccctaaattgcaggtgggctttattgatttcgtgtgcactttcgtgtacaaggaattttctcgtttccatgaagaaattctgccaatgtttgaccggctccagaacaataggaaagaatggaaagccctggcggacgagtatgaagcgaaggtgaaggctctggaagaaaaggaggaggaagaacgtgttgccgcaaagaaggtcgggacagagatttgcaacgggggacccgcacctaagtcttctacctgttgtatactttag

SEQ ID NO: 234746 - DNA, 2562 bp, Artificial Sequence
  Description of Artificial Sequence: Synthetic coding sequence
atgagtctctcagaagaacaggcccgatcatttctcgaccagaatcccgattttgctagacagtactttggcaaaaaattgtcaccagagaacgtggccgcagcatgcgaagacggctgcccaccagactgtgatagtttgcgcgacttgtgccaagttgaggaatccaccgcactgcttgaactggtccaggacatgcaggaatccataaacatggagagggtcgtgtttaaagtgctgcggcgactttgtacattattgcaagctgacagatgcagcctgttcatgtatcgccagcgtaacggggtggccgagctggcaacccgtctgttttccgtccagcctgatagtgttcttgaggattgcttagtgccccctgacagcgaaattgtgttccccctggatatcggggtagtggggcatgtcgcacagaccaagaagatggtgaatgtggaagacgtggcagagtgcccacatttctccagttttgcagacgagctcacggactataaaaccaaaaatatgctggctaccccgataatgaacggaaaagatgttgttgctgtcatcatggctgttaataaactgaacgggcctttctttacatccgaagacgaggatgtcttcctcaaataccttaatttcgccactctttatttaaaaatataccacctgtcgtatctgcataattgtgaaactcggcgaggccaggttctgctttggtcagcaaacaaagtgttcgaagagctgaccgacatagagagacaattccataaggcgttttataccgttcgggcttatctcaactgcgaaagatacagcgtagggctactggacatgaccaaggagaaggaattttttgatgtttggtccgtgctgatgggcgaatctcaaccatactccggaccacggacccccgacggtagagaaatcgtattttacaaggtcatcgactatgtgctacatggtaaggaagagattaaggtcatccctacaccatccgccgaccactgggccctggcatcaggactgccctcctacgtggcagagagtggcttcatttgtaatatcatgaacgcgtccgcagacgagatgttcaaattccaagaaggagccctggacgattcggggtggctgataaagaacgtgctgtcgatgccaatagtgaataagaaggaggagatagtcggagttgcgaccttctacaatcgaaaggatggaaaacctttcgacgaacaagatgaggttttaatggagagtctcacccagttcctaggctggtccgttatgaacacagatacatacgataaaatgaacaaacttgaaaatcgtaaagatatcgcacaggatatggtgctctaccacgttaaatgcgatcgggacgaaattcagctgatccttcctacccgggctagactggggaaggagccggctgactgtgacgaagacgagctgggagagatcttgaaggaagaactgccaggcccaaccactttcgatatctatgagttccatttctctgacctggaatgcaccgaacttgaccttgtgaaatgtggtatacaaatgtactacgagctgggcgtggtgcgtaaattccaaattccacaggaagtgttggttcgctttctattttccatttccaaagggtaccgaagaataacctaccacaactggcgacacgggttcaacgtggcccagacgatgttcacccttttgatgaccggaaagctgaaatcatactataccgacctggaggcgtttgccatggtcactgccggactgtgccatgacattgatcacaggggtacgaataatctctaccaaatgaaaagccagaacccattggccaagttacacgggtccagtatcctggaaaggcaccatcttgagttcggtaaatttctcctgtctgaggaaacattaaacatctaccagaaccttaatcgtcgtcagcacgagcacgtgatccatctaatggatattgccattattgccactgatctagcgttatacttcaagaaacgggctatgttccaaaagatcgttgacgaatcgaaaaattatcaggacaagaaaagctgggttgagtatttgtccttagagacaactaggaaggaaattgtgatggccatgatgatgaccgcctgcgatctatctgcaatcacaaagccatgggaagtgcagtccaaggttgccctcctggttgccgcagagttttgggagcagggcgacttggagagaacagtccttgatcagcagccaatcccaatgatggaccggaacaaagcagctgagttacccaaactgcaggtaggattcatcgatttcgtgtgcacctttgtatacaaagaattctcacgcttccatgaggaaattctgccgatgttcgatcgtcttcagaacaacaggaaggagtggaaagccttggcggacgaatacgaggctaaagtgaaagcattggaagaaaaggaggaagaagaacgggttgccgctaaaaaaggaaccgaaatttgcaatggcggacctgctcccaagtcttctacttgttgcatcctgtag

SEQ ID NO: 234747 - DNA, 2565 bp, Artificial Sequence
  Description of Artificial Sequence: Synthetic coding sequence
atgagcctcagtgaggagcaagccaggtccttcctggaccagaaccctgacttcgcaaggcagtatttcggcaagaaactgtctccagaaaacgtggcagcggcatgtgaggatggctgtccccctgactgcgattcccttcgtgacctttgccaggtggaggagtctaccgctctcctggaactggtgcaggatatgcaggaatctataaatatggagcgggtcgtctttaaggttctgaggcgcttgtgcacactccttcaggcagaccgttgtagtctgttcatgtatcgacagaggaatggagtggccgagttggccacgcggcttttttccgtgcagcctgacagcgtgctggaggattgtctggtgccacctgactcggagatagtgttccctctggacatcggggtcgtaggtcacgtcgcccaaactaagaagatggtgaacgtagaggatgttgcagagtgtccacacttctcatcctttgcagatgagctgaccgactataagacaaaaaacatgctcgcgacacccattatgaacgggaaagatgttgtcgcagtgataatggccgtgaataagctcaacggcccttttttcaccagcgaggacgaggatgtgttcttgaagtaccttaactttgccactctttatttgaaaatttaccaccttagttatctgcacaattgcgaaactcgtcgcggacaggtgcttctttggtcagcaaacaaagtattcgaagagctaaccgatattgagcgccagtttcataaggcattctacacggtcagagcgtaccttaactgcgagcgctactctgttgggctgctcgacatgactaaagagaaagagttctttgatgtgtggtctgtgttgatgggagaatctcagccatactctggccctaggacgccggatgggagagaaatcgtattttacaaggttatagattatgtgctgcacggcaaagaggagatcaaggtgattcccaccccctctgccgatcactgggccctggccagcggcctaccttcgtacgtggccgagagtggctttatctgtaacattatgaacgctagtgccgatgaaatgtttaagttccaggagggtgccctggacgattcaggctggctgatcaaaaatgtcttgtctatgccaatcgtgaataaaaaagaagaaatcgtgggggtggcaacattttacaacagaaaagacgggaagccgttcgatgagcaggatgaagtgttaatggagtcacttactcagttccttgggtggtccgtcatgaatacagacacatatgataagatgaacaagcttgaaaatcgaaaggacatcgctcaagacatggttctttatcatgtcaagtgcgaccgcgatgagattcagttgattctcccgacccgggcacgattagggaaggagccggctgactgcgacgaagatgagttaggagaaatcttgaaagaagaactccctggcccaacaacctttgacatatatgagttccacttcagtgacctcgaatgcacagagctggaccttgttaagtgcggaatccagatgtattatgagctcggagtggtgagaaaatttcaaatcccgcaggaggtgctggtccgatttttattcagcattagtaagggctatcggcgtattacttaccacaattggagacatggctttaatgttgcacagaccatgttcaccctcttgatgaccggtaagctgaagtcctattatacagacctggaggctttcgcaatggttaccgccggtctgtgtcatgatatcgatcacagaggtaccaacaacctgtaccagatgaagagccaaaatcccctggctaaattgcacgggtccagtatcttggagaggcaccacctcgaatttggaaagttcctgctcagcgaggaaaccctgaatatataccaaaatttaaaccggaggcaacatgagcacgtaatacatctgatggatatcgccataattgccaccgacttggcgctctactttaaaaaacgggcaatgttccagaaaattgtcgatgaaagtaaaaactaccaggacaaaaagtcctgggtggagtacctgtcacttgagaccacaagaaaggagattgtcatggctatgatgatgaccgcttgtgacctgtcagccataaccaagccctgggaagtgcagagcaaagttgcccttctggtagcagccgagttttgggagcagggtgacctcgaaaggaccgtgttggatcagcagccaatccctatgatggatcgcaacaaggccgctgagctgcctaagttacaggttggattcatcgatttcgtgtgcacttttgtatataaagaattcagtcggttccatgaagagattctcccaatgttcgatagacttcagaataatagaaaggagtggaaagctctagcagacgaatacgaggcaaaggtgaaggcgctggaagagaaggaggaggaggaaagagtagccgcaaagaaggtcgggactgagatctgtaatggcggtccagctcccaagagttctacttgttgtatactgtag

SEQ ID NO: 234748 - DNA, 2577 bp, Artificial Sequence
  Description of Artificial Sequence: Synthetic coding sequence
atgggggaaatcaatcaagtggccgtagagaaatatcttgaagagaacccacaatttgctaaggagtacttcgacagaaagctgcgcgtagaggtgttgggtgagatcttcaaaaatagtcaggtgcctgtgcagtctagcatgtcctttagcgagctcacccaagtcgaggagagtgcactttgtcttgaactcctgtggaccgtccaggaagaaggaggtacgccggaacagggcgtgcatagagcgctacaacggctcgctcatctcttgcaggcagaccgctgtagcatgtttctctgccgctcaaggaacggtattcccgaagtagcctctaggctgctggacgtaactccaacatcaaagttcgaggataatctcgtaggtcctgacaaggaagtggtgttccctctggacatcgggatagtggggtgggcggcacacacgaagaaaacccacaatgtgcctgatgtcaagaagaactctcacttctccgattttatggacaagcagacgggctatgtgacgaagaaccttctcgcgactcccatcgtggtggggaaggaagtgctggcagtcatcatggccgtgaataaggttaatgcaagcgagttttctaagcaggatgaagaggtcttttccaaatatctgaattttgtctccatcatccttaggctgcatcacacaagctacatgtacaacattgagtcacggaggtcccagatccttatgtggagtgcaaataaggtgttcgaggagctcaccgacgtagagcgccaattccacaaggccctgtacacggtcagatcctacctcaattgtgagaggtacagtattggactgttggatatgactaaggagaaagagttctacgatgaatggcccattaagctgggcgaagttgagccatacaaaggccctaagacacccgatggacgggaagtaaacttttacaagatcatcgattatatcctgcacggtaaagaagaaattaaggtgatccctacccctcctgcagaccattggacccttatcagcggacttcctacatacgtggcagagaacgggtttatatgcaatatgatgaacgctcctgccgatgagtacttcactttccagaagggccctgtagacgagacaggatgggtaataaagaacgtattaagccttccaatcgtcaataagaaagaggacatcgtgggagtggccaccttctataatcgaaaggatgggaaaccatttgatgaacacgatgaatatataactgagacactgacccagtttcttggctggtctctgctgaacaccgacacttacgacaaaatgaataagttagaaaacaggaaagacatcgcccaggaaatgcttatgaatcagactaaggctactcctgaagaaattaagagcatattgaaatttcaagagaagttaaacgtagacgtgatcgatgattgtgaggagaagcaactggttgccatcttaaaggaggatctccccgacccccgatctgccgagctatatgagttccggtttagcgacttccccctgactgaacatggattgattaaatgtggtatccggttattcttcgaaataaatgtggtagagaagttcaaagtcccagtagaggtgctcaccaggtggatgtacacagtgcggaagggatacagggctgtaacgtaccataactggagacacggctttaacgttgggcaaactatgtttaccttgctgatgactggcaggctcaaaaaatattacacggatctggaggcgtttgcgatgctcgctgctgcattttgtcacgacattgaccatcgaggaacaaacaacctatatcagatgaagagcacatcaccgctggccaggcttcatggtagctcaatcctggagcgccaccatctcgaatattcaaagacgttactgcaggacgaaagcctgaatatctttcagaacctgaacaagagacagttcgagactgtgattcacctcttcgaggtggcaatcatcgccacagatttagctctgtacttcaaaaagcgcaccatgttccagaagatagttgacgcctgcgagcagatgcagactgaggaagaggccattaagtatgttactgtcgatccgaccaagaaggaaattataatggctatgatgatgaccgcatgtgacctctctgctattactaagccttgggaggtacagtcccaggttgcgctcatggttgcaaatgaattttgggagcagggcgatttggagcgcacagtcctccagcaacaacccattcctatgatggaccgcaataagcgggatgaactacctaaattgcaggtgggctttattgactttgtgtgtacgttcgtgtacaaggaattttcgcggttccataaagagataacaccaatgctgagtggactccagaataatcgggttgaatggaagtcattggcagatgaatatgatgcgaagatgaaggtaatcgaagaggaggccaaaaagcaggagggcggagcagagaaggcggctgaagactctggaggcggtgatgataagaagagcaaaacctgccttatgctgtag

SEQ ID NO: 234749 - DNA, 453 bp, Artificial Sequence
  Description of Artificial Sequence: Synthetic coding sequence
atgagcgcaaaggacgagagggccagggaaatcctgagaggcttcaagctgaactggatgaacttacgcgacgccgagacaggcaagattctgtggcagggaactgaagacctgtccgtgcctggggttgagcatgaggctcgcgtgccaaagaagatcctgaagtgcaaagcggtgtccagagagctgaatttttcctctactgaacaaatggaaaagttccgactggagcagaaggtctacttcaaaggtcagtgcctggaagaatggttcttcgaatttgggtttgtcatccctaactccactaacacatggcaaagtcttattgaggccgctcctgagtcccagatgatgcccgcttctgtacttaccgggaacgttatcatcgagaccaaattcttcgacgatgatctcttagtgtccacatcaagggtgagacttttttatgtgtag

SEQ ID NO: 234750 - DNA, 414 bp, Artificial Sequence
  Description of Artificial Sequence: Synthetic coding sequence
atgaagcaacgggacaaaggtcgaggctggcaccccgctgagggtggacctgctctgaccgctcaacctcccgaaactaggcctgccctggaccggtcccgacgcgagagccgatcccagggctgccggggagtcagcgttagcttaacaatgaatctcgagcctccaaaagctgagtttcgctctgcaacccgagtcgcaggcggacccgtcacaccgagaaagggtcccccaaagttcaagcagcgacaaacacggcaattcaagagcaagcccccaaaaaaaggagtgcagggctttggggatgatataccaggaatggagggtctgggaacggatatcacagtcatttgtccttgggaagcgtttaatcacttagagttacacgagctggcacaatacggaatcatatag

SEQ ID NO: 234751 - DNA, 264 bp, Artificial Sequence
  Description of Artificial Sequence: Synthetic coding sequence
atgaatctggaacctcctaaggctgagtttagatccgcaacgcgagtggctggcggacccgtcacccctcgcaagggtcccccaaagttcaaacagaggcagactcgccagttcaagagtaagccccctaagaaaggagtgcagggattcggggatgatatccccggtatggagggactgggaactgacatcacagtgatttgcccctgggaggcatttaatcacctggagctccacgagctagcccagtatggcattatttag

SEQ ID NO: 234752 - DNA, 252 bp, Artificial Sequence
  Description of Artificial Sequence: Synthetic coding sequence
atgagtgacaatactactctaccagctcctgcatctaatcaagggcctaccacccccagaaaggggcctcccaagtttaaacagagacagacaaggcagttcaaatccaagcctccaaagaagggcgtcaaggggtttggggatgatatccccggtatggaaggcttgggcaccgacattacagtgatatgtccttgggaggcctttagtcacctggagctccacgaactagctcaatttgggatcatttag

SEQ ID NO: 234753 - DNA, 1371 bp, Artificial Sequence
  Description of Artificial Sequence: Synthetic coding sequence
atgggcatcaccttaatctggtgcctggcacttgtccttattaagtggatcacaagcaaacgaagaggagcaatatcctacgactcttccgaccagacagccctttacattaggatgctgggcgacgtgcgggtccggtcccgggcagggttcgagtctgaacgcaggggaagtcatccctacatcgattttcggattttccatagtcaatctgaaattgaggtgagcgtttctgcaagaaatattaggagactgctttctttccagcgatacctgcgatcatcacggttcttccggggtacggctgtctctaactcgctgaacattctggacgatgactacaacggtcaggcaaaatgtatgttggagaaagtgggcaactggaattttgacatcttcttattcgaccgcctgactaacggcaactcgcttgttagtctgacatttcatctgttctctttacacggactgatagaatattttcatctcgatatgatgaaattaaggaggttcttggtgatgattcaggaggactatcatagccagaacccctaccacaatgccgtgcacgccgctgacgtgacacaggccatgcattgttatcttaaggagcccaagctggctaattccgtaacgccatgggacatcttgctctccctgatcgccgcagccactcacgatctcgaccatcccggtgtgaatcagcctttcctgatcaaaacaaatcactacctggccaccctatacaaaaatactagcgtcctggagaatcatcactggcgctcagccgtaggactgctgcgcgaatccggactgttctcccatctgcccttagaatctcgtcagcagatggaaacacagatcggcgcactgatcctggccactgatatcagtcggcagaacgaatacctttccctattcagatcacacctggacaggggcgacctttgtctcgaggacacacgccaccgacatttggtgttacagatggccttaaaatgcgccgatatctgcaacccctgtcgcacttgggagctcagtaaacaatggtcagagaaggtgactgaggaattttttcatcaaggtgacattgagaaaaaataccacctgggggtcagcccattatgcgaccgacatactgagtccatcgctaatatacagattgggttcatgacatacctcgtcgaacccctgttcactgagtgggctcgattctcgaacacaagactatcccagaccatgctcggacatgtggggttgaacaaagcttcttggaagggtctccaaagggagcagtctagcagcgaagataccgacgctgctttcgagctaaattcacagctactgcctcaggagaacagactcagctag

SEQ ID NO: 234754 - DNA, 1275 bp, Artificial Sequence
  Description of Artificial Sequence: Synthetic coding sequence
atggaggtgtgctatcagttgcctgtgctgccccttgatcgccctgtaccacaacacgttctatcccgcagaggtgccatctccttctcgagcagtagtgctctgttcggttgcccaaatccacgtcagctcagccagcgccgaggggctatctcctatgacagctcggatcagaccgctctgtatataagaatgctcggcgatgtcagagtccggagcagagctggattcgagtccgaacgcaggggatcacatccttatatagatttcaggatttttcatagccagtctgagatcgaagtatccgtaagtgccaggaacatccgacgcctgttgtcgtttcagaggtatttgagatcctctagattctttcgcggaacggctgtgtcaaattcactcaatatcctcgacgacgactataatggtcaggccaaatgtatgctggaaaaggtggggaattggaatttcgatatctttctcttcgacagactgaccaacgggaatagccttgtctccttgacattccatctcttttctttacatggcctcatagaatatttccatctggatatgatgaagcttcggaggttcttggtcatgatccaggaggattaccactcacaaaatccctatcataacgccgtccacgcggcagacgtcacccaggctatgcactgctacctgaaggagcctaaactcgcaaacagcgtcaccccctgggacatattgctgagcctgattgcagccgcaactcacgacctggatcatcctggtgtgaaccaaccatttctgatcaaaaccaaccactacctcgccaccttatacaaaaacaccagcgtgcttgagaatcatcactggcgcagcgccgtcggcttgctaagggagagtgggcttttctcccacctacccttggagtcacggcagcagatggagacccagattggcgcactcatcctggccacggatattagccggcagaatgaatacctgtccctgttccggtcacatctggaccggggtgacttgtgcttggaagacacgcggcaccggcatctggtcctgcagatggccctgaaatgtgcagatatctgtaacccttgcaggacttgggagctttccaagcaatggtcagagaaagttaccgaagagttctttcatcaaggcgatattgaaaagaagtatcacctgggggtgtcaccactgtgcgaccgccacaccgaatcgattgccaacatccagatcggaaactatacctatttggatatcgctggctag

SEQ ID NO: 234755 - DNA, 1449 bp, Artificial Sequence
  Description of Artificial Sequence: Synthetic coding sequence
atggaggtctgctatcaacttccagtcctgccattggatagacccgttccccagcacgttttgtcccgccgaggggctataagcttcagcagtagttctgcactgttcggctgccccaacccccgacaattgtctcagagacggggtgctatctcttacgacagctcagaccaaaccgcgctgtacataaggatgttgggtgacgtacgtgtgcggtcaagggcgggattcgagtctgagcggaggggctcacacccttacatcgactttcgcattttccattcgcagtccgaaatcgaagtgtccgtgtccgcaagaaatattcggagattacttagctttcagcggtatctgcggtcaagccgctttttccgcggtacagcggtctctaacagcctaaatatattagatgacgattataacggtcaggccaagtgcatgttggaaaaggtgggtaactggaacttcgatattttcctgttcgaccgactcaccaacggcaattccctggtgtctttaacattccacttgttctccctccatggactcattgaatactttcacctggatatgatgaagctgcgacggtttttggtgatgatacaggaggattatcactcccaaaatccctatcataatgcagttcacgctgcagacgtaacgcaagccatgcattgctatcttaaagaacccaagctggccaatagcgtgaccccctgggacatcctgctgagtctgatcgcagcggcaacccatgacctagaccaccccggagtaaatcagccatttctgattaagactaatcactacctagccactctctataaaaatacatccgtgctggaaaatcaccactggcgtagtgccgtgggtctattgagagagtctggattgttctctcatctaccacttgagtcacggcagcagatggagacccagattggcgctttaatactggctaccgatatctccagacagaacgagtatctgtctttatttcgaagccatctcgaccgcggtgatctgtgtctggaggatacccgccaccgacacctggttctacagatggcccttaagtgcgcagatatatgtaacccttgccgtacctgggagctttccaagcagtggagtgagaaagtgactgaagagttcttccatcagggagacatagaaaaaaagtaccatttaggggttagcccactatgtgacaggcacaccgagagcatcgccaatattcagatcggcttcatgacttatctggtcgagccactgttcaccgaatgggcgagattctccaacacgcggctgagccaaactatgctagggcatgtgggccttaacaaggcatcatggaagggattgcagcgggaacagtctagttccgaagacaccgatgctgcctttgagttgaacagccaactcttaccccaggaaaatcgtctgtcgtag

SEQ ID NO: 234756 - DNA, 2490 bp, Artificial Sequence
  Description of Artificial Sequence: Synthetic coding sequence
atgggttgtgcaccaagcattcacattagcgagagactggtggctgaagacgctccttcacccgctgctcccccactgagttctggcggaccacgcttgcctcaaggccagaaaactgccgcactaccacggactcgcggtgcgggtctcctcgaatccgagctccgagacggctccggtaagaaagttgccgtagccgacgttcaattcgggccaatgagatttcatcaggaccagctgcaggtgctcttggtgtttacaaaagaggataaccaatgtaacggcttttgccgggcatgcgagaaagctgggttcaaatgcactgtgacaaaggaagcacaggccgtgctggcctgtttcctagataaacaccatgacatcatcatcatcgaccacagaaacccacgacagctggatgccgaggccttgtgtaggtctatcagatcaagtaagttgagtgaaaataccgtgattgtgggggtggtacggagggtcgaccgggaggaacttagcgtgatgcctttcatttccgctggatttactcggagatatgtcgaaaacccaaatatcatggcctgctataatgaactgcttcagctggaatttggggaagttcgttctcagctgaagctacgcgcatgcaatagtgtgtttactgctttagaaaacagtgaggacgccattgaaatcacctcagaggatcgctttatacagtatgccaatccagcgttcgaaacgactatgggataccagtctggggaattgatcggcaaggagcttggggaagtaccaatcaatgagaagaaagcagacctcctcgataccatcaattcatgcatccgcatcggcaaggaatggcaggggatatactatgctaaaaaaaaaaatggagataatattcagcagaacgtcaagatcatccctgtaattggccagggcggtaagatacgccattacgtaagcatcatcagagtgtgtaacgggaacaataaggccgagaagatcagcgagtgcgttcagagcgacacccatacagataaccagaccggcaagcacaaggatcgtcggaaggggtcattagatgtgaaggccgtggcctctcgagctacagaggttagttcccaacgcaggcatagctcaatggcccgaattcatagcatgactattgaggctcccatcaccaaagtgataaacatcataaacgctgctcaggaatcatcacccatgcctgtaaccgaagccctggaccgcgtgttggaaattctgcggaccacagagctctatagccctcagttcggtgccaaggacgatgacccacatgctaatgacctggtgggaggtttgatgagcgacgggctgagacgactgtccggaaatgagtatgttctgtccacgaaaaacacccagatggtgagttcgaatataattacccccatcagtttagacgatgtgccccctagaatagccagagccatggaaaacgaagaatactgggactttgatatcttcgagctcgaagccgctactcacaatcggcctttgatttatctggggctcaagatgttcgccaggttcggaatctgtgagttcctgcactgtagcgagtccacgctgaggtcatggctccaaattatcgaagccaactaccatagctctaacccttaccacaattctacacattcagccgacgtcttgcatgcgacagcctattttctgtcgaaagagcgtataaaggaaactcttgaccctattgatgaagtggccgcattgatagccgctacaatccacgacgtggaccacccgggacgaacaaatagcttcctgtgcaatgccggaagcgaactggccatcttatacaatgatacagcagtgcttgaaagtcaccatgctgcacttgcattccagttgactaccggcgatgacaaatgcaatatcttcaaaaacatggagagaaatgactatcgcactctgcgccaggggattatcgatatggtcctggcgaccgaaatgactaagcacttcgagcacgtgaataagttcgtgaacagtatcaataaaccactggccacactggaagagaatggggagacagacaagaaccaggaggtgatcaacacaatgctccggacacccgaaaatcgcacgctgatcaaacggatgctgattaagtgcgccgatgtgagtaatccctgtagaccccttcagtattgtatcgagtgggccgctaggatttcagaagaatatttcagccagacagatgaggaaaagcagcagggtcttccagtggtgatgcccgtgttcgacaggaacacatgcagtatccctaagtcccaaatttcatttatagattacttcatcactgacatgttcgacgcttgggacgcatttgtggacctccccgacctgatgcagcaccttgataacaactttaaatactggaaggggctcgatgagatgaagttaaggaacctgagacccccacctgagtag

SEQ ID NO: 234757 - DNA, 2352 bp, Artificial Sequence
  Description of Artificial Sequence: Synthetic coding sequence
atgggctgcgccccatctatacatattagcgagagattagtggcagaggacgcaccatctcctgcagctccgccactgagctctggcggaccaaggctcccacagggacagaaaacagccgctctgccacggaccaggggcgctggcttgctggaaagtgagttgcgcgacggctcggggaagaaagtagccgtcgccgacgtccagtttggacctatgagattccatcaggatcaattgcaggttctattagtgttcacgaaggaggataaccagtgtaacgggttttgccgggcatgcgagaaagctggatttaagtgcacagtgactaaggaagcacaggcggtgctcgcttgcttcttggacaaacaccatgacatcatcataattgaccacaggaaccctagacagctggatgccgaagcactctgccgctctatccggagtagcaaattgtcagagaacacggtgattgtgggcgtcgtccgaagggtggaccgcgaggaattgtcagtgatgccctttataagcgctggctttacaagaaggtacgtcgaaaaccccaacataatggcgtgttacaacgagctattgcaactggagttcggggaggtgagatctcagctgaagttgagggcttgtaatagcgtcttcaccgctctagaaaattccgaggacgctatagagattacatccgaggatcggttcatacaggagtggcagggaatctactacgccaagaaaaagaatggggataacattcagcaaaacgttaaaattattccagtgatcggccagggcggaaagatccggcactatgtgagtattatccgcgtctgtaacggaaacaataaagccgagaaaatctcagaatgcgttcagtcggacacgcatactgacaatcagactgggaagcataaagatagaaggaagggaagcctcgacgtaaaagcagtcgcctcaagggcgaccgaggtgagctcccaaaggaggcattccagtatggcacggattcattccatgaccatcgaagccccaatcacaaaagtgatcaacattatcaatgctgcccaggaatcatcaccaatgcctgtaaccgaggctctggacagagtcctcgaaatccttcgtaccactgaactgtattcaccgcagttcggcgctaaggacgacgaccctcatgccaatgaccttgttggagggctgatgagcgacgggctgaggagattgtcgggtaatgagtacgtgttgagcacaaaaaacacacagatggtttccagcaacatcatcacacctatttcgctcgacgacgtcccccctagaatagcaagagctatggagaacgaagaatattgggacttcgatattttcgaacttgaagccgcaacccacaaccggccactgatctaccttggacttaaaatgttcgctcgatttggcatctgtgaatttttgcactgctccgagtccactctgaggtcatggctgcagattatcgaagccaactaccactctagcaacccctatcacaactcaactcacagcgcggacgtgctgcatgctacggcctatttcctctcaaaagaacggattaaagagactctagatcccattgatgaggttgctgcactaattgcggctaccatccatgacgtggaccaccctggaagaacaaactcatttctgtgtaacgcagggagtgaactggccattctgtacaacgatacagccgtactggagagtcaccacgccgcactggcatttcaattgaccactggagacgacaaatgtaatatctttaaaaatatggagcggaacgactatcgcacgctcagacagggcattatcgacatggtcctcgcaacagaaatgaccaagcacttcgagcatgtaaacaaattcgtaaattcaatcaataagccactagccacactagaggagaatggagagaccgataaaaaccaagaggtaatcaacactatgctgcggaccccggaaaatcgtactttgattaagcgcatgctgatcaagtgtgccgatgtgtctaacccctgcagacccctgcagtactgtattgagtgggccgcaagaatttcagaagagtacttttcccaaacagacgaggagaagcagcaggggctccccgtggtgatgcctgttttcgaccgaaatacctgctcaatcccaaaaagtcagatctcatttatcgactactttatcacagacatgttcgacgcttgggatgcctttgttgacctccccgatctcatgcagcaccttgacaacaactttaagtattggaagggcctcgacgagatgaagctgcggaatctgcggcctccccctgagtag

SEQ ID NO: 234758 - DNA, 2490 bp, Artificial Sequence
  Description of Artificial Sequence: Synthetic coding sequence
atgggctgcgccccttctattcacatatctgagaggcttgttgcggaggacgcgcctagtcccgctgccccacccctgtcctctggcggacctcgtcttccccagggtcagaagaccgcagccttgccccgaacacgcggagcgggtttgctagagtctgagctccgggacggctctggaaagaaggtcgctgtggcagatgtccagttcggccctatgagattccatcaagaccagctgcaggtcttgctcgtttttacgaaagaggacaatcagtgtaacggtttttgtcgggcatgcgaaaaagctggttttaaatgcacggtcacgaaagaagcacaggccgtcctggcttgtttcctggacaaacatcacgatataattattatcgatcataggaacccgcgacagctagacgccgaagcactgtgccggagcattcgctccagtaagctcagtgaaaatactgtaattgtgggggtggttagacgggtcgaccgggaggagctgtcagttatgcccttcatctcggctgggttcactagacggtatgtcgaaaaccccaatataatggcatgttataatgagctcctgcagcttgaatttggggaggtgcgaagccaactgaagctgagggcatgtaacagcgtgtttaccgcactcgagaattccgaggatgcgattgaaataacatccgaagaccggttcatccagtacgccaaccccgcatttgagaccactatggggtaccagtcaggggagctgatcggcaaggaactaggggaggttccaataaatgaaaagaaggctgacctgctggataccattaatagttgcattaggatcgggaaggaatggcaaggtatctattatgctaaaaagaaaaatggcgacaatatccaacagaatgtgaaaattatccctgtgattggtcaaggaggcaaaatccgacactatgttagcattatcagagtgtgtaatggtaataataaggccgaaaagatttccgagtgcgtccagagcgatacgcataccgacaaccagactggaaaacacaaggacagaaggaagggtagtctggatgttaaggctgtggctagcagagctaccgaggtgtcatcccaacgcagacactcatcaatggccaggatccatagtatgactattgaggctccaataaccaaagtgattaatatcattaacgcagcgcaggaatcatcacccatgcccgtgacggaagccttggaccgcgttctcgaaatcctcagaaccactgaactctactcacctcagtttggcgctaaagatgacgacccacatgctaacgatctggtagggggactcatgtccgatgggctgcgccgactgtcgggtaatgagtatgtgctgagcactaaaaacacacaaatggtgagctcgaatattatcacaccaatatctttggatgacgtgccacccagaatagccagagccatggaaaatgaggagtactgggacttcgacatattcgagctggaggcagctacccacaaccgcccactcatttatctcgggctgaaaatgtttgcgaggtttggcatctgcgaattcctgcactgtagcgagtctaccttgcggtcctggttgcagatcatcgaggcgaactaccacagtagcaatccctaccacaacagtacccacagcgctgacgtgctgcacgccacggcttactttctgagcaaagagcgaatcaaagaaacactagatcccatcgatgaggtggccgctttgattgccgcaactatccacgatgtcgaccacccgggtaggaccaattcctttctgtgcaatgcagggtctgagctcgctattttgtataatgataccgcagtcctcgagtcccaccacgccgcattggctttccagctaacaacaggagacgataagtgtaacatttttaaaaacatggaaagaaatgactaccggacactgcgacagggcatcatcgacatggtactcgcaaccgagatgacaaagcactttgagcacgtcaataaatttgtaaatagtattaacaaaccactagcaactctggaggaaaacggggaaacagataaaaatcaggaggtgatcaatacaatgctccgcacccctgaaaacagaaccttaatcaaacggatgttaattaagtgtgccgatgtatccaatccttgccgcccactgcagtactgtattgagtgggccgcacgtatctctgaggaatactttagccagacagatgaagaaaaacagcagggattaccagttgtgatgccggtgttcgatcggaacacctgttcaatccccaagtcacaaataagttttattgattattttatcacagacatgtttgacgcctgggatgccttcgttgacctcccagatctgatgcaacacttagacaacaactttaagtattggaagggtctggacgagatgaagctgagaaatctccgaccacccccagagtag

SEQ ID NO: 234759 - DNA, 2274 bp, Artificial Sequence
  Description of Artificial Sequence: Synthetic coding sequence
atgcgctttcatcaagaccagttacaggttctgctggtatttacaaaggaagataaccagtgcaacgggttctgccgagcgtgtgaaaaggccggttttaagtgcaccgtgaccaaagaggcccaggctgtgttggcgtgtttcctcgacaagcatcatgatatcatcatcatcgatcacaggaaccctaggcagctcgacgcggaggccctgtgtcgcagtatcaggagctctaagctatctgagaataccgtgatagtcggtgtcgtgaggcgcgtcgaccgcgaagagcttagcgtgatgccttttattagtgcagggtttaccagacgctatgttgaaaatcccaatatcatggcttgctataatgagctgttacagctcgagtttggtgaagtgaggagccagctgaaattgagggcctgcaatagcgtcttcacagccctcgaaaatagtgaggatgcaatcgagattacgtccgaggaccggttcattcagtatgccaaccccgcattcgaaaccaccatgggatatcagtcaggcgaattgatcggtaaggaattgggcgaagtgcccatcaatgagaagaaagcagacctgctcgacacaatcaatagctgtatccgaatagggaaagagtggcaaggaatctattatgccaagaagaagaatggggacaacatccagcagaatgtcaagatcatacccgtcattggccagggcggaaaaatcagacattacgtgtccataattagagtgtgtaacgggaacaataaggcagaaaagataagcgagtgtgtgcagtctgacacgcataccgataatcaaaccgggaaacacaaggaccgacggaagggaagtctcgacgtgaaagccgtggcatccagagccacggaggttagcagccagcgaagacacagctcaatggccaggatacacagcatgactatcgaagcaccaattaccaaggttatcaatattatcaatgcagcccaagagtcttcccctatgccagtgaccgaagcgctcgacagggtcctggagatccttcggaccacagagctttattccccacagtttggcgcaaaagacgacgacccccatgccaacgatctcgtcgggggactaatgagtgatggcctgcgcaggctctccgggaacgagtatgtgctgtcaaccaaaaacactcagatggtcagtagcaacatcatcaccccaatctcccttgacgacgttccacctagaattgctcgtgctatggagaacgaagagtattgggacttcgacatttttgaactggaggctgccacccataacagacctctgatctatcttgggcttaaaatgtttgcaagattcgggatttgcgagttcctgcattgcagcgagagcacgctgcgcagctggctgcagattattgaggcaaactaccactcttctaacccctatcataattcaacacattcggctgacgtgctacacgccacagcttactttctctccaaggagcgcattaaagaaactctggacccgattgacgaggtagctgcacttatcgccgcaacaattcatgacgtagaccacccaggtcgaaccaattcattcctatgtaacgctggcagcgaactggctatcctttacaatgacacagcggtcctggagtcccatcacgcggctctggctttccagcttaccacaggagatgacaaatgcaacatttttaaaaacatggagcgcaatgattaccggacgttgagacagggtattatagatatggtgctggcgacagaaatgaccaagcacttcgaacatgttaataaatttgtgaatagtatcaataagccgctcgctactctcgaagagaacggggagactgataaaaatcaggaagtgatcaacacaatgctgcgcactccggaaaatagaaccctcatcaagcggatgctgattaaatgcgctgacgtcagtaatccatgcagacctctgcaatattgcattgaatgggcggcacgaatctccgaggagtacttctcccagacagacgaggagaaacaacaaggactgcccgtggtgatgcccgtattcgataggaacacgtgttcaatcccaaagagccagatttcgttcattgactattttataactgacatgtttgatgcttgggatgctttcgtggatcttcctgacttgatgcagcatttagacaataacttcaagtactggaagggtttggatgagatgaagctgcggaacctgagaccaccgccagagtag

SEQ ID NO: 234760 - DNA, 2658 bp, Artificial Sequence
  Description of Artificial Sequence: Synthetic coding sequence
atgggctgcgctcctagcatccatgtcagccaatcgggggttatttattgtcgggattctgatgaatcgagcagtcctcgccagacaaccagcgtctcccagggacctgcagcaccactgcctggcttgtttgtgcaaaccgacgccgctgatgctatccctccaagcagggcatccggcccacccagcgtcgctagggtccgacgcgctcgaaccgaactgggatctggttctagcgccggtagcgccgcaccagctgcaacgacctccaggggtcggcgtcgtcattgctgctcttccgccgaagcggagacacagacatgttacacatccgtaaagcaggtgagttccgccgaggtccgtatcggaccaatgaggctaacacaggatccaattcaggtcctgctcattttcgcaaaagaagattcacagagcgatggcttctggtgggcctgtgatcgggcaggataccgctgtaacatagctagaactccggaatcggctctggagtgcttcctggacaagcatcatgagatcatagtgatcgatcacaggcagactcagaacttcgatgccgaggctgtctgccgcagcattcgcgcaactaacccttccgaacacactgtgatcctggctgtcgtttcacgggtgagtgacgatcacgaagaggcttcagtgttacctctcctgcacgcgggatttaaccggcgttttatggagaacagcagcatcatcgcatgttataacgaattaatccagatcgagcatggagaagtgcgttcccaatttaagctgcgggcttgtaattccgtgtttacggctttggaccactgccatgaggccatcgaaatcaccagcgacgaccatgtgatccagtatgtcaaccctgccttcgagcggatgatgggataccacaagggagaattgctcggcaaggagcttgccgacctccctaaaagtgataagaaccgggcagacctgcttgacaccatcaacacgtgcattaaaaaaggcaaggagtggcagggcgtgtactatgccagacgcaaatctggcgacagcattcagcagcacgttaagatcactccagtgataggacaaggaggcaaaatcagacacttcgtgagtttaaagaagctgtgctgcaccaccgacaataataagcagattcacaaaatacaccgggacagcggggacaactcacagactgagccccatagtttcaggtacaaaaaccgcagaaaggaatctattgacgtgaagtcaattagcagccgagggtctgatgccccatctctgcaaaacagaagatacccctccatggcgagaattcattcgatgacgatcgaagcccctatcacaaaagtgattaacattataaatgccgcacaggagaattcaccagtgactgtggcggaagcattggatcgggtcttggagattctgcgaacaacagaactctatagccctcaattggggaccaaggatgaggacccccacacctctgatctagttggcggattgatgaccgacgggttgcgcaggttgtccggcaacgagtatgtgtttactaaaaacgtgcaccagtctcattcccatttagccatgcccattacaattaatgacgttcctccatgtatcagccaattgctcgataatgaagagagctgggactttaatatcttcgagctggaggctataacacacaagagacctttagtgtacctggggctgaaggtattctcccggttcggtgtatgcgagttccttaactgtagcgaaacaacccttcgagcgtggttccaagtcatcgaggcaaactaccacagcagcaatgcctatcataactccacgcacgccgctgatgtgctacatgcaaccgcatttttccttggcaaggaacgtgtaaagggctcgctcgaccagctggacgaggttgccgctctgattgctgccacagtgcacgatgtagatcaccccggaagaaccaactcttttctttgtaatgctggcagcgagctggctgtcctctacaatgatacagctgttctcgagagccatcacacagccctggcattccagctgacggtgaaggacaccaaatgtaacattttcaaaaatatcgacagaaaccattatcgcaccttaaggcaagcaattatcgacatggttctcgccaccgagatgaccaagcacttcgagcacgtaaataaattcgttaacagcatcaacaaaccgatggctgccgagattgaaggcagcgactgtgagtgcaatccagcgggaaagaacttccctgagaatcagatactgatcaagagaatgatgattaagtgcgcagatgtggctaacccctgtcggccacttgacctgtgcatcgagtgggcaggcaggatcagcgaggagtactttgcccagactgatgaagagaagagacaggggctgcccgttgtcatgcccgtgtttgatcgcaatacatgtagtatacccaagagccagatttctttcatagattactttattaccgacatgttcgacgcctgggatgccttcgcccacctgcccgcactgatgcaacacctggctgacaactacaagcactggaaaaccctcgacgatctcaaatgtaagtcgctccggctgccctctgattcttag

SEQ ID NO: 234761 - DNA, 2493 bp, Artificial Sequence
  Description of Artificial Sequence: Synthetic coding sequence
atgggttgcgccccttcgatccacgtcagtcagagcggagtgatatactgccgggactccgacgagagctctagccccaggcaaacgacctctgtgagccagggacctgccgcaccactgccgggactgtttgtgcaaactgatgcggctgacgccattccacccagtcgagcctctggccctccgtctgttgcccgagtgcgacgcgctagaactgagctgggctcggggtcctcagctggtagcgcggcacctgctgctaccactagcaggggcaggcggagacattgttgtagctccgcagaagccgagactcagacttgctatacgagcgtcaagcaagtttcgagcgccgaggtgagaattggaccaatgagactgacgcaggatcctatccaggtgctccttatcttcgcaaaggaagacagccaatccgatggtttctggtgggcctgcgacagggctggctaccgctgcaacatcgccaggacccccgaatctgctttggaatgttttctggataagcaccatgaaattatcgtgattgaccataggcaaacccaaaatttcgacgctgaggcagtgtgccggagcatccgcgctacaaacccctctgagcatactgtcattctggccgtggtttcccgtgtgagtgatgaccatgaagaggcttcagtgctcccgctcctgcacgccggatttaataggagatttatggagaacagctctatcattgcatgctacaacgaactcatccaaatagagcacggtgaagtacgttcccagttcaagcttagggcctgcaatagtgtatttaccgccctggatcattgccacgaagctatcgaaataacatccgatgaccacgtcatccagtatgtaaatcctgcttttgagcgcatgatgggataccacaagggagagctcctagggaaagagctggccgatctccccaagagcgacaaaaacagagccgatctgttggacactatcaacacttgcatcaagaagggcaaggagtggcagggagtctattacgcacgcagaaagtctggggatagcatacaacagcatgtgaagatcactccggttatcggtcagggcggaaagatcagacatttcgtatctcttaaaaagctttgttgtaccacggacaacaataagcagatccataaaattcatcgagatagcggggacaatagccagactgagcctcactcattccggtataaaaatcgtcgtaaagagtccattgatgtaaagagtatatcctcgagaggaagcgatgcaccgagcctgcagaataggagatacccttctatggcgaggattcactctatgacaatcgaggcccctatcactaaggacggcttgcgccgattgagtgggaacgagtacgtatttactaaaaatgtgcaccagagccacagccacctggcaatgccgatcacaattaacgatgttccaccctgtatcagccagttgctggataacgaggagtcctgggatttcaatatcttcgagcttgaggccataacacataagcgacctcttgtctatcttggactgaaagtcttctctaggttcggagtatgcgaattcctgaattgctcggaaaccactttgagggcctggttccaggtgatcgaagcgaactaccatagctcaaacgcctaccataacagcacacatgctgccgatgtcctacacgctacagcctttttcctgggcaaagaacgggtgaagggatctctcgaccagttggatgaggtcgccgcactaatcgccgctaccgtgcatgatgttgaccacccaggcagaacaaacagctttctctgtaacgccggttccgaactggcagtgttgtacaatgacaccgccgtgctggaatcccaccacaccgccctcgcctttcagctgaccgttaaggatacaaaatgtaacatattcaagaatatcgataggaaccactacaggacgcttaggcaggcaatcatcgacatggtgctagccacagagatgaccaagcatttcgaacacgtgaacaaattcgtgaattctataaacaaacccatggcggctgagatcgagggctccgactgcgagtgcaatcctgctggcaagaatttcccagaaaatcagattctcattaagcgaatgatgatcaaatgcgcggatgtcgcaaacccatgccgtcctctggatctttgcattgagtgggcaggtcgaatctccgaagaatattttgcccagacggacgaggagaagaggcaggggctgcccgttgttatgccagtgtttgatcgtaatacctgttctataccaaaatctcagattagcttcatagattattttatcacagatatgtttgatgcttgggacgcctttgcacacctgccagccctcatgcagcatctggctgacaattacaagcattggaagactctggacgacttgaagtgcaagagtctgagactgccctccgattcttag

SEQ ID NO: 234762 - DNA, 2517 bp, Artificial Sequence
  Description of Artificial Sequence: Synthetic coding sequence
atgggttgtgctccctccattcacgtgagccaaagtggtgtgatctactgccgggattccgatgaatcttcttcaccaagacagaccactagcgtttctcagggcccagcagcacccttacccggtttgttcgtgcaaactgatgccgcagacgccattcctccgtccagagcatcagggccacctagcgtcgctcgggtgcgaagggctcgtacggaactcggatcagggtcaagtgctgggtctgctgcacccgctgctaccacctccagggggaggcgcaggcattgctgctcttccgccgaggcagagactcagacgtgttacacatctgtgaagcaagtttcttctgccgaggtcaggatcggcccaatgcgactgactcaagatccaatccaggtacttctcatcttcgccaaagaggactcacagtcggacggattctggtgggcttgtgacagggccggatacaggtgcaatatagcgaggactcctgagagtgccctggagtgtttcctggataaacaccacgagataatcgtcatcgatcacaggcagactcagaattttgatgctgaggctgtatgcagaagtatcagggcaaccaatcccagcgagcatactgtcattctggctgtggtgtccagagttagcgacgaccacgaggaggccagtgtgctccccctgctgcatgctggcttcaaccgccgttttatggagaattcctctataattgcttgctacaacgaactgatacaaatcgagcacggcgaggtccggagtcagtttaagctccgggcatgcaactcagtttttactgccctggaccactgtcacgaagcaatcgaaatcactagcgacgaccatgtcatacaggagtggcaaggtgtctattacgcaagacgaaaatctggcgactccattcagcagcacgttaagatcacaccagttatcggccagggagggaagatccgtcactttgtttccctgaagaagctctgttgtaccactgacaacaataaacagatccacaagattcatagggatagcggagataacagtcaaaccgaaccacacagttttcgctacaaaaacagacgcaaagaaagcatcgatgttaaatctatctccagtcgcggaagcgacgccccatcactgcagaaccgaaggtaccctagcatggcccgtattcactcgatgacaatcgaggccccaatcaccaaggtcatcaacataataaacgccgctcaggaaaacagccccgttaccgtggcggaggctctagaccgcgttctcgaaatcttgagaacgactgaactttattccccccagctagggaccaaggatgaggatcctcacacatcagacctcgtcggcggactgatgactgacggattaagacgcctgagtggcaatgagtacgtctttaccaaaaacgttcaccagagccattcccacctggctatgcctataaccatcaacgatgtgcctccatgcatcagtcagctgctggataacgaggaaagttgggactttaatattttcgaactggaggctatcacgcacaaaagacctctcgtgtacctggggctcaaagttttctcacggtttggcgtgtgtgagtttctgaactgtagcgagactacacttcgggcttggttccaagtcatcgaagcaaattaccactctagcaacgcctatcacaatagtacgcacgcagcagacgtgctgcacgcaaccgccttcttccttggaaaagagcgggtgaaggggagccttgaccagctagatgaagtggcagcgctcatcgcagccacagtccacgatgtggaccaccccggacgtaccaactcctttttgtgcaatgccggttccgagctggccgtgctgtataacgatacagcggtgctcgaaagccatcatactgccctcgcatttcagcttacagtgaaggacaccaagtgcaatatcttcaagaatatagatcgcaaccactacagaaccctcagacaggctataattgatatggtgctcgccaccgagatgaccaaacactttgagcatgtaaataagtttgtgaactcaatcaataagcctatggccgctgagattgagggatccgactgcgagtgcaatcccgcaggcaaaaatttccccgagaaccagattttgattaagagaatgatgattaaatgcgctgatgttgctaatccatgccggcctctcgatttgtgcatcgagtgggccggtaggattagtgaagagtactttgctcagactgatgaggagaaacgccagggccttcccgttgttatgccggtttttgaccgcaacacatgttccatcccgaagtcgcagattagtttcatagattacttcattaccgacatgttcgacgcatgggatgcttttgcgcacctgcccgcacttatgcagcatttagcagataactataaacattggaaaaccctcgacgaccttaagtgtaagtctctccgcctgccttccgactcgtag

SEQ ID NO: 234763 - DNA, 2598 bp, Artificial Sequence
  Description of Artificial Sequence: Synthetic coding sequence
atgggatgtgctccttctatccatgtttcgcaatctggtgtgatctattgccgggactctgatgaatcaagctctccacggcagacaactagcgtctcacaagggccagccgcacctctgcccggtctgttcgtgcagacagacgcagcggacgcaatccccccatcacgggcttcaggaccgccaagcgtcgcccgagtgcgccgagcacgtactgagcttggctctgggtcgtcagccggatccgctgcccctgctgctacaacctctcgcggacgtagaagacattgttgcagcagtgccgaggctgaaacacagacatgctatacatcagtcaaggtgctactcatcttcgcaaaagaggactcccaatccgacggcttttggtgggcatgcgatcgcgcagggtatcggtgcaacattgccaggaccccagagagcgccctcgagtgcttcctggataaacaccacgaaattatcgtcatcgatcacagacagacccaaaactttgatgctgaggctgtgtgtcggtctatccgagccaccaatccaagcgagcataccgtgatcctggccgtggtctcgcgggtgtccgatgatcacgaggaagcttctgtgctccccctgctgcatgcaggcttcaacaggagattcatggagaactctagcatcatcgcctgctacaatgagctgattcagatagaacacggggaagtgcgttctcagttcaagttgagagcctgcaatagtgtgttcacagctctggaccactgtcacgaggccatagaaattacgtccgatgaccacgtaatacagtatgttaacccagccttcgaaaggatgatgggttaccataagggcgaactgctgggcaaagagctggccgacctgcccaaatctgacaaaaatcgagcagacttgttggatactattaatacctgtattaaaaaggggaaggaatggcagggggtgtattacgctagacgaaagtctggggactctattcagcagcacgtgaagataactcccgtcatcgggcagggcggaaagattcggcacttcgtgagcctgaaaaagctttgttgtacgacagacaacaataagcagattcacaagattcatagggacagcggagataacagccagacagaaccacactccttccggtacaaaaacaggcgcaaggagtctatcgatgtcaaatctatctcttctcgaggttcagatgcaccttctctgcagaatcgccgttatcccagcatggcgaggattcactcgatgacaatcgaagctccaattactaaagttattaatatcatcaacgctgcccaggagaacagccccgttaccgtagcagaggccctggatcgagtgttggagattctgcggacaactgagctctactcgccacagcttggaaccaaggacgaagacccacacacaagcgatctcgtcggtggcctgatgactgatggattacggcgactgagcggcaacgagtatgtgttcacaaagaacgtacaccagtcccattcacatctggcgatgccaatcacaattaatgatgtgcccccttgtatttcccagctcctcgataacgaggagagctgggacttcaacatattcgaactggaggcgatcactcataaacgccctctcgtgtatttgggcttgaaggtcttcagccgattcggcgtgtgtgaattcctgaattgttcagagacaaccctgagagcctggtttcaggtgatagaggccaactatcattcgtcaaatgcctaccacaattctacgcacgccgctgacgttctgcacgcaacggcgttttttctgggcaaggagcgcgtaaagggcagcctcgatcaactggatgaagtcgccgctctaatagctgctacagtccacgacgtggaccaccctgggagaacaaactcattcctttgtaatgctggctccgagttggctgtgctgtataacgatacggcggttctggaatcacaccatactgcactcgctttccagttaacggtgaaggacacgaaatgcaacatttttaagaacatagatcgcaaccattaccgaacactgcggcaggcaattattgacatggtgttagccactgaaatgacaaagcattttgagcatgtgaacaaattcgtgaatagcataaataaaccgatggccgcagagatcgaaggatccgattgcgaatgtaatcccgcaggaaaaaactttccagaaaatcagattctgatcaagcggatgatgatcaaatgtgctgatgttgctaacccttgccgcccactggatctgtgtattgagtgggccggtcgaatcagcgaggaatactttgctcagactgacgaggagaagcggcagggcttgcccgttgtgatgcccgtattcgaccggaacacttgttcgatccctaagtctcagatttcatttatagattattttattaccgatatgtttgatgcttgggacgccttcgctcatttgcccgcactcatgcaacatttagccgataattataaacactggaagacgcttgacgatctgaagtgcaagtccctccgtctcccttcagattcatag

SEQ ID NO: 234764 - DNA, 2367 bp, Artificial Sequence
  Description of Artificial Sequence: Synthetic coding sequence
atgggctgcgccccttcaatccatgtgagtcagagtggagtgatttattgcagggattcggacgagagttccagccctagacagacaactagtgtaagccagggacccgcagctcctttgccagggctatttgttcagacagatgctgcagatgccattccgccatcgcgcgcatccgggccacctagcgtggcccgagtgcgcagggcacgaaccgagttaggctcgggctcttccgcaggcagcgcggcacctgccgctactacgagccgtgggagaaggagacactgttgtagtagcgctgaagctgagacacagacctgttatacatctgtaaagcaggtgagcagtgccgaagtcagaataggacctatgcggctcacacaggatccaatccaagtgctcctgatctttgctaaggaggatagtcagagcgacggattttggtgggcatgtgacagagccggatataggtgtaacattgcccgtactcccgaaagcgcactggagtgtttccttgacaagcaccacgaaattatcgtcatagaccatcggcagacccagaactttgacgccgaggccgtgtgtaggtcaatacgggcaacaaacccatcagaacatactgtaatcctggccgttgtgagccgggtatctgatgaccacgaagaagcatccgtgctccctctccttcatgctggttttaatcgcagattcatggagaattcatcaatcatagcctgctataatgagctgatccagatcgagcatggcgaggtgagatcccagttcaaacttcgcgcatgcaactccgtcttcacggcactggaccactgccatgaagcaatcgagatcacgtccgatgaccacgtgatacagatacataagatccaccgcgactccggtgacaactcccagactgagccccattctttccgctacaaaaataggagaaaagagtcgatcgacgtcaagtcaatcagctcccgcggttcagacgccccaagcctgcaaaacagacgatacccttccatggccaggattcactcaatgacaattgaggccccaattacgaaagtaattaacattatcaacgctgcccaggagaactctcctgtgactgttgctgaagccctggatcgtgttctggagatcttgaggaccacagagctgtactcaccccagctggggaccaaggatgaagatccacacacttctgatctggttggcggacttatgaccgatggactcagacggctgagcggaaacgagtatgttttcactaagaatgttcaccaatctcatagtcacctggcgatgccaatcacaattaatgatgtgcccccttgcatttcccagttgctcgacaatgaagaatcatgggattttaacattttcgagctggaagcaattacacacaaaaggcccttagtttatctcggtctgaaagtgtttagtaggtttggtgtgtgcgaattcctcaattgcagcgagactactctccgcgcttggttccaggtgatcgaagccaattaccactccagcaacgcttatcacaacagcacccatgcggctgatgtactgcacgccaccgcctttttccttggcaaggaacgagtaaagggttcactggatcagcttgacgaggttgccgcactgattgctgctactgtgcacgatgtggaccacccagggagaacaaacagctttctatgtaacgctggctctgagctcgccgttctgtataacgatacagcagtactagaaagccaccatactgctctggccttccagctgactgtgaaagacactaaatgtaatatctttaagaatatagatcggaaccactaccgaacgctgcggcaggctatcattgatatggttctggcaaccgagatgacaaagcacttcgagcacgtgaacaaatttgttaactcaatcaataagccgatggccgcagagatcgaaggcagtgactgcgaatgcaatccagcagggaaaaactttcccgagaatcagatccttatcaagcgcatgatgatcaaatgtgcggatgtcgcaaatccatgtaggccattagacctttgcatcgagtgggctggccgaatctccgaagagtacttcgcacagacagacgaagagaaaagacagggactgcccgtggtcatgccagtctttgaccgaaatacatgttccataccgaagtcccaaatttccttcatagactatttcataaccgacatgtttgacgcttgggacgctttcgcccacttacctgcgctgatgcagcacctcgcagacaactacaagcactggaagacactagacgatctgaagtgtaaaagcttaaggttaccctcagatagctag

SEQ ID NO: 234765 - DNA, 1053 bp, Artificial Sequence
  Description of Artificial Sequence: Synthetic coding sequence
atgcccatcacaattaacgatgtgcccccttgcatttcgcagctgctggacaatgaggagtcctgggattttaacatctttgagttggaggctataacccataagcgccctctcgtgtatctaggcctaaaggtcttttctcgttttggggtgtgcgagttccttaattgtagcgaaaccactctgcgcgcttggtttcaggtgatcgaggccaactatcactcgtcaaacgcttaccacaatagcactcacgcagctgatgttctacacgcaactgcttttttcttgggtaaagaaagagtgaaaggctctttagaccagttggatgaggttgctgccctcattgctgctaccgtgcacgacgtcgaccacccgggtcggaccaactccttcctatgtaacgcaggttctgaactggctgtgctctacaacgacacagccgttctggaatcacatcacactgccctggccttccagctgaccgtgaaggacaccaaatgtaatatttttaagaacatcgatagaaaccattaccgtacactgaggcaggccatcattgacatggtgctggcaaccgaaatgactaaacacttcgagcacgtcaataaatttgtgaactcaatcaacaagcctatggccgctgagatagagggcagtgactgcgaatgcaatcctgctggcaagaacttccccgaaaaccaaattctgataaagcggatgatgatcaagtgtgctgacgttgccaacccatgtcgacccttggatttgtgcatcgagtgggccggtcggatttctgaggagtattttgcccagactgacgaggaaaagcggcagggacttcctgttgtgatgccggtctttgatcgcaacacttgcagcattccaaagtctcagatttcgtttatcgattacttcataaccgacatgtttgatgcatgggatgcctttgcccacctacctgcccttatgcagcacctggcagataactataaacactggaaaacactggatgatctgaagtgcaagagccttaggctacctagcgatagttag

SEQ ID NO: 234766 - DNA, 1782 bp, Artificial Sequence
  Description of Artificial Sequence: Synthetic coding sequence
atggggtccgggagttcttcttatagacccaaagccatataccttgacatcgacggacgcattcagaaggtcattttcagcaaatattgcaattccagtgatattatggatctattttgtatagctaccggcctgcctcgcaatacaacaatctcactgctaacgactgacgatgccatggtgtctatcgatcctacgatgcccgcaaatagtgagagaactccttacaaggttcgacctgtggccattaagcagctcagcgcaggagtagaggacaaaaggactactagtagaggacaaagcgccgagcggcctctgcgcgatagaagagtggtcggcctggaacaacccaggcgggaaggggctttcgagtcaggccaggtcgaaccgaggccacgtgaaccccagggctgttatcaggaggggcagcggatccctccggagcgcgaggagctgattcagagcgtattagctcaagtggctgagcagtttagcagagcatttaagatcaatgaactgaaggctgaggttgccaaccaccttgccgtgcttgagaaaagggtcgaacttgagggactgaaagtggtggagattgagaaatgcaagtcagatattaaaaaaatgcgagaagagttggccgctcgttctagtcgaacaaattgtccatgcaagtattcctttctggataatcacaagaaactgacgcccagaagggatgtcccgacttaccccaaatacctgctgtcccccgaaactatcgaagctctgcgaaaacctacttttgatgtttggctttgggagcctaacgagatgttgtcctgtctggagcatatgtaccacgatctcggcttggtaagagacttttcaattaaccccgtcacactccgcagatggctgttctgtgtgcacgacaattacagaaataatccattccataattttaggcactgcttttgcgtcgcccagatgatgtacagcatggtgtggttatgctctctccaggaaaagttcagccaaactgacatcctcatccttatgactgcggctatctgccatgacctggaccaccctggctataacaatacttaccaaataaacgcacgaaccgaacttgcagtaagatataatgatatctctccactggagaaccaccattgtgccgtggcttttcagattttggccgaacctgaatgcaacattttttcgaatattcccccagacggctttaaacagattagacagggaatgattacattgatcttggccacagacatggcgcgacacgcagagattatggattcctttaaagaaaagatggaaaatttcgattactcaaatgaagaacatatgaccttgctcaagatgatactgattaaatgttgcgatatttctaacgaagtgcggcctatggaagttgcggaaccctgggtagattgtttgctggaagaatacttcatgcagagtgatagggagaaatcggagggcctccctgtcgcaccgttcatggaccgcgacaaagtcaccaaagccacagcccaaatcggctttatcaaattcgtactgatcccaatgttcgagaccgtgaccaaactatttccaatggtcgaggaaatcatgctccagccgctatgggaaagccgcgacagatacgaggagctcaagcgcatcgatgatgcaatgaaggaactacaaaagaaaacagacagtctaacctcaggcgctaccgagaagtcaagagagaggtctagagatgtgaaaaactctgaaggggactgcgcctag

SEQ ID NO: 234767 - DNA, 1704 bp, Artificial Sequence
  Description of Artificial Sequence: Synthetic coding sequence
atgggctccgggagctctagttatcggcctaaggctatctacctcgatatagatggaagaattcaaaaggtgatattcagcaagtattgcaacagtagcgatatcatggatctcttttgtatcgctacaggcctgcccaggaccccatataaggtacgtcccgtggccatcaagcagctgtccgcaggggtggaagataaacgtaccacgagtaggggccaatctgcggaaaggccactgcgcgataggcgcgttgtgggcctcgaacagcctcgtcgagaaggagcatttgaatcaggacaggtggaaccacgcccaagggagccacaaggttgttatcaggagggccagagaatccccccagaaagggaggaactgattcagtccgttctggcccaggtggccgagcaatttagcagggcctttaagatcaatgagcttaaggccgaggtagctaatcaccttgcagttctagagaagcgcgtcgaactcgagggcctgaaggtagtcgaaattgagaagtgcaagagtgatatcaagaagatgagggaagagctcgctgccagaagcagcagaacaaattgtccttgcaagtatagctttctcgataaccataaaaagctcacacccaggagggacgtacctacatacccaaagtacctcctgtcaccagaaaccatagaggccctgcgcaagcccacatttgacgtctggctttgggagcctaatgaaatgctctcatgcctggaacatatgtaccacgacctgggtctcgtgagagatttttccatcaatcccgtgacattgcgccgatggctcttctgcgtccacgataattatagaaataacccatttcacaactttagacactgcttttgcgtcgcccagatgatgtattctatggtgtggctgtgttcccttcaggagaaatttagtcaaacagatatattgatcctcatgaccgcagcaatctgccacgatctggaccacccgggttacaacaacacgtaccagatcaatgctaggactgaattggccgtgcgttacaacgatatctcaccattggagaatcaccattgtgccgtagcttttcaaatcctagccgaacctgagtgtaatattttttcaaacataccgccagatggatttaaacaaattaggcagggaatgatcactctgatcctagccaccgacatggccaggcacgcagaaataatggacagctttaaggaaaaaatggagaatttcgattactccaacgaggagcatatgaccctgctcaaaatgatcctcattaaatgttgtgatatttccaatgaagttaggcccatggaggtagcagaaccgtgggtggactgtctactcgaggaatatttcatgcagagcgatcgcgaaaagagcgagggactgcctgttgccccattcatggatcgggataaagtgacaaaggctactgctcagattggcttcattaaatttgtgctcatcccgatgttcgagacagtgaccaaactgtttcctatggtggaagagattatgctccagcccttgtgggagagtagagacagatatgaggagctcaagcgtattgacgacgcaatgaaggagctgcagaaaaaaactgacagcctgacttccggtgccaccgagaaatcccgggaaaggtcgagggatgtgaagaattctgagggtgactgcgcatag

SEQ ID NO: 234768 - DNA, 1476 bp, Artificial Sequence
  Description of Artificial Sequence: Synthetic coding sequence
atggggagcggctccagtagttataggcctaaggccatctatctggacatagacggaaggatacagaaagagcacgatcacctgcccgcagatcacagacggaggcatggccttcaccgccctcaccatgcaagggagttcaggactcattccgttcagagtgagacgtgtgggcaccaggccactctgagagccttcaagatcaatgagctgaaggccgaggtcgcaaatcacttggcagtgctggagaagagggtggagctagaaggattgaaggtggtagagattgagaagtgcaaatcagacatcaagaagatgagggaggaactggccgctagaagttctcgaacgaactgtccctgcaagtatagctttctggacaaccataaaaagctgacaccgagaagggacgtcccaacatatcctaagtatttgcttagtcctgaaacgattgaggcgctaaggaaaccaaccttcgacgtctggctgtgggagcctaatgaaatgcttagctgcctggagcacatgtaccatgatcttggccttgtccgggatttttctattaatcctgtgactcttcgcagatggcttttttgcgtgcatgataattaccgaaataatccatttcataacttccgccactgtttctgcgtagcccaaatgatgtacagcatggtgtggctgtgtagtctgcaggagaaattttctcaaaccgatattctgatccttatgactgcagccatctgccacgacttagatcatccaggctacaacaacacctaccagattaacgcaaggacggagttggccgtgcgatacaacgatatatcccccctggagaaccaccattgtgccgtagcattccagatcctggccgagcccgagtgcaacattttcagcaatatccctccagatggttttaagcagattagacaggggatgatcacactcattctggccactgacatggcgagacacgccgagattatggacagctttaaggaaaaaatggaaaactttgattattccaacgaagaacatatgacgttgttgaaaatgatcttgataaaatgttgtgacatctccaatgaggtgcgccctatggaggtagccgaaccctgggtggactgccttctcgaagaatattttatgcagtccgaccgtgaaaagagcgagggactccctgtggcgcctttcatggatagagacaaggtgactaaggccacagcccagattgggttcatcaaatttgtgctgataccgatgttcgagaccgttacgaaacttttccccatggtggaagagattatgcttcagccactgtgggagtctagagacaggtacgaggagctcaagcgcattgacgatgcaatgaaagagctccagaagaagactgactcgctgacttccggagcaactgagaagagcagggagagatcgcgagacgtgaaaaattcagaaggcgattgcgcctag

SEQ ID NO: 234769 - DNA, 1602 bp, Artificial Sequence
  Description of Artificial Sequence: Synthetic coding sequence
atggggagcggttcctcaagctacaggcccaaagccatatacctcgacatcgacggccgaatccagaaggtcattttctcgaaatattgtaatagctccgatattatggacctgttctgtatcgccaccggactccctcgcaacaccacgatatcgctactgacgaccgacgacgccatggtcagcatcgaccccactatgcccgctaattctgaaagaaccccctacaaagtgcgcccagtcgcaatcaagcagttatctgaaagggaggagctgatacaaagtgtcctggcccaagtagccgaacagttctcgcgggctttcaagataaatgagctgaaggcagaagtcgcaaatcacctcgctgtgctggagaagcgcgtagagttggagggcctaaaggtagtggagatagaaaagtgtaaaagcgacattaagaagatgcgtgaagagctggcagctcgtagctcaagaactaactgcccatgcaagtatagtttccttgacaaccacaaaaaactgacccctcgtcgggacgtgcccacgtatcccaagtacttactcagccccgaaacaattgaagccctgcggaagccaacttttgacgtatggctctgggagcccaacgagatgcttagttgtctggaacatatgtatcacgatttagggctggtgagggacttttccatcaatcctgtgaccttgaggcgatggttgttctgtgtgcacgacaattatcgaaataacccgttccataatttcagacactgcttctgcgtggctcagatgatgtattccatggtctggctatgttccctgcaggagaaattttcccaaacagacattcttattctgatgactgctgccatctgccacgatctcgatcatccaggatataacaacacatatcagatcaatgccagaacagaactggcagtacgatacaatgatattagcccgctggaaaatcatcactgtgcggtcgcatttcagattctagctgaaccggagtgcaatatctttagcaatattccacctgatggctttaaacagatcagacaaggaatgatcacccttatactagcaaccgatatggctcgtcacgctgagattatggacagcttcaaggagaagatggaaaatttcgactattccaatgaggagcatatgacactcttaaaaatgatcttgattaagtgctgtgatatctcaaacgaggtgcgacctatggaagtcgctgagccctgggttgattgcttgctggaggagtatttcatgcaatctgatcgagaaaaatccgaggggttacccgtggcaccatttatggacagagacaaggttaccaaggccaccgcacagatcgggttcattaagtttgtactgatccccatgtttgagacagtgacaaagctgtttccgatggtagaggagattatgcttcagcctctgtgggagtcgagagaccggtatgaggagctcaagcgcatagacgatgccatgaaggagctccagaagaagaccgatagcctgacatctggcgctaccgagaagagcagggagcgctctcgtgacgtaaagaacagcgaaggcgattgcgcatag

SEQ ID NO: 234770 - DNA, 1398 bp, Artificial Sequence
  Description of Artificial Sequence: Synthetic coding sequence
atgggcagtggttcttcttcttaccgcccaaaggctatttatctcgatattgatggaagaatccaaaagcactccgtgcagagcgagacatgtggccaccaggccactctgcgggctttcaagattaatgagcttaaagcagaggtcgcaaatcacctagctgtcttggagaaaagagtcgagctcgaaggtcttaaggtagtggagattgaaaagtgcaaaagcgatatcaaaaagatgcgggaagaactggctgcgaggtcctctcggacaaattgtccatgtaagtactcattcctcgataaccataagaagctgacccccagacgagacgtacctacctacccaaaatacctgcttagccccgagactatagaggcgctgagaaaaccaacatttgacgtgtggctttgggagcccaacgaaatgctatcatgcctggaacacatgtatcatgacctgggccttgtaagggatttttccatcaaccctgtcacactccggcgatggctcttctgtgtgcacgataattacaggaataatccatttcacaattttagacattgcttctgtgtggcacaaatgatgtattcaatggtgtggttatgctctttacaggagaagttttcccagaccgacatcttgattctaatgacagccgctatatgtcacgacttagatcatccaggatacaataatacataccagattaatgctcggaccgagttagcagtgcgctacaacgacatctcaccactggaaaatcaccactgcgccgtggccttccaaatcctcgctgagcctgagtgtaacatcttctccaacattccccctgacggtttcaaacagattaggcagggcatgattactctcattctggccaccgatatggcacgccacgcagagatcatggattcgttcaaagagaagatggaaaatttcgactatagcaacgaggagcacatgacattgcttaagatgatcctcattaagtgctgtgacataagtaacgaggtgaggccaatggaggtagccgagccctgggtggactgcctgctggaggagtacttcatgcagagcgatagagaaaaaagtgagggtctgcccgttgcccctttcatggaccgggataaggtgaccaaggcgacagcccagatcggattcattaagtttgtgctgatccccatgttcgaaacagtaacaaaacttttcccaatggtggaggaaattatgcttcagcctttgtgggagtcccgcgatagatacgaagaactgaaaaggatcgacgacgcaatgaaagagctgcagaaaaagacggacagtctaacctccggcgctacggagaaaagtcgggaacgttctcgggacgtcaaaaacagcgaaggggattgcgcttag

SEQ ID NO: 234771 - DNA, 1623 bp, Artificial Sequence
  Description of Artificial Sequence: Synthetic coding sequence
atgggcagtggtagtagcagttacagaccaaaagccatatatctggatatagatggacggattcagaaagtgatcttttcaaaatactgtaactcctccgacattatggacctgttctgtatcgctacaggcctgcctaggaatacaaccatttcactcctgaccacagatgacgcaatggtgtcaattgatcccacaatgcctgcaaactcagaacggaacgaattaatactctacacaagcctacggaacctgctatttctcccgagtaaagagagctgggccagccatcaacacagcgttcagtcggaaacatgtggtcatcaggccactctgagggcgttcaaaattaatgagctcaaggccgaggtcgccaatcatctagccgtgctggagaagcgtgtcgaattggaggggctgaaggtggtggaaatcgaaaaatgcaagagtgacatcaaaaagatgagggaggaactagcagccaggagcagccggacaaactgtccctgtaaatacagcttcttagacaatcacaaaaaactgacacccagacgggatgtgcctacctatccaaagtacctgctgtctccggagacaattgaggctctcaggaagccaacctttgacgtttggctctgggagcccaatgagatgctgtcttgcctcgaacatatgtaccacgacctagggctagttcgggattttagcattaatcctgttaccttgcgtaggtggctcttttgtgtgcacgataactacaggaataatccattccataacttccgacactgtttttgcgtggcacagatgatgtacagcatggtgtggttgtgctccctgcaggagaaatttagccagacagatatcttgattctgatgacggctgctatatgtcatgatctagaccatcctggttataataatacctatcagattaatgctcgcaccgaactggccgtgcgctacaatgacatctcgccgctggagaaccatcattgtgccgtggcattccaaatcctcgcagagcccgaatgcaacatcttttctaatattcctcctgatggatttaagcaaatccggcagggcatgatcacactgatcctggcaaccgacatggcccgacacgctgagattatggactcttttaaggagaagatggaaaactttgattattctaatgaggagcacatgactctgctcaaaatgatccttatcaaatgttgcgacatcagcaatgaggtcaggcctatggaggtggctgagccttgggtcgactgccttttggaggagtacttcatgcaatcggacagagagaagagcgaggggcttcccgttgcaccctttatggaccgggacaaagtgacaaaggccacagctcagattgggttcattaagtttgtcctgatacccatgttcgagaccgttaccaagcttttccccatggtagaggaaattatgctccagcccctgtgggagtcaagggaccgatatgaagaacttaaaaggatcgacgatgcgatgaaggaactgcaaaagaagacagattcactgactagcggggctactgaaaaatctagggaaaggtccagagacgttaaaaattctgagggggattgtgcgtag

SEQ ID NO: 234772 - DNA, 1401 bp, Artificial Sequence
  Description of Artificial Sequence: Synthetic coding sequence
atggacgcctttcgatcaactccttacaaagtacgacctgtcgctatcaagcaactgagtgagcgcgaggaacttatccagtccgtgctggcccaggtggccgaacagttcagccgtgccttcaaaataaacgagttaaaggctgaagttgctaaccaccttgcggtgctggagaaaagggtggagttggagggattgaaggtcgttgagatcgagaagtgcaagtctgatatcaaaaagatgagggaagagctagcagcccgatcatctcgtacaaactgcccctgtaagtactctttcttagacaatcacaaaaaactgactccacggcgagacgttcccacttaccccaagtatttgttgagtcctgaaactattgaggccctccggaagcccacctttgacgtctggctctgggagcctaatgagatgctgtcctgcctggagcatatgtatcatgatctgggcctagtgcgggattttagcattaacccagtgactctgcgcaggtggcttttctgtgtgcacgacaactacaggaataacccatttcacaatttcagacactgcttttgcgtggcccagatgatgtactctatggtatggctgtgttcccttcaagaaaagttctctcagaccgatatcctcattctgatgacggccgctatctgccatgatttggaccatccagggtacaacaacacgtatcaaataaacgcccgaaccgagttggccgttagatacaatgatatcagcccattagagaatcatcactgcgcagtggctttccaaattctggcagaacccgaatgtaacatcttctccaatatccctccggatggattcaagcaaatccggcagggaatgattaccctgatcttagccactgacatggccaggcatgctgaaattatggatagttttaaagagaaaatggagaatttcgactattcgaacgaggaacatatgaccctgttgaagatgatacttatcaagtgttgcgatatatcaaatgaagtgaggcccatggaggtcgccgaaccatgggtcgattgcctactggaagagtactttatgcagtctgatcgggagaagtctgagggactgccggtagccccattcatggacagagacaaagtgacgaaagccacagctcagataggctttattaagttcgtgctgattccaatgttcgagacagtaaccaagctgttccctatggttgaagaaataatgctgcagcccctgtgggaatccagagacagatacgaggagctcaagcgtatcgacgatgcgatgaaggaattgcagaaaaaaaccgactccctgactagtggagccactgagaaatctcgcgaaagatccagagatgtgaaaaacagcgaaggcgactgtgcttag

SEQ ID NO: 234773 - DNA, 1659 bp, Artificial Sequence
  Description of Artificial Sequence: Synthetic coding sequence
atggacgcgttccgtaggaacacaacaatatcattgctcaccactgacgatgcaatggtgagcattgatcctactatgcccgcaaattcggaaaggactccatataaggtccggcctgtggcaattaagcagctctccgcaggcgtggaagataaaaggaccaccagtcgtgggcaatccgcggagagacctctgcgcgaccgaagagtggtcgggttagaacagcccaggcgtgaaggtgcttttgaaagtggccaggtcgagcccaggcccagggaacctcaggggtgttaccaggagggacagcgcatccctccagagcgggaggaactgatccagtcagtcttggcgcaggttgcagagcagttctctagggccttcaagatcaatgaactgaaggctgaggtggcaaatcatctggcggtactcgaaaagcgggtcgagctagagggacttaaagtcgttgaaattgaaaaatgcaaatccgacataaaaaaaatgcgggaggagctggcggctcgtagtagccgcactaactgcccctgtaagtactctttcctggataatcataaaaagcttactccacgtcgggacgttcccacctatccaaagtatctgctgtctcccgaaactatagaagccctgcgcaaacctaccttcgatgtgtggttgtgggaaccgaacgagatgctttcttgtctggaacacatgtatcatgatcttgggcttgtgagggatttctctattaaccctgtcacccttcggaggtggctcttctgcgtgcacgacaattatcggaataatccctttcacaatttccgccattgcttttgtgtggcgcaaatgatgtactctatggtttggttgtgtagtctgcaagagaaattctcacaaaccgatatcttaatcctgatgaccgcagctatttgtcacgatctagaccaccccggatacaataacacttaccagatcaacgcccgaaccgaactggctgtgaggtacaatgatatttccccacttgagaaccatcactgtgctgtagcttttcaaatcctggccgagcccgaatgcaacattttctccaatattccgcctgacgggttcaagcagatcaggcaggggatgattactctaattcttgccactgacatggcgaggcatgctgaaataatggatagctttaaagaaaagatggaaaacttcgactactctaacgaggagcatatgacactcctcaaaatgatcctgatcaaatgctgcgatatcagtaacgaggtcaggccaatggaagtggccgagccttgggtggattgcttgctagaagaatattttatgcaatctgaccgtgaaaagtccgagggactgcccgtggccccatttatggaccgcgacaaggtgacgaaagcgacggcacagatcggcttcataaagttcgtgttgatacctatgttcgagaccgtaaccaagctgtttccaatggtggaggagataatgctgcagcctctttgggagtctagggaccggtacgaggagctgaaaagaattgacgacgctatgaaagaactccagaaaaaaactgatagcctcaccagtggggctaccgagaaatcccgagagcgcagtagggacgttaaaaatagcgaaggagactgtgcatag

SEQ ID NO: 234774 - DNA, 1302 bp, Artificial Sequence
  Description of Artificial Sequence: Synthetic coding sequence
atggatgctttcagacgggcttttaagataaatgagttaaaagccgaggtcgccaatcacctggctgtgctcgaaaaaagggtggaattggagggactgaaagtggtggagatcgagaaatgcaagagcgatattaagaagatgagagaggagctcgcagccaggagttctcggacgaattgtccttgcaaatattcgtttctggacaaccataaaaaactcactcctaggcgtgacgtgccaacataccccaagtatctactcagtccggagactattgaagctctcagaaaacccacttttgacgtttggctgtgggagccgaacgaaatgctgtcatgtttggaacacatgtaccacgaccttggtctggtgagggattttagcatcaacccagtgaccctacgacgttggctgttctgcgtgcacgacaactataggaacaaccctttccacaacttccggcactgcttctgcgttgcgcagatgatgtactctatggtatggctgtgtagcttgcaagaaaaattttcacagactgacattttgattctgatgacagcggctatctgtcatgatctggaccatccgggatacaacaatacttaccagatcaacgctcgtacggagctggccgtccggtataacgatataagcccgctggagaaccaccactgtgctgttgctttccagatactggcggaacctgagtgcaacatcttctctaatataccccctgatggtttcaagcagatccgacaaggtatgatcacattgatccttgccaccgatatggcacgccatgccgagatcatggactctttcaaggaaaaaatggagaacttcgattactctaacgaagagcatatgactctgctgaagatgattttgatcaaatgctgcgacatttctaatgaagtgagacccatggaagttgctgagccatgggttgattgtctccttgaagagtacttcatgcagtcggaccgcgagaagagcgagggactgcccgtagccccttttatggatagggataaggtcaccaaagctaccgcccagattggattcatcaaattcgtgttaataccaatgttcgaaaccgtgaccaagttattccccatggtggaggaaattatgctgcagcccctgtgggaaagtcgcgatcgatacgaagagctcaagcgcatcgatgacgctatgaaggagttgcaaaagaagacagactccttaacatccggcgcaaccgagaaaagtcgggaacgctcccgggacgtcaagaactccgaaggtgactgcgcttag

SEQ ID NO: 234775 - DNA, 1380 bp, Artificial Sequence
  Description of Artificial Sequence: Synthetic coding sequence
atggatgcctttagacgtaacactaccattagcttactcacaactgacgatgccatggtgtctattgacccgacaatgccagcaaactccgagagggcctttaagatcaacgagttgaaggcagaggtggctaatcaccttgccgtgctcgagaaaagggttgagctggagggcttgaaggtggtggagatcgagaaatgcaaatcagatatcaagaagatgcgggaggagctggcggcacgcagctctagaacgaattgtccttgcaagtattcattcttggacaaccacaaaaagctgacaccacgtcgcgacgtgcccacgtacccaaagtacctgctttcccccgaaactattgaggccctgcggaaaccgacatttgacgtctggttatgggaacctaacgagatgctctcttgcctggaacatatgtaccacgacctgggtctggtgcgggacttcagtatcaaccctgtcacactgcgaaggtggctcttctgcgtgcacgataactataggaataacccttttcacaattttaggcactgcttttgcgtggcccaaatgatgtacagtatggtctggttatgcagcctgcaggagaagttttcccagacagacattctcattctgatgacagccgctatctgccacgatttggaccaccctgggtacaataacacataccagatcaacgcccgaacagaactggctgtacgttacaacgacatttcaccgctggagaaccatcattgcgctgtcgcttttcaaattctggccgagccagagtgtaacatcttctcgaatatccccccagacggctttaaacagatcaggcagggaatgatcacccttatcctggccaccgatatggcgagacatgccgaaatcatggacagctttaaagaaaaaatggagaacttcgactattcaaacgaagagcacatgacccttttaaagatgatccttatcaagtgctgtgatatcagcaacgaggtgcgacctatggaggtcgctgaaccctgggtggattgcttactagaggagtatttcatgcagtccgacagggaaaaatctgagggcctccccgtcgccccatttatggatagagacaaagtaactaaggctactgcccagatcggtttcattaagttcgtgctgatcccgatgttcgaaacggtgacaaaactattcccaatggtggaagaaataatgttgcagccgctttgggaaagcagggatcgatacgaagagctcaaaagaatagatgacgcaatgaaggaattgcagaagaagaccgactcccttacttcaggggctacggaaaagagcagagagaggagtagagatgttaagaatagcgagggtgattgtgcatag

SEQ ID NO: 234776 - DNA, 1581 bp, Artificial Sequence
  Description of Artificial Sequence: Synthetic coding sequence
atggatgcattccggtcaactccctacaaagtccggcctgtggcaattaaacaactcagtgcaggcgtcgaagacaaacgaactacgagcagaggacagtccgcggaacgaccacttcgggatcggcgtgtcgtgggcttagaacagccccgtcgcgagggagctttcgagagcggccaggtggagccacgcccacgggaaccacaggggtgctaccaggagggacaaagaatccctccagaacgggaggagcttattcaaagcgtgttagcgcaggtggccgaacagtttagccgggcatttaaaataaatgaactgaaggctgaagtggccaaccacctggcggttctggaaaagagagtggaactggagggcttaaaggtggtcgaaatcgaaaagtgtaagtccgatatcaagaagatgcgcgaagaacttgcagccaggagctcccgcacgaactgtccatgtaagtacagcttcttggacaatcacaaaaagctaacaccaaggagggacgtgcccacctaccccaagtacttgctgtctcccgaaaccatcgaggcacttaggaagcctaccttcgacgtttggttatgggagcctaacgaaatgcttagctgcctggaacacatgtatcatgacttaggactggtgcgcgatttctcaattaatcccgttaccttgagacgctggcttttctgcgtccatgataattacaggaataaccctttccacaactttcggcattgtttttgcgttgcccagatgatgtactcaatggtttggctctgtagcctacaagagaagtttagccagacagatatcctaatcctcatgaccgccgctatttgtcatgatctggaccatcccggttacaataacacatatcagattaacgcacgaactgagctggcagtgcgctataatgacatttctccacttgagaatcatcactgcgcagttgccttccagatcttggccgagcccgagtgtaacatcttctcaaatataccacccgacgggtttaaacaaatccggcagggaatgatcacactgatcttggccactgacatggctcggcatgccgagatcatggactctttcaaggagaagatggagaactttgattacagcaatgaagagcacatgacactcctgaaaatgatcctcatcaagtgttgcgatatctccaacgaggtcaggcctatggaagtggctgagccatgggtcgattgcttgctggaagaatactttatgcaatccgaccgggaaaagtcggagggccttccagttgccccttttatggaccgtgataaagtaactaaagcaactgctcagatcgggttcattaaattcgtgttgatccccatgttcgaaacggtgacaaagttgttccccatggtagaggaaattatgctacagcctttatgggaatctagagaccgctacgaggagctgaaacgcatagatgacgcaatgaaagaacttcagaaaaagactgactcattaacgtctggagctaccgagaagtcacgggagcggagcagggacgttaagaattccgaaggggactgtgcttag

SEQ ID NO: 234777 - DNA, 1479 bp, Artificial Sequence
  Description of Artificial Sequence: Synthetic coding sequence
atggatgctttccggcgtaacactacaatctccctattgactactgacgatgctatggtcagcatcgatcccactatgccagccaacagtgagaggaccccctataaagtgcgaccagtagcgatcaagcagctgagcgagcgggaagagctgatccagagcgtgctcgcccaagttgctgagcagttttctcgagcgtttaaaattaacgagctgaaagcagaggtcgccaaccatttagccgtgctggaaaaaagagttgagctggagggcctgaaggtggtggagattgagaaatgcaagtccgatatcaagaagatgagggaggagctggcagcaaggtcaagtcggaccaactgcccgtgcaaatactcttttctggacaatcataagaagctaacgccccgacgcgatgtgccgacctacccaaaatacttgctgtcacccgagaccatagaggctctgagaaaaccaacctttgatgtttggctgtgggagccaaatgaaatgttgtcctgccttgagcatatgtaccacgacctggggcttgtccgcgacttcagcatcaatcccgtcaccttacgcagatggttattttgtgtgcacgacaactatagaaacaacccttttcacaacttccggcactgtttttgtgtggcacagatgatgtacagcatggtgtggctgtgtagcctgcaggaaaagttctcacagaccgacatcctgatcttaatgacggcagcaatctgccatgacttggatcaccctgggtataacaacacatatcagattaatgcacgtacagaactcgccgtccgatataatgacatcagtcctctggaaaaccaccattgtgctgtggcatttcaaatactcgcggaaccagagtgcaacatattctcaaacattccgccagatgggtttaaacaaattcgacagggaatgattacgttaatccttgcaaccgatatggcccgacacgcggaaatcatggacagtttcaaggagaagatggagaactttgattattccaacgaagaacacatgacgttattgaagatgatcctcatcaaatgttgcgatattagtaacgaagtgcgcccaatggaggtggccgaaccatgggtggactgccttcttgaagagtatttcatgcagtctgacagggaaaagagcgagggtctacccgtggctccgttcatggacagggataaggtgactaaagccacggcccagattgggttcatcaagttcgtgcttataccgatgttcgaaactgttactaagctttttccaatggtcgaggaaattatgttgcagccactatgggagtctcgagatcgctacgaggagcttaagcggatcgatgatgccatgaaggagttacagaagaaaaccgattcgctgacctccggcgctaccgagaaatcacgggagaggtctcgcgacgttaagaattccgaaggagactgtgcgtag

SEQ ID NO: 234778 - DNA, 1524 bp, Artificial Sequence
  Description of Artificial Sequence: Synthetic coding sequence
atgggctccggtagttccagctatagacccaaggccatttacctcgatatcgacggcagaatacagaaggtgattttttcgaagtactgtaactcatcagatatcatggacctcttttgcatagcaacagggctgcccagaacaccatataaagtacgcccagttgccataaagcagctcagcgaaagggaagagctaattcaatcagtgctagcacaggtcgcggagcagttctccagagcctttaagattaacgagttgaaagcggaggtggcaaatcaccttgccgttcttgagaagagggtggaattggaaggactgaaggttgtggagattgagaagtgtaaatcagacattaagaagatgcgagaagagctggcagccagatcatcccgtactaactgcccatgcaagtactcattcctcgacaaccataagaaactcacccccagacgagacgtcccaacataccctaagtacctgctatcaccggagaccattgaggccttgagaaaaccaacgttcgacgtttggctctgggaacctaacgaaatgctgtcatgcctggaacatatgtaccacgatttgggtctagtcagggatttctctatcaaccctgtcacgttgaggcgttggctcttctgcgtgcatgacaattacagaaataaccccttccacaattttcggcattgtttttgtgtagctcagatgatgtattccatggtgtggctttgttcccttcaggagaaatttagccaaactgacatactcattttaatgaccgccgcaatatgccacgatctggatcatcctgggtacaacaacacttaccagataaacgccaggactgagctggccgttaggtataacgatatttccccactggagaatcaccattgcgccgtcgcattccagattcttgctgagcccgagtgtaatatttttagtaatattccccctgacggttttaagcagatcaggcagggaatgattacacttatcctcgccacggatatggcacgtcatgccgagataatggactcattcaaggagaagatggagaacttcgactattcaaatgaagaacacatgaccctgctaaagatgattctaatcaaatgctgcgatatcagtaacgaggtccgccctatggaggtggccgaaccatgggtggactgtctgctggaagagtactttatgcagagtgaccgggaaaagtccgaaggtctgcccgttgccccattcatggacagggacaaggtcacaaaggctactgcccaaattgggttcattaagttcgttttgattcctatgtttgaaaccgtgaccaaactgttccccatggtggaggaaatcatgctccagcctttgtgggagtctagggacagatacgaggagctgaaacgcattgacgatgctatgaaggaactgcagaagaaaactgattcactgacatcaggcgctacagagaaatcccgcgaaaggagtagagacgtcaaaaattctgaaggagactgtgcttag

SEQ ID NO: 234779 - DNA, 1398 bp, Artificial Sequence
  Description of Artificial Sequence: Synthetic coding sequence
atggatctgttttgcatcgctactgggttacccaggaatacgacaatctctctcctgactacggatgacgctatggtgtccattgatccaacaatgccagctaactccgaacgggcttttaagatcaatgagctgaaagcagaggttgcaaaccacctggctgtcctggaaaaaagagtggagctggaaggactaaaggtcgtcgagattgagaaatgcaaaagtgatattaagaagatgcgcgaggagttagccgcacggagtagcagaaccaattgcccttgcaagtattccttccttgataaccataaaaagctgaccccacgcagagacgtgcccacatacccaaaatatttgctgagtcccgagacgatcgaagcccttagaaagcccacgttcgatgtctggttatgggagcctaatgaaatgttgagttgcctcgagcatatgtaccacgatcttggcctggtccgtgattttagtatcaacccagtgacgcttcggcgttggttattttgtgtgcacgacaactatcgcaataatcctttccataatttcaggcattgcttctgcgtcgcgcagatgatgtatagtatggtgtggctttgctccctccaagagaagttcagccagaccgatattttaattctgatgactgctgccatttgccacgacctcgatcaccctggatacaataatacataccaaattaacgctagaactgagctggcagtgcggtacaatgatatttcaccccttgagaatcatcactgtgcagtcgcctttcagattttggcagagccagaatgcaacatattcagtaacatacctccggacggcttcaaacaaattaggcaggggatgattaccttgatcctggccactgacatggccaggcacgcagagataatggattctttcaaggaaaagatggagaacttcgattatagtaacgaagaacacatgactctgcttaagatgattctgattaagtgctgtgacatttccaacgaggtacggcctatggaagtggccgagccctgggtcgactgccttctggaggaatactttatgcaaagcgaccgggagaagagcgagggcctgcccgtggctccgttcatggatcgcgataaggtaactaaagctacagcccagattggcttcataaagttcgtgctcatcccaatgttcgaaaccgtgaccaaactgtttcctatggtcgaagaaattatgcttcaacctctctgggaaagcagagaccgatacgaggaactgaagaggatcgatgatgctatgaaagaactacagaagaagacggactcacttacatcaggagcaacggagaagtctcgggagaggtcacgggatgtcaagaatagcgaaggagactgtgcttag

SEQ ID NO: 234780 - DNA, 1869 bp, Artificial Sequence
  Description of Artificial Sequence: Synthetic coding sequence
atgccaccccagttgcagaacggcttgaatctaagcgcaaaagtagtgcagggctccctggactcattgcctcaggccgtgagagagttcctggagaataacgccgagctttgtcagccggatcacatccacatctgtgacggcagcgaggaagaaaacgggcgtttgcttggccagatggaggaggaaggcatccttcggaggctgaaaaagtatgataactgctggctcgccctaaccgacccaagggacgtggccagaattgagtccaaaacggttatcgtgacgcaggagcaacgtgacacagtgcccatccccaagaccggcctttcacagctggggagatggatgtccgaggaggactttgagaaagccttcaacgccagattcccgggttgtatgaagggcagaaccatgtatgtgattcctttttccatgggtcctctgggtagtccgcttagtaagataggaatcgagttaacggatagcccctatgttgtggctagcatgcgcattatgacacggatgggcaccccggtactggaggccgttggcgacggcgagtttgtgaaatgccttcactcagtgggttgcccactgccactccagaagcccctcgtcaacaactggccctgtaatcccgaactgacactgatcgctcatctgccagaccgccgagaaattatcagttttggttccggctatgggggtaattcactcctgggaaaaaaatgctttgctctgcgcatggccagcagactggcaaaggaggaagggtggctagcagaacacatgctgatattaggtataactaatccagagggagaaaaaaaatatttagccgctgcctttcccagcgcctgtgggaaaacgaatctagccatgatgaatccctcgttgcctggctggaaggtggagtgcgtgggggatgatattgcatggatgaagtttgatgcgcaggggcacctcagagctattaatccagaaaatggattctttggtgtggcccctggaaccagcgtgaaaacgaaccccaatgccattaaaactattcagaagaatacaatctttactaacgttgccgaaaccagcgacggcggagtgtattgggaaggaattgatgagcctttagcttccggagtaacaatcaccagttggaagaacaaggaatggtcttccgaggatggtgagccttgcgcgcatccgaattccaggttttgtactcctgcgagtcagtgtcctatcattgatgcggcatgggagtctcctgagggcgtgcctatcgaaggtataatttttgggggaaggagacctgccggagtgccacttgtgtatgaagccctcagttggcaacacggcgtgtttgtgggggcagcaatgcgctcagaagccacagctgcagccgaacataagggcaagattatcatgcatgatccttttgccatgcgacccttctttggctacaacttcggcaagtacctcgcccactggttatccatggcccagcacccagctgccaaacttcctaagatattccacgttaattggttcaggaaggacaaggaagggaaatttctttggccagggttcggtgagaactctcgggtactagagtggatgttcaatcggatcgacggcaaggcgtccaccaagctgacgcccataggctatatacctaaagaagatgcacttaacctgaaaggactcggacatattaacatgatggagctgtttagcatttcaaaagaattttgggagaaggaagttgaggacatcgagaagtatcttgaggaccaggttaacgcagacctgccgtgcgaaatcgagcgcgaaattttggccttaaaacagagaatcagccaaatgtag

SEQ ID NO: 234781 - DNA, 942 bp, Artificial Sequence
  Description of Artificial Sequence: Synthetic coding sequence
atgactacgggcagaacgatgtatgtgatccccttctcaatggggccactggggtctcccctcagcaaaatcggtattgaactgaccgattccccatacgtggttgcttcaatgcgtataatgacacgcatgggcacccctgttctggaggcagtgggcgatggagaatttgtcaagtgtctgcattccgttggctgtccccttccactccagaagcctctggtcaataactggccgtgtaacccggagctaaccctgatcgcacatctgcccgataggcgcgaaattatatctttcgggtccgggtatggagggaactctttattagggaaaaaatgttttgccctccgtatggccagcaggctggcgaaggaagagggctggttggcagaacatatgctgatcttgggaatcaccaatcctgagggcgaaaagaaatacctggccgctgcatttcctagcgcgtgcggtaagacaaacctcgccatgatgaacccaagcctgcccggatggaaagttgagtgtgtcggagatgacattgcttggatgaagttcgatgcccagggacacctgcgtgctattaaccctgagaatggattcttcggagtcgccccaggaacaagcgtaaagacaaacccaaatgctattaagactatccagaaaaatactatcttcaccaacgtggcagaaacctccgacggtggggtgtactgggagggcatcgatgagcccttggcatcaggggtcaccatcacatcctggaaaaacaaggagtggagctcagaagatggcgttagcctcccggaggcattagtttgtcgtgctgcgggaaccgcctgtttatcccaggcactcacctcattgtccctttcttatagagggaccctttgccctccacagttagaggtgctgcacccttgccagccggtaccacatcattag

SEQ ID NO: 234782 - DNA, 915 bp, Artificial Sequence
  Description of Artificial Sequence: Synthetic coding sequence
acaactggccacctgagagccataaacccagaaaatggattcttcggcgtggcccctggcacatccgttaagaccaacccaaatgcgattaagacaattcaaaagaatacaatttttacaaacgtggctgaaacaagtgatggcggagtgtattgggaggggatcgacgagccactagctagtggcgtgactattacgagctggaagaacaaagaatggtccagtgaggatggcgaaccgtgcgcgcacccaaactcaagattctgtactcctgcctctcaatgcccgattatagacgccgcttgggaaagtcccgaaggtgtgcccatcgaagggataatcttcggcggacgccgtccagctggcgtgcctcttgtatatgaggccctctcctggcagcacggcgtttttgtgggtgcggctatgcgctccgaggccacggccgctgccgagcacaaaggtaaaataatcatgcacgacccattcgctatgcgccctttcttcggctataactttggaaaatacctggcacattggctcagcatggcccagcacccagcagctaagctgccaaaaatttttcatgtaaactggtttcgcaaagataaggagggcaaattcctgtggccagggttcggagagaattctcgggtcttggagtggatgtttaatcgcattgacggaaaagcgtcgactaaactgacccctataggttatatccctaaagaggatgcccttaacctcaagggactgggccacattaatatgatggaactcttcagcatatctaaagaattttgggagaaggaagtggaagacatcgagaaatatctggaggaccaggtaaacgccgatctcccttgcgagatcgaacgtgagatactggccctcaagcaacggatatcacagatgtag

SEQ ID NO: 234783 - DNA, 918 bp, Artificial Sequence
  Description of Artificial Sequence: Synthetic coding sequence
atgacaacggggcacctgcgggctattaacccagagaacggatttttcggtgtggcccctggcacctctgtcaagaccaaccccaacgcgatcaagactatacagaaaaatacaatctttactaacgtggctgaaacatcagacgggggtgtgtactgggagggtatcgatgagccactcgcatcaggcgtgactatcacaagctggaagaataaggaatggagcagcgaggacggggaaccatgcgcccatcctaattctcgcttctgcacgcctgcatctcagtgtcctattatcgacgccgcttgggagagcccagagggcgttcccatagagggtatcatattcgggggtagacgccctgccggagtgcccctagtatatgaggcactgtcttggcagcatggggttttcgtcggagccgctatgcgatccgaggcaactgcggctgccgagcacaaagggaaaatcatcatgcacgatcctttcgctatgagacccttttttggatataatttcggaaagtacctggcccactggctgagcatggctcaacaccccgcagctaagttgccaaaaatattccatgtcaattggtttcggaaggacaaggaagggaaattcttgtggcccggatttggcgaaaactctagagtcctggaatggatgtttaacaggattgacggtaaagctagcacaaagcttacccccatcggctacataccaaaggaggatgccctgaacctgaagggactcggacatatcaacatgatggagttgttctccatcagtaaggagttctgggagaaagaggtagaggacatcgagaagtacctagaggatcaggtgaacgcagacctaccctgcgaaattgagcgggagatactggccctgaagcagaggatctcccagatgtag

SEQ ID NO: 234784 - DNA, 1674 bp, Artificial Sequence
  Description of Artificial Sequence: Synthetic coding sequence
atgagcgacccagaaatggggtgggttccagaaccccctacaatgactctaggagctagccgtgttgagctgagagtttcttgccatgggctgctcgaccgggatacactgaccaaaccgcacccatgtgtgcttctgaaactgtattccgatgaacagtgggtggaggttgagagaactgaggtgctgcgcagttgctcatcccccgttttctctcgcgtgctcgcactggaatatttctttgaggagaaacaaccattacaattccatgtcttcgatgcagaggacggtgctacctctcctagaaacgacacctttcttggaagcactgagtgcacactgggccagatcgtcagccagaccaaagtgactaagcccttacttttgaaaaatggaaagacggccggtaagtctaccatcacaattgtagctgaagaggtgtctggtacaaacgattacgtgcaacttacattcagggcttataagctagacaacaaggatttgttcagtaaatctgatcctttcatggagatttacaagactaatgaagaccagagcgatcagcttgtgtggcggacagaggtagttaagaataatttaaatccatcttgggagcccttccggttgtccttacactccctgtgttcatgtgatgtacaccgcccacttaaattcctcgtttatgactacgattcttctggaaagcacgacttcatcggcgaatttacctccacattccaagagatgcaagaggggaccgctaacccgggacaggaaatgcagtgggactgtattaaccctaagtacagggataaaaaaaaaaattacaagtctagcggcactgttgttcttgcacagtgcaccgtggaaaaagtccatacattccttgattatatcatgggtggatgccagattagtttcactgttgctattgacttcaccgcatcaaacggggatcctcgatcatcacagtccctgcactgcctgtccccgcgacaacccaatcactacctgcaggccctacgggcagtcggtggcatctgtcaggactacgactccgataagcgcttcccggcattcgggttcggcgcacggattccccctaatttcgaggttagccatgactttgcaattaatttcgacccagagaatcctgagtgcgaggaaatcagtggcgtgatagcttcgtatagacgatgcctcccccagatccaattatacggtcccactaatgtggcacctattattaatcgagtggcagaacccgctcagagggagcagtctacagggcaagctacaaagtattccgtgttgctggtcctcactgacggggttgtctccgatatggccgaaactcgcactgccatcgttagggccagcaggctcccaatgtccatcatcatagtcggcgtaggtaacgcggacttctccgatatgcgacttctggacggggatgacggacccctccggtgcccgagaggcgtccccgcagcccgagacattgtgcaatttgtgccatttcgagactttaaagatgccgctccctccgctctggcaaaatgcgttctcgcagaggtcccccgacaggtcgttgaatactacgccagccagggcatttcgccgggagccccacggccatgtacgctcgctacaactccatctcctagtccctag

SEQ ID NO: 234785 - DNA, 1326 bp, Artificial Sequence
  Description of Artificial Sequence: Synthetic coding sequence
atggccgctctctatcgccctggactgcgccttaactggcacggcctgtccccgctaggatggccatcttgccggtcaatacagacattgcgagtgttaagcggagatctggggcagctccctactggaatccgggatttcgtggaacacagcgcgagactgtgccaacccgaggggattcatatttgcgatggcacggaagcagaaaacaccgccacattgaccctgctggagcagcaggggctcatcagaaaattgcctaaatacaataactgctggctggcacgcacagatcccaaggacgtggcacgagtcgaatccaaaacagtcattgtcacgccatctcagcgcgacactgtgcagcttccccctggcggagcgcgtgggcagttggggaactggatgagtccagccgattttcagagggctgtggacgagcggttccctggttgcatgcagggcagaaccatgtacgtcctcccatttagcatggggccagtcggaagcccactttctcgaataggcgtacagttgacagacagtgcctacgtggtcgccagcatgcggatcatgaccagactggggactccggtgctccaggccctgggggatggcgacttcgtgaagtgtttgcacagtgttggtcagccactgaccggccagggggagcctgtgtctcagtggccatgtaaccctgagaagacactaatcggacacgtgccagaccagcgcgagattatcagctttgggtcggggtacggagggaacagcctgctggggaaaaagtgtttcgccctgcggatcgcttctcggttagccagggacgaaggatggctggccgagcacatgctgatcctgggtatcacaagcccagctgggaagaagcgatacgtggcggctgctttcccgagtgcctgcggaaaaaccaacctggctatgatgcggccagccttaccaggatggaaggtcgaatgtgtgggcgacgacattgcgtggatgaggttcgactccgagggcagactgcgtgccattaatccagaaaacggattcttcggagtggccccaggcacttctgcgaccaccaaccctaatgctatggctacaatccaaagcaacacgatcttcaccaatgtagctgagaccagcgatgggggagtttattgggaaggcatcgaccagcccctccctcccggagtgacggtgacatcttggctgggaaagccctggaaacccggtatgtgcggaggagaaggagtggcgcagcctcccggactctctacccttatggtggagaagttatctccacaaccccctaccattttttag

SEQ ID NO: 234786 - DNA, 1521 bp, Artificial Sequence
  Description of Artificial Sequence: Synthetic coding sequence
atgtctcccgctgattttcagagggcggtcgacgagcggtttccgggatgtatgcagggtcgcaccatgtacgtgttaccattttcaatggggccagttggctcaccgttaagccgcatcggagtccagctgacagactcggcctacgtagtggcctcaatgagaatcatgactcgtctgggaactcctgtccttcaagcattaggggacggagactttgtcaaatgcctgcactcagtgggccagccacttaccggacaaggtgaacccgtgtctcaatggccgtgcaaccctgaaaagacccttataggacatgtcccagaccagagagaaattattagttttggctctggctacggcggaaactctctactgggcaagaagtgcttcgctcttaggatcgcctctcgactcgctcgggacgaagggtggctcgcagagcatatgctcatcttaggcatcacatcccccgcagggaaaaagcgctatgtggccgcagcctttccatcggcttgcggcaagactaatttggcaatgatgagacccgctctgcccggatggaaggtcgagtgtgttggggacgatattgcttggatgcgcttcgactcagagggcaggctccgcgctattaacccagaaaatgggttcttcggggtcgcacccggaacctctgcgaccaccaatcctaacgcaatggccactatccagtcaaacacgatcttcacaaacgtggcagagacaagcgacggcggagtgtactgggaaggcatcgaccagcccctcccgccaggtgttaccgtaacttcctggttagggaagccatggaagcctggggataaggagccttgtgctcatcctaacagtagattctgcgcccctgcacggcaatgtcccatcatggatccagcatgggaggctccagaaggtgtccccatagatgccatcatatttggtggaagaaggcccaagggggtcccgcttgtttatgaggcttttaactggcgacacggcgtgtttgttggaagcgcgatgcgcagcgagtccaccgccgcagcagagcataagggcaaaattatcatgcacgacccattcgccatgcgcccattctttgggtacaactttgggcactacctggagcactggttgtcaatggagggtcgtaagggggcacaactccccagaattttccacgtcaattggttccggagggacgaagcgggacactttctatggccagggtttggagagaacgcacgggttcttgattggatctgtcgcagactagagggggaagattccgctagggagaccccgatcgggctcgtgccaaaggagggagcgttagatctctcaggactgagggctatcgatactacccagctgttcagcttacctaaagacttttgggagcaggaggtgcgagacatacggtcctatctgacagaacaggtgaaccaagacttgccaaaagaggtcctggcagaactggaagcactggagaggcgcgttcacaagatgtag

SEQ ID NO: 234787 - DNA, 1521 bp, Artificial Sequence
  Description of Artificial Sequence: Synthetic coding sequence
atgtcacctgccgacttccagagagcagtggacgagcggttccctggctgcatgcaggggcgtacgatgtacgtcctgccattctcgatggggccagtcggttctccattaagcaggatcggcgtacaactgactgatagtgcctatgtggtcgccagtatgcgcataatgacaaggctcggcacccctgtactgcaggccctcggagacggtgatttcgttaagtgtcttcacagcgtgggtcagcctctgactggccagggcgagcctgtgtctcagtggccctgcaatcctgagaaaacgcttattggccatgttcccgatcagcgcgagattattagtttcggctccggctacgggggtaacagtttgctgggcaagaagtgctttgcactgcgtattgcatcccgccttgcacgggatgaggggtggctggcggaacacatgctaatactcggtatcacaagcccggctggtaaaaagcgctacgtggctgccgctttccccagcgcttgcgggaaaacaaacctggctatgatgcggccagctcttcctggatggaaggtggagtgtgtgggcgacgacattgcctggatgagattcgattctgaaggcagattaagggccatcaaccccgagaatggcttttttggagtcgcccctggcacttcagccacaaccaatcccaatgcaatggctaccattcagtccaacaccatctttacgaatgttgccgaaacttctgatggtggcgtgtactgggaaggaattgaccagcctcttcctccaggcgttacagtgaccagctggctggggaaaccttggaagcctggcgacaaagaaccctgtgcccatcccaattcaagattttgcgcgcctgcccgacagtgtcctattatggacccagcgtgggaggctcctgagggagtcccgatcgatgcaattattttcgggggaaggcgacccaaaggtgttcccctcgtttatgaggctttcaactggcggcacggagtgttcgttgggtctgcaatgagaagcgagagcactgccgctgcggagcacaagggtaaaataatcatgcatgatcctttcgcaatgagacccttctttggctacaactttggtcactatttggaacactggctgagcatggaaggtaggaaaggtgcacaactgccgaggatattccatgtcaattggtttagacgcgacgaggccggtcacttcctctggcccggtttcggggaaaacgccagagtcctggactggatctgccggaggcttgagggcgaggattccgctagagagactccaatcgggctggtgcccaaggagggggctctggacctctcgggactgcgggctatagacacaacccagctgttttccctgcctaaagatttctgggagcaggaggttagagacatccggagctatttgaccgagcaggttaaccaagatcttcctaaggaagtgctggctgagctcgaggctctggaacggagggtccacaaaatgtag

SEQ ID NO: 234788 - DNA, 2343 bp, Artificial Sequence
  Description of Artificial Sequence: Synthetic coding sequence
atggccgctgtcgatcttgagaagctacgagctagcggcgctgggaaagccatcggagtgctgacgtcaggtggcgatgcccaggggatgaatgccgctgtaagagccgtgacgagaatgggaatctacgtcggggctaaggtttttctgatctatgaggggtacgagggactggttgaaggcggtgaaaacattaagcaagccaactggttgtccgtgtcgaacatcatccagctgggcggaaccattattggctctgccaggtgtaaagccttcaccacccgagaaggtaggcgcgctgccgcttataaccttgtgcagcatggtattacaaacttgtgtgtaatcggcggagacgggtccctgaccggcgctaacattttccggtcggaatgggggtctcttctggaagagctggtggctgagggcaaaatctccgagaccaccgctcgtacttactctcaccttaacatagccggactagtgggatcaatcgataacgacttctgcgggacggacatgaccatcggcaccgacagcgccctgcaccgaattatggaggttattgacgctataactactacagctcagagccaccagaggacatttgttctggaggtgatgggaaggcactgcgggtacctagccctggtgtcagcgttggcaagtggcgctgactggctattcatccctgaagcccctcccgaagacggatgggagaattttatgtgtgagagacttggcgagaccagatcccggggttctcgactcaacattataatcatagccgagggtgcaattgaccgaaacggaaagcctatctcatcatcctatgtgaaagatcttgtggttcagcggctggggtttgacacccgcgtgaccgttctcggccatgtgcaacgcggaggcactccctcagcttttgacaggattctgagctcaaagatgggaatggaggcggtcatggcactcttggaggccactccagatactcccgcatgcgtcgtcaccctgagcgggaaccaaagtgttagattgcctctgatggagtgtgttcagatgaccaaggaggtgcaaaaggccatggatgataaacgattcgatgaggccacgcagttgagaggcggtagttttgaaaataactggaacatttacaaactgcttgcccaccagaagccaccgaaggagaagtctaatttttctttggcaatacttaacgtgggtgcacctgccgctggaatgaatgcagccgtgcgctctgcagtcaggaccggtattagccacggacacaccgtgtatgtggtgcatgacggatttgagggcctggccaaaggccaagtgcaagaggtgggttggcacgacgttgctggatggcttggtcgaggtggaagtatgctgggcacaaagcggacgctgccaaaaggacagcttgaaagcatcgtggaaaatatccgaatctacggaatccacgccctactggtagtaggaggatttgaagcctacgaaggcgtgcttcagctggtggaggcgaggggtagatacgaagagctctgtatagttatgtgtgttatccccgcaactattagtaacaacgttcctggtaccgacttcagtctgggttccgacactgccgtgaatgccgctatggaaagctgcgaccgcattaaacagtctgcctcagggacaaagcgtagggtgtttatcgtcgagaccatggggggatactgtggttatttggccacagtgacggggatagcagttggcgcagacgcagcttacgtgtttgaggaccccttcaacatccacgacctcaaggttaatgtagagcacatgacagagaaaatgaagacagacatccaacgaggtctggttctgagaaacgaaaaatgccacgattactataccacagagtttctgtacaatctgtacagctccgaagggaagggcgtgttcgattgcaggaccaacgttctggggcatctgcagcagggcggagctcctacgccctttgatcgaaactatggcaccaagttgggtgttaaggcgatgctctggctcagtgagaagttgagggaagtctaccgcaaagggagagtattcgctaacgctcccgactctgcatgtgtgatcggtctgaaaaaaaaggccgtagcgtttagccctgtcacagagttaaagaaagataccgactttgagcatagaatgcctagagaacagtggtggctgtcgctgcggctgatgctgaagatgttagcgcagtatcggatatccatggctgcctatgttagtggagagctggaacatgttactagaaggacattgtctatggacaaagggttttag

SEQ ID NO: 234789 - DNA, 762 bp, Artificial Sequence
  Description of Artificial Sequence: Synthetic coding sequence
atgcggtcgatgtgcaaccaaggcaggggacgcgagagttctcggggtgggttgcacgtgcagggatcctgtagggggctgtctcgttctcctcagcaggagactggcttcgctaaggctccagcgggaaccgactgctttttccactgttcaccaggatcacgagggcagggtgatcgcaaagaggaagtcacaagtgagccaggcggaacgtcgataatgtcacgccttggaggcatgaacgccgcagtcagggctgtaacaaggatggggatctatgtgggtgcaaaagtctttctcatctatgagggatacgagggcctggtggaaggcggagagaatattaagcaggccaactggctaagcgtgagtaatataatacagctggggggtacgattattggaagcgccaggtgtaaagcattcacaactagagaaggcagacgcgcagccgcatataacctggtgcagcacgggatcacaaatttgtgcgtgatcggaggcgacgggtcattaaccggcgctaatatatttaggtctgaatgggggtctctcctcgaggagctagtggctgagggcaagatttctgaaacaactgcgaggacatactctcatctcaatattgcgggtctggtgggcagtatcgacaatgatttctgcggtactgatatgaccatcgggacagactctgcattgcaccgtatcatggaggtcatcgacgcaatcacgacccgagggaggctcggcgaactgcacgtctag

SEQ ID NO: 234790 - DNA, 2484 bp, Artificial Sequence
  Description of Artificial Sequence: Synthetic coding sequence
atgtgcaaccagggcaggggccgagagagctcgcgcggaggacttcatgtgcaggggagttgtagggggctgtctagaagtccacaacaagaaaccggcttcgctaaggctcccgctggaaccgactgcttcttccactgttctcctggaagtcgcggacagggagataggaaggaggaggtgacctcggagccaggcggaaccagtatcatgagtcggctcggcggaatgaatgcagcggtcagagccgtgacacgcatgggcatctatgtgggggcaaaagtattcctcatctatgaagggtatgaagggttagttgaaggcggagaaaacatcaagcaggccaactggttgtccgtgtctaatatcattcagctgggcggtacgattatcggctcagccagatgcaaggcatttacaacacgagagggaaggagggcagctgcttataatttggtccagcacggtatcaccaacctttgcgtgataggcggagacggctccttaactggcgcaaacattttccgcagtgagtggggatccctgctagaagagttagttgcagaaggaaagatctccgagacaacagctcgaacatatagtcacctgaacattgcagggctcgtcggaagcatagacaacgacttctgtggcaccgatatgacaattgggacagactctgcgctgcatcgtattatggaggtaatcgacgccatcacaaccactgctcagagtcatcaaagaaccttcgtgctggaggtcatgggtaggcactgtgggtacctcgctctcgtttcagccctggcctccggggcagactggctgtttattccagaagctccaccagaggacggatgggagaacttcatgtgcgagaggttgggcgagacccgaagccgaggttctaggctaaatattattatcatcgccgagggagccatagatcggaatggaaagccaattagctcatcatacgtcaaggatctggtggtccaacggcttgggttcgacacacgagtaacggttttgggacacgttcaacggggaggtacaccttctgccttcgaccgaatccttagcagtaaaatgggcatggaggccgtgatggcactgctcgaagctactccagacacacccgcatgcgtggtcacattatcgggaaaccaaagcgtacgtctccccctcatggaatgcgttcaaatgacaaaggaggtccagaaagcgatggatgataagcggtttgatgaggccacccagctgcgaggcggtagctttgaaaacaactggaacatttacaagctgctggcgcaccagaaacctccaaaagagaaatctaacttttctctggccattctgaatgtgggggcacctgccgcagggatgaacgcagccgtcagatctgccgtgcgcactggcatttcccacgggcacactgtctatgtcgttcacgacggctttgagggcctcgcgaaagggcaagtgcaggaagtgggctggcacgacgtcgctggttggcttgggagaggcggatcaatgctgggaaccaaacgaacactgcctaagggacagctcgagtctatcgttgagaacatccgtatttacgggatccatgctttactggtagtggggggtttcgaggcatacgagggggtccttcagctcgtggaagctcggggaagatatgaggagctgtgtattgttatgtgtgtgattcccgctacgatctctaacaatgtccctggcacagattttagcctgggatcggacacagccgtgaatgcagctatggagagctgtgaccggatcaaacaatctgcgagcggcaccaaaaggcgagttttcatagtggaaactatggggggttactgcggctacctggccaccgtcactggcattgcagtcggagcagatgctgcctacgtcttcgaggacccattcaacatccatgacctgaaggtgaacgtggagcatatgactgagaaaatgaagacggacatccaacgaggtttagtgcttaggaacgagaagtgccacgattattacacgaccgagtttctgtataacttatattcttctgagggaaaaggtgtgtttgattgtcgcactaacgtgctgggacacctccagcaaggcggagctcctaccccatttgataggaactacggaactaagctcggcgtaaaggccatgctttggctgtcagaaaaactccgagaggtatacaggaaaggcagagtttttgcaaatgctccggactctgcctgcgtgataggcctgaagaaaaaagcagtggccttttcaccagtgaccgaactcaaaaaggacaccgatttcgagcatagaatgccgagggagcagtggtggctgagtcttcgattgatgcttaagatgctggcccagtaccgcatcagcatggcggcttatgtgtccggggagctggagcacgtgaccagaagaacactgtcaatggacaaggggttctag

SEQ ID NO: 234791 - DNA, 1722 bp, Artificial Sequence
  Description of Artificial Sequence: Synthetic coding sequence
atgggtcgccactgtgggtacctggcgcttgtgtccgccttagctagcggtgccgactggcttttcataccagaggcccctccagaagacggctgggagaattttatgtgcgaaagattaggtgaaacacggtccagaggttctcgtttgaatattattatcatcgcggagggtgcaattgatagaaacggtaaaccaatctcctcgtcctatgtaaaagatttggtggtacaacgccttgggttcgataccagagttaccgtcctgggacacgttcagcgaggcggtactccgtcagcttttgatcggatcctgtccagtaaaatgggcatggaagccgtgatggccctgctcgaagccacacccgataccccggcttgcgtcgtgacattgtcaggcaaccagagcgtgcggcttccactgatggagtgtgtgcagatgaccaaggaagtgcagaaagcgatggatgataagagatttgacgaagccactcagctccgtggtggcagctttgagaataattggaatatctacaaactgctggcacaccagaaaccccctaaggagaaatcgaacttctccctcgcaattcttaacgtcggcgctccagccgcaggcatgaacgcggctgtccgctctgcagtacggacaggcattagtcacggccacaccgtctatgttgtgcatgacggctttgagggcttggctaagggtcaggttcaagaggtgggttggcatgacgtggcaggttggctggggagaggagggagcatgttggggactaaaagaactttacctaaagggcagctggagtcgatagtggagaatattcgcatctacggcatccacgctctactcgtggtcggaggcttcgaggcatacgaaggagtcctccaacttgtggaggccagagggcgttatgaagaactgtgcatcgtgatgtgtgtgattcctgcgacaatctccaataacgtgccaggaactgacttttccctcgggagcgacaccgcagttaatgccgcaatggaatcctgtgaccgtataaaacagagtgcttccgggacaaaaagaagagtttttattgtggaaacaatgggcggttactgcggctatctggccacagttaccggaatcgcggtcggggctgatgcagcgtatgtattcgaagaccctttcaacatccacgaccttaaggtgaatgtcgaacatatgaccgagaaaatgaaaaccgatattcagcggggactggtcctcaggaatgagaagtgccacgactattacacgaccgaatttctttataacctttacagcagcgaagggaaaggggtttttgattgtcggactaacgtgctagggcacctgcagcagggaggggctcccactcccttcgacagaaattacgggacaaaattaggcgtaaaggctatgctgtggctttccgaaaagctgcgggaagtgtatcgaaagggacgcgtgttcgctaacgcccctgattccgcatgtgtcattggcctcaagaaaaaagcagtggcattcagcccggtgacagagttgaaaaaagatacagactttgagcacaggatgccaagagaacaatggtggttatccctgaggctgatgcttaagatgttggcccaatatcgaatctcaatggccgcttacgtcagcggggagctggaacatgttacacgcagaacgctgtccatggacaaaggcttctag

SEQ ID NO: 234792 - DNA, 2343 bp, Artificial Sequence
  Description of Artificial Sequence: Synthetic coding sequence
atgacccacgaggagcaccatgctgcgaaaaccctcggaattggcaaagcgattgccgtgctgaccagcggtggcgatgctcagggaatgaacgcggcagttcgcgcagtggtgcgggtaggaatatttaccggcgctagggtgttcttcgtgcacgagggctaccagggattggtcgacgggggtgatcatatcaaagaagcgacctgggaaagtgtcagcatgatgttacagttgggaggaaccgttatcggtagtgctagatgcaaagacttccgcgagcgggaaggtaggctacgggcagcatataacctcgtgaagcggggaattactaacctgtgcgtaatcggtggagatggaagtctaacaggagctgacacctttcgaagcgagtggtcagatctgttgagtgatcttcagaaggctggcaagatcacagatgaggaagccacaaagtcatcctacctgaacattgtgggcttagttggaagcatcgacaatgacttttgtggcactgacatgacaatagggaccgatagcgctctgcatcggattatggaaatcgttgatgccatcactacaacggcccagagccatcaacgcaccttcgtgttggaggtgatgggtcggcattgtgggtatctcgccctcgttacaagcctgagttgcggggcagattgggtatttatcccagaatgtccaccagacgatgactgggaagaacatttgtgccgacgactgtctgagacaagaacccgagggagccgcctgaatatcatcattgtggcagagggagccatcgataagaatgggaagcctatcacctcagaggatattaaaaaccttgtggtgaagaggctgggctatgatacccgcgttactgttctgggtcacgtgcaacggggtggcactccttctgcgtttgaccgtatcttgggatcacgtatgggagtggaagcggtgatggcgcttttggagggaacaccagatacgcctgcgtgtgtggtgagcctgtcaggcaaccaagccgtgcggctgcccctaatggagtgtgtgcaagtcaccaaggacgtgactaaggctatggatgagaaaaaattcgacgaggccctgaagctgcggggacgaagtttcatgaataactgggaagtgtataaactcctagcacatgtcagaccaccggtgtccaaatcaggttcccacacggtggccgtgatgaacgttggagcccctgctgctggtatgaatgcggcagtccgcagcacagtgagaatcggacttatccagggtaacagggtgttagtggttcacgacggctttgaaggtcttgcaaagggccaaattgaggaggccggatggagttacgtgggaggctggaccggacaaggcggatcaaagctaggaacgaagcgaaccctgcccaaaaaaagctttgaacaaatcagtgccaacattaccaagtttaacatccagggcctggtgatcattggagggtttgaggcgtataccgggggacttgaattaatggaaggacgcaaacagttcgatgagctgtgcattcctttcgtggtgatcccagctactgtcagcaataatgtaccaggatcggattttagtgtgggggctgatactgccctgaacactatctgcactacctgtgacagaattaaacagagcgcggctgggacaaagcgcagggtttttattattgagacaatgggcggatactgcgggtatctggccacaatggctggactggccgcaggggctgatgcggcttacatcttcgaggaacctttcacaattagagatctacaggcaaacgtcgagcatttagtgcagaagatgaagaccactgtgaagcgaggacttgtattacgcaacgagaaatgtaacgagaattacactaccgattttatattcaacctgtattccgaggaggggaaaggtatcttcgatagtcgtaaaaatgtcttggggcatatgcagcaaggcggttccccaactccgtttgataggaattttgccacgaaaatgggtgcaaaggccatgaattggatgagcggcaagattaaggagtcttataggaacggacggatctttgcaaacaccccggattctgggtgcgttctcggcatgcgcaagcgcgctctggtcttccagcccgtcgccgaattgaaagaccagactgattttgaacacaggattccaaaagaacagtggtggctgaaactgcggccaatattgaaaattctggcaaagtacgagattgatctggacacgtcagaccatgcacacctggagcacatcaccaggaagaggtctggcgaagctgccgtttag

SEQ ID NO: 234793 - DNA, 2556 bp, Artificial Sequence
  Description of Artificial Sequence: Synthetic coding sequence
atgcacaaggatgaatttcatctcaaatttttcatgtgcgtcatccaaagccggcagctggtgcgcaccccccagcgcacagccggagaggcttcaaccagttctatgttaatcccaaaaccaccacccaaaactgacatcctcaaatcacttgatactatggatgaccccgatactgttgggtcgatacccgtctttaaaacggaatggatcatgacccacgaggaacatcacgcagccaagacccttggcatcgggaaagcaattgccgtgttgacaagtggtggagacgcacagggaatgaatgcagcggtccgggcagttgtccgcgtcggcattttcactggcgctcgagtgttctttgtgcatgaagggtatcagggcctggttgatggcggtgaccatattaaagaggctacatgggaatccgtgagcatgatgctacagctgggaggcaccgtcattggaagcgcaagatgtaaggattttcgggaacgcgaagggaggctgcgggctgcttacaacttggtgaagcggggtatcactaatctgtgcgtgatagggggtgacggaagtctcactggagcggatacattccgtagtgagtggagcgatctgctgagcgacttgcagaaagcaggaaaaataactgacgaagaggccactaagtcctcttacttaaatatcgttggtcttgtgggcagtattgacaacgacttctgtgggacagatatgaccataggcacagatagtgccctgcacaggatcatggagatagtggatgccattaccactacggctcagtcccaccagcgtacttttgtgctggaagttatggggcgtcactgcgggtatttagctttggttacatctctgtcttgcggcgcagactgggtattcattcctgaatgcccccctgatgacgactgggaggagcacctgtgtaggagactctctgagactcgaacacgcggaagtcgtttgaacatcataatcgtggccgagggcgcaatcgacaaaaatggcaaacctattacctcagaggacatcaaaaatcttgttgtaaagagactgggctatgacacccgggtgacagtgctaggccacgtccaacggggaggaacaccctccgcatttgacaggatcttagggtcccgaatgggcgtggaggctgtgatggctttactggaaggaacccctgatacaccagcctgtgtcgtgagcctttctggaaatcaagctgtaaggctgccactcatggagtgcgttcaggtgactaaagatgtgacaaaagccatggatgaaaaaaaattcgacgaagcactcaagctccgcggtagatccttcatgaacaactgggaggtgtacaagttattggcccatgtcaggccacctgtcagcaagagcggcagccatacagtggcagtcatgaatgtgggtgcgcctgcggctgggatgaacgcagctgtacggagcactgtgaggattggtctgattcagggcaacagggtcctagtggtgcacgatggctttgagggcctagcaaaagggcagatcgaggaagcagggtggtcatatgtgggtggctggaccggacagggaggtagtaagctgggaaccaagcgcacactcccaaagaagagtttcgagcagatcagcgccaatatcacaaagttcaatatacaaggtcttgtgattatcggagggtttgaggcgtatacggggggactggaactgatggaaggtcgaaagcagtttgatgagttatgcatccccttcgttgtaataccagctacagtaagcaataacgttcccggatctgacttctcagtgggggcagataccgctcttaacacgatctgtaccacgtgcgatcgtataaagcagagcgccgcagggaccaaacgccgtgtgttcattatcgaaactatggggggatactgtggctaccttgccaccatggctggccttgccgcaggtgctgacgccgcttacattttcgaagagcctttcactataagagacctgcaggcaaacgtggagcatttggtgcaaaaaatgaaaacaactgtcaaaagggggctggttctccggaatgagaagtgtaacgaaaactacaccacagacttcatcttcaacctgtattcagaggaaggtaagggcatatttgattcccggaaaaatgtgttagggcacatgcagcagggcggaagcccaaccccgttcgatcgcaattttgccacaaagatgggggctaaggctatgaattggatgtccgggaagattaaagaatcctaccgtaatggcaggatcttcgccaatactccagactccgggtgtgtgctggggatgcggaagagagcactggtttttcagcccgtggctgaattgaaagaccagacagacttcgagcatcggatcccaaaggagcaatggtggctcaagttgagaccaatactgaagatcctggccaagtatgaaatcgacctagatacctctgatcacgcgcacttagagcacattacgcgcaagcgctctggagaagccgctgtctag

SEQ ID NO: 234794 - DNA, 2343 bp, Artificial Sequence
  Description of Artificial Sequence: Synthetic coding sequence
atgactcacgaggaacatcatgctgctaagacccttgggattggtaaagccatcgcggtgctaactagtggcggagacgctcaggggatgaacgctgctgtaagggcagtggtcagagtgggtatttttacaggggctcgggtgttcttcgtacacgaaggctaccaagggctcgtagatgggggagaccacatcaaagaagcaacatgggagtctgtgtccatgatgctacaactgggcggtaccgtgattgggtcagccaggtgtaaggattttagggaaagggagggcaggctgcgggctgcatacaacctggttaagcggggaattaccaacctctgcgtgattggtggagacggatcccttactggggcagatacatttcgatccgagtggtctgacctgctcagcgatctgcaaaaggctggaaagatcacggacgaagaggcaaccaaatcaagctaccttaatatagtgggcttagtcggctcgatagacaacgacttttgcggaaccgacatgaccatcggaacagactcagccttacatagaattatggagatagtcgacgcaatcactaccacggctcagtcacaccagcgaacctttgtactggaagtcatgggcaggcattgtggttacctggcactggtgacgtccctttcttgcggtgccgactgggtgtttataccggaatgcccccctgacgacgactgggaagaacacctctgtcgtagactctctgaaacgcgaacccgtggctctcgccttaacattataattgtggccgaaggagcaatcgataagaatggcaaaccaattacgtctgaagacatcaaaaatcttgtcgttaaacgcctaggatacgatactcgggtaactgtcctcggtcatgtgcaaagaggaggaacgcctagtgccttcgatagaattctgggtagccgtatgggggttgaagccgttatggccttactggaaggcacacccgatacccccgcatgcgttgtgagcctctctggcaaccaggcggtcaggttgccgttaatggagtgcgtccaagtgaccaaagacgtcacgaaagcaatggatgagaagaagttcgatgaggctcttaagctcagaggaaggtctttcatgaataattgggaggtctataaactgctggcacacgttcgacccccagtcagcaaatctggaagccacacagtcgcggttatgaatgttggcgcacccgctgcgggaatgaacgccgctgtgcgctcgactgtcaggatcggcttgatccaggggaatcgagtgctggtggttcacgatggtttcgaaggacttgctaaaggccaaatagaggaagccggttggagctatgtgggcggatggactggccagggaggatccaagctcgggacaaagcgtacactacctaaaaagtccttcgaacagatctcagcgaatatcacaaaattcaatattcaagggctggtcatcattggagggtttgaagcctacactggcggtcttgagctcatggagggcaggaagcagtttgatgaactttgtattccctttgtggttatacccgcaaccgtctctaacaatgtgccaggatccgatttttccgtcggcgcagatacagccttgaatacgatatgtactacttgtgaccggattaagcaaagcgctgcgggaactaaaagacgggtgttcattatcgagacaatgggagggtactgcgggtacctggcgacgatggcaggattggcggcaggggctgacgcagcgtacattttcgaggagccttttactattagagatctgcaagcaaacgtggagcatctcgtccagaagatgaaaactacagtaaagaggggactggtgctgcgaaatgagaagtgtaacgaaaactatacaactgatttcatctttaacctctactcagaagaagggaaaggtatcttcgactcgaggaaaaacgtactcggccatatgcagcagggtgggagcccaacaccctttgacagaaactttgctactaaaatgggggcaaaggccatgaattggatgagcggaaaaattaaagaatcttatcggaacggcagaatatttgccaacacccctgattctggctgtgtgcttggaatgagaaaacgcgctctggtattccagccagtggctgagttaaaagaccagacggactttgaacatcgtattccgaaagaacaatggtggttgaaactgcggccaattcttaaaatcctcgcaaaatacgagatcgatctggacacgtcagatcacgctcacctggaacatattaccagaaagagatctggagaggccgcagtttag

SEQ ID NO: 234795 - DNA, 2250 bp, Artificial Sequence
  Description of Artificial Sequence: Synthetic coding sequence
atgacccacgaggagcaccacgcagccaagactctggggattggcaaagctattgctgtgctgacatccgggggagacgcacaggggatgaacgcggcagtgcgcgctgtagttcgagtagggatcttcaccggcgctagggttttcttcgtgcacgagggttatcaggggctggtggatggtggcgaccatattaaggaagccacgtgggaaagcgttagcatgatgctccagctgggcggaaccgtcattgggtcggctcgttgcaaggatttcagggaaagggaaggccgactcagagccgcatacaaccttgtaaaacggggtattactaacctctgtgttatcggcggtgatgggtcgttaactggtgcagatacctttcgttcagagtggagcgacctgctgtccgacctgcagaaagcgggtaaaattactgatgaggaagctacaaaaagctcctacttgaacatagttggcctggtaggctccatcgacaatgacttctgtggaactgatatgaccattggcacagactcagccctgcaccgcattatggaaattgttgatgccatcaccactactgcccagagccaccagaggacttttgtcctcgaagtgatggggagacactgtggatacctagccctcgttacctccctctcatgtggggctgattgggttttcattccagaatgccctccagacgatgattgggaagagcatctgtgccggaggctgtctgaaactcggactcggggttcacggctgaatatcatcatcgtcgccgaaggtgccatcgataagaacggaaagcccatcacatccgaagatattaagaatgggagccgcatgggcgtcgaagcagtgatggcgctcctcgagggaacgcccgacaccccggcttgtgtagtgtccctaagcgggaaccaggcagttcgattaccactcatggagtgcgtccaagttacaaaagacgtcactaaagctatggacgaaaaaaagttcgatgaggccctgaagcttcgcggacgtagcttcatgaataactgggaggtttataagctgctcgcccatgtccgtccccctgtgtcgaaatctggaagtcacacggttgcggtgatgaatgttggggctcccgctgccggtatgaacgccgcagttcgctcaacagtgcggatcggcctcatacagggtaaccgagtgctcgttgtacacgatggcttcgagggattggctaagggacagattgaggaagccggatggtcctatgttgggggatggaccggccagggcggatccaagttgggcactaaaaggactctgcccaaaaaatctttcgaacaaatctctgctaacattacgaagtttaacatccagggcctggtgatcattggaggatttgaggcctatactggagggcttgagctgatggagggcaggaagcagttcgacgaattgtgcatcccatttgtggtgatcccagccactgtgagcaacaacgtcccagggtcagatttttctgtcggggctgacactgcgctaaacactatttgcactacctgtgacagaatcaaacaaagtgcggctggcaccaagcggagggtgttcatcatcgagactatgggcggttactgtggttacctcgctaccatggctggcctggccgctggagccgatgccgcatacatcttcgaggaaccattcacaatccgcgacctgcaggcaaacgtcgaacatctggtacagaaaatgaaaactacagtgaagagaggcctagttctcagaaacgagaagtgcaacgagaactacactacagattttattttcaatctttactccgaagagggcaaaggaatatttgactccagaaaaaacgtgctgggccacatgcagcagggaggctccccaacgccgttcgaccgcaattttgctacaaagatgggtgctaaggccatgaactggatgtccgggaaaatcaaggagtcttacagaaacggccgaatattcgcgaacactccggactcagggtgtgtgctgggcatgaggaagcgcgctttggtttttcaaccagtggccgagctcaaagaccaaactgatttcgaacatcgtattcccaaagagcaatggtggctaaagctgaggccgatcctcaagattctggccaagtacgaaatcgacctggacacgagcgatcacgctcacctggaacatattacaagaaaacgctcaggggaagcggcagtgtag

SEQ ID NO: 234796 - DNA, 534 bp, Artificial Sequence
  Description of Artificial Sequence: Synthetic coding sequence
atgacccacgaggagcatcacgctgcaaaaactctgggtatcgggaaggccattgcggtgttaactagtggcggagacgcacaaggcatgaacgctgcggtgcgatcaaccgttcgtatcggtttaattcagggaaacagggtcctagtcgttcatgatggctttgagggacttgccaaagggcagatcgaagaagctggctggtcatatgtgggtgggtggaccggacaggggggtagcaaactgggtacaaagagaaccttgccaaagaagagttttgagcagatcagtgctaacatcaccaaatttaacatccagggcctggttatcatcgggggttttgaggcttataccggcggtctggaacttatggaagggagaaagcagtttgacgaattgtgcattcccttcgtcgtcattcctgcaaccgtgagtaataacgttccaggctctgatttcagtgtgggcgcagacaccgccctgaacactatctgtactacctgtgataggattaaacaatccgctgccggatag

SEQ ID NO: 234797 - DNA, 2343 bp, Artificial Sequence
  Description of Artificial Sequence: Synthetic coding sequence
atgacgcacgaggagcaccacgccgcaaagacactgggtattggcaaagctatcgcagttctgacgtccggaggggacgcccagggcatgaacgccgcagtgagagccgttgtgcgcgtaggcatttttaccggagccagagtgtttttcgtccacgaggggtaccagggcttagtggacggaggcgaccatattaaagaagcaacttgggaaagcgtgtctatgatgctgcagttaggtggcacagtcattggctccgccaggtgcaaggacttccgggagcgcgaggggagactgcgcgctgcatataacctggtaaagcgcggaataacaaatttatgcgtgatcggaggggacggttcccttactggggctgatacttttaggtccgagtggtcagatttgctgtccgaccttcagaaggctgggaagattactgacgaagaagccaccaaaagtagctacctaaatatagtcgggctggtgggctctatagataacgatttctgtggaactgatatgaccatcggtacggattccgcactccatcgtattatggagatcgtggatgccatcacaaccactgcccagtcgcatcagagaacattcgtgctcgaagtcatggggagacactgcggctatctcgctctcgtgaccagtctgtcttgtggggcagactgggtcttcatcccagagtgccctccggatgacgattgggaagagcatctttgcaggcgcttatccgaaactaggactagaggttcacggctgaacatcattatcgtggctgagggcgctatcgataagaatgggaaacccatcacaagtgaagacattaagaacctcgtcgtcaagcggttggggtatgatacccgcgtgactgtgctcggacatgtgcagcggggtgggactccaagtgcctttgaccgcatcctgggatcaagaatgggcgtggaggccgtaatggctctgctggagggaacaccagacacacctgcttgcgtagtgtctttatctggcaaccaggctgtaagactgccgctgatggagtgtgtgcaggtgactaaagacgtgaccaaagcgatggacgaaaagaagtttgacgaagctctaaaactgaggggaaggtcattcatgaataactgggaggtctacaaactcctggctcacgtgcgccctcccgtgagcaagtctggcagccacacagtcgccgttatgaacgtaggagctcccgcagctggtatgaacgctgcagttcggagtaccgtgagaattgggctaattcaaggcaatcgcgtgctggtggtgcacgatggctttgagggtctcgccaaaggccaaattgaagaggctggatggtcctatgtcggaggatggactggacagggaggaagcaagctcgggacaaagcgcacccttcccaagaagtcttttgaacagattagcgccaacatcaccaagtttaacatccaggggctggtgatcatcggaggtttcgaagcctacacaggcggattagaattgatggagggacgaaaacagtttgatgagctctgtatccctttcgttgtgatccccgctaccgtaagcaacaatgtccccggatctgactttagtgttggggcagataccgccctgaatacaatttgtaccacatgcgacaggattaaacaatcagcagcagggaccaagaggagagtgttcattatagagactatgggagggtactgtggctacctagctaccatggccggtcttgctgcaggcgcagacgccgcatatatatttgaggagcctttcacaatccgggacctccaagcaaacgtagagcatctggtgcaaaaaatgaagactaccgtgaaacgagggctggttcttagaaatgaaaaatgcaacgagaattacacaaccgactttatcttcaacttatactcggaggaaggcaagggcattttcgatagccggaaaaacgttctggggcacatgcagcagggtgggagccccaccccattcgaccgcaattttgctaccaaaatgggagctaaggccatgaattggatgagtggaaagattaaagagagctatcgtaatggaaggatctttgcaaacacccctgatagcgggtgtgtcttaggcatgaggaaacgagccctagtcttccagccagtagctgagctgaaggatcagacagattttgaacaccgtatccccaaagagcagtggtggctgaagttacgacccattctcaaaattctcgccaagtacgagattgacctggacaccagtgaccatgcacacctggagcacattactcggaaaagatccggagaggccgcagtgtag

SEQ ID NO: 234798 - DNA, 354 bp, Artificial Sequence
  Description of Artificial Sequence: Synthetic coding sequence
atgactcatgaggaacaccatgccgctaagaccctgggtataggtaaggcaattgccgtgctaacctccgggggagatgctcagggtatgaacgccgctgtccgagctgttgtgcgggtggggatttttactggcgcacgcgtatttttcgtgcatgaggggtatcagggactggtcgacggaggcgaccatattaaagaggccacatgggagtctgtcagtatgatgctacagctggggggaacagtaattggcagcgctaggtgtaaggacttccgggagagggaagggcgtttaagagccgcatataacctggtcaagaggggcataaccaacctctgtgtcattgggtag

SEQ ID NO: 234799 - DNA, 486 bp, Artificial Sequence
  Description of Artificial Sequence: Synthetic coding sequence
atgacccatgaagagcatcatgcggctaaaaccctcggtattgggaaagcgattgccgtactgaccagtgggggagacgcccaaggcatgaatgctgcagttagggctgttgttcgggtcggtatcttcacaggtgccagggtgttttttgtacatgaaggctaccaaggactggtggatggtggcgaccatattaaggaggctacttgggagtcggtatctatgatgctacagctgggaggcaccgtcattgggtctgcacggtgtaaagactttagggagcgtgagggacgactgagagcagcttacaacctagtgaaaagaggcattacaaatctatgcgtcatcggcggagatgggtctcttactggagccgatacctttcggtcagagtggtctgacctgttgagcgacctgcagaaagcaggcaaaatcactgacgaggaagccacaaagtcaagttacctcaacatagtcggtctctag

SEQ ID NO: 234800 - DNA, 474 bp, Artificial Sequence
  Description of Artificial Sequence: Synthetic coding sequence
atgacacacgaagagcatcacgccgctaagaccttgggtatcggcaaagccatcgccgtcctcacctctggcggagatgctcaggggatgaacgcagcggtgcgtgcagtcgtaagagtagggatcttcacaggggctagggtgtttttcgtccacgagggctatcagggcctggttgatggcggtgaccatataaaggaggccacctgggaatcagtctccatgatgctgcaactgggcggtacggtcattggcagtgctcgctgtaaggatttccgcgagcgggaagggcgactccgggcagcatataatctggtcaagcgcggtatcaccaacctgtgtgttatcgggggagatgggagcttgaccggtgccgatacattccgcagcgaatggtcagatctgctttccgatctgcaaaaggccggaaaaattactgatgaagaggctactaagtcttcttatctgaattag

SEQ ID NO: 234801 - DNA, 258 bp, Artificial Sequence
  Description of Artificial Sequence: Synthetic coding sequence
atgacacacgaggaacaccatgcggctaaaacattgggcatcgggaaagctatcgcagtactgacaagcgggggagatgctcaggggatgaacgccgctgtcagagctgtggttagggtgggaatctttactggtgcccgagtgtttttcgtgcacgagggttaccaggggctggttgatggaggcgaccacataaaagaggctacttgggaatcagtcagcatgatgctgcaattagggggtacagttatcggatag

SEQ ID NO: 234802 - DNA, 420 bp, Artificial Sequence
  Description of Artificial Sequence: Synthetic coding sequence
atgactcacgaagagcatcatgccgctaaaaccctcggtatcgggaaagccattgctgtgctgacatcaggaggggatgctcagggcatgaatgcagcagtgcgagccgtggtgcgtgtgggtatttttactggtgcccgagtcttcttcgtccacgagggatatcagggtttggttgatgggggtgatcacatcaaggaggcaacctgggagtccgttagcatgatgctgcagctgggaggaactgttataggtagtgccaggtgcaaagactttcgcgagagagagggtcgcctgcgtgctgcctataatctggtcaaaaggggtattacaaatttgtgcgtcatcgggggagatggcagcctgacaggagctgacacctttcggtcagagtggtccgaccttttatcagacctgtag

SEQ ID NO: 234803 - DNA, 2250 bp, Artificial Sequence
  Description of Artificial Sequence: Synthetic coding sequence
atgacccacgaggaacatcacgctgcaaaaaccttgggaattgggaaagctattgcagtgctgacatccggtggagatgcacagggcatgaacgcagccgtcagggcggtggttcgagtggggatctttaccggcgcaagagtgttttttgttcatgaaggctatcaggggctggtcgatgggggagatcacataaaggaagctacatgggaaagcgtttcaatgatgttgcaactgggcggaacagtgatcggatcggcgaggtgcaaggactttcgggagcgggagggacggctgcgcgctgcctacaacctggtgaagcgcggaatcacaaacctgtgtgtgattggaggagacgggagtctgaccggggctgacaccttccgtagtgaatggtcggatctgctttctgacctgcagaaagctggtaaaatcacagatgaggaggcaactaagtccagttacctgaatatcgtcggcctggtcgggagcatcgataacgacttctgcggaaccgatatgaccattggcaccgactccgccctacacaggatcatggagatcgttgatgctatcaccactacagctcaaagccaccagcggactttcgttctggaagtaatgggacgtcattgtggctatttggctctcgtgaccagtctttcatgtggcgctgactgggttttcatacctgagtgcccacctgatgacgactgggaggagcacttgtgccgcaggttgtccgagactcggacaagaggaagccggttgaacatcatcatcgtggctgagggagcaattgataagaatggtaagcctattacatccgaggacattaagaatggttcacgcatgggcgtcgaggccgtgatggccctgctggaaggaacacccgacaccccggcatgtgtcgtcagcctctctggtaaccaggccgtccgacttcctctcatggagtgtgtacaagtgacaaaggacgttaccaaggccatggacgagaagaagttcgacgaagccctgaaactgagaggtcggagttttatgaataattgggaagtgtataagctgctggcccatgtgcgtcctcccgtctcaaagtcagggtcccacaccgtagccgttatgaacgtcggcgcaccagcggctgggatgaacgctgccgtgcgctccaccgttaggattgggctcattcagggcaatcgcgtgctcgtagtgcatgacggattcgaaggacttgccaagggacagattgaggaagccggatggtcttatgtgggcggatggacaggacagggagggtccaagttgggcacgaagcggactctgcctaagaaaagttttgagcagataagcgccaatatcactaaatttaacatccagggacttgtgattataggcggatttgaagcttacacggggggtcttgaattgatggaaggacgaaagcagttcgacgagctttgcattcccttcgtggttattccagcaacagtgtcaaacaatgtaccgggaagtgattttagcgtgggcgcagacacggccctgaatactatttgcaccacatgcgatcgtatcaaacagagtgctgccggtaccaagaggagagtttttattatagaaactatgggagggtattgcgggtacctggctacaatggcgggtctggccgcaggggctgatgcagcatacatcttcgaagaaccatttacaatacgcgatctgcaggccaatgtagagcacttggtgcagaagatgaaaactaccgtgaagaggggattggtgctgagaaatgagaaatgcaatgaaaactacaccactgactttatctttaacctttatagtgaggaaggaaaggggatctttgactcccgcaagaacgttttggggcacatgcagcagggagggtcgccaaccccatttgatagaaactttgccaccaagatgggggcaaaagccatgaattggatgtcaggcaaaatcaaggaatcttaccggaacgggagaatctttgccaatactcccgactcaggctgtgttctaggcatgcggaagcgggctcttgtgttccagcccgtggctgagctgaaagatcagacggactttgaacaccgaatccctaaagaacagtggtggcttaaactgcgccctattctgaagatactggctaagtatgaaatcgacctggatacatccgaccacgcccatcttgaacatattacacgaaagcgaagcggggaggccgcagtgtag

SEQ ID NO: 234804 - DNA, 609 bp, Artificial Sequence
  Description of Artificial Sequence: Synthetic coding sequence
atgggcggatactgtggctacctggctaatatggggggactggccgcaggagcagatgcggcatatatatttgaggagccatttgatatacgggatctgcagagcaatgtcgagcaccttacggagaagatgaaaaccaccattcagcgaggtctcgtgctgaggaatgaatcttgttcagagaactacactactgatttcatctaccagttgtactccgaagaggggaagggtgtatttgattgtcgaaagaatgtacttggtcacatgcagcagggaggggctccctcacccttcgaccggaattttggcacgaaaatctccgccagagccatggaatggataaccgccaaactgaaggaggcccgaggtaggggcaaaaaattcacaaccgatgacagcatctgtgtcctgggcatcagcaagagaaatgtcatctttcagcctgtggcagagctgaagaagcaaacggatttcgagcacagaattccaaaggagcagtggtggctcaagctgcgacctttgatgaagatcctggcaaaatacaaggcctcatacgacgtaagtgatagtgggcaacttgagcacgtgcagccctggtccgtctag

SEQ ID NO: 234805 - DNA, 2331 bp, Artificial Sequence
  Description of Artificial Sequence: Synthetic coding sequence
atgtgcggatacgagcgatgcaggccatgtagaggagctcacggctacctgaggggaggtcaaggggtattgcaccttcgcggattgccaggtcacgggggacgaagactcaagcaccgcagaggcagacttggcgagtgtctgcagcatccagcgagtggcgcagtccgcggtgattggcgggaaaaaccagggtgctggagtcacagatttccctgccccggaaggcatgctttggtcgggggaaccattattgggtctgcaaggtgccaggctttcagaactagagagggccgtcttaaggcagcatgcaaccttctgcagcgtggcataacaaacttgtgtgtcattggtggagacggatctcttaccggggctaacctgtttaggaaagagtggagcggtctcctcgaagaactggctaggaacgggcagatagacaaagaggctgtgcaaaaatatgcgtacctaaacgtcgttgggatggtgggttccattgacaacgatttctgtggcactgatatgacaattggcaccgactccgcactgcacagaattatcgaggtggtcgacgccattatgactactgcccaaagtcatcagcgcacattcgttctggaagtcatggggagacattgcggctacttggctctggtgtcagcactggcctgtggcgctgattgggtttttctgcctgagtcccccccagaggaaggctgggaagaacagatgtgcgtcaaactctccgagaacagagctcgaaaaaagagactgaatattatcattgtcgccgagggggctatcgacacccagaataaacccatcacatctgagaaaatcaaggaactcgtcgtgacacagctgggttacgatacacgggtcactatcctgggccacgtgcagcgcggaggaactcctagtgcatttgatcgcatcctcgcttcaagaatgggcgtcgaagccgttattgctctgctcgaagctactccggatactccagcatgcgtggtgtcactgaatggtaatcatgccgtccggcttcccttgatggagtgcgtccaaatgacgcaagacgtgcagaaagctatggatgaacggcgattccaggatgcagtccggctgcgcggacgttctttcgctggcaacctcaacacatataaaaggctagcgataaagcttccagatgatcagatccctaaaactaattgtaatgtcgctgtgatcaatgttggtgcacctgcagccggtatgaacgctgctgttcggagtgcagtccgcgtaggaattgcggatggacaccggatgcttgcaatttatgacgggtttgacggattcgccaagggtcagatcaaagaaattggctggacggatgtggggggttggacaggacagggaggcagtatcttggggaccaaaagggtgctccctggtaaatatctggaggagatcgcaacgcaaatgagaacccactcaataaacgcattgctcatcataggcggatttgaggcatatctcggattactggagcttagcgcagccagagaaaagcatgaagagttttgcgtccctatggtaatggttccagctacggtgtccaacaacgtcccagggtcagatttttccatcggagccgacacagcactgaatacaatcaccgacacatgtgacaggattaaacagagcgcttctggcaccaaacggagagtgttcatcattgagactatgggcggatattgcgggtacctggctaatatggggggattggctgccggagcagacgctgcttacatcttcgaggagccattcgacatccgcgacctgcagtcaaatgtcgaacatttaacagagaagatgaagaccacaattcagagggggctcgtgctgcgcaacgagtcctgttctgagaactatacgaccgacttcatttatcagctctattccgaagaggggaaaggggtctttgattgccgcaaaaacgtcttaggccacatgcaacaaggaggagcaccttccccctttgaccgtaatttcggaactaaaatttcagccagagccatggaatggattacggctaaactgaaggaagccagagggaggggcaagaagttcacaaccgacgattctatttgtgttttgggcatctccaaacgcaatgtaatcttccagccagttgccgagctcaaaaaacaaactgactttgagcatcgaattcctaaagagcaatggtggctcaaactgaggcccttgatgaaaattctggcaaagtacaaggcctcttatgacgttagtgattccggacaactggaacacgtccaaccatggagcgtgtag

SEQ ID NO: 234806 - DNA, 2355 bp, Artificial Sequence
  Description of Artificial Sequence: Synthetic coding sequence
atggatgcagatgactcccgtgcccctaagggatctttacgcaagttcctcgagcacctgtcaggcgctggcaaagcgatcggagtgttgactagtggaggtgacgcgcaggggatgaacgcggcagttcgcgcagtggtgcgcatggggatttacgtgggcgcaaaagtttattttatatacgaaggctatcagggaatggtggacggcggaagcaatattgccgaagcagactgggagtccgtgtcatccattcttcaggtggggggaactattattggctcagccaggtgccaggcttttcggacgcgggaagggaggctgaaagctgcttgtaacctgctgcagagaggcatcacaaatctgtgtgttattggcggtgatggcagccttaccggggctaacctgttccgaaaggaatggtccggactcctggaagagctcgccagaaacgggcagattgataaagaagccgtgcaaaagtacgcctacctgaatgtcgtagggatggtgggtagtattgataatgacttttgcggtacagatatgactatcggcacagactccgctctccatcgtattattgaagtggtagacgctatcatgacgaccgcgcagtcacaccaacggacgtttgtgttagaagtcatggggagacattgcgggtacttggccctggtttcagccttagcatgcggagctgattgggtgttcttgcccgaatcgcccccagaggaggggtgggaagaacagatgtgtgtgaaactgtcagagaaccgcgctcggaaaaagcgcctgaatataatcatagtggccgaaggcgcaattgatacacaaaacaagccaatcacaagcgaaaaaatcaaagaattggtcgtgacccagctgggctacgatacccgggtgactattttaggccacgtccaaaggggaggaactccaagtgcctttgatcgcatcttggccagccgaatgggagttgaggcagttatagctctgctagaagctacccctgatacccccgcttgcgtcgtgtctctgaatggcaatcatgcggtgaggcttcccttaatggagtgcgttcagatgacgcaagatgtacagaaagctatggacgaaaggaggttccaggatgcagtgaggctgagagggaggagtttcgctggcaatctcaacacatacaaacgccttgccatcaagctccccgacgatcagatacctaaaacaaattgcaacgtggccgtgattaatgttggagcacccgctgctggcatgaacgcagccgtgcggagtgccgttagagtgggcatcgccgacggccataggatgcttgctatctacgatggattcgacggctttgcgaagggacagattaaggaaatcggatggaccgatgtcgggggttggacaggccagggcggtagcatcctgggcacgaaacgagtgctaccaggcaagtacttagaagaaatagccacacagatgagaacgcactcgatcaacgccttgctcatcattggcggtttcgaagcctatctcgggctcctggaattgtctgcagctcgcgaaaaacatgaggaattctgcgtccccatggtgatggtcccggctacggtcagtaataacgtgccaggcagtgatttttcaatcggagctgacaccgccctcaacaccatcaccgatacctgcgaccgaataaagcagagcgcttcaggcacaaagcgccgtgtgttcataattgagacaatggggggttactgcggctatctcgccaatatgggcggactagcagccggtgctgacgctgcctacatcttcgaagagcctttcgatatccgggacttacagtcgaacgtagagcacctgacagagaaaatgaagaccacaattcaaagaggactagtactgaggaacgagtcgtgctctgagaattacacaacggacttcatttaccaactgtattcagaagaagggaagggtgtctttgattgtcggaagaacgtgctcggccacatgcaacaaggcggagccccttccccatttgaccgcaatttcggaacaaagatttctgctagagctatggagtggataactgcaaagctgaaggaggcaagggggagaggaaaaaagtttacaaccgacgatagcatatgtgtactagggatctctaagagaaatgtgattttccagccagttgccgagttgaagaagcaaacagacttcgaacacaggatcccaaaggaacagtggtggttaaagttgcgacctcttatgaagattctcgctaagtataaggctagctatgatgtgtcggattctggacaattagagcatgtgcagccctggagcgtctag

SEQ ID NO: 234807 - DNA, 2322 bp, Artificial Sequence
  Description of Artificial Sequence: Synthetic coding sequence
tacgagcgctgccggccatgcaggggagcccatggctatctgcgtggtggccagggtgttctacatttgcgtgggctgccgggacacgggggacgtaggctgaaacacaggcgcggaagactgggcgaatgcttgcagcatcccgcttccggtgcggtgcggggtgattggcgcgagaagcccggatgctggtcacacaggtttccctgccctggccgacacgcactggttgggggaaccattatcggctccgctagatgtcaagctttcaggacccgcgaggggagactgaaagctgcttgtaatctgctgcagcggggtattacaaatctgtgcgtaatcgggggagacgggtccctgaccggcgctaatttgttcaggaaagaatggtccgggctgcttgaagaactagcacggaatggccagatagacaaggaggctgtgcagaagtacgcatatcttaatgtagtgggaatggtcggcagcattgacaacgatttctgcggcacggatatgaccattggcacagactccgcgctccatagaatcatcgaggttgttgatgccattatgaccacggcccagtcacaccagaggacatttgtgttagaggtaatgggcaggcattgcggatatttggccctggtcagtgccctcgcctgtggtgctgactgggttttccttcccgaaagtccccctgaggaaggctgggaagagcaaatgtgcgttaaactgtccgagaatagagctcggaagaaacggctcaacattatcattgtagctgaaggggctattgacacacagaacaagcccatcacttctgaaaaaattaaagagctcgtggtcactcagctgggttatgacactagggttaccattctcgggcacgtgcagaggggagggacccctagcgccttcgaccgaattcttgcttcgcgcatgggcgttgaggccgtgatcgctcttctggaggcaacacctgatacaccggcatgtgtggttagcctgaacgggaatcacgcagtccggcttccattaatggagtgtgtccaaatgacccaagacgttcagaaggccatggatgagcgccgttttcaggacgccgtgcgcctgcgaggccgaagcttcgccggtaatctcaacacatataagcgccttgcgatcaaactacccgacgaccaaatacccaaaactaattgtaacgtggccgtcattaatgtgggtgccccagccgctgggatgaatgctgcggtgaggtccgctgttagagtgggtattgctgacggacacaggatgctggccatttacgacggttttgatggtttcgctaaaggacaaattaaggagatcggatggacagatgtcggtggctggacaggccagggaggcagcatactcggtacgaaaagggtgctgcctggaaagtacctcgaggaaatcgccacccagatgagaacccattctattaatgcccttcttataattgggggatttgaagcctatctggggctcctggagctgtccgcagcacgcgagaaacacgaggaattttgtgtaccaatggtgatggtccccgctacggtttccaacaatgttccagggtcagattttagtatcggcgctgatactgctctgaatactattacggacacctgtgataggattaagcagtctgcctcaggcaccaaaaggagggttttcattattgagactatgggcggatactgcggttacctcgctaatatggggggactggctgcgggtgcggacgctgcatacattttcgaggaacctttcgatattcgtgacttacagtcgaacgttgagcatctgaccgaaaagatgaaaaccacaatccagcggggactggtgctgagaaatgaaagctgtagtgagaattacacaacggacttcatctaccagctgtatagcgaggaaggaaagggcgttttcgactgccgcaagaacgttctaggccatatgcaacagggaggagccccatcgccgttcgacagaaactttggaaccaaaatctctgccagggccatggagtggattacagcgaaacttaaggaggccagagggcgaggcaagaaatttacaactgatgattctatttgtgtgctcgggatctctaaacgcaacgtcatcttccagcccgtcgccgagctcaagaagcagactgattttgagcacaggatccctaaagagcagtggtggcttaagctgcggcctctgatgaaaatcctggccaagtataaggccagttatgacgtgtccgactctggccagctggagcatgtgcagccgtggtccgtatag

SEQ ID NO: 234808 - DNA, 633 bp, Artificial Sequence
  Description of Artificial Sequence: Synthetic coding sequence
atgaatgctgctgtgcgggctgtggtgcggatggggatctacgtgggcgctaaagtgtatttcatttatgaagggtaccaaggcatggtggatggtggttcaaatattgcagaggcggattgggagtccgtctcaagtattctgcaggttggcggtactatcatcggcagcgctaggtgccaggcattccgcacaagggagggccgactgaaggccgcatgtaatctgttacagaggggcattaccaatctctgcgtgattgggggagatggaagccttaccggtgcgaacttgttcaggaaggaatggagtgggctgctggaggaactggccaggaatggacagatcgacaaagaggccgttcagaaatatgcttacctgaacgtggtcggcatggttggctcgattgacaatgatttttgcgggacagacatgacgataggaacagatagtgcactccacaggataattgaggtggtggacgcaataatgacgactgcgcagagccatcagagaaccttcgtgctggaggtcatgggtaggcattgtggatatttggccctcgtgagtgctctggcctgtggcgcagattgggtgtttctccccgaaagtcctcctgaggaagggtggtag

SEQ ID NO: 234809 - DNA, 501 bp, Artificial Sequence
  Description of Artificial Sequence: Synthetic coding sequence
taagctgacggacaccgcatgctggccatatacgacgggttcgatggttttgcaaagggccagatcaaggagataggctggacggacgtgggaggctggaccggtcaaggtggaagcatccttggtactaagagggtgcttcctggcaagtatctagaggagatcgctacccaaatgcggacacactcgatcaacgccctgttaataattgggggattcgaagcctataaatctgcctgcgatatggctgaggcccgtggtcgacatcaggagttatgcatccctctttgcgtggtgcctgccacaataagcaataacgtgcctggtaccgagatttccctgggatcagatacaggactcaacgcagtggtggagacatgcgaccggataaaacagagtgcaagtggcacgaagagaagagtcttcatcattgagaccatgggcggatattgcgggtatttagcaaatatggggggtctcgccgcaggcgctgatgcttag

SEQ ID NO: 234810 - DNA, 723 bp, Artificial Sequence
  Description of Artificial Sequence: Synthetic coding sequence
atgggcagacattgtggctacttagccctggtgtctgctctggcctgtggagccgactgggtattcctccctgaatctccaccagaagagggctgggaagagcagatgtgtgttaaactttctgagaatagggctcggaagaaacggctgaacatcatcatcgtcgcagagggggctatagacactcaaaacaagcccatcacctctgaaaagatcaaagagctagtggtgactcagctaggctatgacacccgcgttaccatactcgggcatgtgcagcgcggaggcaccccaagtgcctttgatcgtatactcgcttctcgaatgggagtagaggccgtgatcgctctcctggaggccaccccagataccccagcttgtgtcgtgtcccttaacgggaaccatgcggtccgccttccactgatggagtgtgtccaaatgacacaggacgtccagaaggcgatggatgagaggaggtttcaagacgcagtccggctgaggggcagatcatttgcaggtaatctgaacacctacaagcggcttgccataaagctccccgacgaccagattccaaaaactaactgcaatgttgccgtgataaatgtgggagcaccagcagctggcatgaatgctgccgttaggtcagccgtgagggtaggaatagcggacgggcacagaatgctcgccatctatgatggtttcgacggatttgccaaaggttag

SEQ ID NO: 234811 - DNA, 501 bp, Artificial Sequence
  Description of Artificial Sequence: Synthetic coding sequence
atgaacgcagccgtccgagcagtggttcggatggggatctacgtaggggcaaaggtgtacttcatctacgagggctaccagggaatggtggacggcggatcaaacatcgcggaagccgactgggaatccgtgagtagcattctgcaggttggaggaaccatcatcggtagtgccagatgccaggcgttcaggacacgcgagggaaggttgaaagctgcctgtaacctgctgcagcggggaattactaatctgtgtgtaatagggggagacggctccctaaccggggcaaacctgttccgaaaggaatggagcggcctcctagaggagctggctaggaacggacagatagacaaagaggctgttcagaagtatgcttatctcaatgtggtgggaatggtaggcagcattgacaatgacttttgcggtacggatatgaccataggaacggatagcgcgttacacagaatcatagaggtagtggacgccataatgaccacatag

SEQ ID NO: 234812 - DNA, 312 bp, Artificial Sequence
  Description of Artificial Sequence: Synthetic coding sequence
tgatttatttaccagctgtatagtgaagaggggaaaggcgtatttgactgccgcaagaacgttctgggccatatgcagcaagggggagccccatccccgtttgaccgcaattttgggaccaaaatctccgcaagggccatggagtggattacggctaaacttaaagaagcaaggggcagaggaaagaagtttactacagatgacagcatttgcgttttagggatctccaagaggaacgtgatctttcagccagtcgctgagcttaaaaaacagacagatttcgagacagttagcatgcagccccctcgctag

SEQ ID NO: 234813 - DNA, 1743 bp, Artificial Sequence
  Description of Artificial Sequence: Synthetic coding sequence
atgagcgatttcgaggaatggatttctggcacctaccgaaagatggaggagggacctctgccactgctgacttttgcaacagctccttaccacgaccagaagccgggaacctctgggctcagaaagaagacctattattttgaagaaaagccatgctatttagaaaacttcatccaaagcattttctttagcatcgatctgaaggaccgccaggggtcttccctggtagtcggcggagacgggagatacttcaacaaatctgccatcgaaacaattgtacagatggctgcggcaaacggcattggacgcctggttattggccagaacggcatcctatccacccccgcagtttcatgcatcatccgaaagataaaagcaattggcggaatcatcctcactgcgagccataatcccggaggaccaaatggcgacttcggtatcaaatttaatatctctaatggcggacctgcccctgaggctattacggacaagattttccagatttcgaaaaccattgaggaatacgcggtatgtcctgaccttaaagtggacctcggcgttctcggaaagcagcagtttgacctggaaaataaattcaagccattcaccgtggaaatcgtggacagcgtggaggcatacgctacaatgttgaggtccatcttcgatttctctgcactcaaagagctgcttagcggccctaaccgcctgaaaattcgcatcgacgctatgcacggtgtcgttggcccatacgtcaaaaagatcctgtgtgaagaattgggcgctcccgcaaattctgccgtaaactgtgtgcccttagaagattttgggggacatcacccagaccccaatctgacctacgctgccgaccttgtagagacaatgaaaagcggagagcacgacttcggagctgcttttgacggcgatggagaccggaatatgatcctgggcaaacacggattctttgtgaacccctccgattctgtggcagttatcgcagctaacattttctctatcccttactttcaacagaccggtgtgcgagggttcgctcggtcgatgcccacctccggagcgctggatagggtggcttcggccaccaagattgcactgtacgagacccccacaggatggaagttcttcgggaatctgatggatgcctcaaaattatccctgtgcggggaggagtcctttggcaccggctccgaccacatacgtgaaaaagacgggctgtgggcagtgttggcatggctctccatccttgcgacgagaaagcagagcgtggaggacatcctgaaggaccactggcaaaagtacggaagaaactttttcacgcggtacgattacgaagaagtggaggctgaaggggcaaataagatgatgaaagatcttgaagcgctgatgttcgatagaagttttgtcggtaaacagttttccgccaacgataaggtgtatactgtcgagaaggcagacaactttgagtatagcgacccagtcgatggaagtattagccggaaccaaggattaaggctgatttttactgacgggtcccgaattgttttccggctctcagggacagggtcagcgggagctacgatccgcctgtatatcgactcttatgaaaaagacgtcgcaaaaattaatcaggacccgcaagtgatgctcgccccattgatctctatcgcgctcaaggtgagtcaacttcaggagcggaccgggcgaactgcccctactgtgattacctag

SEQ ID NO: 234814 - DNA, 1689 bp, Artificial Sequence
  Description of Artificial Sequence: Synthetic coding sequence
atggtcaaaattgtcaccgtaaaaactcaggcctaccaggatcagaaaccaggcactagcggacttagaaaaagagtcaaagtcttccaatctagcgctaattacgctgagaatttcattcaaagcattatcagtacggtggagcccgctcagcggcaagaagcaacactggttgtaggaggcgacgggaggttttatatgaaggaggcaatccaattgatcgcccgaattgctgctgcgaatggaatcggacgtctagtcatcggacaaaacggaatcctcagcactccagctgtgagctgtataataaggaagatcaaggccatcggcggaatcatcctaaccgcttctcataaccctggaggcccaaatggcgacttcgggatcaagtttaatatctctaatggtggacccgctccagaggcgataactgacaagatttttcagatcagcaagaccatagaggagtacgccgtatgtcctgatttgaaggtggacctgggggtcctgggaaaacagcagttcgacttagagaacaagtttaagccattcacagtggaaatagtggatagtgttgaggcctacgctacgatgctgcggagtatcttcgacttctccgcactgaaagaactgctgtctgggcctaacagactcaaaatacgtatcgatgccatgcatggggtggtgggcccttatgtaaagaagattctgtgcgaggaactaggcgctccggctaactctgcagtcaattgtgtgccactcgaggacttcggcggacaccatccagaccctaacctgacgtacgccgctgacctggtggaaactatgaaatctggcgagcatgacttcggagctgccttcgatggcgatggcgatcggaatatgattctcggtaagcacggattcttcgttaatccctcagatagtgtggccgtgattgccgctaacattttctcaatcccgtatttccagcaaacaggggttcgcggatttgcccgaagcatgcccacgtcgggcgcactcgaccgcgtggccagcgctactaaaatagccctgtatgaaacacccactggttggaaatttttcggaaaccttatggatgcttccaaactgagtctgtgtggcgaagaaagctttggcaccggcagcgaccacattcgcgagaaagacggcctttgggctgtcctggcatggcttagtatactcgcaacccgtaaacagtccgtagaagatatccttaaggaccattggcagaaatacggcagaaacttttttacaagatacgactacgaggaggtcgaggcagaaggcgcaaacaagatgatgaaagatctggaggctctcatgttcgatagatcatttgtgggcaaacagttttccgcaaatgacaaggtctatacggttgagaaagctgacaacttcgagtactcggatccggtagacggctccatcagcagaaaccaagggcttcggctcatcttcaccgacggctcaaggatcgttttccggctatccggcaccggctccgcgggtgccactatcagattgtacatcgactcctacgaaaaagacgtagctaagatcaaccaagatccgcaggtgatgctggcccctctcatcagtatagcactgaaggtttcccagctgcaggagcgcactgggagaaccgctcctacggtaattacgtag

SEQ ID NO: 234815 - DNA, 1617 bp, Artificial Sequence
  Description of Artificial Sequence: Synthetic coding sequence
atggttaaggtatttcagtccagcgcaaactacgcagagaattttatccaatcaattatttcgaccgtggagcccgctcagcggcaggaagctacattggtcgtcggtggagacggcagattctatatgaaagaagccattcaactgatagcaaggatcgcagcagccaacggcattggaaggctggtaatcggtcagaacgggatcttgtcaactcccgcagtgtcatgtatcattaggaagatcaaagccataggaggtatcattttgaccgcgagccacaatcctggtggccctaacggcgacttcggcatcaaattcaacattagcaacggaggcccagcaccagaagctatcaccgacaaaattttccaaatttcaaaaacgatcgaggaatacgctgtgtgtccagacttgaaagtcgacctcggagtgttaggcaagcagcagttcgacttggagaacaagttcaagcccttcacagtcgagatcgtggactccgttgaagcctacgctaccatgctgcgctctatatttgactttagtgccctcaaggagctacttagcggacccaacaggctcaagattcgcattgatgctatgcacggagttgttgggccatacgttaaaaagattctttgcgaagagctgggcgcacccgctaactccgccgtgaactgcgtgccactggaagatttcggcggtcaccaccccgaccccaatctgacgtacgcagcagacttggtcgagactatgaagtcaggcgagcatgactttggggctgccttcgatggggacggagacaggaacatgattctgggaaaacatggtttcttcgtcaaccctagcgatagcgtggctgtcatcgccgcaaacatcttctcgattccatatttccagcagacaggagtccgcggttttgccaggtccatgccaacttcaggcgcactggaccgcgtcgcttccgcaaccaagattgcattgtatgagaccccaactggctggaaattcttcgggaatctcatggatgctagcaagttgagtctgtgcggcgaggaatcatttggaaccggcagtgaccatatcagagagaaggatggtctttgggcagttctggcctggctctccatcctggctactagaaagcaaagtgtggaggacatcctgaaagatcactggcagaaatatgggagaaatttcttcacacgctacgactacgaggaagtagaagccgagggagcgaataagatgatgaaggacctggaagcgctcatgttcgacaggtctttcgtgggaaagcagttcagcgccaacgacaaagtgtacaccgttgagaaggccgataactttgagtattccgaccccgtggacggcagcatcagtcgaaaccagggcttgaggctcatcttcaccgatgggtcacgtatcgtttttaggctgagtggaacagggagcgccggagcgaccattcgtctttacatcgactcttatgagaaagatgtagcgaaaatcaatcaggatcctcaagttatgcttgcccctctgatcagcatcgctctgaaggtgagtcaactccaggaacgaaccgggcgtacggcaccaactgtcattacctag

SEQ ID NO: 234816 - DNA, 1098 bp, Artificial Sequence
  Description of Artificial Sequence: Synthetic coding sequence
atgttgagatcaattttcgattttagtgctttaaaagagctgctctccggtcctaataggctgaagattagaatcgacgcaatgcatggcgttgttggaccatacgtcaagaaaatcttgtgtgaggagcttggtgcccctgctaacagcgctgtgaattgtgtgccgcttgaggactttggcggtcatcaccccgacccaaacctcacttatgccgctgatctggtggagacaatgaagtccggtgaacacgattttggcgctgcatttgacggcgatggggatcggaacatgatcctaggcaagcacgggttcttcgtgaacccctccgacagcgtagcggtcatcgctgctaatatcttcagcataccatactttcagcagacaggggtgagggggttcgctagatctatgccaactagcggagctctggatagagtcgcatccgccaccaagatcgcactatatgagacccccaccggatggaaattcttcggaaatctcatggatgcgtcaaaactgtccctatgcggagaagaaagcttcgggactggcagcgatcacataagggagaaagacgggctctgggcagttctcgcgtggctgtcaattctggccacgagaaagcagtctgtggaggacattttgaaggatcactggcagaaatacggcaggaatttcttcacccgctacgattacgaggaagtcgaggccgaaggcgcaaataagatgatgaaggatctggaggccctcatgtttgatcgtagctttgtgggaaagcagttcagtgctaacgacaaggtgtacacagttgaaaaggcagacaatttcgagtactctgatccagtcgatggctccatctccagaaaccaagggctgaggctgatttttacagacggctctcgaattgtttttaggctgagcggcactggatcagccggagctactatcagactgtacattgactcttatgaaaaagatgtggccaaaattaaccaggacccccaagttatgcttgcccctctgatctctatagctctgaaagtcagtcagctgcaggagaggactgggcgtacagctccaacggtgataacatag

SEQ ID NO: 234817 - DNA, 1839 bp, Artificial Sequence
  Description of Artificial Sequence: Synthetic coding sequence
atggcagctccggagggaagcggactgggtgaagacgccagacttgatcaagaaacagcgcagtggctccggtgggataaaaattcacttaccctagaagcggtgaagagacttatcgcagaagggaacaaagaagagctcagaaaatgctttggtgcccgtatggagttcgggacagctggcctgcgggctgcgatggggcctggcatctccagaatgaatgacttgaccatcatacaaacaacacagggattttgtagatatctggagaagcagttttccgacctgaaacaaaagggcattgtaatttcctttgatgccagggctcacccttctagcggtggcagttctcgcagattcgccaggctggctgcaaccacgttcatttcccaagggattcctgtgtatctgtttagtgatatcacccctacaccctttgtgccatttacagtcagtcatctgaaactctgcgcaggtattatgatcacggccagccacaaccccaaacaggataacggatacaaggtgtattgggataatggcgcacagatcatatctccccatgacaaggggattagtcaggcgatcgaggaaaatctggaaccttggccacaggcttgggatgactcactgattgactcatcaccactgcttcacaatccaagcgctagtatcaacaacgattacttcgaagatctgaaaaaatattgtttccatagaagtgtcaatcgtgagacgaaagtgaagttcgtccatacaagcgtacacggagtgggtcatagctttgtccagtctgccttcaaggcatttgatctggtgccacctgaagctgttcctgaacaaaaggatcctgatcctgaatttcccacggtaaagtaccccaaccccgaagaaggaaaaggggtgcttactctgtcctttgccttggccgataaaactaaggccagaattgtgcttgcaaacgaccccgatgccgaccgcttggctgtggctgagaagcaagactcaggggaatggagggtgttcagtggcaatgaactgggcgcactgctgggatggtggctgtttactagctggaaggaaaagaatcaggatagaagcgccctgaaggatacctatatgctgtcttccaccgtctccagcaaaattctcagagctattgcactgaaagagggtttccatttcgaggaaacgctgacgggatttaaatggatgggcaatcgagcgaagcagctgatcgaccagggaaagaccgtgctctttgctttcgaggaggctatagggtacatgtgctgccccttcgttttagataaggatggcgtatcagccgctgtgatctccgccgagctcgcctcattcctggccaccaaaaacctcagcctgtcccagcagctgaaggctatttacgtggagtatggctaccacattacaaaagctagctacttcatctgccacgaccaagaaacaattaagaagcttttcgagaatcttaggaactatgacgggaagaataactatccaaaggcctgcggcaaattcgaaataagcgctattcgggatctgactacggggtatgatgattctcagcctgacaaaaaagcagtcctgcccacatctaagtctagccagatgataacttttacgtttgcaaatgggggagtggcaaccatgagaaccagcggaacagagccaaagatcaagtactacgcagaactgtgtgccccacctggtaacagtgatcccgaacaactaaagaaggaacttaatgaactggtgtccgctatcgaggaacacttttttcagcctcagaaatataatttgcagcctaaggctgattag

SEQ ID NO: 234818 - DNA, 1359 bp, Artificial Sequence
  Description of Artificial Sequence: Synthetic coding sequence
atgatcactgcctcccacaaccctaagcaggataacggctataaggtatattgggacaacggcgctcaaataataagccctcacgacaaaggcatatcccaggccattgaggagaatttggaaccctggccccaggcctgggacgactcgttgatagattcatctcccttgctgcataacccatcggcatctattaacaatgattactttgaggatctgaaaaagtactgctttcaccgctcggtgaacagagagactaaagttaaattcgtccatacatcagtccacggcgtgggacacagcttcgtccaaagtgcttttaaggcatttgacctggtccctccggaggcagttcctgaacagaaggacccggatcccgagtttccaacagtcaaatatccaaatccggaggagggaaaaggggtgctgacactctcattcgcgctagctgacaaaaccaaagccaggattgtgttggccaatgaccctgacgccgacaggctggcagttgcagagaaacaggatagtggagaatggcgtgtcttcagtggcaatgagcttggagcgctgcttggatggtggctgtttacctcatggaaagagaaaaaccaggataggtctgccctgaaagacacttacatgctcagtagcaccgtgtctagcaagattctgcgggcaattgcactgaaagaggggttccattttgaagagacattaaccggatttaagtggatgggaaaccgggctaaacaactgattgatcaggggaaaaccgtgctcttcgcgtttgaggaggccatcggttacatgtgttgcccctttgtgctcgacaaggacggggtctcggctgccgtgatctccgctgagctggcatcctttctggccaccaaaaacttgtcgctgagccaacagctgaaagccatctatgtagagtacggataccatatcacaaaggcatcttacttcatatgccatgaccaggagaccataaagaaactgttcgagaacctcaggaactacgacggtaaaaacaactaccctaaggcctgtggtaagtttgagattagtgctatccgtgatctgaccactggttatgacgactcacagcccgacaaaaaggccgtgcttccaacaagcaagagtagccagatgataacattcacattcgccaatgggggtgtcgccacgatgcggacctcaggcacagaaccaaaaatcaaatattacgcagagctgtgcgcccctcctggcaattctgaccccgagcagctgaaaaaagagttgaatgagctggtttccgccatcgaagagcatttcttccaacctcaaaagtataacctgcaaccaaaagctgactag

SEQ ID NO: 234819 - DNA, 876 bp, Artificial Sequence
  Description of Artificial Sequence: Synthetic coding sequence
atgagctcacagctgattttgaggccattcaccgtaagccatttaaaattgtgcgctggcatcatgattaccgctagccataatccaaagcaggataatgggtacaaggtgtactgggataacggcgcacagatcattagcccccacgacaaaggtattagtcaggctatcgaggagaacttggagccgtggccacaagcctgggatgattctctgatagactcatcaccgctgctacataacccttctgcctccataaacaacgattatttcgaagacctcaaaaaatattgtttccaccgttctgtgaatcgggagaccaaagtcaagttcgttcataccagcgttcacggtgtaggacattcattcgtacagtctgcttttaaggccttcgacctggtcccccctgaagccgtcccagaacaaaaggatcctgatcccgagttccccaccgtaaagtatcccaatccagaggaaggcaaaggcgtgttaaccctaagcttcgctcttgcggacaaaactaaggcgcgaatagtcctggcaaacgatccagacgcagatcgcctagcagtagctgagaagcaagactccggtgagtggagagtattctccggaaatgaactaggagcactccttgggtggtggctctttactagttggaaagagaaaaaccaggaccggtcggcgctgaaggacacttacatgctcagttctactgtgtcttccaagatacttcgggctatagcgctaaaagaagggtttcatttcgaagagacacttactggcttcaagtggatgggaaatcgggcaaagcagctcattgatcaggggaagacagtactttttgccttcgaggaggcaatcgggaagaagtag

SEQ ID NO: 234820 - DNA, 1869 bp, Artificial Sequence
  Description of Artificial Sequence: Synthetic coding sequence
atggccgagaataccgaaggtgatctgaatagcaatctgctacacgcaccttatcatacaggagatccccaactcgatactgcaataggacaatggttgaggtgggacaagaatcctaaaaccaaggagcagattgagaacctgctcagaaatggaatgaataaagagctgcgcgacaggctctgctgccgcatgacattcggcactgccggtttgaggagcgctatgggtgccggattttgctacatcaacgacctgacagtgatccagagtactcagggaatgtacaagtacctcgaaaggtgcttctccgatttcaaacaacgcggttttgtggtgggctatgacacacggggacaggtgacatccagctgtagttctcaacggctggccaaactcacagccgctgtattgctagcaaaggatgtgccagtttatctgttttcgagatacgttccaaccccctttgtgccgtacgcggttcagaagctgaaagccgtcgctggggtgatgattacggcatcgcataatcgcaaggaagataatggctacaaggtgtactgggagaccggtgcacagatcacaagcccgcacgataaggaaattctgaagtgcatagaggaatgcgtggaaccctggaatggctcttggaatgataacctcgtggacacgtcacctctgaaacgggaccctctgcaggatatttgtagaaggtacatggaggatctcaaaaagatctgcttttaccgtgagttaaacagcaagaccacactcaaattcgtgcatacgagtttccatggcgtcgggcatgattacgtgcaacttgccttcaaagtcttcggcttcaagccaccaatcccagtccctgaacagaaagaccccgatcctgatttttcaactgtaaagtgtcccaatcccgaagagggcgaatcagtcctggagctttctctgcgcctcgcggaaaaagagaatgctcgggtggtgctggccaccgacccagacgcggatagactggccgcagcggagttacaggaaaacggatgctggaaagtcttcacgggtaatgagttagcagccctctttggctggtggatgtttgactgctggaagaagaacaagtcgaggaatgccgacgtgaaaaatgtttatatgctggctaccacagtgagctcgaagatcctcaaagctatcgcactaaaggagggctttcactttgaggagacgcttcctggatttaaatggatcgggtcaaggatcatcgacctgctggagaatgggaaggaagtcttgttcgcgttcgaggaatcaattggatttctctgtggaacttctgtcttagacaaggatggtgtgtcggccgctgtcgtggtcgctgaaatggcctcatatctggaaacgatgaacatcactcttaagcagcagttggtcaaagtgtatgaaaaatacgggtatcacatctctaagacctcctacttcctctgttacgaacctccaaccatcaaatccatattcgagcggctgcgaaattttgattcaccgaaagagtaccccaaattttgcggaaccttcgccatcctgcatgtgagggatgtcactaccgggtacgacagctcacaacccaacaagaaaagcgttctcccggtctcgaaaaattcacaaatgatcactttcaccttccaaaatggctgcgttgctaccctgcgcacatctggaactgagcccaagatcaagtactatgccgagatgtgcgcttcgccggaccaaagcgacaccgcgctgctcgaagaagagctgaaaaagctaatcgacgctctgattgagaactttttgcagccatccaaaaacggcctaatatggcgtagcgtatag

SEQ ID NO: 234821 - DNA, 1713 bp, Artificial Sequence
  Description of Artificial Sequence: Synthetic coding sequence
atgggcggagagtggggacagtcagcaatctgcccagagagtgcgcaggagtggacctaccaggttggacagcacctggtcgacatggatctaggagccattacaaagtattccgcactgcacgcaaagcctaacggcttaatcttgcagtacggcacagccggtttcagaacaaaagccgaacaccttgatcatgttatgttccgcatgggccttttggcagtgcttcgctccaagcagacgaagtcaacgattggggttatggttactgctagccacaaccccgaagaagacaatggggtcaaattagtggatcccctaggcgagatgctggcccctagttgggaggagcacgcgacctgcttggccaacgccgaggaacaggatatgcagcgagtgttgattgatatcagcgagaaagaggccgtgaaccttcagcaggacgccttcgtggtgatcgggcgtgacaccagaccttccagtgaaaagctgtcccagtccgtaatagacggggtcacagtcctagggggacaatttcacgattatggacttctgaccacccctcagttacactatatggtctactgccgcaatacgggtggtcggtatggaaaggctacgatcgagggttactaccagaaactgagcaaagccttcgtggagcttaccaaacaggccagctgctcaggggatgaatatcggtccttgaaggtcgactgcgccaatggcataggtgccctgaagttgagagagatggagcattatttcagccaggggttatccgttcagctcttcaacgatggctctaaagggaagctaaaccatctgtgcggagcagattttgtaaaatcccaccagaagcccccacaaggcatggagatcaagtcgaatgaaaggtgttgcagcttcgacggagatgctgaccggattgtctactactatcatgatgctgatggacattttcacctcattgatggcgacaagatcgccaccttgatcagcagcttcttgaaagaactgctggtggagattggggaaagtctgaacatcggagtcgtgcagaccgcatacgcgaacggttcctccacacggtatctggaggaggtcatgaaggtgccggtgtactgcaccaagacaggggtgaagcacctccatcacaaagctcaggaattcgacatcggagtctatttcgaagcaaatggtcatggcacggccctgttcagcaccgccgtcgagatgaagatcaaacaatcagccgagcagcttgaggataagaagagaaaagcagccaagatgttggagaacattatcgatttgttcaatcaggcagccggagacgccatttctgacatgctggtgattgaagccatcctggcattgaaagggcttactgtccaacagtgggacgctctgtacactgatctgcctaatcgacaacttaaagttcaggtggccgataggcgagtcatctctacaactgatgcggagaggcaagccgtgaccccacccggtctgcaggaagcaataaacgatctggtgaagaaatacaaactctccagagctttcgtgcgaccgtctggcaccgaggacgtggtacgggtctacgccgaggcggatagtcaggaatccgctgaccacctggcacatgaggttagcctcgcagtgttccaactggccggtggcatcggagagcggcctcagcccggattctag

SEQ ID NO: 234822 - DNA, 444 bp, Artificial Sequence
  Description of Artificial Sequence: Synthetic coding sequence
atggacctgggcgctataactaagtacagcgccctgcacgccaaacctaatggcttaatcctgcagtacggaaccgctggatttcgcaccaaagccgagcatcttgaccacgtaatgtttaggatgggccttttggccgtgttgagaagtaaacagacgaagtcaaccatcggggtcatggtcaccgctagccataatccagaggaagataatggtgtcaagctcgtggacccactaggagagatgctcgcaccttcctgggaggaacacgctacatgtttggccaatgcggaagagcaggacatgcagagggtgcttattgacatttctgagaaggaagctgtgaatttacagcaggatgcttttgtcgtgattgggagagatacaaggccaagttctgagaagttgtctcagtccgtcatcgacggtgtgaccgtgctgtag

SEQ ID NO: 234823 - DNA, 1629 bp, Artificial Sequence
  Description of Artificial Sequence: Synthetic coding sequence
atggacctcggcgctattactaaatactcagcactgcatgccaagccgaacggattaattctgcaatatgggaccgctggatttcgtaccaaagccgaacacctagaccacgtcatgtttcgaatgggactgttggccgtcctgcggtccaaacagacaaagagcactatcggagttatggtcacagcttctcacaacccagaggaggacaacggtgtgaagctcgtagaccctctgggggagatgctggccccttcctgggaggaacacgccacctgtctggccaatgctgaggaacaggacatgcaacgcgttcttatcgacatcagcgagaaggaagccgtgaatttacaacaggacgccttcgtggtgatcggcagagacactcgtccttcgagcgagaagctcagccagtccgtgatcgacggcgtgaccgtcctgggtgggcaattccacgattacggactccttacaacaccgcagttgcattacatggtctattgtcgcaacaccggcggacggtatggcaaggcaacaatcgagggttattaccagaagctgagcaaagcctttgtagagctcaccaaacaggcatcatgctcgggagacgagtacaggtcattgaaggtggactgcgccaacggaatcggagctctgaaactcagggagatggaacattactttagccaaggcttatctgtgcagctgtttaatgatggctcaaagggaaagctgaaccacctgtgcggcgctgacttcgttaaaagccaccagaaaccacctcagggtatggagatcaagagcaatgagaggtgttgcagtttcgacggcgacgccgacagaatcgtgtattactaccatgacgccgacggacacttccacctcattgacggagataagatcgctactttgatctcaagcttcttgaaggagctgttagttgagatcggagagtccctcaacattggagtggttcagacagcatatgctaacggtagttcaacccgctacctggaagaagtgatgaaggtgcccgtatattgcactaaaacgggagtaaagcatctgcaccataaagcccaagagtttgacatcggggtgtacttcgaagccaatggtcatggaaccgcactgttttccaccgcagtggaaatgaagattaagcagagtgcagagcagctcgaagataaaaagaggaaagccgctaagatgctcgaaaacatcatcgatctgtttaaccaggcagcaggagacgctatctctgatatgttggtgatcgaggcgattctcgccttgaagggtttaactgtccagcagtgggacgctctgtataccgacctgccgaatagacagttgaaggtgcaggtggctgaccgaagagttatatctacgacagacgccgagaggcaggccgtcacccctcctgggttgcaagaagccataaatgatctggttaaaaaatacaagctgagccgggcattcgtacgtccgagcggtaccgaggacgtggtaagagtatacgcggaggccgactctcaggagtccgccgaccacctggcacacgaggtgagcctggccgtgttccagctagccggtggcatcggggagaggcctcagccaggattctag

SEQ ID NO: 234824 - DNA, 1701 bp, Artificial Sequence
  Description of Artificial Sequence: Synthetic coding sequence
atggacctcggggctattaccaagtattcagcactacacgccaaacctaacggtctgatattgcaatatgggacagctgggttccggaccaaggccgagcacttggatcacgtgatgtttagaatggggctgcttgcggttttgcggtcaaagcagacaaaatccaccattggtgtgatggtgaccgcttcacataatccagaagaggacaatggtgttaagctagtggatccactcggcgaaatgttggcaccctcttgggaagagcatgccacatgtctagccaatgccgaggagcaggatatgcagagggttctcattgatatttccgagaaggaagctgtgaacctgcagcaggacgcctttgtggtcattggtagggacacgcgtccctcatctgagaagctgtcccagtctgtcatcgacggtgtgaccgtgctggggggtcaatttcacgactatggattgctgaccacccctcaacttcactacatggtttactgtaggaacaccggtgggcgttacggtaaggccaccatcgaggggtactatcaaaagttaagtaaggcctttgttgagcttacaaagcaggcatcttgcagtggagacgaatacaggtctctgaaggtggattgtgccaatggcatcggagccctgaaactgagagagatggaacactatttctcccaaggactgtcggtccagctcttcaacgacgggtcgaagggcaagctgaaccacctctgcggggctgattttgtgaaatcccatcagaagccaccacaagggatggaaattaagagcaatgagagatgttgtagcttcgacggcgacgctgacaggatcgtatactactaccatgacgcagatgggcattttcacctaatcgatggcgataaaatcgccaccctgatttcctcatttcttaaggagctgcttgttgaaattggagaatcactgaatatcggtgttgtgcagaccgcatatgcgaacgggtcatctacacgttacctggaggaggtgatgaaggtgccagtgtattgcaccaagactggcgtaaaacacctgcatcacaaggcacaggagttcgatattggggtctatttcgaagcaaacggccacggcaccgctctgttcagcaccgcggtagaaatgaaaattaagcagtctgcggagcaactggaggacaaaaaacggaaggctgccaaaatgctggagaatataatcgatctgtttaaccaggccgctggcgatgccattagtgatatgctcgtgatcgaagcaattctagccctgaaaggactgaccgtacagcagtgggatgcactctatacagacctgcccaatcgtcagctgaaggtgcaagtagcagaccgaagggtaattagcacaacagacgctgagcggcaggccgtcacgcctcctgggcttcaggaagccatcaatgatctggttaaaaagtacaaactctcccgcgcattcgtccggccttccggcacggaagacgtggtgcgcgtgtacgccgaggccgatagtcaggaatcagccgaccacctggcacacgaagtgtcgctggctgtcttccagctggccggaggcattggcgagagaccccagccagggtataaggcagccgaaaccactcataatatcaataacgccttcgggccagggaccgctaacgaacatactgtcccttag

SEQ ID NO: 234825 - DNA, 720 bp, Artificial Sequence
  Description of Artificial Sequence: Synthetic coding sequence
atggagggatcgccaataccagtgctgaccgtcccaaccgcaccgtatgaggatcagagacctgccggtggcggaggcttaaggcgcccaactggactgttcgaggggcagcggaattatcttccaaatttcatccagagcgtgttatctagcatagacctccgagatcgccagggttgcacgatggtagtaggctcagacggacgttatttctcacgcaccgcgatagaaatcgtcgtgcagatggccgctgctaacggcatcgggcgactgattattggccaaaatgggattttgtccacgccagcagtctcctgcatcatccgcaagatcaaggcagcaggtgggatcattctaacggccagtcactgtcctggaggtccaggaggcgagttcggagtgaaatttaatgttgcaaacggagtagagatcgtcgaccccgtcgatatttatctgaacctgttgagaaccatcttcgattttcatgctatcaagggtctgctgacgggcccttctcagttaaaaattcggatcgatgctatgcatggtgtgatggggccatatgtacgcaaagtgttgtgcgacgaactaggagctccagcaaactctgccatcaactgtgtgcctctcgaggactttggcggacagcatcctgatccgaacctcacatatgccacaactttgttagaagcgatgaagggaggagagtatggcttctag

SEQ ID NO: 234826 - DNA, 1704 bp, Artificial Sequence
  Description of Artificial Sequence: Synthetic coding sequence
atggaggggtctcccattccagttttgaccgtgcccaccgccccttatgaggaccagcgcccagcaggcggtgggggtctccgtcgcccaactggtcttttcgagggacagcggaactatctgcctaacttcattcagtccgtgctgtcaagtatcgacttgcgtgacagacagggatgcaccatggttgtcggctctgatggcaggtacttttccaggacagcaattgaaatcgtggttcagatggcggctgcaaacgggatcgggaggctgattattggtcagaacgggatactctcaacccctgcggtgagctgcattattcgtaaaatcaaagccgctgggggaatcattctgacagcctctcattgccctggcggtcccggtggcgagtttggtgtcaagttcaatgtggcaaacggcggtcccgcaccggatgtcgtgagtgataaaatataccagatatcaaagactatagaggagtatgcaatttgccccgatcttaggatagatctatctcgcctgggacggcaagagttcgaccttgagaataagttcaagcccttcagggtggagattgtggatccagtcgatatctacctgaatttgcttcgcaccatctttgatttccacgccattaaaggattgctgactggacccagccagctgaagatcaggatcgacgctatgcacggcgtgatgggtccttatgtccggaaggttttatgcgatgagctgggtgctcccgctaacagcgccattaactgtgtgcctttagaggatttcggtggccagcaccctgaccccaacctgacatatgcaacaaccctcctagaagctatgaaaggtggcgaatacggctttggcgcagctttcgacgccgacggagaccgctatatgattttgggacagaacggtttctttgtttctccttccgattctctagccattatcgccgctaatctgagttgtattccctacttccggcaaatgggagtaaggggcttcgggagatctatgcccacatctatggcacttgatagagtcgcgaaatctatgaaggtgccagtatacgaaacccccgcaggttggcgcttcttcagcaacctcatggacagcggccgttgcaatctctgcggagaggaatcttttgggaccgggagtgatcacctgagagaaaaggatggactgtgggccgtgcttgtatggctgtccatcatcgccgctcggaaacagagtgtggaggaaattgtgagagaccattgggctaagtttggaaggcattactactgtcgtttcgactacgaagggctcgaccccaaaactacttattatatcatgagagaccttgaagctctggtaaccgacaaaagcttcattgggcaacagttcgccgtcggcagccacgtgtactctgtcgccaagaccgattcatttgagtacgttgatcctgtggacggaacggtgactaagaaacaaggcctgaggatcatcttttccgatgcctccagacttatcttcagactttcgtcctcatccggtgttcgtgccactttacgcctgtacgccgaatcttacgaacgcgatcctagcggacacgatcaagaacctcaagccgtactgagcccattgatagcaatcgccctgaaaatatctcaaatacatgagagaactgggaggaggggcccaaccgtgattacttag

SEQ ID NO: 234827 - DNA, 1452 bp, Artificial Sequence
  Description of Artificial Sequence: Synthetic coding sequence
atggcacaagcagatattgctctcatcggcctggccgtgatggggcaaaacttaatcctgaacatgaacgaccatggctttgtggtatgcgcgttcaacagaacagtatccaaggtcgacgattttttggccaatgaggctaagggcaccaaggttgtaggggctcagagtctgaaagagatggtctctaagcttaagaaacctagacgtattattctgttagtgaaggcagggcaagccgtagatgacttcatagaaaagttggttcccctgctggacaccggagacatcatcattgacgggggaaactccgagtaccgagacactactcgtagatgtcgggaccttaaggccaaaggcatcctcttcgtgggatccggcgtgtcgggtggagaggagggtgcccgatacggcccatctttaatgcccggtggaaataaggaagcttggccccatataaagacgattttccagggcatcgcagccaaggttggtactggagagccttgctgtgattgggtgggagatgaaggcgcaggccacttcgtcaagatggtccacaatggcatcgagtacggcgacatgcaactcatctgcgaggcctatcacctgatgaaagatgtcttgggcatggcccaggacgagatggcacaggcgtttgaagattggaataagactgaactggactccttccttatcgagattaccgccaacatcctcaagttccaggacacggacgggaagcatcttctgcccaagattcgagattccgcagggcagaaagggaccggcaaatggactgctatttccgccctcgaatacggagtgccagtcactttgatcggcgaagctgtgtttgcaaggtgtctgagtagcttgaaggacgaacgcatccaggctagcaaaaagctgaaagggccacaaaagtttcaattcgacggagacaaaaaatctttcctcgaggacataagaaaggcgctgtacgcttccaagatcatctcatatgctcagggctttatgcttctaaggcaggcggcaactgagtttgggtggactttaaattacgggggaatcgcactcatgtggagaggaggatgtataatacgctccgtattccttgggaaaatcaaggatgcctttgaccggaaccctgagctgcagaatttactgttagatgacttctttaagtctgccgtagaaaactgccaggattcttggagaagagctgtgagtactggagtccaggctggaattcccatgccttgctttacaactgccctttccttctacgatgggtatagacacgaaatgcttccagcatcactgatccaagcccagcgggactattttggcgctcacacctatgagctcctggccaaacctggacagtttatccacaccaactggacgggacatgggggtacagtctcgagctcctcatataatgcgtag

SEQ ID NO: 234828 - DNA, 1413 bp, Artificial Sequence
  Description of Artificial Sequence: Synthetic coding sequence
atgggacagaacctcatactaaacatgaatgatcatgggtttgtggtctgtgcattcaaccgaactgtgagcaaagtggacgatttcctggcaaatgaagcaaaaggcacaaaggtggttggggctcagagcttaaaggagatggtaagcaaattaaagaagccgagaaggattatcctcctggtcaaggcagggcaggccgtggatgacttcatcgagaaactcgtgccacttctggataccggggacataattattgatggcggaaattctgagtaccgggacaccacaagacgctgccgtgatcttaaggctaaaggcatacttttcgtcgggtctggcgtctccgggggtgaggaaggagccaggtacggcccatccttgatgcctgggggtaataaggaggcctggcctcatatcaaaacaatatttcaggggattgctgccaaggtcgggacgggtgagccttgctgtgattgggtgggtgatgaaggtgccggacacttcgtgaaaatggtacataatggaatcgagtacggcgatatgcagttgatctgcgaagcataccaccttatgaaggatgtcctaggcatggctcaggacgaaatggcccaagcctttgaagactggaataaaaccgaactggattcgttcctgatcgagatcaccgccaacattttgaagtttcaggacacagatgggaagcacctcctacctaagattcgcgacagtgcaggccagaaaggcaccggcaaatggaccgcaatatcggctctggagtatggcgtacctgttacacttataggcgaggcggtgtttgctcggtgtctgtctagcttgaaagacgaacgcattcaggcatccaaaaaactcaaggggccacagaagtttcagttcgatggggataagaagagttttctcgaagacattcggaaagctctttacgcttctaaaataatatcatatgcccagggatttatgctgctgcgccaggccgcaacagaattcggatggacactgaactacggcggaatcgcattgatgtggcggggaggatgtattatccgcagcgtgttcctgggtaagatcaaggacgcctttgatcggaaccctgaacttcaaaatttgctgttggacgactttttcaaatccgctgtagagaactgtcaggacagctggcggagggctgtgtctaccggagtgcaagcagggatcccaatgccctgtttcactacagccctgtccttctatgacggctacaggcacgaaatgttacccgcatcattgatccaggcacaacgcgactattttggggcacacacctatgaactattggccaagcccggacaattcattcacaccaattggactggccatggcggtacagttagctcaagctcctataatgcttag

SEQ ID NO: 234829 - DNA, 1386 bp, Artificial Sequence
  Description of Artificial Sequence: Synthetic coding sequence
atggcccaggcggatatcgccctgattggcctggcagtgatgggccagaatctgatcctaaacatgaacgatcatggatttgtggtctgcgcattcaacaggacggtttcaaaggtggacgactttctggcgaatgaagccaaaggaactaaggtcgtgggcgctcagagtctgaaagaaatggtctctaagctgaagaagccaagaagaataatactgctcgtgaaagcaggccaagccgtcgatgactttatcgaaaaacttcggcgatgtagggacttaaaagccaaaggcatcttattcgtgggctccggcgttagtgggggagaagagggagctcgctacggcccttccttaatgcctgggggaaataaagaggcttggccccacatcaaaacgatcttccagggaatcgctgccaaagtgggaaccggagaaccgtgctgtgattgggtcggagatgaaggcgcaggccatttcgttaagatggtgcacaacggaatagagtatggggacatgcagttgatctgcgaagcctaccacttgatgaaggatgtccttggaatggcacaggatgagatggcgcaagctttcgaggactggaacaaaactgagctggattcattcctgattgagatcacagcgaatattttaaaattccaagatacagatggcaaacacttgctgcccaagatcagggattcagccggacagaagggcaccggaaaatggaccgccatttcagccctggaatacggggtgccagttacactcattggcgaggcggtgtttgccaggtgtttgtccagtctgaaggacgagcggatccaggcatctaagaaattgaaaggcccacagaaattccagttcgacggggacaagaaaagctttctggaggatatacggaaggccctctacgcatcaaagatcatctcctatgctcaaggcttcatgttactgcgccaggcagccacggaatttggatggacccttaactacgggggaattgcactaatgtggcgcggaggatgcatcatccgcagcgtgttcctggggaagatcaaagatgcatttgatagaaatcccgagttgcagaatctgctgttggacgatttttttaaatccgctgtagaaaattgccaggatagttggagaagggctgtgagcacaggagtccaggccggtataccaatgccatgctttaccaccgccttatctttctacgacggttaccgacatgaaatgctgcctgcaagcctcatccaagcccagcgcgattatttcggcgctcacacatacgaacttctggctaaacctggacagtttatccacactaattggactggccatggcggtacggttagcagttcctcctacaacgcatag

SEQ ID NO: 234830 - DNA, 1290 bp, Artificial Sequence
  Description of Artificial Sequence: Synthetic coding sequence
atgacgaccgcgctttggagtgtgctgctgatagggctgtcccccaagctgatgatttcctggccgatgagacaagcggtagacgatttcattgagaagctggtgccactgctggatactggcgacatcatcattgacggaggcaactcagaatatcgggatacaaccaggcgatgcagggatctgaaggctaaggggatcctctttgtgggctcaggcgtaagcggcggtgaggagggtgccagatatgggccatctttgatgcccggtgggaacaaggaggcctggcctcacatcaagaccatattccaggggatagccgctaaagtgggcaccggggagccatgctgtgattgggtcggagacgagggggctgggcacttcgtgaagatggtgcataatggcatcgaatacggcgatatgcagctgatttgcgaagcctatcacttaatgaaggacgtcttgggaatggctcaggacgagatggcgcaggctttcgaagattggaacaaaacagagctggatagctttctcatcgaaataacggctaacatcctgaaattccaggatactgacggtaagcacctgcttcccaagatcagggacagtgcgggacaaaaaggcacaggcaaatggacagctatcagcgcattggagtatggcgtgcctgttactctaatcggtgaggccgtattcgcgcgatgtctctcgtcactgaaagacgagcggatccaggcctcaaagaagttaaaaggcccacagaaattccagttcgatggcgataaaaaatccttcctggaggacattaggaaggccctgtatgcctctaagattattagctatgcacaaggcttcatgttgctcagacaggccgctaccgaatttggatggacactcaactacggcggaatcgctttgatgtggcggggtggatgcattataagaagcgtgtttctcggcaagatcaaagacgccttcgaccgaaatcccgaacttcagaacctgttgttggacgatttctttaagtcggcagttgagaattgccaagattcctggcgtagagcagtgtcaacgggtgtccaggctggcataccaatgccatgctttactacagccttgtctttctacgacggttatcggcacgaaatgcttcccgcatcgctcatccaggctcagcgagactattttggggctcatacctacgagctgctggctaaacctggccaattcattcataccaattggactggacacgggggaactgtgagtagttcgtcgtataatgcttag

SEQ ID NO: 234831 - DNA, 1500 bp, Artificial Sequence
  Description of Artificial Sequence: Synthetic coding sequence
atgacattttggacccaaatgtttttcctgctgcaggactgcgaaggacttatcgtccgatcagccactaaagtaacggccgacgttatcaatgccgctgagaaactacaagtagtgggacgggcagggaccggggtggacaacgtggatctggaggctgccacaaggaaagggatcttggtcatgaataccccgaatggtaacagcctgtctgctgcagaactcacatgtggaatgatcatgtgcctggctaggcagattcctcaggcaaccgcctccatgaaagacggtaaatgggaaagaaaaaagttcatggggaccgagttgaacgggaaaacgctgggcattctcggactgggaaggattggccgagaagtggccacgcgaatgcagagttttggcatgaagacaattggctatgacccgattataagcccagaagtttctgcttctttcggagtacagcaactcccactggaagaaatttggcccctctgcgatttcatcaccgtgcataccccattgctgcctagcaccactggcttgctaaacgacaacactttcgctcagtgtaagaagggcgtccgggtggtgaactgtgcaaggggtgggatcgtcgatgagggcgctctcctccgcgcactgcagtcaggtcaatgtgcgggagccgctctggatgtgtttactgaagagcccccacgggatcgcgctctggtggaccatgagaacgtcatctcttgccctcatctgggcgcatctacgaaagaagcacagagccgctgcggagaggaaatagcagtgcagtttgttgacatggtaaagggcaaatctttgacaggtgtggtgaacgcgcaagccctgacctctgctttctcccctcacactaagccttggattggtctcgccgaggccttgggcaccctcatgagggcctgggctggttcccctaagggaacaatccaagtaatcacccagggcaccagtctgaaaaatgcgggtaactgtttgagtcctgccgtgatcgtggggctgcttaaagaagcttctaaacaggcagatgtcaatctggttaatgccaagctcctcgtgaaggaagcgggactgaatgtgactacctcacacagccccgctgccccaggtgagcagggcttcggcgagtgcctgcttgccgtggcactagctggggcaccctatcaagccgttggcctcgtacaggggaccactccagtcctccagggactcaacggagccgtattcagacctgaggtgcccctccgacgcgatttgcctctccttctgtttcgaactcagacatctgacccggctatgttaccaacaatgattggattgctggccgaggctggcgttcgcctcctgtcgtaccaaacgtccctggtctcagacggagagacctggcatgtaatgggaatttctagtttgttgcccagcctggaggcatggaaacaacatgttaccgaagccttccagttccatttttag

SEQ ID NO: 234832 - DNA, 1602 bp, Artificial Sequence
  Description of Artificial Sequence: Synthetic coding sequence
atggcatttgctaatctacggaaagttctgatcagcgactccctggatccttgctgccgcaaaatcttacaggatggcggtttgcaggtggtggagaagcaaaatctatctaaggaagagctcatagccgagctgcaagactgcgaaggtctaatagtcaggtcagctaccaaagtgaccgccgatgtgattaacgctgccgaaaagctccaggtagtcggaagggcgggtaccggcgtggataatgttgatctcgaggccgctactcgtaagggcatccttgttatgaatacccccaacggcaacagtctctctgccgcagaattaacgtgtgggatgatcatgtgcctggcaaggcagatccctcaagctacggccagcatgaaagacggaaaatgggaacgcaagaaattcatggggaccgaactcaacggaaagacgctgggaatcttgggtcttggcagaatcgggcgagaggtcgccacccgcatgcagtcattcggcatgaaaaccatcggttatgaccccattatttcacctgaagtgagcgcctcattcggcgtgcagcagctgccacttgaggaaatctggccactgtgcgactttattaccgtccacactccactgcttcctagcaccacagggttactgaacgataatacgtttgcccagtgtaaaaagggcgtcagagtcgtgaactgtgctcgaggtggcatcgtggacgagggggctcttctccgcgcactccagtccggtcaatgcgccggagccgcacttgacgtgtttacagaggaaccccctcgtgacagagctctggttgaccacgaaaatgtcatatcttgcccacatctgggagcaagcactaaggaagcacagtcccggtgcggggaggagatcgctgtacagttcgtggacatggttaaggggaaaagcttgaccggcgtggttaacgctcaggctctcacttccgcattttcaccccacactaagccttggatcggtttagccgaagccttaggtacactcatgcgcgcatgggccggaagtcctaagggaacaattcaggttattacccaagggacttcactcaaaaacgcgggtaattgtctgtcgcccgctgtgatcgtgggactgctgaaagaggctagtaaacaagcagacgttaacctggtcaacgctaagttgttggtgaaagaggcaggactcaacgtaacaaccagtcattcaccggcagctcccggagagcaaggattcggggaatgccttttggccgtggctctggcgggagctccttaccaagcagttggcctcgtgcagggcactactcctgtgctgcaaggcctaaacggggcagttttcaggcctgaggtgcctttgaggcgcgatctccccctgctgctcttccgcactcaaacgagcgaccctgctatgctgcctaccatgattgggctgctggccgaagcaggggtcagactgctttcataccagacctctctggtctcggatggcgagacttggcacgtgatgggtataagcagtctactgccgagtctggaagcttggaagcagcatgtgacagaagccttccagttccatttctag

SEQ ID NO: 234833 - DNA, 291 bp, Artificial Sequence
  Description of Artificial Sequence: Synthetic coding sequence
atgaagacaattggatatgacccaattatttcccccgaggtgtcggccagctttggtgttcagcaactgcctctggaagagatctggcccctctgcgattttattactgtacatacaccactgctgccctcaaccaccggactgttgaatgacaacacctttgctcaatgcaagaaaggcgtcagggttgtcaactgtgccagagggggaattgtcgacgaaggcgcactgctgcgcgcactgcagagtggccagtgtgcaggggcagcattggacgtattcaccgaatag

SEQ ID NO: 234834 - DNA, 1221 bp, Artificial Sequence
  Description of Artificial Sequence: Synthetic coding sequence
atgaaggacggtaaatgggagaggaagaaattcatgggtaccgaactcaatgggaagacacttggcatcctggggctgggcagaatcggacgggaggttgcgacaagaatgcagagttttggtatgaaaactatcggctacgaccccataattagtccagaggtttccgctagttttggggttcagcagctgccgcttgaggaaatctggcctctttgtgattttattacagttcataccccactgctgccatctaccactggtctgctaaacgataacacattcgcccagtgtaagaagggcgttagggtggtcaactgcgctaggggtggtattgtggacgaaggagccctcctgcgtgcgctgcagagtggccagtgcgccggagccgctttggacgtctttacagaggaaccgcctagggatagggccttggtcgatcacgagaatgtgattagttgtcctcacctcggcgcatcaacaaaagaagcgcaaagtcggtgcggagaggagattgcagtgcaattcgtggacatggtcaagggaaagtccctgaccggcgtggtgaacgcgcaggcccttacttccgctttttctccccacaccaagccgtggattggtctggccgaggctttggggacactgatgagagcctgggccggatctcctaaaggcacaatacaggtgattacacagggcaccagtcttaagaacgcaggtaattgcctgagtcctgccgtcattgtgggacttctgaaagaagcctccaagcaggcggacgtgaatcttgtaaatgccaagctacttgtcaaggaggcgggacttaatgtgacaacttctcacagccctgcagcacctggggaacagggtttcggtgagtgcctcctggccgtcgccctggctggggctccctaccaggcagtcggcctggtgcaaggcaccactccagtcctccaagggctcaacggcgctgtgtttcggcctgaagtccccctcaggagagatcttcctctgctgctcttccgtactcagactagcgatccagctatgttgcccactatgatcgggctgctcgccgaggccggagtcaggttactcagctatcagacgtctcttgtgtccgacggcgagacctggcacgtcatgggtatcagctccctgctgccctcactggaagcctggaaacagcacgtgacagaggcctttcagtttcacttttag

SEQ ID NO: 234835 - DNA, 1254 bp, Artificial Sequence
  Description of Artificial Sequence: Synthetic coding sequence
atgtctctctccaacaagcttacattggacaagttagatgtcaaaggcaaacgagtggttatgagggtggatttcaacgtgcctatgaagaacaatcagatcaccaacaaccaacgcattaaagccgcagtgccatccatcaagttctgccttgataatggggcaaaatctgtcgtccttatgtctcacttggggcgtccagacggtgtcccaatgccagacaaatactcactggagccagtggcggttgagctgaagtccctactagggaaggacgttcttttcctgaaggactgcgtaggtcccgaagtggaaaaggcctgcgctaatccagcagcaggatccgtgattctgctcgaaaacttgcgcttccacgtagaggaggagggcaaggggaaggacgcaagtggcaataaagtcaaggccgagcccgcaaaaatcgaggcgttccgcgcttcattgagtaagctgggggacgtgtatgtgaacgatgcgttcgggacagctcatcgggctcatagcagcatggttggcgttaacctgcctcagaaggccggaggctttctcatgaagaaggagttgaactatttcgctaaggccctcgagtcacccgagcgcccattcctggcgatcctgggcggagctaaggtggctgataagatccagctcatcaacaatatgcttgacaaggtgaatgaaatgatcatcggaggaggtatggcattcacctttctgaaggtgctgaataatatggagattggtacaagcctttttgatgaggaaggggctaaaatagtgaaggaccttatgtctaaagctgagaaaaacggtgtcaaaatcacactacctgtggatttcgtgacagcagataagttcgatgaaaatgcgaaaactggtcaggctactgtggcatcaggtatacccgctgggtggatgggactcgactgcggaccagaaagtagtaagaagtatgccgaggctgtcaccagagccaagcagatcgtgtggaacgggcctgttggcgtatttgaatgggaagcgtttgctcgagggacaaaggcccttatggatgaggtggtaaaagcaacgagtagaggatgtatcactatcatcggaggcggagacacagccacctgctgtgcgaaatggaatacggaggacaaggtgagccacgttagcacggggggtggagcttctttggaactgcttgaaggcaaagttctgccgggagttgacgctctgagcaacatctag

SEQ ID NO: 234836 - DNA, 846 bp, Artificial Sequence
  Description of Artificial Sequence: Synthetic coding sequence
atgagtttaagtaataaacttacactagataaattggatgtgaaaggcaagcgtgttgtgatgcgggttgacttcaatgtccctatgaagaataaccagataacgaataaccagcggataaaggcggcagtgccaagtatcaagttctgcctcgacaatggagccaagtcagtcgtcctgatgtctcatttgggcaggccagacggaaggcccttcctggcaatcctcggaggcgctaaggtggccgacaagatccaactgatcaacaacatgttggacaaagtgaacgaaatgattatcggtggagggatggcgttcacattcttaaaagtcctaaataacatggagataggcacctcattgtttgatgaagaaggcgctaagatcgtaaaggatctgatgtccaaggctgaaaagaacggggtcaagattaccctgcccgtggacttcgtgacggccgacaagttcgacgagaacgccaaaaccgggcaggcaacagtcgcctctgggatacccgctggctggatggggctagactgtggtccagagagttccaaaaagtatgcggaggcagtcacccgggcaaagcagatcgtgtggaatggaccagtgggagtgtttgaatgggaagcattcgccagagggaccaaggcccttatggatgaggtggtcaaagccacgagccggggatgcataacaataatcggtggtggggacacggcaacctgctgtgccaagtggaacactgaggataaggtcagtcacgtcagcaccggtggtggggcttcactggaactcttggagggaaaggtcttgcctggggttgacgctctgtctaacatctag

SEQ ID NO: 234837 - DNA, 729 bp, Artificial Sequence
  Description of Artificial Sequence: Synthetic coding sequence
atggtaggggtcaacctgccccagaaggctggcggatttctcatgaagaaagagttaaattactttgcgaaggctctcgagagccccgagcgccctttcttggctattcttggaggggctaaagtcgcggataagatccagctgatcaacaacatgctggataaggtgaatgaaatgatcattggtggtgggatggcattcactttcctgaaggtgctcaacaacatggaaattggcacatcgttatttgacgaagagggcgcaaaaatcgtcaaggatctaatgtccaaggccgaaaagaacggcgttaagattaccttacccgtcgactttgtgaccgccgataaattcgatgagaacgctaaaaccggccaggctaccgtggcctcaggaatcccggcaggctggatgggcctagactgcgggccagaatccagtaagaagtacgcagaagccgtgacgagggctaagcagattgtttggaacggacctgtcggggtgtttgagtgggaggcttttgcccgtggcaccaaagcgctgatggacgaagtggtcaaagcgacctcgaggggctgcattactataattggaggcggagatacggcgacatgctgtgcaaaatggaatactgaagataaggtgagccatgtaagtaccgggggaggcgcatccctcgagctactggaggggaaggtcctgcccggagtggatgcactgtcgaacatttag

SEQ ID NO: 234838 - DNA, 1170 bp, Artificial Sequence
  Description of Artificial Sequence: Synthetic coding sequence
atgaaaaataatcagatcactaataaccagcgcataaaagccgctgtgcccagtatcaagttctgcttagataatggcgctaaatcggtggtcttaatgagccatctgggcaggccggacggagtaccaatgcccgacaaatactccttggaacccgtagccgttgaactcaagtctctgctgggtaaggatgtgctgttcctgaaagactgtgtggggcctgaggtcgagaaggcttgcgccaacccagccgctgggagtgtgatcctgttggagaacctgcggtttcacgtggaggaggagggcaagggtaaggatgcttccggtaataaggttaaggcagaaccagcaaaaatcgaagccttccgcgcatcgttgagtaagctaggtgatgtctatgtaaacgacgcttttggaacagcgcatagagcccattcatccatggtcggcgtgaacctgccccagaaagcgggaggattcttaatgaagaaggaattaaattacttcgccaaggctctcgagtcgccagagaggccattcctggcaatactgggaggcgcaaaagtggcagacaagatccagctcatcaacaacatgctggataaagtaaacgaaatgattattggcggaggaatggccttcacatttctcaaagtgttaaacaacatggaaatcggcacttcactgtttgatgaagagggcgcaaagatagtgaaagacctaatgtccaaggccgagaagaacggtgtgaagattactctccctgtggatttcgtgacggcagataagttcgatgaaaatgcaaaaacaggacaggcgactgtggcgtctggcattcccgctggctggatgggactcgattgtggtccggaatcctccaagaaatatgcggaggccgtgactcgcgctaagcagatcgtgtggaatgggccagttggggtgtttgaatgggaggcgttcgcacgcggtacaaaagccctcatggacgaggtcgtgaaagctacttctagaggatgcataacaatcatcgggggtggggatacggcaacctgttgcgccaagtggaacaccgaggacaaagtgagtcacgtcagtactggcggaggcgcatctctcgaattgctggagggcaaggtcctgccaggggtcgatgcgctctcgaacatatag

SEQ ID NO: 234839 - DNA, 1254 bp, Artificial Sequence
  Description of Artificial Sequence: Synthetic coding sequence
atgtccttaagcaaaaaactgaccctggataaactggacgtgcggggaaagcgcgtgatcatgcgcgtggatttcaatgttccaatgaagaaaaatcagatcaccaataaccagcgaatcaaagcgagtattcctagcatcaagtattgcctggataacggagccaaggctgtggttctgatgtcacatttgggcaggcctgatggtgtacctatgccggataagtactcgttagccccagtggcggtcgaactgaagtcacttttgggaaaggatgtccttttcttaaaggactgcgtgggtgctgaggtagagaaagcctgtgcaaaccccgcaccgggatcagtaatcctgttggaaaacctgagatttcatgtggaagaggagggaaaaggccaagatccttccggaaaaaagatcaaggctgagccggacaagattgaggcctttcgagctagcttgagcaaattaggtgatgtgtatgtgaatgacgccttcgggactgcccatcgtgcgcattcatccatggtgggggttaatttgcctcacaaggcaagcggattccttatgaagaaagagctcgattacttcgctaaggcactggagaaccctgttcgaccattcttagcaatattaggcggagccaaagtggcagacaagattcagttgatcaagaatatgctggacaaggtcaatgaaatgatcatcggtgggggaatggcctacacattcttgaaagtcctaaacaacatggaaatcggcgctagcctgtttgacgaagaaggcgcaaaaatcgttaaagatatcatggccaaggcccagaagaacggtgtgcggataacattccctgtggatttcgtgaccggggacaaatttgatgagaacgctcaggttggtaaggctacagtggcttctggaatttcccccggatggatgggactggattgcgggccagagagcaataagaaccacgcacaagtggtcgctcaagccagactcatagtttggaacggacccctgggcgtgtttgaatgggacgcattcgccaaaggcacgaaagccctcatggacgaaattgtaaaggctacctcaaaggggtgtattaccgtcatcggcggtggggacactgccacgtgctgtgcaaaatggaataccgaggataaagtgtcccacgtgtccactgggggtggcgcatctctggaactgctggaaggtaaaatcctgcctggagtggaggccttgagcaacatgtag
